United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 64

SEQ ID NO: 2696486 - DNA, 15 bp, Homo sapiens
attgctgctggtaat

SEQ ID NO: 2696487 - DNA, 16 bp, Homo sapiens
attgtaaactagtact

SEQ ID NO: 2696488 - DNA, 16 bp, Homo sapiens
attgtaccagaactat

SEQ ID NO: 2696489 - DNA, 22 bp, Homo sapiens
attgtatagagatatgcagaag

SEQ ID NO: 2696490 - DNA, 23 bp, Homo sapiens
atttaacttgagggtaataaact

SEQ ID NO: 2696491 - DNA, 15 bp, Homo sapiens
atttactaaaagaat

SEQ ID NO: 2696492 - DNA, 12 bp, Homo sapiens
atttgagagaat

SEQ ID NO: 2696493 - DNA, 22 bp, Homo sapiens
atttgagagaatctactaagtt

SEQ ID NO: 2696494 - DNA, 22 bp, Homo sapiens
atttgaggagcagcttcagttg

SEQ ID NO: 2696495 - DNA, 23 bp, Homo sapiens
atttgaggagcagcttcagttgt

SEQ ID NO: 2696496 - DNA, 18 bp, Homo sapiens
atttgagtgattatttgt

SEQ ID NO: 2696497 - DNA, 17 bp, Homo sapiens
attttaggcagggattt

SEQ ID NO: 2696498 - DNA, 19 bp, Homo sapiens
attttgtggttaagagaat

SEQ ID NO: 2696499 - DNA, 18 bp, Homo sapiens
atttttttaagctgtaaa

SEQ ID NO: 2696500 - DNA, 16 bp, Homo sapiens
caaaaagtttcctttt

SEQ ID NO: 2696501 - DNA, 12 bp, Homo sapiens
caaaagaagtaa

SEQ ID NO: 2696502 - DNA, 17 bp, Homo sapiens
caaaaggtaaatacaat

SEQ ID NO: 2696503 - DNA, 17 bp, Homo sapiens
caaagcaaaagaagtaa

SEQ ID NO: 2696504 - DNA, 15 bp, Homo sapiens
caaagtctaaagttt

SEQ ID NO: 2696505 - DNA, 16 bp, Homo sapiens
caaagtctaaagttta

SEQ ID NO: 2696506 - DNA, 20 bp, Homo sapiens
caaagtctaaagtttacagt

SEQ ID NO: 2696507 - DNA, 15 bp, Homo sapiens
caaatgaaagcataa

SEQ ID NO: 2696508 - DNA, 18 bp, Homo sapiens
caaatgtaaaataagtat

SEQ ID NO: 2696509 - DNA, 13 bp, Homo sapiens
caacgacaaagcc

SEQ ID NO: 2696510 - DNA, 23 bp, Homo sapiens
caagaaaagaacctaatagcacc

SEQ ID NO: 2696511 - DNA, 13 bp, Homo sapiens
caagaagctgcta

SEQ ID NO: 2696512 - DNA, 22 bp, Homo sapiens
caagaagggttttccaccctgg

SEQ ID NO: 2696513 - DNA, 17 bp, Homo sapiens
caagaattctagaaaat

SEQ ID NO: 2696514 - DNA, 19 bp, Homo sapiens
caagaattctagaaaattt

SEQ ID NO: 2696515 - DNA, 12 bp, Homo sapiens
ggaatttgtaag

SEQ ID NO: 2696516 - DNA, 13 bp, Homo sapiens
ggacaagaagctg

SEQ ID NO: 2696517 - DNA, 11 bp, Homo sapiens
ggacacctgcc

SEQ ID NO: 2696518 - DNA, 16 bp, Homo sapiens
ggacacctgccctgcc

SEQ ID NO: 2696519 - DNA, 16 bp, Homo sapiens
ggacagtgcttcagcc

SEQ ID NO: 2696520 - DNA, 19 bp, Homo sapiens
ggacagtgcttcagcctga

SEQ ID NO: 2696521 - DNA, 22 bp, Homo sapiens
ggacagtgcttcagcctgaggc

SEQ ID NO: 2696522 - DNA, 15 bp, Homo sapiens
ggacctttcagctgt

SEQ ID NO: 2696523 - DNA, 11 bp, Homo sapiens
ggactctgagg

SEQ ID NO: 2696524 - DNA, 11 bp, Homo sapiens
ggagagcccag

SEQ ID NO: 2696525 - DNA, 12 bp, Homo sapiens
ggagagcccagc

SEQ ID NO: 2696526 - DNA, 21 bp, Homo sapiens
ggagccgagatcacgccactg

SEQ ID NO: 2696527 - DNA, 15 bp, Homo sapiens
ggagcgcacctgccc

SEQ ID NO: 2696528 - DNA, 21 bp, Homo sapiens
ggagcgcacctgccccctggt

SEQ ID NO: 2696529 - DNA, 20 bp, Homo sapiens
ggaggatcactggagcccag

SEQ ID NO: 2696530 - DNA, 21 bp, Homo sapiens
ggaggatcactggagcccagg

SEQ ID NO: 2696531 - DNA, 22 bp, Homo sapiens
ggaggatcactggagcccagga

SEQ ID NO: 2696532 - DNA, 15 bp, Homo sapiens
ggaggggcctctgaa

SEQ ID NO: 2696533 - DNA, 19 bp, Homo sapiens
ggagggtgggagagcccag

SEQ ID NO: 2696534 - DNA, 15 bp, Homo sapiens
ggaggtggcagccct

SEQ ID NO: 2696535 - DNA, 20 bp, Homo sapiens
ggagtttgaggctgcagcga

SEQ ID NO: 2696536 - DNA, 14 bp, Homo sapiens
ggatcactggagcc

SEQ ID NO: 2696537 - DNA, 14 bp, Homo sapiens
ggatgctgcctgag

SEQ ID NO: 2696538 - DNA, 14 bp, Homo sapiens
ggatggtcctgggg

SEQ ID NO: 2696539 - DNA, 13 bp, Homo sapiens
ggattctgggagg

SEQ ID NO: 2696540 - DNA, 13 bp, Homo sapiens
ggcaagggggcgg

SEQ ID NO: 2696541 - DNA, 19 bp, Homo sapiens
ggcacctatagtcccagct

SEQ ID NO: 2696542 - DNA, 16 bp, Homo sapiens
ggcatgctggggcaag

SEQ ID NO: 2696543 - DNA, 15 bp, Homo sapiens
ggcattcctgcttat

SEQ ID NO: 2696544 - DNA, 17 bp, Homo sapiens
ggccaggtttctgccca

SEQ ID NO: 2696545 - DNA, 23 bp, Homo sapiens
ggccccaccctcgtggacacctg

SEQ ID NO: 2696546 - DNA, 12 bp, Homo sapiens
ggcccccctcca

SEQ ID NO: 2696547 - DNA, 14 bp, Homo sapiens
ggcccccctccagg

SEQ ID NO: 2696548 - DNA, 15 bp, Homo sapiens
ggcccccctccaggc

SEQ ID NO: 2696549 - DNA, 19 bp, Homo sapiens
ggcccccctccaggcatgc

SEQ ID NO: 2696550 - DNA, 21 bp, Homo sapiens
ggccctcccttgcaggtcggt

SEQ ID NO: 2696551 - DNA, 15 bp, Homo sapiens
ggccggtgtgggctg

SEQ ID NO: 2696552 - DNA, 22 bp, Homo sapiens
ggcctctgaaatttcccacacc

SEQ ID NO: 2696553 - DNA, 18 bp, Homo sapiens
ggcctgccttgaagccac

SEQ ID NO: 2696554 - DNA, 23 bp, Homo sapiens
ggcgacagagcgagagtctgtct

SEQ ID NO: 2696555 - DNA, 14 bp, Homo sapiens
ggctcagtctcagg

SEQ ID NO: 2696556 - DNA, 21 bp, Homo sapiens
ggctctgccccagctctggct

SEQ ID NO: 2696557 - DNA, 13 bp, Homo sapiens
ggctgagccctgg

SEQ ID NO: 2696558 - DNA, 12 bp, Homo sapiens
ggctgtgcctta

SEQ ID NO: 2696559 - DNA, 21 bp, Homo sapiens
gggacagtattctcagtgctc

SEQ ID NO: 2696560 - DNA, 20 bp, Homo sapiens
gggacgcgcacacacaccgg

SEQ ID NO: 2696561 - DNA, 13 bp, Homo sapiens
gggacgcgggctg

SEQ ID NO: 2696562 - DNA, 12 bp, Homo sapiens
gggagagcccag

SEQ ID NO: 2696563 - DNA, 16 bp, Homo sapiens
gggatggtcctggggc

SEQ ID NO: 2696564 - DNA, 19 bp, Homo sapiens
gggcacctatagtcccagc

SEQ ID NO: 2696565 - DNA, 17 bp, Homo sapiens
gggcatgctggggcaag

SEQ ID NO: 2696566 - DNA, 19 bp, Homo sapiens
gggcccgaaagctgagacc

SEQ ID NO: 2696567 - DNA, 14 bp, Homo sapiens
gggcggaaggggac

SEQ ID NO: 2696568 - DNA, 12 bp, Homo sapiens
gggctcctggaa

SEQ ID NO: 2696569 - DNA, 16 bp, Homo sapiens
gggctgagccctggca

SEQ ID NO: 2696570 - DNA, 18 bp, Homo sapiens
gggctgagccctggcagg

SEQ ID NO: 2696571 - DNA, 22 bp, Homo sapiens
gggctgcccctgtaggttgctt

SEQ ID NO: 2696572 - DNA, 13 bp, Homo sapiens
gggctgccctgcc

SEQ ID NO: 2696573 - DNA, 15 bp, Homo sapiens
gggctttctggagag

SEQ ID NO: 2696574 - DNA, 17 bp, Homo sapiens
ggggacgcgcacacaca

SEQ ID NO: 2696575 - DNA, 18 bp, Homo sapiens
ggggtattttaggcaggg

SEQ ID NO: 2696576 - DNA, 22 bp, Homo sapiens
ggggtccttcaagttagctcag

SEQ ID NO: 2696577 - DNA, 15 bp, Homo sapiens
gggtggcaagggggc

SEQ ID NO: 2696578 - DNA, 19 bp, Homo sapiens
ggtatgaacttgaggacac

SEQ ID NO: 2696579 - DNA, 20 bp, Homo sapiens
ggtatgaacttgaggacaca

SEQ ID NO: 2696580 - DNA, 22 bp, Homo sapiens
ggtattttaggcagggatttga

SEQ ID NO: 2696581 - DNA, 19 bp, Homo sapiens
ggtcctgcaatctccaggg

SEQ ID NO: 2696582 - DNA, 12 bp, Homo sapiens
ggtcctggggct

SEQ ID NO: 2696583 - DNA, 23 bp, Homo sapiens
ggtcctggggctctgtgcaggga

SEQ ID NO: 2696584 - DNA, 14 bp, Homo sapiens
ggtgacatcccagg

SEQ ID NO: 2696585 - DNA, 20 bp, Homo sapiens
ggtgacatcccaggaggggc

SEQ ID NO: 2696586 - DNA, 14 bp, Homo sapiens
ggtgccaccaataa

SEQ ID NO: 2696587 - DNA, 14 bp, Homo sapiens
ggtggacagtcctg

SEQ ID NO: 2696588 - DNA, 19 bp, Homo sapiens
ggtggcaagggggcggggc

SEQ ID NO: 2696589 - DNA, 20 bp, Homo sapiens
ggtggcaagggggcggggcg

SEQ ID NO: 2696590 - DNA, 19 bp, Homo sapiens
ggtggcgggcacctatagt

SEQ ID NO: 2696591 - DNA, 15 bp, Homo sapiens
ggtgggagagcccag

SEQ ID NO: 2696592 - DNA, 15 bp, Homo sapiens
ggtgtgcctgcagcc

SEQ ID NO: 2696593 - DNA, 15 bp, Homo sapiens
ggtttgttgtaaata

SEQ ID NO: 2696594 - DNA, 18 bp, Homo sapiens
gtaaagaataaatgaatc

SEQ ID NO: 2696595 - DNA, 18 bp, Homo sapiens
gtaagtaccactcaggcc

SEQ ID NO: 2696596 - DNA, 15 bp, Homo sapiens
gtaatttgtatctga

SEQ ID NO: 2696597 - DNA, 21 bp, Homo sapiens
gtaatttgtatctgaaggaga

SEQ ID NO: 2696598 - DNA, 16 bp, Homo sapiens
gtacagttcagttcct

SEQ ID NO: 2696599 - DNA, 19 bp, Homo sapiens
gtacagttcagttcctctt

SEQ ID NO: 2696600 - DNA, 17 bp, Homo sapiens
gtactcaggaggctgag

SEQ ID NO: 2696601 - DNA, 19 bp, Homo sapiens
gtagccaaggtgggctgag

SEQ ID NO: 2696602 - DNA, 15 bp, Homo sapiens
gtagccttgcccgga

SEQ ID NO: 2696603 - DNA, 15 bp, Homo sapiens
gtatagagatatgca

SEQ ID NO: 2696604 - DNA, 14 bp, Homo sapiens
gtatctgaaggaga

SEQ ID NO: 2696605 - DNA, 20 bp, Homo sapiens
gtatgaacttgaggacacat

SEQ ID NO: 2696606 - DNA, 19 bp, Homo sapiens
gtattttaggcagggattt

SEQ ID NO: 2696607 - DNA, 15 bp, Homo sapiens
gtcagactgctggga

SEQ ID NO: 2696608 - DNA, 20 bp, Homo sapiens
gtcagactgctgggactggc

SEQ ID NO: 2696609 - DNA, 15 bp, Homo sapiens
caagagcagaggcag

SEQ ID NO: 2696610 - DNA, 16 bp, Homo sapiens
caagagcagaggcagc

SEQ ID NO: 2696611 - DNA, 16 bp, Homo sapiens
caagatgtcagactgg

SEQ ID NO: 2696612 - DNA, 16 bp, Homo sapiens
caaggtcggtaagttg

SEQ ID NO: 2696613 - DNA, 12 bp, Homo sapiens
caaggtgggctg

SEQ ID NO: 2696614 - DNA, 17 bp, Homo sapiens
caaggtgggctgagccc

SEQ ID NO: 2696615 - DNA, 20 bp, Homo sapiens
caaggtgggctgagccctgg

SEQ ID NO: 2696616 - DNA, 23 bp, Homo sapiens
caaggtgggctgagccctggcag

SEQ ID NO: 2696617 - DNA, 23 bp, Homo sapiens
caagtattaggggtaatatattg

SEQ ID NO: 2696618 - DNA, 21 bp, Homo sapiens
caagtccctgactctctgtga

SEQ ID NO: 2696619 - DNA, 13 bp, Homo sapiens
caagttagctcag

SEQ ID NO: 2696620 - DNA, 14 bp, Homo sapiens
caagttagctcagg

SEQ ID NO: 2696621 - DNA, 16 bp, Homo sapiens
caagttagctcaggag

SEQ ID NO: 2696622 - DNA, 23 bp, Homo sapiens
caataaagctggacaagaagctg

SEQ ID NO: 2696623 - DNA, 13 bp, Homo sapiens
caatacaaattga

SEQ ID NO: 2696624 - DNA, 22 bp, Homo sapiens
caatacaaattgaggacttaat

SEQ ID NO: 2696625 - DNA, 14 bp, Homo sapiens
caatattcaataaa

SEQ ID NO: 2696626 - DNA, 12 bp, Homo sapiens
caatctccaggg

SEQ ID NO: 2696627 - DNA, 18 bp, Homo sapiens
caatctccagggctgccc

SEQ ID NO: 2696628 - DNA, 13 bp, Homo sapiens
caattcataatat

SEQ ID NO: 2696629 - DNA, 12 bp, Homo sapiens
caattcctgggc

SEQ ID NO: 2696630 - DNA, 22 bp, Homo sapiens
cacagccgcagcctccctctga

SEQ ID NO: 2696631 - DNA, 18 bp, Homo sapiens
cacagtgcccagctaatt

SEQ ID NO: 2696632 - DNA, 17 bp, Homo sapiens
cacatgacgtaaaattt

SEQ ID NO: 2696633 - DNA, 14 bp, Homo sapiens
caccaatacaaatt

SEQ ID NO: 2696634 - DNA, 16 bp, Homo sapiens
caccatattcagtgct

SEQ ID NO: 2696635 - DNA, 17 bp, Homo sapiens
caccctcgtggacacct

SEQ ID NO: 2696636 - DNA, 18 bp, Homo sapiens
caccctcgtggacacctg

SEQ ID NO: 2696637 - DNA, 20 bp, Homo sapiens
caccctcgtggacacctgcc

SEQ ID NO: 2696638 - DNA, 21 bp, Homo sapiens
caccgctgccttttgctgctg

SEQ ID NO: 2696639 - DNA, 22 bp, Homo sapiens
cacctctcaatattcaataaag

SEQ ID NO: 2696640 - DNA, 15 bp, Homo sapiens
cacctgccagcctgg

SEQ ID NO: 2696641 - DNA, 22 bp, Homo sapiens
cacctgccatttgcaccctccg

SEQ ID NO: 2696642 - DNA, 15 bp, Homo sapiens
cacctgccccctggt

SEQ ID NO: 2696643 - DNA, 21 bp, Homo sapiens
cacctgccccctggtggacag

SEQ ID NO: 2696644 - DNA, 19 bp, Homo sapiens
cacctgccctgccctgcca

SEQ ID NO: 2696645 - DNA, 23 bp, Homo sapiens
cacctgccctgccctgccacctg

SEQ ID NO: 2696646 - DNA, 11 bp, Homo sapiens
cacctgtctgt

SEQ ID NO: 2696647 - DNA, 17 bp, Homo sapiens
caccttcaattcctggg

SEQ ID NO: 2696648 - DNA, 16 bp, Homo sapiens
caccttttccaggagt

SEQ ID NO: 2696649 - DNA, 22 bp, Homo sapiens
cacgccactgcactccagcctg

SEQ ID NO: 2696650 - DNA, 21 bp, Homo sapiens
cacgcctatgatcccagcact

SEQ ID NO: 2696651 - DNA, 17 bp, Homo sapiens
cactaaacagactattt

SEQ ID NO: 2696652 - DNA, 16 bp, Homo sapiens
cactaataatagtact

SEQ ID NO: 2696653 - DNA, 16 bp, Homo sapiens
cactaggactctgagg

SEQ ID NO: 2696654 - DNA, 17 bp, Homo sapiens
cactaggactctgaggc

SEQ ID NO: 2696655 - DNA, 21 bp, Homo sapiens
cactccagcctgagcaacaga

SEQ ID NO: 2696656 - DNA, 15 bp, Homo sapiens
cactccccaccttca

SEQ ID NO: 2696657 - DNA, 20 bp, Homo sapiens
cactccggtgtgcctgcagc

SEQ ID NO: 2696658 - DNA, 21 bp, Homo sapiens
cactccggtgtgcctgcagcc

SEQ ID NO: 2696659 - DNA, 22 bp, Homo sapiens
cactccggtgtgcctgcagccc

SEQ ID NO: 2696660 - DNA, 13 bp, Homo sapiens
cactgaagctggg

SEQ ID NO: 2696661 - DNA, 11 bp, Homo sapiens
cactggagccc

SEQ ID NO: 2696662 - DNA, 12 bp, Homo sapiens
cactggagccca

SEQ ID NO: 2696663 - DNA, 13 bp, Homo sapiens
cactggagcccag

SEQ ID NO: 2696664 - DNA, 14 bp, Homo sapiens
cactggagcccagg

SEQ ID NO: 2696665 - DNA, 14 bp, Homo sapiens
cactggccccaccc

SEQ ID NO: 2696666 - DNA, 16 bp, Homo sapiens
cactggccccaccctc

SEQ ID NO: 2696667 - DNA, 17 bp, Homo sapiens
cactgtaacctcaaact

SEQ ID NO: 2696668 - DNA, 16 bp, Homo sapiens
cactgtatgctggacg

SEQ ID NO: 2696669 - DNA, 14 bp, Homo sapiens
cagaaaaccccagc

SEQ ID NO: 2696670 - DNA, 20 bp, Homo sapiens
cagactgctgggactggcca

SEQ ID NO: 2696671 - DNA, 16 bp, Homo sapiens
cagactggctggctgc

SEQ ID NO: 2696672 - DNA, 20 bp, Homo sapiens
cagagcgagagtctgtctca

SEQ ID NO: 2696673 - DNA, 15 bp, Homo sapiens
cagagggcccaggca

SEQ ID NO: 2696674 - DNA, 15 bp, Homo sapiens
cagagtgagaccctg

SEQ ID NO: 2696675 - DNA, 15 bp, Homo sapiens
cagatgcccagaggg

SEQ ID NO: 2696676 - DNA, 19 bp, Homo sapiens
cagcactttgggaggctga

SEQ ID NO: 2696677 - DNA, 22 bp, Homo sapiens
cagcactttgggaggctgaggc

SEQ ID NO: 2696678 - DNA, 19 bp, Homo sapiens
cagccgcagcctccctctg

SEQ ID NO: 2696679 - DNA, 13 bp, Homo sapiens
cagcctccctctg

SEQ ID NO: 2696680 - DNA, 18 bp, Homo sapiens
cagcctgaggctgagact

SEQ ID NO: 2696681 - DNA, 16 bp, Homo sapiens
cagcctggcttctgga

SEQ ID NO: 2696682 - DNA, 20 bp, Homo sapiens
cagccttccccctcccaggg

SEQ ID NO: 2696683 - DNA, 21 bp, Homo sapiens
cagctactcagaagcctgagg

SEQ ID NO: 2696684 - DNA, 22 bp, Homo sapiens
cagctactcagaagcctgaggc

SEQ ID NO: 2696685 - DNA, 16 bp, Homo sapiens
cagctgcacctgccag

SEQ ID NO: 2696686 - DNA, 18 bp, Homo sapiens
cagctgcacctgccagcc

SEQ ID NO: 2696687 - DNA, 21 bp, Homo sapiens
cagctgcacctgccagcctgg

SEQ ID NO: 2696688 - DNA, 22 bp, Homo sapiens
cagctgcacctgccagcctggc

SEQ ID NO: 2696689 - DNA, 15 bp, Homo sapiens
caggaggggcctctg

SEQ ID NO: 2696690 - DNA, 16 bp, Homo sapiens
caggaggggcctctga

SEQ ID NO: 2696691 - DNA, 11 bp, Homo sapiens
caggcatgctg

SEQ ID NO: 2696692 - DNA, 18 bp, Homo sapiens
caggccaagagcagaggc

SEQ ID NO: 2696693 - DNA, 19 bp, Homo sapiens
caggccaagagcagaggca

SEQ ID NO: 2696694 - DNA, 19 bp, Homo sapiens
caggccggtgtgggctgtg

SEQ ID NO: 2696695 - DNA, 20 bp, Homo sapiens
cagggacggggactggccct

SEQ ID NO: 2696696 - DNA, 14 bp, Homo sapiens
cagggatttgagga

SEQ ID NO: 2696697 - DNA, 12 bp, Homo sapiens
cagggccagggc

SEQ ID NO: 2696698 - DNA, 13 bp, Homo sapiens
cagggccagggcc

SEQ ID NO: 2696699 - DNA, 14 bp, Homo sapiens
cagggccctgcaga

SEQ ID NO: 2696700 - DNA, 12 bp, Homo sapiens
caggtgcagtgg

SEQ ID NO: 2696701 - DNA, 14 bp, Homo sapiens
cagtaaataaattg

SEQ ID NO: 2696702 - DNA, 15 bp, Homo sapiens
cagtaaataaattgt

SEQ ID NO: 2696703 - DNA, 17 bp, Homo sapiens
cagtattctcagtgctc

SEQ ID NO: 2696704 - DNA, 15 bp, Homo sapiens
cagtcaacatttaca

SEQ ID NO: 2696705 - DNA, 12 bp, Homo sapiens
cagtcctgggag

SEQ ID NO: 2696706 - DNA, 13 bp, Homo sapiens
cagtcctgggaga

SEQ ID NO: 2696707 - DNA, 22 bp, Homo sapiens
cagtcctgggagaacctcaggc

SEQ ID NO: 2696708 - DNA, 13 bp, Homo sapiens
cagtctcaggagc

SEQ ID NO: 2696709 - DNA, 18 bp, Homo sapiens
cagtctcaggagcatggg

SEQ ID NO: 2696710 - DNA, 17 bp, Homo sapiens
cagtgctgtggcctggg

SEQ ID NO: 2696711 - DNA, 17 bp, Homo sapiens
cagtgcttcagcctgag

SEQ ID NO: 2696712 - DNA, 11 bp, Homo sapiens
cagtgtaaaga

SEQ ID NO: 2696713 - DNA, 18 bp, Homo sapiens
cagtgtaaagaataaatg

SEQ ID NO: 2696714 - DNA, 19 bp, Homo sapiens
cagtgtaaagaataaatga

SEQ ID NO: 2696715 - DNA, 13 bp, Homo sapiens
cagttgttttccc

SEQ ID NO: 2696716 - DNA, 15 bp, Homo sapiens
catatatattaaaat

SEQ ID NO: 2696717 - DNA, 18 bp, Homo sapiens
catattgttttaaaataa

SEQ ID NO: 2696718 - DNA, 23 bp, Homo sapiens
catattttcacatgacgtaaaat

SEQ ID NO: 2696719 - DNA, 15 bp, Homo sapiens
catcacagggcagag

SEQ ID NO: 2696720 - DNA, 15 bp, Homo sapiens
catcacctcaggcca

SEQ ID NO: 2696721 - DNA, 21 bp, Homo sapiens
catcagtcattcccacgcttg

SEQ ID NO: 2696722 - DNA, 15 bp, Homo sapiens
catccaaccccccac

SEQ ID NO: 2696723 - DNA, 21 bp, Homo sapiens
catccaaccccccacctgcca

SEQ ID NO: 2696724 - DNA, 16 bp, Homo sapiens
catgaagacaggacag

SEQ ID NO: 2696725 - DNA, 15 bp, Homo sapiens
catgacttttccatg

SEQ ID NO: 2696726 - DNA, 18 bp, Homo sapiens
catgccaaagcaaaagaa

SEQ ID NO: 2696727 - DNA, 23 bp, Homo sapiens
catgctggcctcccaataaagct

SEQ ID NO: 2696728 - DNA, 14 bp, Homo sapiens
catggcgtgtccct

SEQ ID NO: 2696729 - DNA, 18 bp, Homo sapiens
catgggatgtctgaaatc

SEQ ID NO: 2696730 - DNA, 21 bp, Homo sapiens
cattcatgccaaagcaaaaga

SEQ ID NO: 2696731 - DNA, 22 bp, Homo sapiens
cattcatgccaaagcaaaagaa

SEQ ID NO: 2696732 - DNA, 15 bp, Homo sapiens
tgagaccctgtctct

SEQ ID NO: 2696733 - DNA, 20 bp, Homo sapiens
tgagcttggcagctgaacta

SEQ ID NO: 2696734 - DNA, 16 bp, Homo sapiens
tgaggattttgagtat

SEQ ID NO: 2696735 - DNA, 18 bp, Homo sapiens
tgaggctctttctgggcc

SEQ ID NO: 2696736 - DNA, 18 bp, Homo sapiens
tgaggctgagactgcggg

SEQ ID NO: 2696737 - DNA, 12 bp, Homo sapiens
tgaggctgggaa

SEQ ID NO: 2696738 - DNA, 14 bp, Homo sapiens
tgaggggctcctgg

SEQ ID NO: 2696739 - DNA, 18 bp, Homo sapiens
tgagggtaataaacttag

SEQ ID NO: 2696740 - DNA, 16 bp, Homo sapiens
tgagtcacccatgaag

SEQ ID NO: 2696741 - DNA, 18 bp, Homo sapiens
tgataggaaataaatgat

SEQ ID NO: 2696742 - DNA, 21 bp, Homo sapiens
tgatattaaagcgcaaatgaa

SEQ ID NO: 2696743 - DNA, 14 bp, Homo sapiens
tgattaatccattt

SEQ ID NO: 2696744 - DNA, 13 bp, Homo sapiens
tgattttaattac

SEQ ID NO: 2696745 - DNA, 23 bp, Homo sapiens
tgcaataacttgtgtattagata

SEQ ID NO: 2696746 - DNA, 22 bp, Homo sapiens
tgcaatctccagggctgcccct

SEQ ID NO: 2696747 - DNA, 16 bp, Homo sapiens
tgcactccagcctggg

SEQ ID NO: 2696748 - DNA, 17 bp, Homo sapiens
tgcactggccccaccct

SEQ ID NO: 2696749 - DNA, 23 bp, Homo sapiens
tgcagaaggaagggcatccttct

SEQ ID NO: 2696750 - DNA, 22 bp, Homo sapiens
tgcagaggggctttctggagag

SEQ ID NO: 2696751 - DNA, 22 bp, Homo sapiens
tgcagtgacgtgcacctgtact

SEQ ID NO: 2696752 - DNA, 20 bp, Homo sapiens
tgccaaagcaaaagaagtaa

SEQ ID NO: 2696753 - DNA, 12 bp, Homo sapiens
tgccaccaataa

SEQ ID NO: 2696754 - DNA, 13 bp, Homo sapiens
tgccaccaataaa

SEQ ID NO: 2696755 - DNA, 14 bp, Homo sapiens
tgccacctgtctgt

SEQ ID NO: 2696756 - DNA, 16 bp, Homo sapiens
tgccacctgtctgtct

SEQ ID NO: 2696757 - DNA, 23 bp, Homo sapiens
tgccactttggtacatggccagt

SEQ ID NO: 2696758 - DNA, 12 bp, Homo sapiens
tgccagcctggc

SEQ ID NO: 2696759 - DNA, 17 bp, Homo sapiens
tgccagcctggcttctg

SEQ ID NO: 2696760 - DNA, 18 bp, Homo sapiens
tgccagcctggcttctgg

SEQ ID NO: 2696761 - DNA, 22 bp, Homo sapiens
tgccagcctggcttctggagcc

SEQ ID NO: 2696762 - DNA, 23 bp, Homo sapiens
tgccagcctggcttctggagccc

SEQ ID NO: 2696763 - DNA, 20 bp, Homo sapiens
tgcccaggctggtcttgaac

SEQ ID NO: 2696764 - DNA, 13 bp, Homo sapiens
tgccccagctctg

SEQ ID NO: 2696765 - DNA, 18 bp, Homo sapiens
tgccccagctctggcttc

SEQ ID NO: 2696766 - DNA, 13 bp, Homo sapiens
tgccccctggtgg

SEQ ID NO: 2696767 - DNA, 18 bp, Homo sapiens
tgcccggattctgggagg

SEQ ID NO: 2696768 - DNA, 18 bp, Homo sapiens
tgccctccacagccgcag

SEQ ID NO: 2696769 - DNA, 19 bp, Homo sapiens
tgccctgccacctgtctgt

SEQ ID NO: 2696770 - DNA, 22 bp, Homo sapiens
tgccctgccacctgtctgtctg

SEQ ID NO: 2696771 - DNA, 19 bp, Homo sapiens
tgcctgagtcacccatgaa

SEQ ID NO: 2696772 - DNA, 15 bp, Homo sapiens
tgcctgcagccccgc

SEQ ID NO: 2696773 - DNA, 20 bp, Homo sapiens
tgcctggcccccctccaggc

SEQ ID NO: 2696774 - DNA, 14 bp, Homo sapiens
tgccttgaagccac

SEQ ID NO: 2696775 - DNA, 15 bp, Homo sapiens
tgccttttaaaagaa

SEQ ID NO: 2696776 - DNA, 16 bp, Homo sapiens
tgcgaaggggccctgg

SEQ ID NO: 2696777 - DNA, 17 bp, Homo sapiens
tgcgggatggtcctggg

SEQ ID NO: 2696778 - DNA, 16 bp, Homo sapiens
tgctatattttcatga

SEQ ID NO: 2696779 - DNA, 19 bp, Homo sapiens
tgctctcctaccccacctc

SEQ ID NO: 2696780 - DNA, 14 bp, Homo sapiens
tgctgcctgagtca

SEQ ID NO: 2696781 - DNA, 21 bp, Homo sapiens
tgctggcctcccaataaagct

SEQ ID NO: 2696782 - DNA, 22 bp, Homo sapiens
tgctggtaatttgtatctgaag

SEQ ID NO: 2696783 - DNA, 12 bp, Homo sapiens
tgcttcacataa

SEQ ID NO: 2696784 - DNA, 12 bp, Homo sapiens
tgcttcagcctg

SEQ ID NO: 2696785 - DNA, 14 bp, Homo sapiens
tgcttcagcctgag

SEQ ID NO: 2696786 - DNA, 17 bp, Homo sapiens
tgcttcagcctgaggct

SEQ ID NO: 2696787 - DNA, 15 bp, Homo sapiens
tggaaagcctctgct

SEQ ID NO: 2696788 - DNA, 14 bp, Homo sapiens
tggaatttgtaagt

SEQ ID NO: 2696789 - DNA, 18 bp, Homo sapiens
tggaattttctaatataa

SEQ ID NO: 2696790 - DNA, 10 bp, Homo sapiens
tggacacctg

SEQ ID NO: 2696791 - DNA, 14 bp, Homo sapiens
tggacacctgccct

SEQ ID NO: 2696792 - DNA, 17 bp, Homo sapiens
tggacagtcctgggaga

SEQ ID NO: 2696793 - DNA, 17 bp, Homo sapiens
tggacgttcggggcatg

SEQ ID NO: 2696794 - DNA, 22 bp, Homo sapiens
tggagaggagggatgctgcctg

SEQ ID NO: 2696795 - DNA, 15 bp, Homo sapiens
tggagcccttgggtt

SEQ ID NO: 2696796 - DNA, 15 bp, Homo sapiens
tggcaaatgaaagca

SEQ ID NO: 2696797 - DNA, 16 bp, Homo sapiens
tggcaagggggcgggg

SEQ ID NO: 2696798 - DNA, 14 bp, Homo sapiens
tggccccaggtgcc

SEQ ID NO: 2696799 - DNA, 22 bp, Homo sapiens
tggccccaggtgccaccaataa

SEQ ID NO: 2696800 - DNA, 23 bp, Homo sapiens
tggccccaggtgccaccaataaa

SEQ ID NO: 2696801 - DNA, 15 bp, Homo sapiens
tggcccccctccagg

SEQ ID NO: 2696802 - DNA, 17 bp, Homo sapiens
tggcccccctccaggca

SEQ ID NO: 2696803 - DNA, 17 bp, Homo sapiens
tggcctcccaataaagc

SEQ ID NO: 2696804 - DNA, 18 bp, Homo sapiens
tggcctcccaataaagct

SEQ ID NO: 2696805 - DNA, 18 bp, Homo sapiens
tggcgtgtccctctcgga

SEQ ID NO: 2696806 - DNA, 14 bp, Homo sapiens
tggctggctgcagt

SEQ ID NO: 2696807 - DNA, 14 bp, Homo sapiens
tgggagaacctcag

SEQ ID NO: 2696808 - DNA, 13 bp, Homo sapiens
tgggaggctgagg

SEQ ID NO: 2696809 - DNA, 15 bp, Homo sapiens
tgggaggctgaggcg

SEQ ID NO: 2696810 - DNA, 12 bp, Homo sapiens
tggggccttggt

SEQ ID NO: 2696811 - DNA, 20 bp, Homo sapiens
tggggtcttgctatattgcc

SEQ ID NO: 2696812 - DNA, 21 bp, Homo sapiens
tgggtcctgcaatctccaggg

SEQ ID NO: 2696813 - DNA, 22 bp, Homo sapiens
tggtaatttgtatctgaaggag

SEQ ID NO: 2696814 - DNA, 15 bp, Homo sapiens
tggtacatggccagt

SEQ ID NO: 2696815 - DNA, 16 bp, Homo sapiens
tggtacatggccagtg

SEQ ID NO: 2696816 - DNA, 14 bp, Homo sapiens
tggtcctggggctc

SEQ ID NO: 2696817 - DNA, 17 bp, Homo sapiens
tggtggacagtcctggg

SEQ ID NO: 2696818 - DNA, 15 bp, Homo sapiens
tggtgtgaaagtcag

SEQ ID NO: 2696819 - DNA, 18 bp, Homo sapiens
tggttaagagaatgaatt

SEQ ID NO: 2696820 - DNA, 19 bp, Homo sapiens
tgtaagtttatgtctaaag

SEQ ID NO: 2696821 - DNA, 14 bp, Homo sapiens
tgtacagttcagtt

SEQ ID NO: 2696822 - DNA, 18 bp, Homo sapiens
tgtactcaggaggctgag

SEQ ID NO: 2696823 - DNA, 23 bp, Homo sapiens
tgtagccttgccttttaaaagaa

SEQ ID NO: 2696824 - DNA, 11 bp, Homo sapiens
tgtaggttgct

SEQ ID NO: 2696825 - DNA, 18 bp, Homo sapiens
tgtcaatagtattaacta

SEQ ID NO: 2696826 - DNA, 19 bp, Homo sapiens
tgtctaaagagctttagtc

SEQ ID NO: 2696827 - DNA, 21 bp, Homo sapiens
tgtgaaagtcagatgcccaga

SEQ ID NO: 2696828 - DNA, 14 bp, Homo sapiens
tgtgaacatggact

SEQ ID NO: 2696829 - DNA, 13 bp, Homo sapiens
tgtgcctgcagcc

SEQ ID NO: 2696830 - DNA, 17 bp, Homo sapiens
tgtgctgaggactccct

SEQ ID NO: 2696831 - DNA, 20 bp, Homo sapiens
tgtgctgaggactccctcca

SEQ ID NO: 2696832 - DNA, 15 bp, Homo sapiens
tgtggccccaggtgc

SEQ ID NO: 2696833 - DNA, 16 bp, Homo sapiens
tgtggccccaggtgcc

SEQ ID NO: 2696834 - DNA, 17 bp, Homo sapiens
tgttatttgtacagttc

SEQ ID NO: 2696835 - DNA, 19 bp, Homo sapiens
tgtttgggatgtctgagat

SEQ ID NO: 2696836 - DNA, 22 bp, Homo sapiens
tgttttcccgagcaaagtctaa

SEQ ID NO: 2696837 - DNA, 22 bp, Homo sapiens
ttaacttgagggtaataaactt

SEQ ID NO: 2696838 - DNA, 18 bp, Homo sapiens
ttaatagtactattaaca

SEQ ID NO: 2696839 - DNA, 19 bp, Homo sapiens
ttaatcaatatttaagaga

SEQ ID NO: 2696840 - DNA, 17 bp, Homo sapiens
ttacaattttttgctct

SEQ ID NO: 2696841 - DNA, 16 bp, Homo sapiens
ttacagtaaataaatt

SEQ ID NO: 2696842 - DNA, 14 bp, Homo sapiens
gtggacagtcctgg

SEQ ID NO: 2696843 - DNA, 15 bp, Homo sapiens
gtggacagtcctggg

SEQ ID NO: 2696844 - DNA, 13 bp, Homo sapiens
gtggatcacctga

SEQ ID NO: 2696845 - DNA, 15 bp, Homo sapiens
gtggatcacctgagg

SEQ ID NO: 2696846 - DNA, 13 bp, Homo sapiens
gtggcagccctgt

SEQ ID NO: 2696847 - DNA, 14 bp, Homo sapiens
gtggccccaggtgc

SEQ ID NO: 2696848 - DNA, 16 bp, Homo sapiens
gtggccccaggtgcca

SEQ ID NO: 2696849 - DNA, 12 bp, Homo sapiens
gtggcctgggca

SEQ ID NO: 2696850 - DNA, 14 bp, Homo sapiens
gtggcctgggcaag

SEQ ID NO: 2696851 - DNA, 15 bp, Homo sapiens
gtgggagagcccagc

SEQ ID NO: 2696852 - DNA, 18 bp, Homo sapiens
gtgtgaaagtcagatgcc

SEQ ID NO: 2696853 - DNA, 19 bp, Homo sapiens
gtgtgatcccaagtgccag

SEQ ID NO: 2696854 - DNA, 18 bp, Homo sapiens
gtgtgcctgcagccccgc

SEQ ID NO: 2696855 - DNA, 19 bp, Homo sapiens
gttatccaactattaagat

SEQ ID NO: 2696856 - DNA, 16 bp, Homo sapiens
gttatgcactttaaat

SEQ ID NO: 2696857 - DNA, 14 bp, Homo sapiens
gttatttgtacagt

SEQ ID NO: 2696858 - DNA, 20 bp, Homo sapiens
gttatttgtacagttcagtt

SEQ ID NO: 2696859 - DNA, 20 bp, Homo sapiens
gttcagttcctctttgcatg

SEQ ID NO: 2696860 - DNA, 13 bp, Homo sapiens
gttcctctttgca

SEQ ID NO: 2696861 - DNA, 14 bp, Homo sapiens
gttcctctttgcat

SEQ ID NO: 2696862 - DNA, 20 bp, Homo sapiens
gttcctgtaaaatccattta

SEQ ID NO: 2696863 - DNA, 16 bp, Homo sapiens
gttcgagaccagcctg

SEQ ID NO: 2696864 - DNA, 16 bp, Homo sapiens
gttgaatggcctgcct

SEQ ID NO: 2696865 - DNA, 16 bp, Homo sapiens
gttgtaaataaaagta

SEQ ID NO: 2696866 - DNA, 19 bp, Homo sapiens
gttgttaatactatattgc

SEQ ID NO: 2696867 - DNA, 17 bp, Homo sapiens
gtttctccccctgggct

SEQ ID NO: 2696868 - DNA, 20 bp, Homo sapiens
gtttgcactgtatgctggac

SEQ ID NO: 2696869 - DNA, 14 bp, Homo sapiens
gttttccaccctgg

SEQ ID NO: 2696870 - DNA, 16 bp, Homo sapiens
gttttccaccctggaa

SEQ ID NO: 2696871 - DNA, 22 bp, Homo sapiens
gttttcccgagcaaagtctaaa

SEQ ID NO: 2696872 - DNA, 19 bp, Homo sapiens
taaaattgtaaaattgtat

SEQ ID NO: 2696873 - DNA, 14 bp, Homo sapiens
taaaattgtataga

SEQ ID NO: 2696874 - DNA, 22 bp, Homo sapiens
taaacaatttctgcattcttaa

SEQ ID NO: 2696875 - DNA, 15 bp, Homo sapiens
taaacttagaataaa

SEQ ID NO: 2696876 - DNA, 17 bp, Homo sapiens
taaagcgcaaatgaatt

SEQ ID NO: 2696877 - DNA, 18 bp, Homo sapiens
taaagctggacaagaagc

SEQ ID NO: 2696878 - DNA, 20 bp, Homo sapiens
taaagctggacaagaagctg

SEQ ID NO: 2696879 - DNA, 22 bp, Homo sapiens
taaagctggacaagaagctgct

SEQ ID NO: 2696880 - DNA, 22 bp, Homo sapiens
taaaggagaaggcatgaaattg

SEQ ID NO: 2696881 - DNA, 10 bp, Homo sapiens
taaataaaag

SEQ ID NO: 2696882 - DNA, 14 bp, Homo sapiens
taaatggaataatt

SEQ ID NO: 2696883 - DNA, 13 bp, Homo sapiens
taaattccactgg

SEQ ID NO: 2696884 - DNA, 16 bp, Homo sapiens
taaattccactggact

SEQ ID NO: 2696885 - DNA, 12 bp, Homo sapiens
taaattgtttga

SEQ ID NO: 2696886 - DNA, 21 bp, Homo sapiens
taaccagtacttctaagagca

SEQ ID NO: 2696887 - DNA, 13 bp, Homo sapiens
taaccttagagct

SEQ ID NO: 2696888 - DNA, 19 bp, Homo sapiens
taactgttagtattaacta

SEQ ID NO: 2696889 - DNA, 21 bp, Homo sapiens
taacttgtgtattagatatca

SEQ ID NO: 2696890 - DNA, 17 bp, Homo sapiens
taagtttatgtctaaag

SEQ ID NO: 2696891 - DNA, 17 bp, Homo sapiens
taataaacttagaataa

SEQ ID NO: 2696892 - DNA, 12 bp, Homo sapiens
taatatattgct

SEQ ID NO: 2696893 - DNA, 14 bp, Homo sapiens
tacacccttggact

SEQ ID NO: 2696894 - DNA, 16 bp, Homo sapiens
tacactccagcctgag

SEQ ID NO: 2696895 - DNA, 13 bp, Homo sapiens
tacagtaaataaa

SEQ ID NO: 2696896 - DNA, 12 bp, Homo sapiens
tacagttcagtt

SEQ ID NO: 2696897 - DNA, 14 bp, Homo sapiens
taccactcaggcca

SEQ ID NO: 2696898 - DNA, 16 bp, Homo sapiens
taccccaagtccacct

SEQ ID NO: 2696899 - DNA, 19 bp, Homo sapiens
taccccaagtccacctgcc

SEQ ID NO: 2696900 - DNA, 17 bp, Homo sapiens
taccccacctcatgcct

SEQ ID NO: 2696901 - DNA, 18 bp, Homo sapiens
taccccacctcatgcctg

SEQ ID NO: 2696902 - DNA, 21 bp, Homo sapiens
taccccacctcatgcctggcc

SEQ ID NO: 2696903 - DNA, 11 bp, Homo sapiens
tacctcagcct

SEQ ID NO: 2696904 - DNA, 12 bp, Homo sapiens
tacctcagccta

SEQ ID NO: 2696905 - DNA, 14 bp, Homo sapiens
tacctcagcctaga

SEQ ID NO: 2696906 - DNA, 12 bp, Homo sapiens
tactaaaagaat

SEQ ID NO: 2696907 - DNA, 14 bp, Homo sapiens
tactatgacactgt

SEQ ID NO: 2696908 - DNA, 22 bp, Homo sapiens
tactatttttattttaaaataa

SEQ ID NO: 2696909 - DNA, 14 bp, Homo sapiens
tactcctacctcag

SEQ ID NO: 2696910 - DNA, 16 bp, Homo sapiens
tactcctacctcagcc

SEQ ID NO: 2696911 - DNA, 14 bp, Homo sapiens
tacttgtttaacat

SEQ ID NO: 2696912 - DNA, 14 bp, Homo sapiens
tagaataaaattgt

SEQ ID NO: 2696913 - DNA, 15 bp, Homo sapiens
tagaataaaattgta

SEQ ID NO: 2696914 - DNA, 19 bp, Homo sapiens
tagaataaaattgtaaaat

SEQ ID NO: 2696915 - DNA, 17 bp, Homo sapiens
tagagatgactgagtcc

SEQ ID NO: 2696916 - DNA, 13 bp, Homo sapiens
tagagtcagcctt

SEQ ID NO: 2696917 - DNA, 20 bp, Homo sapiens
tagccaaggtgggctgagcc

SEQ ID NO: 2696918 - DNA, 22 bp, Homo sapiens
tagccttgcccggattctggga

SEQ ID NO: 2696919 - DNA, 17 bp, Homo sapiens
taggaagaaaaatgttt

SEQ ID NO: 2696920 - DNA, 16 bp, Homo sapiens
taggactctgaggctc

SEQ ID NO: 2696921 - DNA, 17 bp, Homo sapiens
taggagttcgagaccag

SEQ ID NO: 2696922 - DNA, 15 bp, Homo sapiens
taggcagggatttga

SEQ ID NO: 2696923 - DNA, 12 bp, Homo sapiens
tagtattaacta

SEQ ID NO: 2696924 - DNA, 14 bp, Homo sapiens
tagtattaactatt

SEQ ID NO: 2696925 - DNA, 23 bp, Homo sapiens
tataatgacttatatgctgaatt

SEQ ID NO: 2696926 - DNA, 19 bp, Homo sapiens
tatagcttccagattacaa

SEQ ID NO: 2696927 - DNA, 16 bp, Homo sapiens
tatgaacttgaggaca

SEQ ID NO: 2696928 - DNA, 19 bp, Homo sapiens
tatgaacttgaggacacat

SEQ ID NO: 2696929 - DNA, 21 bp, Homo sapiens
tatgaacttgaggacacatgt

SEQ ID NO: 2696930 - DNA, 16 bp, Homo sapiens
tatgactaattcacaa

SEQ ID NO: 2696931 - DNA, 14 bp, Homo sapiens
tatgctgaattgaa

SEQ ID NO: 2696932 - DNA, 19 bp, Homo sapiens
tatgtatgctgatttacta

SEQ ID NO: 2696933 - DNA, 12 bp, Homo sapiens
tatgtctaaaga

SEQ ID NO: 2696934 - DNA, 22 bp, Homo sapiens
tattaacactaataatagtact

SEQ ID NO: 2696935 - DNA, 11 bp, Homo sapiens
tattcaataaa

SEQ ID NO: 2696936 - DNA, 12 bp, Homo sapiens
tattcaataaag

SEQ ID NO: 2696937 - DNA, 14 bp, Homo sapiens
tattcaataaagct

SEQ ID NO: 2696938 - DNA, 15 bp, Homo sapiens
tattcagtgctgtgg

SEQ ID NO: 2696939 - DNA, 18 bp, Homo sapiens
tattcagtgctgtggcct

SEQ ID NO: 2696940 - DNA, 22 bp, Homo sapiens
tattgctgctggtaatttgtat

SEQ ID NO: 2696941 - DNA, 14 bp, Homo sapiens
tatttactaaaaga

SEQ ID NO: 2696942 - DNA, 11 bp, Homo sapiens
tgggaggaagc

SEQ ID NO: 2696943 - DNA, 13 bp, Homo sapiens
tgggaggaagcag

SEQ ID NO: 2696944 - DNA, 19 bp, Homo sapiens
tgggaggtgagaccacctc

SEQ ID NO: 2696945 - DNA, 21 bp, Homo sapiens
tgggctctgccccagctctgg

SEQ ID NO: 2696946 - DNA, 17 bp, Homo sapiens
tgggctgagccctggca

SEQ ID NO: 2696947 - DNA, 19 bp, Homo sapiens
tggggcaagtccctgactc

SEQ ID NO: 2696948 - DNA, 19 bp, Homo sapiens
tgggtcctgcaatctccag

SEQ ID NO: 2696949 - DNA, 23 bp, Homo sapiens
tgggtcctgcaatctccagggct

SEQ ID NO: 2696950 - DNA, 23 bp, Homo sapiens
tgggttgttaatactatattgct

SEQ ID NO: 2696951 - DNA, 17 bp, Homo sapiens
tgggttttttcacataa

SEQ ID NO: 2696952 - DNA, 19 bp, Homo sapiens
tggtaatttgtatctgaag

SEQ ID NO: 2696953 - DNA, 21 bp, Homo sapiens
tggtatgaacttgaggacaca

SEQ ID NO: 2696954 - DNA, 10 bp, Homo sapiens
tgtagccaag

SEQ ID NO: 2696955 - DNA, 16 bp, Homo sapiens
tgtagccttgcccgga

SEQ ID NO: 2696956 - DNA, 21 bp, Homo sapiens
tgtccctctcggaaggctggc

SEQ ID NO: 2696957 - DNA, 23 bp, Homo sapiens
tgtcgtagccaaggtgggctgag

SEQ ID NO: 2696958 - DNA, 16 bp, Homo sapiens
tgtctgtctgtctgtc

SEQ ID NO: 2696959 - DNA, 23 bp, Homo sapiens
tgtgatcccaagtgccagtcttg

SEQ ID NO: 2696960 - DNA, 17 bp, Homo sapiens
tgtggaaagcctctgct

SEQ ID NO: 2696961 - DNA, 19 bp, Homo sapiens
tgtggaaagcctctgctgc

SEQ ID NO: 2696962 - DNA, 20 bp, Homo sapiens
tgtggaaagcctctgctgcc

SEQ ID NO: 2696963 - DNA, 21 bp, Homo sapiens
tgtggccccaggtgccaccaa

SEQ ID NO: 2696964 - DNA, 16 bp, Homo sapiens
tgttatttgtacagtt

SEQ ID NO: 2696965 - DNA, 13 bp, Homo sapiens
tgttgtaaataaa

SEQ ID NO: 2696966 - DNA, 16 bp, Homo sapiens
tgtttctccccctggg

SEQ ID NO: 2696967 - DNA, 22 bp, Homo sapiens
ttaaatggaataattagcttgt

SEQ ID NO: 2696968 - DNA, 17 bp, Homo sapiens
ttaaccagtacttctaa

SEQ ID NO: 2696969 - DNA, 21 bp, Homo sapiens
ttaaccttagagcttggacag

SEQ ID NO: 2696970 - DNA, 19 bp, Homo sapiens
ttaactgttagtattaact

SEQ ID NO: 2696971 - DNA, 18 bp, Homo sapiens
ttaatactgtattgctgt

SEQ ID NO: 2696972 - DNA, 13 bp, Homo sapiens
ttacagtaaataa

SEQ ID NO: 2696973 - DNA, 15 bp, Homo sapiens
ttacagtaaataaat

SEQ ID NO: 2696974 - DNA, 12 bp, Homo sapiens
ttactaaaagaa

SEQ ID NO: 2696975 - DNA, 15 bp, Homo sapiens
ttagaataaaattgt

SEQ ID NO: 2696976 - DNA, 23 bp, Homo sapiens
ttagtcctaaagggacaataact

SEQ ID NO: 2696977 - DNA, 13 bp, Homo sapiens
ttatgtctaaaga

SEQ ID NO: 2696978 - DNA, 16 bp, Homo sapiens
ttcaagttagctcagg

SEQ ID NO: 2696979 - DNA, 17 bp, Homo sapiens
ttcaagttagctcagga

SEQ ID NO: 2696980 - DNA, 24 bp, Homo sapiens
ttcactccggtgtgcctgcagccc

SEQ ID NO: 2696981 - DNA, 18 bp, Homo sapiens
ttcagggaatttcaggaa

SEQ ID NO: 2696982 - DNA, 23 bp, Homo sapiens
ttcatgacttttccatgtatcta

SEQ ID NO: 2696983 - DNA, 23 bp, Homo sapiens
ttccctgggggcagatatttccc

SEQ ID NO: 2696984 - DNA, 19 bp, Homo sapiens
ttcctctagtgccctccac

SEQ ID NO: 2696985 - DNA, 13 bp, Homo sapiens
ttcctcttcccca

SEQ ID NO: 2696986 - DNA, 12 bp, Homo sapiens
ttcctctttgca

SEQ ID NO: 2696987 - DNA, 16 bp, Homo sapiens
ttcgagaccagcctgg

SEQ ID NO: 2696988 - DNA, 18 bp, Homo sapiens
ttctccccctgggctctg

SEQ ID NO: 2696989 - DNA, 10 bp, Homo sapiens
ttctggagcc

SEQ ID NO: 2696990 - DNA, 22 bp, Homo sapiens
ttctggtatgaacttgaggaca

SEQ ID NO: 2696991 - DNA, 21 bp, Homo sapiens
ttgaagccactgaagctggga

SEQ ID NO: 2696992 - DNA, 11 bp, Homo sapiens
ttgaggacaca

SEQ ID NO: 2696993 - DNA, 14 bp, Homo sapiens
ttgaggacacatgt

SEQ ID NO: 2696994 - DNA, 15 bp, Homo sapiens
ttgaggacacatgtc

SEQ ID NO: 2696995 - DNA, 16 bp, Homo sapiens
ttgaggacacatgtcc

SEQ ID NO: 2696996 - DNA, 19 bp, Homo sapiens
ttgaggagcagcttcagtt

SEQ ID NO: 2696997 - DNA, 15 bp, Homo sapiens
ttgaggattttgagt

SEQ ID NO: 2696998 - DNA, 16 bp, Homo sapiens
ttgaggattttgagta

SEQ ID NO: 2696999 - DNA, 17 bp, Homo sapiens
ttgaggattttgagtat

SEQ ID NO: 2697000 - DNA, 14 bp, Homo sapiens
ttgaggctgcagcg

SEQ ID NO: 2697001 - DNA, 18 bp, Homo sapiens
ttgataaattccactgga

SEQ ID NO: 2697002 - DNA, 19 bp, Homo sapiens
ttgataaattccactggac

SEQ ID NO: 2697003 - DNA, 15 bp, Homo sapiens
ttgctgtcctaggcc

SEQ ID NO: 2697004 - DNA, 20 bp, Homo sapiens
ttggaaagcatcacctcagg

SEQ ID NO: 2697005 - DNA, 15 bp, Homo sapiens
ttggagactctgtgg

SEQ ID NO: 2697006 - DNA, 22 bp, Homo sapiens
ttggagggtgggagagcccagc

SEQ ID NO: 2697007 - DNA, 23 bp, Homo sapiens
ttggagggtgggagagcccagcc

SEQ ID NO: 2697008 - DNA, 22 bp, Homo sapiens
ttgggtcctgcaatctccaggg

SEQ ID NO: 2697009 - DNA, 12 bp, Homo sapiens
ttgtaagtttat

SEQ ID NO: 2697010 - DNA, 17 bp, Homo sapiens
ttgtatagagatatgca

SEQ ID NO: 2697011 - DNA, 18 bp, Homo sapiens
ttgtggaaagcctctgct

SEQ ID NO: 2697012 - DNA, 15 bp, Homo sapiens
ttgttatttgtacag

SEQ ID NO: 2697013 - DNA, 17 bp, Homo sapiens
ttgtttctccccctggg

SEQ ID NO: 2697014 - DNA, 20 bp, Homo sapiens
tttaaatggaataattagct

SEQ ID NO: 2697015 - DNA, 19 bp, Homo sapiens
tttcagctagttaataatt

SEQ ID NO: 2697016 - DNA, 21 bp, Homo sapiens
tttcagctgtgaacatggact

SEQ ID NO: 2697017 - DNA, 16 bp, Homo sapiens
tttcctatgactaatt

SEQ ID NO: 2697018 - DNA, 19 bp, Homo sapiens
tttctctggcagcataatt

SEQ ID NO: 2697019 - DNA, 19 bp, Homo sapiens
tttggagactctgtggggc

SEQ ID NO: 2697020 - DNA, 13 bp, Homo sapiens
tttgtaagtttat

SEQ ID NO: 2697021 - DNA, 14 bp, Homo sapiens
tttgtaccatggtg

SEQ ID NO: 2697022 - DNA, 12 bp, Homo sapiens
ttttaaaagaaa

SEQ ID NO: 2697023 - DNA, 18 bp, Homo sapiens
ttttaggcagggatttga

SEQ ID NO: 2697024 - DNA, 15 bp, Homo sapiens
ttttccaccctggaa

SEQ ID NO: 2697025 - DNA, 23 bp, Homo sapiens
ttttcccgagcaaagtctaaagt

SEQ ID NO: 2697026 - DNA, 11 bp, Homo sapiens
ttttgctgctg

SEQ ID NO: 2697027 - DNA, 16 bp, Homo sapiens
ttttgctgctgctgct

SEQ ID NO: 2697028 - DNA, 20 bp, Homo sapiens
ccgggcggaaggggacgcgg

SEQ ID NO: 2697029 - DNA, 17 bp, Homo sapiens
ccggtgtgcctgcagcc

SEQ ID NO: 2697030 - DNA, 19 bp, Homo sapiens
cctaccccacctcatgcct

SEQ ID NO: 2697031 - DNA, 12 bp, Homo sapiens
cctacctcagcc

SEQ ID NO: 2697032 - DNA, 13 bp, Homo sapiens
cctacctcagcct

SEQ ID NO: 2697033 - DNA, 14 bp, Homo sapiens
cctacctcagccta

SEQ ID NO: 2697034 - DNA, 13 bp, Homo sapiens
cctatgatcccag

SEQ ID NO: 2697035 - DNA, 17 bp, Homo sapiens
cctcaggcttccttggc

SEQ ID NO: 2697036 - DNA, 15 bp, Homo sapiens
cctcatgcctggccc

SEQ ID NO: 2697037 - DNA, 20 bp, Homo sapiens
cctccaggcatgctggcctc

SEQ ID NO: 2697038 - DNA, 13 bp, Homo sapiens
cctccatgtggcc

SEQ ID NO: 2697039 - DNA, 14 bp, Homo sapiens
cctccatgtggccc

SEQ ID NO: 2697040 - DNA, 18 bp, Homo sapiens
cctcccaataaagctgga

SEQ ID NO: 2697041 - DNA, 21 bp, Homo sapiens
cctcccagggccagggccctg

SEQ ID NO: 2697042 - DNA, 20 bp, Homo sapiens
cctccccattagagtcagcc

SEQ ID NO: 2697043 - DNA, 15 bp, Homo sapiens
cctcccccagagggg

SEQ ID NO: 2697044 - DNA, 20 bp, Homo sapiens
cctccttccttgctgtccta

SEQ ID NO: 2697045 - DNA, 15 bp, Homo sapiens
cctcgtggacacctg

SEQ ID NO: 2697046 - DNA, 21 bp, Homo sapiens
cctcgtggacacctgccctgc

SEQ ID NO: 2697047 - DNA, 13 bp, Homo sapiens
cctctagtgccct

SEQ ID NO: 2697048 - DNA, 14 bp, Homo sapiens
cctctagtgccctc

SEQ ID NO: 2697049 - DNA, 15 bp, Homo sapiens
cctctagtgccctcc

SEQ ID NO: 2697050 - DNA, 16 bp, Homo sapiens
cctctgacctgcaggc

SEQ ID NO: 2697051 - DNA, 19 bp, Homo sapiens
cctctgacctgcaggccaa

SEQ ID NO: 2697052 - DNA, 15 bp, Homo sapiens
cctctgctgccatgg

SEQ ID NO: 2697053 - DNA, 23 bp, Homo sapiens
cctgaaacccagtaattctaccc

SEQ ID NO: 2697054 - DNA, 18 bp, Homo sapiens
cctgactctctgtgacct

SEQ ID NO: 2697055 - DNA, 23 bp, Homo sapiens
cctgagtctgctatattttcatg

SEQ ID NO: 2697056 - DNA, 19 bp, Homo sapiens
cctgcagaggggaaaccag

SEQ ID NO: 2697057 - DNA, 14 bp, Homo sapiens
cctgccacctgtct

SEQ ID NO: 2697058 - DNA, 17 bp, Homo sapiens
cctgccacctgtctgtc

SEQ ID NO: 2697059 - DNA, 14 bp, Homo sapiens
cctgccagcctggc

SEQ ID NO: 2697060 - DNA, 21 bp, Homo sapiens
cctgccctgccacctgtctgt

SEQ ID NO: 2697061 - DNA, 13 bp, Homo sapiens
cctgccttgaagc

SEQ ID NO: 2697062 - DNA, 16 bp, Homo sapiens
cctgccttgaagccac

SEQ ID NO: 2697063 - DNA, 19 bp, Homo sapiens
cctgcgaaggggccctggt

SEQ ID NO: 2697064 - DNA, 15 bp, Homo sapiens
cctggaaaggctcag

SEQ ID NO: 2697065 - DNA, 20 bp, Homo sapiens
cctggaaaggctcagtctca

SEQ ID NO: 2697066 - DNA, 17 bp, Homo sapiens
cctggcaggatgaccct

SEQ ID NO: 2697067 - DNA, 16 bp, Homo sapiens
cctggcccccctccag

SEQ ID NO: 2697068 - DNA, 17 bp, Homo sapiens
cctggcccccctccagg

SEQ ID NO: 2697069 - DNA, 20 bp, Homo sapiens
cctggcccccctccaggcat

SEQ ID NO: 2697070 - DNA, 20 bp, Homo sapiens
cctggcttctggagcccttg

SEQ ID NO: 2697071 - DNA, 21 bp, Homo sapiens
cctggcttctggagcccttgg

SEQ ID NO: 2697072 - DNA, 14 bp, Homo sapiens
cctgggctctgccc

SEQ ID NO: 2697073 - DNA, 24 bp, Homo sapiens
cctgggctctgccccagctctggc

SEQ ID NO: 2697074 - DNA, 15 bp, Homo sapiens
cctggtccttccagg

SEQ ID NO: 2697075 - DNA, 22 bp, Homo sapiens
cctggtgattctgatgcagcct

SEQ ID NO: 2697076 - DNA, 17 bp, Homo sapiens
cctggtgcactggcccc

SEQ ID NO: 2697077 - DNA, 12 bp, Homo sapiens
cctggtggacag

SEQ ID NO: 2697078 - DNA, 13 bp, Homo sapiens
cctgtactcagga

SEQ ID NO: 2697079 - DNA, 15 bp, Homo sapiens
cctgtactcaggagg

SEQ ID NO: 2697080 - DNA, 21 bp, Homo sapiens
cctgtactcaggaggctgagg

SEQ ID NO: 2697081 - DNA, 13 bp, Homo sapiens
cctgtaggttgct

SEQ ID NO: 2697082 - DNA, 21 bp, Homo sapiens
cctgtctgtctgtctgtccca

SEQ ID NO: 2697083 - DNA, 21 bp, Homo sapiens
cctgtgctgaggactccctcc

SEQ ID NO: 2697084 - DNA, 18 bp, Homo sapiens
cctgttgttcccatctgc

SEQ ID NO: 2697085 - DNA, 19 bp, Homo sapiens
ccttcaagttagctcagga

SEQ ID NO: 2697086 - DNA, 20 bp, Homo sapiens
ccttccccctcccagggcca

SEQ ID NO: 2697087 - DNA, 20 bp, Homo sapiens
ccttcctacacccttggact

SEQ ID NO: 2697088 - DNA, 13 bp, Homo sapiens
ccttttgctgctg

SEQ ID NO: 2697089 - DNA, 15 bp, Homo sapiens
cgagaccagcctggc

SEQ ID NO: 2697090 - DNA, 15 bp, Homo sapiens
cgagagtctgtctca

SEQ ID NO: 2697091 - DNA, 19 bp, Homo sapiens
cgagcaaagtctaaagttt

SEQ ID NO: 2697092 - DNA, 21 bp, Homo sapiens
cgagctccttgggtcctgcaa

SEQ ID NO: 2697093 - DNA, 21 bp, Homo sapiens
cgatgaatttggagactctgt

SEQ ID NO: 2697094 - DNA, 21 bp, Homo sapiens
cgccactacactccagcctga

SEQ ID NO: 2697095 - DNA, 21 bp, Homo sapiens
cgccactgcactccagcctgg

SEQ ID NO: 2697096 - DNA, 23 bp, Homo sapiens
cgccactgcactccagcctgggc

SEQ ID NO: 2697097 - DNA, 15 bp, Homo sapiens
cgcccagctgcacct

SEQ ID NO: 2697098 - DNA, 16 bp, Homo sapiens
cgcctatgatcccagc

SEQ ID NO: 2697099 - DNA, 22 bp, Homo sapiens
cgccttcactccggtgtgcctg

SEQ ID NO: 2697100 - DNA, 12 bp, Homo sapiens
cgcgcacacaca

SEQ ID NO: 2697101 - DNA, 18 bp, Homo sapiens
cggaaggctggctgggca

SEQ ID NO: 2697102 - DNA, 22 bp, Homo sapiens
cggaaggggacgcgggctgtgc

SEQ ID NO: 2697103 - DNA, 14 bp, Homo sapiens
cggacctttcagct

SEQ ID NO: 2697104 - DNA, 14 bp, Homo sapiens
cgggctgtgcctta

SEQ ID NO: 2697105 - DNA, 15 bp, Homo sapiens
cggggagggggacgc

SEQ ID NO: 2697106 - DNA, 16 bp, Homo sapiens
cggggcatgctggggc

SEQ ID NO: 2697107 - DNA, 23 bp, Homo sapiens
cggtcaccgagacggctggacct

SEQ ID NO: 2697108 - DNA, 20 bp, Homo sapiens
cggtgtgcctgcagccccgc

SEQ ID NO: 2697109 - DNA, 16 bp, Homo sapiens
cggtgtgggctgtgtc

SEQ ID NO: 2697110 - DNA, 14 bp, Homo sapiens
cgtggacacctgcc

SEQ ID NO: 2697111 - DNA, 15 bp, Homo sapiens
cgtggacacctgccc

SEQ ID NO: 2697112 - DNA, 19 bp, Homo sapiens
cgtggacacctgccctgcc

SEQ ID NO: 2697113 - DNA, 20 bp, Homo sapiens
ctaaagggacaataactctg

SEQ ID NO: 2697114 - DNA, 24 bp, Homo sapiens
ctaaagtttacagtaaataaattg

SEQ ID NO: 2697115 - DNA, 16 bp, Homo sapiens
ctacacccttggactt

SEQ ID NO: 2697116 - DNA, 21 bp, Homo sapiens
ctaccctgaaacccagtaatt

SEQ ID NO: 2697117 - DNA, 22 bp, Homo sapiens
ctacctcactattcaagtatta

SEQ ID NO: 2697118 - DNA, 12 bp, Homo sapiens
ctacctcagcct

SEQ ID NO: 2697119 - DNA, 15 bp, Homo sapiens
ctacctcagcctaga

SEQ ID NO: 2697120 - DNA, 17 bp, Homo sapiens
ctactcagaagcctgag

SEQ ID NO: 2697121 - DNA, 19 bp, Homo sapiens
ctactcagaagcctgaggc

SEQ ID NO: 2697122 - DNA, 21 bp, Homo sapiens
ctactcagaagcctgaggctg

SEQ ID NO: 2697123 - DNA, 14 bp, Homo sapiens
ctactgaaaatgca

SEQ ID NO: 2697124 - DNA, 14 bp, Homo sapiens
ctaggactctgagg

SEQ ID NO: 2697125 - DNA, 15 bp, Homo sapiens
ctaggactctgaggc

SEQ ID NO: 2697126 - DNA, 16 bp, Homo sapiens
ctaggactctgaggct

SEQ ID NO: 2697127 - DNA, 13 bp, Homo sapiens
ctagtactattac

SEQ ID NO: 2697128 - DNA, 15 bp, Homo sapiens
ctatttaacttgagg

SEQ ID NO: 2697129 - DNA, 12 bp, Homo sapiens
ctcaaaaagttt

SEQ ID NO: 2697130 - DNA, 16 bp, Homo sapiens
ctcaatattcaataaa

SEQ ID NO: 2697131 - DNA, 21 bp, Homo sapiens
ctcaatgtgcaataacttgtg

SEQ ID NO: 2697132 - DNA, 20 bp, Homo sapiens
ctcacgcctatgatcccagc

SEQ ID NO: 2697133 - DNA, 14 bp, Homo sapiens
ctcagaagcctgag

SEQ ID NO: 2697134 - DNA, 16 bp, Homo sapiens
ctcagaagcctgaggc

SEQ ID NO: 2697135 - DNA, 13 bp, Homo sapiens
ctcagtgctctcc

SEQ ID NO: 2697136 - DNA, 14 bp, Homo sapiens
ctcatgcctggccc

SEQ ID NO: 2697137 - DNA, 23 bp, Homo sapiens
ctcatgcctggcccccctccagg

SEQ ID NO: 2697138 - DNA, 18 bp, Homo sapiens
ctccaatccacacatatt

SEQ ID NO: 2697139 - DNA, 16 bp, Homo sapiens
ctccaggcatgctggc

SEQ ID NO: 2697140 - DNA, 16 bp, Homo sapiens
ctccatgtggccccag

SEQ ID NO: 2697141 - DNA, 15 bp, Homo sapiens
ctcccaataaagctg

SEQ ID NO: 2697142 - DNA, 16 bp, Homo sapiens
ctcccagggccagggc

SEQ ID NO: 2697143 - DNA, 23 bp, Homo sapiens
ctcccagggccagggccctgcag

SEQ ID NO: 2697144 - DNA, 21 bp, Homo sapiens
ctccccattagagtcagcctt

SEQ ID NO: 2697145 - DNA, 12 bp, Homo sapiens
ctccccctgggc

SEQ ID NO: 2697146 - DNA, 16 bp, Homo sapiens
ctccctccatgtggcc

SEQ ID NO: 2697147 - DNA, 17 bp, Homo sapiens
ctccctctgacctgcag

SEQ ID NO: 2697148 - DNA, 17 bp, Homo sapiens
gctggggcaagtccctg

SEQ ID NO: 2697149 - DNA, 13 bp, Homo sapiens
gctgtcctaggcc

SEQ ID NO: 2697150 - DNA, 16 bp, Homo sapiens
gctgtcctaggccaca

SEQ ID NO: 2697151 - DNA, 14 bp, Homo sapiens
gctgtggcctgggc

SEQ ID NO: 2697152 - DNA, 15 bp, Homo sapiens
gctgtggcctgggca

SEQ ID NO: 2697153 - DNA, 15 bp, Homo sapiens
gcttcagcctgaggc

SEQ ID NO: 2697154 - DNA, 15 bp, Homo sapiens
gcttcagttgttttc

SEQ ID NO: 2697155 - DNA, 12 bp, Homo sapiens
gcttctggagcc

SEQ ID NO: 2697156 - DNA, 14 bp, Homo sapiens
gcttctggagccct

SEQ ID NO: 2697157 - DNA, 18 bp, Homo sapiens
gcttctggagcccttggg

SEQ ID NO: 2697158 - DNA, 19 bp, Homo sapiens
gcttggaaagcatcacctc

SEQ ID NO: 2697159 - DNA, 13 bp, Homo sapiens
gctttctggagag

SEQ ID NO: 2697160 - DNA, 16 bp, Homo sapiens
ggaaagcctctgctgc

SEQ ID NO: 2697161 - DNA, 13 bp, Homo sapiens
ggaaataaatgat

SEQ ID NO: 2697162 - DNA, 18 bp, Homo sapiens
ggaacggggtccttcaag

SEQ ID NO: 2697163 - DNA, 20 bp, Homo sapiens
ggaagcggaggttgcaggga

SEQ ID NO: 2697164 - DNA, 14 bp, Homo sapiens
ggaaggctggctgg

SEQ ID NO: 2697165 - DNA, 17 bp, Homo sapiens
ggaaggctggctgggca

SEQ ID NO: 2697166 - DNA, 17 bp, Homo sapiens
ggaagggcatccttctg

SEQ ID NO: 2697167 - DNA, 15 bp, Homo sapiens
ggacaagaagctgct

SEQ ID NO: 2697168 - DNA, 16 bp, Homo sapiens
ggacaagaagctgcta

SEQ ID NO: 2697169 - DNA, 10 bp, Homo sapiens
ggacacctgc

SEQ ID NO: 2697170 - DNA, 14 bp, Homo sapiens
ggacacctgccctg

SEQ ID NO: 2697171 - DNA, 15 bp, Homo sapiens
ggacacctgccctgc

SEQ ID NO: 2697172 - DNA, 17 bp, Homo sapiens
ggacagtattctcagtg

SEQ ID NO: 2697173 - DNA, 15 bp, Homo sapiens
ggacagtcctgggag

SEQ ID NO: 2697174 - DNA, 16 bp, Homo sapiens
ggacagtcctgggaga

SEQ ID NO: 2697175 - DNA, 20 bp, Homo sapiens
ggacagtgcttcagcctgag

SEQ ID NO: 2697176 - DNA, 23 bp, Homo sapiens
ggacagtgcttcagcctgaggct

SEQ ID NO: 2697177 - DNA, 19 bp, Homo sapiens
ggacatggtgtttaaaatt

SEQ ID NO: 2697178 - DNA, 23 bp, Homo sapiens
ggacctgaagggtgacatcccag

SEQ ID NO: 2697179 - DNA, 13 bp, Homo sapiens
ggagactctgtgg

SEQ ID NO: 2697180 - DNA, 16 bp, Homo sapiens
ggagactctgtggggc

SEQ ID NO: 2697181 - DNA, 17 bp, Homo sapiens
ggagattttccttccta

SEQ ID NO: 2697182 - DNA, 19 bp, Homo sapiens
ggagcgcacctgccccctg

SEQ ID NO: 2697183 - DNA, 16 bp, Homo sapiens
ggaggatcactggagc

SEQ ID NO: 2697184 - DNA, 21 bp, Homo sapiens
ggagggggacgcgcacacaca

SEQ ID NO: 2697185 - DNA, 19 bp, Homo sapiens
ggagtttgaggctgcagcg

SEQ ID NO: 2697186 - DNA, 17 bp, Homo sapiens
ggatcactggagcccag

SEQ ID NO: 2697187 - DNA, 16 bp, Homo sapiens
ggatggtcctggggct

SEQ ID NO: 2697188 - DNA, 21 bp, Homo sapiens
ggatttgaggagcagcttcag

SEQ ID NO: 2697189 - DNA, 18 bp, Homo sapiens
ggcacctatagtcccagc

SEQ ID NO: 2697190 - DNA, 16 bp, Homo sapiens
ggcagagccgggaagc

SEQ ID NO: 2697191 - DNA, 21 bp, Homo sapiens
ggcagctgaactattggaggg

SEQ ID NO: 2697192 - DNA, 15 bp, Homo sapiens
ggcagggatttgagg

SEQ ID NO: 2697193 - DNA, 13 bp, Homo sapiens
ggcatcacagggc

SEQ ID NO: 2697194 - DNA, 14 bp, Homo sapiens
ggcatcacagggca

SEQ ID NO: 2697195 - DNA, 16 bp, Homo sapiens
ggcatcacagggcaga

SEQ ID NO: 2697196 - DNA, 23 bp, Homo sapiens
ggcatcacagggcagagccggga

SEQ ID NO: 2697197 - DNA, 16 bp, Homo sapiens
ggcatccttctgcctt

SEQ ID NO: 2697198 - DNA, 19 bp, Homo sapiens
ggcatccttctgccttttt

SEQ ID NO: 2697199 - DNA, 12 bp, Homo sapiens
ggcatgctgggg

SEQ ID NO: 2697200 - DNA, 13 bp, Homo sapiens
ggcatgctggggc

SEQ ID NO: 2697201 - DNA, 13 bp, Homo sapiens
ggcattcctgctt

SEQ ID NO: 2697202 - DNA, 18 bp, Homo sapiens
ggccagggccctgcagag

SEQ ID NO: 2697203 - DNA, 18 bp, Homo sapiens
ggcccccctccaggcatg

SEQ ID NO: 2697204 - DNA, 18 bp, Homo sapiens
ggcctcccaataaagctg

SEQ ID NO: 2697205 - DNA, 19 bp, Homo sapiens
ggcctcccaataaagctgg

SEQ ID NO: 2697206 - DNA, 20 bp, Homo sapiens
ggcctcccaataaagctgga

SEQ ID NO: 2697207 - DNA, 22 bp, Homo sapiens
ggcctccgtcatgaatgccttc

SEQ ID NO: 2697208 - DNA, 15 bp, Homo sapiens
ggcggaaggggacgc

SEQ ID NO: 2697209 - DNA, 16 bp, Homo sapiens
ggcgtggtggcgggca

SEQ ID NO: 2697210 - DNA, 21 bp, Homo sapiens
ggctcacgcctatgatcccag

SEQ ID NO: 2697211 - DNA, 23 bp, Homo sapiens
ggctcacgcctatgatcccagca

SEQ ID NO: 2697212 - DNA, 17 bp, Homo sapiens
ggctcagtctcaggagc

SEQ ID NO: 2697213 - DNA, 14 bp, Homo sapiens
ggctctgccccagc

SEQ ID NO: 2697214 - DNA, 23 bp, Homo sapiens
ggctctgccccagctctggcttc

SEQ ID NO: 2697215 - DNA, 12 bp, Homo sapiens
ggctgagccctg

SEQ ID NO: 2697216 - DNA, 14 bp, Homo sapiens
ggctgagccctggc

SEQ ID NO: 2697217 - DNA, 22 bp, Homo sapiens
ggctgcagtgacgtgcacctgt

SEQ ID NO: 2697218 - DNA, 13 bp, Homo sapiens
ggctgccctgcca

SEQ ID NO: 2697219 - DNA, 13 bp, Homo sapiens
ggctggacctgca

SEQ ID NO: 2697220 - DNA, 14 bp, Homo sapiens
ggctggacctgcac

SEQ ID NO: 2697221 - DNA, 21 bp, Homo sapiens
ggcttccagaaaaccccagca

SEQ ID NO: 2697222 - DNA, 13 bp, Homo sapiens
ggcttctggagcc

SEQ ID NO: 2697223 - DNA, 20 bp, Homo sapiens
ggcttctggagcccttgggt

SEQ ID NO: 2697224 - DNA, 12 bp, Homo sapiens
ggctttctggag

SEQ ID NO: 2697225 - DNA, 13 bp, Homo sapiens
ggctttctggaga

SEQ ID NO: 2697226 - DNA, 23 bp, Homo sapiens
gggaagcggaggttgcagggagc

SEQ ID NO: 2697227 - DNA, 15 bp, Homo sapiens
gggacagtattctca

SEQ ID NO: 2697228 - DNA, 17 bp, Homo sapiens
gggacgcgcacacacac

SEQ ID NO: 2697229 - DNA, 15 bp, Homo sapiens
gggagaacctcaggc

SEQ ID NO: 2697230 - DNA, 23 bp, Homo sapiens
gggaggaagcaggttgaggggct

SEQ ID NO: 2697231 - DNA, 17 bp, Homo sapiens
gggaggatcactggagc

SEQ ID NO: 2697232 - DNA, 14 bp, Homo sapiens
gggaggctgaggcg

SEQ ID NO: 2697233 - DNA, 13 bp, Homo sapiens
gggccagggccct

SEQ ID NO: 2697234 - DNA, 14 bp, Homo sapiens
gggccagggccctg

SEQ ID NO: 2697235 - DNA, 16 bp, Homo sapiens
gggccagggccctgca

SEQ ID NO: 2697236 - DNA, 18 bp, Homo sapiens
gggccagggccctgcaga

SEQ ID NO: 2697237 - DNA, 15 bp, Homo sapiens
gggccctgcagaggg

SEQ ID NO: 2697238 - DNA, 14 bp, Homo sapiens
gggcctctgaaatt

SEQ ID NO: 2697239 - DNA, 20 bp, Homo sapiens
gggctcctggaaaggctcag

SEQ ID NO: 2697240 - DNA, 23 bp, Homo sapiens
gggctcctggaaaggctcagtct

SEQ ID NO: 2697241 - DNA, 12 bp, Homo sapiens
gggctctgcccc

SEQ ID NO: 2697242 - DNA, 20 bp, Homo sapiens
gggctctgccccagctctgg

SEQ ID NO: 2697243 - DNA, 21 bp, Homo sapiens
gggctctgccccagctctggc

SEQ ID NO: 2697244 - DNA, 15 bp, Homo sapiens
gggctgagccctggc

SEQ ID NO: 2697245 - DNA, 21 bp, Homo sapiens
gggctgcccctgtaggttgct

SEQ ID NO: 2697246 - DNA, 12 bp, Homo sapiens
gggctgccctgc

SEQ ID NO: 2697247 - DNA, 18 bp, Homo sapiens
ggggacgcgcacacacac

SEQ ID NO: 2697248 - DNA, 16 bp, Homo sapiens
ggggagggggacgcgc

SEQ ID NO: 2697249 - DNA, 21 bp, Homo sapiens
ggggccctggtccttccaggc

SEQ ID NO: 2697250 - DNA, 11 bp, Homo sapiens
ggggctcctgg

SEQ ID NO: 2697251 - DNA, 15 bp, Homo sapiens
ggggctttctggaga

SEQ ID NO: 2697252 - DNA, 23 bp, Homo sapiens
gggtgacatcccaggaggggcct

SEQ ID NO: 2697253 - DNA, 16 bp, Homo sapiens
ggtatgaacttgagga

SEQ ID NO: 2697254 - DNA, 18 bp, Homo sapiens
ggtcctgcaatctccagg

SEQ ID NO: 2697255 - DNA, 23 bp, Homo sapiens
ggtcggtttggtttgttgtaaat

SEQ ID NO: 2697256 - DNA, 13 bp, Homo sapiens
ggtgacatcccag

SEQ ID NO: 2697257 - DNA, 17 bp, Homo sapiens
ggtgcactggccccacc

SEQ ID NO: 2697258 - DNA, 18 bp, Homo sapiens
ggtgccaccaataaaaat

SEQ ID NO: 2697259 - DNA, 16 bp, Homo sapiens
ggtggacagtcctggg

SEQ ID NO: 2697260 - DNA, 13 bp, Homo sapiens
ggtgggctgagcc

SEQ ID NO: 2697261 - DNA, 17 bp, Homo sapiens
ggtgggctgagccctgg

SEQ ID NO: 2697262 - DNA, 14 bp, Homo sapiens
ggtgtgcctgcagc

SEQ ID NO: 2697263 - DNA, 19 bp, Homo sapiens
ggttgaggggctcctggaa

SEQ ID NO: 2697264 - DNA, 13 bp, Homo sapiens
gtaaaagctaatt

SEQ ID NO: 2697265 - DNA, 15 bp, Homo sapiens
gtaaaattgtataga

SEQ ID NO: 2697266 - DNA, 14 bp, Homo sapiens
gtaaataaattgtt

SEQ ID NO: 2697267 - DNA, 18 bp, Homo sapiens
gtaaataaattgtttgac

SEQ ID NO: 2697268 - DNA, 19 bp, Homo sapiens
gtaagtttatgtctaaaga

SEQ ID NO: 2697269 - DNA, 13 bp, Homo sapiens
agcatcacctcag

SEQ ID NO: 2697270 - DNA, 16 bp, Homo sapiens
agcatcacctcaggcc

SEQ ID NO: 2697271 - DNA, 20 bp, Homo sapiens
agcatcacctcaggccaggt

SEQ ID NO: 2697272 - DNA, 14 bp, Homo sapiens
agccaaactctgcc

SEQ ID NO: 2697273 - DNA, 19 bp, Homo sapiens
agccaaggtgggctgagcc

SEQ ID NO: 2697274 - DNA, 13 bp, Homo sapiens
agccactgaagct

SEQ ID NO: 2697275 - DNA, 13 bp, Homo sapiens
agccctggcagga

SEQ ID NO: 2697276 - DNA, 12 bp, Homo sapiens
agcccttgggtt

SEQ ID NO: 2697277 - DNA, 14 bp, Homo sapiens
agcctccctctgac

SEQ ID NO: 2697278 - DNA, 21 bp, Homo sapiens
agcctccctctgacctgcagg

SEQ ID NO: 2697279 - DNA, 12 bp, Homo sapiens
agcctctgctgc

SEQ ID NO: 2697280 - DNA, 13 bp, Homo sapiens
agcctctgctgcc

SEQ ID NO: 2697281 - DNA, 18 bp, Homo sapiens
agcctctgctgccatggc

SEQ ID NO: 2697282 - DNA, 15 bp, Homo sapiens
agcctgggcgacaga

SEQ ID NO: 2697283 - DNA, 23 bp, Homo sapiens
agcctgtccactaacttgtcttt

SEQ ID NO: 2697284 - DNA, 19 bp, Homo sapiens
agccttccccctcccaggg

SEQ ID NO: 2697285 - DNA, 16 bp, Homo sapiens
agcgagagtctgtctc

SEQ ID NO: 2697286 - DNA, 12 bp, Homo sapiens
agcgcacctgcc

SEQ ID NO: 2697287 - DNA, 19 bp, Homo sapiens
agcgcacctgccccctggt

SEQ ID NO: 2697288 - DNA, 21 bp, Homo sapiens
agcgcacctgccccctggtgg

SEQ ID NO: 2697289 - DNA, 24 bp, Homo sapiens
agcgcctgtgctgaggactccctc

SEQ ID NO: 2697290 - DNA, 14 bp, Homo sapiens
agctagttaataat

SEQ ID NO: 2697291 - DNA, 17 bp, Homo sapiens
agctagttaataattct

SEQ ID NO: 2697292 - DNA, 12 bp, Homo sapiens
agctctggcttc

SEQ ID NO: 2697293 - DNA, 16 bp, Homo sapiens
agctgcacctgccagc

SEQ ID NO: 2697294 - DNA, 22 bp, Homo sapiens
agctgcacctgccagcctggct

SEQ ID NO: 2697295 - DNA, 20 bp, Homo sapiens
agctggacaagaagctgcta

SEQ ID NO: 2697296 - DNA, 16 bp, Homo sapiens
agcttggacagtctga

SEQ ID NO: 2697297 - DNA, 18 bp, Homo sapiens
aggaagggcatccttctg

SEQ ID NO: 2697298 - DNA, 20 bp, Homo sapiens
aggaagggcatccttctgcc

SEQ ID NO: 2697299 - DNA, 13 bp, Homo sapiens
aggacacatgtcc

SEQ ID NO: 2697300 - DNA, 21 bp, Homo sapiens
aggacagtgcttcagcctgag

SEQ ID NO: 2697301 - DNA, 22 bp, Homo sapiens
aggacagtgcttcagcctgagg

SEQ ID NO: 2697302 - DNA, 16 bp, Homo sapiens
aggactatgggtacat

SEQ ID NO: 2697303 - DNA, 13 bp, Homo sapiens
aggactctgaggc

SEQ ID NO: 2697304 - DNA, 17 bp, Homo sapiens
aggactctgaggctctt

SEQ ID NO: 2697305 - DNA, 12 bp, Homo sapiens
aggaggggcctc

SEQ ID NO: 2697306 - DNA, 14 bp, Homo sapiens
aggaggtggcagcc

SEQ ID NO: 2697307 - DNA, 18 bp, Homo sapiens
aggaggtggcagccctgt

SEQ ID NO: 2697308 - DNA, 21 bp, Homo sapiens
aggaggtggcagccctgtagg

SEQ ID NO: 2697309 - DNA, 22 bp, Homo sapiens
aggagttcgagaccagcctggc

SEQ ID NO: 2697310 - DNA, 22 bp, Homo sapiens
aggagttctgaagctgacagca

SEQ ID NO: 2697311 - DNA, 20 bp, Homo sapiens
aggagtttgaggctgcagcg

SEQ ID NO: 2697312 - DNA, 24 bp, Homo sapiens
aggagtttgaggctgcagcgagct

SEQ ID NO: 2697313 - DNA, 16 bp, Homo sapiens
aggatcactggagccc

SEQ ID NO: 2697314 - DNA, 22 bp, Homo sapiens
aggatcactggagcccaggagt

SEQ ID NO: 2697315 - DNA, 14 bp, Homo sapiens
aggcagggatttga

SEQ ID NO: 2697316 - DNA, 18 bp, Homo sapiens
aggcatgctggcctccca

SEQ ID NO: 2697317 - DNA, 20 bp, Homo sapiens
aggccaagagcagaggcagc

SEQ ID NO: 2697318 - DNA, 22 bp, Homo sapiens
aggccacaccatctcctttcag

SEQ ID NO: 2697319 - DNA, 18 bp, Homo sapiens
aggctctttctgggccaa

SEQ ID NO: 2697320 - DNA, 15 bp, Homo sapiens
aggctgcagcgagct

SEQ ID NO: 2697321 - DNA, 19 bp, Homo sapiens
agggaacggggtccttcaa

SEQ ID NO: 2697322 - DNA, 15 bp, Homo sapiens
agggccagggccctg

SEQ ID NO: 2697323 - DNA, 17 bp, Homo sapiens
agggcccaggcaggcca

SEQ ID NO: 2697324 - DNA, 12 bp, Homo sapiens
agggccctgcag

SEQ ID NO: 2697325 - DNA, 14 bp, Homo sapiens
agggctgcccctgt

SEQ ID NO: 2697326 - DNA, 19 bp, Homo sapiens
aggggaggatcactggagc

SEQ ID NO: 2697327 - DNA, 13 bp, Homo sapiens
aggggcctctgaa

SEQ ID NO: 2697328 - DNA, 23 bp, Homo sapiens
aggggctcctggaaaggctcagt

SEQ ID NO: 2697329 - DNA, 20 bp, Homo sapiens
aggggctttctggagaggag

SEQ ID NO: 2697330 - DNA, 15 bp, Homo sapiens
agggggcggggcggg

SEQ ID NO: 2697331 - DNA, 22 bp, Homo sapiens
agggtaataaacttagaataaa

SEQ ID NO: 2697332 - DNA, 15 bp, Homo sapiens
agggtaatagaaatg

SEQ ID NO: 2697333 - DNA, 18 bp, Homo sapiens
agggttttccaccctgga

SEQ ID NO: 2697334 - DNA, 11 bp, Homo sapiens
aggtgcagtgg

SEQ ID NO: 2697335 - DNA, 15 bp, Homo sapiens
aggtgccaccaataa

SEQ ID NO: 2697336 - DNA, 22 bp, Homo sapiens
aggtgccaccaataaaaatcct

SEQ ID NO: 2697337 - DNA, 13 bp, Homo sapiens
aggtggcagccct

SEQ ID NO: 2697338 - DNA, 17 bp, Homo sapiens
aggtgggctgagccctg

SEQ ID NO: 2697339 - DNA, 19 bp, Homo sapiens
aggtgggctgagccctggc

SEQ ID NO: 2697340 - DNA, 21 bp, Homo sapiens
aggttaggagttcgagaccag

SEQ ID NO: 2697341 - DNA, 12 bp, Homo sapiens
aggttgcaggga

SEQ ID NO: 2697342 - DNA, 18 bp, Homo sapiens
aggttgcagggagccgag

SEQ ID NO: 2697343 - DNA, 14 bp, Homo sapiens
agtaaaagctaatt

SEQ ID NO: 2697344 - DNA, 19 bp, Homo sapiens
agtaagtaccactcaggcc

SEQ ID NO: 2697345 - DNA, 20 bp, Homo sapiens
agtaagtaccactcaggcca

SEQ ID NO: 2697346 - DNA, 22 bp, Homo sapiens
agtatctcggacctttcagctg

SEQ ID NO: 2697347 - DNA, 23 bp, Homo sapiens
agtcagatgcccagagggcccag

SEQ ID NO: 2697348 - DNA, 22 bp, Homo sapiens
agtccacctgcctatccatcct

SEQ ID NO: 2697349 - DNA, 21 bp, Homo sapiens
agtccctgactctctgtgacc

SEQ ID NO: 2697350 - DNA, 17 bp, Homo sapiens
agtcctcgtagccatct

SEQ ID NO: 2697351 - DNA, 14 bp, Homo sapiens
agtctaaagtttac

SEQ ID NO: 2697352 - DNA, 13 bp, Homo sapiens
agtctcaggagca

SEQ ID NO: 2697353 - DNA, 17 bp, Homo sapiens
agtgccctccacagccg

SEQ ID NO: 2697354 - DNA, 16 bp, Homo sapiens
agtgctgtggcctggg

SEQ ID NO: 2697355 - DNA, 19 bp, Homo sapiens
agtgcttcagcctgaggct

SEQ ID NO: 2697356 - DNA, 15 bp, Homo sapiens
agtgtagccttgccc

SEQ ID NO: 2697357 - DNA, 17 bp, Homo sapiens
agtgtagccttgcccgg

SEQ ID NO: 2697358 - DNA, 24 bp, Homo sapiens
agttcagttcctctttgcatggaa

SEQ ID NO: 2697359 - DNA, 18 bp, Homo sapiens
agttcctctagtgccctc

SEQ ID NO: 2697360 - DNA, 18 bp, Homo sapiens
agttgtggaaagcctctg

SEQ ID NO: 2697361 - DNA, 20 bp, Homo sapiens
agttgtggaaagcctctgct

SEQ ID NO: 2697362 - DNA, 21 bp, Homo sapiens
agttgtggaaagcctctgctg

SEQ ID NO: 2697363 - DNA, 13 bp, Homo sapiens
agtttacagtaaa

SEQ ID NO: 2697364 - DNA, 16 bp, Homo sapiens
agtttacagtaaataa

SEQ ID NO: 2697365 - DNA, 18 bp, Homo sapiens
agtttacagtaaataaat

SEQ ID NO: 2697366 - DNA, 20 bp, Homo sapiens
agtttacagtaaataaattg

SEQ ID NO: 2697367 - DNA, 19 bp, Homo sapiens
ataaaaataccttaaatct

SEQ ID NO: 2697368 - DNA, 11 bp, Homo sapiens
ataaaattgta

SEQ ID NO: 2697369 - DNA, 21 bp, Homo sapiens
ataaagctggacaagaagctg

SEQ ID NO: 2697370 - DNA, 23 bp, Homo sapiens
ataaagctggacaagaagctgct

SEQ ID NO: 2697371 - DNA, 15 bp, Homo sapiens
ataaatgaatcttac

SEQ ID NO: 2697372 - DNA, 13 bp, Homo sapiens
atagtattaacta

SEQ ID NO: 2697373 - DNA, 18 bp, Homo sapiens
atatatgctcaaccagaa

SEQ ID NO: 2697374 - DNA, 22 bp, Homo sapiens
atatattaaaatgtaggaagaa

SEQ ID NO: 2697375 - DNA, 17 bp, Homo sapiens
atatatttactaaaaga

SEQ ID NO: 2697376 - DNA, 13 bp, Homo sapiens
atattcaataaag

SEQ ID NO: 2697377 - DNA, 20 bp, Homo sapiens
atattcaataaagctgctga

SEQ ID NO: 2697378 - DNA, 14 bp, Homo sapiens
atcacctcaggcca

SEQ ID NO: 2697379 - DNA, 14 bp, Homo sapiens
atcactggagccca

SEQ ID NO: 2697380 - DNA, 17 bp, Homo sapiens
atcactggagcccagga

SEQ ID NO: 2697381 - DNA, 15 bp, Homo sapiens
atcatgtaacattct

SEQ ID NO: 2697382 - DNA, 15 bp, Homo sapiens
atccaactattaaga

SEQ ID NO: 2697383 - DNA, 11 bp, Homo sapiens
atccatcctgc

SEQ ID NO: 2697384 - DNA, 13 bp, Homo sapiens
atccttctgcctt

SEQ ID NO: 2697385 - DNA, 13 bp, Homo sapiens
atctgaaggagat

SEQ ID NO: 2697386 - DNA, 14 bp, Homo sapiens
atctttaataagta

SEQ ID NO: 2697387 - DNA, 16 bp, Homo sapiens
atctttgttttaacca

SEQ ID NO: 2697388 - DNA, 18 bp, Homo sapiens
atctttgttttaaccagt

SEQ ID NO: 2697389 - DNA, 15 bp, Homo sapiens
ccatgtggccccagg

SEQ ID NO: 2697390 - DNA, 21 bp, Homo sapiens
ccatgtggccccaggtgccac

SEQ ID NO: 2697391 - DNA, 18 bp, Homo sapiens
cccaagtgccagtcttgt

SEQ ID NO: 2697392 - DNA, 14 bp, Homo sapiens
cccaataaagctgg

SEQ ID NO: 2697393 - DNA, 15 bp, Homo sapiens
cccaataaagctgga

SEQ ID NO: 2697394 - DNA, 20 bp, Homo sapiens
cccaccctcgtggacacctg

SEQ ID NO: 2697395 - DNA, 21 bp, Homo sapiens
cccaccttcaattcctgggcc

SEQ ID NO: 2697396 - DNA, 22 bp, Homo sapiens
cccaccttcaattcctgggccc

SEQ ID NO: 2697397 - DNA, 13 bp, Homo sapiens
cccagagggccca

SEQ ID NO: 2697398 - DNA, 15 bp, Homo sapiens
cccagagggcccagg

SEQ ID NO: 2697399 - DNA, 23 bp, Homo sapiens
cccagagggcccaggcaggccac

SEQ ID NO: 2697400 - DNA, 21 bp, Homo sapiens
cccagcgcctgtgctgaggac

SEQ ID NO: 2697401 - DNA, 22 bp, Homo sapiens
cccagctactcagaagcctgag

SEQ ID NO: 2697402 - DNA, 23 bp, Homo sapiens
cccagctactcagaagcctgagg

SEQ ID NO: 2697403 - DNA, 13 bp, Homo sapiens
cccaggaggggcc

SEQ ID NO: 2697404 - DNA, 14 bp, Homo sapiens
cccaggaggggcct

SEQ ID NO: 2697405 - DNA, 18 bp, Homo sapiens
cccaggaggggcctctga

SEQ ID NO: 2697406 - DNA, 23 bp, Homo sapiens
cccaggagtttgaggctgcagcg

SEQ ID NO: 2697407 - DNA, 20 bp, Homo sapiens
cccagggccagggccctgca

SEQ ID NO: 2697408 - DNA, 22 bp, Homo sapiens
cccagggccagggccctgcaga

SEQ ID NO: 2697409 - DNA, 20 bp, Homo sapiens
cccagtgtaaagaataaatg

SEQ ID NO: 2697410 - DNA, 22 bp, Homo sapiens
ccccaccctcgtggacacctgc

SEQ ID NO: 2697411 - DNA, 14 bp, Homo sapiens
ccccactccccacc

SEQ ID NO: 2697412 - DNA, 17 bp, Homo sapiens
ccccagctctggcttcc

SEQ ID NO: 2697413 - DNA, 17 bp, Homo sapiens
ccccaggtgccaccaat

SEQ ID NO: 2697414 - DNA, 17 bp, Homo sapiens
ccccattagagtcagcc

SEQ ID NO: 2697415 - DNA, 10 bp, Homo sapiens
ccccctgggc

SEQ ID NO: 2697416 - DNA, 11 bp, Homo sapiens
ccccctgggct

SEQ ID NO: 2697417 - DNA, 13 bp, Homo sapiens
ccccctgggctct

SEQ ID NO: 2697418 - DNA, 23 bp, Homo sapiens
ccccgcccagctgcacctgccag

SEQ ID NO: 2697419 - DNA, 20 bp, Homo sapiens
cccctggtggacagtcctgg

SEQ ID NO: 2697420 - DNA, 21 bp, Homo sapiens
cccctggtggacagtcctggg

SEQ ID NO: 2697421 - DNA, 23 bp, Homo sapiens
cccctggtggacagtcctgggag

SEQ ID NO: 2697422 - DNA, 15 bp, Homo sapiens
cccgcgcctccttcc

SEQ ID NO: 2697423 - DNA, 16 bp, Homo sapiens
ccctccacagccgcag

SEQ ID NO: 2697424 - DNA, 22 bp, Homo sapiens
ccctccaggcatgctggcctcc

SEQ ID NO: 2697425 - DNA, 22 bp, Homo sapiens
ccctcccagggccagggccctg

SEQ ID NO: 2697426 - DNA, 17 bp, Homo sapiens
ccctcgtggacacctgc

SEQ ID NO: 2697427 - DNA, 18 bp, Homo sapiens
ccctcgtggacacctgcc

SEQ ID NO: 2697428 - DNA, 22 bp, Homo sapiens
ccctcgtggacacctgccctgc

SEQ ID NO: 2697429 - DNA, 13 bp, Homo sapiens
ccctgccacctgt

SEQ ID NO: 2697430 - DNA, 17 bp, Homo sapiens
ccctgcgaaggggccct

SEQ ID NO: 2697431 - DNA, 22 bp, Homo sapiens
ccctggcaggatgaccctgcga

SEQ ID NO: 2697432 - DNA, 13 bp, Homo sapiens
ccctgggctctgc

SEQ ID NO: 2697433 - DNA, 20 bp, Homo sapiens
ccctggtggacagtcctggg

SEQ ID NO: 2697434 - DNA, 23 bp, Homo sapiens
ccctggtggacagtcctgggaga

SEQ ID NO: 2697435 - DNA, 12 bp, Homo sapiens
cccttgtgtgtg

SEQ ID NO: 2697436 - DNA, 18 bp, Homo sapiens
ccgagacggctggacctg

SEQ ID NO: 2697437 - DNA, 21 bp, Homo sapiens
ccgagatcacgccactgcact

SEQ ID NO: 2697438 - DNA, 22 bp, Homo sapiens
ccgcagggacggggactggccc

SEQ ID NO: 2697439 - DNA, 22 bp, Homo sapiens
ccgcccagctgcacctgccagc

SEQ ID NO: 2697440 - DNA, 17 bp, Homo sapiens
ccgctgccttttgctgc

SEQ ID NO: 2697441 - DNA, 21 bp, Homo sapiens
ccgctgccttttgctgctgct

SEQ ID NO: 2697442 - DNA, 15 bp, Homo sapiens
ccggtgtgcctgcag

SEQ ID NO: 2697443 - DNA, 17 bp, Homo sapiens
cctacacccttggactt

SEQ ID NO: 2697444 - DNA, 13 bp, Homo sapiens
cctaccccacctc

SEQ ID NO: 2697445 - DNA, 16 bp, Homo sapiens
cctacctcagcctaga

SEQ ID NO: 2697446 - DNA, 18 bp, Homo sapiens
cctacctcagcctagacc

SEQ ID NO: 2697447 - DNA, 16 bp, Homo sapiens
cctagaccctcctcct

SEQ ID NO: 2697448 - DNA, 18 bp, Homo sapiens
cctatagtcccagctact

SEQ ID NO: 2697449 - DNA, 15 bp, Homo sapiens
cctatgatcccagca

SEQ ID NO: 2697450 - DNA, 17 bp, Homo sapiens
cctcactattcaagtat

SEQ ID NO: 2697451 - DNA, 21 bp, Homo sapiens
cctcaggccaggtgcagtggc

SEQ ID NO: 2697452 - DNA, 17 bp, Homo sapiens
cctcatgcctggccccc

SEQ ID NO: 2697453 - DNA, 22 bp, Homo sapiens
cctcatgcctggcccccctcca

SEQ ID NO: 2697454 - DNA, 23 bp, Homo sapiens
cctcatgcctggcccccctccag

SEQ ID NO: 2697455 - DNA, 15 bp, Homo sapiens
cctccacagccgcag

SEQ ID NO: 2697456 - DNA, 16 bp, Homo sapiens
cctccacagccgcagc

SEQ ID NO: 2697457 - DNA, 18 bp, Homo sapiens
cctccaggcatgctggcc

SEQ ID NO: 2697458 - DNA, 19 bp, Homo sapiens
cctccaggcatgctggcct

SEQ ID NO: 2697459 - DNA, 16 bp, Homo sapiens
cctcccaataaagctg

SEQ ID NO: 2697460 - DNA, 17 bp, Homo sapiens
cctcccaataaagctgg

SEQ ID NO: 2697461 - DNA, 14 bp, Homo sapiens
cctcccagggccag

SEQ ID NO: 2697462 - DNA, 21 bp, Homo sapiens
cctccccattagagtcagcct

SEQ ID NO: 2697463 - DNA, 19 bp, Homo sapiens
cctccctctgacctgcagg

SEQ ID NO: 2697464 - DNA, 20 bp, Homo sapiens
cctcgtggacacctgccctg

SEQ ID NO: 2697465 - DNA, 18 bp, Homo sapiens
cctctcaatattcaataa

SEQ ID NO: 2697466 - DNA, 20 bp, Homo sapiens
cctctgacctgcaggccaag

SEQ ID NO: 2697467 - DNA, 22 bp, Homo sapiens
cctgaagggtgacatcccagga

SEQ ID NO: 2697468 - DNA, 17 bp, Homo sapiens
cctgactctctgtgacc

SEQ ID NO: 2697469 - DNA, 23 bp, Homo sapiens
cctgagcaacagagtgagaccct

SEQ ID NO: 2697470 - DNA, 15 bp, Homo sapiens
cctgcaatctccagg

SEQ ID NO: 2697471 - DNA, 17 bp, Homo sapiens
cctgcaatctccagggc

SEQ ID NO: 2697472 - DNA, 21 bp, Homo sapiens
cctgcaatctccagggctgcc

SEQ ID NO: 2697473 - DNA, 22 bp, Homo sapiens
cctgcagccccgcgcctccttc

SEQ ID NO: 2697474 - DNA, 12 bp, Homo sapiens
cctgccacctgt

SEQ ID NO: 2697475 - DNA, 16 bp, Homo sapiens
cctgccacctgtctgt

SEQ ID NO: 2697476 - DNA, 23 bp, Homo sapiens
cctgccactttggtacatggcca

SEQ ID NO: 2697477 - DNA, 15 bp, Homo sapiens
cctgccagcctggct

SEQ ID NO: 2697478 - DNA, 16 bp, Homo sapiens
cctgccagcctggctt

SEQ ID NO: 2697479 - DNA, 21 bp, Homo sapiens
cctgccagcctggcttctgga

SEQ ID NO: 2697480 - DNA, 12 bp, Homo sapiens
cctgccccctgg

SEQ ID NO: 2697481 - DNA, 13 bp, Homo sapiens
cctgccccctggt

SEQ ID NO: 2697482 - DNA, 14 bp, Homo sapiens
cctgccccctggtg

SEQ ID NO: 2697483 - DNA, 16 bp, Homo sapiens
cctgccccgcccagct

SEQ ID NO: 2697484 - DNA, 22 bp, Homo sapiens
cctgccccgcccagctgcacct

SEQ ID NO: 2697485 - DNA, 17 bp, Homo sapiens
cctgccctgccacctgt

SEQ ID NO: 2697486 - DNA, 17 bp, Homo sapiens
cctgccttgaagccact

SEQ ID NO: 2697487 - DNA, 21 bp, Homo sapiens
cctgccttgaagccactgaag

SEQ ID NO: 2697488 - DNA, 22 bp, Homo sapiens
cctgccttgaagccactgaagc

SEQ ID NO: 2697489 - DNA, 23 bp, Homo sapiens
cctgccttgaagccactgaagct

SEQ ID NO: 2697490 - DNA, 22 bp, Homo sapiens
cctggaaaggctcagtctcagg

SEQ ID NO: 2697491 - DNA, 22 bp, Homo sapiens
cctggcaggatgaccctgcgaa

SEQ ID NO: 2697492 - DNA, 13 bp, Homo sapiens
cctggcttctgga

SEQ ID NO: 2697493 - DNA, 22 bp, Homo sapiens
cctggcttctggagcccttggg

SEQ ID NO: 2697494 - DNA, 18 bp, Homo sapiens
cctgggagaacctcaggc

SEQ ID NO: 2697495 - DNA, 12 bp, Homo sapiens
cctgggctctgc

SEQ ID NO: 2697496 - DNA, 20 bp, Homo sapiens
cctgggctctgccccagctc

SEQ ID NO: 2697497 - DNA, 18 bp, Homo sapiens
cctggggctctgtgcagg

SEQ ID NO: 2697498 - DNA, 19 bp, Homo sapiens
cctggtccttccaggcccc

SEQ ID NO: 2697499 - DNA, 19 bp, Homo sapiens
cctggtgcactggccccac

SEQ ID NO: 2697500 - DNA, 18 bp, Homo sapiens
cctggtggacagtcctgg

SEQ ID NO: 2697501 - DNA, 14 bp, Homo sapiens
cctgtactcaggag

SEQ ID NO: 2697502 - DNA, 22 bp, Homo sapiens
cctgtactcaggaggctgaggg

SEQ ID NO: 2697503 - DNA, 23 bp, Homo sapiens
cctgtactcaggaggctgagggg

SEQ ID NO: 2697504 - DNA, 22 bp, Homo sapiens
cctgtctgtctgtctgtcccaa

SEQ ID NO: 2697505 - DNA, 14 bp, Homo sapiens
cctgtgctgaggac

SEQ ID NO: 2697506 - DNA, 15 bp, Homo sapiens
cctgtgctgaggact

SEQ ID NO: 2697507 - DNA, 19 bp, Homo sapiens
cctgtgctgaggactccct

SEQ ID NO: 2697508 - DNA, 13 bp, Homo sapiens
gcctgaggctggg

SEQ ID NO: 2697509 - DNA, 16 bp, Homo sapiens
gcctgccttgaagcca

SEQ ID NO: 2697510 - DNA, 19 bp, Homo sapiens
gcctggcccccctccaggc

SEQ ID NO: 2697511 - DNA, 15 bp, Homo sapiens
gcctggcttctggag

SEQ ID NO: 2697512 - DNA, 18 bp, Homo sapiens
gcctggcttctggagccc

SEQ ID NO: 2697513 - DNA, 19 bp, Homo sapiens
gcctgtgctgaggactccc

SEQ ID NO: 2697514 - DNA, 18 bp, Homo sapiens
gccttggttcccttgtgt

SEQ ID NO: 2697515 - DNA, 16 bp, Homo sapiens
gccttttgctgctgct

SEQ ID NO: 2697516 - DNA, 14 bp, Homo sapiens
gcgaaggggccctg

SEQ ID NO: 2697517 - DNA, 19 bp, Homo sapiens
gcgacagagcgagagtctg

SEQ ID NO: 2697518 - DNA, 16 bp, Homo sapiens
gcggaggttgcaggga

SEQ ID NO: 2697519 - DNA, 17 bp, Homo sapiens
gcgggatggtcctgggg

SEQ ID NO: 2697520 - DNA, 15 bp, Homo sapiens
gcgggctgtgcctta

SEQ ID NO: 2697521 - DNA, 19 bp, Homo sapiens
gcgggtggatcacctgagg

SEQ ID NO: 2697522 - DNA, 16 bp, Homo sapiens
gctactcagaagcctg

SEQ ID NO: 2697523 - DNA, 19 bp, Homo sapiens
gctactcagaagcctgagg

SEQ ID NO: 2697524 - DNA, 14 bp, Homo sapiens
gctatattttcatg

SEQ ID NO: 2697525 - DNA, 13 bp, Homo sapiens
gctcaaaaagttt

SEQ ID NO: 2697526 - DNA, 21 bp, Homo sapiens
gctcacgcctatgatcccagc

SEQ ID NO: 2697527 - DNA, 22 bp, Homo sapiens
gctcacgcctatgatcccagca

SEQ ID NO: 2697528 - DNA, 17 bp, Homo sapiens
gctcagtctcaggagca

SEQ ID NO: 2697529 - DNA, 20 bp, Homo sapiens
gctcagtctcaggagcatgg

SEQ ID NO: 2697530 - DNA, 22 bp, Homo sapiens
gctcctggaaaggctcagtctc

SEQ ID NO: 2697531 - DNA, 17 bp, Homo sapiens
gctctcctaccccacct

SEQ ID NO: 2697532 - DNA, 18 bp, Homo sapiens
gctctgccccagctctgg

SEQ ID NO: 2697533 - DNA, 20 bp, Homo sapiens
gctctgccccagctctggct

SEQ ID NO: 2697534 - DNA, 14 bp, Homo sapiens
gctctttctgggcc

SEQ ID NO: 2697535 - DNA, 14 bp, Homo sapiens
gctgaattgaacat

SEQ ID NO: 2697536 - DNA, 14 bp, Homo sapiens
gctgagactgcggg

SEQ ID NO: 2697537 - DNA, 13 bp, Homo sapiens
gctgagccctggc

SEQ ID NO: 2697538 - DNA, 16 bp, Homo sapiens
gctgagccctggcagg

SEQ ID NO: 2697539 - DNA, 20 bp, Homo sapiens
gctgcagtgacgtgcacctg

SEQ ID NO: 2697540 - DNA, 20 bp, Homo sapiens
gctgcccctggtgcactggc

SEQ ID NO: 2697541 - DNA, 13 bp, Homo sapiens
gctgcccctgtag

SEQ ID NO: 2697542 - DNA, 19 bp, Homo sapiens
gctgcccctgtaggttgct

SEQ ID NO: 2697543 - DNA, 16 bp, Homo sapiens
gctggacaagaagctg

SEQ ID NO: 2697544 - DNA, 20 bp, Homo sapiens
gctggcctcccaataaagct

SEQ ID NO: 2697545 - DNA, 21 bp, Homo sapiens
gctggcctcccaataaagctg

SEQ ID NO: 2697546 - DNA, 16 bp, Homo sapiens
gctggctgggcatgga

SEQ ID NO: 2697547 - DNA, 16 bp, Homo sapiens
gctgggactggccagg

SEQ ID NO: 2697548 - DNA, 23 bp, Homo sapiens
gctggtaatttgtatctgaagga

SEQ ID NO: 2697549 - DNA, 14 bp, Homo sapiens
gctgtcctaggcca

SEQ ID NO: 2697550 - DNA, 17 bp, Homo sapiens
gcttatcaataaacctg

SEQ ID NO: 2697551 - DNA, 20 bp, Homo sapiens
gcttcagcctgaggctgaga

SEQ ID NO: 2697552 - DNA, 21 bp, Homo sapiens
gcttcagcctgaggctgagac

SEQ ID NO: 2697553 - DNA, 22 bp, Homo sapiens
gcttccttggcatcacagggca

SEQ ID NO: 2697554 - DNA, 23 bp, Homo sapiens
gctttagtcctagaggacctgag

SEQ ID NO: 2697555 - DNA, 13 bp, Homo sapiens
ggaaagcctctgc

SEQ ID NO: 2697556 - DNA, 19 bp, Homo sapiens
ggaaaggctcagtctcagg

SEQ ID NO: 2697557 - DNA, 22 bp, Homo sapiens
ggaatcaagatgtcagactggc

SEQ ID NO: 2697558 - DNA, 12 bp, Homo sapiens
ggacacatgtcc

SEQ ID NO: 2697559 - DNA, 13 bp, Homo sapiens
ggacacctgccct

SEQ ID NO: 2697560 - DNA, 17 bp, Homo sapiens
ggacacctgccctgccc

SEQ ID NO: 2697561 - DNA, 20 bp, Homo sapiens
ggacagtattctcagtgctc

SEQ ID NO: 2697562 - DNA, 13 bp, Homo sapiens
ggacagtcctggg

SEQ ID NO: 2697563 - DNA, 19 bp, Homo sapiens
ggacagtcctgggagaacc

SEQ ID NO: 2697564 - DNA, 14 bp, Homo sapiens
ggacagtgcttcag

SEQ ID NO: 2697565 - DNA, 18 bp, Homo sapiens
ggacagtgcttcagcctg

SEQ ID NO: 2697566 - DNA, 21 bp, Homo sapiens
ggacctgaagggtgacatccc

SEQ ID NO: 2697567 - DNA, 21 bp, Homo sapiens
ggacctgcacgccaccgctgc

SEQ ID NO: 2697568 - DNA, 17 bp, Homo sapiens
ggacctttcagctgtga

SEQ ID NO: 2697569 - DNA, 16 bp, Homo sapiens
ggacgcgcacacacac

SEQ ID NO: 2697570 - DNA, 13 bp, Homo sapiens
ggacgcgggctgt

SEQ ID NO: 2697571 - DNA, 19 bp, Homo sapiens
ggacgcgggctgtgcctta

SEQ ID NO: 2697572 - DNA, 13 bp, Homo sapiens
ggactctgaggct

SEQ ID NO: 2697573 - DNA, 15 bp, Homo sapiens
ggagaacctcaggct

SEQ ID NO: 2697574 - DNA, 20 bp, Homo sapiens
ggagactctgtggggccttg

SEQ ID NO: 2697575 - DNA, 20 bp, Homo sapiens
ggagagatcatagctcactg

SEQ ID NO: 2697576 - DNA, 16 bp, Homo sapiens
ggagattttccttcct

SEQ ID NO: 2697577 - DNA, 22 bp, Homo sapiens
ggagcagcacgattttgcacaa

SEQ ID NO: 2697578 - DNA, 13 bp, Homo sapiens
ggagcccttgggt

SEQ ID NO: 2697579 - DNA, 19 bp, Homo sapiens
ggaggaagcaggttgaggg

SEQ ID NO: 2697580 - DNA, 20 bp, Homo sapiens
ggaggaggtggcagccctgt

SEQ ID NO: 2697581 - DNA, 17 bp, Homo sapiens
ggaggtgagaccacctc

SEQ ID NO: 2697582 - DNA, 17 bp, Homo sapiens
ggaggtggcagccctgt

SEQ ID NO: 2697583 - DNA, 12 bp, Homo sapiens
ggaggttgcagg

SEQ ID NO: 2697584 - DNA, 17 bp, Homo sapiens
ggaggttgcagggagcc

SEQ ID NO: 2697585 - DNA, 18 bp, Homo sapiens
ggagttcgagaccagcct

SEQ ID NO: 2697586 - DNA, 18 bp, Homo sapiens
ggatcactggagcccagg

SEQ ID NO: 2697587 - DNA, 20 bp, Homo sapiens
ggatggtcctggggctctgt

SEQ ID NO: 2697588 - DNA, 19 bp, Homo sapiens
ggattctgggaggaagcag

SEQ ID NO: 2697589 - DNA, 15 bp, Homo sapiens
ggcaagggggcgggg

SEQ ID NO: 2697590 - DNA, 13 bp, Homo sapiens
ggcagccctgtag

SEQ ID NO: 2697591 - DNA, 15 bp, Homo sapiens
ggcagccctgtaggg

SEQ ID NO: 2697592 - DNA, 15 bp, Homo sapiens
ggcaggatgaccctg

SEQ ID NO: 2697593 - DNA, 17 bp, Homo sapiens
ggcatcacagggcagag

SEQ ID NO: 2697594 - DNA, 22 bp, Homo sapiens
ggcatcacagggcagagccggg

SEQ ID NO: 2697595 - DNA, 13 bp, Homo sapiens
ggccagggccctg

SEQ ID NO: 2697596 - DNA, 17 bp, Homo sapiens
ggccagggccctgcaga

SEQ ID NO: 2697597 - DNA, 15 bp, Homo sapiens
ggcccaggcaggcca

SEQ ID NO: 2697598 - DNA, 20 bp, Homo sapiens
ggccccaggtgccaccaata

SEQ ID NO: 2697599 - DNA, 22 bp, Homo sapiens
ggccccaggtgccaccaataaa

SEQ ID NO: 2697600 - DNA, 23 bp, Homo sapiens
ggcccccctccaggcatgctggc

SEQ ID NO: 2697601 - DNA, 17 bp, Homo sapiens
ggccctggtccttccag

SEQ ID NO: 2697602 - DNA, 21 bp, Homo sapiens
ggcctcccaataaagctggac

SEQ ID NO: 2697603 - DNA, 22 bp, Homo sapiens
ggcgggcacctatagtcccagc

SEQ ID NO: 2697604 - DNA, 20 bp, Homo sapiens
ggcgggggcccgaaagctga

SEQ ID NO: 2697605 - DNA, 20 bp, Homo sapiens
ggctcacgcctatgatccca

SEQ ID NO: 2697606 - DNA, 15 bp, Homo sapiens
ggctcagtctcagga

SEQ ID NO: 2697607 - DNA, 15 bp, Homo sapiens
ggctctgtgcaggga

SEQ ID NO: 2697608 - DNA, 21 bp, Homo sapiens
ggctgagactgcgggatggtc

SEQ ID NO: 2697609 - DNA, 15 bp, Homo sapiens
ggctggctgcagtga

SEQ ID NO: 2697610 - DNA, 13 bp, Homo sapiens
ggctggctgggca

SEQ ID NO: 2697611 - DNA, 16 bp, Homo sapiens
ggcttctggagccctt

SEQ ID NO: 2697612 - DNA, 20 bp, Homo sapiens
gggaggaggtggcagccctg

SEQ ID NO: 2697613 - DNA, 22 bp, Homo sapiens
gggaggatcactggagcccagg

SEQ ID NO: 2697614 - DNA, 13 bp, Homo sapiens
gggagggggacgc

SEQ ID NO: 2697615 - DNA, 18 bp, Homo sapiens
gggaggtgagaccacctc

SEQ ID NO: 2697616 - DNA, 15 bp, Homo sapiens
gggatggtcctgggg

SEQ ID NO: 2697617 - DNA, 24 bp, Homo sapiens
gggcaagtccctgactctctgtga

SEQ ID NO: 2697618 - DNA, 17 bp, Homo sapiens
gggcagagccgggaagc

SEQ ID NO: 2697619 - DNA, 22 bp, Homo sapiens
gggcatggacgttcggggcatg

SEQ ID NO: 2697620 - DNA, 13 bp, Homo sapiens
gggcccaggcagg

SEQ ID NO: 2697621 - DNA, 22 bp, Homo sapiens
gggccccaaacgggctgccctg

SEQ ID NO: 2697622 - DNA, 19 bp, Homo sapiens
gggccctggtccttccagg

SEQ ID NO: 2697623 - DNA, 11 bp, Homo sapiens
gggctctgccc

SEQ ID NO: 2697624 - DNA, 19 bp, Homo sapiens
gggctctgccccagctctg

SEQ ID NO: 2697625 - DNA, 13 bp, Homo sapiens
gggctgagccctg

SEQ ID NO: 2697626 - DNA, 17 bp, Homo sapiens
gggctgagccctggcag

SEQ ID NO: 2697627 - DNA, 14 bp, Homo sapiens
gggctttctggaga

SEQ ID NO: 2697628 - DNA, 19 bp, Homo sapiens
tgaaaagctaccctgaaac

SEQ ID NO: 2697629 - DNA, 23 bp, Homo sapiens
tgaaatttcccacaccccagcgc

SEQ ID NO: 2697630 - DNA, 17 bp, Homo sapiens
tgaacttgaggacacat

SEQ ID NO: 2697631 - DNA, 22 bp, Homo sapiens
tgaacttgaggacacatgtcca

SEQ ID NO: 2697632 - DNA, 14 bp, Homo sapiens
tgaagacaggacag

SEQ ID NO: 2697633 - DNA, 16 bp, Homo sapiens
tgaagccactgaagct

SEQ ID NO: 2697634 - DNA, 23 bp, Homo sapiens
tgaagtttcctatgactaattca

SEQ ID NO: 2697635 - DNA, 15 bp, Homo sapiens
tgaatcttactcctt

SEQ ID NO: 2697636 - DNA, 21 bp, Homo sapiens
tgaatggcctgccttgaagcc

SEQ ID NO: 2697637 - DNA, 14 bp, Homo sapiens
tgaatttggagact

SEQ ID NO: 2697638 - DNA, 13 bp, Homo sapiens
tgacatcccagga

SEQ ID NO: 2697639 - DNA, 18 bp, Homo sapiens
tgacattttaaaaaacaa

SEQ ID NO: 2697640 - DNA, 21 bp, Homo sapiens
tgaccctgcgaaggggccctg

SEQ ID NO: 2697641 - DNA, 22 bp, Homo sapiens
tgaccctgcgaaggggccctgg

SEQ ID NO: 2697642 - DNA, 20 bp, Homo sapiens
tgacctgcaggccaagagca

SEQ ID NO: 2697643 - DNA, 19 bp, Homo sapiens
tgacgtgcacctgtactca

SEQ ID NO: 2697644 - DNA, 23 bp, Homo sapiens
tgagaccctcgccacggggaggg

SEQ ID NO: 2697645 - DNA, 14 bp, Homo sapiens
tgagaccctgtctc

SEQ ID NO: 2697646 - DNA, 22 bp, Homo sapiens
tgagactgcgggatggtcctgg

SEQ ID NO: 2697647 - DNA, 15 bp, Homo sapiens
tgaggacacatgtcc

SEQ ID NO: 2697648 - DNA, 17 bp, Homo sapiens
tgaggctctttctgggc

SEQ ID NO: 2697649 - DNA, 13 bp, Homo sapiens
tgaggctgagact

SEQ ID NO: 2697650 - DNA, 13 bp, Homo sapiens
tgaggctgcagcg

SEQ ID NO: 2697651 - DNA, 15 bp, Homo sapiens
tgaggggctcctgga

SEQ ID NO: 2697652 - DNA, 12 bp, Homo sapiens
tgaggttaggag

SEQ ID NO: 2697653 - DNA, 21 bp, Homo sapiens
tgagtctttaacatcttgaac

SEQ ID NO: 2697654 - DNA, 14 bp, Homo sapiens
tgagtgattatttg

SEQ ID NO: 2697655 - DNA, 20 bp, Homo sapiens
tgagtgattatttgttattt

SEQ ID NO: 2697656 - DNA, 19 bp, Homo sapiens
tgatcccaagtgccagtct

SEQ ID NO: 2697657 - DNA, 12 bp, Homo sapiens
tgatcccagcac

SEQ ID NO: 2697658 - DNA, 16 bp, Homo sapiens
tgcaccctccgccttc

SEQ ID NO: 2697659 - DNA, 17 bp, Homo sapiens
tgcacctgccagcctgg

SEQ ID NO: 2697660 - DNA, 18 bp, Homo sapiens
tgcacctgccagcctggc

SEQ ID NO: 2697661 - DNA, 20 bp, Homo sapiens
tgcacctgccagcctggctt

SEQ ID NO: 2697662 - DNA, 16 bp, Homo sapiens
tgcacctgtactcagg

SEQ ID NO: 2697663 - DNA, 14 bp, Homo sapiens
tgcactccagcctg

SEQ ID NO: 2697664 - DNA, 15 bp, Homo sapiens
tgcactccagcctgg

SEQ ID NO: 2697665 - DNA, 15 bp, Homo sapiens
tgcactggccccacc

SEQ ID NO: 2697666 - DNA, 16 bp, Homo sapiens
tgcactggccccaccc

SEQ ID NO: 2697667 - DNA, 13 bp, Homo sapiens
tgcagaggggaaa

SEQ ID NO: 2697668 - DNA, 20 bp, Homo sapiens
tgcagaggggctttctggag

SEQ ID NO: 2697669 - DNA, 18 bp, Homo sapiens
tgcagtgacgtgcacctg

SEQ ID NO: 2697670 - DNA, 17 bp, Homo sapiens
tgcagtggctcacgcct

SEQ ID NO: 2697671 - DNA, 19 bp, Homo sapiens
tgcatttgttccattaaaa

SEQ ID NO: 2697672 - DNA, 16 bp, Homo sapiens
tgccaaagcaaaagaa

SEQ ID NO: 2697673 - DNA, 17 bp, Homo sapiens
tgccaaagcaaaagaag

SEQ ID NO: 2697674 - DNA, 11 bp, Homo sapiens
tgccaccaata

SEQ ID NO: 2697675 - DNA, 16 bp, Homo sapiens
tgccaccaataaaaat

SEQ ID NO: 2697676 - DNA, 17 bp, Homo sapiens
tgccaccaataaaaatc

SEQ ID NO: 2697677 - DNA, 19 bp, Homo sapiens
tgccaccaataaaaatcct

SEQ ID NO: 2697678 - DNA, 21 bp, Homo sapiens
tgccaccaataaaaatcctac

SEQ ID NO: 2697679 - DNA, 11 bp, Homo sapiens
tgccagccaca

SEQ ID NO: 2697680 - DNA, 16 bp, Homo sapiens
tgccagcctggcttct

SEQ ID NO: 2697681 - DNA, 21 bp, Homo sapiens
tgccagcctggcttctggagc

SEQ ID NO: 2697682 - DNA, 17 bp, Homo sapiens
tgccatttgcaccctcc

SEQ ID NO: 2697683 - DNA, 21 bp, Homo sapiens
tgccatttgcaccctccgcct

SEQ ID NO: 2697684 - DNA, 22 bp, Homo sapiens
tgccatttgcaccctccgcctt

SEQ ID NO: 2697685 - DNA, 18 bp, Homo sapiens
tgcccagagggcccaggc

SEQ ID NO: 2697686 - DNA, 21 bp, Homo sapiens
tgcccagagggcccaggcagg

SEQ ID NO: 2697687 - DNA, 13 bp, Homo sapiens
tgccccgcccagc

SEQ ID NO: 2697688 - DNA, 21 bp, Homo sapiens
tgcccctgtaggttgcttaaa

SEQ ID NO: 2697689 - DNA, 16 bp, Homo sapiens
tgcccggattctggga

SEQ ID NO: 2697690 - DNA, 22 bp, Homo sapiens
tgcccggattctgggaggaagc

SEQ ID NO: 2697691 - DNA, 14 bp, Homo sapiens
tgcctatccatcct

SEQ ID NO: 2697692 - DNA, 15 bp, Homo sapiens
tgcctatccatcctg

SEQ ID NO: 2697693 - DNA, 22 bp, Homo sapiens
tgcctgcagccccgcgcctcct

SEQ ID NO: 2697694 - DNA, 21 bp, Homo sapiens
tgcctggcccccctccaggca

SEQ ID NO: 2697695 - DNA, 23 bp, Homo sapiens
tgccttttgctgctgctgctgcg

SEQ ID NO: 2697696 - DNA, 21 bp, Homo sapiens
tgcgaaggggccctggtcctt

SEQ ID NO: 2697697 - DNA, 22 bp, Homo sapiens
tgctatattttcatgacttttc

SEQ ID NO: 2697698 - DNA, 15 bp, Homo sapiens
tgctgctgctgctgc

SEQ ID NO: 2697699 - DNA, 20 bp, Homo sapiens
tgctggacggcattcctgct

SEQ ID NO: 2697700 - DNA, 22 bp, Homo sapiens
tgctggcctcccaataaagctg

SEQ ID NO: 2697701 - DNA, 15 bp, Homo sapiens
tgctgggactggcca

SEQ ID NO: 2697702 - DNA, 14 bp, Homo sapiens
tgctgtggcctggg

SEQ ID NO: 2697703 - DNA, 16 bp, Homo sapiens
tgctgtggcctgggca

SEQ ID NO: 2697704 - DNA, 15 bp, Homo sapiens
tgcttcagcctgagg

SEQ ID NO: 2697705 - DNA, 19 bp, Homo sapiens
tggaaagcatcacctcagg

SEQ ID NO: 2697706 - DNA, 21 bp, Homo sapiens
tggaaagcatcacctcaggcc

SEQ ID NO: 2697707 - DNA, 16 bp, Homo sapiens
tggaatttgtaagttt

SEQ ID NO: 2697708 - DNA, 17 bp, Homo sapiens
tggacaagaagctgcta

SEQ ID NO: 2697709 - DNA, 16 bp, Homo sapiens
tggacacctgccctgc

SEQ ID NO: 2697710 - DNA, 14 bp, Homo sapiens
tggacagtcctggg

SEQ ID NO: 2697711 - DNA, 14 bp, Homo sapiens
tggacagtctgagc

SEQ ID NO: 2697712 - DNA, 17 bp, Homo sapiens
tggagacttggaagagt

SEQ ID NO: 2697713 - DNA, 16 bp, Homo sapiens
tggagcgcacctgccc

SEQ ID NO: 2697714 - DNA, 20 bp, Homo sapiens
tggagggtgggagagcccag

SEQ ID NO: 2697715 - DNA, 14 bp, Homo sapiens
tggcagccctgtag

SEQ ID NO: 2697716 - DNA, 22 bp, Homo sapiens
tggcaggatgaccctgcgaagg

SEQ ID NO: 2697717 - DNA, 18 bp, Homo sapiens
tggcatcacagggcagag

SEQ ID NO: 2697718 - DNA, 20 bp, Homo sapiens
tggcatcacagggcagagcc

SEQ ID NO: 2697719 - DNA, 22 bp, Homo sapiens
tggccccaccctcgtggacacc

SEQ ID NO: 2697720 - DNA, 16 bp, Homo sapiens
tggccccaggtgccac

SEQ ID NO: 2697721 - DNA, 13 bp, Homo sapiens
tggctggctgcag

SEQ ID NO: 2697722 - DNA, 12 bp, Homo sapiens
tggctgggcatg

SEQ ID NO: 2697723 - DNA, 23 bp, Homo sapiens
tggcttccagaaaaccccagcat

SEQ ID NO: 2697724 - DNA, 14 bp, Homo sapiens
tggcttctggagcc

SEQ ID NO: 2697725 - DNA, 23 bp, Homo sapiens
tgggactggccaggtttctgccc

SEQ ID NO: 2697726 - DNA, 22 bp, Homo sapiens
tgggagaacctcaggcttcctt

SEQ ID NO: 2697727 - DNA, 14 bp, Homo sapiens
tgggagagcccagc

SEQ ID NO: 2697728 - DNA, 18 bp, Homo sapiens
tgggagagcccagccatt

SEQ ID NO: 2697729 - DNA, 24 bp, Homo sapiens
tgggaggaagcaggttgaggggct

SEQ ID NO: 2697730 - DNA, 14 bp, Homo sapiens
tgggaggctgaggc

SEQ ID NO: 2697731 - DNA, 12 bp, Homo sapiens
tgggctctgccc

SEQ ID NO: 2697732 - DNA, 19 bp, Homo sapiens
tgggctctgccccagctct

SEQ ID NO: 2697733 - DNA, 18 bp, Homo sapiens
tgggctgagccctggcag

SEQ ID NO: 2697734 - DNA, 17 bp, Homo sapiens
tggggataaaggagaag

SEQ ID NO: 2697735 - DNA, 22 bp, Homo sapiens
tgggtcctgcaatctccagggc

SEQ ID NO: 2697736 - DNA, 18 bp, Homo sapiens
tgggtgtgtgtagccaag

SEQ ID NO: 2697737 - DNA, 21 bp, Homo sapiens
tgggttcctcttccccactcc

SEQ ID NO: 2697738 - DNA, 22 bp, Homo sapiens
tggtatgaacttgaggacacat

SEQ ID NO: 2697739 - DNA, 11 bp, Homo sapiens
tggtcctgggg

SEQ ID NO: 2697740 - DNA, 23 bp, Homo sapiens
tggtccttccaggcccccaccac

SEQ ID NO: 2697741 - DNA, 14 bp, Homo sapiens
tgtaaaattgtata

SEQ ID NO: 2697742 - DNA, 20 bp, Homo sapiens
tgtaaagaataaatgaatct

SEQ ID NO: 2697743 - DNA, 20 bp, Homo sapiens
tgtaagtttatgtctaaaga

SEQ ID NO: 2697744 - DNA, 19 bp, Homo sapiens
tgtaatttcagctagttaa

SEQ ID NO: 2697745 - DNA, 15 bp, Homo sapiens
tgtatctacctcact

SEQ ID NO: 2697746 - DNA, 22 bp, Homo sapiens
tgtatctgaaggagattttcct

SEQ ID NO: 2697747 - DNA, 18 bp, Homo sapiens
aaaactcatacaatgata

SEQ ID NO: 2697748 - DNA, 11 bp, Homo sapiens
aaaacttattt

SEQ ID NO: 2697749 - DNA, 23 bp, Homo sapiens
aaaagaatttgtgacattttaaa

SEQ ID NO: 2697750 - DNA, 23 bp, Homo sapiens
aaaagtaagtaccactcaggcca

SEQ ID NO: 2697751 - DNA, 14 bp, Homo sapiens
aaaataagtatttc

SEQ ID NO: 2697752 - DNA, 15 bp, Homo sapiens
aaaataataatagta

SEQ ID NO: 2697753 - DNA, 16 bp, Homo sapiens
aaaatccatttaatca

SEQ ID NO: 2697754 - DNA, 18 bp, Homo sapiens
aaaatcctttttgtattt

SEQ ID NO: 2697755 - DNA, 19 bp, Homo sapiens
aaaatgccacttaacagga

SEQ ID NO: 2697756 - DNA, 13 bp, Homo sapiens
aaacagactattt

SEQ ID NO: 2697757 - DNA, 19 bp, Homo sapiens
aaaccttaccttggaattg

SEQ ID NO: 2697758 - DNA, 22 bp, Homo sapiens
aaacttagaataaaattgtaaa

SEQ ID NO: 2697759 - DNA, 12 bp, Homo sapiens
aaacttatttga

SEQ ID NO: 2697760 - DNA, 14 bp, Homo sapiens
aaacttatttgagt

SEQ ID NO: 2697761 - DNA, 13 bp, Homo sapiens
aaagcaaaagaag

SEQ ID NO: 2697762 - DNA, 15 bp, Homo sapiens
aaagcaaaagaagta

SEQ ID NO: 2697763 - DNA, 16 bp, Homo sapiens
aaagcatcacctcagg

SEQ ID NO: 2697764 - DNA, 19 bp, Homo sapiens
aaagtaagtaccactcagg

SEQ ID NO: 2697765 - DNA, 12 bp, Homo sapiens
aaagtctaaagt

SEQ ID NO: 2697766 - DNA, 22 bp, Homo sapiens
aaagtctaaagtttacagtaaa

SEQ ID NO: 2697767 - DNA, 13 bp, Homo sapiens
aaataaaatttac

SEQ ID NO: 2697768 - DNA, 13 bp, Homo sapiens
aaataaattgttt

SEQ ID NO: 2697769 - DNA, 18 bp, Homo sapiens
aaatatccaccactttaa

SEQ ID NO: 2697770 - DNA, 19 bp, Homo sapiens
aaatgattttattaccttg

SEQ ID NO: 2697771 - DNA, 20 bp, Homo sapiens
aaattgaggacttaatttac

SEQ ID NO: 2697772 - DNA, 14 bp, Homo sapiens
aacacaaatgtaaa

SEQ ID NO: 2697773 - DNA, 19 bp, Homo sapiens
aacactaaacagactattt

SEQ ID NO: 2697774 - DNA, 18 bp, Homo sapiens
aacctcaggcttccttgg

SEQ ID NO: 2697775 - DNA, 23 bp, Homo sapiens
aacgacaaagccaaactctgcca

SEQ ID NO: 2697776 - DNA, 15 bp, Homo sapiens
aacgggctgccctgc

SEQ ID NO: 2697777 - DNA, 15 bp, Homo sapiens
aacggggtccttcaa

SEQ ID NO: 2697778 - DNA, 20 bp, Homo sapiens
aactagagatgactgagtcc

SEQ ID NO: 2697779 - DNA, 15 bp, Homo sapiens
aacttaaacaatttc

SEQ ID NO: 2697780 - DNA, 15 bp, Homo sapiens
aacttagaataaaat

SEQ ID NO: 2697781 - DNA, 16 bp, Homo sapiens
aacttagaataaaatt

SEQ ID NO: 2697782 - DNA, 21 bp, Homo sapiens
aacttagaataaaattgtaaa

SEQ ID NO: 2697783 - DNA, 13 bp, Homo sapiens
aacttatttgagt

SEQ ID NO: 2697784 - DNA, 16 bp, Homo sapiens
aagaataaatgaatct

SEQ ID NO: 2697785 - DNA, 20 bp, Homo sapiens
aagacccagtgtaaagaata

SEQ ID NO: 2697786 - DNA, 18 bp, Homo sapiens
aagagagaaaacttattt

SEQ ID NO: 2697787 - DNA, 23 bp, Homo sapiens
aagatatatatttactaaaagaa

SEQ ID NO: 2697788 - DNA, 16 bp, Homo sapiens
aagatgtcagactggc

SEQ ID NO: 2697789 - DNA, 18 bp, Homo sapiens
aagcatcacctcaggcca

SEQ ID NO: 2697790 - DNA, 14 bp, Homo sapiens
aagccaaactctgc

SEQ ID NO: 2697791 - DNA, 13 bp, Homo sapiens
aagccactgaagc

SEQ ID NO: 2697792 - DNA, 11 bp, Homo sapiens
aagcctctgct

SEQ ID NO: 2697793 - DNA, 15 bp, Homo sapiens
aagcctgaggctggg

SEQ ID NO: 2697794 - DNA, 18 bp, Homo sapiens
aagctggacaagaagctg

SEQ ID NO: 2697795 - DNA, 19 bp, Homo sapiens
aagctggacaagaagctgc

SEQ ID NO: 2697796 - DNA, 17 bp, Homo sapiens
aagctgtaaaaagagag

SEQ ID NO: 2697797 - DNA, 18 bp, Homo sapiens
aaggagattttccttcct

SEQ ID NO: 2697798 - DNA, 14 bp, Homo sapiens
aaggggccctggtc

SEQ ID NO: 2697799 - DNA, 21 bp, Homo sapiens
aaggggccctggtccttccag

SEQ ID NO: 2697800 - DNA, 20 bp, Homo sapiens
aaggtgggctgagccctggc

SEQ ID NO: 2697801 - DNA, 18 bp, Homo sapiens
aagtaagtaccactcagg

SEQ ID NO: 2697802 - DNA, 17 bp, Homo sapiens
aagtaccactcaggcca

SEQ ID NO: 2697803 - DNA, 20 bp, Homo sapiens
aagtattaggggtaatatat

SEQ ID NO: 2697804 - DNA, 18 bp, Homo sapiens
aagtcagtcaacatttac

SEQ ID NO: 2697805 - DNA, 19 bp, Homo sapiens
aagtccctgactctctgtg

SEQ ID NO: 2697806 - DNA, 15 bp, Homo sapiens
aagtctaaagtttac

SEQ ID NO: 2697807 - DNA, 21 bp, Homo sapiens
aagtgccagtcttgtgtctgc

SEQ ID NO: 2697808 - DNA, 14 bp, Homo sapiens
aagttcctctagtg

SEQ ID NO: 2697809 - DNA, 12 bp, Homo sapiens
aagtttacagta

SEQ ID NO: 2697810 - DNA, 18 bp, Homo sapiens
aagtttacagtaaataaa

SEQ ID NO: 2697811 - DNA, 20 bp, Homo sapiens
aagtttacagtaaataaatt

SEQ ID NO: 2697812 - DNA, 21 bp, Homo sapiens
aagtttacagtaaataaattg

SEQ ID NO: 2697813 - DNA, 16 bp, Homo sapiens
aagtttatgtctaaag

SEQ ID NO: 2697814 - DNA, 21 bp, Homo sapiens
aagtttgcactgtatgctgga

SEQ ID NO: 2697815 - DNA, 17 bp, Homo sapiens
aataaacttagaataaa

SEQ ID NO: 2697816 - DNA, 12 bp, Homo sapiens
aataaagctgga

SEQ ID NO: 2697817 - DNA, 16 bp, Homo sapiens
aataataatagtacta

SEQ ID NO: 2697818 - DNA, 13 bp, Homo sapiens
aataatagtacta

SEQ ID NO: 2697819 - DNA, 19 bp, Homo sapiens
aatacagaaattagccggg

SEQ ID NO: 2697820 - DNA, 13 bp, Homo sapiens
aatagaaatgcat

SEQ ID NO: 2697821 - DNA, 21 bp, Homo sapiens
aatagagagtatgtaatcttt

SEQ ID NO: 2697822 - DNA, 21 bp, Homo sapiens
aataggatgataggaaataaa

SEQ ID NO: 2697823 - DNA, 14 bp, Homo sapiens
aatagtattaacta

SEQ ID NO: 2697824 - DNA, 14 bp, Homo sapiens
aatatattgaacac

SEQ ID NO: 2697825 - DNA, 19 bp, Homo sapiens
aatattgcccaaataatat

SEQ ID NO: 2697826 - DNA, 18 bp, Homo sapiens
aatcatgaagtaaattga

SEQ ID NO: 2697827 - DNA, 18 bp, Homo sapiens
aatctccagggctgcccc

SEQ ID NO: 2697828 - DNA, 20 bp, Homo sapiens
aatctccagggctgcccctg

SEQ ID NO: 2697829 - DNA, 23 bp, Homo sapiens
aatctccagggctgcccctgtag

SEQ ID NO: 2697830 - DNA, 18 bp, Homo sapiens
aatctgattaatccattt

SEQ ID NO: 2697831 - DNA, 13 bp, Homo sapiens
aatgaattctgaa

SEQ ID NO: 2697832 - DNA, 14 bp, Homo sapiens
aatggcctgccttg

SEQ ID NO: 2697833 - DNA, 14 bp, Homo sapiens
aatgtagtggagag

SEQ ID NO: 2697834 - DNA, 13 bp, Homo sapiens
aattccactggac

SEQ ID NO: 2697835 - DNA, 18 bp, Homo sapiens
aattctaccctgaaagtg

SEQ ID NO: 2697836 - DNA, 13 bp, Homo sapiens
aattgtatagaga

SEQ ID NO: 2697837 - DNA, 22 bp, Homo sapiens
aatttcccacaccccagcgcct

SEQ ID NO: 2697838 - DNA, 14 bp, Homo sapiens
aatttgtaagttta

SEQ ID NO: 2697839 - DNA, 12 bp, Homo sapiens
aatttgtatctg

SEQ ID NO: 2697840 - DNA, 15 bp, Homo sapiens
aatttgtatctgaag

SEQ ID NO: 2697841 - DNA, 15 bp, Homo sapiens
acaactatgaaatcg

SEQ ID NO: 2697842 - DNA, 14 bp, Homo sapiens
acaagaagctgcta

SEQ ID NO: 2697843 - DNA, 18 bp, Homo sapiens
acacccttggacttgagg

SEQ ID NO: 2697844 - DNA, 15 bp, Homo sapiens
acacctgccctgccc

SEQ ID NO: 2697845 - DNA, 17 bp, Homo sapiens
acacctgccctgccctg

SEQ ID NO: 2697846 - DNA, 20 bp, Homo sapiens
acacctgccctgccctgcca

SEQ ID NO: 2697847 - DNA, 22 bp, Homo sapiens
acacctgccctgccctgccacc

SEQ ID NO: 2697848 - DNA, 17 bp, Homo sapiens
acacggggtattttagg

SEQ ID NO: 2697849 - DNA, 15 bp, Homo sapiens
acactaaacagacta

SEQ ID NO: 2697850 - DNA, 20 bp, Homo sapiens
acactaaacagactatttaa

SEQ ID NO: 2697851 - DNA, 16 bp, Homo sapiens
acactccagcctgagc

SEQ ID NO: 2697852 - DNA, 13 bp, Homo sapiens
acagaacactaaa

SEQ ID NO: 2697853 - DNA, 20 bp, Homo sapiens
acagccgcagcctccctctg

SEQ ID NO: 2697854 - DNA, 22 bp, Homo sapiens
acagccgcagcctccctctgac

SEQ ID NO: 2697855 - DNA, 20 bp, Homo sapiens
acaggacagtgcttcagcct

SEQ ID NO: 2697856 - DNA, 22 bp, Homo sapiens
acaggacagtgcttcagcctga

SEQ ID NO: 2697857 - DNA, 21 bp, Homo sapiens
acaggattaatatattgaaca

SEQ ID NO: 2697858 - DNA, 16 bp, Homo sapiens
acagggcagagccggg

SEQ ID NO: 2697859 - DNA, 18 bp, Homo sapiens
acagtattctcagtgctc

SEQ ID NO: 2697860 - DNA, 12 bp, Homo sapiens
acagtcctggga

SEQ ID NO: 2697861 - DNA, 21 bp, Homo sapiens
acagtcctgggagaacctcag

SEQ ID NO: 2697862 - DNA, 14 bp, Homo sapiens
acagtgcttcagcc

SEQ ID NO: 2697863 - DNA, 18 bp, Homo sapiens
acagtgcttcagcctgag

SEQ ID NO: 2697864 - DNA, 14 bp, Homo sapiens
acatgacgtaaaat

SEQ ID NO: 2697865 - DNA, 14 bp, Homo sapiens
acatggccagtgtg

SEQ ID NO: 2697866 - DNA, 21 bp, Homo sapiens
acatgtccagtgggaggtgag

SEQ ID NO: 2697867 - DNA, 14 bp, Homo sapiens
acattaaattaaat

SEQ ID NO: 2697868 - DNA, 22 bp, Homo sapiens
acattggtatatttccattcat

SEQ ID NO: 2697869 - DNA, 17 bp, Homo sapiens
acattttaaaaaacaaa

SEQ ID NO: 2697870 - DNA, 16 bp, Homo sapiens
accagtacttctaaga

SEQ ID NO: 2697871 - DNA, 16 bp, Homo sapiens
accatggagacaagaa

SEQ ID NO: 2697872 - DNA, 21 bp, Homo sapiens
acccagtgtaaagaataaatg

SEQ ID NO: 2697873 - DNA, 20 bp, Homo sapiens
acccatgaagacaggacagt

SEQ ID NO: 2697874 - DNA, 19 bp, Homo sapiens
accccacctcatgcctggc

SEQ ID NO: 2697875 - DNA, 13 bp, Homo sapiens
accccagcatcct

SEQ ID NO: 2697876 - DNA, 12 bp, Homo sapiens
accccccacctg

SEQ ID NO: 2697877 - DNA, 13 bp, Homo sapiens
accccccacctgc

SEQ ID NO: 2697878 - DNA, 22 bp, Homo sapiens
accctccgccttcactccggtg

SEQ ID NO: 2697879 - DNA, 15 bp, Homo sapiens
accctcgtggacacc

SEQ ID NO: 2697880 - DNA, 22 bp, Homo sapiens
accctcgtggacacctgccctg

SEQ ID NO: 2697881 - DNA, 23 bp, Homo sapiens
accctcgtggacacctgccctgc

SEQ ID NO: 2697882 - DNA, 18 bp, Homo sapiens
actccagcctgggcgaca

SEQ ID NO: 2697883 - DNA, 16 bp, Homo sapiens
actccggtgtgcctgc

SEQ ID NO: 2697884 - DNA, 20 bp, Homo sapiens
actccggtgtgcctgcagcc

SEQ ID NO: 2697885 - DNA, 14 bp, Homo sapiens
actcctacctcagc

SEQ ID NO: 2697886 - DNA, 23 bp, Homo sapiens
actctgaggctctttctgggcca

SEQ ID NO: 2697887 - DNA, 13 bp, Homo sapiens
actctgccagcca

SEQ ID NO: 2697888 - DNA, 19 bp, Homo sapiens
actgcgggatggtcctggg

SEQ ID NO: 2697889 - DNA, 21 bp, Homo sapiens
actgcgggatggtcctggggc

SEQ ID NO: 2697890 - DNA, 14 bp, Homo sapiens
actggagcccagga

SEQ ID NO: 2697891 - DNA, 16 bp, Homo sapiens
actggctggctgcagt

SEQ ID NO: 2697892 - DNA, 17 bp, Homo sapiens
actggctggctgcagtg

SEQ ID NO: 2697893 - DNA, 17 bp, Homo sapiens
actgttagtattaacta

SEQ ID NO: 2697894 - DNA, 12 bp, Homo sapiens
acttgaggacac

SEQ ID NO: 2697895 - DNA, 15 bp, Homo sapiens
acttgaggacacatg

SEQ ID NO: 2697896 - DNA, 19 bp, Homo sapiens
actttggtacatggccagt

SEQ ID NO: 2697897 - DNA, 19 bp, Homo sapiens
agaaacacaaatgtaaaat

SEQ ID NO: 2697898 - DNA, 14 bp, Homo sapiens
agaaattagccggg

SEQ ID NO: 2697899 - DNA, 13 bp, Homo sapiens
agaagtaaaagct

SEQ ID NO: 2697900 - DNA, 14 bp, Homo sapiens
agaataaaattgta

SEQ ID NO: 2697901 - DNA, 13 bp, Homo sapiens
agaataaatgaat

SEQ ID NO: 2697902 - DNA, 15 bp, Homo sapiens
agaattctagaaaat

SEQ ID NO: 2697903 - DNA, 14 bp, Homo sapiens
agaccagcctggcc

SEQ ID NO: 2697904 - DNA, 16 bp, Homo sapiens
agacccagtgtaaaga

SEQ ID NO: 2697905 - DNA, 22 bp, Homo sapiens
agacccagtgtaaagaataaat

SEQ ID NO: 2697906 - DNA, 17 bp, Homo sapiens
agacggctggacctgca

SEQ ID NO: 2697907 - DNA, 16 bp, Homo sapiens
agactctgtggggcct

SEQ ID NO: 2697908 - DNA, 20 bp, Homo sapiens
agactgcgggatggtcctgg

SEQ ID NO: 2697909 - DNA, 23 bp, Homo sapiens
agactgcgggatggtcctggggc

SEQ ID NO: 2697910 - DNA, 14 bp, Homo sapiens
agactggctggctg

SEQ ID NO: 2697911 - DNA, 19 bp, Homo sapiens
agagaaaacttatttgagt

SEQ ID NO: 2697912 - DNA, 19 bp, Homo sapiens
agagagaaaacttatttga

SEQ ID NO: 2697913 - DNA, 17 bp, Homo sapiens
agagatgactgagtcct

SEQ ID NO: 2697914 - DNA, 18 bp, Homo sapiens
agagatgactgagtcctc

SEQ ID NO: 2697915 - DNA, 21 bp, Homo sapiens
agagcttggacagtctgagct

SEQ ID NO: 2697916 - DNA, 22 bp, Homo sapiens
agagcttggacagtctgagctg

SEQ ID NO: 2697917 - DNA, 16 bp, Homo sapiens
agagggcccaggcagg

SEQ ID NO: 2697918 - DNA, 18 bp, Homo sapiens
agagtcagccttccccct

SEQ ID NO: 2697919 - DNA, 21 bp, Homo sapiens
agatgcccagagggcccaggc

SEQ ID NO: 2697920 - DNA, 13 bp, Homo sapiens
agattttccttcc

SEQ ID NO: 2697921 - DNA, 14 bp, Homo sapiens
agcaaagtctaaag

SEQ ID NO: 2697922 - DNA, 23 bp, Homo sapiens
agcaaagtctaaagtttacagta

SEQ ID NO: 2697923 - DNA, 21 bp, Homo sapiens
agcactttgggaggctgaggc

SEQ ID NO: 2697924 - DNA, 22 bp, Homo sapiens
agcactttgggaggctgaggcg

SEQ ID NO: 2697925 - DNA, 20 bp, Homo sapiens
agcagcacgattttgcacaa

SEQ ID NO: 2697926 - DNA, 21 bp, Homo sapiens
agcagcacgattttgcacaaa

SEQ ID NO: 2697927 - DNA, 17 bp, Homo sapiens
agcagcttcagttgttt

SEQ ID NO: 2697928 - DNA, 21 bp, Homo sapiens
agcaggttgaggggctcctgg

SEQ ID NO: 2697929 - DNA, 22 bp, Homo sapiens
agcaggttgaggggctcctgga

SEQ ID NO: 2697930 - DNA, 15 bp, Homo sapiens
agcatcacctcaggc

SEQ ID NO: 2697931 - DNA, 15 bp, Homo sapiens
agccaaactctgcca

SEQ ID NO: 2697932 - DNA, 22 bp, Homo sapiens
agccaaggtgggctgagccctg

SEQ ID NO: 2697933 - DNA, 19 bp, Homo sapiens
agcccaggagtttgaggct

SEQ ID NO: 2697934 - DNA, 17 bp, Homo sapiens
agccctggcaggatgac

SEQ ID NO: 2697935 - DNA, 21 bp, Homo sapiens
agccctggcaggatgaccctg

SEQ ID NO: 2697936 - DNA, 18 bp, Homo sapiens
agccgagatcacgccact

SEQ ID NO: 2697937 - DNA, 15 bp, Homo sapiens
agcctagaccctcct

SEQ ID NO: 2697938 - DNA, 22 bp, Homo sapiens
agcctccctctgacctgcaggc

SEQ ID NO: 2697939 - DNA, 17 bp, Homo sapiens
agcctgaggctgagact

SEQ ID NO: 2697940 - DNA, 14 bp, Homo sapiens
agcctggccaacat

SEQ ID NO: 2697941 - DNA, 14 bp, Homo sapiens
agcctggcttctgg

SEQ ID NO: 2697942 - DNA, 15 bp, Homo sapiens
agcctggcttctgga

SEQ ID NO: 2697943 - DNA, 19 bp, Homo sapiens
agcctggcttctggagccc

SEQ ID NO: 2697944 - DNA, 14 bp, Homo sapiens
agcctgggcgacag

SEQ ID NO: 2697945 - DNA, 21 bp, Homo sapiens
agccttgcccggattctggga

SEQ ID NO: 2697946 - DNA, 14 bp, Homo sapiens
agcgagttgtggaa

SEQ ID NO: 2697947 - DNA, 19 bp, Homo sapiens
agcgatgaatttggagact

SEQ ID NO: 2697948 - DNA, 17 bp, Homo sapiens
agcgcacctgccccctg

SEQ ID NO: 2697949 - DNA, 18 bp, Homo sapiens
agcgcacctgccccctgg

SEQ ID NO: 2697950 - DNA, 23 bp, Homo sapiens
agcggaggttgcagggagccgag

SEQ ID NO: 2697951 - DNA, 14 bp, Homo sapiens
agctactcagaagc

SEQ ID NO: 2697952 - DNA, 18 bp, Homo sapiens
agctgcacctgccagcct

SEQ ID NO: 2697953 - DNA, 21 bp, Homo sapiens
agctgcacctgccagcctggc

SEQ ID NO: 2697954 - DNA, 16 bp, Homo sapiens
agctggacaagaagct

SEQ ID NO: 2697955 - DNA, 17 bp, Homo sapiens
agctggacaagaagctg

SEQ ID NO: 2697956 - DNA, 18 bp, Homo sapiens
agctggacaagaagctgc

SEQ ID NO: 2697957 - DNA, 17 bp, Homo sapiens
agctgtgaacatggact

SEQ ID NO: 2697958 - DNA, 19 bp, Homo sapiens
agcttggacagtctgagct

SEQ ID NO: 2697959 - DNA, 17 bp, Homo sapiens
aggacagtgcttcagcc

SEQ ID NO: 2697960 - DNA, 18 bp, Homo sapiens
aggacagtgcttcagcct

SEQ ID NO: 2697961 - DNA, 21 bp, Homo sapiens
aggacatgatggagcgcacct

SEQ ID NO: 2697962 - DNA, 13 bp, Homo sapiens
aggactccctcca

SEQ ID NO: 2697963 - DNA, 20 bp, Homo sapiens
aggagcagcttcagttgttt

SEQ ID NO: 2697964 - DNA, 17 bp, Homo sapiens
aggaggtggcagccctg

SEQ ID NO: 2697965 - DNA, 23 bp, Homo sapiens
aggaggtggcagccctgtaggga

SEQ ID NO: 2697966 - DNA, 16 bp, Homo sapiens
aggagttcgagaccag

SEQ ID NO: 2697967 - DNA, 21 bp, Homo sapiens
aggagttcgagaccagcctgg

SEQ ID NO: 2697968 - DNA, 19 bp, Homo sapiens
aggagtttgaggctgcagc

SEQ ID NO: 2697969 - DNA, 16 bp, Homo sapiens
aggcatgctggcctcc

SEQ ID NO: 2697970 - DNA, 17 bp, Homo sapiens
aggccaagagcagaggc

SEQ ID NO: 2697971 - DNA, 21 bp, Homo sapiens
aggccacaccatctcctttca

SEQ ID NO: 2697972 - DNA, 22 bp, Homo sapiens
aggccaccatattcagtgctgt

SEQ ID NO: 2697973 - DNA, 16 bp, Homo sapiens
aggctcagtctcagga

SEQ ID NO: 2697974 - DNA, 18 bp, Homo sapiens
aggctcagtctcaggagc

SEQ ID NO: 2697975 - DNA, 19 bp, Homo sapiens
aggctcagtctcaggagca

SEQ ID NO: 2697976 - DNA, 11 bp, Homo sapiens
aggctgaggcg

SEQ ID NO: 2697977 - DNA, 21 bp, Homo sapiens
aggctgaggcgggtggatcac

SEQ ID NO: 2697978 - DNA, 13 bp, Homo sapiens
aggctggtcttga

SEQ ID NO: 2697979 - DNA, 17 bp, Homo sapiens
agggatgctgcctgagt

SEQ ID NO: 2697980 - DNA, 12 bp, Homo sapiens
agggccagggcc

SEQ ID NO: 2697981 - DNA, 14 bp, Homo sapiens
agggccagggccct

SEQ ID NO: 2697982 - DNA, 13 bp, Homo sapiens
agggccctgcaga

SEQ ID NO: 2697983 - DNA, 12 bp, Homo sapiens
agggctgcccct

SEQ ID NO: 2697984 - DNA, 23 bp, Homo sapiens
aggggaaaccagtgtagccttgc

SEQ ID NO: 2697985 - DNA, 17 bp, Homo sapiens
aggggacgcgggctgtg

SEQ ID NO: 2697986 - DNA, 12 bp, Homo sapiens
aggggccctggt

SEQ ID NO: 2697987 - DNA, 14 bp, Homo sapiens
aggggctttctgga

SEQ ID NO: 2697988 - DNA, 16 bp, Homo sapiens
aggggctttctggaga

SEQ ID NO: 2697989 - DNA, 19 bp, Homo sapiens
aggggtaatatattgctgc

SEQ ID NO: 2697990 - DNA, 16 bp, Homo sapiens
agggtgggagagccca

SEQ ID NO: 2697991 - DNA, 17 bp, Homo sapiens
agggtgggagagcccag

SEQ ID NO: 2697992 - DNA, 18 bp, Homo sapiens
agggtgggagagcccagc

SEQ ID NO: 2697993 - DNA, 19 bp, Homo sapiens
agggttttccaccctggaa

SEQ ID NO: 2697994 - DNA, 16 bp, Homo sapiens
aggtaaatacaatggt

SEQ ID NO: 2697995 - DNA, 14 bp, Homo sapiens
aggtgagaccacct

SEQ ID NO: 2697996 - DNA, 16 bp, Homo sapiens
aggtgagaccacctct

SEQ ID NO: 2697997 - DNA, 17 bp, Homo sapiens
aggtgccaccaataaaa

SEQ ID NO: 2697998 - DNA, 14 bp, Homo sapiens
aggtggcagccctg

SEQ ID NO: 2697999 - DNA, 16 bp, Homo sapiens
aggtgggctgagccct

SEQ ID NO: 2698000 - DNA, 17 bp, Homo sapiens
aggttgaggggctcctg

SEQ ID NO: 2698001 - DNA, 20 bp, Homo sapiens
aggttgaggggctcctggaa

SEQ ID NO: 2698002 - DNA, 12 bp, Homo sapiens
agtaaaagctaa

SEQ ID NO: 2698003 - DNA, 14 bp, Homo sapiens
agtaaataaattgt

SEQ ID NO: 2698004 - DNA, 19 bp, Homo sapiens
agtaaataaattgtttgac

SEQ ID NO: 2698005 - DNA, 22 bp, Homo sapiens
agtaattctaccctgaaagtga

SEQ ID NO: 2698006 - DNA, 15 bp, Homo sapiens
agtaccactcaggcc

SEQ ID NO: 2698007 - DNA, 22 bp, Homo sapiens
agtactattactattactattt

SEQ ID NO: 2698008 - DNA, 14 bp, Homo sapiens
agtacttctaagag

SEQ ID NO: 2698009 - DNA, 17 bp, Homo sapiens
agtcacccatgaagaca

SEQ ID NO: 2698010 - DNA, 15 bp, Homo sapiens
agtcagactgctggg

SEQ ID NO: 2698011 - DNA, 23 bp, Homo sapiens
agtcagccttccccctcccaggg

SEQ ID NO: 2698012 - DNA, 21 bp, Homo sapiens
agtcctgggagaacctcaggc

SEQ ID NO: 2698013 - DNA, 22 bp, Homo sapiens
agtcctgggagaacctcaggct

SEQ ID NO: 2698014 - DNA, 20 bp, Homo sapiens
agtctaaagtttacagtaaa

SEQ ID NO: 2698015 - DNA, 17 bp, Homo sapiens
agtctcaggagcatggg

SEQ ID NO: 2698016 - DNA, 16 bp, Homo sapiens
agtctgctatattttc

SEQ ID NO: 2698017 - DNA, 20 bp, Homo sapiens
agtgccagtcttgtgtctgc

SEQ ID NO: 2698018 - DNA, 18 bp, Homo sapiens
agtgctgtggcctgggca

SEQ ID NO: 2698019 - DNA, 14 bp, Homo sapiens
agtgcttcagcctg

SEQ ID NO: 2698020 - DNA, 18 bp, Homo sapiens
agtgcttcagcctgaggc

SEQ ID NO: 2698021 - DNA, 20 bp, Homo sapiens
agtgcttcagcctgaggctg

SEQ ID NO: 2698022 - DNA, 13 bp, Homo sapiens
agtgtagccttgc

SEQ ID NO: 2698023 - DNA, 18 bp, Homo sapiens
agtgtagccttgcccgga

SEQ ID NO: 2698024 - DNA, 20 bp, Homo sapiens
agttcagttcctctttgcat

SEQ ID NO: 2698025 - DNA, 16 bp, Homo sapiens
agttcctctttgcatg

SEQ ID NO: 2698026 - DNA, 18 bp, Homo sapiens
agttcgagaccagcctgg

SEQ ID NO: 2698027 - DNA, 21 bp, Homo sapiens
agttcgagaccagcctggcca

SEQ ID NO: 2698028 - DNA, 16 bp, Homo sapiens
agtttatgtctaaaga

SEQ ID NO: 2698029 - DNA, 21 bp, Homo sapiens
agtttatgtctaaagagcttt

SEQ ID NO: 2698030 - DNA, 18 bp, Homo sapiens
agtttcctatgactaatt

SEQ ID NO: 2698031 - DNA, 14 bp, Homo sapiens
agtttgaggctgca

SEQ ID NO: 2698032 - DNA, 20 bp, Homo sapiens
agtttgcactgtatgctgga

SEQ ID NO: 2698033 - DNA, 18 bp, Homo sapiens
ataaaaataatatatgct

SEQ ID NO: 2698034 - DNA, 13 bp, Homo sapiens
ataaaatttacct

SEQ ID NO: 2698035 - DNA, 20 bp, Homo sapiens
ataaagctggacaagaagct

SEQ ID NO: 2698036 - DNA, 22 bp, Homo sapiens
ataaagctggacaagaagctgc

SEQ ID NO: 2698037 - DNA, 17 bp, Homo sapiens
ataagtgggagctaaat

SEQ ID NO: 2698038 - DNA, 13 bp, Homo sapiens
ataatagtactat

SEQ ID NO: 2698039 - DNA, 17 bp, Homo sapiens
atacaatggtttctgaa

SEQ ID NO: 2698040 - DNA, 13 bp, Homo sapiens
atagtactattac

SEQ ID NO: 2698041 - DNA, 20 bp, Homo sapiens
atatctttaataagtaatct

SEQ ID NO: 2698042 - DNA, 20 bp, Homo sapiens
atatgtatgctgatttacta

SEQ ID NO: 2698043 - DNA, 20 bp, Homo sapiens
atattaaagcgcaaatgaat

SEQ ID NO: 2698044 - DNA, 18 bp, Homo sapiens
atattaggggatggagag

SEQ ID NO: 2698045 - DNA, 22 bp, Homo sapiens
atattcagtgctgtggcctggg

SEQ ID NO: 2698046 - DNA, 23 bp, Homo sapiens
atattcagtgctgtggcctgggc

SEQ ID NO: 2698047 - DNA, 16 bp, Homo sapiens
atattgcccaaataat

SEQ ID NO: 2698048 - DNA, 21 bp, Homo sapiens
atattgctgctggtaatttgt

SEQ ID NO: 2698049 - DNA, 23 bp, Homo sapiens
atattgctgtatggtatatgcat

SEQ ID NO: 2698050 - DNA, 13 bp, Homo sapiens
atatttaaatcat

SEQ ID NO: 2698051 - DNA, 14 bp, Homo sapiens
atattttagattac

SEQ ID NO: 2698052 - DNA, 19 bp, Homo sapiens
atcacagggcagagccggg

SEQ ID NO: 2698053 - DNA, 20 bp, Homo sapiens
atcacagggcagagccggga

SEQ ID NO: 2698054 - DNA, 12 bp, Homo sapiens
atcacctgaggt

SEQ ID NO: 2698055 - DNA, 23 bp, Homo sapiens
atcacgccactgcactccagcct

SEQ ID NO: 2698056 - DNA, 19 bp, Homo sapiens
atcatgtaacattcttcta

SEQ ID NO: 2698057 - DNA, 20 bp, Homo sapiens
atccaaccccccacctgcca

SEQ ID NO: 2698058 - DNA, 19 bp, Homo sapiens
atccaccactttaacctta

SEQ ID NO: 2698059 - DNA, 18 bp, Homo sapiens
atcccaggaggggcctct

SEQ ID NO: 2698060 - DNA, 23 bp, Homo sapiens
atcccaggaggggcctctgaaat

SEQ ID NO: 2698061 - DNA, 11 bp, Homo sapiens
atccttctgcc

SEQ ID NO: 2698062 - DNA, 23 bp, Homo sapiens
atcgcgccactacactccagcct

SEQ ID NO: 2698063 - DNA, 21 bp, Homo sapiens
atctacctcactattcaagta

SEQ ID NO: 2698064 - DNA, 18 bp, Homo sapiens
atctccagggctgcccct

SEQ ID NO: 2698065 - DNA, 14 bp, Homo sapiens
cctggtggacagtc

SEQ ID NO: 2698066 - DNA, 19 bp, Homo sapiens
cctggtggacagtcctggg

SEQ ID NO: 2698067 - DNA, 20 bp, Homo sapiens
cctggtggacagtcctggga

SEQ ID NO: 2698068 - DNA, 21 bp, Homo sapiens
ccttacttaagtcgggggtgg

SEQ ID NO: 2698069 - DNA, 13 bp, Homo sapiens
ccttccaggcccc

SEQ ID NO: 2698070 - DNA, 17 bp, Homo sapiens
ccttccccctcccaggg

SEQ ID NO: 2698071 - DNA, 20 bp, Homo sapiens
ccttccttgctgtcctaggc

SEQ ID NO: 2698072 - DNA, 19 bp, Homo sapiens
ccttgaagccactgaagct

SEQ ID NO: 2698073 - DNA, 22 bp, Homo sapiens
ccttgaagccactgaagctggg

SEQ ID NO: 2698074 - DNA, 18 bp, Homo sapiens
ccttgccttttaaaagaa

SEQ ID NO: 2698075 - DNA, 19 bp, Homo sapiens
ccttggcatcacagggcag

SEQ ID NO: 2698076 - DNA, 12 bp, Homo sapiens
cctttcagctgt

SEQ ID NO: 2698077 - DNA, 20 bp, Homo sapiens
cctttcagggaatttcagga

SEQ ID NO: 2698078 - DNA, 13 bp, Homo sapiens
ccttttaaaagaa

SEQ ID NO: 2698079 - DNA, 16 bp, Homo sapiens
cgagaccagcctggcc

SEQ ID NO: 2698080 - DNA, 10 bp, Homo sapiens
cgcacacaca

SEQ ID NO: 2698081 - DNA, 22 bp, Homo sapiens
cgcgccactacactccagcctg

SEQ ID NO: 2698082 - DNA, 19 bp, Homo sapiens
cggcatattattccatatc

SEQ ID NO: 2698083 - DNA, 14 bp, Homo sapiens
cggcattcctgctt

SEQ ID NO: 2698084 - DNA, 18 bp, Homo sapiens
cgggatggtcctggggct

SEQ ID NO: 2698085 - DNA, 19 bp, Homo sapiens
cgggcacctatagtcccag

SEQ ID NO: 2698086 - DNA, 21 bp, Homo sapiens
cgggcacctatagtcccagct

SEQ ID NO: 2698087 - DNA, 16 bp, Homo sapiens
cggggtattttaggca

SEQ ID NO: 2698088 - DNA, 18 bp, Homo sapiens
cgggtggatcacctgagg

SEQ ID NO: 2698089 - DNA, 15 bp, Homo sapiens
cggtgtgcctgcagc

SEQ ID NO: 2698090 - DNA, 23 bp, Homo sapiens
cggtttggtttgttgtaaataaa

SEQ ID NO: 2698091 - DNA, 16 bp, Homo sapiens
ctaaacagactattta

SEQ ID NO: 2698092 - DNA, 14 bp, Homo sapiens
ctaaagtttacagt

SEQ ID NO: 2698093 - DNA, 19 bp, Homo sapiens
ctaaagtttacagtaaata

SEQ ID NO: 2698094 - DNA, 21 bp, Homo sapiens
ctaaagtttacagtaaataaa

SEQ ID NO: 2698095 - DNA, 14 bp, Homo sapiens
ctacactccagcct

SEQ ID NO: 2698096 - DNA, 13 bp, Homo sapiens
ctactcagaagcc

SEQ ID NO: 2698097 - DNA, 15 bp, Homo sapiens
ctactcctacctcag

SEQ ID NO: 2698098 - DNA, 19 bp, Homo sapiens
ctaggccacaccatctcct

SEQ ID NO: 2698099 - DNA, 13 bp, Homo sapiens
ctagtactattat

SEQ ID NO: 2698100 - DNA, 18 bp, Homo sapiens
ctagtgccctccacagcc

SEQ ID NO: 2698101 - DNA, 22 bp, Homo sapiens
ctatctaggtattttcttcaaa

SEQ ID NO: 2698102 - DNA, 17 bp, Homo sapiens
ctattagtgttaactgt

SEQ ID NO: 2698103 - DNA, 11 bp, Homo sapiens
ctcaaatgctg

SEQ ID NO: 2698104 - DNA, 17 bp, Homo sapiens
ctcaatattcaataaag

SEQ ID NO: 2698105 - DNA, 18 bp, Homo sapiens
ctcaatattcaataaagc

SEQ ID NO: 2698106 - DNA, 19 bp, Homo sapiens
ctcaatattcaataaagct

SEQ ID NO: 2698107 - DNA, 19 bp, Homo sapiens
ctcagccctgaaaataaca

SEQ ID NO: 2698108 - DNA, 17 bp, Homo sapiens
ctcaggcttccttggca

SEQ ID NO: 2698109 - DNA, 16 bp, Homo sapiens
ctcagtctcaggagca

SEQ ID NO: 2698110 - DNA, 21 bp, Homo sapiens
ctcagtgctctcctaccccac

SEQ ID NO: 2698111 - DNA, 14 bp, Homo sapiens
ctccacagccgcag

SEQ ID NO: 2698112 - DNA, 12 bp, Homo sapiens
ctccagcctggg

SEQ ID NO: 2698113 - DNA, 15 bp, Homo sapiens
ctccaggcatgctgg

SEQ ID NO: 2698114 - DNA, 14 bp, Homo sapiens
ctccagggctgccc

SEQ ID NO: 2698115 - DNA, 15 bp, Homo sapiens
ctccagggctgcccc

SEQ ID NO: 2698116 - DNA, 16 bp, Homo sapiens
ctccagggctgcccct

SEQ ID NO: 2698117 - DNA, 13 bp, Homo sapiens
ctccatgtggccc

SEQ ID NO: 2698118 - DNA, 16 bp, Homo sapiens
ctcccaataaagctgg

SEQ ID NO: 2698119 - DNA, 17 bp, Homo sapiens
ctcccaataaagctgga

SEQ ID NO: 2698120 - DNA, 19 bp, Homo sapiens
ctcccagggccagggccct

SEQ ID NO: 2698121 - DNA, 23 bp, Homo sapiens
ctccccctgggctctgccccagc

SEQ ID NO: 2698122 - DNA, 13 bp, Homo sapiens
ctccctctgacct

SEQ ID NO: 2698123 - DNA, 14 bp, Homo sapiens
ctccctctgacctg

SEQ ID NO: 2698124 - DNA, 19 bp, Homo sapiens
ctccgccttcactccggtg

SEQ ID NO: 2698125 - DNA, 18 bp, Homo sapiens
ctccggtgtgcctgcagc

SEQ ID NO: 2698126 - DNA, 12 bp, Homo sapiens
ctcctacctcag

SEQ ID NO: 2698127 - DNA, 20 bp, Homo sapiens
ctcctggaaaggctcagtct

SEQ ID NO: 2698128 - DNA, 24 bp, Homo sapiens
ctcctggaaaggctcagtctcagg

SEQ ID NO: 2698129 - DNA, 22 bp, Homo sapiens
ctccttccttgctgtcctaggc

SEQ ID NO: 2698130 - DNA, 15 bp, Homo sapiens
ctccttgggtcctgc

SEQ ID NO: 2698131 - DNA, 19 bp, Homo sapiens
ctcgtggacacctgccctg

SEQ ID NO: 2698132 - DNA, 21 bp, Homo sapiens
ctcgtggacacctgccctgcc

SEQ ID NO: 2698133 - DNA, 10 bp, Homo sapiens
ctctcaatat

SEQ ID NO: 2698134 - DNA, 20 bp, Homo sapiens
ctctctactcctacctcagc

SEQ ID NO: 2698135 - DNA, 22 bp, Homo sapiens
ctctctactcctacctcagcct

SEQ ID NO: 2698136 - DNA, 13 bp, Homo sapiens
ctctgacctgcag

SEQ ID NO: 2698137 - DNA, 20 bp, Homo sapiens
ctctgaggctctttctgggc

SEQ ID NO: 2698138 - DNA, 17 bp, Homo sapiens
ctctgccccagctctgg

SEQ ID NO: 2698139 - DNA, 18 bp, Homo sapiens
ctctgccccagctctggc

SEQ ID NO: 2698140 - DNA, 23 bp, Homo sapiens
ctctgtgacctgccccgcccagc

SEQ ID NO: 2698141 - DNA, 12 bp, Homo sapiens
ctcttatttgct

SEQ ID NO: 2698142 - DNA, 17 bp, Homo sapiens
ctgaagctgacagcact

SEQ ID NO: 2698143 - DNA, 19 bp, Homo sapiens
ctgctgggactggccaggt

SEQ ID NO: 2698144 - DNA, 14 bp, Homo sapiens
ctggaaaggctcag

SEQ ID NO: 2698145 - DNA, 15 bp, Homo sapiens
ctggaaaggctcagt

SEQ ID NO: 2698146 - DNA, 18 bp, Homo sapiens
ctggacttgagcttggca

SEQ ID NO: 2698147 - DNA, 15 bp, Homo sapiens
ctggagcccaggagt

SEQ ID NO: 2698148 - DNA, 13 bp, Homo sapiens
ctggcccccctcc

SEQ ID NO: 2698149 - DNA, 16 bp, Homo sapiens
ctggcccccctccagg

SEQ ID NO: 2698150 - DNA, 18 bp, Homo sapiens
ctggcctcccaataaagc

SEQ ID NO: 2698151 - DNA, 22 bp, Homo sapiens
ctggcctcccaataaagctgga

SEQ ID NO: 2698152 - DNA, 14 bp, Homo sapiens
ctggctgggcatgg

SEQ ID NO: 2698153 - DNA, 15 bp, Homo sapiens
ctggcttctggagcc

SEQ ID NO: 2698154 - DNA, 13 bp, Homo sapiens
ctgggaggaagca

SEQ ID NO: 2698155 - DNA, 20 bp, Homo sapiens
ctgggccaagttcctctagt

SEQ ID NO: 2698156 - DNA, 21 bp, Homo sapiens
ctgggccaagttcctctagtg

SEQ ID NO: 2698157 - DNA, 24 bp, Homo sapiens
ctgggccccaaacgggctgccctg

SEQ ID NO: 2698158 - DNA, 17 bp, Homo sapiens
ctgggctctgccccagc

SEQ ID NO: 2698159 - DNA, 17 bp, Homo sapiens
ctggtaatttgtatctg

SEQ ID NO: 2698160 - DNA, 22 bp, Homo sapiens
ctggtaatttgtatctgaagga

SEQ ID NO: 2698161 - DNA, 16 bp, Homo sapiens
ctggtgcactggcccc

SEQ ID NO: 2698162 - DNA, 12 bp, Homo sapiens
ctggtggacagt

SEQ ID NO: 2698163 - DNA, 15 bp, Homo sapiens
ctgtaaaatccattt

SEQ ID NO: 2698164 - DNA, 15 bp, Homo sapiens
ctgtctgtctgtccc

SEQ ID NO: 2698165 - DNA, 22 bp, Homo sapiens
ctgtgacctgccccgcccagct

SEQ ID NO: 2698166 - DNA, 10 bp, Homo sapiens
ctgtgcctta

SEQ ID NO: 2698167 - DNA, 11 bp, Homo sapiens
ctgtgccttac

SEQ ID NO: 2698168 - DNA, 11 bp, Homo sapiens
cttagaataaa

SEQ ID NO: 2698169 - DNA, 17 bp, Homo sapiens
cttagaataaaattgta

SEQ ID NO: 2698170 - DNA, 20 bp, Homo sapiens
cttagaataaaattgtaaaa

SEQ ID NO: 2698171 - DNA, 22 bp, Homo sapiens
cttataagtgggagctaaataa

SEQ ID NO: 2698172 - DNA, 11 bp, Homo sapiens
cttatttgagt

SEQ ID NO: 2698173 - DNA, 13 bp, Homo sapiens
cttatttgagtga

SEQ ID NO: 2698174 - DNA, 16 bp, Homo sapiens
cttcaagttagctcag

SEQ ID NO: 2698175 - DNA, 20 bp, Homo sapiens
cttcaagttagctcaggagg

SEQ ID NO: 2698176 - DNA, 24 bp, Homo sapiens
cttcactccggtgtgcctgcagcc

SEQ ID NO: 2698177 - DNA, 16 bp, Homo sapiens
cttcagcctgaggctg

SEQ ID NO: 2698178 - DNA, 20 bp, Homo sapiens
cttcagcctgaggctgagac

SEQ ID NO: 2698179 - DNA, 23 bp, Homo sapiens
cttcctacacccttggacttgag

SEQ ID NO: 2698180 - DNA, 20 bp, Homo sapiens
cttccttgctgtcctaggcc

SEQ ID NO: 2698181 - DNA, 19 bp, Homo sapiens
cttgaagccactgaagctg

SEQ ID NO: 2698182 - DNA, 21 bp, Homo sapiens
cttgaagccactgaagctggg

SEQ ID NO: 2698183 - DNA, 13 bp, Homo sapiens
cttgaggacacat

SEQ ID NO: 2698184 - DNA, 17 bp, Homo sapiens
cttgcccggattctggg

SEQ ID NO: 2698185 - DNA, 20 bp, Homo sapiens
cttgctgtcctaggccacac

SEQ ID NO: 2698186 - DNA, 22 bp, Homo sapiens
cttggaaagcatcacctcaggc

SEQ ID NO: 2698187 - DNA, 23 bp, Homo sapiens
cttggaaagcatcacctcaggcc

SEQ ID NO: 2698188 - DNA, 15 bp, Homo sapiens
cttggacagtctgag

SEQ ID NO: 2698189 - DNA, 23 bp, Homo sapiens
cttgtccttttgtaccatggtgt

SEQ ID NO: 2698190 - DNA, 13 bp, Homo sapiens
ctttaataagtaa

SEQ ID NO: 2698191 - DNA, 13 bp, Homo sapiens
ctttaccactatg

SEQ ID NO: 2698192 - DNA, 13 bp, Homo sapiens
ctttcagctgtga

SEQ ID NO: 2698193 - DNA, 14 bp, Homo sapiens
ctttctgggccaag

SEQ ID NO: 2698194 - DNA, 14 bp, Homo sapiens
ctttctgtctcaaa

SEQ ID NO: 2698195 - DNA, 19 bp, Homo sapiens
cttttaaaagaaaaagtat

SEQ ID NO: 2698196 - DNA, 14 bp, Homo sapiens
cttttgctgctgct

SEQ ID NO: 2698197 - DNA, 19 bp, Homo sapiens
gaaaccagtgtagccttgc

SEQ ID NO: 2698198 - DNA, 18 bp, Homo sapiens
gaaagcatcacctcaggc

SEQ ID NO: 2698199 - DNA, 15 bp, Homo sapiens
gaaagcctctgctgc

SEQ ID NO: 2698200 - DNA, 16 bp, Homo sapiens
gaaagcctctgctgcc

SEQ ID NO: 2698201 - DNA, 17 bp, Homo sapiens
gaaagtcagatgcccag

SEQ ID NO: 2698202 - DNA, 20 bp, Homo sapiens
gaaattgtctagcagagcag

SEQ ID NO: 2698203 - DNA, 22 bp, Homo sapiens
gaactattggagggtgggagag

SEQ ID NO: 2698204 - DNA, 14 bp, Homo sapiens
gaacttgaggacac

SEQ ID NO: 2698205 - DNA, 23 bp, Homo sapiens
gaaggggccctggtccttccagg

SEQ ID NO: 2698206 - DNA, 17 bp, Homo sapiens
gaagggtgacatcccag

SEQ ID NO: 2698207 - DNA, 16 bp, Homo sapiens
gaagtcagtcaacatt

SEQ ID NO: 2698208 - DNA, 13 bp, Homo sapiens
gaataaaattgta

SEQ ID NO: 2698209 - DNA, 19 bp, Homo sapiens
gaatgccttccgggccggg

SEQ ID NO: 2698210 - DNA, 20 bp, Homo sapiens
gaatgccttccgggccgggc

SEQ ID NO: 2698211 - DNA, 16 bp, Homo sapiens
gaattctagaaaattt

SEQ ID NO: 2698212 - DNA, 22 bp, Homo sapiens
gaatttgtaagtttatgtctaa

SEQ ID NO: 2698213 - DNA, 20 bp, Homo sapiens
gacaaagccaaactctgcca

SEQ ID NO: 2698214 - DNA, 12 bp, Homo sapiens
gacaagaagctg

SEQ ID NO: 2698215 - DNA, 12 bp, Homo sapiens
gacacctgccct

SEQ ID NO: 2698216 - DNA, 22 bp, Homo sapiens
gacaggacagtgcttcagcctg

SEQ ID NO: 2698217 - DNA, 18 bp, Homo sapiens
gacagtcctgggagaacc

SEQ ID NO: 2698218 - DNA, 19 bp, Homo sapiens
gacagtgcttcagcctgag

SEQ ID NO: 2698219 - DNA, 20 bp, Homo sapiens
gacctgcacgccaccgctgc

SEQ ID NO: 2698220 - DNA, 20 bp, Homo sapiens
gacctgcaggccaagagcag

SEQ ID NO: 2698221 - DNA, 22 bp, Homo sapiens
gacgcgcacacacaccggtcac

SEQ ID NO: 2698222 - DNA, 12 bp, Homo sapiens
gacggctggacc

SEQ ID NO: 2698223 - DNA, 13 bp, Homo sapiens
gacggctggacct

SEQ ID NO: 2698224 - DNA, 17 bp, Homo sapiens
gacggctggacctgcac

SEQ ID NO: 2698225 - DNA, 19 bp, Homo sapiens
gactccctccatgtggccc

SEQ ID NO: 2698226 - DNA, 17 bp, Homo sapiens
gctactcagaagcctga

SEQ ID NO: 2698227 - DNA, 21 bp, Homo sapiens
gctactcagaagcctgaggct

SEQ ID NO: 2698228 - DNA, 17 bp, Homo sapiens
gctcaggaggcttggaa

SEQ ID NO: 2698229 - DNA, 21 bp, Homo sapiens
gctcagtctcaggagcatggg

SEQ ID NO: 2698230 - DNA, 23 bp, Homo sapiens
gctcctggaaaggctcagtctca

SEQ ID NO: 2698231 - DNA, 16 bp, Homo sapiens
gctccttgggtcctgc

SEQ ID NO: 2698232 - DNA, 18 bp, Homo sapiens
gctccttgggtcctgcaa

SEQ ID NO: 2698233 - DNA, 13 bp, Homo sapiens
gctctgccccagc

SEQ ID NO: 2698234 - DNA, 15 bp, Homo sapiens
gctctgccccagctc

SEQ ID NO: 2698235 - DNA, 18 bp, Homo sapiens
gctctttctgggccaagt

SEQ ID NO: 2698236 - DNA, 12 bp, Homo sapiens
gctgagccctgg

SEQ ID NO: 2698237 - DNA, 15 bp, Homo sapiens
gctgagccctggcag

SEQ ID NO: 2698238 - DNA, 21 bp, Homo sapiens
gctgaggactccctccatgtg

SEQ ID NO: 2698239 - DNA, 17 bp, Homo sapiens
gctgcatatgagtcttt

SEQ ID NO: 2698240 - DNA, 18 bp, Homo sapiens
gctggacaagaagctgct

SEQ ID NO: 2698241 - DNA, 13 bp, Homo sapiens
gctggacctgcac

SEQ ID NO: 2698242 - DNA, 16 bp, Homo sapiens
gctggacggcattcct

SEQ ID NO: 2698243 - DNA, 14 bp, Homo sapiens
gctgggactggcca

SEQ ID NO: 2698244 - DNA, 13 bp, Homo sapiens
gctgtatggtata

SEQ ID NO: 2698245 - DNA, 14 bp, Homo sapiens
gcttcagcctgagg

SEQ ID NO: 2698246 - DNA, 19 bp, Homo sapiens
gcttccagaaaaccccagc

SEQ ID NO: 2698247 - DNA, 13 bp, Homo sapiens
gcttctggagccc

SEQ ID NO: 2698248 - DNA, 21 bp, Homo sapiens
gcttggaaagcatcacctcag

SEQ ID NO: 2698249 - DNA, 18 bp, Homo sapiens
ggaaagcatcacctcagg

SEQ ID NO: 2698250 - DNA, 19 bp, Homo sapiens
ggaaagcatcacctcaggc

SEQ ID NO: 2698251 - DNA, 14 bp, Homo sapiens
ggaaagcctctgct

SEQ ID NO: 2698252 - DNA, 20 bp, Homo sapiens
ggaaaggctcagtctcagga

SEQ ID NO: 2698253 - DNA, 23 bp, Homo sapiens
ggaagcgatgaatttggagactc

SEQ ID NO: 2698254 - DNA, 22 bp, Homo sapiens
ggaagcggaggttgcagggagc

SEQ ID NO: 2698255 - DNA, 18 bp, Homo sapiens
tcactattcaagtattag

SEQ ID NO: 2698256 - DNA, 20 bp, Homo sapiens
tcagaagcctgaggctggga

SEQ ID NO: 2698257 - DNA, 13 bp, Homo sapiens
tcagactgctggg

SEQ ID NO: 2698258 - DNA, 15 bp, Homo sapiens
tcagactgctgggac

SEQ ID NO: 2698259 - DNA, 21 bp, Homo sapiens
tcagactgctgggactggcca

SEQ ID NO: 2698260 - DNA, 14 bp, Homo sapiens
tcagactggctggc

SEQ ID NO: 2698261 - DNA, 14 bp, Homo sapiens
tcagatgcccagag

SEQ ID NO: 2698262 - DNA, 13 bp, Homo sapiens
tcagccctgaaaa

SEQ ID NO: 2698263 - DNA, 21 bp, Homo sapiens
tcagccttccccctcccaggg

SEQ ID NO: 2698264 - DNA, 21 bp, Homo sapiens
tcagctagttaataattcttt

SEQ ID NO: 2698265 - DNA, 15 bp, Homo sapiens
tcaggcttccttggc

SEQ ID NO: 2698266 - DNA, 17 bp, Homo sapiens
tcagtgctgtggcctgg

SEQ ID NO: 2698267 - DNA, 19 bp, Homo sapiens
tcagtgctgtggcctgggc

SEQ ID NO: 2698268 - DNA, 19 bp, Homo sapiens
tcagttcctctttgcatgg

SEQ ID NO: 2698269 - DNA, 12 bp, Homo sapiens
tcagttgttttc

SEQ ID NO: 2698270 - DNA, 18 bp, Homo sapiens
tcatgacttttccatgta

SEQ ID NO: 2698271 - DNA, 20 bp, Homo sapiens
tcatgccaaagcaaaagaag

SEQ ID NO: 2698272 - DNA, 15 bp, Homo sapiens
tcatgcctggccccc

SEQ ID NO: 2698273 - DNA, 19 bp, Homo sapiens
tcatgcctggcccccctcc

SEQ ID NO: 2698274 - DNA, 22 bp, Homo sapiens
tcatgcctggcccccctccagg

SEQ ID NO: 2698275 - DNA, 23 bp, Homo sapiens
tcatgcctggcccccctccaggc

SEQ ID NO: 2698276 - DNA, 20 bp, Homo sapiens
tccacagtgcccagctaatt

SEQ ID NO: 2698277 - DNA, 10 bp, Homo sapiens
tccactggac

SEQ ID NO: 2698278 - DNA, 12 bp, Homo sapiens
tccactggactt

SEQ ID NO: 2698279 - DNA, 21 bp, Homo sapiens
tccagataattggtggatcaa

SEQ ID NO: 2698280 - DNA, 20 bp, Homo sapiens
tccagcctgggcgacagagc

SEQ ID NO: 2698281 - DNA, 17 bp, Homo sapiens
tccaggcatgctggcct

SEQ ID NO: 2698282 - DNA, 23 bp, Homo sapiens
tccagtgggaggtgagaccacct

SEQ ID NO: 2698283 - DNA, 18 bp, Homo sapiens
tccatgtggccccaggtg

SEQ ID NO: 2698284 - DNA, 19 bp, Homo sapiens
tccattaaaaaaaacagaa

SEQ ID NO: 2698285 - DNA, 13 bp, Homo sapiens
tccattttaacaa

SEQ ID NO: 2698286 - DNA, 12 bp, Homo sapiens
tcccaataaagc

SEQ ID NO: 2698287 - DNA, 15 bp, Homo sapiens
tcccaataaagctgg

SEQ ID NO: 2698288 - DNA, 12 bp, Homo sapiens
tcccaggagggg

SEQ ID NO: 2698289 - DNA, 21 bp, Homo sapiens
tcccaggaggggcctctgaaa

SEQ ID NO: 2698290 - DNA, 16 bp, Homo sapiens
tcccagggccagggcc

SEQ ID NO: 2698291 - DNA, 17 bp, Homo sapiens
tcccagggccagggccc

SEQ ID NO: 2698292 - DNA, 18 bp, Homo sapiens
tccccaccttcaattcct

SEQ ID NO: 2698293 - DNA, 22 bp, Homo sapiens
tccccaccttcaattcctgggc

SEQ ID NO: 2698294 - DNA, 19 bp, Homo sapiens
tccccattagagtcagcct

SEQ ID NO: 2698295 - DNA, 20 bp, Homo sapiens
tcccgagcaaagtctaaagt

SEQ ID NO: 2698296 - DNA, 17 bp, Homo sapiens
tccctctgacctgcagg

SEQ ID NO: 2698297 - DNA, 18 bp, Homo sapiens
tccctctgacctgcaggc

SEQ ID NO: 2698298 - DNA, 17 bp, Homo sapiens
tccctgactctctgtga

SEQ ID NO: 2698299 - DNA, 17 bp, Homo sapiens
tccgccttcactccggt

SEQ ID NO: 2698300 - DNA, 15 bp, Homo sapiens
tccggtgtgcctgca

SEQ ID NO: 2698301 - DNA, 19 bp, Homo sapiens
tccggtgtgcctgcagccc

SEQ ID NO: 2698302 - DNA, 17 bp, Homo sapiens
tcctgcaatctccaggg

SEQ ID NO: 2698303 - DNA, 19 bp, Homo sapiens
tcctgcaatctccagggct

SEQ ID NO: 2698304 - DNA, 20 bp, Homo sapiens
tcctgcaatctccagggctg

SEQ ID NO: 2698305 - DNA, 21 bp, Homo sapiens
tcctgcaatctccagggctgc

SEQ ID NO: 2698306 - DNA, 22 bp, Homo sapiens
tcctggaaaggctcagtctcag

SEQ ID NO: 2698307 - DNA, 19 bp, Homo sapiens
tcctgggagaacctcaggc

SEQ ID NO: 2698308 - DNA, 20 bp, Homo sapiens
tcctgggagaacctcaggct

SEQ ID NO: 2698309 - DNA, 18 bp, Homo sapiens
tcctggggctctgtgcag

SEQ ID NO: 2698310 - DNA, 19 bp, Homo sapiens
tcctggggctctgtgcagg

SEQ ID NO: 2698311 - DNA, 16 bp, Homo sapiens
tcctgtaaaatccatt

SEQ ID NO: 2698312 - DNA, 20 bp, Homo sapiens
tccttcaagttagctcagga

SEQ ID NO: 2698313 - DNA, 22 bp, Homo sapiens
tccttcctacacccttggactt

SEQ ID NO: 2698314 - DNA, 15 bp, Homo sapiens
tccttctgccttttt

SEQ ID NO: 2698315 - DNA, 17 bp, Homo sapiens
tccttgctgtcctaggc

SEQ ID NO: 2698316 - DNA, 19 bp, Homo sapiens
tccttgctgtcctaggcca

SEQ ID NO: 2698317 - DNA, 21 bp, Homo sapiens
tccttgctgtcctaggccaca

SEQ ID NO: 2698318 - DNA, 22 bp, Homo sapiens
tcctttcagggaatttcaggaa

SEQ ID NO: 2698319 - DNA, 16 bp, Homo sapiens
tcgagaccagcctggc

SEQ ID NO: 2698320 - DNA, 18 bp, Homo sapiens
tcggggcatgctggggca

SEQ ID NO: 2698321 - DNA, 16 bp, Homo sapiens
tcgtggacacctgccc

SEQ ID NO: 2698322 - DNA, 17 bp, Homo sapiens
tcgtggacacctgccct

SEQ ID NO: 2698323 - DNA, 20 bp, Homo sapiens
tcgtggacacctgccctgcc

SEQ ID NO: 2698324 - DNA, 22 bp, Homo sapiens
tcgtgggtgtgtgtagccaagg

SEQ ID NO: 2698325 - DNA, 12 bp, Homo sapiens
tctaaagtttac

SEQ ID NO: 2698326 - DNA, 13 bp, Homo sapiens
tctaaagtttaca

SEQ ID NO: 2698327 - DNA, 17 bp, Homo sapiens
tctaaagtttacagtaa

SEQ ID NO: 2698328 - DNA, 22 bp, Homo sapiens
tctaaagtttacagtaaataaa

SEQ ID NO: 2698329 - DNA, 19 bp, Homo sapiens
tctaactagaaatctgcca

SEQ ID NO: 2698330 - DNA, 13 bp, Homo sapiens
tctaccctgaaag

SEQ ID NO: 2698331 - DNA, 14 bp, Homo sapiens
tctcagtgctctcc

SEQ ID NO: 2698332 - DNA, 17 bp, Homo sapiens
tctccagggctgcccct

SEQ ID NO: 2698333 - DNA, 12 bp, Homo sapiens
tctccccctggg

SEQ ID NO: 2698334 - DNA, 14 bp, Homo sapiens
tctccccctgggct

SEQ ID NO: 2698335 - DNA, 24 bp, Homo sapiens
tctcctaccccacctcatgcctgg

SEQ ID NO: 2698336 - DNA, 17 bp, Homo sapiens
tctcggaaggctggctg

SEQ ID NO: 2698337 - DNA, 21 bp, Homo sapiens
tctcggacctttcagctgtga

SEQ ID NO: 2698338 - DNA, 20 bp, Homo sapiens
tctctctactcctacctcag

SEQ ID NO: 2698339 - DNA, 15 bp, Homo sapiens
tctgaaagaatcatt

SEQ ID NO: 2698340 - DNA, 12 bp, Homo sapiens
tctgacctgcag

SEQ ID NO: 2698341 - DNA, 21 bp, Homo sapiens
tctgacctgcaggccaagagc

SEQ ID NO: 2698342 - DNA, 18 bp, Homo sapiens
tctgcccacattggaccc

SEQ ID NO: 2698343 - DNA, 20 bp, Homo sapiens
tctgccccagctctggcttc

SEQ ID NO: 2698344 - DNA, 17 bp, Homo sapiens
tctgctatattttcatg

SEQ ID NO: 2698345 - DNA, 12 bp, Homo sapiens
tctggagccctt

SEQ ID NO: 2698346 - DNA, 12 bp, Homo sapiens
tctgggccaagt

SEQ ID NO: 2698347 - DNA, 15 bp, Homo sapiens
tctgtctgtctgtcc

SEQ ID NO: 2698348 - DNA, 18 bp, Homo sapiens
tcttcccccactcctctt

SEQ ID NO: 2698349 - DNA, 19 bp, Homo sapiens
tcttctacttgtttaacat

SEQ ID NO: 2698350 - DNA, 15 bp, Homo sapiens
tgaaaagctaccctg

SEQ ID NO: 2698351 - DNA, 18 bp, Homo sapiens
tgaaagtcagatgcccag

SEQ ID NO: 2698352 - DNA, 16 bp, Homo sapiens
tgaacttgaggacaca

SEQ ID NO: 2698353 - DNA, 19 bp, Homo sapiens
tgaagacccagtgtaaaga

SEQ ID NO: 2698354 - DNA, 23 bp, Homo sapiens
tgaagacccagtgtaaagaataa

SEQ ID NO: 2698355 - DNA, 20 bp, Homo sapiens
tgaagccactgaagctggga

SEQ ID NO: 2698356 - DNA, 19 bp, Homo sapiens
tgaagggtgacatcccagg

SEQ ID NO: 2698357 - DNA, 23 bp, Homo sapiens
tgaagggtgacatcccaggaggg

SEQ ID NO: 2698358 - DNA, 13 bp, Homo sapiens
gactctctgtgac

SEQ ID NO: 2698359 - DNA, 15 bp, Homo sapiens
gactctctgtgacct

SEQ ID NO: 2698360 - DNA, 19 bp, Homo sapiens
gactctgaggctctttctg

SEQ ID NO: 2698361 - DNA, 22 bp, Homo sapiens
gactctgaggctctttctgggc

SEQ ID NO: 2698362 - DNA, 18 bp, Homo sapiens
gactctgtggggccttgg

SEQ ID NO: 2698363 - DNA, 22 bp, Homo sapiens
gactgagtcctcgtagccatct

SEQ ID NO: 2698364 - DNA, 23 bp, Homo sapiens
gacttgaggattttgagtatctc

SEQ ID NO: 2698365 - DNA, 14 bp, Homo sapiens
gagaacctcaggct

SEQ ID NO: 2698366 - DNA, 14 bp, Homo sapiens
gagaccagcctggc

SEQ ID NO: 2698367 - DNA, 16 bp, Homo sapiens
gagacggctggacctg

SEQ ID NO: 2698368 - DNA, 23 bp, Homo sapiens
gagactgcgggatggtcctgggg

SEQ ID NO: 2698369 - DNA, 10 bp, Homo sapiens
gagagcccag

SEQ ID NO: 2698370 - DNA, 11 bp, Homo sapiens
gagagcccagc

SEQ ID NO: 2698371 - DNA, 13 bp, Homo sapiens
gagatgactgagt

SEQ ID NO: 2698372 - DNA, 16 bp, Homo sapiens
gagatgactgagtcct

SEQ ID NO: 2698373 - DNA, 20 bp, Homo sapiens
gagcaacagagtgagaccct

SEQ ID NO: 2698374 - DNA, 16 bp, Homo sapiens
gagcaggggcagggtg

SEQ ID NO: 2698375 - DNA, 12 bp, Homo sapiens
gagcccaggagt

SEQ ID NO: 2698376 - DNA, 13 bp, Homo sapiens
gagccctggcagg

SEQ ID NO: 2698377 - DNA, 12 bp, Homo sapiens
gaggacacatgt

SEQ ID NO: 2698378 - DNA, 14 bp, Homo sapiens
gaggacacatgtcc

SEQ ID NO: 2698379 - DNA, 13 bp, Homo sapiens
gaggactccctcc

SEQ ID NO: 2698380 - DNA, 21 bp, Homo sapiens
gaggactccctccatgtggcc

SEQ ID NO: 2698381 - DNA, 16 bp, Homo sapiens
gaggatcactggagcc

SEQ ID NO: 2698382 - DNA, 13 bp, Homo sapiens
gaggattttgagt

SEQ ID NO: 2698383 - DNA, 12 bp, Homo sapiens
gaggcgggtgga

SEQ ID NO: 2698384 - DNA, 17 bp, Homo sapiens
gagggatgctgcctgag

SEQ ID NO: 2698385 - DNA, 20 bp, Homo sapiens
gagggatgctgcctgagtca

SEQ ID NO: 2698386 - DNA, 16 bp, Homo sapiens
gagggcccaggcaggc

SEQ ID NO: 2698387 - DNA, 12 bp, Homo sapiens
gaggggctcctg

SEQ ID NO: 2698388 - DNA, 16 bp, Homo sapiens
gagggtaataaactta

SEQ ID NO: 2698389 - DNA, 18 bp, Homo sapiens
gagggtgggagagcccag

SEQ ID NO: 2698390 - DNA, 22 bp, Homo sapiens
gaggttaggagttcgagaccag

SEQ ID NO: 2698391 - DNA, 13 bp, Homo sapiens
gaggttgcaggga

SEQ ID NO: 2698392 - DNA, 20 bp, Homo sapiens
gagtcacccatgaagacagg

SEQ ID NO: 2698393 - DNA, 23 bp, Homo sapiens
tgaataattttctggcactggtt

SEQ ID NO: 2698394 - DNA, 20 bp, Homo sapiens
tgaatgccttccgggccggg

SEQ ID NO: 2698395 - DNA, 15 bp, Homo sapiens
tgaatggcctgcctt

SEQ ID NO: 2698396 - DNA, 17 bp, Homo sapiens
tgaatggcctgccttga

SEQ ID NO: 2698397 - DNA, 20 bp, Homo sapiens
tgaatttggagactctgtgg

SEQ ID NO: 2698398 - DNA, 19 bp, Homo sapiens
tgacaactgtttaattgaa

SEQ ID NO: 2698399 - DNA, 20 bp, Homo sapiens
tgacatcccaggaggggcct

SEQ ID NO: 2698400 - DNA, 23 bp, Homo sapiens
tgaccctgcgaaggggccctggt

SEQ ID NO: 2698401 - DNA, 11 bp, Homo sapiens
tgacctgcagg

SEQ ID NO: 2698402 - DNA, 15 bp, Homo sapiens
tgactctctgtgacc

SEQ ID NO: 2698403 - DNA, 13 bp, Homo sapiens
tgacttttccatg

SEQ ID NO: 2698404 - DNA, 12 bp, Homo sapiens
tgagaccacctc

SEQ ID NO: 2698405 - DNA, 15 bp, Homo sapiens
tgagaccacctctca

SEQ ID NO: 2698406 - DNA, 15 bp, Homo sapiens
ttagagcttggacag

SEQ ID NO: 2698407 - DNA, 12 bp, Homo sapiens
ttcaataaagct

SEQ ID NO: 2698408 - DNA, 14 bp, Homo sapiens
ttcaattcctgggc

SEQ ID NO: 2698409 - DNA, 21 bp, Homo sapiens
ttcactccggtgtgcctgcag

SEQ ID NO: 2698410 - DNA, 22 bp, Homo sapiens
ttcactccggtgtgcctgcagc

SEQ ID NO: 2698411 - DNA, 23 bp, Homo sapiens
ttcactccggtgtgcctgcagcc

SEQ ID NO: 2698412 - DNA, 22 bp, Homo sapiens
ttcagggaatttcaggaactag

SEQ ID NO: 2698413 - DNA, 11 bp, Homo sapiens
ttccaccctgg

SEQ ID NO: 2698414 - DNA, 16 bp, Homo sapiens
tggcccccctccaggc

SEQ ID NO: 2698415 - DNA, 21 bp, Homo sapiens
tggcccccctccaggcatgct

SEQ ID NO: 2698416 - DNA, 20 bp, Homo sapiens
tggcctcccaataaagctgg

SEQ ID NO: 2698417 - DNA, 22 bp, Homo sapiens
tggcctcccaataaagctggac

SEQ ID NO: 2698418 - DNA, 11 bp, Homo sapiens
tggcctgggca

SEQ ID NO: 2698419 - DNA, 15 bp, Homo sapiens
tgggagaacctcagg

SEQ ID NO: 2698420 - DNA, 23 bp, Homo sapiens
tgggagaacctcaggcttccttg

SEQ ID NO: 2698421 - DNA, 15 bp, Homo sapiens
gggcccgaaagctga

SEQ ID NO: 2698422 - DNA, 21 bp, Homo sapiens
gggcctctgaaatttcccaca

SEQ ID NO: 2698423 - DNA, 11 bp, Homo sapiens
gggctcctgga

SEQ ID NO: 2698424 - DNA, 19 bp, Homo sapiens
ggggaggatcactggagcc

SEQ ID NO: 2698425 - DNA, 11 bp, Homo sapiens
ggggaggggga

SEQ ID NO: 2698426 - DNA, 21 bp, Homo sapiens
ggggctcctggaaaggctcag

SEQ ID NO: 2698427 - DNA, 21 bp, Homo sapiens
gggtaataaacttagaataaa

SEQ ID NO: 2698428 - DNA, 20 bp, Homo sapiens
gggtcctgcaatctccaggg

SEQ ID NO: 2698429 - DNA, 15 bp, Homo sapiens
gggtgacatcccagg

SEQ ID NO: 2698430 - DNA, 14 bp, Homo sapiens
gggtgggagagccc

SEQ ID NO: 2698431 - DNA, 19 bp, Homo sapiens
gggtgggagagcccagcca

SEQ ID NO: 2698432 - DNA, 14 bp, Homo sapiens
gggttcctcttccc

SEQ ID NO: 2698433 - DNA, 17 bp, Homo sapiens
gggttttccaccctgga

SEQ ID NO: 2698434 - DNA, 15 bp, Homo sapiens
ggtaataaacttaga

SEQ ID NO: 2698435 - DNA, 21 bp, Homo sapiens
ggtatgaacttgaggacacat

SEQ ID NO: 2698436 - DNA, 23 bp, Homo sapiens
ggtcctgcaatctccagggctgc

SEQ ID NO: 2698437 - DNA, 15 bp, Homo sapiens
ggtcctggggctctg

SEQ ID NO: 2698438 - DNA, 22 bp, Homo sapiens
ggtcctggggctctgtgcaggg

SEQ ID NO: 2698439 - DNA, 15 bp, Homo sapiens
ggtccttccaggccc

SEQ ID NO: 2698440 - DNA, 14 bp, Homo sapiens
ggtgagaccacctc

SEQ ID NO: 2698441 - DNA, 15 bp, Homo sapiens
ggtgagaccacctct

SEQ ID NO: 2698442 - DNA, 12 bp, Homo sapiens
ggtgccaccaat

SEQ ID NO: 2698443 - DNA, 16 bp, Homo sapiens
ggtgccaccaataaaa

SEQ ID NO: 2698444 - DNA, 23 bp, Homo sapiens
ggtgccaccaataaaaatcctac

SEQ ID NO: 2698445 - DNA, 18 bp, Homo sapiens
ggtggacagtcctgggag

SEQ ID NO: 2698446 - DNA, 16 bp, Homo sapiens
ggtggatcacctgagg

SEQ ID NO: 2698447 - DNA, 15 bp, Homo sapiens
ggtggcagccctgta

SEQ ID NO: 2698448 - DNA, 18 bp, Homo sapiens
ggtggcagccctgtaggg

SEQ ID NO: 2698449 - DNA, 16 bp, Homo sapiens
ggtgggagagcccagc

SEQ ID NO: 2698450 - DNA, 18 bp, Homo sapiens
ggtgggctgagccctggc

SEQ ID NO: 2698451 - DNA, 20 bp, Homo sapiens
ggttaggagttcgagaccag

SEQ ID NO: 2698452 - DNA, 18 bp, Homo sapiens
tatatttactaaaagaat

SEQ ID NO: 2698453 - DNA, 15 bp, Homo sapiens
tatccaccactttaa

SEQ ID NO: 2698454 - DNA, 21 bp, Homo sapiens
tatctgaaggagattttcctt

SEQ ID NO: 2698455 - DNA, 23 bp, Homo sapiens
tatgaacttgaggacacatgtcc

SEQ ID NO: 2698456 - DNA, 17 bp, Homo sapiens
tattagtattattaaca

SEQ ID NO: 2698457 - DNA, 15 bp, Homo sapiens
tattatggaattact

SEQ ID NO: 2698458 - DNA, 22 bp, Homo sapiens
tattcagtgctgtggcctgggc

SEQ ID NO: 2698459 - DNA, 14 bp, Homo sapiens
tatttaacttgagg

SEQ ID NO: 2698460 - DNA, 15 bp, Homo sapiens
tatttactaaaagaa

SEQ ID NO: 2698461 - DNA, 16 bp, Homo sapiens
tatttactaaaagaat

SEQ ID NO: 2698462 - DNA, 13 bp, Homo sapiens
tattttagattac

SEQ ID NO: 2698463 - DNA, 21 bp, Homo sapiens
tattttaggcagggatttgag

SEQ ID NO: 2698464 - DNA, 17 bp, Homo sapiens
tcaagatgtcagactgg

SEQ ID NO: 2698465 - DNA, 16 bp, Homo sapiens
tcaatagtattaacta

SEQ ID NO: 2698466 - DNA, 15 bp, Homo sapiens
tcaatattcaataaa

SEQ ID NO: 2698467 - DNA, 22 bp, Homo sapiens
tcaccgagacggctggacctgc

SEQ ID NO: 2698468 - DNA, 23 bp, Homo sapiens
tcaccgagacggctggacctgca

SEQ ID NO: 2698469 - DNA, 19 bp, Homo sapiens
tcacgcctatgatcccagc

SEQ ID NO: 2698470 - DNA, 14 bp, Homo sapiens
tcactccggtgtgc

SEQ ID NO: 2698471 - DNA, 19 bp, Homo sapiens
tcactccggtgtgcctgca

SEQ ID NO: 2698472 - DNA, 20 bp, Homo sapiens
tcactccggtgtgcctgcag

SEQ ID NO: 2698473 - DNA, 21 bp, Homo sapiens
tcactccggtgtgcctgcagc

SEQ ID NO: 2698474 - DNA, 12 bp, Homo sapiens
tcactggagccc

SEQ ID NO: 2698475 - DNA, 14 bp, Homo sapiens
tcactggagcccag

SEQ ID NO: 2698476 - DNA, 15 bp, Homo sapiens
tcactggagcccagg

SEQ ID NO: 2698477 - DNA, 16 bp, Homo sapiens
tcagactgctgggact

SEQ ID NO: 2698478 - DNA, 23 bp, Homo sapiens
tcagactgctgggactggccagg

SEQ ID NO: 2698479 - DNA, 21 bp, Homo sapiens
tcagactggctggctgcagtg

SEQ ID NO: 2698480 - DNA, 18 bp, Homo sapiens
tcagcctgaggctgagac

SEQ ID NO: 2698481 - DNA, 20 bp, Homo sapiens
tcagcctgaggctgagactg

SEQ ID NO: 2698482 - DNA, 14 bp, Homo sapiens
tcaggcttccttgg

SEQ ID NO: 2698483 - DNA, 23 bp, Homo sapiens
tcaggcttccttggcatcacagg

SEQ ID NO: 2698484 - DNA, 22 bp, Homo sapiens
tcagggaatttcaggaactaga

SEQ ID NO: 2698485 - DNA, 14 bp, Homo sapiens
tcagtgctgtggcc

SEQ ID NO: 2698486 - DNA, 22 bp, Homo sapiens
tcagtgctgtggcctgggcaag

SEQ ID NO: 2698487 - DNA, 17 bp, Homo sapiens
tcatgacttttccatgt

SEQ ID NO: 2698488 - DNA, 17 bp, Homo sapiens
tcatgccaaagcaaaag

SEQ ID NO: 2698489 - DNA, 14 bp, Homo sapiens
tcatgcctggcccc

SEQ ID NO: 2698490 - DNA, 21 bp, Homo sapiens
tcatgcctggcccccctccag

SEQ ID NO: 2698491 - DNA, 15 bp, Homo sapiens
tcatgcttactattt

SEQ ID NO: 2698492 - DNA, 17 bp, Homo sapiens
tccaaccccccacctgc

SEQ ID NO: 2698493 - DNA, 14 bp, Homo sapiens
tccacagccgcagc

SEQ ID NO: 2698494 - DNA, 23 bp, Homo sapiens
tccacctgcctatccatcctgcg

SEQ ID NO: 2698495 - DNA, 16 bp, Homo sapiens
tccactggacttgagc

SEQ ID NO: 2698496 - DNA, 18 bp, Homo sapiens
tccagaaaaccccagcat

SEQ ID NO: 2698497 - DNA, 11 bp, Homo sapiens
tccatgtggcc

SEQ ID NO: 2698498 - DNA, 21 bp, Homo sapiens
tccatgtggccccaggtgcca

SEQ ID NO: 2698499 - DNA, 17 bp, Homo sapiens
tccattttaacaaacaa

SEQ ID NO: 2698500 - DNA, 17 bp, Homo sapiens
tcccaagtgccagtctt

SEQ ID NO: 2698501 - DNA, 16 bp, Homo sapiens
tcccaataaagctgga

SEQ ID NO: 2698502 - DNA, 17 bp, Homo sapiens
tcccaataaagctggac

SEQ ID NO: 2698503 - DNA, 21 bp, Homo sapiens
tcccagctactcagaagcctg

SEQ ID NO: 2698504 - DNA, 23 bp, Homo sapiens
tcccagctactcagaagcctgag

SEQ ID NO: 2698505 - DNA, 20 bp, Homo sapiens
tcccagggccagggccctgc

SEQ ID NO: 2698506 - DNA, 23 bp, Homo sapiens
tccccaccttcaattcctgggcc

SEQ ID NO: 2698507 - DNA, 21 bp, Homo sapiens
tccccattagagtcagccttc

SEQ ID NO: 2698508 - DNA, 22 bp, Homo sapiens
tcccccactcctcttatttgct

SEQ ID NO: 2698509 - DNA, 23 bp, Homo sapiens
tccccctgggctctgccccagct

SEQ ID NO: 2698510 - DNA, 22 bp, Homo sapiens
tccctctcggaaggctggctgg

SEQ ID NO: 2698511 - DNA, 23 bp, Homo sapiens
tccctctcggaaggctggctggg

SEQ ID NO: 2698512 - DNA, 13 bp, Homo sapiens
tccctctgacctg

SEQ ID NO: 2698513 - DNA, 16 bp, Homo sapiens
tccctgactctctgtg

SEQ ID NO: 2698514 - DNA, 20 bp, Homo sapiens
tccctgactctctgtgacct

SEQ ID NO: 2698515 - DNA, 13 bp, Homo sapiens
tcccttgtgtgtg

SEQ ID NO: 2698516 - DNA, 15 bp, Homo sapiens
tcccttgtgtgtgtg

SEQ ID NO: 2698517 - DNA, 21 bp, Homo sapiens
tcctaccccacctcatgcctg

SEQ ID NO: 2698518 - DNA, 12 bp, Homo sapiens
tcctacctcagc

SEQ ID NO: 2698519 - DNA, 13 bp, Homo sapiens
tcctacctcagcc

SEQ ID NO: 2698520 - DNA, 14 bp, Homo sapiens
tcctagaggacctg

SEQ ID NO: 2698521 - DNA, 15 bp, Homo sapiens
tcctagaggacctga

SEQ ID NO: 2698522 - DNA, 15 bp, Homo sapiens
tcctcctcccccaga

SEQ ID NO: 2698523 - DNA, 13 bp, Homo sapiens
tcctcttatttgc

SEQ ID NO: 2698524 - DNA, 14 bp, Homo sapiens
tcctctttgcatgg

SEQ ID NO: 2698525 - DNA, 15 bp, Homo sapiens
tcctgcaatctccag

SEQ ID NO: 2698526 - DNA, 16 bp, Homo sapiens
tcctgcaatctccagg

SEQ ID NO: 2698527 - DNA, 19 bp, Homo sapiens
tcctggaaaggctcagtct

SEQ ID NO: 2698528 - DNA, 18 bp, Homo sapiens
tcctgggagaacctcagg

SEQ ID NO: 2698529 - DNA, 18 bp, Homo sapiens
tccttcaagttagctcag

SEQ ID NO: 2698530 - DNA, 23 bp, Homo sapiens
tccttcaagttagctcaggaggc

SEQ ID NO: 2698531 - DNA, 21 bp, Homo sapiens
tcctttcagggaatttcagga

SEQ ID NO: 2698532 - DNA, 23 bp, Homo sapiens
tcctttcagggaatttcaggaac

SEQ ID NO: 2698533 - DNA, 13 bp, Homo sapiens
tcgagaccagcct

SEQ ID NO: 2698534 - DNA, 19 bp, Homo sapiens
tcgagaccagcctggccaa

SEQ ID NO: 2698535 - DNA, 19 bp, Homo sapiens
tcggaaggctggctgggca

SEQ ID NO: 2698536 - DNA, 17 bp, Homo sapiens
tcggacctttcagctgt

SEQ ID NO: 2698537 - DNA, 16 bp, Homo sapiens
tcggggcatgctgggg

SEQ ID NO: 2698538 - DNA, 17 bp, Homo sapiens
tcggggcatgctggggc

SEQ ID NO: 2698539 - DNA, 16 bp, Homo sapiens
tcgggggtggcaaggg

SEQ ID NO: 2698540 - DNA, 13 bp, Homo sapiens
tcgtggacacctg

SEQ ID NO: 2698541 - DNA, 14 bp, Homo sapiens
tcgtggacacctgc

SEQ ID NO: 2698542 - DNA, 15 bp, Homo sapiens
tcgtggacacctgcc

SEQ ID NO: 2698543 - DNA, 19 bp, Homo sapiens
tcgtggacacctgccctgc

SEQ ID NO: 2698544 - DNA, 19 bp, Homo sapiens
tctaaagtttacagtaaat

SEQ ID NO: 2698545 - DNA, 16 bp, Homo sapiens
tctaatataatgactt

SEQ ID NO: 2698546 - DNA, 19 bp, Homo sapiens
tctactcctacctcagcct

SEQ ID NO: 2698547 - DNA, 22 bp, Homo sapiens
tctactcctacctcagcctaga

SEQ ID NO: 2698548 - DNA, 17 bp, Homo sapiens
tctacttgtttaacatt

SEQ ID NO: 2698549 - DNA, 14 bp, Homo sapiens
tctacttttaaaga

SEQ ID NO: 2698550 - DNA, 17 bp, Homo sapiens
gctatgatcgcgccact

SEQ ID NO: 2698551 - DNA, 15 bp, Homo sapiens
gctcaggaggcttgg

SEQ ID NO: 2698552 - DNA, 16 bp, Homo sapiens
gctcaggaggcttgga

SEQ ID NO: 2698553 - DNA, 21 bp, Homo sapiens
gctcctggaaaggctcagtct

SEQ ID NO: 2698554 - DNA, 18 bp, Homo sapiens
gctctcctaccccacctc

SEQ ID NO: 2698555 - DNA, 19 bp, Homo sapiens
gctctgccccagctctggc

SEQ ID NO: 2698556 - DNA, 14 bp, Homo sapiens
gctctgtgcaggga

SEQ ID NO: 2698557 - DNA, 14 bp, Homo sapiens
gctgagccctggca

SEQ ID NO: 2698558 - DNA, 13 bp, Homo sapiens
gctgaggactccc

SEQ ID NO: 2698559 - DNA, 22 bp, Homo sapiens
gctgaggggaggatcactggag

SEQ ID NO: 2698560 - DNA, 18 bp, Homo sapiens
gctgcacctgccagcctg

SEQ ID NO: 2698561 - DNA, 20 bp, Homo sapiens
gctgcacctgccagcctggc

SEQ ID NO: 2698562 - DNA, 23 bp, Homo sapiens
gctgccatggcgtgtccctctcg

SEQ ID NO: 2698563 - DNA, 15 bp, Homo sapiens
gctgccctgccactt

SEQ ID NO: 2698564 - DNA, 15 bp, Homo sapiens
gctggacaagaagct

SEQ ID NO: 2698565 - DNA, 22 bp, Homo sapiens
gctggacctgcacgccaccgct

SEQ ID NO: 2698566 - DNA, 18 bp, Homo sapiens
gctggcctcccaataaag

SEQ ID NO: 2698567 - DNA, 23 bp, Homo sapiens
gctggcctcccaataaagctgga

SEQ ID NO: 2698568 - DNA, 14 bp, Homo sapiens
gctggctgcagtga

SEQ ID NO: 2698569 - DNA, 18 bp, Homo sapiens
gctgtgaacatggactct

SEQ ID NO: 2698570 - DNA, 12 bp, Homo sapiens
gcttcagcctga

SEQ ID NO: 2698571 - DNA, 23 bp, Homo sapiens
gcttcagcctgaggctgagactg

SEQ ID NO: 2698572 - DNA, 18 bp, Homo sapiens
gcttcagttgttttcccg

SEQ ID NO: 2698573 - DNA, 17 bp, Homo sapiens
gcttctggagcccttgg

SEQ ID NO: 2698574 - DNA, 13 bp, Homo sapiens
gcttggcagctga

SEQ ID NO: 2698575 - DNA, 12 bp, Homo sapiens
ggaaaggctcag

SEQ ID NO: 2698576 - DNA, 23 bp, Homo sapiens
ggaaaggctcagtctcaggagca

SEQ ID NO: 2698577 - DNA, 19 bp, Homo sapiens
ggaatttgtaagtttatgt

SEQ ID NO: 2698578 - DNA, 14 bp, Homo sapiens
ggacaagaagctgc

SEQ ID NO: 2698579 - DNA, 13 bp, Homo sapiens
ggacacatgtcca

SEQ ID NO: 2698580 - DNA, 19 bp, Homo sapiens
ggacacatgtccagtggga

SEQ ID NO: 2698581 - DNA, 12 bp, Homo sapiens
ggacacctgccc

SEQ ID NO: 2698582 - DNA, 14 bp, Homo sapiens
ggacagtcctggga

SEQ ID NO: 2698583 - DNA, 17 bp, Homo sapiens
ggacagtgcttcagcct

SEQ ID NO: 2698584 - DNA, 21 bp, Homo sapiens
ggacagtgcttcagcctgagg

SEQ ID NO: 2698585 - DNA, 17 bp, Homo sapiens
ggacctgagtctgctat

SEQ ID NO: 2698586 - DNA, 15 bp, Homo sapiens
ggacgcgcacacaca

SEQ ID NO: 2698587 - DNA, 18 bp, Homo sapiens
ggacggcattcctgctta

SEQ ID NO: 2698588 - DNA, 19 bp, Homo sapiens
ggactccctccatgtggcc

SEQ ID NO: 2698589 - DNA, 21 bp, Homo sapiens
ggactctgaggctctttctgg

SEQ ID NO: 2698590 - DNA, 18 bp, Homo sapiens
ggacttgaggattttgag

SEQ ID NO: 2698591 - DNA, 23 bp, Homo sapiens
ggagcgcacctgccccctggtgg

SEQ ID NO: 2698592 - DNA, 17 bp, Homo sapiens
ggaggatcactggagcc

SEQ ID NO: 2698593 - DNA, 19 bp, Homo sapiens
ggaggatcactggagccca

SEQ ID NO: 2698594 - DNA, 12 bp, Homo sapiens
ggaggctgaggc

SEQ ID NO: 2698595 - DNA, 21 bp, Homo sapiens
ggagggatgctgcctgagtca

SEQ ID NO: 2698596 - DNA, 14 bp, Homo sapiens
ggaggttgcaggga

SEQ ID NO: 2698597 - DNA, 20 bp, Homo sapiens
ggagttcgagaccagcctgg

SEQ ID NO: 2698598 - DNA, 13 bp, Homo sapiens
ggagtttgaggct

SEQ ID NO: 2698599 - DNA, 13 bp, Homo sapiens
ggatcactggagc

SEQ ID NO: 2698600 - DNA, 19 bp, Homo sapiens
ggatcactggagcccagga

SEQ ID NO: 2698601 - DNA, 22 bp, Homo sapiens
ggatggtcctggggctctgtgc

SEQ ID NO: 2698602 - DNA, 12 bp, Homo sapiens
ggattttgagta

SEQ ID NO: 2698603 - DNA, 22 bp, Homo sapiens
ggcaagtccctgactctctgtg

SEQ ID NO: 2698604 - DNA, 23 bp, Homo sapiens
ggcaagtccctgactctctgtga

SEQ ID NO: 2698605 - DNA, 22 bp, Homo sapiens
ggcacctatagtcccagctact

SEQ ID NO: 2698606 - DNA, 13 bp, Homo sapiens
ggcatgctggcct

SEQ ID NO: 2698607 - DNA, 14 bp, Homo sapiens
ggcatgctggggca

SEQ ID NO: 2698608 - DNA, 16 bp, Homo sapiens
ggccagggccctgcag

SEQ ID NO: 2698609 - DNA, 14 bp, Homo sapiens
ggccaggtgcagtg

SEQ ID NO: 2698610 - DNA, 19 bp, Homo sapiens
ggccagtgtgatcccaagt

SEQ ID NO: 2698611 - DNA, 14 bp, Homo sapiens
ggccccaggtgcca

SEQ ID NO: 2698612 - DNA, 17 bp, Homo sapiens
ggccccaggtgccacca

SEQ ID NO: 2698613 - DNA, 16 bp, Homo sapiens
ggcccccctccaggca

SEQ ID NO: 2698614 - DNA, 14 bp, Homo sapiens
ggcccgaaagctga

SEQ ID NO: 2698615 - DNA, 12 bp, Homo sapiens
ggccctggtcct

SEQ ID NO: 2698616 - DNA, 15 bp, Homo sapiens
ggccctggtccttcc

SEQ ID NO: 2698617 - DNA, 17 bp, Homo sapiens
ggcctcccaataaagct

SEQ ID NO: 2698618 - DNA, 17 bp, Homo sapiens
ggcctctgaaatttccc

SEQ ID NO: 2698619 - DNA, 13 bp, Homo sapiens
ggctcctggaaag

SEQ ID NO: 2698620 - DNA, 12 bp, Homo sapiens
ggctctgcccca

SEQ ID NO: 2698621 - DNA, 20 bp, Homo sapiens
ggctctgccccagctctggc

SEQ ID NO: 2698622 - DNA, 15 bp, Homo sapiens
ggctgagccctggca

SEQ ID NO: 2698623 - DNA, 16 bp, Homo sapiens
ggctgagccctggcag

SEQ ID NO: 2698624 - DNA, 12 bp, Homo sapiens
ggctgccctgcc

SEQ ID NO: 2698625 - DNA, 14 bp, Homo sapiens
ggctggctgcagtg

SEQ ID NO: 2698626 - DNA, 18 bp, Homo sapiens
ggcttctggagcccttgg

SEQ ID NO: 2698627 - DNA, 14 bp, Homo sapiens
ggctttctggagag

SEQ ID NO: 2698628 - DNA, 14 bp, Homo sapiens
gggagaacctcagg

SEQ ID NO: 2698629 - DNA, 16 bp, Homo sapiens
gggagaacctcaggct

SEQ ID NO: 2698630 - DNA, 19 bp, Homo sapiens
gggaggatcactggagccc

SEQ ID NO: 2698631 - DNA, 23 bp, Homo sapiens
gggaggatcactggagcccagga

SEQ ID NO: 2698632 - DNA, 13 bp, Homo sapiens
gggcagagccggg

SEQ ID NO: 2698633 - DNA, 14 bp, Homo sapiens
gggcagagccggga

SEQ ID NO: 2698634 - DNA, 14 bp, Homo sapiens
gggcatgctggggc

SEQ ID NO: 2698635 - DNA, 20 bp, Homo sapiens
gggcatggacgttcggggca

SEQ ID NO: 2698636 - DNA, 20 bp, Homo sapiens
gagagaaaacttatttgagt

SEQ ID NO: 2698637 - DNA, 13 bp, Homo sapiens
gagagcccagcca

SEQ ID NO: 2698638 - DNA, 14 bp, Homo sapiens
gagagtctgtctca

SEQ ID NO: 2698639 - DNA, 21 bp, Homo sapiens
gagatgactgagtcctcgtag

SEQ ID NO: 2698640 - DNA, 13 bp, Homo sapiens
gagcagaggcagc

SEQ ID NO: 2698641 - DNA, 21 bp, Homo sapiens
gagcatggggataaaggagaa

SEQ ID NO: 2698642 - DNA, 22 bp, Homo sapiens
gagcccagccattaccatggag

SEQ ID NO: 2698643 - DNA, 11 bp, Homo sapiens
gaggacacatg

SEQ ID NO: 2698644 - DNA, 19 bp, Homo sapiens
gaggagggatgctgcctga

SEQ ID NO: 2698645 - DNA, 18 bp, Homo sapiens
gaggaggtggcagccctg

SEQ ID NO: 2698646 - DNA, 17 bp, Homo sapiens
gaggatcactggagccc

SEQ ID NO: 2698647 - DNA, 13 bp, Homo sapiens
gagggcccaggca

SEQ ID NO: 2698648 - DNA, 14 bp, Homo sapiens
gaggggcctctgaa

SEQ ID NO: 2698649 - DNA, 13 bp, Homo sapiens
gaggggctcctgg

SEQ ID NO: 2698650 - DNA, 14 bp, Homo sapiens
gaggggctcctgga

SEQ ID NO: 2698651 - DNA, 15 bp, Homo sapiens
gaggggctcctggaa

SEQ ID NO: 2698652 - DNA, 15 bp, Homo sapiens
gaggtgagaccacct

SEQ ID NO: 2698653 - DNA, 21 bp, Homo sapiens
gagtctgctatattttcatga

SEQ ID NO: 2698654 - DNA, 17 bp, Homo sapiens
gagttcgagaccagcct

SEQ ID NO: 2698655 - DNA, 16 bp, Homo sapiens
gagttgtggaaagcct

SEQ ID NO: 2698656 - DNA, 20 bp, Homo sapiens
gagttgtggaaagcctctgc

SEQ ID NO: 2698657 - DNA, 15 bp, Homo sapiens
gataaactaaaagca

SEQ ID NO: 2698658 - DNA, 18 bp, Homo sapiens
gatcactggagcccagga

SEQ ID NO: 2698659 - DNA, 16 bp, Homo sapiens
gatgctgcctgagtca

SEQ ID NO: 2698660 - DNA, 22 bp, Homo sapiens
gatggagcgcacctgccccctg

SEQ ID NO: 2698661 - DNA, 13 bp, Homo sapiens
gatggtcctgggg

SEQ ID NO: 2698662 - DNA, 23 bp, Homo sapiens
gattatttgttatttgtacagtt

SEQ ID NO: 2698663 - DNA, 15 bp, Homo sapiens
gattctgggaggaag

SEQ ID NO: 2698664 - DNA, 14 bp, Homo sapiens
gattttgagtatct

SEQ ID NO: 2698665 - DNA, 12 bp, Homo sapiens
gattttgcacaa

SEQ ID NO: 2698666 - DNA, 18 bp, Homo sapiens
gcaaaagaagtaaaagct

SEQ ID NO: 2698667 - DNA, 14 bp, Homo sapiens
gcaaagtctaaagt

SEQ ID NO: 2698668 - DNA, 16 bp, Homo sapiens
gcaaagtctaaagttt

SEQ ID NO: 2698669 - DNA, 13 bp, Homo sapiens
gcacctgccagcc

SEQ ID NO: 2698670 - DNA, 16 bp, Homo sapiens
gcacctgccagcctgg

SEQ ID NO: 2698671 - DNA, 21 bp, Homo sapiens
gcacctgtactcaggaggctg

SEQ ID NO: 2698672 - DNA, 14 bp, Homo sapiens
gcactccagcctgg

SEQ ID NO: 2698673 - DNA, 14 bp, Homo sapiens
gcactggccccacc

SEQ ID NO: 2698674 - DNA, 15 bp, Homo sapiens
gcactgtatgctgga

SEQ ID NO: 2698675 - DNA, 16 bp, Homo sapiens
gcactttgggaggctg

SEQ ID NO: 2698676 - DNA, 20 bp, Homo sapiens
gcactttgggaggctgaggc

SEQ ID NO: 2698677 - DNA, 21 bp, Homo sapiens
gcactttgggaggctgaggcg

SEQ ID NO: 2698678 - DNA, 22 bp, Homo sapiens
gcagaaggaagggcatccttct

SEQ ID NO: 2698679 - DNA, 12 bp, Homo sapiens
gcagaggggctt

SEQ ID NO: 2698680 - DNA, 22 bp, Homo sapiens
gcagcgagctatgatcgcgcca

SEQ ID NO: 2698681 - DNA, 14 bp, Homo sapiens
gcagggatttgagg

SEQ ID NO: 2698682 - DNA, 14 bp, Homo sapiens
gcatcacagggcag

SEQ ID NO: 2698683 - DNA, 21 bp, Homo sapiens
gcatcacagggcagagccggg

SEQ ID NO: 2698684 - DNA, 17 bp, Homo sapiens
gcatcacctcaggccag

SEQ ID NO: 2698685 - DNA, 15 bp, Homo sapiens
gcatgctggggcaag

SEQ ID NO: 2698686 - DNA, 13 bp, Homo sapiens
gcatggaatttgt

SEQ ID NO: 2698687 - DNA, 22 bp, Homo sapiens
gcatggggataaaggagaaggc

SEQ ID NO: 2698688 - DNA, 17 bp, Homo sapiens
gccaaactctgccagcc

SEQ ID NO: 2698689 - DNA, 16 bp, Homo sapiens
gccaaagcaaaagaag

SEQ ID NO: 2698690 - DNA, 21 bp, Homo sapiens
gccaaagcaaaagaagtaaaa

SEQ ID NO: 2698691 - DNA, 23 bp, Homo sapiens
gccaacgacaaagccaaactctg

SEQ ID NO: 2698692 - DNA, 16 bp, Homo sapiens
gccaagagcagaggca

SEQ ID NO: 2698693 - DNA, 23 bp, Homo sapiens
gccaaggtgggctgagccctggc

SEQ ID NO: 2698694 - DNA, 19 bp, Homo sapiens
gccacaccatctcctttca

SEQ ID NO: 2698695 - DNA, 13 bp, Homo sapiens
gccaccaataaaa

SEQ ID NO: 2698696 - DNA, 14 bp, Homo sapiens
gccaccaataaaaa

SEQ ID NO: 2698697 - DNA, 22 bp, Homo sapiens
gccaccatattcagtgctgtgg

SEQ ID NO: 2698698 - DNA, 23 bp, Homo sapiens
gccaccatattcagtgctgtggc

SEQ ID NO: 2698699 - DNA, 15 bp, Homo sapiens
gccaccgctgccttt

SEQ ID NO: 2698700 - DNA, 12 bp, Homo sapiens
gccacctgtctg

SEQ ID NO: 2698701 - DNA, 19 bp, Homo sapiens
gccactacactccagcctg

SEQ ID NO: 2698702 - DNA, 21 bp, Homo sapiens
gccactacactccagcctgag

SEQ ID NO: 2698703 - DNA, 17 bp, Homo sapiens
gccactgaagctgggat

SEQ ID NO: 2698704 - DNA, 18 bp, Homo sapiens
gccactgcactccagcct

SEQ ID NO: 2698705 - DNA, 19 bp, Homo sapiens
gccactgcactccagcctg

SEQ ID NO: 2698706 - DNA, 20 bp, Homo sapiens
gccactgcactccagcctgg

SEQ ID NO: 2698707 - DNA, 16 bp, Homo sapiens
gccagcctggcttctg

SEQ ID NO: 2698708 - DNA, 13 bp, Homo sapiens
gccagtcttgtgt

SEQ ID NO: 2698709 - DNA, 17 bp, Homo sapiens
gccagtgtgatcccaag

SEQ ID NO: 2698710 - DNA, 17 bp, Homo sapiens
gccatggcgtgtccctc

SEQ ID NO: 2698711 - DNA, 16 bp, Homo sapiens
gccattaccatggaga

SEQ ID NO: 2698712 - DNA, 21 bp, Homo sapiens
gcccagagggcccaggcaggc

SEQ ID NO: 2698713 - DNA, 20 bp, Homo sapiens
gcccagccattaccatggag

SEQ ID NO: 2698714 - DNA, 13 bp, Homo sapiens
gcccagctgcacc

SEQ ID NO: 2698715 - DNA, 15 bp, Homo sapiens
gcccagctgcacctg

SEQ ID NO: 2698716 - DNA, 11 bp, Homo sapiens
ctccccctggg

SEQ ID NO: 2698717 - DNA, 18 bp, Homo sapiens
ctccctctgacctgcagg

SEQ ID NO: 2698718 - DNA, 23 bp, Homo sapiens
ctccggtgtgcctgcagccccgc

SEQ ID NO: 2698719 - DNA, 19 bp, Homo sapiens
ctccgtcatgaatgccttc

SEQ ID NO: 2698720 - DNA, 13 bp, Homo sapiens
ctcctacctcagc

SEQ ID NO: 2698721 - DNA, 15 bp, Homo sapiens
ctcctacctcagcct

SEQ ID NO: 2698722 - DNA, 16 bp, Homo sapiens
ctcctacctcagccta

SEQ ID NO: 2698723 - DNA, 19 bp, Homo sapiens
ctcgccacggggaggggga

SEQ ID NO: 2698724 - DNA, 12 bp, Homo sapiens
ctcgtggacacc

SEQ ID NO: 2698725 - DNA, 14 bp, Homo sapiens
ctcgtggacacctg

SEQ ID NO: 2698726 - DNA, 14 bp, Homo sapiens
ctctagtgccctcc

SEQ ID NO: 2698727 - DNA, 18 bp, Homo sapiens
ctctcaatattcaataaa

SEQ ID NO: 2698728 - DNA, 20 bp, Homo sapiens
ctctcctaccccacctcatg

SEQ ID NO: 2698729 - DNA, 21 bp, Homo sapiens
ctctcctaccccacctcatgc

SEQ ID NO: 2698730 - DNA, 19 bp, Homo sapiens
ctctctactcctacctcag

SEQ ID NO: 2698731 - DNA, 14 bp, Homo sapiens
ctctgaaatttccc

SEQ ID NO: 2698732 - DNA, 20 bp, Homo sapiens
ctctgaaatttcccacaccc

SEQ ID NO: 2698733 - DNA, 14 bp, Homo sapiens
ctctgacctgcagg

SEQ ID NO: 2698734 - DNA, 15 bp, Homo sapiens
ctctgacctgcaggc

SEQ ID NO: 2698735 - DNA, 19 bp, Homo sapiens
ctctgaggctctttctggg

SEQ ID NO: 2698736 - DNA, 12 bp, Homo sapiens
ctctgccccagc

SEQ ID NO: 2698737 - DNA, 19 bp, Homo sapiens
ctctgccccagctctggct

SEQ ID NO: 2698738 - DNA, 21 bp, Homo sapiens
ctctgccccagctctggcttc

SEQ ID NO: 2698739 - DNA, 13 bp, Homo sapiens
ctctgctgccatg

SEQ ID NO: 2698740 - DNA, 15 bp, Homo sapiens
ctctgctgccatggc

SEQ ID NO: 2698741 - DNA, 16 bp, Homo sapiens
ctctttcactcaggct

SEQ ID NO: 2698742 - DNA, 12 bp, Homo sapiens
ctctttctgggc

SEQ ID NO: 2698743 - DNA, 21 bp, Homo sapiens
ctgaagggtgacatcccagga

SEQ ID NO: 2698744 - DNA, 12 bp, Homo sapiens
ctgacctgcagg

SEQ ID NO: 2698745 - DNA, 14 bp, Homo sapiens
ctgagactgcggga

SEQ ID NO: 2698746 - DNA, 16 bp, Homo sapiens
ctgagcaacagagtga

SEQ ID NO: 2698747 - DNA, 13 bp, Homo sapiens
ctgaggactccct

SEQ ID NO: 2698748 - DNA, 15 bp, Homo sapiens
ctgaggctgagactg

SEQ ID NO: 2698749 - DNA, 22 bp, Homo sapiens
ctgaggggaggatcactggagc

SEQ ID NO: 2698750 - DNA, 23 bp, Homo sapiens
ctgaggggaggatcactggagcc

SEQ ID NO: 2698751 - DNA, 22 bp, Homo sapiens
ctgagtctgctatattttcatg

SEQ ID NO: 2698752 - DNA, 13 bp, Homo sapiens
ctgcacctgccag

SEQ ID NO: 2698753 - DNA, 18 bp, Homo sapiens
ctgcacctgccagcctgg

SEQ ID NO: 2698754 - DNA, 20 bp, Homo sapiens
ctgcacgccaccgctgcctt

SEQ ID NO: 2698755 - DNA, 20 bp, Homo sapiens
ctgcactccagcctgggcga

SEQ ID NO: 2698756 - DNA, 20 bp, Homo sapiens
ctgcagaggggctttctgga

SEQ ID NO: 2698757 - DNA, 15 bp, Homo sapiens
ctgcaggccaagagc

SEQ ID NO: 2698758 - DNA, 19 bp, Homo sapiens
ctgcaggccaagagcagag

SEQ ID NO: 2698759 - DNA, 21 bp, Homo sapiens
ctgcaggccaagagcagaggc

SEQ ID NO: 2698760 - DNA, 12 bp, Homo sapiens
ctgccacctgtc

SEQ ID NO: 2698761 - DNA, 13 bp, Homo sapiens
ctgccacctgtct

SEQ ID NO: 2698762 - DNA, 16 bp, Homo sapiens
ctgccacctgtctgtc

SEQ ID NO: 2698763 - DNA, 17 bp, Homo sapiens
ctgccacctgtctgtct

SEQ ID NO: 2698764 - DNA, 12 bp, Homo sapiens
ctgccagcctgg

SEQ ID NO: 2698765 - DNA, 13 bp, Homo sapiens
ctgccagcctggc

SEQ ID NO: 2698766 - DNA, 23 bp, Homo sapiens
ctgccagcctggcttctggagcc

SEQ ID NO: 2698767 - DNA, 21 bp, Homo sapiens
ctgccatggcgtgtccctctc

SEQ ID NO: 2698768 - DNA, 20 bp, Homo sapiens
ctgccatttgcaccctccgc

SEQ ID NO: 2698769 - DNA, 21 bp, Homo sapiens
ctgccatttgcaccctccgcc

SEQ ID NO: 2698770 - DNA, 12 bp, Homo sapiens
ctgccccctggt

SEQ ID NO: 2698771 - DNA, 16 bp, Homo sapiens
ctgccctgccacctgt

SEQ ID NO: 2698772 - DNA, 17 bp, Homo sapiens
ctgccctgccacctgtc

SEQ ID NO: 2698773 - DNA, 21 bp, Homo sapiens
ctgccctgccacctgtctgtc

SEQ ID NO: 2698774 - DNA, 16 bp, Homo sapiens
ctgccctgccactttg

SEQ ID NO: 2698775 - DNA, 17 bp, Homo sapiens
ctgcgaaggggccctgg

SEQ ID NO: 2698776 - DNA, 18 bp, Homo sapiens
ctgcgggatggtcctggg

SEQ ID NO: 2698777 - DNA, 22 bp, Homo sapiens
ctgcgggatggtcctggggctc

SEQ ID NO: 2698778 - DNA, 22 bp, Homo sapiens
ctgctgccatggcgtgtccctc

SEQ ID NO: 2698779 - DNA, 23 bp, Homo sapiens
ctgcttatcaataaacctgtttg

SEQ ID NO: 2698780 - DNA, 13 bp, Homo sapiens
ctggaaaggctca

SEQ ID NO: 2698781 - DNA, 22 bp, Homo sapiens
ctggaaaggctcagtctcagga

SEQ ID NO: 2698782 - DNA, 23 bp, Homo sapiens
ctggaaaggctcagtctcaggag

SEQ ID NO: 2698783 - DNA, 23 bp, Homo sapiens
ctggaatcaagatgtcagactgg

SEQ ID NO: 2698784 - DNA, 14 bp, Homo sapiens
ctggacaagaagct

SEQ ID NO: 2698785 - DNA, 18 bp, Homo sapiens
ctggacaagaagctgcta

SEQ ID NO: 2698786 - DNA, 15 bp, Homo sapiens
ctggacggcattcct

SEQ ID NO: 2698787 - DNA, 15 bp, Homo sapiens
ctggacttgagcttg

SEQ ID NO: 2698788 - DNA, 15 bp, Homo sapiens
ctggagcccttgggt

SEQ ID NO: 2698789 - DNA, 15 bp, Homo sapiens
ctggcccccctccag

SEQ ID NO: 2698790 - DNA, 18 bp, Homo sapiens
ctggcccccctccaggca

SEQ ID NO: 2698791 - DNA, 14 bp, Homo sapiens
ctgggagaacctca

SEQ ID NO: 2698792 - DNA, 15 bp, Homo sapiens
ctgggagaacctcag

SEQ ID NO: 2698793 - DNA, 17 bp, Homo sapiens
ctgggagaacctcaggc

SEQ ID NO: 2698794 - DNA, 14 bp, Homo sapiens
ctgggaggaagcag

SEQ ID NO: 2698795 - DNA, 14 bp, Homo sapiens
ctgggattcctccc

SEQ ID NO: 2698796 - DNA, 15 bp, Homo sapiens
ctgggccaagttcct

SEQ ID NO: 2698797 - DNA, 18 bp, Homo sapiens
ctgggccaagttcctcta

SEQ ID NO: 2698798 - DNA, 23 bp, Homo sapiens
ctgggctctgccccagctctggc

SEQ ID NO: 2698799 - DNA, 14 bp, Homo sapiens
ctggggcaagtccc

SEQ ID NO: 2698800 - DNA, 21 bp, Homo sapiens
ctggggcaagtccctgactct

SEQ ID NO: 2698801 - DNA, 21 bp, Homo sapiens
ctggtaatttgtatctgaagg

SEQ ID NO: 2698802 - DNA, 20 bp, Homo sapiens
ctggtatgaacttgaggaca

SEQ ID NO: 2698803 - DNA, 22 bp, Homo sapiens
ctggtatgaacttgaggacaca

SEQ ID NO: 2698804 - DNA, 23 bp, Homo sapiens
ctggtatgaacttgaggacacat

SEQ ID NO: 2698805 - DNA, 16 bp, Homo sapiens
ctggtccttccaggcc

SEQ ID NO: 2698806 - DNA, 17 bp, Homo sapiens
ctggtggacagtcctgg

SEQ ID NO: 2698807 - DNA, 19 bp, Homo sapiens
ctggtggacagtcctggga

SEQ ID NO: 2698808 - DNA, 21 bp, Homo sapiens
ctgtaaaaagagagaaaactt

SEQ ID NO: 2698809 - DNA, 20 bp, Homo sapiens
ctgtaaaatccatttaatca

SEQ ID NO: 2698810 - DNA, 20 bp, Homo sapiens
ctgtactcaggaggctgagg

SEQ ID NO: 2698811 - DNA, 15 bp, Homo sapiens
ctgtcctaggccaca

SEQ ID NO: 2698812 - DNA, 17 bp, Homo sapiens
ctgtctcaaaccctggc

SEQ ID NO: 2698813 - DNA, 14 bp, Homo sapiens
ctgtctgtctgtcc

SEQ ID NO: 2698814 - DNA, 16 bp, Homo sapiens
ctgtctgtctgtccca

SEQ ID NO: 2698815 - DNA, 15 bp, Homo sapiens
ctgtgcagggaggag

SEQ ID NO: 2698816 - DNA, 22 bp, Homo sapiens
ctgtgcagggaggaggtggcag

SEQ ID NO: 2698817 - DNA, 18 bp, Homo sapiens
ctgtgttgcgtgtcgtgg

SEQ ID NO: 2698818 - DNA, 20 bp, Homo sapiens
cttacttaagtcgggggtgg

SEQ ID NO: 2698819 - DNA, 19 bp, Homo sapiens
cttcaagttagctcaggag

SEQ ID NO: 2698820 - DNA, 14 bp, Homo sapiens
cttcactccggtgt

SEQ ID NO: 2698821 - DNA, 16 bp, Homo sapiens
cttccaggcccccacc

SEQ ID NO: 2698822 - DNA, 19 bp, Homo sapiens
cttccaggcccccaccact

SEQ ID NO: 2698823 - DNA, 19 bp, Homo sapiens
cttccttggcatcacaggg

SEQ ID NO: 2698824 - DNA, 13 bp, Homo sapiens
cttctggagccct

SEQ ID NO: 2698825 - DNA, 13 bp, Homo sapiens
cttgaagccactg

SEQ ID NO: 2698826 - DNA, 16 bp, Homo sapiens
cttgaagccactgaag

SEQ ID NO: 2698827 - DNA, 17 bp, Homo sapiens
cttgaagccactgaagc

SEQ ID NO: 2698828 - DNA, 12 bp, Homo sapiens
cttgagcttggc

SEQ ID NO: 2698829 - DNA, 21 bp, Homo sapiens
cttgagcttggcagctgaact

SEQ ID NO: 2698830 - DNA, 18 bp, Homo sapiens
cttgcccggattctggga

SEQ ID NO: 2698831 - DNA, 17 bp, Homo sapiens
cttgctgtcctaggcca

SEQ ID NO: 2698832 - DNA, 20 bp, Homo sapiens
cttggcatcacagggcagag

SEQ ID NO: 2698833 - DNA, 17 bp, Homo sapiens
cttggttcccttgtgtg

SEQ ID NO: 2698834 - DNA, 21 bp, Homo sapiens
ctttaaaataataatagtact

SEQ ID NO: 2698835 - DNA, 14 bp, Homo sapiens
ctttcagctgtgaa

SEQ ID NO: 2698836 - DNA, 20 bp, Homo sapiens
ctttcagggaatttcaggaa

SEQ ID NO: 2698837 - DNA, 14 bp, Homo sapiens
ctttctttaatagt

SEQ ID NO: 2698838 - DNA, 15 bp, Homo sapiens
cttttctgcagaggg

SEQ ID NO: 2698839 - DNA, 18 bp, Homo sapiens
cctcgtggacacctgccc

SEQ ID NO: 2698840 - DNA, 22 bp, Homo sapiens
cctcgtggacacctgccctgcc

SEQ ID NO: 2698841 - DNA, 22 bp, Homo sapiens
cctctcaatattcaataaagct

SEQ ID NO: 2698842 - DNA, 21 bp, Homo sapiens
cctctgaaatttcccacaccc

SEQ ID NO: 2698843 - DNA, 15 bp, Homo sapiens
cctctgacctgcagg

SEQ ID NO: 2698844 - DNA, 14 bp, Homo sapiens
cctctgctgccatg

SEQ ID NO: 2698845 - DNA, 15 bp, Homo sapiens
cctctttgcatggaa

SEQ ID NO: 2698846 - DNA, 20 bp, Homo sapiens
cctgaagggtgacatcccag

SEQ ID NO: 2698847 - DNA, 16 bp, Homo sapiens
cctgactctctgtgac

SEQ ID NO: 2698848 - DNA, 21 bp, Homo sapiens
cctgaggctgagactgcggga

SEQ ID NO: 2698849 - DNA, 15 bp, Homo sapiens
cctgagtcacccatg

SEQ ID NO: 2698850 - DNA, 18 bp, Homo sapiens
cctgagtcacccatgaag

SEQ ID NO: 2698851 - DNA, 18 bp, Homo sapiens
cctgcaatctccagggct

SEQ ID NO: 2698852 - DNA, 20 bp, Homo sapiens
cctgcaatctccagggctgc

SEQ ID NO: 2698853 - DNA, 23 bp, Homo sapiens
cctgcaatctccagggctgcccc

SEQ ID NO: 2698854 - DNA, 16 bp, Homo sapiens
cctgcacgccaccgct

SEQ ID NO: 2698855 - DNA, 22 bp, Homo sapiens
cctgcaggccaagagcagaggc

SEQ ID NO: 2698856 - DNA, 23 bp, Homo sapiens
cctgccatttgcaccctccgcct

SEQ ID NO: 2698857 - DNA, 15 bp, Homo sapiens
cctgccccctggtgg

SEQ ID NO: 2698858 - DNA, 16 bp, Homo sapiens
cctgccccctggtgga

SEQ ID NO: 2698859 - DNA, 11 bp, Homo sapiens
cctgccctgcc

SEQ ID NO: 2698860 - DNA, 15 bp, Homo sapiens
cctgccctgccacct

SEQ ID NO: 2698861 - DNA, 15 bp, Homo sapiens
cctgccctgccctgc

SEQ ID NO: 2698862 - DNA, 19 bp, Homo sapiens
cctgccttgaagccactga

SEQ ID NO: 2698863 - DNA, 17 bp, Homo sapiens
cctgcgaaggggccctg

SEQ ID NO: 2698864 - DNA, 20 bp, Homo sapiens
cctgcgaaggggccctggtc

SEQ ID NO: 2698865 - DNA, 17 bp, Homo sapiens
cctggaaaggctcagtc

SEQ ID NO: 2698866 - DNA, 23 bp, Homo sapiens
cctggaaaggctcagtctcagga

SEQ ID NO: 2698867 - DNA, 18 bp, Homo sapiens
cctggcccccctccaggc

SEQ ID NO: 2698868 - DNA, 23 bp, Homo sapiens
cctggcccccctccaggcatgct

SEQ ID NO: 2698869 - DNA, 16 bp, Homo sapiens
cctggcctcaagcaat

SEQ ID NO: 2698870 - DNA, 14 bp, Homo sapiens
cctggcttctggag

SEQ ID NO: 2698871 - DNA, 15 bp, Homo sapiens
cctggcttctggagc

SEQ ID NO: 2698872 - DNA, 16 bp, Homo sapiens
cctggcttctggagcc

SEQ ID NO: 2698873 - DNA, 17 bp, Homo sapiens
cctgggagaacctcagg

SEQ ID NO: 2698874 - DNA, 15 bp, Homo sapiens
cctggggctctgtgc

SEQ ID NO: 2698875 - DNA, 18 bp, Homo sapiens
cctggtccttccaggccc

SEQ ID NO: 2698876 - DNA, 20 bp, Homo sapiens
cctggtgcactggccccacc

SEQ ID NO: 2698877 - DNA, 17 bp, Homo sapiens
cctggtggacagtcctg

SEQ ID NO: 2698878 - DNA, 20 bp, Homo sapiens
cctgtctgtctgtctgtccc

SEQ ID NO: 2698879 - DNA, 16 bp, Homo sapiens
cctgtgctgaggactc

SEQ ID NO: 2698880 - DNA, 17 bp, Homo sapiens
cctgtgctgaggactcc

SEQ ID NO: 2698881 - DNA, 17 bp, Homo sapiens
ccttcaagttagctcag

SEQ ID NO: 2698882 - DNA, 14 bp, Homo sapiens
ccttcaattcctgg

SEQ ID NO: 2698883 - DNA, 15 bp, Homo sapiens
ccttcaattcctggg

SEQ ID NO: 2698884 - DNA, 20 bp, Homo sapiens
ccttcaattcctgggcccca

SEQ ID NO: 2698885 - DNA, 14 bp, Homo sapiens
ccttcactccggtg

SEQ ID NO: 2698886 - DNA, 20 bp, Homo sapiens
ccttcactccggtgtgcctg

SEQ ID NO: 2698887 - DNA, 23 bp, Homo sapiens
ccttcactccggtgtgcctgcag

SEQ ID NO: 2698888 - DNA, 20 bp, Homo sapiens
ccttcagatcagccacacct

SEQ ID NO: 2698889 - DNA, 16 bp, Homo sapiens
ccttccccctcccagg

SEQ ID NO: 2698890 - DNA, 18 bp, Homo sapiens
ccttgcccggattctggg

SEQ ID NO: 2698891 - DNA, 19 bp, Homo sapiens
ccttgcccggattctggga

SEQ ID NO: 2698892 - DNA, 19 bp, Homo sapiens
ccttgccttttaaaagaaa

SEQ ID NO: 2698893 - DNA, 16 bp, Homo sapiens
ccttgctgtcctaggc

SEQ ID NO: 2698894 - DNA, 13 bp, Homo sapiens
ccttggacttgag

SEQ ID NO: 2698895 - DNA, 15 bp, Homo sapiens
ccttggacttgagga

SEQ ID NO: 2698896 - DNA, 17 bp, Homo sapiens
ccttggttcccttgtgt

SEQ ID NO: 2698897 - DNA, 20 bp, Homo sapiens
ccttttccaggagttctgaa

SEQ ID NO: 2698898 - DNA, 10 bp, Homo sapiens
cgaaagctga

SEQ ID NO: 2698899 - DNA, 14 bp, Homo sapiens
cgagaccagcctgg

SEQ ID NO: 2698900 - DNA, 17 bp, Homo sapiens
cgagaccagcctggcca

SEQ ID NO: 2698901 - DNA, 17 bp, Homo sapiens
cgagacggctggacctg

SEQ ID NO: 2698902 - DNA, 14 bp, Homo sapiens
cgagagtctgtctc

SEQ ID NO: 2698903 - DNA, 16 bp, Homo sapiens
cgagatcacgccactg

SEQ ID NO: 2698904 - DNA, 20 bp, Homo sapiens
cgagatcacgccactgcact

SEQ ID NO: 2698905 - DNA, 23 bp, Homo sapiens
cgatgaatttggagactctgtgg

SEQ ID NO: 2698906 - DNA, 16 bp, Homo sapiens
cgcacctgccccctgg

SEQ ID NO: 2698907 - DNA, 17 bp, Homo sapiens
cgcacctgccccctggt

SEQ ID NO: 2698908 - DNA, 16 bp, Homo sapiens
cgccacggggaggggg

SEQ ID NO: 2698909 - DNA, 22 bp, Homo sapiens
cgccactacactccagcctgag

SEQ ID NO: 2698910 - DNA, 22 bp, Homo sapiens
cgccactgcactccagcctggg

SEQ ID NO: 2698911 - DNA, 23 bp, Homo sapiens
cgcccagctgcacctgccagcct

SEQ ID NO: 2698912 - DNA, 23 bp, Homo sapiens
cgcgccactacactccagcctga

SEQ ID NO: 2698913 - DNA, 19 bp, Homo sapiens
cggaaggggacgcgggctg

SEQ ID NO: 2698914 - DNA, 12 bp, Homo sapiens
cgggaagcggag

SEQ ID NO: 2698915 - DNA, 14 bp, Homo sapiens
cgggctgccctgcc

SEQ ID NO: 2698916 - DNA, 17 bp, Homo sapiens
cggggcatgctggggca

SEQ ID NO: 2698917 - DNA, 23 bp, Homo sapiens
cggggcgggggcccgaaagctga

SEQ ID NO: 2698918 - DNA, 19 bp, Homo sapiens
cgggggtggcaagggggcg

SEQ ID NO: 2698919 - DNA, 23 bp, Homo sapiens
cgggggtggcaagggggcggggc

SEQ ID NO: 2698920 - DNA, 17 bp, Homo sapiens
cggtgtgcctgcagccc

SEQ ID NO: 2698921 - DNA, 13 bp, Homo sapiens
cgtggacacctgc

SEQ ID NO: 2698922 - DNA, 18 bp, Homo sapiens
cgtggacacctgccctgc

SEQ ID NO: 2698923 - DNA, 23 bp, Homo sapiens
cgtgggtgtgtgtagccaaggtc

SEQ ID NO: 2698924 - DNA, 15 bp, Homo sapiens
cgtgtcgtgggtgtg

SEQ ID NO: 2698925 - DNA, 10 bp, Homo sapiens
ctaaaagaat

SEQ ID NO: 2698926 - DNA, 13 bp, Homo sapiens
ctaaagtttacag

SEQ ID NO: 2698927 - DNA, 22 bp, Homo sapiens
ctaattcacaaaaaaagtaatt

SEQ ID NO: 2698928 - DNA, 20 bp, Homo sapiens
ctacacccttggacttgagg

SEQ ID NO: 2698929 - DNA, 16 bp, Homo sapiens
ctacactccagcctga

SEQ ID NO: 2698930 - DNA, 18 bp, Homo sapiens
ctacactccagcctgagc

SEQ ID NO: 2698931 - DNA, 11 bp, Homo sapiens
ctacctcagcc

SEQ ID NO: 2698932 - DNA, 14 bp, Homo sapiens
ctacctcagcctag

SEQ ID NO: 2698933 - DNA, 17 bp, Homo sapiens
ctactcctacctcagcc

SEQ ID NO: 2698934 - DNA, 18 bp, Homo sapiens
ctactcctacctcagcct

SEQ ID NO: 2698935 - DNA, 21 bp, Homo sapiens
ctactcctacctcagcctaga

SEQ ID NO: 2698936 - DNA, 14 bp, Homo sapiens
ctacttgtttaaca

SEQ ID NO: 2698937 - DNA, 15 bp, Homo sapiens
ctacttgtttaacat

SEQ ID NO: 2698938 - DNA, 19 bp, Homo sapiens
ctagcagagcaggggcagg

SEQ ID NO: 2698939 - DNA, 23 bp, Homo sapiens
ctagcagagcaggggcagggtga

SEQ ID NO: 2698940 - DNA, 12 bp, Homo sapiens
ctaggactctga

SEQ ID NO: 2698941 - DNA, 12 bp, Homo sapiens
ctagtactatta

SEQ ID NO: 2698942 - DNA, 22 bp, Homo sapiens
ctatgatcccagcactttggga

SEQ ID NO: 2698943 - DNA, 20 bp, Homo sapiens
ctatttttattttaaaataa

SEQ ID NO: 2698944 - DNA, 13 bp, Homo sapiens
ctcaaaaatgatt

SEQ ID NO: 2698945 - DNA, 11 bp, Homo sapiens
ctcagaagcct

SEQ ID NO: 2698946 - DNA, 15 bp, Homo sapiens
ctcagaagcctgagg

SEQ ID NO: 2698947 - DNA, 17 bp, Homo sapiens
ctcagaagcctgaggct

SEQ ID NO: 2698948 - DNA, 19 bp, Homo sapiens
ctcaggccaacaagccaac

SEQ ID NO: 2698949 - DNA, 15 bp, Homo sapiens
ctcaggccaggtgca

SEQ ID NO: 2698950 - DNA, 14 bp, Homo sapiens
ctcagtctcaggag

SEQ ID NO: 2698951 - DNA, 15 bp, Homo sapiens
ctcagtctcaggagc

SEQ ID NO: 2698952 - DNA, 16 bp, Homo sapiens
ctcatgcctggccccc

SEQ ID NO: 2698953 - DNA, 21 bp, Homo sapiens
ctcatgcctggcccccctcca

SEQ ID NO: 2698954 - DNA, 13 bp, Homo sapiens
ctccagcctgagc

SEQ ID NO: 2698955 - DNA, 13 bp, Homo sapiens
ctccagcctgggc

SEQ ID NO: 2698956 - DNA, 17 bp, Homo sapiens
ctccaggcatgctggcc

SEQ ID NO: 2698957 - DNA, 23 bp, Homo sapiens
ctccaggcatgctggcctcccaa

SEQ ID NO: 2698958 - DNA, 22 bp, Homo sapiens
ctccatgtggccccaggtgcca

SEQ ID NO: 2698959 - DNA, 18 bp, Homo sapiens
ctcccaataaagctggac

SEQ ID NO: 2698960 - DNA, 22 bp, Homo sapiens
ctcccagggccagggccctgca

SEQ ID NO: 2698961 - DNA, 18 bp, Homo sapiens
catgcctggcccccctcc

SEQ ID NO: 2698962 - DNA, 21 bp, Homo sapiens
catgcctggcccccctccagg

SEQ ID NO: 2698963 - DNA, 22 bp, Homo sapiens
catgcctggcccccctccaggc

SEQ ID NO: 2698964 - DNA, 23 bp, Homo sapiens
catgcctggcccccctccaggca

SEQ ID NO: 2698965 - DNA, 20 bp, Homo sapiens
catgctgatttaccacttat

SEQ ID NO: 2698966 - DNA, 16 bp, Homo sapiens
catgctggcctcccaa

SEQ ID NO: 2698967 - DNA, 20 bp, Homo sapiens
catgctggcctcccaataaa

SEQ ID NO: 2698968 - DNA, 22 bp, Homo sapiens
catgctggcctcccaataaagc

SEQ ID NO: 2698969 - DNA, 16 bp, Homo sapiens
catggaatttgtaagt

SEQ ID NO: 2698970 - DNA, 22 bp, Homo sapiens
catggtgtttaaaatttaaatc

SEQ ID NO: 2698971 - DNA, 19 bp, Homo sapiens
catgtggccccaggtgcca

SEQ ID NO: 2698972 - DNA, 19 bp, Homo sapiens
cattcacaactatgaaatc

SEQ ID NO: 2698973 - DNA, 14 bp, Homo sapiens
catttaatcaatat

SEQ ID NO: 2698974 - DNA, 19 bp, Homo sapiens
ccaagagcagaggcagcga

SEQ ID NO: 2698975 - DNA, 17 bp, Homo sapiens
ccaaggtgggctgagcc

SEQ ID NO: 2698976 - DNA, 14 bp, Homo sapiens
ccaataaaaatcct

SEQ ID NO: 2698977 - DNA, 13 bp, Homo sapiens
ccaataaagctgg

SEQ ID NO: 2698978 - DNA, 14 bp, Homo sapiens
ccaataaagctgga

SEQ ID NO: 2698979 - DNA, 15 bp, Homo sapiens
ccacagccgcagcct

SEQ ID NO: 2698980 - DNA, 19 bp, Homo sapiens
ccacagtgcccagctaatt

SEQ ID NO: 2698981 - DNA, 11 bp, Homo sapiens
ccaccaataaa

SEQ ID NO: 2698982 - DNA, 22 bp, Homo sapiens
ccaccatattcagtgctgtggc

SEQ ID NO: 2698983 - DNA, 22 bp, Homo sapiens
ccaccctcgtggacacctgccc

SEQ ID NO: 2698984 - DNA, 22 bp, Homo sapiens
ccaccgctgccttttgctgctg

SEQ ID NO: 2698985 - DNA, 13 bp, Homo sapiens
ccacctctcaata

SEQ ID NO: 2698986 - DNA, 14 bp, Homo sapiens
ccacctctcaatat

SEQ ID NO: 2698987 - DNA, 23 bp, Homo sapiens
ccacctctcaatattcaataaag

SEQ ID NO: 2698988 - DNA, 15 bp, Homo sapiens
ccacctgcctatcca

SEQ ID NO: 2698989 - DNA, 14 bp, Homo sapiens
ccacctgtctgtct

SEQ ID NO: 2698990 - DNA, 18 bp, Homo sapiens
ccactacactccagcctg

SEQ ID NO: 2698991 - DNA, 16 bp, Homo sapiens
ccactccccaccttca

SEQ ID NO: 2698992 - DNA, 14 bp, Homo sapiens
ccactgcactccag

SEQ ID NO: 2698993 - DNA, 20 bp, Homo sapiens
ccactggacttgagcttggc

SEQ ID NO: 2698994 - DNA, 21 bp, Homo sapiens
ccactttggtacatggccagt

SEQ ID NO: 2698995 - DNA, 13 bp, Homo sapiens
ccagagggcccag

SEQ ID NO: 2698996 - DNA, 17 bp, Homo sapiens
ccagagggcccaggcag

SEQ ID NO: 2698997 - DNA, 21 bp, Homo sapiens
ccagcatccttttctgcagag

SEQ ID NO: 2698998 - DNA, 10 bp, Homo sapiens
ccagcctggc

SEQ ID NO: 2698999 - DNA, 20 bp, Homo sapiens
ccagcctggcttctggagcc

SEQ ID NO: 2699000 - DNA, 14 bp, Homo sapiens
ccagctactcagaa

SEQ ID NO: 2699001 - DNA, 17 bp, Homo sapiens
ccagctactcagaagcc

SEQ ID NO: 2699002 - DNA, 20 bp, Homo sapiens
ccagctactcagaagcctga

SEQ ID NO: 2699003 - DNA, 17 bp, Homo sapiens
ccagctgcacctgccag

SEQ ID NO: 2699004 - DNA, 23 bp, Homo sapiens
ccagctgcacctgccagcctggc

SEQ ID NO: 2699005 - DNA, 18 bp, Homo sapiens
ccaggaggggcctctgaa

SEQ ID NO: 2699006 - DNA, 22 bp, Homo sapiens
ccaggagtttgaggctgcagcg

SEQ ID NO: 2699007 - DNA, 13 bp, Homo sapiens
ccaggcatgctgg

SEQ ID NO: 2699008 - DNA, 16 bp, Homo sapiens
ccaggcatgctggcct

SEQ ID NO: 2699009 - DNA, 14 bp, Homo sapiens
ccagggccagggcc

SEQ ID NO: 2699010 - DNA, 17 bp, Homo sapiens
ccagggccagggccctg

SEQ ID NO: 2699011 - DNA, 15 bp, Homo sapiens
ccagggccctgcaga

SEQ ID NO: 2699012 - DNA, 13 bp, Homo sapiens
ccagggctgcccc

SEQ ID NO: 2699013 - DNA, 19 bp, Homo sapiens
ccagggctgcccctgtagg

SEQ ID NO: 2699014 - DNA, 16 bp, Homo sapiens
ccaggtgccaccaata

SEQ ID NO: 2699015 - DNA, 12 bp, Homo sapiens
ccagtcttgtgt

SEQ ID NO: 2699016 - DNA, 19 bp, Homo sapiens
ccagtgtaaagaataaatg

SEQ ID NO: 2699017 - DNA, 20 bp, Homo sapiens
ccagtgtaaagaataaatga

SEQ ID NO: 2699018 - DNA, 14 bp, Homo sapiens
ccagtgtagccttg

SEQ ID NO: 2699019 - DNA, 15 bp, Homo sapiens
ccagtgtagccttgc

SEQ ID NO: 2699020 - DNA, 18 bp, Homo sapiens
ccatctcctttcagggaa

SEQ ID NO: 2699021 - DNA, 13 bp, Homo sapiens
ccatgaagacagg

SEQ ID NO: 2699022 - DNA, 17 bp, Homo sapiens
ccatgaagacaggacag

SEQ ID NO: 2699023 - DNA, 16 bp, Homo sapiens
ccatgtggccccaggt

SEQ ID NO: 2699024 - DNA, 18 bp, Homo sapiens
ccattcatgccaaagcaa

SEQ ID NO: 2699025 - DNA, 23 bp, Homo sapiens
cccaccactaggactctgaggct

SEQ ID NO: 2699026 - DNA, 22 bp, Homo sapiens
cccaccctcgtggacacctgcc

SEQ ID NO: 2699027 - DNA, 20 bp, Homo sapiens
cccacctcatgcctggcccc

SEQ ID NO: 2699028 - DNA, 10 bp, Homo sapiens
cccagccatt

SEQ ID NO: 2699029 - DNA, 20 bp, Homo sapiens
cccagccattaccatggaga

SEQ ID NO: 2699030 - DNA, 22 bp, Homo sapiens
cccagccattaccatggagaca

SEQ ID NO: 2699031 - DNA, 17 bp, Homo sapiens
cccagctactcagaagc

SEQ ID NO: 2699032 - DNA, 21 bp, Homo sapiens
cccagctactcagaagcctga

SEQ ID NO: 2699033 - DNA, 22 bp, Homo sapiens
cccagctgcacctgccagcctg

SEQ ID NO: 2699034 - DNA, 15 bp, Homo sapiens
cccagggccagggcc

SEQ ID NO: 2699035 - DNA, 17 bp, Homo sapiens
cccagggccagggccct

SEQ ID NO: 2699036 - DNA, 19 bp, Homo sapiens
cccatgaagacaggacagt

SEQ ID NO: 2699037 - DNA, 21 bp, Homo sapiens
ccccaccctcgtggacacctg

SEQ ID NO: 2699038 - DNA, 23 bp, Homo sapiens
ccccaccctcgtggacacctgcc

SEQ ID NO: 2699039 - DNA, 12 bp, Homo sapiens
ccccacctgcca

SEQ ID NO: 2699040 - DNA, 20 bp, Homo sapiens
ccccaggtgccaccaataaa

SEQ ID NO: 2699041 - DNA, 15 bp, Homo sapiens
cccccaccactagga

SEQ ID NO: 2699042 - DNA, 12 bp, Homo sapiens
ccccctccaggc

SEQ ID NO: 2699043 - DNA, 20 bp, Homo sapiens
ccccctccaggcatgctggc

SEQ ID NO: 2699044 - DNA, 21 bp, Homo sapiens
ccccctggtggacagtcctgg

SEQ ID NO: 2699045 - DNA, 17 bp, Homo sapiens
ccccgcccagctgcacc

SEQ ID NO: 2699046 - DNA, 16 bp, Homo sapiens
cccctccaggcatgct

SEQ ID NO: 2699047 - DNA, 12 bp, Homo sapiens
cccctcccaggg

SEQ ID NO: 2699048 - DNA, 23 bp, Homo sapiens
cccctggtgcactggccccaccc

SEQ ID NO: 2699049 - DNA, 15 bp, Homo sapiens
cccctggtggacagt

SEQ ID NO: 2699050 - DNA, 14 bp, Homo sapiens
cccggattctggga

SEQ ID NO: 2699051 - DNA, 11 bp, Homo sapiens
ccctccaggca

SEQ ID NO: 2699052 - DNA, 19 bp, Homo sapiens
ccctccaggcatgctggcc

SEQ ID NO: 2699053 - DNA, 13 bp, Homo sapiens
ccctccgccttca

SEQ ID NO: 2699054 - DNA, 21 bp, Homo sapiens
ccctccgccttcactccggtg

SEQ ID NO: 2699055 - DNA, 16 bp, Homo sapiens
ccctcgtggacacctg

SEQ ID NO: 2699056 - DNA, 23 bp, Homo sapiens
ccctcgtggacacctgccctgcc

SEQ ID NO: 2699057 - DNA, 13 bp, Homo sapiens
ccctgactctctg

SEQ ID NO: 2699058 - DNA, 15 bp, Homo sapiens
ccctgccacctgtct

SEQ ID NO: 2699059 - DNA, 17 bp, Homo sapiens
ccctgccacctgtctgt

SEQ ID NO: 2699060 - DNA, 18 bp, Homo sapiens
ccctgccctgccacctgt

SEQ ID NO: 2699061 - DNA, 20 bp, Homo sapiens
ccctgcgaaggggccctggt

SEQ ID NO: 2699062 - DNA, 21 bp, Homo sapiens
ccctgcgaaggggccctggtc

SEQ ID NO: 2699063 - DNA, 15 bp, Homo sapiens
ccctgggctctgccc

SEQ ID NO: 2699064 - DNA, 13 bp, Homo sapiens
ccctggtccttcc

SEQ ID NO: 2699065 - DNA, 16 bp, Homo sapiens
ccctggtccttccagg

SEQ ID NO: 2699066 - DNA, 17 bp, Homo sapiens
ccctggtccttccaggc

SEQ ID NO: 2699067 - DNA, 17 bp, Homo sapiens
ccctggtggacagtcct

SEQ ID NO: 2699068 - DNA, 18 bp, Homo sapiens
ccctggtggacagtcctg

SEQ ID NO: 2699069 - DNA, 20 bp, Homo sapiens
ccgagcaaagtctaaagttt

SEQ ID NO: 2699070 - DNA, 14 bp, Homo sapiens
ccgcagcctccctc

SEQ ID NO: 2699071 - DNA, 17 bp, Homo sapiens
ccgcccagctgcacctg

SEQ ID NO: 2699072 - DNA, 23 bp, Homo sapiens
ccggtcaccgagacggctggacc

SEQ ID NO: 2699073 - DNA, 13 bp, Homo sapiens
cctatccatcctg

SEQ ID NO: 2699074 - DNA, 23 bp, Homo sapiens
cctatccatcctgcgagctcctt

SEQ ID NO: 2699075 - DNA, 14 bp, Homo sapiens
cctcagcctagacc

SEQ ID NO: 2699076 - DNA, 16 bp, Homo sapiens
cctcagcctagaccct

SEQ ID NO: 2699077 - DNA, 14 bp, Homo sapiens
cctcatgcctggcc

SEQ ID NO: 2699078 - DNA, 17 bp, Homo sapiens
cctccacagccgcagcc

SEQ ID NO: 2699079 - DNA, 22 bp, Homo sapiens
cctccatgtggccccaggtgcc

SEQ ID NO: 2699080 - DNA, 19 bp, Homo sapiens
cctccgccttcactccggt

SEQ ID NO: 2699081 - DNA, 16 bp, Homo sapiens
cctcgtggacacctgc

SEQ ID NO: 2699082 - DNA, 17 bp, Homo sapiens
cctcgtggacacctgcc

SEQ ID NO: 2699083 - DNA, 18 bp, Homo sapiens
caagccaacgacaaagcc

SEQ ID NO: 2699084 - DNA, 21 bp, Homo sapiens
caaggtgggctgagccctggc

SEQ ID NO: 2699085 - DNA, 24 bp, Homo sapiens
caaggtgggctgagccctggcagg

SEQ ID NO: 2699086 - DNA, 20 bp, Homo sapiens
caagtccctgactctctgtg

SEQ ID NO: 2699087 - DNA, 23 bp, Homo sapiens
caagtccctgactctctgtgacc

SEQ ID NO: 2699088 - DNA, 17 bp, Homo sapiens
caagttagctcaggagg

SEQ ID NO: 2699089 - DNA, 15 bp, Homo sapiens
caataaagctgctga

SEQ ID NO: 2699090 - DNA, 17 bp, Homo sapiens
caataaagctgctgaga

SEQ ID NO: 2699091 - DNA, 12 bp, Homo sapiens
caataaagctgg

SEQ ID NO: 2699092 - DNA, 13 bp, Homo sapiens
caataaagctgga

SEQ ID NO: 2699093 - DNA, 17 bp, Homo sapiens
caataaagctggacaag

SEQ ID NO: 2699094 - DNA, 16 bp, Homo sapiens
caatattcaataaagc

SEQ ID NO: 2699095 - DNA, 17 bp, Homo sapiens
caatattcaataaagct

SEQ ID NO: 2699096 - DNA, 16 bp, Homo sapiens
cacaaaaaaagtaatt

SEQ ID NO: 2699097 - DNA, 13 bp, Homo sapiens
cacaccccagcgc

SEQ ID NO: 2699098 - DNA, 21 bp, Homo sapiens
cacagccgcagcctccctctg

SEQ ID NO: 2699099 - DNA, 17 bp, Homo sapiens
cacagggcagagccggg

SEQ ID NO: 2699100 - DNA, 16 bp, Homo sapiens
caccaataaaaatcct

SEQ ID NO: 2699101 - DNA, 20 bp, Homo sapiens
caccactaggactctgaggc

SEQ ID NO: 2699102 - DNA, 15 bp, Homo sapiens
cacccatgaagacag

SEQ ID NO: 2699103 - DNA, 23 bp, Homo sapiens
caccctcgtggacacctgccctg

SEQ ID NO: 2699104 - DNA, 23 bp, Homo sapiens
cacctcaggccaggtgcagtggc

SEQ ID NO: 2699105 - DNA, 16 bp, Homo sapiens
cacctcatgcctggcc

SEQ ID NO: 2699106 - DNA, 13 bp, Homo sapiens
cacctctcaatat

SEQ ID NO: 2699107 - DNA, 20 bp, Homo sapiens
cacctgccagcctggcttct

SEQ ID NO: 2699108 - DNA, 22 bp, Homo sapiens
cacctgccagcctggcttctgg

SEQ ID NO: 2699109 - DNA, 17 bp, Homo sapiens
cacctgccatttgcacc

SEQ ID NO: 2699110 - DNA, 18 bp, Homo sapiens
cacctgccctgccctgcc

SEQ ID NO: 2699111 - DNA, 22 bp, Homo sapiens
cacctgccctgccctgccacct

SEQ ID NO: 2699112 - DNA, 16 bp, Homo sapiens
cacctgtactcaggag

SEQ ID NO: 2699113 - DNA, 13 bp, Homo sapiens
cacctgtctgtct

SEQ ID NO: 2699114 - DNA, 14 bp, Homo sapiens
cacctgtctgtctg

SEQ ID NO: 2699115 - DNA, 22 bp, Homo sapiens
cacctgtctgtctgtctgtccc

SEQ ID NO: 2699116 - DNA, 18 bp, Homo sapiens
caccttcaattcctgggc

SEQ ID NO: 2699117 - DNA, 19 bp, Homo sapiens
cacgcctatgatcccagca

SEQ ID NO: 2699118 - DNA, 22 bp, Homo sapiens
cacgcctatgatcccagcactt

SEQ ID NO: 2699119 - DNA, 18 bp, Homo sapiens
cactacactccagcctga

SEQ ID NO: 2699120 - DNA, 19 bp, Homo sapiens
cactacactccagcctgag

SEQ ID NO: 2699121 - DNA, 18 bp, Homo sapiens
cactaggactctgaggct

SEQ ID NO: 2699122 - DNA, 12 bp, Homo sapiens
cactccagcctg

SEQ ID NO: 2699123 - DNA, 13 bp, Homo sapiens
cactccagcctga

SEQ ID NO: 2699124 - DNA, 14 bp, Homo sapiens
cactccagcctgag

SEQ ID NO: 2699125 - DNA, 15 bp, Homo sapiens
cactccagcctgagc

SEQ ID NO: 2699126 - DNA, 14 bp, Homo sapiens
cactccagcctggg

SEQ ID NO: 2699127 - DNA, 15 bp, Homo sapiens
cactccagcctgggc

SEQ ID NO: 2699128 - DNA, 16 bp, Homo sapiens
cactccagcctgggcg

SEQ ID NO: 2699129 - DNA, 14 bp, Homo sapiens
cactccccaccttc

SEQ ID NO: 2699130 - DNA, 16 bp, Homo sapiens
cactgcactccagcct

SEQ ID NO: 2699131 - DNA, 19 bp, Homo sapiens
cactgcactccagcctggg

SEQ ID NO: 2699132 - DNA, 15 bp, Homo sapiens
cactggagcccagga

SEQ ID NO: 2699133 - DNA, 19 bp, Homo sapiens
cactttaaatggaataatt

SEQ ID NO: 2699134 - DNA, 19 bp, Homo sapiens
cactttggtacatggccag

SEQ ID NO: 2699135 - DNA, 16 bp, Homo sapiens
cagaaattagccgggc

SEQ ID NO: 2699136 - DNA, 14 bp, Homo sapiens
cagaagcctgaggc

SEQ ID NO: 2699137 - DNA, 19 bp, Homo sapiens
cagactatttaacttgagg

SEQ ID NO: 2699138 - DNA, 15 bp, Homo sapiens
cagactgctgggact

SEQ ID NO: 2699139 - DNA, 23 bp, Homo sapiens
cagactgctgggactggccaggt

SEQ ID NO: 2699140 - DNA, 15 bp, Homo sapiens
cagagcaggggcagg

SEQ ID NO: 2699141 - DNA, 18 bp, Homo sapiens
cagagggcccaggcaggc

SEQ ID NO: 2699142 - DNA, 18 bp, Homo sapiens
cagaggggctttctggag

SEQ ID NO: 2699143 - DNA, 23 bp, Homo sapiens
cagaggggtgggttcctcttccc

SEQ ID NO: 2699144 - DNA, 19 bp, Homo sapiens
cagagtgagaccctgtctc

SEQ ID NO: 2699145 - DNA, 19 bp, Homo sapiens
cagatgcccagagggccca

SEQ ID NO: 2699146 - DNA, 20 bp, Homo sapiens
cagcactttgggaggctgag

SEQ ID NO: 2699147 - DNA, 16 bp, Homo sapiens
cagccgcagcctccct

SEQ ID NO: 2699148 - DNA, 21 bp, Homo sapiens
cagcctccctctgacctgcag

SEQ ID NO: 2699149 - DNA, 12 bp, Homo sapiens
cagcctgaggct

SEQ ID NO: 2699150 - DNA, 14 bp, Homo sapiens
cagcctggcttctg

SEQ ID NO: 2699151 - DNA, 15 bp, Homo sapiens
cagcctggcttctgg

SEQ ID NO: 2699152 - DNA, 17 bp, Homo sapiens
cagcctggcttctggag

SEQ ID NO: 2699153 - DNA, 21 bp, Homo sapiens
cagcctggcttctggagccct

SEQ ID NO: 2699154 - DNA, 15 bp, Homo sapiens
cagcctgggcgacag

SEQ ID NO: 2699155 - DNA, 22 bp, Homo sapiens
cagcgcctgtgctgaggactcc

SEQ ID NO: 2699156 - DNA, 23 bp, Homo sapiens
cagctactcagaagcctgaggct

SEQ ID NO: 2699157 - DNA, 17 bp, Homo sapiens
cagctgcacctgccagc

SEQ ID NO: 2699158 - DNA, 18 bp, Homo sapiens
cagctgtgaacatggact

SEQ ID NO: 2699159 - DNA, 12 bp, Homo sapiens
cagcttcagttg

SEQ ID NO: 2699160 - DNA, 21 bp, Homo sapiens
caggacagtgcttcagcctga

SEQ ID NO: 2699161 - DNA, 15 bp, Homo sapiens
caggaggctgagggg

SEQ ID NO: 2699162 - DNA, 17 bp, Homo sapiens
caggaggggcctctgaa

SEQ ID NO: 2699163 - DNA, 12 bp, Homo sapiens
caggagttctga

SEQ ID NO: 2699164 - DNA, 13 bp, Homo sapiens
caggagttctgaa

SEQ ID NO: 2699165 - DNA, 21 bp, Homo sapiens
caggagtttgaggctgcagcg

SEQ ID NO: 2699166 - DNA, 22 bp, Homo sapiens
caggagtttgaggctgcagcga

SEQ ID NO: 2699167 - DNA, 17 bp, Homo sapiens
cagggacggggactggc

SEQ ID NO: 2699168 - DNA, 18 bp, Homo sapiens
cagggaggaggtggcagc

SEQ ID NO: 2699169 - DNA, 21 bp, Homo sapiens
cagggaggaggtggcagccct

SEQ ID NO: 2699170 - DNA, 22 bp, Homo sapiens
cagggaggaggtggcagccctg

SEQ ID NO: 2699171 - DNA, 15 bp, Homo sapiens
cagggcagagccggg

SEQ ID NO: 2699172 - DNA, 18 bp, Homo sapiens
cagggccagggccctgca

SEQ ID NO: 2699173 - DNA, 13 bp, Homo sapiens
cagggccctgcag

SEQ ID NO: 2699174 - DNA, 15 bp, Homo sapiens
cagggccctgcagag

SEQ ID NO: 2699175 - DNA, 12 bp, Homo sapiens
cagggctgcccc

SEQ ID NO: 2699176 - DNA, 13 bp, Homo sapiens
caggtgcagtggc

SEQ ID NO: 2699177 - DNA, 15 bp, Homo sapiens
caggtgcagtggctc

SEQ ID NO: 2699178 - DNA, 18 bp, Homo sapiens
caggtgccaccaataaaa

SEQ ID NO: 2699179 - DNA, 20 bp, Homo sapiens
caggtgccaccaataaaaat

SEQ ID NO: 2699180 - DNA, 20 bp, Homo sapiens
caggttgaggggctcctgga

SEQ ID NO: 2699181 - DNA, 17 bp, Homo sapiens
cagtaaataaattgttt

SEQ ID NO: 2699182 - DNA, 12 bp, Homo sapiens
cagtacttctaa

SEQ ID NO: 2699183 - DNA, 16 bp, Homo sapiens
cagtgacgtgcacctg

SEQ ID NO: 2699184 - DNA, 13 bp, Homo sapiens
cagtgctgtggcc

SEQ ID NO: 2699185 - DNA, 15 bp, Homo sapiens
cagtgctgtggcctg

SEQ ID NO: 2699186 - DNA, 19 bp, Homo sapiens
cagtgctgtggcctgggca

SEQ ID NO: 2699187 - DNA, 16 bp, Homo sapiens
cagtgcttcagcctga

SEQ ID NO: 2699188 - DNA, 20 bp, Homo sapiens
cagtgcttcagcctgaggct

SEQ ID NO: 2699189 - DNA, 20 bp, Homo sapiens
cagtggctcacgcctatgat

SEQ ID NO: 2699190 - DNA, 22 bp, Homo sapiens
cagtgggaggtgagaccacctc

SEQ ID NO: 2699191 - DNA, 19 bp, Homo sapiens
cagtgtagccttgcccgga

SEQ ID NO: 2699192 - DNA, 19 bp, Homo sapiens
cagtgtgatcccaagtgcc

SEQ ID NO: 2699193 - DNA, 22 bp, Homo sapiens
cagtgtgatcccaagtgccagt

SEQ ID NO: 2699194 - DNA, 14 bp, Homo sapiens
cagttgttttcccg

SEQ ID NO: 2699195 - DNA, 13 bp, Homo sapiens
catcacctcaggc

SEQ ID NO: 2699196 - DNA, 19 bp, Homo sapiens
catccaaccccccacctgc

SEQ ID NO: 2699197 - DNA, 22 bp, Homo sapiens
catcccaggaggggcctctgaa

SEQ ID NO: 2699198 - DNA, 24 bp, Homo sapiens
catgaaattgtctagcagagcagg

SEQ ID NO: 2699199 - DNA, 17 bp, Homo sapiens
catgaagacaggacagt

SEQ ID NO: 2699200 - DNA, 20 bp, Homo sapiens
catgaggacatgatggagcg

SEQ ID NO: 2699201 - DNA, 21 bp, Homo sapiens
catgaggacatgatggagcgc

SEQ ID NO: 2699202 - DNA, 22 bp, Homo sapiens
catgaggacatgatggagcgca

SEQ ID NO: 2699203 - DNA, 19 bp, Homo sapiens
catgatggagcgcacctgc

SEQ ID NO: 2699204 - DNA, 19 bp, Homo sapiens
catgccaaagcaaaagaag

SEQ ID NO: 2699205 - DNA, 15 bp, Homo sapiens
agtaaaagctaatta

SEQ ID NO: 2699206 - DNA, 20 bp, Homo sapiens
agtaaaagctaattaggatt

SEQ ID NO: 2699207 - DNA, 15 bp, Homo sapiens
agtaaataaattgtt

SEQ ID NO: 2699208 - DNA, 16 bp, Homo sapiens
agtactattactagta

SEQ ID NO: 2699209 - DNA, 16 bp, Homo sapiens
agtattctcagtgctc

SEQ ID NO: 2699210 - DNA, 16 bp, Homo sapiens
agtcacccatgaagac

SEQ ID NO: 2699211 - DNA, 20 bp, Homo sapiens
agtcacccatgaagacagga

SEQ ID NO: 2699212 - DNA, 14 bp, Homo sapiens
agtcagatgcccag

SEQ ID NO: 2699213 - DNA, 22 bp, Homo sapiens
agtcagccttccccctcccagg

SEQ ID NO: 2699214 - DNA, 22 bp, Homo sapiens
agtcccagctactcagaagcct

SEQ ID NO: 2699215 - DNA, 15 bp, Homo sapiens
agtcctcgtagccat

SEQ ID NO: 2699216 - DNA, 17 bp, Homo sapiens
agtctaaagtttacagt

SEQ ID NO: 2699217 - DNA, 23 bp, Homo sapiens
agtctaaagtttacagtaaataa

SEQ ID NO: 2699218 - DNA, 17 bp, Homo sapiens
agtctgtctcaaaagaa

SEQ ID NO: 2699219 - DNA, 14 bp, Homo sapiens
agtgacgtgcacct

SEQ ID NO: 2699220 - DNA, 17 bp, Homo sapiens
agtgagaccctgtctct

SEQ ID NO: 2699221 - DNA, 21 bp, Homo sapiens
agtgccctccacagccgcagc

SEQ ID NO: 2699222 - DNA, 14 bp, Homo sapiens
agtggctcacgcct

SEQ ID NO: 2699223 - DNA, 17 bp, Homo sapiens
agtgtaaagaataaatg

SEQ ID NO: 2699224 - DNA, 18 bp, Homo sapiens
agtgtaaagaataaatga

SEQ ID NO: 2699225 - DNA, 19 bp, Homo sapiens
agtgtaaagaataaatgaa

SEQ ID NO: 2699226 - DNA, 22 bp, Homo sapiens
agtgtaaagaataaatgaatct

SEQ ID NO: 2699227 - DNA, 16 bp, Homo sapiens
agttagctcaggaggc

SEQ ID NO: 2699228 - DNA, 15 bp, Homo sapiens
agttcctctttgcat

SEQ ID NO: 2699229 - DNA, 21 bp, Homo sapiens
agttcctctttgcatggaatt

SEQ ID NO: 2699230 - DNA, 14 bp, Homo sapiens
agttcgagaccagc

SEQ ID NO: 2699231 - DNA, 19 bp, Homo sapiens
agttcgagaccagcctggc

SEQ ID NO: 2699232 - DNA, 19 bp, Homo sapiens
agttgtggaaagcctctgc

SEQ ID NO: 2699233 - DNA, 22 bp, Homo sapiens
agtttacagtaaataaattgtt

SEQ ID NO: 2699234 - DNA, 15 bp, Homo sapiens
ataaaaataccttaa

SEQ ID NO: 2699235 - DNA, 23 bp, Homo sapiens
ataaaattgtaaaattgtataga

SEQ ID NO: 2699236 - DNA, 14 bp, Homo sapiens
ataaacttagaata

SEQ ID NO: 2699237 - DNA, 15 bp, Homo sapiens
ataaattccactgga

SEQ ID NO: 2699238 - DNA, 13 bp, Homo sapiens
ataaattgtttga

SEQ ID NO: 2699239 - DNA, 20 bp, Homo sapiens
atacaatggtttctgaaaga

SEQ ID NO: 2699240 - DNA, 13 bp, Homo sapiens
atagtactattaa

SEQ ID NO: 2699241 - DNA, 13 bp, Homo sapiens
atatattgaacac

SEQ ID NO: 2699242 - DNA, 12 bp, Homo sapiens
atatattgctgc

SEQ ID NO: 2699243 - DNA, 18 bp, Homo sapiens
atatatttactaaaagaa

SEQ ID NO: 2699244 - DNA, 18 bp, Homo sapiens
atatcagaatcgctaata

SEQ ID NO: 2699245 - DNA, 21 bp, Homo sapiens
atatctattattataaaaata

SEQ ID NO: 2699246 - DNA, 23 bp, Homo sapiens
atatctattattataaaaataat

SEQ ID NO: 2699247 - DNA, 23 bp, Homo sapiens
atatctcaatgtgcaataacttg

SEQ ID NO: 2699248 - DNA, 14 bp, Homo sapiens
atatctttaataag

SEQ ID NO: 2699249 - DNA, 20 bp, Homo sapiens
atatgcatgctgatttacca

SEQ ID NO: 2699250 - DNA, 17 bp, Homo sapiens
atatgctgaattgaaca

SEQ ID NO: 2699251 - DNA, 22 bp, Homo sapiens
atatgtagccttgccttttaaa

SEQ ID NO: 2699252 - DNA, 21 bp, Homo sapiens
atatgttcaccaggagattac

SEQ ID NO: 2699253 - DNA, 15 bp, Homo sapiens
atattcaataaagct

SEQ ID NO: 2699254 - DNA, 14 bp, Homo sapiens
atatttaaatcatt

SEQ ID NO: 2699255 - DNA, 14 bp, Homo sapiens
atatttgtccagat

SEQ ID NO: 2699256 - DNA, 23 bp, Homo sapiens
atattttcatgacttttccatgt

SEQ ID NO: 2699257 - DNA, 18 bp, Homo sapiens
atcaagatgtcagactgg

SEQ ID NO: 2699258 - DNA, 12 bp, Homo sapiens
atcacagggcag

SEQ ID NO: 2699259 - DNA, 15 bp, Homo sapiens
atcacagggcagagc

SEQ ID NO: 2699260 - DNA, 12 bp, Homo sapiens
atcacctcaggc

SEQ ID NO: 2699261 - DNA, 12 bp, Homo sapiens
atcactggagcc

SEQ ID NO: 2699262 - DNA, 15 bp, Homo sapiens
atcccaagtgccagt

SEQ ID NO: 2699263 - DNA, 13 bp, Homo sapiens
atcccaggagggg

SEQ ID NO: 2699264 - DNA, 15 bp, Homo sapiens
atcccaggaggggcc

SEQ ID NO: 2699265 - DNA, 20 bp, Homo sapiens
atctccagggctgcccctgt

SEQ ID NO: 2699266 - DNA, 21 bp, Homo sapiens
atctctctactcctacctcag

SEQ ID NO: 2699267 - DNA, 22 bp, Homo sapiens
atctctctactcctacctcagc

SEQ ID NO: 2699268 - DNA, 23 bp, Homo sapiens
atctctctactcctacctcagcc

SEQ ID NO: 2699269 - DNA, 16 bp, Homo sapiens
atctttgaaagctgaa

SEQ ID NO: 2699270 - DNA, 13 bp, Homo sapiens
atgaaaatgaata

SEQ ID NO: 2699271 - DNA, 20 bp, Homo sapiens
atgaacttgaggacacatgt

SEQ ID NO: 2699272 - DNA, 21 bp, Homo sapiens
atgaagacaggacagtgcttc

SEQ ID NO: 2699273 - DNA, 20 bp, Homo sapiens
atgaatttggagactctgtg

SEQ ID NO: 2699274 - DNA, 21 bp, Homo sapiens
atgaatttggagactctgtgg

SEQ ID NO: 2699275 - DNA, 17 bp, Homo sapiens
atgacttttccatgtat

SEQ ID NO: 2699276 - DNA, 20 bp, Homo sapiens
atgacttttccatgtatcta

SEQ ID NO: 2699277 - DNA, 14 bp, Homo sapiens
atgcataccagtaa

SEQ ID NO: 2699278 - DNA, 23 bp, Homo sapiens
atgcccagagggcccaggcaggc

SEQ ID NO: 2699279 - DNA, 19 bp, Homo sapiens
atgcctggcccccctccag

SEQ ID NO: 2699280 - DNA, 20 bp, Homo sapiens
atgcctggcccccctccagg

SEQ ID NO: 2699281 - DNA, 21 bp, Homo sapiens
atgcctggcccccctccaggc

SEQ ID NO: 2699282 - DNA, 16 bp, Homo sapiens
atgctgaattgaacat

SEQ ID NO: 2699283 - DNA, 12 bp, Homo sapiens
atgctgcctgag

SEQ ID NO: 2699284 - DNA, 13 bp, Homo sapiens
atgctgcctgagt

SEQ ID NO: 2699285 - DNA, 22 bp, Homo sapiens
atgctggacggcattcctgctt

SEQ ID NO: 2699286 - DNA, 22 bp, Homo sapiens
atgctggcctcccaataaagct

SEQ ID NO: 2699287 - DNA, 23 bp, Homo sapiens
atgctggcctcccaataaagctg

SEQ ID NO: 2699288 - DNA, 12 bp, Homo sapiens
atggaatttgta

SEQ ID NO: 2699289 - DNA, 17 bp, Homo sapiens
atggaatttgtaagttt

SEQ ID NO: 2699290 - DNA, 17 bp, Homo sapiens
atggactcttcccccac

SEQ ID NO: 2699291 - DNA, 19 bp, Homo sapiens
atggcctgccttgaagcca

SEQ ID NO: 2699292 - DNA, 15 bp, Homo sapiens
atgtaaaataagtat

SEQ ID NO: 2699293 - DNA, 18 bp, Homo sapiens
atgtggccccaggtgcca

SEQ ID NO: 2699294 - DNA, 18 bp, Homo sapiens
attaaaatgtaggaagaa

SEQ ID NO: 2699295 - DNA, 17 bp, Homo sapiens
attaaagcgcaaatgaa

SEQ ID NO: 2699296 - DNA, 16 bp, Homo sapiens
attacaggattaatat

SEQ ID NO: 2699297 - DNA, 21 bp, Homo sapiens
attacaggattaatatattga

SEQ ID NO: 2699298 - DNA, 15 bp, Homo sapiens
attaccatggagaca

SEQ ID NO: 2699299 - DNA, 14 bp, Homo sapiens
attactagtactat

SEQ ID NO: 2699300 - DNA, 22 bp, Homo sapiens
attatttgttatttgtacagtt

SEQ ID NO: 2699301 - DNA, 12 bp, Homo sapiens
attcaataaagc

SEQ ID NO: 2699302 - DNA, 21 bp, Homo sapiens
attcagtgctgtggcctgggc

SEQ ID NO: 2699303 - DNA, 22 bp, Homo sapiens
attcagtgctgtggcctgggca

SEQ ID NO: 2699304 - DNA, 21 bp, Homo sapiens
attcatgccaaagcaaaagaa

SEQ ID NO: 2699305 - DNA, 19 bp, Homo sapiens
attgctagtactagtacta

SEQ ID NO: 2699306 - DNA, 19 bp, Homo sapiens
attgctattactagtacta

SEQ ID NO: 2699307 - DNA, 22 bp, Homo sapiens
attggagggtgggagagcccag

SEQ ID NO: 2699308 - DNA, 21 bp, Homo sapiens
atttaaatcattttaacttct

SEQ ID NO: 2699309 - DNA, 23 bp, Homo sapiens
atttaaatctgattaatccattt

SEQ ID NO: 2699310 - DNA, 19 bp, Homo sapiens
atttacttaatgggtacaa

SEQ ID NO: 2699311 - DNA, 22 bp, Homo sapiens
atttgtaagtttatgtctaaag

SEQ ID NO: 2699312 - DNA, 15 bp, Homo sapiens
atttgtacagttcag

SEQ ID NO: 2699313 - DNA, 14 bp, Homo sapiens
atttgtatctgaag

SEQ ID NO: 2699314 - DNA, 21 bp, Homo sapiens
atttgtatctgaaggagattt

SEQ ID NO: 2699315 - DNA, 18 bp, Homo sapiens
atttgttatttgtacagt

SEQ ID NO: 2699316 - DNA, 19 bp, Homo sapiens
atttgttatttgtacagtt

SEQ ID NO: 2699317 - DNA, 21 bp, Homo sapiens
attttaggcagggatttgagg

SEQ ID NO: 2699318 - DNA, 21 bp, Homo sapiens
caaaagaaaaaaaaaagcacc

SEQ ID NO: 2699319 - DNA, 18 bp, Homo sapiens
caaagcaaaagaagtaaa

SEQ ID NO: 2699320 - DNA, 22 bp, Homo sapiens
caaagcaaaagaagtaaaagct

SEQ ID NO: 2699321 - DNA, 22 bp, Homo sapiens
caaagccaaactctgccagcca

SEQ ID NO: 2699322 - DNA, 20 bp, Homo sapiens
caaaggagacgggggagcag

SEQ ID NO: 2699323 - DNA, 17 bp, Homo sapiens
caaattggacagaagat

SEQ ID NO: 2699324 - DNA, 12 bp, Homo sapiens
caagaagctgct

SEQ ID NO: 2699325 - DNA, 15 bp, Homo sapiens
caagatgtcagactg

SEQ ID NO: 2699326 - DNA, 19 bp, Homo sapiens
agctggacaagaagctgct

SEQ ID NO: 2699327 - DNA, 15 bp, Homo sapiens
agctgtaaaaagaga

SEQ ID NO: 2699328 - DNA, 11 bp, Homo sapiens
aggacacatgt

SEQ ID NO: 2699329 - DNA, 19 bp, Homo sapiens
aggacagtgcttcagcctg

SEQ ID NO: 2699330 - DNA, 20 bp, Homo sapiens
aggacagtgcttcagcctga

SEQ ID NO: 2699331 - DNA, 16 bp, Homo sapiens
aggagcagcttcagtt

SEQ ID NO: 2699332 - DNA, 13 bp, Homo sapiens
aggaggctgaggg

SEQ ID NO: 2699333 - DNA, 20 bp, Homo sapiens
aggaggtggcagccctgtag

SEQ ID NO: 2699334 - DNA, 13 bp, Homo sapiens
aggagttctgaag

SEQ ID NO: 2699335 - DNA, 20 bp, Homo sapiens
aggagttctgaagctgacag

SEQ ID NO: 2699336 - DNA, 15 bp, Homo sapiens
aggatcactggagcc

SEQ ID NO: 2699337 - DNA, 20 bp, Homo sapiens
aggatcactggagcccagga

SEQ ID NO: 2699338 - DNA, 15 bp, Homo sapiens
aggcagggatttgag

SEQ ID NO: 2699339 - DNA, 16 bp, Homo sapiens
aggcagggatttgagg

SEQ ID NO: 2699340 - DNA, 17 bp, Homo sapiens
aggctcagtctcaggag

SEQ ID NO: 2699341 - DNA, 23 bp, Homo sapiens
aggctcagtctcaggagcatggg

SEQ ID NO: 2699342 - DNA, 17 bp, Homo sapiens
aggctgagactgcggga

SEQ ID NO: 2699343 - DNA, 22 bp, Homo sapiens
aggctgaggggaggatcactgg

SEQ ID NO: 2699344 - DNA, 15 bp, Homo sapiens
agggaatttcaggaa

SEQ ID NO: 2699345 - DNA, 16 bp, Homo sapiens
agggacagtattctca

SEQ ID NO: 2699346 - DNA, 19 bp, Homo sapiens
agggacggggactggccct

SEQ ID NO: 2699347 - DNA, 18 bp, Homo sapiens
agggatgctgcctgagtc

SEQ ID NO: 2699348 - DNA, 12 bp, Homo sapiens
agggatttgagg

SEQ ID NO: 2699349 - DNA, 15 bp, Homo sapiens
agggcagagccggga

SEQ ID NO: 2699350 - DNA, 19 bp, Homo sapiens
agggccagggccctgcaga

SEQ ID NO: 2699351 - DNA, 22 bp, Homo sapiens
agggccagggccctgcagaggg

SEQ ID NO: 2699352 - DNA, 15 bp, Homo sapiens
agggcccaggcaggc

SEQ ID NO: 2699353 - DNA, 22 bp, Homo sapiens
agggctgcccctgtaggttgct

SEQ ID NO: 2699354 - DNA, 20 bp, Homo sapiens
aggggaaaccagtgtagcct

SEQ ID NO: 2699355 - DNA, 23 bp, Homo sapiens
aggggcctctgaaatttcccaca

SEQ ID NO: 2699356 - DNA, 17 bp, Homo sapiens
aggggctttctggagag

SEQ ID NO: 2699357 - DNA, 21 bp, Homo sapiens
agggggacgcgcacacacacc

SEQ ID NO: 2699358 - DNA, 20 bp, Homo sapiens
aggggtgggttcctcttccc

SEQ ID NO: 2699359 - DNA, 21 bp, Homo sapiens
aggggtgggttcctcttcccc

SEQ ID NO: 2699360 - DNA, 15 bp, Homo sapiens
agggtgacatcccag

SEQ ID NO: 2699361 - DNA, 16 bp, Homo sapiens
aggtgcagtggctcac

SEQ ID NO: 2699362 - DNA, 20 bp, Homo sapiens
aggtgccaccaataaaaatc

SEQ ID NO: 2699363 - DNA, 15 bp, Homo sapiens
aggtggcagccctgt

SEQ ID NO: 2699364 - DNA, 15 bp, Homo sapiens
aggtgggctgagccc

SEQ ID NO: 2699365 - DNA, 20 bp, Homo sapiens
aggtgggctgagccctggca

SEQ ID NO: 2699366 - DNA, 13 bp, Homo sapiens
agtaaaagctaat

SEQ ID NO: 2699367 - DNA, 21 bp, Homo sapiens
tctgaggctctttctgggcca

SEQ ID NO: 2699368 - DNA, 15 bp, Homo sapiens
tctgattaatccatt

SEQ ID NO: 2699369 - DNA, 16 bp, Homo sapiens
tctgccccagctctgg

SEQ ID NO: 2699370 - DNA, 17 bp, Homo sapiens
tctgccccagctctggc

SEQ ID NO: 2699371 - DNA, 15 bp, Homo sapiens
tctgcgtctgtgttg

SEQ ID NO: 2699372 - DNA, 19 bp, Homo sapiens
tctgggccaagttcctcta

SEQ ID NO: 2699373 - DNA, 14 bp, Homo sapiens
tctgtctgtcccaa

SEQ ID NO: 2699374 - DNA, 11 bp, Homo sapiens
tcttatttgct

SEQ ID NO: 2699375 - DNA, 21 bp, Homo sapiens
tcttcaaaaggtaaatacaat

SEQ ID NO: 2699376 - DNA, 15 bp, Homo sapiens
tctttgcatggaatt

SEQ ID NO: 2699377 - DNA, 20 bp, Homo sapiens
tgaaaatgaatagagagtat

SEQ ID NO: 2699378 - DNA, 16 bp, Homo sapiens
tgaaacccagtaattc

SEQ ID NO: 2699379 - DNA, 17 bp, Homo sapiens
tgaaagtttgcactgta

SEQ ID NO: 2699380 - DNA, 18 bp, Homo sapiens
tgaacttgaggacacatg

SEQ ID NO: 2699381 - DNA, 19 bp, Homo sapiens
tgaacttgaggacacatgt

SEQ ID NO: 2699382 - DNA, 20 bp, Homo sapiens
tgaacttgaggacacatgtc

SEQ ID NO: 2699383 - DNA, 19 bp, Homo sapiens
tgaagccactgaagctggg

SEQ ID NO: 2699384 - DNA, 16 bp, Homo sapiens
tgaagggtgacatccc

SEQ ID NO: 2699385 - DNA, 18 bp, Homo sapiens
tgaagggtgacatcccag

SEQ ID NO: 2699386 - DNA, 14 bp, Homo sapiens
tgaagtaaattgaa

SEQ ID NO: 2699387 - DNA, 17 bp, Homo sapiens
tgaatttggagactctg

SEQ ID NO: 2699388 - DNA, 13 bp, Homo sapiens
tgacctgccccgc

SEQ ID NO: 2699389 - DNA, 19 bp, Homo sapiens
tgacctgccccgcccagct

SEQ ID NO: 2699390 - DNA, 20 bp, Homo sapiens
tgacctgccccgcccagctg

SEQ ID NO: 2699391 - DNA, 18 bp, Homo sapiens
tgacgtgcacctgtactc

SEQ ID NO: 2699392 - DNA, 18 bp, Homo sapiens
tgacttttccatgtatct

SEQ ID NO: 2699393 - DNA, 22 bp, Homo sapiens
tgacttttccatgtatctacct

SEQ ID NO: 2699394 - DNA, 12 bp, Homo sapiens
tgagaccctgtc

SEQ ID NO: 2699395 - DNA, 23 bp, Homo sapiens
tgagactgcgggatggtcctggg

SEQ ID NO: 2699396 - DNA, 12 bp, Homo sapiens
tgaggacacatg

SEQ ID NO: 2699397 - DNA, 13 bp, Homo sapiens
tgaggacacatgt

SEQ ID NO: 2699398 - DNA, 14 bp, Homo sapiens
tgaggacacatgtc

SEQ ID NO: 2699399 - DNA, 22 bp, Homo sapiens
tgaggggaggatcactggagcc

SEQ ID NO: 2699400 - DNA, 21 bp, Homo sapiens
tgagggtaataaacttagaat

SEQ ID NO: 2699401 - DNA, 23 bp, Homo sapiens
tgatgaaaatgaatagagagtat

SEQ ID NO: 2699402 - DNA, 15 bp, Homo sapiens
tgcacctgccagcct

SEQ ID NO: 2699403 - DNA, 16 bp, Homo sapiens
tgcacctgccagcctg

SEQ ID NO: 2699404 - DNA, 19 bp, Homo sapiens
tgcacctgccagcctggct

SEQ ID NO: 2699405 - DNA, 22 bp, Homo sapiens
tgcacctgccagcctggcttct

SEQ ID NO: 2699406 - DNA, 20 bp, Homo sapiens
tgcacctgtactcaggaggc

SEQ ID NO: 2699407 - DNA, 17 bp, Homo sapiens
tgcactccagcctgggc

SEQ ID NO: 2699408 - DNA, 16 bp, Homo sapiens
tgcactttaaatggaa

SEQ ID NO: 2699409 - DNA, 21 bp, Homo sapiens
tgcagccccgcgcctccttcc

SEQ ID NO: 2699410 - DNA, 20 bp, Homo sapiens
tgcaggccaagagcagaggc

SEQ ID NO: 2699411 - DNA, 14 bp, Homo sapiens
tgcagggagccgag

SEQ ID NO: 2699412 - DNA, 24 bp, Homo sapiens
tgcagggaggaggtggcagccctg

SEQ ID NO: 2699413 - DNA, 19 bp, Homo sapiens
tgcagtgacgtgcacctgt

SEQ ID NO: 2699414 - DNA, 22 bp, Homo sapiens
tgcattcttaatctccactgtt

SEQ ID NO: 2699415 - DNA, 20 bp, Homo sapiens
tgcatttttatcatgtaaca

SEQ ID NO: 2699416 - DNA, 14 bp, Homo sapiens
tgccacacactgtt

SEQ ID NO: 2699417 - DNA, 14 bp, Homo sapiens
tgccaccaataaaa

SEQ ID NO: 2699418 - DNA, 10 bp, Homo sapiens
tgccacctgt

SEQ ID NO: 2699419 - DNA, 12 bp, Homo sapiens
tgccacctgtct

SEQ ID NO: 2699420 - DNA, 17 bp, Homo sapiens
tgccatggcgtgtccct

SEQ ID NO: 2699421 - DNA, 16 bp, Homo sapiens
tgccatttgcaccctc

SEQ ID NO: 2699422 - DNA, 19 bp, Homo sapiens
tgcccagagggcccaggca

SEQ ID NO: 2699423 - DNA, 20 bp, Homo sapiens
tgcccagagggcccaggcag

SEQ ID NO: 2699424 - DNA, 14 bp, Homo sapiens
tgccccagctctgg

SEQ ID NO: 2699425 - DNA, 16 bp, Homo sapiens
tgccccagctctggct

SEQ ID NO: 2699426 - DNA, 19 bp, Homo sapiens
tgccccagctctggcttcc

SEQ ID NO: 2699427 - DNA, 17 bp, Homo sapiens
tgcccggattctgggag

SEQ ID NO: 2699428 - DNA, 21 bp, Homo sapiens
tgccctccacagccgcagcct

SEQ ID NO: 2699429 - DNA, 17 bp, Homo sapiens
tgccctgccacctgtct

SEQ ID NO: 2699430 - DNA, 20 bp, Homo sapiens
tgccctgccacctgtctgtc

SEQ ID NO: 2699431 - DNA, 14 bp, Homo sapiens
tgccctgccctgcc

SEQ ID NO: 2699432 - DNA, 12 bp, Homo sapiens
tgcctggccccc

SEQ ID NO: 2699433 - DNA, 16 bp, Homo sapiens
tgcctggcccccctcc

SEQ ID NO: 2699434 - DNA, 15 bp, Homo sapiens
tgccttgaagccact

SEQ ID NO: 2699435 - DNA, 16 bp, Homo sapiens
tgccttttaaaagaaa

SEQ ID NO: 2699436 - DNA, 18 bp, Homo sapiens
tgctatattttcatgact

SEQ ID NO: 2699437 - DNA, 15 bp, Homo sapiens
tgctgaggactccct

SEQ ID NO: 2699438 - DNA, 17 bp, Homo sapiens
tgctgaggactccctcc

SEQ ID NO: 2699439 - DNA, 22 bp, Homo sapiens
tgctgaggactccctccatgtg

SEQ ID NO: 2699440 - DNA, 17 bp, Homo sapiens
tgctgggactggccagg

SEQ ID NO: 2699441 - DNA, 16 bp, Homo sapiens
tgctgtcctaggccac

SEQ ID NO: 2699442 - DNA, 23 bp, Homo sapiens
tgctgtcctaggccacaccatct

SEQ ID NO: 2699443 - DNA, 12 bp, Homo sapiens
tgctgtggcctg

SEQ ID NO: 2699444 - DNA, 15 bp, Homo sapiens
tgctgtggcctgggc

SEQ ID NO: 2699445 - DNA, 20 bp, Homo sapiens
tggaaagcatcacctcaggc

SEQ ID NO: 2699446 - DNA, 12 bp, Homo sapiens
tggaaagcctct

SEQ ID NO: 2699447 - DNA, 14 bp, Homo sapiens
tggaaagcctctgc

SEQ ID NO: 2699448 - DNA, 16 bp, Homo sapiens
tggaaagcctctgctg

SEQ ID NO: 2699449 - DNA, 18 bp, Homo sapiens
tggaaagcctctgctgcc

SEQ ID NO: 2699450 - DNA, 17 bp, Homo sapiens
tggaaaggctcagtctc

SEQ ID NO: 2699451 - DNA, 21 bp, Homo sapiens
tggaaaggctcagtctcagga

SEQ ID NO: 2699452 - DNA, 13 bp, Homo sapiens
tggacaagaagct

SEQ ID NO: 2699453 - DNA, 15 bp, Homo sapiens
tggacaagaagctgc

SEQ ID NO: 2699454 - DNA, 11 bp, Homo sapiens
tggacacctgc

SEQ ID NO: 2699455 - DNA, 13 bp, Homo sapiens
tggacacctgccc

SEQ ID NO: 2699456 - DNA, 15 bp, Homo sapiens
tggacacctgccctg

SEQ ID NO: 2699457 - DNA, 17 bp, Homo sapiens
tggacacctgccctgcc

SEQ ID NO: 2699458 - DNA, 23 bp, Homo sapiens
tggacacctgccctgccctgcca

SEQ ID NO: 2699459 - DNA, 12 bp, Homo sapiens
tggacagaagat

SEQ ID NO: 2699460 - DNA, 12 bp, Homo sapiens
tggacagtcctg

SEQ ID NO: 2699461 - DNA, 16 bp, Homo sapiens
tggacagtcctgggag

SEQ ID NO: 2699462 - DNA, 21 bp, Homo sapiens
tggagaggagggatgctgcct

SEQ ID NO: 2699463 - DNA, 21 bp, Homo sapiens
tggagcgcacctgccccctgg

SEQ ID NO: 2699464 - DNA, 22 bp, Homo sapiens
tggagcgcacctgccccctggt

SEQ ID NO: 2699465 - DNA, 11 bp, Homo sapiens
tggcagccctg

SEQ ID NO: 2699466 - DNA, 17 bp, Homo sapiens
tggcagccctgtaggga

SEQ ID NO: 2699467 - DNA, 15 bp, Homo sapiens
tggcatcacagggca

SEQ ID NO: 2699468 - DNA, 16 bp, Homo sapiens
tggccagtgtgatccc

SEQ ID NO: 2699469 - DNA, 15 bp, Homo sapiens
tggccccaggtgcca

SEQ ID NO: 2699470 - DNA, 18 bp, Homo sapiens
tggccccaggtgccacca

SEQ ID NO: 2699471 - DNA, 12 bp, Homo sapiens
tggcccccctcc

SEQ ID NO: 2699472 - DNA, 14 bp, Homo sapiens
tggcccccctccag

SEQ ID NO: 2699473 - DNA, 21 bp, Homo sapiens
aaaaagtaagtaccactcagg

SEQ ID NO: 2699474 - DNA, 15 bp, Homo sapiens
aaaacttatttgagt

SEQ ID NO: 2699475 - DNA, 19 bp, Homo sapiens
aaaagagagaaaacttatt

SEQ ID NO: 2699476 - DNA, 23 bp, Homo sapiens
aaaagggacagtattctcagtgc

SEQ ID NO: 2699477 - DNA, 15 bp, Homo sapiens
aaaattgtaaaattg

SEQ ID NO: 2699478 - DNA, 15 bp, Homo sapiens
aaaattgtatagaga

SEQ ID NO: 2699479 - DNA, 13 bp, Homo sapiens
aaacaaaaataaa

SEQ ID NO: 2699480 - DNA, 18 bp, Homo sapiens
aaagaataaatgaatctt

SEQ ID NO: 2699481 - DNA, 17 bp, Homo sapiens
aaagcatcacctcaggc

SEQ ID NO: 2699482 - DNA, 16 bp, Homo sapiens
aaagcctctgctgcca

SEQ ID NO: 2699483 - DNA, 23 bp, Homo sapiens
aaagctgctgagaatctagcctc

SEQ ID NO: 2699484 - DNA, 18 bp, Homo sapiens
aaagctggacaagaagct

SEQ ID NO: 2699485 - DNA, 14 bp, Homo sapiens
aaaggtaaatacaa

SEQ ID NO: 2699486 - DNA, 21 bp, Homo sapiens
aaagtttacagtaaataaatt

SEQ ID NO: 2699487 - DNA, 22 bp, Homo sapiens
aaagtttacagtaaataaattg

SEQ ID NO: 2699488 - DNA, 19 bp, Homo sapiens
aaataataatagtactatt

SEQ ID NO: 2699489 - DNA, 21 bp, Homo sapiens
aaatcgctgctcaaaaatgat

SEQ ID NO: 2699490 - DNA, 16 bp, Homo sapiens
aaatctccaatccaca

SEQ ID NO: 2699491 - DNA, 18 bp, Homo sapiens
aaatgcatttttatcatg

SEQ ID NO: 2699492 - DNA, 22 bp, Homo sapiens
aaatgctgggggtaggtggcta

SEQ ID NO: 2699493 - DNA, 15 bp, Homo sapiens
aacattgctgatttt

SEQ ID NO: 2699494 - DNA, 17 bp, Homo sapiens
aaccagtacttctaaga

SEQ ID NO: 2699495 - DNA, 14 bp, Homo sapiens
aaccagtgtagcct

SEQ ID NO: 2699496 - DNA, 16 bp, Homo sapiens
aactagaaatctgcca

SEQ ID NO: 2699497 - DNA, 13 bp, Homo sapiens
aactatgaaatcg

SEQ ID NO: 2699498 - DNA, 14 bp, Homo sapiens
aactctgccagcca

SEQ ID NO: 2699499 - DNA, 15 bp, Homo sapiens
aacttgaggacacat

SEQ ID NO: 2699500 - DNA, 16 bp, Homo sapiens
aacttgaggacacatg

SEQ ID NO: 2699501 - DNA, 20 bp, Homo sapiens
aacttgaggacacatgtcca

SEQ ID NO: 2699502 - DNA, 19 bp, Homo sapiens
aacttgagggtaataaact

SEQ ID NO: 2699503 - DNA, 15 bp, Homo sapiens
aagcaaaagaagtaa

SEQ ID NO: 2699504 - DNA, 19 bp, Homo sapiens
aagcaccgcctccaaatgc

SEQ ID NO: 2699505 - DNA, 22 bp, Homo sapiens
aagcaggttgaggggctcctgg

SEQ ID NO: 2699506 - DNA, 16 bp, Homo sapiens
aagccaacgacaaagc

SEQ ID NO: 2699507 - DNA, 17 bp, Homo sapiens
aagccactgaagctggg

SEQ ID NO: 2699508 - DNA, 21 bp, Homo sapiens
aagcggaggttgcagggagcc

SEQ ID NO: 2699509 - DNA, 17 bp, Homo sapiens
aagctggacaagaagct

SEQ ID NO: 2699510 - DNA, 22 bp, Homo sapiens
aaggaagggcatccttctgcct

SEQ ID NO: 2699511 - DNA, 16 bp, Homo sapiens
aaggctggctgggcat

SEQ ID NO: 2699512 - DNA, 19 bp, Homo sapiens
aagggacagtattctcagt

SEQ ID NO: 2699513 - DNA, 14 bp, Homo sapiens
aagggcatccttct

SEQ ID NO: 2699514 - DNA, 13 bp, Homo sapiens
aaggggccctggt

SEQ ID NO: 2699515 - DNA, 16 bp, Homo sapiens
aagggtgacatcccag

SEQ ID NO: 2699516 - DNA, 19 bp, Homo sapiens
aagggttttccaccctgga

SEQ ID NO: 2699517 - DNA, 16 bp, Homo sapiens
aaggtgggctgagccc

SEQ ID NO: 2699518 - DNA, 22 bp, Homo sapiens
aagtattaggggtaatatattg

SEQ ID NO: 2699519 - DNA, 11 bp, Homo sapiens
aagtctaaagt

SEQ ID NO: 2699520 - DNA, 21 bp, Homo sapiens
aagtctaaagtttacagtaaa

SEQ ID NO: 2699521 - DNA, 21 bp, Homo sapiens
aagttgaatggcctgccttga

SEQ ID NO: 2699522 - DNA, 14 bp, Homo sapiens
aagtttgcactgta

SEQ ID NO: 2699523 - DNA, 12 bp, Homo sapiens
aataaaattgta

SEQ ID NO: 2699524 - DNA, 21 bp, Homo sapiens
aataaacttagaataaaattg

SEQ ID NO: 2699525 - DNA, 11 bp, Homo sapiens
aataaagctgg

SEQ ID NO: 2699526 - DNA, 21 bp, Homo sapiens
aatagcaccaatacaaattga

SEQ ID NO: 2699527 - DNA, 15 bp, Homo sapiens
aatattcaataaagc

SEQ ID NO: 2699528 - DNA, 16 bp, Homo sapiens
aatattcaataaagct

SEQ ID NO: 2699529 - DNA, 21 bp, Homo sapiens
aatattgcccaaataatattt

SEQ ID NO: 2699530 - DNA, 15 bp, Homo sapiens
aatcaatatttaaga

SEQ ID NO: 2699531 - DNA, 14 bp, Homo sapiens
aatccatttaatca

SEQ ID NO: 2699532 - DNA, 21 bp, Homo sapiens
aatctccagggctgcccctgt

SEQ ID NO: 2699533 - DNA, 15 bp, Homo sapiens
aatgaaagtttgcac

SEQ ID NO: 2699534 - DNA, 14 bp, Homo sapiens
aatgccacttaaca

SEQ ID NO: 2699535 - DNA, 16 bp, Homo sapiens
aatgccacttaacagg

SEQ ID NO: 2699536 - DNA, 21 bp, Homo sapiens
aattccactggacttgagctt

SEQ ID NO: 2699537 - DNA, 18 bp, Homo sapiens
aattgtaaaattgtatag

SEQ ID NO: 2699538 - DNA, 21 bp, Homo sapiens
aattgtaaaattgtatagaga

SEQ ID NO: 2699539 - DNA, 21 bp, Homo sapiens
aatttcagctagttaataatt

SEQ ID NO: 2699540 - DNA, 22 bp, Homo sapiens
aatttcagctagttaataattc

SEQ ID NO: 2699541 - DNA, 21 bp, Homo sapiens
aatttcccacaccccagcgcc

SEQ ID NO: 2699542 - DNA, 17 bp, Homo sapiens
aatttgtatctgaagga

SEQ ID NO: 2699543 - DNA, 20 bp, Homo sapiens
acaaatatccaccactttaa

SEQ ID NO: 2699544 - DNA, 16 bp, Homo sapiens
acacaccggtcaccga

SEQ ID NO: 2699545 - DNA, 17 bp, Homo sapiens
acacaccggtcaccgag

SEQ ID NO: 2699546 - DNA, 20 bp, Homo sapiens
acacatattgttttaaaata

SEQ ID NO: 2699547 - DNA, 13 bp, Homo sapiens
acaccccagcgcc

SEQ ID NO: 2699548 - DNA, 13 bp, Homo sapiens
acacctgccctgc

SEQ ID NO: 2699549 - DNA, 21 bp, Homo sapiens
acactaaacagactatttaac

SEQ ID NO: 2699550 - DNA, 12 bp, Homo sapiens
acactccagcct

SEQ ID NO: 2699551 - DNA, 14 bp, Homo sapiens
acactccagcctga

SEQ ID NO: 2699552 - DNA, 17 bp, Homo sapiens
acagaaattagccgggc

SEQ ID NO: 2699553 - DNA, 23 bp, Homo sapiens
acagccgcagcctccctctgacc

SEQ ID NO: 2699554 - DNA, 17 bp, Homo sapiens
acagtaaataaattgtt

SEQ ID NO: 2699555 - DNA, 23 bp, Homo sapiens
acagtaaataaattgtttgacca

SEQ ID NO: 2699556 - DNA, 15 bp, Homo sapiens
acagtgcttcagcct

SEQ ID NO: 2699557 - DNA, 20 bp, Homo sapiens
acagtgcttcagcctgaggc

SEQ ID NO: 2699558 - DNA, 21 bp, Homo sapiens
acagtgcttcagcctgaggct

SEQ ID NO: 2699559 - DNA, 16 bp, Homo sapiens
acagttcagttcctct

SEQ ID NO: 2699560 - DNA, 15 bp, Homo sapiens
acatcccaggagggg

SEQ ID NO: 2699561 - DNA, 18 bp, Homo sapiens
acatcccaggaggggcct

SEQ ID NO: 2699562 - DNA, 16 bp, Homo sapiens
acatgacgtaaaattt

SEQ ID NO: 2699563 - DNA, 21 bp, Homo sapiens
acatgaggacatgatggagcg

SEQ ID NO: 2699564 - DNA, 15 bp, Homo sapiens
accacctctcaatat

SEQ ID NO: 2699565 - DNA, 11 bp, Homo sapiens
accagcctggc

SEQ ID NO: 2699566 - DNA, 14 bp, Homo sapiens
accagtacttctaa

SEQ ID NO: 2699567 - DNA, 17 bp, Homo sapiens
accagtacttctaagag

SEQ ID NO: 2699568 - DNA, 16 bp, Homo sapiens
accagtgtagccttgc

SEQ ID NO: 2699569 - DNA, 20 bp, Homo sapiens
acccagtgtaaagaataaat

SEQ ID NO: 2699570 - DNA, 22 bp, Homo sapiens
acccagtgtaaagaataaatga

SEQ ID NO: 2699571 - DNA, 23 bp, Homo sapiens
acccagtgtaaagaataaatgaa

SEQ ID NO: 2699572 - DNA, 15 bp, Homo sapiens
accccaagtccacct

SEQ ID NO: 2699573 - DNA, 17 bp, Homo sapiens
accctcgtggacacctg

SEQ ID NO: 2699574 - DNA, 19 bp, Homo sapiens
accctcgtggacacctgcc

SEQ ID NO: 2699575 - DNA, 20 bp, Homo sapiens
accctcgtggacacctgccc

SEQ ID NO: 2699576 - DNA, 22 bp, Homo sapiens
accctgcgaaggggccctggtc

SEQ ID NO: 2699577 - DNA, 18 bp, Homo sapiens
acccttggacttgaggat

SEQ ID NO: 2699578 - DNA, 21 bp, Homo sapiens
accgagacggctggacctgca

SEQ ID NO: 2699579 - DNA, 16 bp, Homo sapiens
accgccgcagggacgg

SEQ ID NO: 2699580 - DNA, 22 bp, Homo sapiens
accgctgccttttgctgctgct

SEQ ID NO: 2699581 - DNA, 15 bp, Homo sapiens
accggtcaccgagac

SEQ ID NO: 2699582 - DNA, 22 bp, Homo sapiens
acctatagtcccagctactcag

SEQ ID NO: 2699583 - DNA, 21 bp, Homo sapiens
acctcagccctgaaaataaca

SEQ ID NO: 2699584 - DNA, 19 bp, Homo sapiens
acctcaggcttccttggca

SEQ ID NO: 2699585 - DNA, 20 bp, Homo sapiens
acctctcaatattcaataaa

SEQ ID NO: 2699586 - DNA, 20 bp, Homo sapiens
acctgaagggtgacatccca

SEQ ID NO: 2699587 - DNA, 15 bp, Homo sapiens
acctgccagcctggc

SEQ ID NO: 2699588 - DNA, 15 bp, Homo sapiens
caggcatgctggcct

SEQ ID NO: 2699589 - DNA, 23 bp, Homo sapiens
caggccaagagcagaggcagcga

SEQ ID NO: 2699590 - DNA, 22 bp, Homo sapiens
caggccggtgtgggctgtgtcg

SEQ ID NO: 2699591 - DNA, 19 bp, Homo sapiens
cagggaggaggtggcagcc

SEQ ID NO: 2699592 - DNA, 16 bp, Homo sapiens
cagggcagagccggga

SEQ ID NO: 2699593 - DNA, 18 bp, Homo sapiens
cagggccctgcagagggg

SEQ ID NO: 2699594 - DNA, 15 bp, Homo sapiens
cagggctgcccctgt

SEQ ID NO: 2699595 - DNA, 18 bp, Homo sapiens
cagggctgcccctgtagg

SEQ ID NO: 2699596 - DNA, 15 bp, Homo sapiens
caggtgccaccaata

SEQ ID NO: 2699597 - DNA, 22 bp, Homo sapiens
caggttgaggggctcctggaaa

SEQ ID NO: 2699598 - DNA, 16 bp, Homo sapiens
cagtaaataaattgtt

SEQ ID NO: 2699599 - DNA, 13 bp, Homo sapiens
cagtacttctaag

SEQ ID NO: 2699600 - DNA, 19 bp, Homo sapiens
cagtctcaggagcatgggg

SEQ ID NO: 2699601 - DNA, 18 bp, Homo sapiens
cagtgacgtgcacctgta

SEQ ID NO: 2699602 - DNA, 22 bp, Homo sapiens
cagtgctctcctaccccacctc

SEQ ID NO: 2699603 - DNA, 20 bp, Homo sapiens
cagtgctgtggcctgggcaa

SEQ ID NO: 2699604 - DNA, 19 bp, Homo sapiens
cagtgcttcagcctgaggc

SEQ ID NO: 2699605 - DNA, 23 bp, Homo sapiens
cagttcctctttgcatggaattt

SEQ ID NO: 2699606 - DNA, 13 bp, Homo sapiens
catatgagtcttt

SEQ ID NO: 2699607 - DNA, 22 bp, Homo sapiens
catattgttttaaaataagaat

SEQ ID NO: 2699608 - DNA, 13 bp, Homo sapiens
catcacagggcag

SEQ ID NO: 2699609 - DNA, 16 bp, Homo sapiens
catcccaggaggggcc

SEQ ID NO: 2699610 - DNA, 21 bp, Homo sapiens
catcccaggaggggcctctga

SEQ ID NO: 2699611 - DNA, 17 bp, Homo sapiens
catccttttctgcagag

SEQ ID NO: 2699612 - DNA, 22 bp, Homo sapiens
catctctctactcctacctcag

SEQ ID NO: 2699613 - DNA, 14 bp, Homo sapiens
catgaagacaggac

SEQ ID NO: 2699614 - DNA, 15 bp, Homo sapiens
catgaagacaggaca

SEQ ID NO: 2699615 - DNA, 18 bp, Homo sapiens
catgatggagcgcacctg

SEQ ID NO: 2699616 - DNA, 20 bp, Homo sapiens
catgctggggcaagtccctg

SEQ ID NO: 2699617 - DNA, 19 bp, Homo sapiens
catggaatttgtaagttta

SEQ ID NO: 2699618 - DNA, 22 bp, Homo sapiens
catggtgtgaaagtcagatgcc

SEQ ID NO: 2699619 - DNA, 23 bp, Homo sapiens
catggtgtgaaagtcagatgccc

SEQ ID NO: 2699620 - DNA, 17 bp, Homo sapiens
catgtggccccaggtgc

SEQ ID NO: 2699621 - DNA, 17 bp, Homo sapiens
cattaaaaaaaacagaa

SEQ ID NO: 2699622 - DNA, 13 bp, Homo sapiens
ccaaactctgcca

SEQ ID NO: 2699623 - DNA, 18 bp, Homo sapiens
ccaaggtgggctgagccc

SEQ ID NO: 2699624 - DNA, 16 bp, Homo sapiens
ccaagtccacctgcct

SEQ ID NO: 2699625 - DNA, 16 bp, Homo sapiens
ccaagtgccagtcttg

SEQ ID NO: 2699626 - DNA, 15 bp, Homo sapiens
ccaccaataaaaatc

SEQ ID NO: 2699627 - DNA, 18 bp, Homo sapiens
ccaccctcgtggacacct

SEQ ID NO: 2699628 - DNA, 19 bp, Homo sapiens
ccaccctcgtggacacctg

SEQ ID NO: 2699629 - DNA, 21 bp, Homo sapiens
ccaccctcgtggacacctgcc

SEQ ID NO: 2699630 - DNA, 11 bp, Homo sapiens
ccaccctggaa

SEQ ID NO: 2699631 - DNA, 16 bp, Homo sapiens
ccacctgcctatccat

SEQ ID NO: 2699632 - DNA, 20 bp, Homo sapiens
ccacctgcctatccatcctg

SEQ ID NO: 2699633 - DNA, 16 bp, Homo sapiens
ccacctgtctgtctgt

SEQ ID NO: 2699634 - DNA, 17 bp, Homo sapiens
ccaccttcaattcctgg

SEQ ID NO: 2699635 - DNA, 19 bp, Homo sapiens
ccaccttcaattcctgggc

SEQ ID NO: 2699636 - DNA, 14 bp, Homo sapiens
ccactacactccag

SEQ ID NO: 2699637 - DNA, 22 bp, Homo sapiens
ccactacactccagcctgagca

SEQ ID NO: 2699638 - DNA, 18 bp, Homo sapiens
ccactaggactctgaggc

SEQ ID NO: 2699639 - DNA, 20 bp, Homo sapiens
ccactaggactctgaggctc

SEQ ID NO: 2699640 - DNA, 16 bp, Homo sapiens
ccactgaagctgggat

SEQ ID NO: 2699641 - DNA, 16 bp, Homo sapiens
ccactggacttgagct

SEQ ID NO: 2699642 - DNA, 21 bp, Homo sapiens
ccactggacttgagcttggca

SEQ ID NO: 2699643 - DNA, 15 bp, Homo sapiens
ccagaaaaccccagc

SEQ ID NO: 2699644 - DNA, 16 bp, Homo sapiens
ccagaaaaccccagca

SEQ ID NO: 2699645 - DNA, 14 bp, Homo sapiens
ccagcactttggga

SEQ ID NO: 2699646 - DNA, 12 bp, Homo sapiens
ccagcctgagca

SEQ ID NO: 2699647 - DNA, 12 bp, Homo sapiens
ccagcctggcca

SEQ ID NO: 2699648 - DNA, 13 bp, Homo sapiens
ccagcctggcttc

SEQ ID NO: 2699649 - DNA, 17 bp, Homo sapiens
ccagcctggcttctgga

SEQ ID NO: 2699650 - DNA, 16 bp, Homo sapiens
ccagcctgggcgacag

SEQ ID NO: 2699651 - DNA, 14 bp, Homo sapiens
ccagctctggcttc

SEQ ID NO: 2699652 - DNA, 19 bp, Homo sapiens
ccagctgcacctgccagcc

SEQ ID NO: 2699653 - DNA, 22 bp, Homo sapiens
ccagctgcacctgccagcctgg

SEQ ID NO: 2699654 - DNA, 13 bp, Homo sapiens
ccaggaggggcct

SEQ ID NO: 2699655 - DNA, 20 bp, Homo sapiens
ccaggaggggcctctgaaat

SEQ ID NO: 2699656 - DNA, 21 bp, Homo sapiens
ccaggagtttgaggctgcagc

SEQ ID NO: 2699657 - DNA, 17 bp, Homo sapiens
ccaggcatgctggcctc

SEQ ID NO: 2699658 - DNA, 16 bp, Homo sapiens
ccagggccagggccct

SEQ ID NO: 2699659 - DNA, 20 bp, Homo sapiens
ccagtgggaggtgagaccac

SEQ ID NO: 2699660 - DNA, 16 bp, Homo sapiens
ccatctcctttcaggg

SEQ ID NO: 2699661 - DNA, 20 bp, Homo sapiens
ccatctctctactcctacct

SEQ ID NO: 2699662 - DNA, 19 bp, Homo sapiens
ccatgaagacaggacagtg

SEQ ID NO: 2699663 - DNA, 15 bp, Homo sapiens
ccatgtatctacctc

SEQ ID NO: 2699664 - DNA, 17 bp, Homo sapiens
ccatgtggccccaggtg

SEQ ID NO: 2699665 - DNA, 19 bp, Homo sapiens
ccatgtggccccaggtgcc

SEQ ID NO: 2699666 - DNA, 20 bp, Homo sapiens
ccatgtggccccaggtgcca

SEQ ID NO: 2699667 - DNA, 22 bp, Homo sapiens
ccatgtggccccaggtgccacc

SEQ ID NO: 2699668 - DNA, 11 bp, Homo sapiens
cccaataaagc

SEQ ID NO: 2699669 - DNA, 14 bp, Homo sapiens
cccacattggaccc

SEQ ID NO: 2699670 - DNA, 23 bp, Homo sapiens
cccacctcatgcctggcccccct

SEQ ID NO: 2699671 - DNA, 19 bp, Homo sapiens
cccaccttcaattcctggg

SEQ ID NO: 2699672 - DNA, 17 bp, Homo sapiens
cccactccccaccttca

SEQ ID NO: 2699673 - DNA, 22 bp, Homo sapiens
cccagagggcccaggcaggcca

SEQ ID NO: 2699674 - DNA, 12 bp, Homo sapiens
cccagctgcacc

SEQ ID NO: 2699675 - DNA, 17 bp, Homo sapiens
cccaggaggggcctctg

SEQ ID NO: 2699676 - DNA, 21 bp, Homo sapiens
cccagggccagggccctgcag

SEQ ID NO: 2699677 - DNA, 19 bp, Homo sapiens
cccaggtgccaccaataaa

SEQ ID NO: 2699678 - DNA, 20 bp, Homo sapiens
cccaggtgccaccaataaaa

SEQ ID NO: 2699679 - DNA, 21 bp, Homo sapiens
cccaggtgccaccaataaaaa

SEQ ID NO: 2699680 - DNA, 19 bp, Homo sapiens
cccagtgtaaagaataaat

SEQ ID NO: 2699681 - DNA, 22 bp, Homo sapiens
cccagtgtaaagaataaatgaa

SEQ ID NO: 2699682 - DNA, 19 bp, Homo sapiens
ccccaaacgggctgccctg

SEQ ID NO: 2699683 - DNA, 19 bp, Homo sapiens
ccccaggtgccaccaataa

SEQ ID NO: 2699684 - DNA, 21 bp, Homo sapiens
ccccaggtgccaccaataaaa

SEQ ID NO: 2699685 - DNA, 16 bp, Homo sapiens
ccccctccaggcatgc

SEQ ID NO: 2699686 - DNA, 13 bp, Homo sapiens
ccccctcccaggg

SEQ ID NO: 2699687 - DNA, 19 bp, Homo sapiens
ccccctggtggacagtcct

SEQ ID NO: 2699688 - DNA, 23 bp, Homo sapiens
ccccctggtggacagtcctggga

SEQ ID NO: 2699689 - DNA, 11 bp, Homo sapiens
cccctccaggc

SEQ ID NO: 2699690 - DNA, 22 bp, Homo sapiens
cccctccaggcatgctggcctc

SEQ ID NO: 2699691 - DNA, 14 bp, Homo sapiens
cccctcccagggcc

SEQ ID NO: 2699692 - DNA, 23 bp, Homo sapiens
cccctgggctctgccccagctct

SEQ ID NO: 2699693 - DNA, 19 bp, Homo sapiens
cccctggtggacagtcctg

SEQ ID NO: 2699694 - DNA, 22 bp, Homo sapiens
cccctggtggacagtcctggga

SEQ ID NO: 2699695 - DNA, 13 bp, Homo sapiens
cccgcccagctgc

SEQ ID NO: 2699696 - DNA, 16 bp, Homo sapiens
cccggattctgggagg

SEQ ID NO: 2699697 - DNA, 14 bp, Homo sapiens
ccctccaggcatgc

SEQ ID NO: 2699698 - DNA, 22 bp, Homo sapiens
ccctccgccttcactccggtgt

SEQ ID NO: 2699699 - DNA, 18 bp, Homo sapiens
ccctgactctctgtgacc

SEQ ID NO: 2699700 - DNA, 14 bp, Homo sapiens
ccctgccacctgtc

SEQ ID NO: 2699701 - DNA, 15 bp, Homo sapiens
ccctgccctgccacc

SEQ ID NO: 2699702 - DNA, 17 bp, Homo sapiens
ccctgccctgccacctg

SEQ ID NO: 2699703 - DNA, 20 bp, Homo sapiens
ccctggcaggatgaccctgc

SEQ ID NO: 2699704 - DNA, 16 bp, Homo sapiens
ccctgggctctgcccc

SEQ ID NO: 2699705 - DNA, 16 bp, Homo sapiens
cccttggacttgagga

SEQ ID NO: 2699706 - DNA, 11 bp, Homo sapiens
ccgaaagctga

SEQ ID NO: 2699707 - DNA, 15 bp, Homo sapiens
ccgcagggacgggga

SEQ ID NO: 2699708 - DNA, 17 bp, Homo sapiens
cttcagttgttttcccg

SEQ ID NO: 2699709 - DNA, 13 bp, Homo sapiens
cttctgccttttt

SEQ ID NO: 2699710 - DNA, 11 bp, Homo sapiens
cttctggagcc

SEQ ID NO: 2699711 - DNA, 12 bp, Homo sapiens
cttgaggacaca

SEQ ID NO: 2699712 - DNA, 16 bp, Homo sapiens
cttgaggacacatgtc

SEQ ID NO: 2699713 - DNA, 17 bp, Homo sapiens
cttgaggacacatgtcc

SEQ ID NO: 2699714 - DNA, 18 bp, Homo sapiens
cttgaggacacatgtcca

SEQ ID NO: 2699715 - DNA, 16 bp, Homo sapiens
cttgaggattttgagt

SEQ ID NO: 2699716 - DNA, 17 bp, Homo sapiens
cttgaggattttgagta

SEQ ID NO: 2699717 - DNA, 17 bp, Homo sapiens
cttgccttttaaaagaa

SEQ ID NO: 2699718 - DNA, 14 bp, Homo sapiens
cttgctgtcctagg

SEQ ID NO: 2699719 - DNA, 15 bp, Homo sapiens
cttgctgtcctaggc

SEQ ID NO: 2699720 - DNA, 16 bp, Homo sapiens
cttgctgtcctaggcc

SEQ ID NO: 2699721 - DNA, 20 bp, Homo sapiens
cttggaaagcatcacctcag

SEQ ID NO: 2699722 - DNA, 18 bp, Homo sapiens
cttggaattggaattact

SEQ ID NO: 2699723 - DNA, 15 bp, Homo sapiens
cttggcagctgaact

SEQ ID NO: 2699724 - DNA, 18 bp, Homo sapiens
cttggcatcacagggcag

SEQ ID NO: 2699725 - DNA, 19 bp, Homo sapiens
cttggcatcacagggcaga

SEQ ID NO: 2699726 - DNA, 22 bp, Homo sapiens
cttggcatcacagggcagagcc

SEQ ID NO: 2699727 - DNA, 23 bp, Homo sapiens
cttgggtcctgcaatctccaggg

SEQ ID NO: 2699728 - DNA, 13 bp, Homo sapiens
cttgtgtctgcgt

SEQ ID NO: 2699729 - DNA, 21 bp, Homo sapiens
ctttgcatggaatttgtaagt

SEQ ID NO: 2699730 - DNA, 17 bp, Homo sapiens
ctttgggaggctgaggc

SEQ ID NO: 2699731 - DNA, 18 bp, Homo sapiens
ctttgggaggctgaggcg

SEQ ID NO: 2699732 - DNA, 14 bp, Homo sapiens
cttttaaaagaaaa

SEQ ID NO: 2699733 - DNA, 18 bp, Homo sapiens
cttttccaggagttctga

SEQ ID NO: 2699734 - DNA, 12 bp, Homo sapiens
cttttctgcaga

SEQ ID NO: 2699735 - DNA, 21 bp, Homo sapiens
gaaaaaaaaagtcagactgct

SEQ ID NO: 2699736 - DNA, 12 bp, Homo sapiens
gaaaataacaga

SEQ ID NO: 2699737 - DNA, 20 bp, Homo sapiens
gaaagtcagatgcccagagg

SEQ ID NO: 2699738 - DNA, 24 bp, Homo sapiens
gaaataagaaacacaaatgtaaaa

SEQ ID NO: 2699739 - DNA, 16 bp, Homo sapiens
gaacggggtccttcaa

SEQ ID NO: 2699740 - DNA, 13 bp, Homo sapiens
gaacttgaggaca

SEQ ID NO: 2699741 - DNA, 15 bp, Homo sapiens
gaacttgaggacaca

SEQ ID NO: 2699742 - DNA, 21 bp, Homo sapiens
gaacttgaggacacatgtcca

SEQ ID NO: 2699743 - DNA, 15 bp, Homo sapiens
gaagccactgaagct

SEQ ID NO: 2699744 - DNA, 16 bp, Homo sapiens
gaaggctggctgggca

SEQ ID NO: 2699745 - DNA, 20 bp, Homo sapiens
gaaggggacgcgggctgtgc

SEQ ID NO: 2699746 - DNA, 20 bp, Homo sapiens
gaagggttttccaccctgga

SEQ ID NO: 2699747 - DNA, 21 bp, Homo sapiens
gaatcaagatgtcagactggc

SEQ ID NO: 2699748 - DNA, 13 bp, Homo sapiens
gaatcttactcct

SEQ ID NO: 2699749 - DNA, 21 bp, Homo sapiens
gaatggcctgccttgaagcca

SEQ ID NO: 2699750 - DNA, 14 bp, Homo sapiens
gaatttgtaagttt

SEQ ID NO: 2699751 - DNA, 14 bp, Homo sapiens
gacaagaagctgct

SEQ ID NO: 2699752 - DNA, 9 bp, Homo sapiens
gacacctgc

SEQ ID NO: 2699753 - DNA, 10 bp, Homo sapiens
gacacctgcc

SEQ ID NO: 2699754 - DNA, 14 bp, Homo sapiens
gacaggacagtgct

SEQ ID NO: 2699755 - DNA, 23 bp, Homo sapiens
gacaggacagtgcttcagcctga

SEQ ID NO: 2699756 - DNA, 14 bp, Homo sapiens
gacagtattctcag

SEQ ID NO: 2699757 - DNA, 16 bp, Homo sapiens
gacagtattctcagtg

SEQ ID NO: 2699758 - DNA, 14 bp, Homo sapiens
gacagtcctgggag

SEQ ID NO: 2699759 - DNA, 23 bp, Homo sapiens
gacatcccaggaggggcctctga

SEQ ID NO: 2699760 - DNA, 21 bp, Homo sapiens
gacatgatggagcgcacctgc

SEQ ID NO: 2699761 - DNA, 19 bp, Homo sapiens
gaccctcctcctcccccag

SEQ ID NO: 2699762 - DNA, 13 bp, Homo sapiens
gacctgcaggcca

SEQ ID NO: 2699763 - DNA, 14 bp, Homo sapiens
gacggctggacctg

SEQ ID NO: 2699764 - DNA, 16 bp, Homo sapiens
gacggctggacctgca

SEQ ID NO: 2699765 - DNA, 18 bp, Homo sapiens
gacgtgcacctgtactca

SEQ ID NO: 2699766 - DNA, 16 bp, Homo sapiens
gactaattcacaaaaa

SEQ ID NO: 2699767 - DNA, 16 bp, Homo sapiens
gactatttaacttgag

SEQ ID NO: 2699768 - DNA, 12 bp, Homo sapiens
gactctctgtga

SEQ ID NO: 2699769 - DNA, 19 bp, Homo sapiens
gactctctgtgacctgccc

SEQ ID NO: 2699770 - DNA, 21 bp, Homo sapiens
gactgcgggatggtcctgggg

SEQ ID NO: 2699771 - DNA, 12 bp, Homo sapiens
gactgctgggac

SEQ ID NO: 2699772 - DNA, 19 bp, Homo sapiens
gactgctgggactggccag

SEQ ID NO: 2699773 - DNA, 14 bp, Homo sapiens
gactggctggctgc

SEQ ID NO: 2699774 - DNA, 19 bp, Homo sapiens
gacttgaggattttgagta

SEQ ID NO: 2699775 - DNA, 16 bp, Homo sapiens
gagaaaacttatttga

SEQ ID NO: 2699776 - DNA, 22 bp, Homo sapiens
gagaaaacttatttgagtgatt

SEQ ID NO: 2699777 - DNA, 23 bp, Homo sapiens
gagactctgtggggccttggttc

SEQ ID NO: 2699778 - DNA, 19 bp, Homo sapiens
gagactgcgggatggtcct

SEQ ID NO: 2699779 - DNA, 12 bp, Homo sapiens
gagattttcctt

SEQ ID NO: 2699780 - DNA, 16 bp, Homo sapiens
gagcaaagtctaaagt

SEQ ID NO: 2699781 - DNA, 19 bp, Homo sapiens
gagcaaagtctaaagttta

SEQ ID NO: 2699782 - DNA, 13 bp, Homo sapiens
gagcaggggcagg

SEQ ID NO: 2699783 - DNA, 23 bp, Homo sapiens
gagccctggcaggatgaccctgc

SEQ ID NO: 2699784 - DNA, 18 bp, Homo sapiens
gagcgcacctgccccctg

SEQ ID NO: 2699785 - DNA, 20 bp, Homo sapiens
gagcgcacctgccccctggt

SEQ ID NO: 2699786 - DNA, 13 bp, Homo sapiens
gagcttggacagt

SEQ ID NO: 2699787 - DNA, 18 bp, Homo sapiens
gaggacatgatggagcgc

SEQ ID NO: 2699788 - DNA, 18 bp, Homo sapiens
gaggactccctccatgtg

SEQ ID NO: 2699789 - DNA, 15 bp, Homo sapiens
gaggaggtggcagcc

SEQ ID NO: 2699790 - DNA, 22 bp, Homo sapiens
gaggaggtggcagccctgtagg

SEQ ID NO: 2699791 - DNA, 19 bp, Homo sapiens
gaggatcactggagcccag

SEQ ID NO: 2699792 - DNA, 19 bp, Homo sapiens
gaggcgggtggatcacctg

SEQ ID NO: 2699793 - DNA, 12 bp, Homo sapiens
gaggctgaggcg

SEQ ID NO: 2699794 - DNA, 15 bp, Homo sapiens
gagggatgctgcctg

SEQ ID NO: 2699795 - DNA, 21 bp, Homo sapiens
gaggggaggatcactggagcc

SEQ ID NO: 2699796 - DNA, 17 bp, Homo sapiens
gaggggctttctggaga

SEQ ID NO: 2699797 - DNA, 21 bp, Homo sapiens
gagggggacgcgcacacacac

SEQ ID NO: 2699798 - DNA, 15 bp, Homo sapiens
gaggtggcagccctg

SEQ ID NO: 2699799 - DNA, 16 bp, Homo sapiens
gaggtggcagccctgt

SEQ ID NO: 2699800 - DNA, 19 bp, Homo sapiens
gaggttgcagggagccgag

SEQ ID NO: 2699801 - DNA, 23 bp, Homo sapiens
gagtatctcggacctttcagctg

SEQ ID NO: 2699802 - DNA, 13 bp, Homo sapiens
gagtgagaccctg

SEQ ID NO: 2699803 - DNA, 20 bp, Homo sapiens
gagttcgagaccagcctggc

SEQ ID NO: 2699804 - DNA, 21 bp, Homo sapiens
gagttcgagaccagcctggcc

SEQ ID NO: 2699805 - DNA, 16 bp, Homo sapiens
gataaattccactgga

SEQ ID NO: 2699806 - DNA, 23 bp, Homo sapiens
gatcacgccactgcactccagcc

SEQ ID NO: 2699807 - DNA, 12 bp, Homo sapiens
gatcactggagc

SEQ ID NO: 2699808 - DNA, 17 bp, Homo sapiens
gatcactggagcccagg

SEQ ID NO: 2699809 - DNA, 23 bp, Homo sapiens
gatcgcgccactacactccagcc

SEQ ID NO: 2699810 - DNA, 23 bp, Homo sapiens
gatgcccagagggcccaggcagg

SEQ ID NO: 2699811 - DNA, 12 bp, Homo sapiens
gatgctgcctga

SEQ ID NO: 2699812 - DNA, 16 bp, Homo sapiens
gatggagcgcacctgc

SEQ ID NO: 2699813 - DNA, 21 bp, Homo sapiens
gatggtcctggggctctgtgc

SEQ ID NO: 2699814 - DNA, 21 bp, Homo sapiens
gattatttgttatttgtacag

SEQ ID NO: 2699815 - DNA, 22 bp, Homo sapiens
gattctgggaggaagcaggttg

SEQ ID NO: 2699816 - DNA, 16 bp, Homo sapiens
gcaaaagaagtaaaag

SEQ ID NO: 2699817 - DNA, 15 bp, Homo sapiens
gcaaagtctaaagtt

SEQ ID NO: 2699818 - DNA, 22 bp, Homo sapiens
gcaaagtctaaagtttacagta

SEQ ID NO: 2699819 - DNA, 14 bp, Homo sapiens
gcaacagagtgaga

SEQ ID NO: 2699820 - DNA, 19 bp, Homo sapiens
gcaacagagtgagaccctg

SEQ ID NO: 2699821 - DNA, 13 bp, Homo sapiens
gcaagggggcggg

SEQ ID NO: 2699822 - DNA, 20 bp, Homo sapiens
gcaagtccctgactctctgt

SEQ ID NO: 2699823 - DNA, 13 bp, Homo sapiens
gcaatctccaggg

SEQ ID NO: 2699824 - DNA, 20 bp, Homo sapiens
gcaatctccagggctgcccc

SEQ ID NO: 2699825 - DNA, 18 bp, Homo sapiens
gcacctatagtcccagct

SEQ ID NO: 2699826 - DNA, 14 bp, Homo sapiens
gcacctgccagcct

SEQ ID NO: 2699827 - DNA, 15 bp, Homo sapiens
gcacctgccagcctg

SEQ ID NO: 2699828 - DNA, 17 bp, Homo sapiens
tgcccctgtaggttgct

SEQ ID NO: 2699829 - DNA, 15 bp, Homo sapiens
tgcccggattctggg

SEQ ID NO: 2699830 - DNA, 14 bp, Homo sapiens
tgccctgccacctg

SEQ ID NO: 2699831 - DNA, 15 bp, Homo sapiens
tgccctgccacctgt

SEQ ID NO: 2699832 - DNA, 16 bp, Homo sapiens
tgccctgccacctgtc

SEQ ID NO: 2699833 - DNA, 21 bp, Homo sapiens
tgccctgccacctgtctgtct

SEQ ID NO: 2699834 - DNA, 15 bp, Homo sapiens
tgccctgccctgcca

SEQ ID NO: 2699835 - DNA, 18 bp, Homo sapiens
tgccctgccctgccacct

SEQ ID NO: 2699836 - DNA, 16 bp, Homo sapiens
tgcctatccatcctgc

SEQ ID NO: 2699837 - DNA, 17 bp, Homo sapiens
tgcctatccatcctgcg

SEQ ID NO: 2699838 - DNA, 11 bp, Homo sapiens
tgcctgcagcc

SEQ ID NO: 2699839 - DNA, 18 bp, Homo sapiens
tgcctggcccccctccag

SEQ ID NO: 2699840 - DNA, 19 bp, Homo sapiens
tgcctggcccccctccagg

SEQ ID NO: 2699841 - DNA, 17 bp, Homo sapiens
tgccttttgctgctgct

SEQ ID NO: 2699842 - DNA, 18 bp, Homo sapiens
tgcgaaggggccctggtc

SEQ ID NO: 2699843 - DNA, 18 bp, Homo sapiens
tgcgggatggtcctgggg

SEQ ID NO: 2699844 - DNA, 19 bp, Homo sapiens
tgcgggatggtcctggggc

SEQ ID NO: 2699845 - DNA, 13 bp, Homo sapiens
tgcgtgtcgtggg

SEQ ID NO: 2699846 - DNA, 22 bp, Homo sapiens
tgctctcctaccccacctcatg

SEQ ID NO: 2699847 - DNA, 18 bp, Homo sapiens
tgctgaggactccctcca

SEQ ID NO: 2699848 - DNA, 19 bp, Homo sapiens
tgctggacggcattcctgc

SEQ ID NO: 2699849 - DNA, 23 bp, Homo sapiens
tgctggcctcccaataaagctgg

SEQ ID NO: 2699850 - DNA, 18 bp, Homo sapiens
tgctggggcaagtccctg

SEQ ID NO: 2699851 - DNA, 23 bp, Homo sapiens
tgctggggcaagtccctgactct

SEQ ID NO: 2699852 - DNA, 14 bp, Homo sapiens
tgctgtcctaggcc

SEQ ID NO: 2699853 - DNA, 22 bp, Homo sapiens
tgcttcagcctgaggctgagac

SEQ ID NO: 2699854 - DNA, 23 bp, Homo sapiens
tgcttcagcctgaggctgagact

SEQ ID NO: 2699855 - DNA, 16 bp, Homo sapiens
tggaaagcatcacctc

SEQ ID NO: 2699856 - DNA, 13 bp, Homo sapiens
tggaaaggctcag

SEQ ID NO: 2699857 - DNA, 20 bp, Homo sapiens
tggaaaggctcagtctcagg

SEQ ID NO: 2699858 - DNA, 23 bp, Homo sapiens
tggaaaggctcagtctcaggagc

SEQ ID NO: 2699859 - DNA, 22 bp, Homo sapiens
tggaattttctaatataatgac

SEQ ID NO: 2699860 - DNA, 16 bp, Homo sapiens
tggacaagaagctgct

SEQ ID NO: 2699861 - DNA, 12 bp, Homo sapiens
tggacacctgcc

SEQ ID NO: 2699862 - DNA, 18 bp, Homo sapiens
tggacacctgccctgccc

SEQ ID NO: 2699863 - DNA, 13 bp, Homo sapiens
tggacagtcctgg

SEQ ID NO: 2699864 - DNA, 15 bp, Homo sapiens
tggacagtcctggga

SEQ ID NO: 2699865 - DNA, 17 bp, Homo sapiens
tggacttgagcttggca

SEQ ID NO: 2699866 - DNA, 18 bp, Homo sapiens
tggacttgaggattttga

SEQ ID NO: 2699867 - DNA, 14 bp, Homo sapiens
tggagactctgtgg

SEQ ID NO: 2699868 - DNA, 19 bp, Homo sapiens
tggagactctgtggggcct

SEQ ID NO: 2699869 - DNA, 23 bp, Homo sapiens
tggagaggagggatgctgcctga

SEQ ID NO: 2699870 - DNA, 14 bp, Homo sapiens
tggagcgcacctgc

SEQ ID NO: 2699871 - DNA, 12 bp, Homo sapiens
tggcagccctgt

SEQ ID NO: 2699872 - DNA, 23 bp, Homo sapiens
tggcccccctccaggcatgctgg

SEQ ID NO: 2699873 - DNA, 22 bp, Homo sapiens
tggcttccagaaaaccccagca

SEQ ID NO: 2699874 - DNA, 15 bp, Homo sapiens
tgggctctgccccag

SEQ ID NO: 2699875 - DNA, 17 bp, Homo sapiens
tgggctctgccccagct

SEQ ID NO: 2699876 - DNA, 20 bp, Homo sapiens
tgggctctgccccagctctg

SEQ ID NO: 2699877 - DNA, 23 bp, Homo sapiens
tgggctctgccccagctctggct

SEQ ID NO: 2699878 - DNA, 12 bp, Homo sapiens
tgggctgagccc

SEQ ID NO: 2699879 - DNA, 15 bp, Homo sapiens
tgggctgagccctgg

SEQ ID NO: 2699880 - DNA, 16 bp, Homo sapiens
tgggctgagccctggc

SEQ ID NO: 2699881 - DNA, 15 bp, Homo sapiens
tggggctctgtgcag

SEQ ID NO: 2699882 - DNA, 17 bp, Homo sapiens
tggggctctgtgcaggg

SEQ ID NO: 2699883 - DNA, 13 bp, Homo sapiens
tgggttcctcttc

SEQ ID NO: 2699884 - DNA, 21 bp, Homo sapiens
tggtaatttgtatctgaagga

SEQ ID NO: 2699885 - DNA, 19 bp, Homo sapiens
tggtatgaacttgaggaca

SEQ ID NO: 2699886 - DNA, 23 bp, Homo sapiens
tggtatgaacttgaggacacatg

SEQ ID NO: 2699887 - DNA, 16 bp, Homo sapiens
tggtcctggggctctg

SEQ ID NO: 2699888 - DNA, 19 bp, Homo sapiens
tggtcctggggctctgtgc

SEQ ID NO: 2699889 - DNA, 16 bp, Homo sapiens
tggtggacagtcctgg

SEQ ID NO: 2699890 - DNA, 18 bp, Homo sapiens
tggtggacagtcctggga

SEQ ID NO: 2699891 - DNA, 22 bp, Homo sapiens
tgtaaaaagagagaaaacttat

SEQ ID NO: 2699892 - DNA, 14 bp, Homo sapiens
tgtaaaataagtat

SEQ ID NO: 2699893 - DNA, 15 bp, Homo sapiens
tgtaaagaataaatg

SEQ ID NO: 2699894 - DNA, 10 bp, Homo sapiens
tgtaaataaa

SEQ ID NO: 2699895 - DNA, 20 bp, Homo sapiens
tgtacactttctgtctcaaa

SEQ ID NO: 2699896 - DNA, 20 bp, Homo sapiens
tgtacagttcagttcctctt

SEQ ID NO: 2699897 - DNA, 17 bp, Homo sapiens
tgtagccttgcccggat

SEQ ID NO: 2699898 - DNA, 13 bp, Homo sapiens
tgtaggttgctta

SEQ ID NO: 2699899 - DNA, 18 bp, Homo sapiens
tgtatctgaaggagattt

SEQ ID NO: 2699900 - DNA, 12 bp, Homo sapiens
tgtatgctggac

SEQ ID NO: 2699901 - DNA, 13 bp, Homo sapiens
tgtattagatatc

SEQ ID NO: 2699902 - DNA, 18 bp, Homo sapiens
tgtattagatatcaatgt

SEQ ID NO: 2699903 - DNA, 21 bp, Homo sapiens
tgtcatgtactgacaactgtt

SEQ ID NO: 2699904 - DNA, 15 bp, Homo sapiens
tgtctgtctgtccca

SEQ ID NO: 2699905 - DNA, 15 bp, Homo sapiens
tgtctgtctgtctgt

SEQ ID NO: 2699906 - DNA, 22 bp, Homo sapiens
tgtgaaagtcagatgcccagag

SEQ ID NO: 2699907 - DNA, 12 bp, Homo sapiens
tgtgcctgcagc

SEQ ID NO: 2699908 - DNA, 12 bp, Homo sapiens
tgtggggccttg

SEQ ID NO: 2699909 - DNA, 22 bp, Homo sapiens
tgtgtgttgatcccaagacaat

SEQ ID NO: 2699910 - DNA, 15 bp, Homo sapiens
tgttaatactgtatt

SEQ ID NO: 2699911 - DNA, 13 bp, Homo sapiens
tgttaatagtact

SEQ ID NO: 2699912 - DNA, 15 bp, Homo sapiens
tgttagtattaacta

SEQ ID NO: 2699913 - DNA, 16 bp, Homo sapiens
tgttgtaaataaaagt

SEQ ID NO: 2699914 - DNA, 15 bp, Homo sapiens
tgtttctccccctgg

SEQ ID NO: 2699915 - DNA, 22 bp, Homo sapiens
tgtttgtttctccccctgggct

SEQ ID NO: 2699916 - DNA, 21 bp, Homo sapiens
tgttttaaccagtacttctaa

SEQ ID NO: 2699917 - DNA, 17 bp, Homo sapiens
ttaaaatgtaggaagaa

SEQ ID NO: 2699918 - DNA, 15 bp, Homo sapiens
ttaagagaatgaatt

SEQ ID NO: 2699919 - DNA, 17 bp, Homo sapiens
ttacagtaaataaattg

SEQ ID NO: 2699920 - DNA, 18 bp, Homo sapiens
ttacagtaaataaattgt

SEQ ID NO: 2699921 - DNA, 14 bp, Homo sapiens
ttagaataaaattg

SEQ ID NO: 2699922 - DNA, 14 bp, Homo sapiens
ttagagtcagcctt

SEQ ID NO: 2699923 - DNA, 21 bp, Homo sapiens
ttaggagttcgagaccagcct

SEQ ID NO: 2699924 - DNA, 19 bp, Homo sapiens
ttaggcagggatttgagga

SEQ ID NO: 2699925 - DNA, 13 bp, Homo sapiens
ttagtattaacta

SEQ ID NO: 2699926 - DNA, 14 bp, Homo sapiens
ttatttgtacagtt

SEQ ID NO: 2699927 - DNA, 20 bp, Homo sapiens
ttatttttttaagctgtaaa

SEQ ID NO: 2699928 - DNA, 20 bp, Homo sapiens
ttcaacctcagccctgaaaa

SEQ ID NO: 2699929 - DNA, 21 bp, Homo sapiens
ttcaagtattaggggtaatat

SEQ ID NO: 2699930 - DNA, 16 bp, Homo sapiens
ttcaattcctgggccc

SEQ ID NO: 2699931 - DNA, 19 bp, Homo sapiens
ttcagtgctgtggcctggg

SEQ ID NO: 2699932 - DNA, 21 bp, Homo sapiens
ttcagtgctgtggcctgggca

SEQ ID NO: 2699933 - DNA, 11 bp, Homo sapiens
ttcattcacaa

SEQ ID NO: 2699934 - DNA, 12 bp, Homo sapiens
ttccactggact

SEQ ID NO: 2699935 - DNA, 22 bp, Homo sapiens
ttccactggacttgagcttggc

SEQ ID NO: 2699936 - DNA, 11 bp, Homo sapiens
ttcccatctgc

SEQ ID NO: 2699937 - DNA, 21 bp, Homo sapiens
ttcccgagcaaagtctaaagt

SEQ ID NO: 2699938 - DNA, 23 bp, Homo sapiens
ttcccgagcaaagtctaaagttt

SEQ ID NO: 2699939 - DNA, 15 bp, Homo sapiens
ttcctatgactaatt

SEQ ID NO: 2699940 - DNA, 15 bp, Homo sapiens
ttcctctttgcatgg

SEQ ID NO: 2699941 - DNA, 17 bp, Homo sapiens
ttcctctttgcatggaa

SEQ ID NO: 2699942 - DNA, 20 bp, Homo sapiens
ttccttgctgtcctaggcca

SEQ ID NO: 2699943 - DNA, 17 bp, Homo sapiens
ttcgagaccagcctggc

SEQ ID NO: 2699944 - DNA, 22 bp, Homo sapiens
ttctcagtgctctcctacccca

SEQ ID NO: 2699945 - DNA, 16 bp, Homo sapiens
ttctgaagctgacagc

SEQ ID NO: 2699946 - DNA, 19 bp, Homo sapiens
ttctgcccacattggaccc

SEQ ID NO: 2699947 - DNA, 16 bp, Homo sapiens
ttctgggaggaagcag

SEQ ID NO: 2699948 - DNA, 14 bp, Homo sapiens
aattagccgggcgt

SEQ ID NO: 2699949 - DNA, 14 bp, Homo sapiens
aattccactggact

SEQ ID NO: 2699950 - DNA, 11 bp, Homo sapiens
aattcctgggc

SEQ ID NO: 2699951 - DNA, 15 bp, Homo sapiens
aattgtatagagata

SEQ ID NO: 2699952 - DNA, 23 bp, Homo sapiens
aattgtatagagatatgcagaag

SEQ ID NO: 2699953 - DNA, 23 bp, Homo sapiens
aatttaaatctgattaatccatt

SEQ ID NO: 2699954 - DNA, 20 bp, Homo sapiens
aatttacctttaaaataata

SEQ ID NO: 2699955 - DNA, 18 bp, Homo sapiens
aatttgtatctgaaggag

SEQ ID NO: 2699956 - DNA, 19 bp, Homo sapiens
aatttgtatctgaaggaga

SEQ ID NO: 2699957 - DNA, 23 bp, Homo sapiens
acaagaagggttttccaccctgg

SEQ ID NO: 2699958 - DNA, 18 bp, Homo sapiens
acacctgccctgccctgc

SEQ ID NO: 2699959 - DNA, 23 bp, Homo sapiens
acacctgccctgccctgccacct

SEQ ID NO: 2699960 - DNA, 21 bp, Homo sapiens
acagagcgagagtctgtctca

SEQ ID NO: 2699961 - DNA, 12 bp, Homo sapiens
acagtaaataaa

SEQ ID NO: 2699962 - DNA, 15 bp, Homo sapiens
acagtaaataaattg

SEQ ID NO: 2699963 - DNA, 17 bp, Homo sapiens
acagtattctcagtgct

SEQ ID NO: 2699964 - DNA, 23 bp, Homo sapiens
acagtcctgggagaacctcaggc

SEQ ID NO: 2699965 - DNA, 18 bp, Homo sapiens
acagtgcccagctaattt

SEQ ID NO: 2699966 - DNA, 17 bp, Homo sapiens
acagtgcttcagcctga

SEQ ID NO: 2699967 - DNA, 22 bp, Homo sapiens
acagtgcttcagcctgaggctg

SEQ ID NO: 2699968 - DNA, 12 bp, Homo sapiens
acagttcagttc

SEQ ID NO: 2699969 - DNA, 21 bp, Homo sapiens
acagttcagttcctctttgca

SEQ ID NO: 2699970 - DNA, 23 bp, Homo sapiens
acatcccaggaggggcctctgaa

SEQ ID NO: 2699971 - DNA, 15 bp, Homo sapiens
acatggccagtgtga

SEQ ID NO: 2699972 - DNA, 12 bp, Homo sapiens
accaataaaaat

SEQ ID NO: 2699973 - DNA, 15 bp, Homo sapiens
accaatacaaattga

SEQ ID NO: 2699974 - DNA, 23 bp, Homo sapiens
accacctctcaatattcaataaa

SEQ ID NO: 2699975 - DNA, 20 bp, Homo sapiens
accagcctggccaacatggt

SEQ ID NO: 2699976 - DNA, 21 bp, Homo sapiens
accagtgtagccttgcccgga

SEQ ID NO: 2699977 - DNA, 19 bp, Homo sapiens
accatattcagtgctgtgg

SEQ ID NO: 2699978 - DNA, 15 bp, Homo sapiens
acccagtgtaaagaa

SEQ ID NO: 2699979 - DNA, 15 bp, Homo sapiens
accctccgccttcac

SEQ ID NO: 2699980 - DNA, 18 bp, Homo sapiens
accctcgtggacacctgc

SEQ ID NO: 2699981 - DNA, 20 bp, Homo sapiens
accctgcgaaggggccctgg

SEQ ID NO: 2699982 - DNA, 21 bp, Homo sapiens
accctgtctcttaaagaaaaa

SEQ ID NO: 2699983 - DNA, 15 bp, Homo sapiens
acccttggacttgag

SEQ ID NO: 2699984 - DNA, 18 bp, Homo sapiens
accgagacggctggacct

SEQ ID NO: 2699985 - DNA, 15 bp, Homo sapiens
acctatagtcccagc

SEQ ID NO: 2699986 - DNA, 15 bp, Homo sapiens
acctcagcctagacc

SEQ ID NO: 2699987 - DNA, 18 bp, Homo sapiens
acctcaggcttccttggc

SEQ ID NO: 2699988 - DNA, 23 bp, Homo sapiens
acctgaagggtgacatcccagga

SEQ ID NO: 2699989 - DNA, 21 bp, Homo sapiens
acctgccagcctggcttctgg

SEQ ID NO: 2699990 - DNA, 19 bp, Homo sapiens
acctgccatttgcaccctc

SEQ ID NO: 2699991 - DNA, 12 bp, Homo sapiens
acctgccctgcc

SEQ ID NO: 2699992 - DNA, 17 bp, Homo sapiens
acctgccctgccctgcc

SEQ ID NO: 2699993 - DNA, 20 bp, Homo sapiens
acctgccctgccctgccacc

SEQ ID NO: 2699994 - DNA, 12 bp, Homo sapiens
acctgtactcag

SEQ ID NO: 2699995 - DNA, 17 bp, Homo sapiens
accttcaattcctgggc

SEQ ID NO: 2699996 - DNA, 19 bp, Homo sapiens
accttcatgcttactattt

SEQ ID NO: 2699997 - DNA, 14 bp, Homo sapiens
acctttaaaataat

SEQ ID NO: 2699998 - DNA, 22 bp, Homo sapiens
acgacaaagccaaactctgcca

SEQ ID NO: 2699999 - DNA, 16 bp, Homo sapiens
acgcctatgatcccag

SEQ ID NO: 2700000 - DNA, 14 bp, Homo sapiens
acggctggacctgc

SEQ ID NO: 2700001 - DNA, 14 bp, Homo sapiens
acggggtccttcaa

SEQ ID NO: 2700002 - DNA, 23 bp, Homo sapiens
acgtgcacctgtactcaggaggc

SEQ ID NO: 2700003 - DNA, 14 bp, Homo sapiens
actaacttgtcttt

SEQ ID NO: 2700004 - DNA, 18 bp, Homo sapiens
actacactccagcctgag

SEQ ID NO: 2700005 - DNA, 19 bp, Homo sapiens
actacactccagcctgagc

SEQ ID NO: 2700006 - DNA, 16 bp, Homo sapiens
actaggactctgaggc

SEQ ID NO: 2700007 - DNA, 13 bp, Homo sapiens
actattggagggt

SEQ ID NO: 2700008 - DNA, 20 bp, Homo sapiens
actccagcctgggcgacaga

SEQ ID NO: 2700009 - DNA, 16 bp, Homo sapiens
actccctccatgtggc

SEQ ID NO: 2700010 - DNA, 15 bp, Homo sapiens
actccggtgtgcctg

SEQ ID NO: 2700011 - DNA, 15 bp, Homo sapiens
actcctacctcagcc

SEQ ID NO: 2700012 - DNA, 14 bp, Homo sapiens
actcctcttatttg

SEQ ID NO: 2700013 - DNA, 16 bp, Homo sapiens
actcctcttatttgct

SEQ ID NO: 2700014 - DNA, 14 bp, Homo sapiens
actctatagacttt

SEQ ID NO: 2700015 - DNA, 16 bp, Homo sapiens
actctgtggggccttg

SEQ ID NO: 2700016 - DNA, 17 bp, Homo sapiens
actctgtggggccttgg

SEQ ID NO: 2700017 - DNA, 20 bp, Homo sapiens
actcttcccccactcctctt

SEQ ID NO: 2700018 - DNA, 17 bp, Homo sapiens
actgcactccagcctgg

SEQ ID NO: 2700019 - DNA, 18 bp, Homo sapiens
actgcactccagcctggg

SEQ ID NO: 2700020 - DNA, 20 bp, Homo sapiens
actgcactccagcctgggcg

SEQ ID NO: 2700021 - DNA, 13 bp, Homo sapiens
actgctgggactg

SEQ ID NO: 2700022 - DNA, 22 bp, Homo sapiens
actggacttgagcttggcagct

SEQ ID NO: 2700023 - DNA, 13 bp, Homo sapiens
actgtatgctgga

SEQ ID NO: 2700024 - DNA, 19 bp, Homo sapiens
acttatatgctgaattgaa

SEQ ID NO: 2700025 - DNA, 12 bp, Homo sapiens
acttatttgagt

SEQ ID NO: 2700026 - DNA, 17 bp, Homo sapiens
acttgaggacacatgtc

SEQ ID NO: 2700027 - DNA, 15 bp, Homo sapiens
acttgagggtaataa

SEQ ID NO: 2700028 - DNA, 17 bp, Homo sapiens
acttgagggtaataaac

SEQ ID NO: 2700029 - DNA, 18 bp, Homo sapiens
acttgagggtaataaact

SEQ ID NO: 2700030 - DNA, 23 bp, Homo sapiens
acttgtccttttgtaccatggtg

SEQ ID NO: 2700031 - DNA, 13 bp, Homo sapiens
actttaaatggaa

SEQ ID NO: 2700032 - DNA, 18 bp, Homo sapiens
actttaaatggaataatt

SEQ ID NO: 2700033 - DNA, 19 bp, Homo sapiens
actttaaatggaataatta

SEQ ID NO: 2700034 - DNA, 17 bp, Homo sapiens
acttttccatgtatcta

SEQ ID NO: 2700035 - DNA, 21 bp, Homo sapiens
acttttccatgtatctacctc

SEQ ID NO: 2700036 - DNA, 19 bp, Homo sapiens
agaacctcaggcttccttg

SEQ ID NO: 2700037 - DNA, 11 bp, Homo sapiens
agaagatatct

SEQ ID NO: 2700038 - DNA, 17 bp, Homo sapiens
agaagcctgaggctggg

SEQ ID NO: 2700039 - DNA, 21 bp, Homo sapiens
agaagggttttccaccctgga

SEQ ID NO: 2700040 - DNA, 21 bp, Homo sapiens
agaatgttatccaactattaa

SEQ ID NO: 2700041 - DNA, 21 bp, Homo sapiens
agacaggacagtgcttcagcc

SEQ ID NO: 2700042 - DNA, 15 bp, Homo sapiens
agaccagcctggcca

SEQ ID NO: 2700043 - DNA, 20 bp, Homo sapiens
agacccagtgtaaagaataa

SEQ ID NO: 2700044 - DNA, 23 bp, Homo sapiens
agacccccccccccaacagaaca

SEQ ID NO: 2700045 - DNA, 17 bp, Homo sapiens
agactatttaacttgag

SEQ ID NO: 2700046 - DNA, 22 bp, Homo sapiens
agactgcgggatggtcctgggg

SEQ ID NO: 2700047 - DNA, 15 bp, Homo sapiens
agactgctgggactg

SEQ ID NO: 2700048 - DNA, 19 bp, Homo sapiens
agactgctgggactggcca

SEQ ID NO: 2700049 - DNA, 20 bp, Homo sapiens
agactgctgggactggccag

SEQ ID NO: 2700050 - DNA, 21 bp, Homo sapiens
agagagaaaacttatttgagt

SEQ ID NO: 2700051 - DNA, 14 bp, Homo sapiens
agagcccagccatt

SEQ ID NO: 2700052 - DNA, 13 bp, Homo sapiens
agagccgggaagc

SEQ ID NO: 2700053 - DNA, 17 bp, Homo sapiens
agaggagggatgctgcc

SEQ ID NO: 2700054 - DNA, 17 bp, Homo sapiens
agagggcccaggcaggc

SEQ ID NO: 2700055 - DNA, 21 bp, Homo sapiens
agagggcccaggcaggccacc

SEQ ID NO: 2700056 - DNA, 22 bp, Homo sapiens
agaggggaaaccagtgtagcct

SEQ ID NO: 2700057 - DNA, 22 bp, Homo sapiens
agatatatatttactaaaagaa

SEQ ID NO: 2700058 - DNA, 23 bp, Homo sapiens
agatatatatttactaaaagaat

SEQ ID NO: 2700059 - DNA, 14 bp, Homo sapiens
agatgactgagtcc

SEQ ID NO: 2700060 - DNA, 22 bp, Homo sapiens
agatgcccagagggcccaggca

SEQ ID NO: 2700061 - DNA, 18 bp, Homo sapiens
agatgtcagactggctgg

SEQ ID NO: 2700062 - DNA, 15 bp, Homo sapiens
agcaaagtctaaagt

SEQ ID NO: 2700063 - DNA, 20 bp, Homo sapiens
agcaaagtctaaagtttaca

SEQ ID NO: 2700064 - DNA, 22 bp, Homo sapiens
agcaacagagtgagaccctgtc

SEQ ID NO: 2700065 - DNA, 17 bp, Homo sapiens
agcacgattttgcacaa

SEQ ID NO: 2700066 - DNA, 20 bp, Homo sapiens
agcaggttgaggggctcctg

SEQ ID NO: 2700067 - DNA, 20 bp, Homo sapiens
cctgttgttcccatctgcgc

SEQ ID NO: 2700068 - DNA, 16 bp, Homo sapiens
ccttcaattcctgggc

SEQ ID NO: 2700069 - DNA, 14 bp, Homo sapiens
ccttgaagccactg

SEQ ID NO: 2700070 - DNA, 21 bp, Homo sapiens
ccttgcaggtcggtttggttt

SEQ ID NO: 2700071 - DNA, 15 bp, Homo sapiens
cctttcagctgtgaa

SEQ ID NO: 2700072 - DNA, 12 bp, Homo sapiens
cctttcagggaa

SEQ ID NO: 2700073 - DNA, 15 bp, Homo sapiens
ccttttgctgctgct

SEQ ID NO: 2700074 - DNA, 19 bp, Homo sapiens
ccttttgtaccatggtgtg

SEQ ID NO: 2700075 - DNA, 22 bp, Homo sapiens
ccttttttatttttttaagctg

SEQ ID NO: 2700076 - DNA, 13 bp, Homo sapiens
cgaaggggccctg

SEQ ID NO: 2700077 - DNA, 13 bp, Homo sapiens
cgagaccagcctg

SEQ ID NO: 2700078 - DNA, 15 bp, Homo sapiens
cgagacggctggacc

SEQ ID NO: 2700079 - DNA, 16 bp, Homo sapiens
cgagacggctggacct

SEQ ID NO: 2700080 - DNA, 20 bp, Homo sapiens
cgagcaaagtctaaagttta

SEQ ID NO: 2700081 - DNA, 22 bp, Homo sapiens
cgagttgtggaaagcctctgct

SEQ ID NO: 2700082 - DNA, 12 bp, Homo sapiens
cgcacacacacc

SEQ ID NO: 2700083 - DNA, 22 bp, Homo sapiens
cgcacacacaccggtcaccgag

SEQ ID NO: 2700084 - DNA, 16 bp, Homo sapiens
cgcagcctccctctga

SEQ ID NO: 2700085 - DNA, 15 bp, Homo sapiens
cgccaccgctgcctt

SEQ ID NO: 2700086 - DNA, 18 bp, Homo sapiens
cgcccagctgcacctgcc

SEQ ID NO: 2700087 - DNA, 20 bp, Homo sapiens
cgcccagctgcacctgccag

SEQ ID NO: 2700088 - DNA, 18 bp, Homo sapiens
cgcctgtgctgaggactc

SEQ ID NO: 2700089 - DNA, 11 bp, Homo sapiens
cgcgcacacac

SEQ ID NO: 2700090 - DNA, 20 bp, Homo sapiens
cgctgccttttgctgctgct

SEQ ID NO: 2700091 - DNA, 13 bp, Homo sapiens
cggaggttgcagg

SEQ ID NO: 2700092 - DNA, 16 bp, Homo sapiens
cgggatggtcctgggg

SEQ ID NO: 2700093 - DNA, 19 bp, Homo sapiens
cggggcatgctggggcaag

SEQ ID NO: 2700094 - DNA, 18 bp, Homo sapiens
cgggggcccgaaagctga

SEQ ID NO: 2700095 - DNA, 22 bp, Homo sapiens
cgggggcccgaaagctgagacc

SEQ ID NO: 2700096 - DNA, 19 bp, Homo sapiens
cgggtggatcacctgaggt

SEQ ID NO: 2700097 - DNA, 22 bp, Homo sapiens
cggtttggtttgttgtaaataa

SEQ ID NO: 2700098 - DNA, 20 bp, Homo sapiens
cgtagccaaggtgggctgag

SEQ ID NO: 2700099 - DNA, 15 bp, Homo sapiens
cgtgcacctgtactc

SEQ ID NO: 2700100 - DNA, 12 bp, Homo sapiens
cgtggacacctg

SEQ ID NO: 2700101 - DNA, 17 bp, Homo sapiens
cgtggacacctgccctg

SEQ ID NO: 2700102 - DNA, 15 bp, Homo sapiens
cgtgtccctctcgga

SEQ ID NO: 2700103 - DNA, 18 bp, Homo sapiens
ctaaacagactatttaac

SEQ ID NO: 2700104 - DNA, 18 bp, Homo sapiens
ctaaagtttacagtaaat

SEQ ID NO: 2700105 - DNA, 19 bp, Homo sapiens
ctaatagaaccaagaattc

SEQ ID NO: 2700106 - DNA, 17 bp, Homo sapiens
ctacactccagcctgag

SEQ ID NO: 2700107 - DNA, 16 bp, Homo sapiens
ctactcagaagcctga

SEQ ID NO: 2700108 - DNA, 16 bp, Homo sapiens
ctactcctacctcagc

SEQ ID NO: 2700109 - DNA, 22 bp, Homo sapiens
ctaggactctgaggctctttct

SEQ ID NO: 2700110 - DNA, 19 bp, Homo sapiens
ctagtgccctccacagccg

SEQ ID NO: 2700111 - DNA, 23 bp, Homo sapiens
ctagtgccctccacagccgcagc

SEQ ID NO: 2700112 - DNA, 13 bp, Homo sapiens
ctagttaataatt

SEQ ID NO: 2700113 - DNA, 20 bp, Homo sapiens
ctataggtttttaaatggaa

SEQ ID NO: 2700114 - DNA, 12 bp, Homo sapiens
ctatccatcctg

SEQ ID NO: 2700115 - DNA, 13 bp, Homo sapiens
ctatccatcctgc

SEQ ID NO: 2700116 - DNA, 14 bp, Homo sapiens
ctatccatcctgcg

SEQ ID NO: 2700117 - DNA, 21 bp, Homo sapiens
ctatgatcccagcactttggg

SEQ ID NO: 2700118 - DNA, 20 bp, Homo sapiens
ctattagtattattaacact

SEQ ID NO: 2700119 - DNA, 14 bp, Homo sapiens
ctatttaacttgag

SEQ ID NO: 2700120 - DNA, 20 bp, Homo sapiens
ctcaaactcctggactcatg

SEQ ID NO: 2700121 - DNA, 17 bp, Homo sapiens
ctcaatgtgcaataact

SEQ ID NO: 2700122 - DNA, 13 bp, Homo sapiens
ctcagaagcctga

SEQ ID NO: 2700123 - DNA, 18 bp, Homo sapiens
ctcagaagcctgaggctg

SEQ ID NO: 2700124 - DNA, 14 bp, Homo sapiens
ctcaggaggctgag

SEQ ID NO: 2700125 - DNA, 15 bp, Homo sapiens
ctcaggaggctgagg

SEQ ID NO: 2700126 - DNA, 16 bp, Homo sapiens
ctcaggaggctgaggg

SEQ ID NO: 2700127 - DNA, 18 bp, Homo sapiens
ctcaggccaggtgcagtg

SEQ ID NO: 2700128 - DNA, 13 bp, Homo sapiens
ctcagtctcagga

SEQ ID NO: 2700129 - DNA, 20 bp, Homo sapiens
ctcatgcctggcccccctcc

SEQ ID NO: 2700130 - DNA, 22 bp, Homo sapiens
ctcatgcctggcccccctccag

SEQ ID NO: 2700131 - DNA, 15 bp, Homo sapiens
ctccacagccgcagc

SEQ ID NO: 2700132 - DNA, 14 bp, Homo sapiens
ctccagcctgagca

SEQ ID NO: 2700133 - DNA, 19 bp, Homo sapiens
ctccaggcatgctggcctc

SEQ ID NO: 2700134 - DNA, 13 bp, Homo sapiens
ctccagggctgcc

SEQ ID NO: 2700135 - DNA, 18 bp, Homo sapiens
ctccagggctgcccctgt

SEQ ID NO: 2700136 - DNA, 21 bp, Homo sapiens
ctccatgtggccccaggtgcc

SEQ ID NO: 2700137 - DNA, 21 bp, Homo sapiens
ctccccaccttcaattcctgg

SEQ ID NO: 2700138 - DNA, 23 bp, Homo sapiens
ctccccaccttcaattcctgggc

SEQ ID NO: 2700139 - DNA, 13 bp, Homo sapiens
ctccccctgggct

SEQ ID NO: 2700140 - DNA, 18 bp, Homo sapiens
ctccgtcatgaatgcctt

SEQ ID NO: 2700141 - DNA, 20 bp, Homo sapiens
ctccgtcatgaatgccttcc

SEQ ID NO: 2700142 - DNA, 14 bp, Homo sapiens
ctcctacctcagcc

SEQ ID NO: 2700143 - DNA, 15 bp, Homo sapiens
ctcctcctcccccag

SEQ ID NO: 2700144 - DNA, 17 bp, Homo sapiens
ctcctggaaaggctcag

SEQ ID NO: 2700145 - DNA, 22 bp, Homo sapiens
ctcctggaaaggctcagtctca

SEQ ID NO: 2700146 - DNA, 23 bp, Homo sapiens
ctcctggaaaggctcagtctcag

SEQ ID NO: 2700147 - DNA, 16 bp, Homo sapiens
ctcggaaggctggctg

SEQ ID NO: 2700148 - DNA, 20 bp, Homo sapiens
ctcggaaggctggctgggca

SEQ ID NO: 2700149 - DNA, 14 bp, Homo sapiens
ctcgtagccatctc

SEQ ID NO: 2700150 - DNA, 17 bp, Homo sapiens
ctcgtggacacctgccc

SEQ ID NO: 2700151 - DNA, 19 bp, Homo sapiens
ctctactaaaaatacagaa

SEQ ID NO: 2700152 - DNA, 19 bp, Homo sapiens
ctctcaatattcaataaag

SEQ ID NO: 2700153 - DNA, 21 bp, Homo sapiens
ctctcaatattcaataaagct

SEQ ID NO: 2700154 - DNA, 19 bp, Homo sapiens
ctctcggaaggctggctgg

SEQ ID NO: 2700155 - DNA, 22 bp, Homo sapiens
ctctcggaaggctggctgggca

SEQ ID NO: 2700156 - DNA, 14 bp, Homo sapiens
ctctgccagccaca

SEQ ID NO: 2700157 - DNA, 15 bp, Homo sapiens
ctctgtgacctgccc

SEQ ID NO: 2700158 - DNA, 20 bp, Homo sapiens
ctgaaaataacagaattctg

SEQ ID NO: 2700159 - DNA, 21 bp, Homo sapiens
ctgaaggagattttccttcct

SEQ ID NO: 2700160 - DNA, 19 bp, Homo sapiens
ctgaagggtgacatcccag

SEQ ID NO: 2700161 - DNA, 20 bp, Homo sapiens
ctgaagggtgacatcccagg

SEQ ID NO: 2700162 - DNA, 20 bp, Homo sapiens
ctgacaactgtttaattgaa

SEQ ID NO: 2700163 - DNA, 13 bp, Homo sapiens
ctgacctgcaggc

SEQ ID NO: 2700164 - DNA, 13 bp, Homo sapiens
ctgactctctgtg

SEQ ID NO: 2700165 - DNA, 14 bp, Homo sapiens
ctgactctctgtga

SEQ ID NO: 2700166 - DNA, 12 bp, Homo sapiens
ctgagccctggc

SEQ ID NO: 2700167 - DNA, 16 bp, Homo sapiens
ctgaggctctttctgg

SEQ ID NO: 2700168 - DNA, 17 bp, Homo sapiens
ctgagtctgctatattt

SEQ ID NO: 2700169 - DNA, 21 bp, Homo sapiens
ctgagtctgctatattttcat

SEQ ID NO: 2700170 - DNA, 20 bp, Homo sapiens
ctgattaatccattttaaca

SEQ ID NO: 2700171 - DNA, 24 bp, Homo sapiens
ctgattttctctggcagcataatt

SEQ ID NO: 2700172 - DNA, 20 bp, Homo sapiens
ctgcacctgccagcctggct

SEQ ID NO: 2700173 - DNA, 14 bp, Homo sapiens
ctgcactccagcct

SEQ ID NO: 2700174 - DNA, 16 bp, Homo sapiens
ctgcactccagcctgg

SEQ ID NO: 2700175 - DNA, 19 bp, Homo sapiens
ctgcactccagcctgggcg

SEQ ID NO: 2700176 - DNA, 21 bp, Homo sapiens
ctgcagaggggaaaccagtgt

SEQ ID NO: 2700177 - DNA, 23 bp, Homo sapiens
ctgcagaggggaaaccagtgtag

SEQ ID NO: 2700178 - DNA, 19 bp, Homo sapiens
ctgcagaggggctttctgg

SEQ ID NO: 2700179 - DNA, 23 bp, Homo sapiens
ctgcagaggggctttctggagag

SEQ ID NO: 2700180 - DNA, 15 bp, Homo sapiens
ctgccacctgtctgt

SEQ ID NO: 2700181 - DNA, 18 bp, Homo sapiens
ctgccacctgtctgtctg

SEQ ID NO: 2700182 - DNA, 15 bp, Homo sapiens
ctgccagcctggctt

SEQ ID NO: 2700183 - DNA, 16 bp, Homo sapiens
ctgccagcctggcttc

SEQ ID NO: 2700184 - DNA, 19 bp, Homo sapiens
ctgccagcctggcttctgg

SEQ ID NO: 2700185 - DNA, 20 bp, Homo sapiens
ctgccagcctggcttctgga

SEQ ID NO: 2700186 - DNA, 22 bp, Homo sapiens
ctgccagcctggcttctggagc

SEQ ID NO: 2700187 - DNA, 12 bp, Homo sapiens
ggggagggggac

SEQ ID NO: 2700188 - DNA, 16 bp, Homo sapiens
ggggcatgctggggca

SEQ ID NO: 2700189 - DNA, 12 bp, Homo sapiens
ggggccctggtc

SEQ ID NO: 2700190 - DNA, 12 bp, Homo sapiens
ggggctcctgga

SEQ ID NO: 2700191 - DNA, 13 bp, Homo sapiens
ggggctcctggaa

SEQ ID NO: 2700192 - DNA, 19 bp, Homo sapiens
gggtcctgcaatctccagg

SEQ ID NO: 2700193 - DNA, 16 bp, Homo sapiens
gggttttccaccctgg

SEQ ID NO: 2700194 - DNA, 22 bp, Homo sapiens
ggtatgaacttgaggacacatg

SEQ ID NO: 2700195 - DNA, 23 bp, Homo sapiens
ggtatgaacttgaggacacatgt

SEQ ID NO: 2700196 - DNA, 21 bp, Homo sapiens
ggtccttcaagttagctcagg

SEQ ID NO: 2700197 - DNA, 16 bp, Homo sapiens
ggtccttccaggcccc

SEQ ID NO: 2700198 - DNA, 17 bp, Homo sapiens
ggtgccaccaataaaaa

SEQ ID NO: 2700199 - DNA, 15 bp, Homo sapiens
ggtggacagtcctgg

SEQ ID NO: 2700200 - DNA, 17 bp, Homo sapiens
ggtggacagtcctggga

SEQ ID NO: 2700201 - DNA, 15 bp, Homo sapiens
ggtgggctgagccct

SEQ ID NO: 2700202 - DNA, 20 bp, Homo sapiens
ggtgtgaaagtcagatgccc

SEQ ID NO: 2700203 - DNA, 13 bp, Homo sapiens
ggtgtgcctgcag

SEQ ID NO: 2700204 - DNA, 14 bp, Homo sapiens
ggtgtgtgtagcca

SEQ ID NO: 2700205 - DNA, 19 bp, Homo sapiens
ggttgcttaaaagggacag

SEQ ID NO: 2700206 - DNA, 16 bp, Homo sapiens
ggtttgttgtaaataa

SEQ ID NO: 2700207 - DNA, 23 bp, Homo sapiens
gtaagttgaatggcctgccttga

SEQ ID NO: 2700208 - DNA, 15 bp, Homo sapiens
gtaatatattgctgc

SEQ ID NO: 2700209 - DNA, 21 bp, Homo sapiens
gtaatatctattattataaaa

SEQ ID NO: 2700210 - DNA, 18 bp, Homo sapiens
gtaattctaccctgaaag

SEQ ID NO: 2700211 - DNA, 14 bp, Homo sapiens
gtaatttgtatctg

SEQ ID NO: 2700212 - DNA, 22 bp, Homo sapiens
gtacagttcagttcctctttgc

SEQ ID NO: 2700213 - DNA, 23 bp, Homo sapiens
gtacagttcagttcctctttgca

SEQ ID NO: 2700214 - DNA, 18 bp, Homo sapiens
gtagccaaggtgggctga

SEQ ID NO: 2700215 - DNA, 22 bp, Homo sapiens
gtagccttgccttttaaaagaa

SEQ ID NO: 2700216 - DNA, 20 bp, Homo sapiens
gtatctcggacctttcagct

SEQ ID NO: 2700217 - DNA, 11 bp, Homo sapiens
gtatctgaagg

SEQ ID NO: 2700218 - DNA, 15 bp, Homo sapiens
gtatgaacttgagga

SEQ ID NO: 2700219 - DNA, 16 bp, Homo sapiens
gtatgaacttgaggac

SEQ ID NO: 2700220 - DNA, 19 bp, Homo sapiens
gtatgaacttgaggacaca

SEQ ID NO: 2700221 - DNA, 23 bp, Homo sapiens
gtatgaacttgaggacacatgtc

SEQ ID NO: 2700222 - DNA, 13 bp, Homo sapiens
gtattagatatca

SEQ ID NO: 2700223 - DNA, 14 bp, Homo sapiens
gtattttcttcaaa

SEQ ID NO: 2700224 - DNA, 18 bp, Homo sapiens
gtcagactggctggctgc

SEQ ID NO: 2700225 - DNA, 22 bp, Homo sapiens
gtcagactggctggctgcagtg

SEQ ID NO: 2700226 - DNA, 15 bp, Homo sapiens
gtccacctgcctatc

SEQ ID NO: 2700227 - DNA, 17 bp, Homo sapiens
gtccctgactctctgtg

SEQ ID NO: 2700228 - DNA, 22 bp, Homo sapiens
gtccttttgtaccatggtgtga

SEQ ID NO: 2700229 - DNA, 15 bp, Homo sapiens
gtctaaagtttacag

SEQ ID NO: 2700230 - DNA, 16 bp, Homo sapiens
gtctcaccacacataa

SEQ ID NO: 2700231 - DNA, 16 bp, Homo sapiens
gtctcaggagcatggg

SEQ ID NO: 2700232 - DNA, 15 bp, Homo sapiens
gtctgctatattttc

SEQ ID NO: 2700233 - DNA, 18 bp, Homo sapiens
gtctgctatattttcatg

SEQ ID NO: 2700234 - DNA, 14 bp, Homo sapiens
gtctgtctgtctgt

SEQ ID NO: 2700235 - DNA, 17 bp, Homo sapiens
gtgacatcccaggaggg

SEQ ID NO: 2700236 - DNA, 23 bp, Homo sapiens
gtgacctgccccgcccagctgca

SEQ ID NO: 2700237 - DNA, 13 bp, Homo sapiens
gtgagaccacctc

SEQ ID NO: 2700238 - DNA, 20 bp, Homo sapiens
gtgagaccacctctcaatat

SEQ ID NO: 2700239 - DNA, 19 bp, Homo sapiens
gtgattatttgttatttgt

SEQ ID NO: 2700240 - DNA, 14 bp, Homo sapiens
gtgccaccaataaa

SEQ ID NO: 2700241 - DNA, 17 bp, Homo sapiens
gtgccaccaataaaaat

SEQ ID NO: 2700242 - DNA, 11 bp, Homo sapiens
gtgcctgcagc

SEQ ID NO: 2700243 - DNA, 19 bp, Homo sapiens
gtgccttacttaagtcggg

SEQ ID NO: 2700244 - DNA, 12 bp, Homo sapiens
gtgctgaggact

SEQ ID NO: 2700245 - DNA, 13 bp, Homo sapiens
gtgcttcagcctg

SEQ ID NO: 2700246 - DNA, 13 bp, Homo sapiens
gtggacagtcctg

SEQ ID NO: 2700247 - DNA, 13 bp, Homo sapiens
gtggcaagggggc

SEQ ID NO: 2700248 - DNA, 15 bp, Homo sapiens
gtggcaagggggcgg

SEQ ID NO: 2700249 - DNA, 16 bp, Homo sapiens
gtggcaagggggcggg

SEQ ID NO: 2700250 - DNA, 17 bp, Homo sapiens
gtggccccaggtgccac

SEQ ID NO: 2700251 - DNA, 16 bp, Homo sapiens
gtgggctgagccctgg

SEQ ID NO: 2700252 - DNA, 18 bp, Homo sapiens
gtgggctgagccctggca

SEQ ID NO: 2700253 - DNA, 16 bp, Homo sapiens
gtgtaaagaataaatg

SEQ ID NO: 2700254 - DNA, 15 bp, Homo sapiens
gtgtcgtagccaagg

SEQ ID NO: 2700255 - DNA, 14 bp, Homo sapiens
gttatccaactatt

SEQ ID NO: 2700256 - DNA, 23 bp, Homo sapiens
gttctggtatgaacttgaggaca

SEQ ID NO: 2700257 - DNA, 16 bp, Homo sapiens
gttgaggggctcctgg

SEQ ID NO: 2700258 - DNA, 17 bp, Homo sapiens
gttgaggggctcctgga

SEQ ID NO: 2700259 - DNA, 18 bp, Homo sapiens
gttgataaattccactgg

SEQ ID NO: 2700260 - DNA, 21 bp, Homo sapiens
gttgataaattccactggact

SEQ ID NO: 2700261 - DNA, 12 bp, Homo sapiens
gttgtaaataaa

SEQ ID NO: 2700262 - DNA, 13 bp, Homo sapiens
gtttacagtaaat

SEQ ID NO: 2700263 - DNA, 15 bp, Homo sapiens
gtttctccccctggg

SEQ ID NO: 2700264 - DNA, 23 bp, Homo sapiens
gtttctccccctgggctctgccc

SEQ ID NO: 2700265 - DNA, 20 bp, Homo sapiens
gtttctgaaagaatcatttg

SEQ ID NO: 2700266 - DNA, 19 bp, Homo sapiens
gtttgcactgtatgctgga

SEQ ID NO: 2700267 - DNA, 22 bp, Homo sapiens
gtttgcactgtatgctggacgg

SEQ ID NO: 2700268 - DNA, 20 bp, Homo sapiens
gttttaaccagtacttctaa

SEQ ID NO: 2700269 - DNA, 19 bp, Homo sapiens
gtttttctacttttaaaga

SEQ ID NO: 2700270 - DNA, 19 bp, Homo sapiens
taaaaccccatctctacta

SEQ ID NO: 2700271 - DNA, 12 bp, Homo sapiens
taaaagaaaaag

SEQ ID NO: 2700272 - DNA, 14 bp, Homo sapiens
taaaattgtaaaat

SEQ ID NO: 2700273 - DNA, 22 bp, Homo sapiens
taaaattgtaaaattgtataga

SEQ ID NO: 2700274 - DNA, 16 bp, Homo sapiens
taaaattgtatagaga

SEQ ID NO: 2700275 - DNA, 23 bp, Homo sapiens
taaaattgtatagagatatgcag

SEQ ID NO: 2700276 - DNA, 20 bp, Homo sapiens
taaacattggtatatttcca

SEQ ID NO: 2700277 - DNA, 21 bp, Homo sapiens
taaagctggacaagaagctgc

SEQ ID NO: 2700278 - DNA, 12 bp, Homo sapiens
taaataaattgt

SEQ ID NO: 2700279 - DNA, 13 bp, Homo sapiens
taaataaattgtt

SEQ ID NO: 2700280 - DNA, 15 bp, Homo sapiens
taaataaattgtttg

SEQ ID NO: 2700281 - DNA, 20 bp, Homo sapiens
taaataaattgtttgaccat

SEQ ID NO: 2700282 - DNA, 13 bp, Homo sapiens
taaatctgattaa

SEQ ID NO: 2700283 - DNA, 17 bp, Homo sapiens
taaccagtacttctaag

SEQ ID NO: 2700284 - DNA, 22 bp, Homo sapiens
taacttgagggtaataaactta

SEQ ID NO: 2700285 - DNA, 13 bp, Homo sapiens
taagctgtaaaaa

SEQ ID NO: 2700286 - DNA, 15 bp, Homo sapiens
taagctgtaaaaaga

SEQ ID NO: 2700287 - DNA, 23 bp, Homo sapiens
taataaacttagaataaaattgt

SEQ ID NO: 2700288 - DNA, 14 bp, Homo sapiens
taatagtactattg

SEQ ID NO: 2700289 - DNA, 16 bp, Homo sapiens
taattagcttgttaca

SEQ ID NO: 2700290 - DNA, 22 bp, Homo sapiens
taatttcagctagttaataatt

SEQ ID NO: 2700291 - DNA, 17 bp, Homo sapiens
tacagaaattagccggg

SEQ ID NO: 2700292 - DNA, 16 bp, Homo sapiens
tacagtaaataaattg

SEQ ID NO: 2700293 - DNA, 17 bp, Homo sapiens
tacagtaaataaattgt

SEQ ID NO: 2700294 - DNA, 21 bp, Homo sapiens
tacagtaaataaattgtttga

SEQ ID NO: 2700295 - DNA, 20 bp, Homo sapiens
taccccaagtccacctgcct

SEQ ID NO: 2700296 - DNA, 14 bp, Homo sapiens
tactagtactatta

SEQ ID NO: 2700297 - DNA, 20 bp, Homo sapiens
tactattatggaattactct

SEQ ID NO: 2700298 - DNA, 16 bp, Homo sapiens
tactcagaagcctgag

SEQ ID NO: 2700299 - DNA, 19 bp, Homo sapiens
tactcagaagcctgaggct

SEQ ID NO: 2700300 - DNA, 17 bp, Homo sapiens
tactcctacctcagcct

SEQ ID NO: 2700301 - DNA, 14 bp, Homo sapiens
tactgaaaatgcat

SEQ ID NO: 2700302 - DNA, 21 bp, Homo sapiens
tactgacaactgtttaattga

SEQ ID NO: 2700303 - DNA, 12 bp, Homo sapiens
tacttctaagag

SEQ ID NO: 2700304 - DNA, 22 bp, Homo sapiens
tagaaatgcataccagtaattg

SEQ ID NO: 2700305 - DNA, 20 bp, Homo sapiens
tagagatatgcagaaggaag

SEQ ID NO: 2700306 - DNA, 15 bp, Homo sapiens
tagagcttggacagt

SEQ ID NO: 2700307 - DNA, 20 bp, Homo sapiens
aaaaagtcagactgctggga

SEQ ID NO: 2700308 - DNA, 14 bp, Homo sapiens
aaaacaaaaataaa

SEQ ID NO: 2700309 - DNA, 22 bp, Homo sapiens
aaaactgaccatcagtatattt

SEQ ID NO: 2700310 - DNA, 11 bp, Homo sapiens
aaaagctaatt

SEQ ID NO: 2700311 - DNA, 19 bp, Homo sapiens
aaaagtatgtgaatatgaa

SEQ ID NO: 2700312 - DNA, 20 bp, Homo sapiens
aaacacaaatgtaaaataag

SEQ ID NO: 2700313 - DNA, 19 bp, Homo sapiens
aaaccagtgtagccttgcc

SEQ ID NO: 2700314 - DNA, 13 bp, Homo sapiens
aaactagtactat

SEQ ID NO: 2700315 - DNA, 17 bp, Homo sapiens
aaacttagaataaaatt

SEQ ID NO: 2700316 - DNA, 18 bp, Homo sapiens
aaacttagaataaaattg

SEQ ID NO: 2700317 - DNA, 13 bp, Homo sapiens
aaagaaaaagtat

SEQ ID NO: 2700318 - DNA, 13 bp, Homo sapiens
aaagaagtaaaag

SEQ ID NO: 2700319 - DNA, 16 bp, Homo sapiens
aaagaagtaaaagcta

SEQ ID NO: 2700320 - DNA, 22 bp, Homo sapiens
aaagagagaaaacttatttgag

SEQ ID NO: 2700321 - DNA, 14 bp, Homo sapiens
aaagcaaaagaagt

SEQ ID NO: 2700322 - DNA, 19 bp, Homo sapiens
aaagcaaaagaagtaaaag

SEQ ID NO: 2700323 - DNA, 23 bp, Homo sapiens
aaagcaggacatatgagaaaact

SEQ ID NO: 2700324 - DNA, 17 bp, Homo sapiens
aaagccaaactctgcca

SEQ ID NO: 2700325 - DNA, 19 bp, Homo sapiens
aaagctggacaagaagctg

SEQ ID NO: 2700326 - DNA, 16 bp, Homo sapiens
aaaggcaaaaccttac

SEQ ID NO: 2700327 - DNA, 19 bp, Homo sapiens
aaaggctcagtctcaggag

SEQ ID NO: 2700328 - DNA, 21 bp, Homo sapiens
aaaggctcagtctcaggagca

SEQ ID NO: 2700329 - DNA, 16 bp, Homo sapiens
aaagtctaaagtttac

SEQ ID NO: 2700330 - DNA, 15 bp, Homo sapiens
aaataaattgtttga

SEQ ID NO: 2700331 - DNA, 20 bp, Homo sapiens
aaataacagaattctgaagt

SEQ ID NO: 2700332 - DNA, 21 bp, Homo sapiens
aaatacaatggtttctgaaag

SEQ ID NO: 2700333 - DNA, 14 bp, Homo sapiens
aaatgaatagagag

SEQ ID NO: 2700334 - DNA, 13 bp, Homo sapiens
aaattccactgga

SEQ ID NO: 2700335 - DNA, 14 bp, Homo sapiens
aaatttatataaaa

SEQ ID NO: 2700336 - DNA, 12 bp, Homo sapiens
aacaatggagat

SEQ ID NO: 2700337 - DNA, 13 bp, Homo sapiens
aacagactattta

SEQ ID NO: 2700338 - DNA, 15 bp, Homo sapiens
aaccagtacttctaa

SEQ ID NO: 2700339 - DNA, 16 bp, Homo sapiens
aaccagtacttctaag

SEQ ID NO: 2700340 - DNA, 17 bp, Homo sapiens
aacgggctgccctgcca

SEQ ID NO: 2700341 - DNA, 20 bp, Homo sapiens
aactattagtattattaaca

SEQ ID NO: 2700342 - DNA, 19 bp, Homo sapiens
aacttagaataaaattgta

SEQ ID NO: 2700343 - DNA, 19 bp, Homo sapiens
aacttatttgagtgattat

SEQ ID NO: 2700344 - DNA, 12 bp, Homo sapiens
aacttgaggaca

SEQ ID NO: 2700345 - DNA, 13 bp, Homo sapiens
aacttgaggacac

SEQ ID NO: 2700346 - DNA, 17 bp, Homo sapiens
aacttgaggacacatgt

SEQ ID NO: 2700347 - DNA, 18 bp, Homo sapiens
aacttgaggacacatgtc

SEQ ID NO: 2700348 - DNA, 16 bp, Homo sapiens
aacttgagggtaataa

SEQ ID NO: 2700349 - DNA, 22 bp, Homo sapiens
aacttgagggtaataaacttag

SEQ ID NO: 2700350 - DNA, 23 bp, Homo sapiens
aagacaggacagtgcttcagcct

SEQ ID NO: 2700351 - DNA, 17 bp, Homo sapiens
aagacccagtgtaaaga

SEQ ID NO: 2700352 - DNA, 19 bp, Homo sapiens
aagcatcacctcaggccag

SEQ ID NO: 2700353 - DNA, 15 bp, Homo sapiens
aagccaaactctgcc

SEQ ID NO: 2700354 - DNA, 20 bp, Homo sapiens
aagccaaactctgccagcca

SEQ ID NO: 2700355 - DNA, 14 bp, Homo sapiens
aagccactgaagct

SEQ ID NO: 2700356 - DNA, 14 bp, Homo sapiens
aagcctctgctgcc

SEQ ID NO: 2700357 - DNA, 20 bp, Homo sapiens
aagcgatgaatttggagact

SEQ ID NO: 2700358 - DNA, 21 bp, Homo sapiens
aagcgatgaatttggagactc

SEQ ID NO: 2700359 - DNA, 21 bp, Homo sapiens
aagctgctgagaatctagcct

SEQ ID NO: 2700360 - DNA, 17 bp, Homo sapiens
aaggctcagtctcagga

SEQ ID NO: 2700361 - DNA, 23 bp, Homo sapiens
aaggggacgcgggctgtgcctta

SEQ ID NO: 2700362 - DNA, 14 bp, Homo sapiens
aagggtgacatccc

SEQ ID NO: 2700363 - DNA, 21 bp, Homo sapiens
aagggttttccaccctggaat

SEQ ID NO: 2700364 - DNA, 19 bp, Homo sapiens
aaggtgggctgagccctgg

SEQ ID NO: 2700365 - DNA, 21 bp, Homo sapiens
aagtaagtaccactcaggcca

SEQ ID NO: 2700366 - DNA, 13 bp, Homo sapiens
aagtctaaagttt

SEQ ID NO: 2700367 - DNA, 17 bp, Homo sapiens
aagtctaaagtttacag

SEQ ID NO: 2700368 - DNA, 19 bp, Homo sapiens
aagtctaaagtttacagta

SEQ ID NO: 2700369 - DNA, 15 bp, Homo sapiens
aagttagctcaggag

SEQ ID NO: 2700370 - DNA, 22 bp, Homo sapiens
aagtttacagtaaataaattgt

SEQ ID NO: 2700371 - DNA, 14 bp, Homo sapiens
aataaaattgtaaa

SEQ ID NO: 2700372 - DNA, 19 bp, Homo sapiens
aataaacttagaataaaat

SEQ ID NO: 2700373 - DNA, 14 bp, Homo sapiens
aataaagctgctga

SEQ ID NO: 2700374 - DNA, 13 bp, Homo sapiens
aataaagctggac

SEQ ID NO: 2700375 - DNA, 23 bp, Homo sapiens
aataaagctggacaagaagctgc

SEQ ID NO: 2700376 - DNA, 13 bp, Homo sapiens
aataaattgtttg

SEQ ID NO: 2700377 - DNA, 13 bp, Homo sapiens
aatatattgaaca

SEQ ID NO: 2700378 - DNA, 20 bp, Homo sapiens
aatatccaccactttaacct

SEQ ID NO: 2700379 - DNA, 14 bp, Homo sapiens
aatccattttaaca

SEQ ID NO: 2700380 - DNA, 17 bp, Homo sapiens
aatctaaaaatcctttt

SEQ ID NO: 2700381 - DNA, 21 bp, Homo sapiens
aatctccaatccacacatatt

SEQ ID NO: 2700382 - DNA, 19 bp, Homo sapiens
aatctccagggctgcccct

SEQ ID NO: 2700383 - DNA, 23 bp, Homo sapiens
aatgaaagcataagcttaagcat

SEQ ID NO: 2700384 - DNA, 22 bp, Homo sapiens
aatgcatttttatcatgtaaca

SEQ ID NO: 2700385 - DNA, 23 bp, Homo sapiens
aatgccaacttgtccttttgtac

SEQ ID NO: 2700386 - DNA, 20 bp, Homo sapiens
aatggcctgccttgaagcca

SEQ ID NO: 2700387 - DNA, 22 bp, Homo sapiens
aatggcctgccttgaagccact

SEQ ID NO: 2700388 - DNA, 13 bp, Homo sapiens
aattctagaaaat

SEQ ID NO: 2700389 - DNA, 17 bp, Homo sapiens
aatttacctttaaaata

SEQ ID NO: 2700390 - DNA, 15 bp, Homo sapiens
aatttgtaagtttat

SEQ ID NO: 2700391 - DNA, 14 bp, Homo sapiens
aatttgtatctgaa

SEQ ID NO: 2700392 - DNA, 20 bp, Homo sapiens
aatttgtatctgaaggagat

SEQ ID NO: 2700393 - DNA, 19 bp, Homo sapiens
acaaagccaaactctgcca

SEQ ID NO: 2700394 - DNA, 13 bp, Homo sapiens
acaagaagctgct

SEQ ID NO: 2700395 - DNA, 21 bp, Homo sapiens
acaccagagtgtagaataata

SEQ ID NO: 2700396 - DNA, 16 bp, Homo sapiens
acacccttggacttga

SEQ ID NO: 2700397 - DNA, 12 bp, Homo sapiens
acacctgccctg

SEQ ID NO: 2700398 - DNA, 14 bp, Homo sapiens
acacctgccctgcc

SEQ ID NO: 2700399 - DNA, 22 bp, Homo sapiens
acaccttttccaggagttctga

SEQ ID NO: 2700400 - DNA, 16 bp, Homo sapiens
acacggggtattttag

SEQ ID NO: 2700401 - DNA, 15 bp, Homo sapiens
acactccagcctgag

SEQ ID NO: 2700402 - DNA, 17 bp, Homo sapiens
acactccagcctgagca

SEQ ID NO: 2700403 - DNA, 17 bp, Homo sapiens
acagactatttaacttg

SEQ ID NO: 2700404 - DNA, 13 bp, Homo sapiens
acagccgcagcct

SEQ ID NO: 2700405 - DNA, 17 bp, Homo sapiens
acaggacagtgcttcag

SEQ ID NO: 2700406 - DNA, 13 bp, Homo sapiens
acagtaaataaat

SEQ ID NO: 2700407 - DNA, 14 bp, Homo sapiens
acagtaaataaatt

SEQ ID NO: 2700408 - DNA, 18 bp, Homo sapiens
acagtaaataaattgttt

SEQ ID NO: 2700409 - DNA, 22 bp, Homo sapiens
acagtcctgggagaacctcagg

SEQ ID NO: 2700410 - DNA, 17 bp, Homo sapiens
acagtgcccagctaatt

SEQ ID NO: 2700411 - DNA, 17 bp, Homo sapiens
accactaggactctgag

SEQ ID NO: 2700412 - DNA, 13 bp, Homo sapiens
accagtgtagcct

SEQ ID NO: 2700413 - DNA, 14 bp, Homo sapiens
acccagtgtaaaga

SEQ ID NO: 2700414 - DNA, 19 bp, Homo sapiens
acccatgaagacaggacag

SEQ ID NO: 2700415 - DNA, 22 bp, Homo sapiens
accccaagtccacctgcctatc

SEQ ID NO: 2700416 - DNA, 22 bp, Homo sapiens
accccacctcatgcctggcccc

SEQ ID NO: 2700417 - DNA, 18 bp, Homo sapiens
accctgcgaaggggccct

SEQ ID NO: 2700418 - DNA, 19 bp, Homo sapiens
accctgcgaaggggccctg

SEQ ID NO: 2700419 - DNA, 16 bp, Homo sapiens
acctatagtcccagct

SEQ ID NO: 2700420 - DNA, 20 bp, Homo sapiens
acctcactattcaagtatta

SEQ ID NO: 2700421 - DNA, 10 bp, Homo sapiens
acctcagcct

SEQ ID NO: 2700422 - DNA, 13 bp, Homo sapiens
acctcaggccagg

SEQ ID NO: 2700423 - DNA, 21 bp, Homo sapiens
acctcaggccaggtgcagtgg

SEQ ID NO: 2700424 - DNA, 18 bp, Homo sapiens
acctcatgcctggccccc

SEQ ID NO: 2700425 - DNA, 12 bp, Homo sapiens
acctctcaatat

SEQ ID NO: 2700426 - DNA, 19 bp, Homo sapiens
acctctcaatattcaataa

SEQ ID NO: 2700427 - DNA, 23 bp, Homo sapiens
acctctcaatattcaataaagct

SEQ ID NO: 2700428 - DNA, 18 bp, Homo sapiens
acctgagtctgctatatt

SEQ ID NO: 2700429 - DNA, 16 bp, Homo sapiens
acctgcacgccaccgc

SEQ ID NO: 2700430 - DNA, 19 bp, Homo sapiens
acctgcaggccaagagcag

SEQ ID NO: 2700431 - DNA, 14 bp, Homo sapiens
acctgccagcctgg

SEQ ID NO: 2700432 - DNA, 15 bp, Homo sapiens
acctgccatttgcac

SEQ ID NO: 2700433 - DNA, 18 bp, Homo sapiens
acctgccctgccctgcca

SEQ ID NO: 2700434 - DNA, 22 bp, Homo sapiens
acctgccctgccctgccacctg

SEQ ID NO: 2700435 - DNA, 21 bp, Homo sapiens
acctgcctatccatcctgcga

SEQ ID NO: 2700436 - DNA, 12 bp, Homo sapiens
acctgtctgtct

SEQ ID NO: 2700437 - DNA, 22 bp, Homo sapiens
accttttccaggagttctgaag

SEQ ID NO: 2700438 - DNA, 14 bp, Homo sapiens
acgattttgcacaa

SEQ ID NO: 2700439 - DNA, 15 bp, Homo sapiens
acgcgcacacacacc

SEQ ID NO: 2700440 - DNA, 13 bp, Homo sapiens
acggggaggggga

SEQ ID NO: 2700441 - DNA, 14 bp, Homo sapiens
actaaaagaatttg

SEQ ID NO: 2700442 - DNA, 15 bp, Homo sapiens
actacactccagcct

SEQ ID NO: 2700443 - DNA, 15 bp, Homo sapiens
actagaaatctgcca

SEQ ID NO: 2700444 - DNA, 17 bp, Homo sapiens
actaggactctgaggct

SEQ ID NO: 2700445 - DNA, 16 bp, Homo sapiens
gaaagcatcacctcag

SEQ ID NO: 2700446 - DNA, 17 bp, Homo sapiens
gaaagcatcacctcagg

SEQ ID NO: 2700447 - DNA, 21 bp, Homo sapiens
gaaagctgagaccctcgccac

SEQ ID NO: 2700448 - DNA, 14 bp, Homo sapiens
gaaaggctcagtct

SEQ ID NO: 2700449 - DNA, 19 bp, Homo sapiens
gaaaggctcagtctcagga

SEQ ID NO: 2700450 - DNA, 22 bp, Homo sapiens
gaaaggctcagtctcaggagca

SEQ ID NO: 2700451 - DNA, 16 bp, Homo sapiens
gaaatgcataccagta

SEQ ID NO: 2700452 - DNA, 22 bp, Homo sapiens
gaaatgcataccagtaattggc

SEQ ID NO: 2700453 - DNA, 18 bp, Homo sapiens
gaacctcaggcttccttg

SEQ ID NO: 2700454 - DNA, 17 bp, Homo sapiens
gaacttgaggacacatg

SEQ ID NO: 2700455 - DNA, 18 bp, Homo sapiens
gaacttgaggacacatgt

SEQ ID NO: 2700456 - DNA, 19 bp, Homo sapiens
gaacttgaggacacatgtc

SEQ ID NO: 2700457 - DNA, 14 bp, Homo sapiens
gaagaaaaatgttt

SEQ ID NO: 2700458 - DNA, 15 bp, Homo sapiens
gaagacaggacagtg

SEQ ID NO: 2700459 - DNA, 18 bp, Homo sapiens
gaagacccagtgtaaaga

SEQ ID NO: 2700460 - DNA, 23 bp, Homo sapiens
gaagacccagtgtaaagaataaa

SEQ ID NO: 2700461 - DNA, 18 bp, Homo sapiens
gaagcaggttgaggggct

SEQ ID NO: 2700462 - DNA, 22 bp, Homo sapiens
gaagcaggttgaggggctcctg

SEQ ID NO: 2700463 - DNA, 13 bp, Homo sapiens
gaaggctggctgg

SEQ ID NO: 2700464 - DNA, 23 bp, Homo sapiens
gaagtttcctatgactaattcac

SEQ ID NO: 2700465 - DNA, 22 bp, Homo sapiens
gaataaaattgtaaaattgtat

SEQ ID NO: 2700466 - DNA, 11 bp, Homo sapiens
gacacctgccc

SEQ ID NO: 2700467 - DNA, 13 bp, Homo sapiens
gacacctgccctg

SEQ ID NO: 2700468 - DNA, 15 bp, Homo sapiens
gacacctgccctgcc

SEQ ID NO: 2700469 - DNA, 16 bp, Homo sapiens
gacacctgccctgccc

SEQ ID NO: 2700470 - DNA, 22 bp, Homo sapiens
gacacctgccctgccctgccac

SEQ ID NO: 2700471 - DNA, 23 bp, Homo sapiens
gacacctgccctgccctgccacc

SEQ ID NO: 2700472 - DNA, 16 bp, Homo sapiens
gacactgttaatagta

SEQ ID NO: 2700473 - DNA, 23 bp, Homo sapiens
gacagtcctgggagaacctcagg

SEQ ID NO: 2700474 - DNA, 11 bp, Homo sapiens
gaccagcctgg

SEQ ID NO: 2700475 - DNA, 13 bp, Homo sapiens
gaccagcctggcc

SEQ ID NO: 2700476 - DNA, 20 bp, Homo sapiens
gaccctgcgaaggggccctg

SEQ ID NO: 2700477 - DNA, 21 bp, Homo sapiens
gacctgaagggtgacatccca

SEQ ID NO: 2700478 - DNA, 21 bp, Homo sapiens
gacctgccccgcccagctgca

SEQ ID NO: 2700479 - DNA, 14 bp, Homo sapiens
gacgcgcacacaca

SEQ ID NO: 2700480 - DNA, 14 bp, Homo sapiens
gactctctgtgacc

SEQ ID NO: 2700481 - DNA, 22 bp, Homo sapiens
gactgcgggatggtcctggggc

SEQ ID NO: 2700482 - DNA, 14 bp, Homo sapiens
gactgctgggactg

SEQ ID NO: 2700483 - DNA, 16 bp, Homo sapiens
gactggctggctgcag

SEQ ID NO: 2700484 - DNA, 17 bp, Homo sapiens
gacttttccatgtatct

SEQ ID NO: 2700485 - DNA, 12 bp, Homo sapiens
gagaccacctct

SEQ ID NO: 2700486 - DNA, 17 bp, Homo sapiens
gagaccctcgccacggg

SEQ ID NO: 2700487 - DNA, 12 bp, Homo sapiens
gagactctgtgg

SEQ ID NO: 2700488 - DNA, 19 bp, Homo sapiens
actattactattactattt

SEQ ID NO: 2700489 - DNA, 14 bp, Homo sapiens
actatttaacttga

SEQ ID NO: 2700490 - DNA, 18 bp, Homo sapiens
actatttaacttgagggt

SEQ ID NO: 2700491 - DNA, 17 bp, Homo sapiens
actcagaagcctgaggc

SEQ ID NO: 2700492 - DNA, 16 bp, Homo sapiens
actcaggaggctgagg

SEQ ID NO: 2700493 - DNA, 14 bp, Homo sapiens
actccagcctgagc

SEQ ID NO: 2700494 - DNA, 23 bp, Homo sapiens
actccctccatgtggccccaggt

SEQ ID NO: 2700495 - DNA, 21 bp, Homo sapiens
actccggtgtgcctgcagccc

SEQ ID NO: 2700496 - DNA, 17 bp, Homo sapiens
actcctacctcagccta

SEQ ID NO: 2700497 - DNA, 16 bp, Homo sapiens
actctgccagccacat

SEQ ID NO: 2700498 - DNA, 19 bp, Homo sapiens
actgcactccagcctgggc

SEQ ID NO: 2700499 - DNA, 21 bp, Homo sapiens
actgcactccagcctgggcga

SEQ ID NO: 2700500 - DNA, 20 bp, Homo sapiens
actgcgggatggtcctgggg

SEQ ID NO: 2700501 - DNA, 22 bp, Homo sapiens
actgcgggatggtcctggggct

SEQ ID NO: 2700502 - DNA, 21 bp, Homo sapiens
actggagacttggaagagttg

SEQ ID NO: 2700503 - DNA, 12 bp, Homo sapiens
actggagcccag

SEQ ID NO: 2700504 - DNA, 12 bp, Homo sapiens
actggccccacc

SEQ ID NO: 2700505 - DNA, 13 bp, Homo sapiens
actggccccaccc

SEQ ID NO: 2700506 - DNA, 16 bp, Homo sapiens
actgttaatagtacta

SEQ ID NO: 2700507 - DNA, 22 bp, Homo sapiens
actgttaatagtactattaaca

SEQ ID NO: 2700508 - DNA, 16 bp, Homo sapiens
acttagaataaaattg

SEQ ID NO: 2700509 - DNA, 18 bp, Homo sapiens
acttagaataaaattgta

SEQ ID NO: 2700510 - DNA, 22 bp, Homo sapiens
acttagaataaaattgtaaaat

SEQ ID NO: 2700511 - DNA, 20 bp, Homo sapiens
acttataagtgggagctaaa

SEQ ID NO: 2700512 - DNA, 22 bp, Homo sapiens
acttatatgctgaattgaacat

SEQ ID NO: 2700513 - DNA, 17 bp, Homo sapiens
acttatgcatagatata

SEQ ID NO: 2700514 - DNA, 11 bp, Homo sapiens
acttatttgag

SEQ ID NO: 2700515 - DNA, 16 bp, Homo sapiens
acttgaggacacatgt

SEQ ID NO: 2700516 - DNA, 11 bp, Homo sapiens
acttgggatgt

SEQ ID NO: 2700517 - DNA, 17 bp, Homo sapiens
acttgtgtattagatat

SEQ ID NO: 2700518 - DNA, 14 bp, Homo sapiens
acttgtttaacatt

SEQ ID NO: 2700519 - DNA, 19 bp, Homo sapiens
actttgggaggctgaggcg

SEQ ID NO: 2700520 - DNA, 23 bp, Homo sapiens
agaaacacaaatgtaaaataagt

SEQ ID NO: 2700521 - DNA, 20 bp, Homo sapiens
agaacctaatagcaccaata

SEQ ID NO: 2700522 - DNA, 12 bp, Homo sapiens
agaagcctgagg

SEQ ID NO: 2700523 - DNA, 14 bp, Homo sapiens
agaagcctgaggct

SEQ ID NO: 2700524 - DNA, 20 bp, Homo sapiens
agaagggttttccaccctgg

SEQ ID NO: 2700525 - DNA, 22 bp, Homo sapiens
agaagggttttccaccctggaa

SEQ ID NO: 2700526 - DNA, 23 bp, Homo sapiens
agaagggttttccaccctggaat

SEQ ID NO: 2700527 - DNA, 16 bp, Homo sapiens
agaagtaaaagctaat

SEQ ID NO: 2700528 - DNA, 12 bp, Homo sapiens
agaataaaattg

SEQ ID NO: 2700529 - DNA, 13 bp, Homo sapiens
agaataaaattgt

SEQ ID NO: 2700530 - DNA, 12 bp, Homo sapiens
agaccagcctgg

SEQ ID NO: 2700531 - DNA, 13 bp, Homo sapiens
agaccagcctggc

SEQ ID NO: 2700532 - DNA, 23 bp, Homo sapiens
agacccagtgtaaagaataaatg

SEQ ID NO: 2700533 - DNA, 20 bp, Homo sapiens
agagatatgcagaaggaagg

SEQ ID NO: 2700534 - DNA, 16 bp, Homo sapiens
agagccgggaagcgat

SEQ ID NO: 2700535 - DNA, 18 bp, Homo sapiens
agagcttggacagtctga

SEQ ID NO: 2700536 - DNA, 18 bp, Homo sapiens
agaggggctttctggaga

SEQ ID NO: 2700537 - DNA, 22 bp, Homo sapiens
agatcacgccactgcactccag

SEQ ID NO: 2700538 - DNA, 15 bp, Homo sapiens
agatgactgagtcct

SEQ ID NO: 2700539 - DNA, 14 bp, Homo sapiens
agatggggtcttgc

SEQ ID NO: 2700540 - DNA, 19 bp, Homo sapiens
agattacaggattaatata

SEQ ID NO: 2700541 - DNA, 21 bp, Homo sapiens
agattacaggattaatatatt

SEQ ID NO: 2700542 - DNA, 12 bp, Homo sapiens
agcactttggga

SEQ ID NO: 2700543 - DNA, 14 bp, Homo sapiens
agcagagcaggggc

SEQ ID NO: 2700544 - DNA, 13 bp, Homo sapiens
agcagaggcagcg

SEQ ID NO: 2700545 - DNA, 14 bp, Homo sapiens
agcatcacctcagg

SEQ ID NO: 2700546 - DNA, 19 bp, Homo sapiens
agcatcacctcaggccagg

SEQ ID NO: 2700547 - DNA, 19 bp, Homo sapiens
agcatccttttctgcagag

SEQ ID NO: 2700548 - DNA, 23 bp, Homo sapiens
agccaaggtgggctgagccctgg

SEQ ID NO: 2700549 - DNA, 16 bp, Homo sapiens
agccactgaagctggg

SEQ ID NO: 2700550 - DNA, 18 bp, Homo sapiens
agccattaccatggagac

SEQ ID NO: 2700551 - DNA, 23 bp, Homo sapiens
agcccagccattaccatggagac

SEQ ID NO: 2700552 - DNA, 15 bp, Homo sapiens
agccccgcgcctcct

SEQ ID NO: 2700553 - DNA, 18 bp, Homo sapiens
agccccgcgcctccttcc

SEQ ID NO: 2700554 - DNA, 18 bp, Homo sapiens
agccgcagcctccctctg

SEQ ID NO: 2700555 - DNA, 22 bp, Homo sapiens
agccgggcgtggtggcgggcac

SEQ ID NO: 2700556 - DNA, 18 bp, Homo sapiens
agccgtccaacttaaaaa

SEQ ID NO: 2700557 - DNA, 15 bp, Homo sapiens
agcctactgaaaatg

SEQ ID NO: 2700558 - DNA, 13 bp, Homo sapiens
agcctccctctga

SEQ ID NO: 2700559 - DNA, 18 bp, Homo sapiens
agcctggcttctggagcc

SEQ ID NO: 2700560 - DNA, 20 bp, Homo sapiens
agcctggcttctggagccct

SEQ ID NO: 2700561 - DNA, 20 bp, Homo sapiens
agcctgttgttcccatctgc

SEQ ID NO: 2700562 - DNA, 18 bp, Homo sapiens
agcgatgaatttggagac

SEQ ID NO: 2700563 - DNA, 15 bp, Homo sapiens
agctactcagaagcc

SEQ ID NO: 2700564 - DNA, 19 bp, Homo sapiens
agctactcagaagcctgag

SEQ ID NO: 2700565 - DNA, 20 bp, Homo sapiens
agctactcagaagcctgagg

SEQ ID NO: 2700566 - DNA, 21 bp, Homo sapiens
agctactcagaagcctgaggc

SEQ ID NO: 2700567 - DNA, 20 bp, Homo sapiens
agctctggcttccagaaaac

SEQ ID NO: 2700568 - DNA, 18 bp, Homo sapiens
agctgagaccctcgccac

SEQ ID NO: 2700569 - DNA, 14 bp, Homo sapiens
taatatattgaaca

SEQ ID NO: 2700570 - DNA, 17 bp, Homo sapiens
taatattttagattaca

SEQ ID NO: 2700571 - DNA, 17 bp, Homo sapiens
tacactccagcctgagc

SEQ ID NO: 2700572 - DNA, 18 bp, Homo sapiens
tacactccagcctgagca

SEQ ID NO: 2700573 - DNA, 15 bp, Homo sapiens
tacagtaaataaatt

SEQ ID NO: 2700574 - DNA, 16 bp, Homo sapiens
tacatggccagtgtga

SEQ ID NO: 2700575 - DNA, 11 bp, Homo sapiens
tactaaaagaa

SEQ ID NO: 2700576 - DNA, 14 bp, Homo sapiens
tactatattgctgt

SEQ ID NO: 2700577 - DNA, 19 bp, Homo sapiens
tagcaccaatacaaattga

SEQ ID NO: 2700578 - DNA, 23 bp, Homo sapiens
tagccaaggtgggctgagccctg

SEQ ID NO: 2700579 - DNA, 22 bp, Homo sapiens
tagccttgccttttaaaagaaa

SEQ ID NO: 2700580 - DNA, 18 bp, Homo sapiens
taggactctgaggctctt

SEQ ID NO: 2700581 - DNA, 23 bp, Homo sapiens
taggagttcgagaccagcctggc

SEQ ID NO: 2700582 - DNA, 23 bp, Homo sapiens
taggggtaatatattgctgctgg

SEQ ID NO: 2700583 - DNA, 14 bp, Homo sapiens
tagtactattacta

SEQ ID NO: 2700584 - DNA, 18 bp, Homo sapiens
tagtcctagaggacctga

SEQ ID NO: 2700585 - DNA, 17 bp, Homo sapiens
tagtgccctccacagcc

SEQ ID NO: 2700586 - DNA, 14 bp, Homo sapiens
tagtgttaactgtt

SEQ ID NO: 2700587 - DNA, 17 bp, Homo sapiens
tatagagatatgcagaa

SEQ ID NO: 2700588 - DNA, 21 bp, Homo sapiens
tatagagatatgcagaaggaa

SEQ ID NO: 2700589 - DNA, 17 bp, Homo sapiens
tatagcttccagattac

SEQ ID NO: 2700590 - DNA, 18 bp, Homo sapiens
tatatctttaataagtaa

SEQ ID NO: 2700591 - DNA, 18 bp, Homo sapiens
tatatgctgaattgaaca

SEQ ID NO: 2700592 - DNA, 17 bp, Homo sapiens
tatatttactaaaagaa

SEQ ID NO: 2700593 - DNA, 18 bp, Homo sapiens
gcccagctgcacctgcca

SEQ ID NO: 2700594 - DNA, 14 bp, Homo sapiens
gccccaggtgccac

SEQ ID NO: 2700595 - DNA, 22 bp, Homo sapiens
gccccaggtgccaccaataaaa

SEQ ID NO: 2700596 - DNA, 17 bp, Homo sapiens
gcccgaaagctgagacc

SEQ ID NO: 2700597 - DNA, 15 bp, Homo sapiens
gcccggattctggga

SEQ ID NO: 2700598 - DNA, 17 bp, Homo sapiens
gcccggattctgggagg

SEQ ID NO: 2700599 - DNA, 14 bp, Homo sapiens
gccctccacagccg

SEQ ID NO: 2700600 - DNA, 13 bp, Homo sapiens
gccctgcagaggg

SEQ ID NO: 2700601 - DNA, 22 bp, Homo sapiens
gccgagatcacgccactgcact

SEQ ID NO: 2700602 - DNA, 19 bp, Homo sapiens
gcctatccatcctgcgagc

SEQ ID NO: 2700603 - DNA, 15 bp, Homo sapiens
gcctatgatcccagc

SEQ ID NO: 2700604 - DNA, 20 bp, Homo sapiens
gcctcccaataaagctggac

SEQ ID NO: 2700605 - DNA, 14 bp, Homo sapiens
gcctccctctgacc

SEQ ID NO: 2700606 - DNA, 21 bp, Homo sapiens
gcctccctctgacctgcaggc

SEQ ID NO: 2700607 - DNA, 20 bp, Homo sapiens
gcctccttccttgctgtcct

SEQ ID NO: 2700608 - DNA, 17 bp, Homo sapiens
gcctgaggctgagactg

SEQ ID NO: 2700609 - DNA, 23 bp, Homo sapiens
gcctgccttgaagccactgaagc

SEQ ID NO: 2700610 - DNA, 20 bp, Homo sapiens
gcctggcccccctccaggca

SEQ ID NO: 2700611 - DNA, 13 bp, Homo sapiens
gcctggcttctgg

SEQ ID NO: 2700612 - DNA, 17 bp, Homo sapiens
gcctggcttctggagcc

SEQ ID NO: 2700613 - DNA, 12 bp, Homo sapiens
gcctgggcaaga

SEQ ID NO: 2700614 - DNA, 20 bp, Homo sapiens
gcctgggcgacagagcgaga

SEQ ID NO: 2700615 - DNA, 19 bp, Homo sapiens
gcctgttgttcccatctgc

SEQ ID NO: 2700616 - DNA, 14 bp, Homo sapiens
gccttgaagccact

SEQ ID NO: 2700617 - DNA, 22 bp, Homo sapiens
gccttgcccggattctgggagg

SEQ ID NO: 2700618 - DNA, 15 bp, Homo sapiens
gcgaaggggccctgg

SEQ ID NO: 2700619 - DNA, 16 bp, Homo sapiens
gcgagagtctgtctca

SEQ ID NO: 2700620 - DNA, 21 bp, Homo sapiens
gcgagctatgatcgcgccact

SEQ ID NO: 2700621 - DNA, 11 bp, Homo sapiens
gcgcacacaca

SEQ ID NO: 2700622 - DNA, 17 bp, Homo sapiens
gcgcacctgccccctgg

SEQ ID NO: 2700623 - DNA, 18 bp, Homo sapiens
gcgcacctgccccctggt

SEQ ID NO: 2700624 - DNA, 21 bp, Homo sapiens
gcgccactacactccagcctg

SEQ ID NO: 2700625 - DNA, 15 bp, Homo sapiens
gcgcctccttccttg

SEQ ID NO: 2700626 - DNA, 15 bp, Homo sapiens
gcggaggttgcaggg

SEQ ID NO: 2700627 - DNA, 15 bp, Homo sapiens
gcgggatggtcctgg

SEQ ID NO: 2700628 - DNA, 22 bp, Homo sapiens
gctatattttcatgacttttcc

SEQ ID NO: 2700629 - DNA, 23 bp, Homo sapiens
gctatattttcatgacttttcca

SEQ ID NO: 2700630 - DNA, 18 bp, Homo sapiens
ggttgaggggctcctgga

SEQ ID NO: 2700631 - DNA, 13 bp, Homo sapiens
ggttgcagggagc

SEQ ID NO: 2700632 - DNA, 14 bp, Homo sapiens
gtaaagaataaatg

SEQ ID NO: 2700633 - DNA, 15 bp, Homo sapiens
gtaaagaataaatga

SEQ ID NO: 2700634 - DNA, 16 bp, Homo sapiens
gtaaagaataaatgaa

SEQ ID NO: 2700635 - DNA, 12 bp, Homo sapiens
gtaatatattgc

SEQ ID NO: 2700636 - DNA, 13 bp, Homo sapiens
gtaatatattgct

SEQ ID NO: 2700637 - DNA, 16 bp, Homo sapiens
gtaatatattgctgct

SEQ ID NO: 2700638 - DNA, 20 bp, Homo sapiens
gtaatatattgctgctggta

SEQ ID NO: 2700639 - DNA, 13 bp, Homo sapiens
gtaatttgtatct

SEQ ID NO: 2700640 - DNA, 14 bp, Homo sapiens
gtacagttcagttc

SEQ ID NO: 2700641 - DNA, 23 bp, Homo sapiens
gtactcaggaggctgaggggagg

SEQ ID NO: 2700642 - DNA, 12 bp, Homo sapiens
gtacttctaaga

SEQ ID NO: 2700643 - DNA, 19 bp, Homo sapiens
gtattaggggtaatatatt

SEQ ID NO: 2700644 - DNA, 22 bp, Homo sapiens
gtattaggggtaatatattgct

SEQ ID NO: 2700645 - DNA, 19 bp, Homo sapiens
gtattattaacactaataa

SEQ ID NO: 2700646 - DNA, 16 bp, Homo sapiens
gtcagactgctgggac

SEQ ID NO: 2700647 - DNA, 24 bp, Homo sapiens
gtccagtgggaggtgagaccacct

SEQ ID NO: 2700648 - DNA, 21 bp, Homo sapiens
gtccctctcggaaggctggct

SEQ ID NO: 2700649 - DNA, 17 bp, Homo sapiens
gtcctcgtagccatctc

SEQ ID NO: 2700650 - DNA, 21 bp, Homo sapiens
gtcctgcaatctccagggctg

SEQ ID NO: 2700651 - DNA, 20 bp, Homo sapiens
gtcctgggagaacctcaggc

SEQ ID NO: 2700652 - DNA, 21 bp, Homo sapiens
gtcctgggagaacctcaggct

SEQ ID NO: 2700653 - DNA, 16 bp, Homo sapiens
gtcctggggctctgtg

SEQ ID NO: 2700654 - DNA, 14 bp, Homo sapiens
gtccttccaggccc

SEQ ID NO: 2700655 - DNA, 17 bp, Homo sapiens
gtccttttgtaccatgg

SEQ ID NO: 2700656 - DNA, 13 bp, Homo sapiens
gtcgggggtggca

SEQ ID NO: 2700657 - DNA, 20 bp, Homo sapiens
gtcgtagccaaggtgggctg

SEQ ID NO: 2700658 - DNA, 17 bp, Homo sapiens
gtctaaagtttacagta

SEQ ID NO: 2700659 - DNA, 19 bp, Homo sapiens
gtctagcagagcaggggca

SEQ ID NO: 2700660 - DNA, 12 bp, Homo sapiens
gtctcaggagca

SEQ ID NO: 2700661 - DNA, 16 bp, Homo sapiens
gtctgtctgtctgtcc

SEQ ID NO: 2700662 - DNA, 14 bp, Homo sapiens
gtgagaccacctct

SEQ ID NO: 2700663 - DNA, 13 bp, Homo sapiens
gtgcactggcccc

SEQ ID NO: 2700664 - DNA, 16 bp, Homo sapiens
gtgcactggccccacc

SEQ ID NO: 2700665 - DNA, 18 bp, Homo sapiens
gtgcactggccccaccct

SEQ ID NO: 2700666 - DNA, 14 bp, Homo sapiens
gtgcccagctaatt

SEQ ID NO: 2700667 - DNA, 15 bp, Homo sapiens
gtgcttcagcctgag

SEQ ID NO: 2700668 - DNA, 14 bp, Homo sapiens
gtggaaagcctctg

SEQ ID NO: 2700669 - DNA, 15 bp, Homo sapiens
gtggaaagcctctgc

SEQ ID NO: 2700670 - DNA, 12 bp, Homo sapiens
gtggacacctgc

SEQ ID NO: 2700671 - DNA, 16 bp, Homo sapiens
gtggacacctgccctg

SEQ ID NO: 2700672 - DNA, 17 bp, Homo sapiens
gtggacacctgccctgc

SEQ ID NO: 2700673 - DNA, 19 bp, Homo sapiens
gtggacacctgccctgccc

SEQ ID NO: 2700674 - DNA, 16 bp, Homo sapiens
gtggacagtcctggga

SEQ ID NO: 2700675 - DNA, 12 bp, Homo sapiens
gtggcagccctg

SEQ ID NO: 2700676 - DNA, 14 bp, Homo sapiens
gtggcagccctgta

SEQ ID NO: 2700677 - DNA, 14 bp, Homo sapiens
gtgggagagcccag

SEQ ID NO: 2700678 - DNA, 17 bp, Homo sapiens
gtgggaggtgagaccac

SEQ ID NO: 2700679 - DNA, 13 bp, Homo sapiens
gtgggctgagccc

SEQ ID NO: 2700680 - DNA, 15 bp, Homo sapiens
gtgtaaagaataaat

SEQ ID NO: 2700681 - DNA, 22 bp, Homo sapiens
gtgtaaagaataaatgaatctt

SEQ ID NO: 2700682 - DNA, 16 bp, Homo sapiens
gtgtagccttgcccgg

SEQ ID NO: 2700683 - DNA, 13 bp, Homo sapiens
gtgtgcctgcagc

SEQ ID NO: 2700684 - DNA, 14 bp, Homo sapiens
gtgtgggctgtgtc

SEQ ID NO: 2700685 - DNA, 15 bp, Homo sapiens
gtgttgatcccaaga

SEQ ID NO: 2700686 - DNA, 15 bp, Homo sapiens
gttaggagttcgaga

SEQ ID NO: 2700687 - DNA, 22 bp, Homo sapiens
gttatccaactattaagatatc

SEQ ID NO: 2700688 - DNA, 17 bp, Homo sapiens
gttcgagaccagcctgg

SEQ ID NO: 2700689 - DNA, 19 bp, Homo sapiens
gttcgagaccagcctggcc

SEQ ID NO: 2700690 - DNA, 18 bp, Homo sapiens
gttgaggggctcctggaa

SEQ ID NO: 2700691 - DNA, 19 bp, Homo sapiens
gttgtggaaagcctctgct

SEQ ID NO: 2700692 - DNA, 19 bp, Homo sapiens
gttgttaatactgtattgc

SEQ ID NO: 2700693 - DNA, 19 bp, Homo sapiens
gtttacagtaaataaattg

SEQ ID NO: 2700694 - DNA, 15 bp, Homo sapiens
gtttatgtctaaaga

SEQ ID NO: 2700695 - DNA, 14 bp, Homo sapiens
gtttctccccctgg

SEQ ID NO: 2700696 - DNA, 16 bp, Homo sapiens
gtttgaggctgcagcg

SEQ ID NO: 2700697 - DNA, 18 bp, Homo sapiens
gtttgtttctccccctgg

SEQ ID NO: 2700698 - DNA, 19 bp, Homo sapiens
gtttgtttctccccctggg

SEQ ID NO: 2700699 - DNA, 23 bp, Homo sapiens
gttttcccgagcaaagtctaaag

SEQ ID NO: 2700700 - DNA, 19 bp, Homo sapiens
taaaaagagagaaaactta

SEQ ID NO: 2700701 - DNA, 20 bp, Homo sapiens
taaaaagagagaaaacttat

SEQ ID NO: 2700702 - DNA, 12 bp, Homo sapiens
taaaagctaatt

SEQ ID NO: 2700703 - DNA, 16 bp, Homo sapiens
taaaattgtaaaattg

SEQ ID NO: 2700704 - DNA, 19 bp, Homo sapiens
taaacttagaataaaattg

SEQ ID NO: 2700705 - DNA, 20 bp, Homo sapiens
taaacttagaataaaattgt

SEQ ID NO: 2700706 - DNA, 21 bp, Homo sapiens
taaacttagaataaaattgta

SEQ ID NO: 2700707 - DNA, 13 bp, Homo sapiens
taaagaataaatg

SEQ ID NO: 2700708 - DNA, 16 bp, Homo sapiens
taaagctggacaagaa

SEQ ID NO: 2700709 - DNA, 19 bp, Homo sapiens
taaagctggacaagaagct

SEQ ID NO: 2700710 - DNA, 23 bp, Homo sapiens
taaagctggacaagaagctgcta

SEQ ID NO: 2700711 - DNA, 17 bp, Homo sapiens
taaaggagaaggcatga

SEQ ID NO: 2700712 - DNA, 13 bp, Homo sapiens
taaagtttacagt

SEQ ID NO: 2700713 - DNA, 17 bp, Homo sapiens
taaagtttacagtaaat

SEQ ID NO: 2700714 - DNA, 23 bp, Homo sapiens
taaagtttacagtaaataaattg

SEQ ID NO: 2700715 - DNA, 12 bp, Homo sapiens
taaatacaatgg

SEQ ID NO: 2700716 - DNA, 14 bp, Homo sapiens
taaattccactgga

SEQ ID NO: 2700717 - DNA, 12 bp, Homo sapiens
taagctgtaaaa

SEQ ID NO: 2700718 - DNA, 17 bp, Homo sapiens
taagttgaatggcctgc

SEQ ID NO: 2700719 - DNA, 18 bp, Homo sapiens
taataaacttagaataaa

SEQ ID NO: 2700720 - DNA, 14 bp, Homo sapiens
taatagaaatgcat

SEQ ID NO: 2700721 - DNA, 17 bp, Homo sapiens
taatagtactattaaca

SEQ ID NO: 2700722 - DNA, 12 bp, Homo sapiens
taatatattgaa

SEQ ID NO: 2700723 - DNA, 17 bp, Homo sapiens
tctcaatattcaataaa

SEQ ID NO: 2700724 - DNA, 18 bp, Homo sapiens
tctcaatattcaataaag

SEQ ID NO: 2700725 - DNA, 24 bp, Homo sapiens
tctccagggctgcccctgtaggtt

SEQ ID NO: 2700726 - DNA, 20 bp, Homo sapiens
tctccccctgggctctgccc

SEQ ID NO: 2700727 - DNA, 15 bp, Homo sapiens
tctcctaccccacct

SEQ ID NO: 2700728 - DNA, 16 bp, Homo sapiens
tctcctaccccacctc

SEQ ID NO: 2700729 - DNA, 19 bp, Homo sapiens
tctctactcctacctcagc

SEQ ID NO: 2700730 - DNA, 20 bp, Homo sapiens
tctctactcctacctcagcc

SEQ ID NO: 2700731 - DNA, 22 bp, Homo sapiens
tctctctactcctacctcagcc

SEQ ID NO: 2700732 - DNA, 18 bp, Homo sapiens
tctctgtgacctgccccg

SEQ ID NO: 2700733 - DNA, 15 bp, Homo sapiens
tctgaaatttcccac

SEQ ID NO: 2700734 - DNA, 16 bp, Homo sapiens
tctgaaatttcccaca

SEQ ID NO: 2700735 - DNA, 12 bp, Homo sapiens
tctgaaggagat

SEQ ID NO: 2700736 - DNA, 19 bp, Homo sapiens
tctgaaggagattttcctt

SEQ ID NO: 2700737 - DNA, 15 bp, Homo sapiens
tctgacctgcaggcc

SEQ ID NO: 2700738 - DNA, 19 bp, Homo sapiens
tctgacctgcaggccaaga

SEQ ID NO: 2700739 - DNA, 11 bp, Homo sapiens
tctgagatcag

SEQ ID NO: 2700740 - DNA, 20 bp, Homo sapiens
cagctgcacctgccagcctg

SEQ ID NO: 2700741 - DNA, 16 bp, Homo sapiens
caggacagtgcttcag

SEQ ID NO: 2700742 - DNA, 22 bp, Homo sapiens
caggacagtgcttcagcctgag

SEQ ID NO: 2700743 - DNA, 13 bp, Homo sapiens
caggaggctgagg

SEQ ID NO: 2700744 - DNA, 18 bp, Homo sapiens
caggagtttgaggctgca

SEQ ID NO: 2700745 - DNA, 15 bp, Homo sapiens
caggatgaccctgcg

SEQ ID NO: 2700746 - DNA, 12 bp, Homo sapiens
caggattaatat

SEQ ID NO: 2700747 - DNA, 14 bp, Homo sapiens
caggcatgctggcc

SEQ ID NO: 2700748 - DNA, 19 bp, Homo sapiens
caggcatgctggcctccca

SEQ ID NO: 2700749 - DNA, 21 bp, Homo sapiens
caggccaagagcagaggcagc

SEQ ID NO: 2700750 - DNA, 23 bp, Homo sapiens
caggccaccatattcagtgctgt

SEQ ID NO: 2700751 - DNA, 15 bp, Homo sapiens
caggccaggtgcagt

SEQ ID NO: 2700752 - DNA, 16 bp, Homo sapiens
caggccaggtgcagtg

SEQ ID NO: 2700753 - DNA, 15 bp, Homo sapiens
caggcccccaccact

SEQ ID NO: 2700754 - DNA, 14 bp, Homo sapiens
caggcttccttggc

SEQ ID NO: 2700755 - DNA, 23 bp, Homo sapiens
cagggaatttcaggaactagaga

SEQ ID NO: 2700756 - DNA, 16 bp, Homo sapiens
cagggacggggactgg

SEQ ID NO: 2700757 - DNA, 20 bp, Homo sapiens
cagggaggaggtggcagccc

SEQ ID NO: 2700758 - DNA, 23 bp, Homo sapiens
cagggaggaggtggcagccctgt

SEQ ID NO: 2700759 - DNA, 13 bp, Homo sapiens
cagggatttgagg

SEQ ID NO: 2700760 - DNA, 12 bp, Homo sapiens
cagggcagagcc

SEQ ID NO: 2700761 - DNA, 15 bp, Homo sapiens
cagggccagggccct

SEQ ID NO: 2700762 - DNA, 16 bp, Homo sapiens
cagggccagggccctg

SEQ ID NO: 2700763 - DNA, 19 bp, Homo sapiens
cagggccagggccctgcag

SEQ ID NO: 2700764 - DNA, 23 bp, Homo sapiens
cagggctgcccctgtaggttgct

SEQ ID NO: 2700765 - DNA, 16 bp, Homo sapiens
caggtgccaccaataa

SEQ ID NO: 2700766 - DNA, 17 bp, Homo sapiens
caggtgccaccaataaa

SEQ ID NO: 2700767 - DNA, 21 bp, Homo sapiens
caggttgaggggctcctggaa

SEQ ID NO: 2700768 - DNA, 19 bp, Homo sapiens
cagtaaataaattgtttga

SEQ ID NO: 2700769 - DNA, 24 bp, Homo sapiens
cagtaaataaattgtttgaccatg

SEQ ID NO: 2700770 - DNA, 14 bp, Homo sapiens
cagtacttctaaga

SEQ ID NO: 2700771 - DNA, 20 bp, Homo sapiens
cagtccagtcaagaaaagaa

SEQ ID NO: 2700772 - DNA, 21 bp, Homo sapiens
cagtcctgggagaacctcagg

SEQ ID NO: 2700773 - DNA, 23 bp, Homo sapiens
cagtcctgggagaacctcaggct

SEQ ID NO: 2700774 - DNA, 14 bp, Homo sapiens
cagtctcaggagca

SEQ ID NO: 2700775 - DNA, 11 bp, Homo sapiens
cagtctgagct

SEQ ID NO: 2700776 - DNA, 17 bp, Homo sapiens
cagtgacgtgcacctgt

SEQ ID NO: 2700777 - DNA, 22 bp, Homo sapiens
cagtgacgtgcacctgtactca

SEQ ID NO: 2700778 - DNA, 15 bp, Homo sapiens
cagtgcccagctaat

SEQ ID NO: 2700779 - DNA, 12 bp, Homo sapiens
cagtgctgtggc

SEQ ID NO: 2700780 - DNA, 18 bp, Homo sapiens
cagtgctgtggcctgggc

SEQ ID NO: 2700781 - DNA, 14 bp, Homo sapiens
cagtgcttcagcct

SEQ ID NO: 2700782 - DNA, 15 bp, Homo sapiens
cagtgcttcagcctg

SEQ ID NO: 2700783 - DNA, 18 bp, Homo sapiens
cagtgcttcagcctgagg

SEQ ID NO: 2700784 - DNA, 21 bp, Homo sapiens
cagtgggaggtgagaccacct

SEQ ID NO: 2700785 - DNA, 20 bp, Homo sapiens
cagtgtaaagaataaatgaa

SEQ ID NO: 2700786 - DNA, 18 bp, Homo sapiens
cagtgtgatcccaagtgc

SEQ ID NO: 2700787 - DNA, 15 bp, Homo sapiens
cagttcctctttgca

SEQ ID NO: 2700788 - DNA, 17 bp, Homo sapiens
cagttcctctttgcatg

SEQ ID NO: 2700789 - DNA, 18 bp, Homo sapiens
cagttcctctttgcatgg

SEQ ID NO: 2700790 - DNA, 20 bp, Homo sapiens
catcacagggcagagccggg

SEQ ID NO: 2700791 - DNA, 12 bp, Homo sapiens
catcacctcagg

SEQ ID NO: 2700792 - DNA, 18 bp, Homo sapiens
catcacctcaggccaggt

SEQ ID NO: 2700793 - DNA, 16 bp, Homo sapiens
catccaaccccccacc

SEQ ID NO: 2700794 - DNA, 19 bp, Homo sapiens
catcccaggaggggcctct

SEQ ID NO: 2700795 - DNA, 12 bp, Homo sapiens
catccttctgcc

SEQ ID NO: 2700796 - DNA, 15 bp, Homo sapiens
catccttctgccttt

SEQ ID NO: 2700797 - DNA, 19 bp, Homo sapiens
catccttttctgcagaggg

SEQ ID NO: 2700798 - DNA, 21 bp, Homo sapiens
catctctctactcctacctca

SEQ ID NO: 2700799 - DNA, 23 bp, Homo sapiens
catctctctactcctacctcagc

SEQ ID NO: 2700800 - DNA, 19 bp, Homo sapiens
catgaagtaaattgaaagc

SEQ ID NO: 2700801 - DNA, 15 bp, Homo sapiens
catgacgtaaaattt

SEQ ID NO: 2700802 - DNA, 21 bp, Homo sapiens
catgacttttccatgtatcta

SEQ ID NO: 2700803 - DNA, 17 bp, Homo sapiens
catgcctggcccccctc

SEQ ID NO: 2700804 - DNA, 15 bp, Homo sapiens
catgctgatttacca

SEQ ID NO: 2700805 - DNA, 19 bp, Homo sapiens
catggacgttcggggcatg

SEQ ID NO: 2700806 - DNA, 19 bp, Homo sapiens
catggcgtgtccctctcgg

SEQ ID NO: 2700807 - DNA, 14 bp, Homo sapiens
catgtatctacctc

SEQ ID NO: 2700808 - DNA, 18 bp, Homo sapiens
catgtggccccaggtgcc

SEQ ID NO: 2700809 - DNA, 18 bp, Homo sapiens
cattcatgccaaagcaaa

SEQ ID NO: 2700810 - DNA, 18 bp, Homo sapiens
catttaatcaatatttaa

SEQ ID NO: 2700811 - DNA, 15 bp, Homo sapiens
catttgataaactaa

SEQ ID NO: 2700812 - DNA, 23 bp, Homo sapiens
ccaaataatattttagattacag

SEQ ID NO: 2700813 - DNA, 20 bp, Homo sapiens
ccaaggtgggctgagccctg

SEQ ID NO: 2700814 - DNA, 23 bp, Homo sapiens
ccaaggtgggctgagccctggca

SEQ ID NO: 2700815 - DNA, 12 bp, Homo sapiens
ccacagccgcag

SEQ ID NO: 2700816 - DNA, 18 bp, Homo sapiens
ccacagccgcagcctccc

SEQ ID NO: 2700817 - DNA, 12 bp, Homo sapiens
ccaccaataaaa

SEQ ID NO: 2700818 - DNA, 20 bp, Homo sapiens
ccaccactaggactctgagg

SEQ ID NO: 2700819 - DNA, 23 bp, Homo sapiens
ccaccatattcagtgctgtggcc

SEQ ID NO: 2700820 - DNA, 17 bp, Homo sapiens
ccaccctcgtggacacc

SEQ ID NO: 2700821 - DNA, 20 bp, Homo sapiens
ccaccctcgtggacacctgc

SEQ ID NO: 2700822 - DNA, 19 bp, Homo sapiens
ccacctgcctatccatcct

SEQ ID NO: 2700823 - DNA, 21 bp, Homo sapiens
ccacctgcctatccatcctgc

SEQ ID NO: 2700824 - DNA, 12 bp, Homo sapiens
ccacctgtctgt

SEQ ID NO: 2700825 - DNA, 13 bp, Homo sapiens
ccacggggagggg

SEQ ID NO: 2700826 - DNA, 19 bp, Homo sapiens
ccactacactccagcctga

SEQ ID NO: 2700827 - DNA, 16 bp, Homo sapiens
ccactaggactctgag

SEQ ID NO: 2700828 - DNA, 15 bp, Homo sapiens
ccactgaagctggga

SEQ ID NO: 2700829 - DNA, 17 bp, Homo sapiens
ccactgcactccagcct

SEQ ID NO: 2700830 - DNA, 18 bp, Homo sapiens
ccactgcactccagcctg

SEQ ID NO: 2700831 - DNA, 21 bp, Homo sapiens
ccactgcactccagcctgggc

SEQ ID NO: 2700832 - DNA, 23 bp, Homo sapiens
ccagaggggtgggttcctcttcc

SEQ ID NO: 2700833 - DNA, 11 bp, Homo sapiens
ccagattacaa

SEQ ID NO: 2700834 - DNA, 19 bp, Homo sapiens
ccagcatccttttctgcag

SEQ ID NO: 2700835 - DNA, 19 bp, Homo sapiens
ccagccattaccatggaga

SEQ ID NO: 2700836 - DNA, 21 bp, Homo sapiens
ccagccattaccatggagaca

SEQ ID NO: 2700837 - DNA, 21 bp, Homo sapiens
ccagcctggcttctggagccc

SEQ ID NO: 2700838 - DNA, 19 bp, Homo sapiens
ccagcctgggcgacagagc

SEQ ID NO: 2700839 - DNA, 20 bp, Homo sapiens
ccagcgcctgtgctgaggac

SEQ ID NO: 2700840 - DNA, 22 bp, Homo sapiens
ccagcgcctgtgctgaggactc

SEQ ID NO: 2700841 - DNA, 16 bp, Homo sapiens
ccagctactcagaagc

SEQ ID NO: 2700842 - DNA, 21 bp, Homo sapiens
ccagctactcagaagcctgag

SEQ ID NO: 2700843 - DNA, 23 bp, Homo sapiens
ccagctactcagaagcctgaggc

SEQ ID NO: 2700844 - DNA, 18 bp, Homo sapiens
ccagctgcacctgccagc

SEQ ID NO: 2700845 - DNA, 17 bp, Homo sapiens
ccaggaggggcctctga

SEQ ID NO: 2700846 - DNA, 20 bp, Homo sapiens
ccaggagtttgaggctgcag

SEQ ID NO: 2700847 - DNA, 12 bp, Homo sapiens
ccaggcatgctg

SEQ ID NO: 2700848 - DNA, 18 bp, Homo sapiens
ccagggctcaaaaagttt

SEQ ID NO: 2700849 - DNA, 16 bp, Homo sapiens
ccagggctgcccctgt

SEQ ID NO: 2700850 - DNA, 18 bp, Homo sapiens
ccaggtgccaccaataaa

SEQ ID NO: 2700851 - DNA, 19 bp, Homo sapiens
ccaggtgccaccaataaaa

SEQ ID NO: 2700852 - DNA, 14 bp, Homo sapiens
ccagtacttctaag

SEQ ID NO: 2700853 - DNA, 15 bp, Homo sapiens
ccagtacttctaaga

SEQ ID NO: 2700854 - DNA, 16 bp, Homo sapiens
ccagtacttctaagag

SEQ ID NO: 2700855 - DNA, 23 bp, Homo sapiens
ccagtgggaggtgagaccacctc

SEQ ID NO: 2700856 - DNA, 22 bp, Homo sapiens
ccatattcagtgctgtggcctg

SEQ ID NO: 2700857 - DNA, 16 bp, Homo sapiens
ccatgaagacaggaca

SEQ ID NO: 2700858 - DNA, 19 bp, Homo sapiens
ccatggcgtgtccctctcg

SEQ ID NO: 2700859 - DNA, 21 bp, Homo sapiens
gaccctgcgaaggggccctgg

SEQ ID NO: 2700860 - DNA, 22 bp, Homo sapiens
gaccctgcgaaggggccctggt

SEQ ID NO: 2700861 - DNA, 12 bp, Homo sapiens
gaccctgtctct

SEQ ID NO: 2700862 - DNA, 22 bp, Homo sapiens
gacctgaagggtgacatcccag

SEQ ID NO: 2700863 - DNA, 23 bp, Homo sapiens
gacctgaagggtgacatcccagg

SEQ ID NO: 2700864 - DNA, 17 bp, Homo sapiens
gacctttcagctgtgaa

SEQ ID NO: 2700865 - DNA, 18 bp, Homo sapiens
gacgcgggctgtgcctta

SEQ ID NO: 2700866 - DNA, 21 bp, Homo sapiens
gacgttcggggcatgctgggg

SEQ ID NO: 2700867 - DNA, 14 bp, Homo sapiens
gactccctccatgt

SEQ ID NO: 2700868 - DNA, 17 bp, Homo sapiens
gactctgtggggccttg

SEQ ID NO: 2700869 - DNA, 17 bp, Homo sapiens
gactggctggctgcagt

SEQ ID NO: 2700870 - DNA, 18 bp, Homo sapiens
gacttttccatgtatcta

SEQ ID NO: 2700871 - DNA, 23 bp, Homo sapiens
gagaaaactgaccatcagtatat

SEQ ID NO: 2700872 - DNA, 18 bp, Homo sapiens
gagaaaacttatttgagt

SEQ ID NO: 2700873 - DNA, 13 bp, Homo sapiens
gagaccagcctgg

SEQ ID NO: 2700874 - DNA, 22 bp, Homo sapiens
gagaccctcgccacggggaggg

SEQ ID NO: 2700875 - DNA, 14 bp, Homo sapiens
gagacggctggacc

SEQ ID NO: 2700876 - DNA, 15 bp, Homo sapiens
gagacggctggacct

SEQ ID NO: 2700877 - DNA, 19 bp, Homo sapiens
gagacggctggacctgcac

SEQ ID NO: 2700878 - DNA, 22 bp, Homo sapiens
gagactgcgggatggtcctggg

SEQ ID NO: 2700879 - DNA, 13 bp, Homo sapiens
gagagaaaactta

SEQ ID NO: 2700880 - DNA, 16 bp, Homo sapiens
gagatatgcagaagga

SEQ ID NO: 2700881 - DNA, 16 bp, Homo sapiens
gagatcacgccactgc

SEQ ID NO: 2700882 - DNA, 18 bp, Homo sapiens
gagattaagaatattgcc

SEQ ID NO: 2700883 - DNA, 14 bp, Homo sapiens
gagcaaagtctaaa

SEQ ID NO: 2700884 - DNA, 15 bp, Homo sapiens
gagcagcttcagttg

SEQ ID NO: 2700885 - DNA, 22 bp, Homo sapiens
gagcatggggataaaggagaag

SEQ ID NO: 2700886 - DNA, 19 bp, Homo sapiens
gagccgagatcacgccact

SEQ ID NO: 2700887 - DNA, 20 bp, Homo sapiens
gagccgagatcacgccactg

SEQ ID NO: 2700888 - DNA, 13 bp, Homo sapiens
gaggacacatgtc

SEQ ID NO: 2700889 - DNA, 20 bp, Homo sapiens
gaggaggtggcagccctgta

SEQ ID NO: 2700890 - DNA, 20 bp, Homo sapiens
gaggatcactggagcccagg

SEQ ID NO: 2700891 - DNA, 16 bp, Homo sapiens
gaggctctttctgggc

SEQ ID NO: 2700892 - DNA, 16 bp, Homo sapiens
gaggctgcagcgagct

SEQ ID NO: 2700893 - DNA, 15 bp, Homo sapiens
gaggcttggaaagca

SEQ ID NO: 2700894 - DNA, 19 bp, Homo sapiens
gagggtgggagagcccagc

SEQ ID NO: 2700895 - DNA, 16 bp, Homo sapiens
gaggtgagaccacctc

SEQ ID NO: 2700896 - DNA, 18 bp, Homo sapiens
gaggtggcagccctgtag

SEQ ID NO: 2700897 - DNA, 18 bp, Homo sapiens
gagtctgctatattttca

SEQ ID NO: 2700898 - DNA, 12 bp, Homo sapiens
gagtctgtctca

SEQ ID NO: 2700899 - DNA, 19 bp, Homo sapiens
gagttcgagaccagcctgg

SEQ ID NO: 2700900 - DNA, 22 bp, Homo sapiens
gatatatatttactaaaagaat

SEQ ID NO: 2700901 - DNA, 13 bp, Homo sapiens
gatatctcaatgt

SEQ ID NO: 2700902 - DNA, 14 bp, Homo sapiens
gatatgcagaagga

SEQ ID NO: 2700903 - DNA, 14 bp, Homo sapiens
gatcacctgaggtt

SEQ ID NO: 2700904 - DNA, 13 bp, Homo sapiens
gatcactggagcc

SEQ ID NO: 2700905 - DNA, 14 bp, Homo sapiens
gatcactggagccc

SEQ ID NO: 2700906 - DNA, 14 bp, Homo sapiens
gatgactgagtcct

SEQ ID NO: 2700907 - DNA, 17 bp, Homo sapiens
gatgactgagtcctcgt

SEQ ID NO: 2700908 - DNA, 19 bp, Homo sapiens
gatgcccagagggcccagg

SEQ ID NO: 2700909 - DNA, 20 bp, Homo sapiens
gatgcccagagggcccaggc

SEQ ID NO: 2700910 - DNA, 22 bp, Homo sapiens
gatgcccagagggcccaggcag

SEQ ID NO: 2700911 - DNA, 14 bp, Homo sapiens
gatgctgcctgagt

SEQ ID NO: 2700912 - DNA, 18 bp, Homo sapiens
gattaatatattgaacac

SEQ ID NO: 2700913 - DNA, 23 bp, Homo sapiens
gattaatccattttaacaaacaa

SEQ ID NO: 2700914 - DNA, 22 bp, Homo sapiens
gattatttgttatttgtacagt

SEQ ID NO: 2700915 - DNA, 21 bp, Homo sapiens
gcaaagtctaaagtttacagt

SEQ ID NO: 2700916 - DNA, 15 bp, Homo sapiens
gcaagggggcggggc

SEQ ID NO: 2700917 - DNA, 22 bp, Homo sapiens
gcaagtccctgactctctgtga

SEQ ID NO: 2700918 - DNA, 20 bp, Homo sapiens
gcacacacaccggtcaccga

SEQ ID NO: 2700919 - DNA, 16 bp, Homo sapiens
gcaccctccgccttca

SEQ ID NO: 2700920 - DNA, 21 bp, Homo sapiens
gcacctatagtcccagctact

SEQ ID NO: 2700921 - DNA, 17 bp, Homo sapiens
gcacctgccagcctggc

SEQ ID NO: 2700922 - DNA, 22 bp, Homo sapiens
gcacctgccagcctggcttctg

SEQ ID NO: 2700923 - DNA, 17 bp, Homo sapiens
gcacctgccccctggtg

SEQ ID NO: 2700924 - DNA, 22 bp, Homo sapiens
gcacctgccccctggtggacag

SEQ ID NO: 2700925 - DNA, 19 bp, Homo sapiens
gcacctgtactcaggaggc

SEQ ID NO: 2700926 - DNA, 15 bp, Homo sapiens
gcactccagcctggg

SEQ ID NO: 2700927 - DNA, 16 bp, Homo sapiens
gcactgtatgctggac

SEQ ID NO: 2700928 - DNA, 14 bp, Homo sapiens
gcagagcaggggca

SEQ ID NO: 2700929 - DNA, 18 bp, Homo sapiens
gcagaggggctttctgga

SEQ ID NO: 2700930 - DNA, 16 bp, Homo sapiens
gcagcctccctctgac

SEQ ID NO: 2700931 - DNA, 22 bp, Homo sapiens
gcagcctccctctgacctgcag

SEQ ID NO: 2700932 - DNA, 24 bp, Homo sapiens
gcaggccaagagcagaggcagcga

SEQ ID NO: 2700933 - DNA, 17 bp, Homo sapiens
gcagggacggggactgg

SEQ ID NO: 2700934 - DNA, 19 bp, Homo sapiens
gcaggttgaggggctcctg

SEQ ID NO: 2700935 - DNA, 18 bp, Homo sapiens
gcagtgacgtgcacctgt

SEQ ID NO: 2700936 - DNA, 16 bp, Homo sapiens
gcagtggctcacgcct

SEQ ID NO: 2700937 - DNA, 15 bp, Homo sapiens
gcatcacagggcaga

SEQ ID NO: 2700938 - DNA, 17 bp, Homo sapiens
gcatggaatttgtaagt

SEQ ID NO: 2700939 - DNA, 16 bp, Homo sapiens
gccaaggtgggctgag

SEQ ID NO: 2700940 - DNA, 15 bp, Homo sapiens
gccaagttcctctag

SEQ ID NO: 2700941 - DNA, 21 bp, Homo sapiens
gccaagttcctctagtgccct

SEQ ID NO: 2700942 - DNA, 10 bp, Homo sapiens
gccacctgtc

SEQ ID NO: 2700943 - DNA, 21 bp, Homo sapiens
gccactgcactccagcctggg

SEQ ID NO: 2700944 - DNA, 12 bp, Homo sapiens
gccagcctggct

SEQ ID NO: 2700945 - DNA, 19 bp, Homo sapiens
gccagcctggcttctggag

SEQ ID NO: 2700946 - DNA, 22 bp, Homo sapiens
gccaggtttctgcccacattgg

SEQ ID NO: 2700947 - DNA, 20 bp, Homo sapiens
gccagtgtgatcccaagtgc

SEQ ID NO: 2700948 - DNA, 20 bp, Homo sapiens
gccatttgcaccctccgcct

SEQ ID NO: 2700949 - DNA, 15 bp, Homo sapiens
gcccagagggcccag

SEQ ID NO: 2700950 - DNA, 16 bp, Homo sapiens
gcccagagggcccagg

SEQ ID NO: 2700951 - DNA, 20 bp, Homo sapiens
gcccagagggcccaggcagg

SEQ ID NO: 2700952 - DNA, 21 bp, Homo sapiens
gcccagccattaccatggaga

SEQ ID NO: 2700953 - DNA, 14 bp, Homo sapiens
gcccagctgcacct

SEQ ID NO: 2700954 - DNA, 14 bp, Homo sapiens
gcccaggcaggcca

SEQ ID NO: 2700955 - DNA, 20 bp, Homo sapiens
gccccaaacgggctgccctg

SEQ ID NO: 2700956 - DNA, 21 bp, Homo sapiens
gccccaccctcgtggacacct

SEQ ID NO: 2700957 - DNA, 22 bp, Homo sapiens
gccccaccctcgtggacacctg

SEQ ID NO: 2700958 - DNA, 14 bp, Homo sapiens
gccccagctctggc

SEQ ID NO: 2700959 - DNA, 13 bp, Homo sapiens
gccccaggtgcca

SEQ ID NO: 2700960 - DNA, 20 bp, Homo sapiens
gccccaggtgccaccaataa

SEQ ID NO: 2700961 - DNA, 21 bp, Homo sapiens
gccccctggtggacagtcctg

SEQ ID NO: 2700962 - DNA, 23 bp, Homo sapiens
gccccctggtggacagtcctggg

SEQ ID NO: 2700963 - DNA, 17 bp, Homo sapiens
gccccgcgcctccttcc

SEQ ID NO: 2700964 - DNA, 18 bp, Homo sapiens
gcccctgtaggttgctta

SEQ ID NO: 2700965 - DNA, 23 bp, Homo sapiens
gccctccacagccgcagcctccc

SEQ ID NO: 2700966 - DNA, 21 bp, Homo sapiens
gccctgcagaggggaaaccag

SEQ ID NO: 2700967 - DNA, 15 bp, Homo sapiens
gccctgccacctgtc

SEQ ID NO: 2700968 - DNA, 16 bp, Homo sapiens
gccctgccacctgtct

SEQ ID NO: 2700969 - DNA, 20 bp, Homo sapiens
gccctgccacctgtctgtct

SEQ ID NO: 2700970 - DNA, 13 bp, Homo sapiens
gccctgccctgcc

SEQ ID NO: 2700971 - DNA, 17 bp, Homo sapiens
gccgcagcctccctctg

SEQ ID NO: 2700972 - DNA, 17 bp, Homo sapiens
gccgcagggacggggac

SEQ ID NO: 2700973 - DNA, 15 bp, Homo sapiens
gcctatccatcctgc

SEQ ID NO: 2700974 - DNA, 16 bp, Homo sapiens
gcctatccatcctgcg

SEQ ID NO: 2700975 - DNA, 11 bp, Homo sapiens
gcctctgctgc

SEQ ID NO: 2700976 - DNA, 13 bp, Homo sapiens
gcctgaggctgag

SEQ ID NO: 2700977 - DNA, 18 bp, Homo sapiens
gcctgaggctgagactgc

SEQ ID NO: 2700978 - DNA, 19 bp, Homo sapiens
tagagcttggacagtctga

SEQ ID NO: 2700979 - DNA, 21 bp, Homo sapiens
tagccaaggtgggctgagccc

SEQ ID NO: 2700980 - DNA, 13 bp, Homo sapiens
taggaagaaaaat

SEQ ID NO: 2700981 - DNA, 14 bp, Homo sapiens
taggactctgaggc

SEQ ID NO: 2700982 - DNA, 15 bp, Homo sapiens
taggactctgaggct

SEQ ID NO: 2700983 - DNA, 17 bp, Homo sapiens
taggcagggatttgagg

SEQ ID NO: 2700984 - DNA, 19 bp, Homo sapiens
taggcagggatttgaggag

SEQ ID NO: 2700985 - DNA, 16 bp, Homo sapiens
taggggtaatatattg

SEQ ID NO: 2700986 - DNA, 18 bp, Homo sapiens
tagtactagtactattgc

SEQ ID NO: 2700987 - DNA, 22 bp, Homo sapiens
tagtactattatggaattactc

SEQ ID NO: 2700988 - DNA, 20 bp, Homo sapiens
tagtactattgctattacta

SEQ ID NO: 2700989 - DNA, 23 bp, Homo sapiens
tagtgccctccacagccgcagcc

SEQ ID NO: 2700990 - DNA, 20 bp, Homo sapiens
tatagtcccagctactcaga

SEQ ID NO: 2700991 - DNA, 18 bp, Homo sapiens
tatatcaatgtaacaaaa

SEQ ID NO: 2700992 - DNA, 17 bp, Homo sapiens
tatatgctcaaccagaa

SEQ ID NO: 2700993 - DNA, 23 bp, Homo sapiens
tatattttcatgacttttccatg

SEQ ID NO: 2700994 - DNA, 18 bp, Homo sapiens
tatgaacttgaggacaca

SEQ ID NO: 2700995 - DNA, 22 bp, Homo sapiens
tatgaacttgaggacacatgtc

SEQ ID NO: 2700996 - DNA, 15 bp, Homo sapiens
tatgatcccagcact

SEQ ID NO: 2700997 - DNA, 15 bp, Homo sapiens
tatgcatagatatat

SEQ ID NO: 2700998 - DNA, 20 bp, Homo sapiens
tatgttcaccaggagattac

SEQ ID NO: 2700999 - DNA, 20 bp, Homo sapiens
tattaaagcgcaaatgaatt

SEQ ID NO: 2701000 - DNA, 13 bp, Homo sapiens
tattactagtact

SEQ ID NO: 2701001 - DNA, 13 bp, Homo sapiens
tattcaataaagc

SEQ ID NO: 2701002 - DNA, 22 bp, Homo sapiens
tattttaggcagggatttgagg

SEQ ID NO: 2701003 - DNA, 20 bp, Homo sapiens
tatttttttaagctgtaaaa

SEQ ID NO: 2701004 - DNA, 21 bp, Homo sapiens
tcaaaaatgattttattacct

SEQ ID NO: 2701005 - DNA, 24 bp, Homo sapiens
tcaaccagaaaacttagaaataag

SEQ ID NO: 2701006 - DNA, 15 bp, Homo sapiens
tcaatagtattaact

SEQ ID NO: 2701007 - DNA, 19 bp, Homo sapiens
tcaatatttaagagattaa

SEQ ID NO: 2701008 - DNA, 17 bp, Homo sapiens
tcaattcctgggcccca

SEQ ID NO: 2701009 - DNA, 18 bp, Homo sapiens
tcacaaaaaaagtaattg

SEQ ID NO: 2701010 - DNA, 18 bp, Homo sapiens
tcacagggcagagccggg

SEQ ID NO: 2701011 - DNA, 19 bp, Homo sapiens
tcacagggcagagccggga

SEQ ID NO: 2701012 - DNA, 16 bp, Homo sapiens
tcaccaggagattaca

SEQ ID NO: 2701013 - DNA, 18 bp, Homo sapiens
tcaccgagacggctggac

SEQ ID NO: 2701014 - DNA, 14 bp, Homo sapiens
tcacgccactgcac

SEQ ID NO: 2701015 - DNA, 11 bp, Homo sapiens
tcactggagcc

SEQ ID NO: 2701016 - DNA, 13 bp, Homo sapiens
tcactggagccca

SEQ ID NO: 2701017 - DNA, 17 bp, Homo sapiens
tcactggagcccaggag

SEQ ID NO: 2701018 - DNA, 13 bp, Homo sapiens
tcagaagcctgag

SEQ ID NO: 2701019 - DNA, 15 bp, Homo sapiens
tcagaagcctgaggc

SEQ ID NO: 2701020 - DNA, 13 bp, Homo sapiens
tcagactggctgg

SEQ ID NO: 2701021 - DNA, 20 bp, Homo sapiens
tcagactggctggctgcagt

SEQ ID NO: 2701022 - DNA, 21 bp, Homo sapiens
tcagatgcccagagggcccag

SEQ ID NO: 2701023 - DNA, 18 bp, Homo sapiens
tcagccctgaaaataaca

SEQ ID NO: 2701024 - DNA, 13 bp, Homo sapiens
tcagcctgaggct

SEQ ID NO: 2701025 - DNA, 22 bp, Homo sapiens
tcagccttccccctcccagggc

SEQ ID NO: 2701026 - DNA, 12 bp, Homo sapiens
tcagctgtgaac

SEQ ID NO: 2701027 - DNA, 15 bp, Homo sapiens
tcaggaggctgaggg

SEQ ID NO: 2701028 - DNA, 18 bp, Homo sapiens
tcaggaggctgaggggag

SEQ ID NO: 2701029 - DNA, 18 bp, Homo sapiens
tcaggccaggtgcagtgg

SEQ ID NO: 2701030 - DNA, 15 bp, Homo sapiens
tcagtgctgtggcct

SEQ ID NO: 2701031 - DNA, 16 bp, Homo sapiens
tcagttcctctttgca

SEQ ID NO: 2701032 - DNA, 17 bp, Homo sapiens
tcagttcctctttgcat

SEQ ID NO: 2701033 - DNA, 21 bp, Homo sapiens
tcagttcctctttgcatggaa

SEQ ID NO: 2701034 - DNA, 16 bp, Homo sapiens
tccaactattaagata

SEQ ID NO: 2701035 - DNA, 17 bp, Homo sapiens
tccacagccgcagcctc

SEQ ID NO: 2701036 - DNA, 13 bp, Homo sapiens
tccacctgcctat

SEQ ID NO: 2701037 - DNA, 17 bp, Homo sapiens
tccactggacttgagct

SEQ ID NO: 2701038 - DNA, 13 bp, Homo sapiens
tccagcctgagca

SEQ ID NO: 2701039 - DNA, 11 bp, Homo sapiens
tccagcctggg

SEQ ID NO: 2701040 - DNA, 17 bp, Homo sapiens
tccagcctgggcgacag

SEQ ID NO: 2701041 - DNA, 14 bp, Homo sapiens
tccaggcatgctgg

SEQ ID NO: 2701042 - DNA, 19 bp, Homo sapiens
tccaggcatgctggcctcc

SEQ ID NO: 2701043 - DNA, 13 bp, Homo sapiens
tccagggctgccc

SEQ ID NO: 2701044 - DNA, 20 bp, Homo sapiens
tccatgtggccccaggtgcc

SEQ ID NO: 2701045 - DNA, 23 bp, Homo sapiens
tccatttaatcaatatttaagag

SEQ ID NO: 2701046 - DNA, 21 bp, Homo sapiens
tcccaaagaagttctggtatg

SEQ ID NO: 2701047 - DNA, 13 bp, Homo sapiens
tcccaataaagct

SEQ ID NO: 2701048 - DNA, 16 bp, Homo sapiens
tcccagctactcagaa

SEQ ID NO: 2701049 - DNA, 19 bp, Homo sapiens
tcccagctactcagaagcc

SEQ ID NO: 2701050 - DNA, 15 bp, Homo sapiens
tcccaggaggggcct

SEQ ID NO: 2701051 - DNA, 19 bp, Homo sapiens
tcccaggaggggcctctga

SEQ ID NO: 2701052 - DNA, 21 bp, Homo sapiens
tcccagggccagggccctgca

SEQ ID NO: 2701053 - DNA, 22 bp, Homo sapiens
tcccagggccagggccctgcag

SEQ ID NO: 2701054 - DNA, 20 bp, Homo sapiens
tccccaccttcaattcctgg

SEQ ID NO: 2701055 - DNA, 19 bp, Homo sapiens
tccccctcccagggccagg

SEQ ID NO: 2701056 - DNA, 12 bp, Homo sapiens
tccccctgggct

SEQ ID NO: 2701057 - DNA, 14 bp, Homo sapiens
tccccctgggctct

SEQ ID NO: 2701058 - DNA, 20 bp, Homo sapiens
tccccctgggctctgcccca

SEQ ID NO: 2701059 - DNA, 22 bp, Homo sapiens
tccccctgggctctgccccagc

SEQ ID NO: 2701060 - DNA, 12 bp, Homo sapiens
tccctctcggaa

SEQ ID NO: 2701061 - DNA, 20 bp, Homo sapiens
tccgggccgggcggaagggg

SEQ ID NO: 2701062 - DNA, 17 bp, Homo sapiens
tcctacacccttggact

SEQ ID NO: 2701063 - DNA, 18 bp, Homo sapiens
tcctacacccttggactt

SEQ ID NO: 2701064 - DNA, 14 bp, Homo sapiens
tcctaccccacctc

SEQ ID NO: 2701065 - DNA, 23 bp, Homo sapiens
tcctaccccacctcatgcctggc

SEQ ID NO: 2701066 - DNA, 16 bp, Homo sapiens
tcctacctcagcctag

SEQ ID NO: 2701067 - DNA, 22 bp, Homo sapiens
tcctccccattagagtcagcct

SEQ ID NO: 2701068 - DNA, 18 bp, Homo sapiens
tcctgcaatctccagggc

SEQ ID NO: 2701069 - DNA, 17 bp, Homo sapiens
tcctgggagaacctcag

SEQ ID NO: 2701070 - DNA, 23 bp, Homo sapiens
tcctgggagaacctcaggcttcc

SEQ ID NO: 2701071 - DNA, 16 bp, Homo sapiens
tcctggggctctgtgc

SEQ ID NO: 2701072 - DNA, 15 bp, Homo sapiens
tcctgtaaaatccat

SEQ ID NO: 2701073 - DNA, 16 bp, Homo sapiens
tccttccaggccccca

SEQ ID NO: 2701074 - DNA, 15 bp, Homo sapiens
tcgtgggtgtgtgta

SEQ ID NO: 2701075 - DNA, 15 bp, Homo sapiens
tctaaagtttacagt

SEQ ID NO: 2701076 - DNA, 16 bp, Homo sapiens
tctaaagtttacagta

SEQ ID NO: 2701077 - DNA, 17 bp, Homo sapiens
tctactcctacctcagc

SEQ ID NO: 2701078 - DNA, 14 bp, Homo sapiens
tctagtgccctcca

SEQ ID NO: 2701079 - DNA, 17 bp, Homo sapiens
tctatatttaaatcatt

SEQ ID NO: 2701080 - DNA, 20 bp, Homo sapiens
tctattattataaaaataat

SEQ ID NO: 2701081 - DNA, 19 bp, Homo sapiens
tctcaatgtgcaataactt

SEQ ID NO: 2701082 - DNA, 16 bp, Homo sapiens
tctccagggctgcccc

SEQ ID NO: 2701083 - DNA, 17 bp, Homo sapiens
tctcctaccccacctca

SEQ ID NO: 2701084 - DNA, 22 bp, Homo sapiens
tctcctaccccacctcatgcct

SEQ ID NO: 2701085 - DNA, 23 bp, Homo sapiens
tctcctaccccacctcatgcctg

SEQ ID NO: 2701086 - DNA, 16 bp, Homo sapiens
tctgacctgcaggcca

SEQ ID NO: 2701087 - DNA, 19 bp, Homo sapiens
tctgaggctctttctgggc

SEQ ID NO: 2701088 - DNA, 17 bp, Homo sapiens
tctgattaatccatttt

SEQ ID NO: 2701089 - DNA, 13 bp, Homo sapiens
tctgccagccaca

SEQ ID NO: 2701090 - DNA, 14 bp, Homo sapiens
tctgccccagctct

SEQ ID NO: 2701091 - DNA, 13 bp, Homo sapiens
tctgcctttttta

SEQ ID NO: 2701092 - DNA, 13 bp, Homo sapiens
tctggagcccttg

SEQ ID NO: 2701093 - DNA, 23 bp, Homo sapiens
tctggcttccagaaaaccccagc

SEQ ID NO: 2701094 - DNA, 16 bp, Homo sapiens
tctgggccaagttcct

SEQ ID NO: 2701095 - DNA, 23 bp, Homo sapiens
tctggtatgaacttgaggacaca

SEQ ID NO: 2701096 - DNA, 16 bp, Homo sapiens
tctgtctgtcccaaag

SEQ ID NO: 2701097 - DNA, 14 bp, Homo sapiens
tcttccccactccc

SEQ ID NO: 2701098 - DNA, 13 bp, Homo sapiens
attcaataaagct

SEQ ID NO: 2701099 - DNA, 17 bp, Homo sapiens
attcacaaaaaaagtaa

SEQ ID NO: 2701100 - DNA, 22 bp, Homo sapiens
attccacagtgcccagctaatt

SEQ ID NO: 2701101 - DNA, 18 bp, Homo sapiens
attggctccaattcataa

SEQ ID NO: 2701102 - DNA, 15 bp, Homo sapiens
attgtaaaattgtat

SEQ ID NO: 2701103 - DNA, 17 bp, Homo sapiens
attgtaaaattgtatag

SEQ ID NO: 2701104 - DNA, 17 bp, Homo sapiens
attgtaaactagtacta

SEQ ID NO: 2701105 - DNA, 15 bp, Homo sapiens
attgtatagagatat

SEQ ID NO: 2701106 - DNA, 22 bp, Homo sapiens
atttaaatcattttaacttcta

SEQ ID NO: 2701107 - DNA, 20 bp, Homo sapiens
atttaacttgagggtaataa

SEQ ID NO: 2701108 - DNA, 21 bp, Homo sapiens
atttaacttgagggtaataaa

SEQ ID NO: 2701109 - DNA, 22 bp, Homo sapiens
atttaacttgagggtaataaac

SEQ ID NO: 2701110 - DNA, 13 bp, Homo sapiens
atttactaaaaga

SEQ ID NO: 2701111 - DNA, 14 bp, Homo sapiens
atttactaaaagaa

SEQ ID NO: 2701112 - DNA, 20 bp, Homo sapiens
atttcagctagttaataatt

SEQ ID NO: 2701113 - DNA, 15 bp, Homo sapiens
atttgataaactaaa

SEQ ID NO: 2701114 - DNA, 17 bp, Homo sapiens
atttggagactctgtgg

SEQ ID NO: 2701115 - DNA, 14 bp, Homo sapiens
atttgtaagtttat

SEQ ID NO: 2701116 - DNA, 23 bp, Homo sapiens
atttgtaagtttatgtctaaaga

SEQ ID NO: 2701117 - DNA, 13 bp, Homo sapiens
atttgtacagttc

SEQ ID NO: 2701118 - DNA, 17 bp, Homo sapiens
atttgttatttgtacag

SEQ ID NO: 2701119 - DNA, 22 bp, Homo sapiens
attttattaccttgttcctgta

SEQ ID NO: 2701120 - DNA, 20 bp, Homo sapiens
attttcacatgacgtaaaat

SEQ ID NO: 2701121 - DNA, 21 bp, Homo sapiens
attttgagtatctcggacctt

SEQ ID NO: 2701122 - DNA, 10 bp, Homo sapiens
attttgcaca

SEQ ID NO: 2701123 - DNA, 17 bp, Homo sapiens
attttgtggttaagaga

SEQ ID NO: 2701124 - DNA, 17 bp, Homo sapiens
caaaaatgccacttaac

SEQ ID NO: 2701125 - DNA, 16 bp, Homo sapiens
caaaaggtaaatacaa

SEQ ID NO: 2701126 - DNA, 16 bp, Homo sapiens
caaactctgccagcca

SEQ ID NO: 2701127 - DNA, 14 bp, Homo sapiens
caaagcaaaagaag

SEQ ID NO: 2701128 - DNA, 17 bp, Homo sapiens
caaagccaaactctgcc

SEQ ID NO: 2701129 - DNA, 13 bp, Homo sapiens
caaagtctaaagt

SEQ ID NO: 2701130 - DNA, 19 bp, Homo sapiens
caaagtctaaagtttacag

SEQ ID NO: 2701131 - DNA, 19 bp, Homo sapiens
caacagagtgagaccctgt

SEQ ID NO: 2701132 - DNA, 23 bp, Homo sapiens
caacagagtgagaccctgtctct

SEQ ID NO: 2701133 - DNA, 17 bp, Homo sapiens
caaccccccacctgcca

SEQ ID NO: 2701134 - DNA, 23 bp, Homo sapiens
caagaagggttttccaccctgga

SEQ ID NO: 2701135 - DNA, 17 bp, Homo sapiens
caagatgtcagactggc

SEQ ID NO: 2701136 - DNA, 19 bp, Homo sapiens
caagccaacgacaaagcca

SEQ ID NO: 2701137 - DNA, 16 bp, Homo sapiens
caaggtgggctgagcc

SEQ ID NO: 2701138 - DNA, 19 bp, Homo sapiens
caaggtgggctgagccctg

SEQ ID NO: 2701139 - DNA, 16 bp, Homo sapiens
caagtccacctgccta

SEQ ID NO: 2701140 - DNA, 19 bp, Homo sapiens
caataaagctggacaagaa

SEQ ID NO: 2701141 - DNA, 23 bp, Homo sapiens
caatacaaattgaggacttaatt

SEQ ID NO: 2701142 - DNA, 23 bp, Homo sapiens
caataccccaagtccacctgcct

SEQ ID NO: 2701143 - DNA, 15 bp, Homo sapiens
caatattcaataaag

SEQ ID NO: 2701144 - DNA, 20 bp, Homo sapiens
caatctccagggctgcccct

SEQ ID NO: 2701145 - DNA, 16 bp, Homo sapiens
caatcttcaatgaata

SEQ ID NO: 2701146 - DNA, 17 bp, Homo sapiens
caatgaaagtttgcact

SEQ ID NO: 2701147 - DNA, 13 bp, Homo sapiens
caattcctgggcc

SEQ ID NO: 2701148 - DNA, 16 bp, Homo sapiens
caattcctgggcccca

SEQ ID NO: 2701149 - DNA, 13 bp, Homo sapiens
cacagggcagagc

SEQ ID NO: 2701150 - DNA, 14 bp, Homo sapiens
cacagggcagagcc

SEQ ID NO: 2701151 - DNA, 12 bp, Homo sapiens
caccaataaaaa

SEQ ID NO: 2701152 - DNA, 13 bp, Homo sapiens
caccaataaaaat

SEQ ID NO: 2701153 - DNA, 14 bp, Homo sapiens
cacccatgaagaca

SEQ ID NO: 2701154 - DNA, 22 bp, Homo sapiens
cacccatgaagacaggacagtg

SEQ ID NO: 2701155 - DNA, 12 bp, Homo sapiens
caccccagcgcc

SEQ ID NO: 2701156 - DNA, 19 bp, Homo sapiens
caccctcgtggacacctgc

SEQ ID NO: 2701157 - DNA, 14 bp, Homo sapiens
cacccttggacttg

SEQ ID NO: 2701158 - DNA, 16 bp, Homo sapiens
cacccttggacttgag

SEQ ID NO: 2701159 - DNA, 18 bp, Homo sapiens
caccgagacggctggacc

SEQ ID NO: 2701160 - DNA, 16 bp, Homo sapiens
caccgctgccttttgc

SEQ ID NO: 2701161 - DNA, 14 bp, Homo sapiens
cacctcatgcctgg

SEQ ID NO: 2701162 - DNA, 19 bp, Homo sapiens
cacctcatgcctggccccc

SEQ ID NO: 2701163 - DNA, 21 bp, Homo sapiens
cacctctcaatattcaataaa

SEQ ID NO: 2701164 - DNA, 23 bp, Homo sapiens
cacctctcaatattcaataaagc

SEQ ID NO: 2701165 - DNA, 18 bp, Homo sapiens
cacctgaggttaggagtt

SEQ ID NO: 2701166 - DNA, 14 bp, Homo sapiens
cacctgccagcctg

SEQ ID NO: 2701167 - DNA, 14 bp, Homo sapiens
cacctgccccctgg

SEQ ID NO: 2701168 - DNA, 13 bp, Homo sapiens
cacctgccctgcc

SEQ ID NO: 2701169 - DNA, 14 bp, Homo sapiens
cacctgccctgccc

SEQ ID NO: 2701170 - DNA, 16 bp, Homo sapiens
cacctgccctgccctg

SEQ ID NO: 2701171 - DNA, 17 bp, Homo sapiens
cacctgccctgccctgc

SEQ ID NO: 2701172 - DNA, 21 bp, Homo sapiens
cacctgccctgccctgccacc

SEQ ID NO: 2701173 - DNA, 17 bp, Homo sapiens
cacctgcctatccatcc

SEQ ID NO: 2701174 - DNA, 22 bp, Homo sapiens
cacctgtactcaggaggctgag

SEQ ID NO: 2701175 - DNA, 16 bp, Homo sapiens
cacctgtctgtctgtc

SEQ ID NO: 2701176 - DNA, 19 bp, Homo sapiens
caccttcaattcctgggcc

SEQ ID NO: 2701177 - DNA, 14 bp, Homo sapiens
cacgccactgcact

SEQ ID NO: 2701178 - DNA, 18 bp, Homo sapiens
cacgcctatgatcccagc

SEQ ID NO: 2701179 - DNA, 16 bp, Homo sapiens
cactacactccagcct

SEQ ID NO: 2701180 - DNA, 20 bp, Homo sapiens
cactacactccagcctgagc

SEQ ID NO: 2701181 - DNA, 13 bp, Homo sapiens
cactccagcctgg

SEQ ID NO: 2701182 - DNA, 23 bp, Homo sapiens
cactccagcctgggcgacagagc

SEQ ID NO: 2701183 - DNA, 17 bp, Homo sapiens
cactgaagctgggattc

SEQ ID NO: 2701184 - DNA, 17 bp, Homo sapiens
cactgcactccagcctg

SEQ ID NO: 2701185 - DNA, 18 bp, Homo sapiens
cactgcactccagcctgg

SEQ ID NO: 2701186 - DNA, 20 bp, Homo sapiens
cactgcactccagcctgggc

SEQ ID NO: 2701187 - DNA, 13 bp, Homo sapiens
cactggccccacc

SEQ ID NO: 2701188 - DNA, 21 bp, Homo sapiens
cagaaaacttagaaataagaa

SEQ ID NO: 2701189 - DNA, 15 bp, Homo sapiens
cagaagcctgaggct

SEQ ID NO: 2701190 - DNA, 19 bp, Homo sapiens
cagaagcctgaggctggga

SEQ ID NO: 2701191 - DNA, 21 bp, Homo sapiens
cagaaggaagggcatccttct

SEQ ID NO: 2701192 - DNA, 13 bp, Homo sapiens
cagactgctggga

SEQ ID NO: 2701193 - DNA, 14 bp, Homo sapiens
cagagcaggggcag

SEQ ID NO: 2701194 - DNA, 16 bp, Homo sapiens
cagagggcccaggcag

SEQ ID NO: 2701195 - DNA, 22 bp, Homo sapiens
cagagggcccaggcaggccacc

SEQ ID NO: 2701196 - DNA, 22 bp, Homo sapiens
cagatgcccagagggcccaggc

SEQ ID NO: 2701197 - DNA, 18 bp, Homo sapiens
cagcactttgggaggctg

SEQ ID NO: 2701198 - DNA, 23 bp, Homo sapiens
cagcatccttttctgcagagggg

SEQ ID NO: 2701199 - DNA, 16 bp, Homo sapiens
cagccattaccatgga

SEQ ID NO: 2701200 - DNA, 16 bp, Homo sapiens
cagccccgcgcctcct

SEQ ID NO: 2701201 - DNA, 18 bp, Homo sapiens
cagccccgcgcctccttc

SEQ ID NO: 2701202 - DNA, 14 bp, Homo sapiens
cagcctccctctga

SEQ ID NO: 2701203 - DNA, 15 bp, Homo sapiens
cagcctccctctgac

SEQ ID NO: 2701204 - DNA, 15 bp, Homo sapiens
cagcctgaggctgag

SEQ ID NO: 2701205 - DNA, 19 bp, Homo sapiens
cagcctgaggctgagactg

SEQ ID NO: 2701206 - DNA, 19 bp, Homo sapiens
cagcctggcttctggagcc

SEQ ID NO: 2701207 - DNA, 14 bp, Homo sapiens
cagccttccccctc

SEQ ID NO: 2701208 - DNA, 21 bp, Homo sapiens
cagccttccccctcccagggc

SEQ ID NO: 2701209 - DNA, 19 bp, Homo sapiens
cagcgcctgtgctgaggac

SEQ ID NO: 2701210 - DNA, 14 bp, Homo sapiens
cagctactcagaag

SEQ ID NO: 2701211 - DNA, 16 bp, Homo sapiens
cagctactcagaagcc

SEQ ID NO: 2701212 - DNA, 19 bp, Homo sapiens
cagctactcagaagcctga

SEQ ID NO: 2701213 - DNA, 16 bp, Homo sapiens
cagctagttaataatt

SEQ ID NO: 2701214 - DNA, 20 bp, Homo sapiens
cagctgtgaacatggactct

SEQ ID NO: 2701215 - DNA, 20 bp, Homo sapiens
caggacagtgcttcagcctg

SEQ ID NO: 2701216 - DNA, 21 bp, Homo sapiens
caggaggcttggaaagcatca

SEQ ID NO: 2701217 - DNA, 20 bp, Homo sapiens
caggagtttgaggctgcagc

SEQ ID NO: 2701218 - DNA, 15 bp, Homo sapiens
gcacctgccccctgg

SEQ ID NO: 2701219 - DNA, 16 bp, Homo sapiens
gcacgattttgcacaa

SEQ ID NO: 2701220 - DNA, 16 bp, Homo sapiens
gcactccagcctgggc

SEQ ID NO: 2701221 - DNA, 20 bp, Homo sapiens
gcagagcaggggcagggtga

SEQ ID NO: 2701222 - DNA, 19 bp, Homo sapiens
gcagaggggctttctggag

SEQ ID NO: 2701223 - DNA, 23 bp, Homo sapiens
gcagccccgcgcctccttccttg

SEQ ID NO: 2701224 - DNA, 14 bp, Homo sapiens
gcagcctccctctg

SEQ ID NO: 2701225 - DNA, 13 bp, Homo sapiens
gcagcttcagttg

SEQ ID NO: 2701226 - DNA, 21 bp, Homo sapiens
gcaggttgaggggctcctgga

SEQ ID NO: 2701227 - DNA, 22 bp, Homo sapiens
gcatcacagggcagagccggga

SEQ ID NO: 2701228 - DNA, 20 bp, Homo sapiens
gcatccttttctgcagaggg

SEQ ID NO: 2701229 - DNA, 24 bp, Homo sapiens
gcatgctggcctcccaataaagct

SEQ ID NO: 2701230 - DNA, 13 bp, Homo sapiens
gcatgctggggca

SEQ ID NO: 2701231 - DNA, 16 bp, Homo sapiens
gcatgctggggcaagt

SEQ ID NO: 2701232 - DNA, 23 bp, Homo sapiens
gcatggggataaaggagaaggca

SEQ ID NO: 2701233 - DNA, 19 bp, Homo sapiens
gcatttgttccattaaaaa

SEQ ID NO: 2701234 - DNA, 14 bp, Homo sapiens
gccaacgacaaagc

SEQ ID NO: 2701235 - DNA, 22 bp, Homo sapiens
gccaaggtgggctgagccctgg

SEQ ID NO: 2701236 - DNA, 12 bp, Homo sapiens
gccaccaataaa

SEQ ID NO: 2701237 - DNA, 18 bp, Homo sapiens
gccaccaataaaaatcct

SEQ ID NO: 2701238 - DNA, 14 bp, Homo sapiens
gccacctgtctgtc

SEQ ID NO: 2701239 - DNA, 15 bp, Homo sapiens
gccacctgtctgtct

SEQ ID NO: 2701240 - DNA, 17 bp, Homo sapiens
gccacggggagggggac

SEQ ID NO: 2701241 - DNA, 17 bp, Homo sapiens
gccactacactccagcc

SEQ ID NO: 2701242 - DNA, 18 bp, Homo sapiens
gccactacactccagcct

SEQ ID NO: 2701243 - DNA, 20 bp, Homo sapiens
gccactacactccagcctga

SEQ ID NO: 2701244 - DNA, 22 bp, Homo sapiens
gccactacactccagcctgagc

SEQ ID NO: 2701245 - DNA, 14 bp, Homo sapiens
gccactgaagctgg

SEQ ID NO: 2701246 - DNA, 22 bp, Homo sapiens
gccactgcactccagcctgggc

SEQ ID NO: 2701247 - DNA, 22 bp, Homo sapiens
gccactttggtacatggccagt

SEQ ID NO: 2701248 - DNA, 11 bp, Homo sapiens
gccagcctggc

SEQ ID NO: 2701249 - DNA, 17 bp, Homo sapiens
gccagcctggcttctgg

SEQ ID NO: 2701250 - DNA, 18 bp, Homo sapiens
gccagcctggcttctgga

SEQ ID NO: 2701251 - DNA, 20 bp, Homo sapiens
gccagcctggcttctggagc

SEQ ID NO: 2701252 - DNA, 21 bp, Homo sapiens
gccagcctggcttctggagcc

SEQ ID NO: 2701253 - DNA, 13 bp, Homo sapiens
gccagggccctgc

SEQ ID NO: 2701254 - DNA, 19 bp, Homo sapiens
gccagggccctgcagaggg

SEQ ID NO: 2701255 - DNA, 13 bp, Homo sapiens
gccaggtgcagtg

SEQ ID NO: 2701256 - DNA, 14 bp, Homo sapiens
gccaggtgcagtgg

SEQ ID NO: 2701257 - DNA, 22 bp, Homo sapiens
gccatggcgtgtccctctcgga

SEQ ID NO: 2701258 - DNA, 13 bp, Homo sapiens
gccattaccatgg

SEQ ID NO: 2701259 - DNA, 18 bp, Homo sapiens
gccattaccatggagaca

SEQ ID NO: 2701260 - DNA, 16 bp, Homo sapiens
gcccacattggaccca

SEQ ID NO: 2701261 - DNA, 13 bp, Homo sapiens
gcccagagggccc

SEQ ID NO: 2701262 - DNA, 23 bp, Homo sapiens
gcccagccattaccatggagaca

SEQ ID NO: 2701263 - DNA, 23 bp, Homo sapiens
gcccagctgcacctgccagcctg

SEQ ID NO: 2701264 - DNA, 24 bp, Homo sapiens
gcccagctgcacctgccagcctgg

SEQ ID NO: 2701265 - DNA, 22 bp, Homo sapiens
gcccaggagtttgaggctgcag

SEQ ID NO: 2701266 - DNA, 23 bp, Homo sapiens
gccccaccctcgtggacacctgc

SEQ ID NO: 2701267 - DNA, 15 bp, Homo sapiens
gccccaggtgccacc

SEQ ID NO: 2701268 - DNA, 19 bp, Homo sapiens
gccccaggtgccaccaata

SEQ ID NO: 2701269 - DNA, 23 bp, Homo sapiens
gccccaggtgccaccaataaaaa

SEQ ID NO: 2701270 - DNA, 12 bp, Homo sapiens
gcccccctccag

SEQ ID NO: 2701271 - DNA, 14 bp, Homo sapiens
gcccccctccaggc

SEQ ID NO: 2701272 - DNA, 15 bp, Homo sapiens
gcccccctccaggca

SEQ ID NO: 2701273 - DNA, 16 bp, Homo sapiens
gcccggattctgggag

SEQ ID NO: 2701274 - DNA, 13 bp, Homo sapiens
gccctgccacctg

SEQ ID NO: 2701275 - DNA, 18 bp, Homo sapiens
gccctgccacctgtctgt

SEQ ID NO: 2701276 - DNA, 17 bp, Homo sapiens
gccctgccctgccacct

SEQ ID NO: 2701277 - DNA, 19 bp, Homo sapiens
gccctggcaggatgaccct

SEQ ID NO: 2701278 - DNA, 15 bp, Homo sapiens
gccctggtccttcca

SEQ ID NO: 2701279 - DNA, 18 bp, Homo sapiens
gccctggtccttccaggc

SEQ ID NO: 2701280 - DNA, 20 bp, Homo sapiens
gccgagatcacgccactgca

SEQ ID NO: 2701281 - DNA, 17 bp, Homo sapiens
gccgggcggaaggggac

SEQ ID NO: 2701282 - DNA, 19 bp, Homo sapiens
gccgggcgtggtggcgggc

SEQ ID NO: 2701283 - DNA, 19 bp, Homo sapiens
gcctactgaaaatgcattt

SEQ ID NO: 2701284 - DNA, 14 bp, Homo sapiens
gcctatccatcctg

SEQ ID NO: 2701285 - DNA, 17 bp, Homo sapiens
gcctccaaatgccaact

SEQ ID NO: 2701286 - DNA, 15 bp, Homo sapiens
gcctcccaataaagc

SEQ ID NO: 2701287 - DNA, 16 bp, Homo sapiens
gcctcccaataaagct

SEQ ID NO: 2701288 - DNA, 17 bp, Homo sapiens
gcctcccaataaagctg

SEQ ID NO: 2701289 - DNA, 20 bp, Homo sapiens
gcctccctctgacctgcagg

SEQ ID NO: 2701290 - DNA, 16 bp, Homo sapiens
gcctctgaaatttccc

SEQ ID NO: 2701291 - DNA, 19 bp, Homo sapiens
gcctctgaaatttcccaca

SEQ ID NO: 2701292 - DNA, 15 bp, Homo sapiens
gcctctgctgccatg

SEQ ID NO: 2701293 - DNA, 11 bp, Homo sapiens
gcctgcagccc

SEQ ID NO: 2701294 - DNA, 15 bp, Homo sapiens
gcctggcccccctcc

SEQ ID NO: 2701295 - DNA, 18 bp, Homo sapiens
gcctggcccccctccagg

SEQ ID NO: 2701296 - DNA, 14 bp, Homo sapiens
gcctggcttctgga

SEQ ID NO: 2701297 - DNA, 15 bp, Homo sapiens
gcctgtttgggatgt

SEQ ID NO: 2701298 - DNA, 20 bp, Homo sapiens
gccttcactccggtgtgcct

SEQ ID NO: 2701299 - DNA, 18 bp, Homo sapiens
gccttccccctcccaggg

SEQ ID NO: 2701300 - DNA, 23 bp, Homo sapiens
gccttccccctcccagggccagg

SEQ ID NO: 2701301 - DNA, 15 bp, Homo sapiens
gccttgaagccactg

SEQ ID NO: 2701302 - DNA, 14 bp, Homo sapiens
gccttttaaaagaa

SEQ ID NO: 2701303 - DNA, 15 bp, Homo sapiens
gccttttaaaagaaa

SEQ ID NO: 2701304 - DNA, 17 bp, Homo sapiens
gcgagttgtggaaagcc

SEQ ID NO: 2701305 - DNA, 19 bp, Homo sapiens
gcgatgaatttggagactc

SEQ ID NO: 2701306 - DNA, 19 bp, Homo sapiens
gcgcacctgccccctggtg

SEQ ID NO: 2701307 - DNA, 24 bp, Homo sapiens
gcgccactacactccagcctgagc

SEQ ID NO: 2701308 - DNA, 13 bp, Homo sapiens
gcggaaggggacg

SEQ ID NO: 2701309 - DNA, 22 bp, Homo sapiens
gcggcgaccgccgcagggacgg

SEQ ID NO: 2701310 - DNA, 16 bp, Homo sapiens
gcgggatggtcctggg

SEQ ID NO: 2701311 - DNA, 20 bp, Homo sapiens
gcgggcacctatagtcccag

SEQ ID NO: 2701312 - DNA, 19 bp, Homo sapiens
gcgtgtcgtgggtgtgtgt

SEQ ID NO: 2701313 - DNA, 14 bp, Homo sapiens
gctactcagaagcc

SEQ ID NO: 2701314 - DNA, 15 bp, Homo sapiens
gctactcagaagcct

SEQ ID NO: 2701315 - DNA, 18 bp, Homo sapiens
gctactcagaagcctgag

SEQ ID NO: 2701316 - DNA, 18 bp, Homo sapiens
gctattactagtactatt

SEQ ID NO: 2701317 - DNA, 21 bp, Homo sapiens
gctcacacggggtattttagg

SEQ ID NO: 2701318 - DNA, 13 bp, Homo sapiens
gctcaggaggctt

SEQ ID NO: 2701319 - DNA, 14 bp, Homo sapiens
gctcagtctcagga

SEQ ID NO: 2701320 - DNA, 18 bp, Homo sapiens
gctcctggaaaggctcag

SEQ ID NO: 2701321 - DNA, 13 bp, Homo sapiens
gctctttctgggc

SEQ ID NO: 2701322 - DNA, 11 bp, Homo sapiens
gctgagccctg

SEQ ID NO: 2701323 - DNA, 14 bp, Homo sapiens
gctgaggactccct

SEQ ID NO: 2701324 - DNA, 17 bp, Homo sapiens
gctgattttctctggca

SEQ ID NO: 2701325 - DNA, 17 bp, Homo sapiens
gctgcacctgccagcct

SEQ ID NO: 2701326 - DNA, 19 bp, Homo sapiens
gctgcacctgccagcctgg

SEQ ID NO: 2701327 - DNA, 21 bp, Homo sapiens
gctgcacctgccagcctggct

SEQ ID NO: 2701328 - DNA, 22 bp, Homo sapiens
gctgcacctgccagcctggctt

SEQ ID NO: 2701329 - DNA, 22 bp, Homo sapiens
gctgccatggcgtgtccctctc

SEQ ID NO: 2701330 - DNA, 17 bp, Homo sapiens
gctgccttttgctgctg

SEQ ID NO: 2701331 - DNA, 19 bp, Homo sapiens
gctgccttttgctgctgct

SEQ ID NO: 2701332 - DNA, 17 bp, Homo sapiens
gctggacaagaagctgc

SEQ ID NO: 2701333 - DNA, 19 bp, Homo sapiens
gctggacaagaagctgcta

SEQ ID NO: 2701334 - DNA, 22 bp, Homo sapiens
gctggcctcccaataaagctgg

SEQ ID NO: 2701335 - DNA, 13 bp, Homo sapiens
gctggctgcagtg

SEQ ID NO: 2701336 - DNA, 15 bp, Homo sapiens
gctggctgggcatgg

SEQ ID NO: 2701337 - DNA, 15 bp, Homo sapiens
gctgggactggccag

SEQ ID NO: 2701338 - DNA, 17 bp, Homo sapiens
tcaggccaggtgcagtg

SEQ ID NO: 2701339 - DNA, 14 bp, Homo sapiens
tcagtctcaggagc

SEQ ID NO: 2701340 - DNA, 12 bp, Homo sapiens
tcagtgctgtgg

SEQ ID NO: 2701341 - DNA, 18 bp, Homo sapiens
tcagttcctctttgcatg

SEQ ID NO: 2701342 - DNA, 18 bp, Homo sapiens
tccaacttaaaaaggcaa

SEQ ID NO: 2701343 - DNA, 16 bp, Homo sapiens
tccacagccgcagcct

SEQ ID NO: 2701344 - DNA, 18 bp, Homo sapiens
tccacagccgcagcctcc

SEQ ID NO: 2701345 - DNA, 12 bp, Homo sapiens
tccaccctggaa

SEQ ID NO: 2701346 - DNA, 22 bp, Homo sapiens
tccacctgcctatccatcctgc

SEQ ID NO: 2701347 - DNA, 16 bp, Homo sapiens
tccaggcatgctggcc

SEQ ID NO: 2701348 - DNA, 18 bp, Homo sapiens
tccaggcatgctggcctc

SEQ ID NO: 2701349 - DNA, 14 bp, Homo sapiens
tccagggctgcccc

SEQ ID NO: 2701350 - DNA, 22 bp, Homo sapiens
tccatgtggccccaggtgccac

SEQ ID NO: 2701351 - DNA, 14 bp, Homo sapiens
tcccaataaagctg

SEQ ID NO: 2701352 - DNA, 17 bp, Homo sapiens
tcccacaccccagcgcc

SEQ ID NO: 2701353 - DNA, 23 bp, Homo sapiens
tcccagggccagggccctgcaga

SEQ ID NO: 2701354 - DNA, 17 bp, Homo sapiens
tccccctcccagggcca

SEQ ID NO: 2701355 - DNA, 18 bp, Homo sapiens
tccccctcccagggccag

SEQ ID NO: 2701356 - DNA, 10 bp, Homo sapiens
tccccctggg

SEQ ID NO: 2701357 - DNA, 15 bp, Homo sapiens
tccccctgggctctg

SEQ ID NO: 2701358 - DNA, 19 bp, Homo sapiens
tcccgagcaaagtctaaag

SEQ ID NO: 2701359 - DNA, 18 bp, Homo sapiens
tccctgactctctgtgac

SEQ ID NO: 2701360 - DNA, 12 bp, Homo sapiens
tccggtgtgcct

SEQ ID NO: 2701361 - DNA, 17 bp, Homo sapiens
tccggtgtgcctgcagc

SEQ ID NO: 2701362 - DNA, 18 bp, Homo sapiens
tccggtgtgcctgcagcc

SEQ ID NO: 2701363 - DNA, 20 bp, Homo sapiens
tcctacacccttggacttga

SEQ ID NO: 2701364 - DNA, 14 bp, Homo sapiens
tcctacctcagcct

SEQ ID NO: 2701365 - DNA, 17 bp, Homo sapiens
tcctacctcagcctaga

SEQ ID NO: 2701366 - DNA, 13 bp, Homo sapiens
tcctaggccacac

SEQ ID NO: 2701367 - DNA, 17 bp, Homo sapiens
tcctctttgcatggaat

SEQ ID NO: 2701368 - DNA, 16 bp, Homo sapiens
tcctggaaaggctcag

SEQ ID NO: 2701369 - DNA, 15 bp, Homo sapiens
tcctggggctctgtg

SEQ ID NO: 2701370 - DNA, 19 bp, Homo sapiens
tccttcaagttagctcagg

SEQ ID NO: 2701371 - DNA, 13 bp, Homo sapiens
tccttccaggccc

SEQ ID NO: 2701372 - DNA, 21 bp, Homo sapiens
tccttccaggcccccaccact

SEQ ID NO: 2701373 - DNA, 21 bp, Homo sapiens
tccttcctacacccttggact

SEQ ID NO: 2701374 - DNA, 23 bp, Homo sapiens
tccttcctacacccttggacttg

SEQ ID NO: 2701375 - DNA, 19 bp, Homo sapiens
tccttccttgctgtcctag

SEQ ID NO: 2701376 - DNA, 12 bp, Homo sapiens
tccttctgcctt

SEQ ID NO: 2701377 - DNA, 20 bp, Homo sapiens
tccttggcatcacagggcag

SEQ ID NO: 2701378 - DNA, 14 bp, Homo sapiens
tccttgggtcctgc

SEQ ID NO: 2701379 - DNA, 15 bp, Homo sapiens
tcgagaccagcctgg

SEQ ID NO: 2701380 - DNA, 17 bp, Homo sapiens
tcgagaccagcctggcc

SEQ ID NO: 2701381 - DNA, 21 bp, Homo sapiens
tcggtaagttgaatggcctgc

SEQ ID NO: 2701382 - DNA, 12 bp, Homo sapiens
tcgtggacacct

SEQ ID NO: 2701383 - DNA, 18 bp, Homo sapiens
tcgtggacacctgccctg

SEQ ID NO: 2701384 - DNA, 18 bp, Homo sapiens
tctaaagtttacagtaaa

SEQ ID NO: 2701385 - DNA, 20 bp, Homo sapiens
tctagtgccctccacagccg

SEQ ID NO: 2701386 - DNA, 20 bp, Homo sapiens
tctcaatattcaataaagct

SEQ ID NO: 2701387 - DNA, 17 bp, Homo sapiens
tctcaccacacataata

SEQ ID NO: 2701388 - DNA, 15 bp, Homo sapiens
tctcaggagcatggg

SEQ ID NO: 2701389 - DNA, 13 bp, Homo sapiens
tctccccctgggc

SEQ ID NO: 2701390 - DNA, 19 bp, Homo sapiens
tctcctaccccacctcatg

SEQ ID NO: 2701391 - DNA, 14 bp, Homo sapiens
tctcctttcaggga

SEQ ID NO: 2701392 - DNA, 21 bp, Homo sapiens
tctctactcctacctcagcct

SEQ ID NO: 2701393 - DNA, 19 bp, Homo sapiens
tctctctactcctacctca

SEQ ID NO: 2701394 - DNA, 16 bp, Homo sapiens
tctgaatgtacacttt

SEQ ID NO: 2701395 - DNA, 14 bp, Homo sapiens
tctgacctgcaggc

SEQ ID NO: 2701396 - DNA, 17 bp, Homo sapiens
tctgacctgcaggccaa

SEQ ID NO: 2701397 - DNA, 16 bp, Homo sapiens
tctggagcccttgggt

SEQ ID NO: 2701398 - DNA, 23 bp, Homo sapiens
tctgggccaagttcctctagtgc

SEQ ID NO: 2701399 - DNA, 22 bp, Homo sapiens
tctggtatgaacttgaggacac

SEQ ID NO: 2701400 - DNA, 15 bp, Homo sapiens
tctgtctgtcccaaa

SEQ ID NO: 2701401 - DNA, 18 bp, Homo sapiens
tctgtctgtctgtcccaa

SEQ ID NO: 2701402 - DNA, 19 bp, Homo sapiens
tcttccccactccccacct

SEQ ID NO: 2701403 - DNA, 12 bp, Homo sapiens
tctttgcatgga

SEQ ID NO: 2701404 - DNA, 21 bp, Homo sapiens
tgaaaatgcatttttatcatg

SEQ ID NO: 2701405 - DNA, 12 bp, Homo sapiens
tgaaagctgaat

SEQ ID NO: 2701406 - DNA, 15 bp, Homo sapiens
tgaaagtcagatgcc

SEQ ID NO: 2701407 - DNA, 22 bp, Homo sapiens
tgaaattgtctagcagagcagg

SEQ ID NO: 2701408 - DNA, 14 bp, Homo sapiens
tgaacatggactct

SEQ ID NO: 2701409 - DNA, 21 bp, Homo sapiens
tgaacttgaggacacatgtcc

SEQ ID NO: 2701410 - DNA, 20 bp, Homo sapiens
tgaagacccagtgtaaagaa

SEQ ID NO: 2701411 - DNA, 21 bp, Homo sapiens
tgaagacccagtgtaaagaat

SEQ ID NO: 2701412 - DNA, 13 bp, Homo sapiens
tgaagctgacagc

SEQ ID NO: 2701413 - DNA, 20 bp, Homo sapiens
tgaaggagattttccttcct

SEQ ID NO: 2701414 - DNA, 12 bp, Homo sapiens
tgaatggcctgc

SEQ ID NO: 2701415 - DNA, 15 bp, Homo sapiens
tgaatttggagactc

SEQ ID NO: 2701416 - DNA, 12 bp, Homo sapiens
tgacatcccagg

SEQ ID NO: 2701417 - DNA, 14 bp, Homo sapiens
tgacatcccaggag

SEQ ID NO: 2701418 - DNA, 20 bp, Homo sapiens
tgaccctgcgaaggggccct

SEQ ID NO: 2701419 - DNA, 23 bp, Homo sapiens
tgacgtgcacctgtactcaggag

SEQ ID NO: 2701420 - DNA, 13 bp, Homo sapiens
tgactctctgtga

SEQ ID NO: 2701421 - DNA, 19 bp, Homo sapiens
tgacttttccatgtatcta

SEQ ID NO: 2701422 - DNA, 19 bp, Homo sapiens
tgagaccacctctcaatat

SEQ ID NO: 2701423 - DNA, 19 bp, Homo sapiens
tgagcttggcagctgaact

SEQ ID NO: 2701424 - DNA, 16 bp, Homo sapiens
tgaggacacatgtcca

SEQ ID NO: 2701425 - DNA, 16 bp, Homo sapiens
tgaggagcagcttcag

SEQ ID NO: 2701426 - DNA, 20 bp, Homo sapiens
tgaggagcagcttcagttgt

SEQ ID NO: 2701427 - DNA, 23 bp, Homo sapiens
tgaggcgggtggatcacctgagg

SEQ ID NO: 2701428 - DNA, 16 bp, Homo sapiens
tgaggctctttctggg

SEQ ID NO: 2701429 - DNA, 21 bp, Homo sapiens
tgaggggaggatcactggagc

SEQ ID NO: 2701430 - DNA, 22 bp, Homo sapiens
tgagggtaataaacttagaata

SEQ ID NO: 2701431 - DNA, 16 bp, Homo sapiens
tgataaactaaaagca

SEQ ID NO: 2701432 - DNA, 19 bp, Homo sapiens
tgataaattccactggact

SEQ ID NO: 2701433 - DNA, 13 bp, Homo sapiens
tgatcccagcact

SEQ ID NO: 2701434 - DNA, 14 bp, Homo sapiens
tgcaatctccaggg

SEQ ID NO: 2701435 - DNA, 16 bp, Homo sapiens
tgcaatctccagggct

SEQ ID NO: 2701436 - DNA, 14 bp, Homo sapiens
tgcaccctccgcct

SEQ ID NO: 2701437 - DNA, 17 bp, Homo sapiens
tgcacctgtactcagga

SEQ ID NO: 2701438 - DNA, 12 bp, Homo sapiens
tgcactccagcc

SEQ ID NO: 2701439 - DNA, 13 bp, Homo sapiens
tgcactccagcct

SEQ ID NO: 2701440 - DNA, 18 bp, Homo sapiens
tgcactccagcctgggcg

SEQ ID NO: 2701441 - DNA, 19 bp, Homo sapiens
tgcactccagcctgggcga

SEQ ID NO: 2701442 - DNA, 15 bp, Homo sapiens
tgcactgtatgctgg

SEQ ID NO: 2701443 - DNA, 16 bp, Homo sapiens
tgcactgtatgctgga

SEQ ID NO: 2701444 - DNA, 21 bp, Homo sapiens
tgcagaggggctttctggaga

SEQ ID NO: 2701445 - DNA, 21 bp, Homo sapiens
tgcaggccaagagcagaggca

SEQ ID NO: 2701446 - DNA, 19 bp, Homo sapiens
tgcatggaatttgtaagtt

SEQ ID NO: 2701447 - DNA, 22 bp, Homo sapiens
tgccaaagcaaaagaagtaaaa

SEQ ID NO: 2701448 - DNA, 15 bp, Homo sapiens
tgccaccaataaaaa

SEQ ID NO: 2701449 - DNA, 11 bp, Homo sapiens
tgccacctgtc

SEQ ID NO: 2701450 - DNA, 13 bp, Homo sapiens
tgccacctgtctg

SEQ ID NO: 2701451 - DNA, 15 bp, Homo sapiens
tgccacctgtctgtc

SEQ ID NO: 2701452 - DNA, 15 bp, Homo sapiens
tgccagcctggcttc

SEQ ID NO: 2701453 - DNA, 20 bp, Homo sapiens
tgccagcctggcttctggag

SEQ ID NO: 2701454 - DNA, 19 bp, Homo sapiens
tgccatttgcaccctccgc

SEQ ID NO: 2701455 - DNA, 23 bp, Homo sapiens
tgcccagagggcccaggcaggcc

SEQ ID NO: 2701456 - DNA, 12 bp, Homo sapiens
tgccccctggtg

SEQ ID NO: 2701457 - DNA, 21 bp, Homo sapiens
tgccccctggtggacagtcct

SEQ ID NO: 2701458 - DNA, 22 bp, Homo sapiens
tgccccctggtggacagtcctg

SEQ ID NO: 2701459 - DNA, 14 bp, Homo sapiens
aaaataaagcaaat

SEQ ID NO: 2701460 - DNA, 14 bp, Homo sapiens
aactgtgctcccac

SEQ ID NO: 2701461 - DNA, 18 bp, Homo sapiens
aacttagaataaaattgt

SEQ ID NO: 2701462 - DNA, 13 bp, Homo sapiens
aacttcagcacca

SEQ ID NO: 2701463 - DNA, 22 bp, Homo sapiens
aacttgagggtaataaacttag

SEQ ID NO: 2701464 - DNA, 14 bp, Homo sapiens
aacttgattcttgt

SEQ ID NO: 2701465 - DNA, 13 bp, Homo sapiens
aactttcatttaa

SEQ ID NO: 2701466 - DNA, 17 bp, Homo sapiens
aactttgatctctgctt

SEQ ID NO: 2701467 - DNA, 15 bp, Homo sapiens
aactttgccttaagt

SEQ ID NO: 2701468 - DNA, 15 bp, Homo sapiens
aactttgcttgatta

SEQ ID NO: 2701469 - DNA, 22 bp, Homo sapiens
aagaaaaccctaagtgtggatg

SEQ ID NO: 2701470 - DNA, 15 bp, Homo sapiens
aagaaaagttttgta

SEQ ID NO: 2701471 - DNA, 17 bp, Homo sapiens
aagaaatcgccttatga

SEQ ID NO: 2701472 - DNA, 13 bp, Homo sapiens
aagaactgcccca

SEQ ID NO: 2701473 - DNA, 18 bp, Homo sapiens
aagaactgccccatctcc

SEQ ID NO: 2701474 - DNA, 20 bp, Homo sapiens
aagaactttgccttaagttt

SEQ ID NO: 2701475 - DNA, 15 bp, Homo sapiens
aagaattctattttg

SEQ ID NO: 2701476 - DNA, 18 bp, Homo sapiens
aagaattctattttgctg

SEQ ID NO: 2701477 - DNA, 20 bp, Homo sapiens
aagacaaacaccttatttgt

SEQ ID NO: 2701478 - DNA, 23 bp, Homo sapiens
aagacaggacagtgcttcagcct

SEQ ID NO: 2701479 - DNA, 11 bp, Homo sapiens
aagacatcaat

SEQ ID NO: 2701480 - DNA, 12 bp, Homo sapiens
aagacatcaatg

SEQ ID NO: 2701481 - DNA, 15 bp, Homo sapiens
aagacatcaatgaaa

SEQ ID NO: 2701482 - DNA, 19 bp, Homo sapiens
aagacttcaatattaaatg

SEQ ID NO: 2701483 - DNA, 13 bp, Homo sapiens
aagagaggcacct

SEQ ID NO: 2701484 - DNA, 18 bp, Homo sapiens
aagagaggcacctgctgg

SEQ ID NO: 2701485 - DNA, 19 bp, Homo sapiens
aagagaggcacctgctgga

SEQ ID NO: 2701486 - DNA, 20 bp, Homo sapiens
aagagatctttctttccaaa

SEQ ID NO: 2701487 - DNA, 22 bp, Homo sapiens
aagagccttcacatgaaattag

SEQ ID NO: 2701488 - DNA, 22 bp, Homo sapiens
aagaggagagaggaagctctct

SEQ ID NO: 2701489 - DNA, 19 bp, Homo sapiens
aagagggtgaacaaagaaa

SEQ ID NO: 2701490 - DNA, 14 bp, Homo sapiens
aagaggttctgcac

SEQ ID NO: 2701491 - DNA, 15 bp, Homo sapiens
aagagtctctccagc

SEQ ID NO: 2701492 - DNA, 16 bp, Homo sapiens
aagagtctctccagcc

SEQ ID NO: 2701493 - DNA, 22 bp, Homo sapiens
aagagtctctggctcagctgtg

SEQ ID NO: 2701494 - DNA, 15 bp, Homo sapiens
aagagtgtaacatcc

SEQ ID NO: 2701495 - DNA, 17 bp, Homo sapiens
aagatactcaagcaggt

SEQ ID NO: 2701496 - DNA, 23 bp, Homo sapiens
aagatcagctattcccttctgat

SEQ ID NO: 2701497 - DNA, 15 bp, Homo sapiens
aagatctcagcagcc

SEQ ID NO: 2701498 - DNA, 21 bp, Homo sapiens
aagatggcttatttgtataat

SEQ ID NO: 2701499 - DNA, 23 bp, Homo sapiens
aagattaactttcaaaagcaaac

SEQ ID NO: 2701500 - DNA, 13 bp, Homo sapiens
aagcaaaaacaat

SEQ ID NO: 2701501 - DNA, 17 bp, Homo sapiens
aagcaaagccacatttt

SEQ ID NO: 2701502 - DNA, 21 bp, Homo sapiens
aagcaagacgtcctggaatga

SEQ ID NO: 2701503 - DNA, 23 bp, Homo sapiens
aagcaagacgtcctggaatgaag

SEQ ID NO: 2701504 - DNA, 17 bp, Homo sapiens
aagcaatttatatcttt

SEQ ID NO: 2701505 - DNA, 19 bp, Homo sapiens
aagcaatttatatctttat

SEQ ID NO: 2701506 - DNA, 23 bp, Homo sapiens
aagcaatttatatctttatgcaa

SEQ ID NO: 2701507 - DNA, 15 bp, Homo sapiens
aagcacaagtacttt

SEQ ID NO: 2701508 - DNA, 20 bp, Homo sapiens
aagcacagtctgatgacaca

SEQ ID NO: 2701509 - DNA, 21 bp, Homo sapiens
aagcaggaggaggtgccaaca

SEQ ID NO: 2701510 - DNA, 16 bp, Homo sapiens
aagcaggcttgtgctt

SEQ ID NO: 2701511 - DNA, 15 bp, Homo sapiens
aagcatcacctcagg

SEQ ID NO: 2701512 - DNA, 14 bp, Homo sapiens
aagcatcctcccca

SEQ ID NO: 2701513 - DNA, 15 bp, Homo sapiens
aagcattttcagcat

SEQ ID NO: 2701514 - DNA, 14 bp, Homo sapiens
aagccaaactctgc

SEQ ID NO: 2701515 - DNA, 16 bp, Homo sapiens
aagccaaactctgcca

SEQ ID NO: 2701516 - DNA, 15 bp, Homo sapiens
aagccacactttgaa

SEQ ID NO: 2701517 - DNA, 12 bp, Homo sapiens
aagccaccgcag

SEQ ID NO: 2701518 - DNA, 16 bp, Homo sapiens
aagccaccgcagctgc

SEQ ID NO: 2701519 - DNA, 17 bp, Homo sapiens
aagccaccgcagctgct

SEQ ID NO: 2701520 - DNA, 18 bp, Homo sapiens
aagccaccgcagctgctg

SEQ ID NO: 2701521 - DNA, 22 bp, Homo sapiens
aagccatatctagtcaataact

SEQ ID NO: 2701522 - DNA, 20 bp, Homo sapiens
aagccattttttgaggagag

SEQ ID NO: 2701523 - DNA, 15 bp, Homo sapiens
aagccctcggcctcc

SEQ ID NO: 2701524 - DNA, 13 bp, Homo sapiens
aagcctctgtgtc

SEQ ID NO: 2701525 - DNA, 20 bp, Homo sapiens
aagcctctgtgtcactggct

SEQ ID NO: 2701526 - DNA, 15 bp, Homo sapiens
aagcctgaggctggg

SEQ ID NO: 2701527 - DNA, 18 bp, Homo sapiens
aagcgggatcccagcatc

SEQ ID NO: 2701528 - DNA, 17 bp, Homo sapiens
aagctcaggtcctgctg

SEQ ID NO: 2701529 - DNA, 22 bp, Homo sapiens
aagctctatggattatccactg

SEQ ID NO: 2701530 - DNA, 19 bp, Homo sapiens
aagctctgaacaaaagctt

SEQ ID NO: 2701531 - DNA, 14 bp, Homo sapiens
aagctgcagcttcc

SEQ ID NO: 2701532 - DNA, 16 bp, Homo sapiens
aagctgcagcttcctg

SEQ ID NO: 2701533 - DNA, 20 bp, Homo sapiens
aagctgtgtctctgtatata

SEQ ID NO: 2701534 - DNA, 12 bp, Homo sapiens
aagctttctcct

SEQ ID NO: 2701535 - DNA, 22 bp, Homo sapiens
aaggaagggcatccttctgcct

SEQ ID NO: 2701536 - DNA, 16 bp, Homo sapiens
aaggacctgaaataag

SEQ ID NO: 2701537 - DNA, 20 bp, Homo sapiens
aaggactggccgtggctcca

SEQ ID NO: 2701538 - DNA, 22 bp, Homo sapiens
aaggactggccgtggctccaga

SEQ ID NO: 2701539 - DNA, 20 bp, Homo sapiens
aaggagaaaatgcattatgt

SEQ ID NO: 2701540 - DNA, 23 bp, Homo sapiens
aaggagatagacgggttgaaaga

SEQ ID NO: 2701541 - DNA, 15 bp, Homo sapiens
aaggaggctggctgg

SEQ ID NO: 2701542 - DNA, 16 bp, Homo sapiens
aaggcagccacagaca

SEQ ID NO: 2701543 - DNA, 23 bp, Homo sapiens
aaggcagtgaacacactcagcag

SEQ ID NO: 2701544 - DNA, 13 bp, Homo sapiens
aaggcagttctgt

SEQ ID NO: 2701545 - DNA, 14 bp, Homo sapiens
aaggccacactggc

SEQ ID NO: 2701546 - DNA, 16 bp, Homo sapiens
aaggctcagtctcagg

SEQ ID NO: 2701547 - DNA, 17 bp, Homo sapiens
aaggctcagtctcagga

SEQ ID NO: 2701548 - DNA, 16 bp, Homo sapiens
aaggctggctgggcat

SEQ ID NO: 2701549 - DNA, 17 bp, Homo sapiens
aaggctttggcaacaga

SEQ ID NO: 2701550 - DNA, 17 bp, Homo sapiens
aagggaactgaagacct

SEQ ID NO: 2701551 - DNA, 16 bp, Homo sapiens
aagggcctgctctgct

SEQ ID NO: 2701552 - DNA, 22 bp, Homo sapiens
aagggctcagagctgctgagca

SEQ ID NO: 2701553 - DNA, 19 bp, Homo sapiens
aagggttttccaccctgga

SEQ ID NO: 2701554 - DNA, 14 bp, Homo sapiens
aaggtaataaatac

SEQ ID NO: 2701555 - DNA, 22 bp, Homo sapiens
aaggtaatttttttttgtaaag

SEQ ID NO: 2701556 - DNA, 19 bp, Homo sapiens
aaggtaggttttaaaaata

SEQ ID NO: 2701557 - DNA, 22 bp, Homo sapiens
aaggtataaggatcttttgtaa

SEQ ID NO: 2701558 - DNA, 20 bp, Homo sapiens
aaggtatttagaatatatta

SEQ ID NO: 2701559 - DNA, 15 bp, Homo sapiens
aaggtctataaacat

SEQ ID NO: 2701560 - DNA, 18 bp, Homo sapiens
aaggtctcacactcctcc

SEQ ID NO: 2701561 - DNA, 21 bp, Homo sapiens
aaggtctcacactcctcctgc

SEQ ID NO: 2701562 - DNA, 13 bp, Homo sapiens
aaggtcttcttgt

SEQ ID NO: 2701563 - DNA, 19 bp, Homo sapiens
aaggtcttcttgtgtcctg

SEQ ID NO: 2701564 - DNA, 20 bp, Homo sapiens
aaggtcttcttgtgtcctga

SEQ ID NO: 2701565 - DNA, 23 bp, Homo sapiens
aaggtgcacagacctcagagatg

SEQ ID NO: 2701566 - DNA, 22 bp, Homo sapiens
aaggtggtctgctcgggcccag

SEQ ID NO: 2701567 - DNA, 13 bp, Homo sapiens
aattccactggac

SEQ ID NO: 2701568 - DNA, 17 bp, Homo sapiens
aattcctagctgtaaat

SEQ ID NO: 2701569 - DNA, 11 bp, Homo sapiens
aattcctgggc

SEQ ID NO: 2701570 - DNA, 12 bp, Homo sapiens
aattctttctca

SEQ ID NO: 2701571 - DNA, 20 bp, Homo sapiens
aattgaaggagaaaatgcat

SEQ ID NO: 2701572 - DNA, 15 bp, Homo sapiens
aattgagagatgttt

SEQ ID NO: 2701573 - DNA, 14 bp, Homo sapiens
aattgagctagaaa

SEQ ID NO: 2701574 - DNA, 14 bp, Homo sapiens
aattgcacttttaa

SEQ ID NO: 2701575 - DNA, 19 bp, Homo sapiens
aattgcttgaacccaggag

SEQ ID NO: 2701576 - DNA, 21 bp, Homo sapiens
aattgtaaaattgtatagaga

SEQ ID NO: 2701577 - DNA, 13 bp, Homo sapiens
aattgtatagaga

SEQ ID NO: 2701578 - DNA, 15 bp, Homo sapiens
aattgtatagagata

SEQ ID NO: 2701579 - DNA, 20 bp, Homo sapiens
aattgtcattatttttgtta

SEQ ID NO: 2701580 - DNA, 22 bp, Homo sapiens
aattgtctgtctgctcttattt

SEQ ID NO: 2701581 - DNA, 14 bp, Homo sapiens
aattgttctgggtg

SEQ ID NO: 2701582 - DNA, 20 bp, Homo sapiens
aatttaaagaaacactaaat

SEQ ID NO: 2701583 - DNA, 14 bp, Homo sapiens
aatttaatttatag

SEQ ID NO: 2701584 - DNA, 17 bp, Homo sapiens
aatttactttttaaaca

SEQ ID NO: 2701585 - DNA, 14 bp, Homo sapiens
aatttatatcttta

SEQ ID NO: 2701586 - DNA, 16 bp, Homo sapiens
aatttatgatataata

SEQ ID NO: 2701587 - DNA, 16 bp, Homo sapiens
aatttattattgttct

SEQ ID NO: 2701588 - DNA, 21 bp, Homo sapiens
aatttcaggaatttaatttat

SEQ ID NO: 2701589 - DNA, 22 bp, Homo sapiens
aatttgactgtcctcgcagaga

SEQ ID NO: 2701590 - DNA, 12 bp, Homo sapiens
aatttgtatctg

SEQ ID NO: 2701591 - DNA, 14 bp, Homo sapiens
aatttgtatctgaa

SEQ ID NO: 2701592 - DNA, 15 bp, Homo sapiens
aatttgtatctgaag

SEQ ID NO: 2701593 - DNA, 13 bp, Homo sapiens
acagtgaacagct

SEQ ID NO: 2701594 - DNA, 16 bp, Homo sapiens
acagtgaacagcttca

SEQ ID NO: 2701595 - DNA, 16 bp, Homo sapiens
acagtgaatttaagca

SEQ ID NO: 2701596 - DNA, 20 bp, Homo sapiens
acagtgacgtgactcagagc

SEQ ID NO: 2701597 - DNA, 21 bp, Homo sapiens
acagtgacgtgactcagagct

SEQ ID NO: 2701598 - DNA, 22 bp, Homo sapiens
acagtgacgtgactcagagctt

SEQ ID NO: 2701599 - DNA, 20 bp, Homo sapiens
acagtgactcgggctcctgt

SEQ ID NO: 2701600 - DNA, 23 bp, Homo sapiens
acagtgactcgggctcctgtgcc

SEQ ID NO: 2701601 - DNA, 15 bp, Homo sapiens
acagtgctctgcctc

SEQ ID NO: 2701602 - DNA, 21 bp, Homo sapiens
acagtgcttcagcctgaggct

SEQ ID NO: 2701603 - DNA, 14 bp, Homo sapiens
acagtggcactaaa

SEQ ID NO: 2701604 - DNA, 19 bp, Homo sapiens
acagtggcactaaaatgtt

SEQ ID NO: 2701605 - DNA, 15 bp, Homo sapiens
acagtgtctgggctg

SEQ ID NO: 2701606 - DNA, 16 bp, Homo sapiens
acagtgtctgggctga

SEQ ID NO: 2701607 - DNA, 21 bp, Homo sapiens
acagtgtctgggctgactggg

SEQ ID NO: 2701608 - DNA, 21 bp, Homo sapiens
acagtgttaggcctggcacag

SEQ ID NO: 2701609 - DNA, 16 bp, Homo sapiens
acagtgtttcctgagt

SEQ ID NO: 2701610 - DNA, 12 bp, Homo sapiens
acagttcagttc

SEQ ID NO: 2701611 - DNA, 21 bp, Homo sapiens
acagttcataattcaccaaaa

SEQ ID NO: 2701612 - DNA, 14 bp, Homo sapiens
acagttcatttaat

SEQ ID NO: 2701613 - DNA, 14 bp, Homo sapiens
acataatttgcaat

SEQ ID NO: 2701614 - DNA, 22 bp, Homo sapiens
acataatttgcaatttcaggaa

SEQ ID NO: 2701615 - DNA, 20 bp, Homo sapiens
acatacaaaaaaaatcttta

SEQ ID NO: 2701616 - DNA, 19 bp, Homo sapiens
acatacaacctatgtaatt

SEQ ID NO: 2701617 - DNA, 22 bp, Homo sapiens
acatacaacctatgtaattttt

SEQ ID NO: 2701618 - DNA, 14 bp, Homo sapiens
acatataaaagtta

SEQ ID NO: 2701619 - DNA, 14 bp, Homo sapiens
acatatatgtatat

SEQ ID NO: 2701620 - DNA, 14 bp, Homo sapiens
acatatgtatcttt

SEQ ID NO: 2701621 - DNA, 21 bp, Homo sapiens
acatatgtatctttggggaaa

SEQ ID NO: 2701622 - DNA, 16 bp, Homo sapiens
acatatgtctgtcttt

SEQ ID NO: 2701623 - DNA, 21 bp, Homo sapiens
acatatgtctgtctttgcaaa

SEQ ID NO: 2701624 - DNA, 11 bp, Homo sapiens
atttctgaaca

SEQ ID NO: 2701625 - DNA, 21 bp, Homo sapiens
atttctttaatctgttgtttg

SEQ ID NO: 2701626 - DNA, 23 bp, Homo sapiens
atttgaaagtgggtttcaattta

SEQ ID NO: 2701627 - DNA, 23 bp, Homo sapiens
atttgaggagcagcttcagttgt

SEQ ID NO: 2701628 - DNA, 18 bp, Homo sapiens
atttgagtgattatttgt

SEQ ID NO: 2701629 - DNA, 22 bp, Homo sapiens
atttgatttcgatgtacagtct

SEQ ID NO: 2701630 - DNA, 17 bp, Homo sapiens
atttgccctaagaactt

SEQ ID NO: 2701631 - DNA, 21 bp, Homo sapiens
atttgccctaagaactttgag

SEQ ID NO: 2701632 - DNA, 20 bp, Homo sapiens
atttgcctaattcctggcat

SEQ ID NO: 2701633 - DNA, 14 bp, Homo sapiens
atttgcctgcctgg

SEQ ID NO: 2701634 - DNA, 20 bp, Homo sapiens
atttggaagagaggcacctg

SEQ ID NO: 2701635 - DNA, 17 bp, Homo sapiens
atttggagactctgtgg

SEQ ID NO: 2701636 - DNA, 22 bp, Homo sapiens
atttggcagaactgctggggct

SEQ ID NO: 2701637 - DNA, 22 bp, Homo sapiens
atttgtaagtttatgtctaaag

SEQ ID NO: 2701638 - DNA, 13 bp, Homo sapiens
atttgtacagttc

SEQ ID NO: 2701639 - DNA, 15 bp, Homo sapiens
atttgtccaattctc

SEQ ID NO: 2701640 - DNA, 12 bp, Homo sapiens
attttacagtct

SEQ ID NO: 2701641 - DNA, 17 bp, Homo sapiens
attttaccaaagcatca

SEQ ID NO: 2701642 - DNA, 15 bp, Homo sapiens
attttactgacagaa

SEQ ID NO: 2701643 - DNA, 21 bp, Homo sapiens
attttactgacagaaatgcaa

SEQ ID NO: 2701644 - DNA, 11 bp, Homo sapiens
attttagaaaa

SEQ ID NO: 2701645 - DNA, 21 bp, Homo sapiens
attttaggcagggatttgagg

SEQ ID NO: 2701646 - DNA, 18 bp, Homo sapiens
attttatataaagaaaat

SEQ ID NO: 2701647 - DNA, 20 bp, Homo sapiens
attttatctacccagtcatg

SEQ ID NO: 2701648 - DNA, 15 bp, Homo sapiens
attttattttatagt

SEQ ID NO: 2701649 - DNA, 19 bp, Homo sapiens
attttcatgacttttccat

SEQ ID NO: 2701650 - DNA, 14 bp, Homo sapiens
attttcatttctaa

SEQ ID NO: 2701651 - DNA, 17 bp, Homo sapiens
attttcccactgcaccc

SEQ ID NO: 2701652 - DNA, 14 bp, Homo sapiens
attttctcctgtgg

SEQ ID NO: 2701653 - DNA, 17 bp, Homo sapiens
attttcttggaattttg

SEQ ID NO: 2701654 - DNA, 19 bp, Homo sapiens
attttcttggaattttgta

SEQ ID NO: 2701655 - DNA, 16 bp, Homo sapiens
attttctttcatacat

SEQ ID NO: 2701656 - DNA, 20 bp, Homo sapiens
attttgagggtgtaaccagt

SEQ ID NO: 2701657 - DNA, 21 bp, Homo sapiens
attttgagtatctcggacctt

SEQ ID NO: 2701658 - DNA, 18 bp, Homo sapiens
attttgcattagacagat

SEQ ID NO: 2701659 - DNA, 15 bp, Homo sapiens
attttgctggagact

SEQ ID NO: 2701660 - DNA, 20 bp, Homo sapiens
attttgctggagactattta

SEQ ID NO: 2701661 - DNA, 20 bp, Homo sapiens
attttggaaaaatgtcactg

SEQ ID NO: 2701662 - DNA, 22 bp, Homo sapiens
attttgtaattattgtgatttc

SEQ ID NO: 2701663 - DNA, 17 bp, Homo sapiens
attttgtacaaagatat

SEQ ID NO: 2701664 - DNA, 20 bp, Homo sapiens
attttgtacaaagatatgct

SEQ ID NO: 2701665 - DNA, 14 bp, Homo sapiens
attttgtcgaattt

SEQ ID NO: 2701666 - DNA, 20 bp, Homo sapiens
atttttaaagaaaagttttg

SEQ ID NO: 2701667 - DNA, 14 bp, Homo sapiens
atttttaagcaaat

SEQ ID NO: 2701668 - DNA, 15 bp, Homo sapiens
atttttataaatatg

SEQ ID NO: 2701669 - DNA, 20 bp, Homo sapiens
atttttataaatatgtgaaa

SEQ ID NO: 2701670 - DNA, 23 bp, Homo sapiens
atttttataaatatgtgaaaatg

SEQ ID NO: 2701671 - DNA, 13 bp, Homo sapiens
atttttgaaagaa

SEQ ID NO: 2701672 - DNA, 23 bp, Homo sapiens
atttttgctcttctgtatgtgac

SEQ ID NO: 2701673 - DNA, 14 bp, Homo sapiens
atttttgtacatta

SEQ ID NO: 2701674 - DNA, 15 bp, Homo sapiens
atttttgtacattat

SEQ ID NO: 2701675 - DNA, 16 bp, Homo sapiens
atttttgtacattatg

SEQ ID NO: 2701676 - DNA, 16 bp, Homo sapiens
atttttgtgtatccag

SEQ ID NO: 2701677 - DNA, 21 bp, Homo sapiens
atttttgttagcaaagattaa

SEQ ID NO: 2701678 - DNA, 15 bp, Homo sapiens
attttttagaccctc

SEQ ID NO: 2701679 - DNA, 22 bp, Homo sapiens
attttttgcagtcttttgctgt

SEQ ID NO: 2701680 - DNA, 13 bp, Homo sapiens
atttttttccaga

SEQ ID NO: 2701681 - DNA, 21 bp, Homo sapiens
caaaaacatatgtctgtcttt

SEQ ID NO: 2701682 - DNA, 11 bp, Homo sapiens
caaaagcaggc

SEQ ID NO: 2701683 - DNA, 13 bp, Homo sapiens
caaaatgtccagc

SEQ ID NO: 2701684 - DNA, 15 bp, Homo sapiens
caaaattactggaca

SEQ ID NO: 2701685 - DNA, 18 bp, Homo sapiens
caaaattactggacatat

SEQ ID NO: 2701686 - DNA, 18 bp, Homo sapiens
caaacacacagactctgt

SEQ ID NO: 2701687 - DNA, 11 bp, Homo sapiens
caaacactggg

SEQ ID NO: 2701688 - DNA, 18 bp, Homo sapiens
caaacactgtgatgttgg

SEQ ID NO: 2701689 - DNA, 17 bp, Homo sapiens
caaacatatgtatcttt

SEQ ID NO: 2701690 - DNA, 19 bp, Homo sapiens
caaacatatgtatctttgg

SEQ ID NO: 2701691 - DNA, 21 bp, Homo sapiens
caaaccaggggtaccaggcac

SEQ ID NO: 2701692 - DNA, 23 bp, Homo sapiens
caaaccctgtggggcctgatggt

SEQ ID NO: 2701693 - DNA, 14 bp, Homo sapiens
caaagaaaacccta

SEQ ID NO: 2701694 - DNA, 19 bp, Homo sapiens
caaagaaaaccctaagtgt

SEQ ID NO: 2701695 - DNA, 16 bp, Homo sapiens
caaagaatcaacagtg

SEQ ID NO: 2701696 - DNA, 13 bp, Homo sapiens
caaagacatcagt

SEQ ID NO: 2701697 - DNA, 14 bp, Homo sapiens
caaagagtctctgg

SEQ ID NO: 2701698 - DNA, 15 bp, Homo sapiens
caaagagtctctggc

SEQ ID NO: 2701699 - DNA, 20 bp, Homo sapiens
caaagatatgctaagcagta

SEQ ID NO: 2701700 - DNA, 17 bp, Homo sapiens
caaagatctcagcagcc

SEQ ID NO: 2701701 - DNA, 15 bp, Homo sapiens
caaagattaaatgtg

SEQ ID NO: 2701702 - DNA, 16 bp, Homo sapiens
caaagtctaaagttta

SEQ ID NO: 2701703 - DNA, 17 bp, Homo sapiens
caaagtctaaagtttac

SEQ ID NO: 2701704 - DNA, 19 bp, Homo sapiens
caaagtctaaagtttacag

SEQ ID NO: 2701705 - DNA, 12 bp, Homo sapiens
caaagtggaggt

SEQ ID NO: 2701706 - DNA, 20 bp, Homo sapiens
caaagttttcagattgtaaa

SEQ ID NO: 2701707 - DNA, 11 bp, Homo sapiens
caaataatttt

SEQ ID NO: 2701708 - DNA, 21 bp, Homo sapiens
caaatacatacaacctatgta

SEQ ID NO: 2701709 - DNA, 18 bp, Homo sapiens
caaatagcaaggccaggg

SEQ ID NO: 2701710 - DNA, 21 bp, Homo sapiens
caaatagcaaggccagggcac

SEQ ID NO: 2701711 - DNA, 19 bp, Homo sapiens
caaatcacaaacatatgta

SEQ ID NO: 2701712 - DNA, 20 bp, Homo sapiens
caaatgctgtgcaaacagtg

SEQ ID NO: 2701713 - DNA, 18 bp, Homo sapiens
caaatggctgtaaaacta

SEQ ID NO: 2701714 - DNA, 15 bp, Homo sapiens
caaattaatctttta

SEQ ID NO: 2701715 - DNA, 18 bp, Homo sapiens
caaattaatcttttaaaa

SEQ ID NO: 2701716 - DNA, 19 bp, Homo sapiens
caaattaatcttttaaaaa

SEQ ID NO: 2701717 - DNA, 14 bp, Homo sapiens
caaattatttttat

SEQ ID NO: 2701718 - DNA, 13 bp, Homo sapiens
caaattgtctgtc

SEQ ID NO: 2701719 - DNA, 20 bp, Homo sapiens
caaattgtctgtctgctctt

SEQ ID NO: 2701720 - DNA, 21 bp, Homo sapiens
caaattgtctgtctgctctta

SEQ ID NO: 2701721 - DNA, 16 bp, Homo sapiens
caaattttgaggtctt

SEQ ID NO: 2701722 - DNA, 13 bp, Homo sapiens
caacaaacactgt

SEQ ID NO: 2701723 - DNA, 12 bp, Homo sapiens
caacacatgtgg

SEQ ID NO: 2701724 - DNA, 15 bp, Homo sapiens
caacactcttcttga

SEQ ID NO: 2701725 - DNA, 20 bp, Homo sapiens
caacactcttcttgagcaga

SEQ ID NO: 2701726 - DNA, 19 bp, Homo sapiens
caacagagtgagaccctgt

SEQ ID NO: 2701727 - DNA, 12 bp, Homo sapiens
caacaggagaga

SEQ ID NO: 2701728 - DNA, 19 bp, Homo sapiens
caacattaccttgtctttc

SEQ ID NO: 2701729 - DNA, 18 bp, Homo sapiens
caacatttttgtacatta

SEQ ID NO: 2701730 - DNA, 19 bp, Homo sapiens
caacatttttgtacattat

SEQ ID NO: 2701731 - DNA, 21 bp, Homo sapiens
caacatttttgtacattatgt

SEQ ID NO: 2701732 - DNA, 23 bp, Homo sapiens
caaccatcagaccaccagcaaat

SEQ ID NO: 2701733 - DNA, 18 bp, Homo sapiens
caacccagccgctgcccg

SEQ ID NO: 2701734 - DNA, 12 bp, Homo sapiens
caaccccagctg

SEQ ID NO: 2701735 - DNA, 22 bp, Homo sapiens
caaccccagctggcctctagaa

SEQ ID NO: 2701736 - DNA, 13 bp, Homo sapiens
caacccccagcac

SEQ ID NO: 2701737 - DNA, 13 bp, Homo sapiens
caacccctccccc

SEQ ID NO: 2701738 - DNA, 19 bp, Homo sapiens
caacccctcccccacgtct

SEQ ID NO: 2701739 - DNA, 13 bp, Homo sapiens
caaccctggtgtg

SEQ ID NO: 2701740 - DNA, 16 bp, Homo sapiens
caacctccacctcctg

SEQ ID NO: 2701741 - DNA, 17 bp, Homo sapiens
caacctccacctcctgg

SEQ ID NO: 2701742 - DNA, 22 bp, Homo sapiens
caacctgcccctccccagccct

SEQ ID NO: 2701743 - DNA, 12 bp, Homo sapiens
caacctgcctgt

SEQ ID NO: 2701744 - DNA, 15 bp, Homo sapiens
atgccccctcgtgcc

SEQ ID NO: 2701745 - DNA, 18 bp, Homo sapiens
atgccccctcgtgccagt

SEQ ID NO: 2701746 - DNA, 17 bp, Homo sapiens
atgccgtgtagtttctg

SEQ ID NO: 2701747 - DNA, 18 bp, Homo sapiens
atgccgtgtagtttctgg

SEQ ID NO: 2701748 - DNA, 20 bp, Homo sapiens
atgcctcagccagccctgga

SEQ ID NO: 2701749 - DNA, 21 bp, Homo sapiens
atgcctcagccagccctggag

SEQ ID NO: 2701750 - DNA, 19 bp, Homo sapiens
atgctatctcgctagccat

SEQ ID NO: 2701751 - DNA, 15 bp, Homo sapiens
atgctgaaatctatt

SEQ ID NO: 2701752 - DNA, 21 bp, Homo sapiens
atgctgcccagggtcagtgta

SEQ ID NO: 2701753 - DNA, 22 bp, Homo sapiens
atgctggacattaacaagatca

SEQ ID NO: 2701754 - DNA, 14 bp, Homo sapiens
atgctggcctcttg

SEQ ID NO: 2701755 - DNA, 20 bp, Homo sapiens
atgctggcctcttggcacct

SEQ ID NO: 2701756 - DNA, 15 bp, Homo sapiens
atgctgggctgggtg

SEQ ID NO: 2701757 - DNA, 17 bp, Homo sapiens
atgctgtactaaaatat

SEQ ID NO: 2701758 - DNA, 20 bp, Homo sapiens
atgctgtcaggagatggaag

SEQ ID NO: 2701759 - DNA, 17 bp, Homo sapiens
atgctgtgcaaacagtg

SEQ ID NO: 2701760 - DNA, 14 bp, Homo sapiens
atgctttctccttt

SEQ ID NO: 2701761 - DNA, 21 bp, Homo sapiens
atgctttgaagtacaattgtg

SEQ ID NO: 2701762 - DNA, 13 bp, Homo sapiens
atggaactcccca

SEQ ID NO: 2701763 - DNA, 20 bp, Homo sapiens
atggaactccccagggcctc

SEQ ID NO: 2701764 - DNA, 20 bp, Homo sapiens
atggaagaagttttaactat

SEQ ID NO: 2701765 - DNA, 12 bp, Homo sapiens
atggaatttgta

SEQ ID NO: 2701766 - DNA, 15 bp, Homo sapiens
atggaatttgtaagt

SEQ ID NO: 2701767 - DNA, 18 bp, Homo sapiens
atggacatcgatatgaaa

SEQ ID NO: 2701768 - DNA, 20 bp, Homo sapiens
atggacatcgatatgaaaaa

SEQ ID NO: 2701769 - DNA, 17 bp, Homo sapiens
atggagcgcacctgccc

SEQ ID NO: 2701770 - DNA, 23 bp, Homo sapiens
atggagcgcacctgccccctggt

SEQ ID NO: 2701771 - DNA, 16 bp, Homo sapiens
atggagtgagcagtag

SEQ ID NO: 2701772 - DNA, 13 bp, Homo sapiens
atggagtgtttga

SEQ ID NO: 2701773 - DNA, 16 bp, Homo sapiens
atggattccaaagcat

SEQ ID NO: 2701774 - DNA, 19 bp, Homo sapiens
atggcacgatctcagctca

SEQ ID NO: 2701775 - DNA, 15 bp, Homo sapiens
atggcagctgggccc

SEQ ID NO: 2701776 - DNA, 13 bp, Homo sapiens
atggcatggagac

SEQ ID NO: 2701777 - DNA, 17 bp, Homo sapiens
atggcccagccactgca

SEQ ID NO: 2701778 - DNA, 19 bp, Homo sapiens
atggcccagccactgcagc

SEQ ID NO: 2701779 - DNA, 12 bp, Homo sapiens
atggccttccct

SEQ ID NO: 2701780 - DNA, 18 bp, Homo sapiens
atggccttccctccccac

SEQ ID NO: 2701781 - DNA, 11 bp, Homo sapiens
atggctggggg

SEQ ID NO: 2701782 - DNA, 13 bp, Homo sapiens
atggctgtaaaac

SEQ ID NO: 2701783 - DNA, 16 bp, Homo sapiens
atggcttacttacaaa

SEQ ID NO: 2701784 - DNA, 19 bp, Homo sapiens
atggcttatttgtataatg

SEQ ID NO: 2701785 - DNA, 20 bp, Homo sapiens
atgggaaagtatttttgaaa

SEQ ID NO: 2701786 - DNA, 14 bp, Homo sapiens
atgggcactgctgg

SEQ ID NO: 2701787 - DNA, 13 bp, Homo sapiens
atgggcctgctgc

SEQ ID NO: 2701788 - DNA, 23 bp, Homo sapiens
atggggcattaatattcttttgt

SEQ ID NO: 2701789 - DNA, 20 bp, Homo sapiens
atggggggaggggggagggc

SEQ ID NO: 2701790 - DNA, 17 bp, Homo sapiens
atggtactaaggagaat

SEQ ID NO: 2701791 - DNA, 15 bp, Homo sapiens
atggtagactgtgac

SEQ ID NO: 2701792 - DNA, 16 bp, Homo sapiens
atggtagactgtgaca

SEQ ID NO: 2701793 - DNA, 19 bp, Homo sapiens
atggtcttgatctcctgag

SEQ ID NO: 2701794 - DNA, 16 bp, Homo sapiens
atggtgtgtgtctctg

SEQ ID NO: 2701795 - DNA, 19 bp, Homo sapiens
atggtgtgtgtctctgaca

SEQ ID NO: 2701796 - DNA, 15 bp, Homo sapiens
atgtaaaatcttcag

SEQ ID NO: 2701797 - DNA, 16 bp, Homo sapiens
atgtaaaatcttcagc

SEQ ID NO: 2701798 - DNA, 17 bp, Homo sapiens
atgtaaaatcttcagct

SEQ ID NO: 2701799 - DNA, 23 bp, Homo sapiens
atgtaaaatcttcagctggtgga

SEQ ID NO: 2701800 - DNA, 19 bp, Homo sapiens
atgtaatgcttatgtgttg

SEQ ID NO: 2701801 - DNA, 17 bp, Homo sapiens
atgtaatttttaaagca

SEQ ID NO: 2701802 - DNA, 20 bp, Homo sapiens
atgtaatttttaaagcaaat

SEQ ID NO: 2701803 - DNA, 18 bp, Homo sapiens
atgtacagtctcaatttt

SEQ ID NO: 2701804 - DNA, 17 bp, Homo sapiens
atgtactgtacttccca

SEQ ID NO: 2701805 - DNA, 13 bp, Homo sapiens
atgtatatgtata

SEQ ID NO: 2701806 - DNA, 15 bp, Homo sapiens
atgtatctacctcac

SEQ ID NO: 2701807 - DNA, 19 bp, Homo sapiens
atgtatgtgccaattttgt

SEQ ID NO: 2701808 - DNA, 15 bp, Homo sapiens
atgtcactgaagtga

SEQ ID NO: 2701809 - DNA, 20 bp, Homo sapiens
atgtcactgaagtgattgaa

SEQ ID NO: 2701810 - DNA, 21 bp, Homo sapiens
atgtcactgaagtgattgaaa

SEQ ID NO: 2701811 - DNA, 13 bp, Homo sapiens
atgtcagaaactc

SEQ ID NO: 2701812 - DNA, 11 bp, Homo sapiens
atgtcagcctt

SEQ ID NO: 2701813 - DNA, 12 bp, Homo sapiens
atgtcatttctc

SEQ ID NO: 2701814 - DNA, 20 bp, Homo sapiens
atgtccctgaagtcttgcat

SEQ ID NO: 2701815 - DNA, 23 bp, Homo sapiens
atgtcctccaacaataaagagct

SEQ ID NO: 2701816 - DNA, 16 bp, Homo sapiens
atgtcctttgtgtcca

SEQ ID NO: 2701817 - DNA, 20 bp, Homo sapiens
atgtcggcacgtcccatgtg

SEQ ID NO: 2701818 - DNA, 21 bp, Homo sapiens
atgtcggcacgtcccatgtgc

SEQ ID NO: 2701819 - DNA, 17 bp, Homo sapiens
atgtctgtctttgcaaa

SEQ ID NO: 2701820 - DNA, 18 bp, Homo sapiens
atgtgaaaatatttaaag

SEQ ID NO: 2701821 - DNA, 13 bp, Homo sapiens
atgtgacaacatt

SEQ ID NO: 2701822 - DNA, 21 bp, Homo sapiens
atgtgagattactttgtcccg

SEQ ID NO: 2701823 - DNA, 17 bp, Homo sapiens
atgtgcaactcttgtat

SEQ ID NO: 2701824 - DNA, 18 bp, Homo sapiens
atgtgcacctatggccca

SEQ ID NO: 2701825 - DNA, 14 bp, Homo sapiens
atgtgccaattttg

SEQ ID NO: 2701826 - DNA, 16 bp, Homo sapiens
atgtgccaattttgtc

SEQ ID NO: 2701827 - DNA, 18 bp, Homo sapiens
atgtgctcccaccaggca

SEQ ID NO: 2701828 - DNA, 19 bp, Homo sapiens
atgtgctcccaccaggcag

SEQ ID NO: 2701829 - DNA, 17 bp, Homo sapiens
atgtggatacagtcatt

SEQ ID NO: 2701830 - DNA, 18 bp, Homo sapiens
atgtgggaaaaaagaaat

SEQ ID NO: 2701831 - DNA, 19 bp, Homo sapiens
atgtgggaaaaaagaaatc

SEQ ID NO: 2701832 - DNA, 16 bp, Homo sapiens
atgtgtaacttctaga

SEQ ID NO: 2701833 - DNA, 18 bp, Homo sapiens
atgtgtcccagtgaacag

SEQ ID NO: 2701834 - DNA, 21 bp, Homo sapiens
atgtgtcccagtgaacagttt

SEQ ID NO: 2701835 - DNA, 15 bp, Homo sapiens
atgttaaatgccttg

SEQ ID NO: 2701836 - DNA, 14 bp, Homo sapiens
atgttacttaaaca

SEQ ID NO: 2701837 - DNA, 15 bp, Homo sapiens
atgttattggaattt

SEQ ID NO: 2701838 - DNA, 16 bp, Homo sapiens
atgttcagaattttgg

SEQ ID NO: 2701839 - DNA, 21 bp, Homo sapiens
atgttcatgtgtaacttctag

SEQ ID NO: 2701840 - DNA, 17 bp, Homo sapiens
atgttcctgttcctcgg

SEQ ID NO: 2701841 - DNA, 15 bp, Homo sapiens
atgttgggcatgatt

SEQ ID NO: 2701842 - DNA, 12 bp, Homo sapiens
atgttggtgcaa

SEQ ID NO: 2701843 - DNA, 21 bp, Homo sapiens
atgttggtgcaattaactctg

SEQ ID NO: 2701844 - DNA, 16 bp, Homo sapiens
atgttttaaaagtttg

SEQ ID NO: 2701845 - DNA, 14 bp, Homo sapiens
attaaaaaaacaca

SEQ ID NO: 2701846 - DNA, 19 bp, Homo sapiens
attaaaaatattttttaaa

SEQ ID NO: 2701847 - DNA, 17 bp, Homo sapiens
attaaaacagaagcaaa

SEQ ID NO: 2701848 - DNA, 13 bp, Homo sapiens
attaaaatttttt

SEQ ID NO: 2701849 - DNA, 21 bp, Homo sapiens
attaaacactaaatgcaagat

SEQ ID NO: 2701850 - DNA, 17 bp, Homo sapiens
attaaattctctctaac

SEQ ID NO: 2701851 - DNA, 19 bp, Homo sapiens
agtaagtaccactcaggcc

SEQ ID NO: 2701852 - DNA, 23 bp, Homo sapiens
agtaagtttctcatcccatgggc

SEQ ID NO: 2701853 - DNA, 16 bp, Homo sapiens
agtacattcatctgga

SEQ ID NO: 2701854 - DNA, 21 bp, Homo sapiens
agtaccaaatccacaagccat

SEQ ID NO: 2701855 - DNA, 18 bp, Homo sapiens
agtagcaccctggattga

SEQ ID NO: 2701856 - DNA, 21 bp, Homo sapiens
agtagtgtcttcctagtatat

SEQ ID NO: 2701857 - DNA, 22 bp, Homo sapiens
agtagtgtcttcctagtatatt

SEQ ID NO: 2701858 - DNA, 19 bp, Homo sapiens
agtataaattcgctgtgag

SEQ ID NO: 2701859 - DNA, 16 bp, Homo sapiens
agtataggataaatta

SEQ ID NO: 2701860 - DNA, 20 bp, Homo sapiens
agtataggataaattacatt

SEQ ID NO: 2701861 - DNA, 21 bp, Homo sapiens
agtatatattctacacatata

SEQ ID NO: 2701862 - DNA, 19 bp, Homo sapiens
agtatcaatccttgttcag

SEQ ID NO: 2701863 - DNA, 14 bp, Homo sapiens
agtatcctgctggt

SEQ ID NO: 2701864 - DNA, 19 bp, Homo sapiens
agtatctattgtgttggct

SEQ ID NO: 2701865 - DNA, 22 bp, Homo sapiens
agtatctcggacctttcagctg

SEQ ID NO: 2701866 - DNA, 21 bp, Homo sapiens
agtatgccttcctgtttaaaa

SEQ ID NO: 2701867 - DNA, 21 bp, Homo sapiens
agtcaacactcttcttgagca

SEQ ID NO: 2701868 - DNA, 19 bp, Homo sapiens
agtcaagttccctcctgca

SEQ ID NO: 2701869 - DNA, 16 bp, Homo sapiens
agtcacccatgaagac

SEQ ID NO: 2701870 - DNA, 17 bp, Homo sapiens
agtcacccatgaagaca

SEQ ID NO: 2701871 - DNA, 20 bp, Homo sapiens
agtcacccatgaagacagga

SEQ ID NO: 2701872 - DNA, 16 bp, Homo sapiens
agtcagagtgtccctt

SEQ ID NO: 2701873 - DNA, 23 bp, Homo sapiens
agtcagccttccccctcccaggg

SEQ ID NO: 2701874 - DNA, 21 bp, Homo sapiens
agtcaggtgtggcggtgcgtg

SEQ ID NO: 2701875 - DNA, 16 bp, Homo sapiens
agtcatggtcctggct

SEQ ID NO: 2701876 - DNA, 18 bp, Homo sapiens
agtcatggtcctggctgg

SEQ ID NO: 2701877 - DNA, 18 bp, Homo sapiens
agtcattgtcgctcagca

SEQ ID NO: 2701878 - DNA, 12 bp, Homo sapiens
agtccaacctgc

SEQ ID NO: 2701879 - DNA, 17 bp, Homo sapiens
agtccacttttaaaact

SEQ ID NO: 2701880 - DNA, 21 bp, Homo sapiens
agtccagtcaagttccctcct

SEQ ID NO: 2701881 - DNA, 21 bp, Homo sapiens
agtccagtcctttgttgctgt

SEQ ID NO: 2701882 - DNA, 23 bp, Homo sapiens
agtccagtcctttgttgctgttg

SEQ ID NO: 2701883 - DNA, 22 bp, Homo sapiens
agtcccttagaagatctgcttc

SEQ ID NO: 2701884 - DNA, 13 bp, Homo sapiens
agtcctagagctc

SEQ ID NO: 2701885 - DNA, 16 bp, Homo sapiens
agtcctagagctcctg

SEQ ID NO: 2701886 - DNA, 18 bp, Homo sapiens
agtcctcacagcctctcc

SEQ ID NO: 2701887 - DNA, 20 bp, Homo sapiens
agtcctcacagcctctccct

SEQ ID NO: 2701888 - DNA, 12 bp, Homo sapiens
agtcctgctggc

SEQ ID NO: 2701889 - DNA, 14 bp, Homo sapiens
agtcctgctggcct

SEQ ID NO: 2701890 - DNA, 15 bp, Homo sapiens
agtcctgctggcctg

SEQ ID NO: 2701891 - DNA, 19 bp, Homo sapiens
atcaggggacaaaccaggg

SEQ ID NO: 2701892 - DNA, 20 bp, Homo sapiens
atcaggtttactcagtgaaa

SEQ ID NO: 2701893 - DNA, 15 bp, Homo sapiens
atcagtgtgcccccc

SEQ ID NO: 2701894 - DNA, 17 bp, Homo sapiens
atcagttttatccacag

SEQ ID NO: 2701895 - DNA, 17 bp, Homo sapiens
atcataacatagttgaa

SEQ ID NO: 2701896 - DNA, 18 bp, Homo sapiens
atcataacatagttgaaa

SEQ ID NO: 2701897 - DNA, 20 bp, Homo sapiens
atcataacatagttgaaaaa

SEQ ID NO: 2701898 - DNA, 22 bp, Homo sapiens
atcatattaattattttccaaa

SEQ ID NO: 2701899 - DNA, 23 bp, Homo sapiens
atcatatttaataggataaatta

SEQ ID NO: 2701900 - DNA, 21 bp, Homo sapiens
atcatcccatctaagctgcag

SEQ ID NO: 2701901 - DNA, 12 bp, Homo sapiens
atcatctttgct

SEQ ID NO: 2701902 - DNA, 22 bp, Homo sapiens
atcatctttgctgaatgtcatt

SEQ ID NO: 2701903 - DNA, 17 bp, Homo sapiens
atcattggataaatttg

SEQ ID NO: 2701904 - DNA, 19 bp, Homo sapiens
atcatttaaacatgcagaa

SEQ ID NO: 2701905 - DNA, 19 bp, Homo sapiens
atcattttatataaagaaa

SEQ ID NO: 2701906 - DNA, 23 bp, Homo sapiens
atccaaatgctgtgcaaacagtg

SEQ ID NO: 2701907 - DNA, 15 bp, Homo sapiens
atccatttggcagaa

SEQ ID NO: 2701908 - DNA, 22 bp, Homo sapiens
atccatttggcagaactgctgg

SEQ ID NO: 2701909 - DNA, 18 bp, Homo sapiens
atcccatctaagctgcag

SEQ ID NO: 2701910 - DNA, 19 bp, Homo sapiens
atcccatctaagctgcagc

SEQ ID NO: 2701911 - DNA, 12 bp, Homo sapiens
atcccccagcct

SEQ ID NO: 2701912 - DNA, 23 bp, Homo sapiens
atcccctgtcccctggggctggt

SEQ ID NO: 2701913 - DNA, 23 bp, Homo sapiens
atccgacttgaattttcccactg

SEQ ID NO: 2701914 - DNA, 22 bp, Homo sapiens
atcctcaggtagtactgggaat

SEQ ID NO: 2701915 - DNA, 13 bp, Homo sapiens
atcctccccacca

SEQ ID NO: 2701916 - DNA, 20 bp, Homo sapiens
atcctccccaccagagctgc

SEQ ID NO: 2701917 - DNA, 21 bp, Homo sapiens
atcctccccaccagagctgcc

SEQ ID NO: 2701918 - DNA, 13 bp, Homo sapiens
atcctcctctcca

SEQ ID NO: 2701919 - DNA, 13 bp, Homo sapiens
atcctgaggctga

SEQ ID NO: 2701920 - DNA, 18 bp, Homo sapiens
atcctgggcccccagaga

SEQ ID NO: 2701921 - DNA, 16 bp, Homo sapiens
atcctggtttgtaatg

SEQ ID NO: 2701922 - DNA, 23 bp, Homo sapiens
atcctgtgctatgctggacatta

SEQ ID NO: 2701923 - DNA, 11 bp, Homo sapiens
atccttctgcc

SEQ ID NO: 2701924 - DNA, 14 bp, Homo sapiens
atccttggagagca

SEQ ID NO: 2701925 - DNA, 17 bp, Homo sapiens
atccttggagagcagct

SEQ ID NO: 2701926 - DNA, 19 bp, Homo sapiens
atccttggagagcagctgg

SEQ ID NO: 2701927 - DNA, 17 bp, Homo sapiens
atcgatatgaaaaataa

SEQ ID NO: 2701928 - DNA, 20 bp, Homo sapiens
atcgcaccactgtgtattta

SEQ ID NO: 2701929 - DNA, 16 bp, Homo sapiens
atctaagctgcagctt

SEQ ID NO: 2701930 - DNA, 16 bp, Homo sapiens
atctaatttaccatta

SEQ ID NO: 2701931 - DNA, 18 bp, Homo sapiens
atctacccagtcatgtac

SEQ ID NO: 2701932 - DNA, 21 bp, Homo sapiens
atctacctcactattcaagta

SEQ ID NO: 2701933 - DNA, 21 bp, Homo sapiens
atctatatacaaagccttggt

SEQ ID NO: 2701934 - DNA, 18 bp, Homo sapiens
atctatatctctaaactg

SEQ ID NO: 2701935 - DNA, 21 bp, Homo sapiens
atctatatctctaaactgctg

SEQ ID NO: 2701936 - DNA, 16 bp, Homo sapiens
atctattgtgttggct

SEQ ID NO: 2701937 - DNA, 11 bp, Homo sapiens
atctcagcagc

SEQ ID NO: 2701938 - DNA, 18 bp, Homo sapiens
atctcagcagccagctcc

SEQ ID NO: 2701939 - DNA, 19 bp, Homo sapiens
atctcagcagccagctcct

SEQ ID NO: 2701940 - DNA, 22 bp, Homo sapiens
atctcattcaggtgttctcttc

SEQ ID NO: 2701941 - DNA, 13 bp, Homo sapiens
atctccctgacct

SEQ ID NO: 2701942 - DNA, 12 bp, Homo sapiens
atctcctcccac

SEQ ID NO: 2701943 - DNA, 22 bp, Homo sapiens
atctctctactcctacctcagc

SEQ ID NO: 2701944 - DNA, 18 bp, Homo sapiens
atctctgagtgtctctgc

SEQ ID NO: 2701945 - DNA, 22 bp, Homo sapiens
atctctgagtgtctctgcctgg

SEQ ID NO: 2701946 - DNA, 23 bp, Homo sapiens
atctctgagtgtctctgcctgga

SEQ ID NO: 2701947 - DNA, 13 bp, Homo sapiens
atctgaaggagat

SEQ ID NO: 2701948 - DNA, 15 bp, Homo sapiens
atctgaaggagattt

SEQ ID NO: 2701949 - DNA, 17 bp, Homo sapiens
atctgagaagtgtatat

SEQ ID NO: 2701950 - DNA, 12 bp, Homo sapiens
atctgcagggag

SEQ ID NO: 2701951 - DNA, 23 bp, Homo sapiens
atctgcccgcctcggcctcccaa

SEQ ID NO: 2701952 - DNA, 21 bp, Homo sapiens
atctgcttccctggggcccca

SEQ ID NO: 2701953 - DNA, 14 bp, Homo sapiens
atctggaggctgcg

SEQ ID NO: 2701954 - DNA, 20 bp, Homo sapiens
atctggccacactgggctca

SEQ ID NO: 2701955 - DNA, 21 bp, Homo sapiens
atctggccacactgggctcac

SEQ ID NO: 2701956 - DNA, 14 bp, Homo sapiens
atctgtccatcctc

SEQ ID NO: 2701957 - DNA, 15 bp, Homo sapiens
atctgtccatcctcc

SEQ ID NO: 2701958 - DNA, 17 bp, Homo sapiens
atctgtgataattttct

SEQ ID NO: 2701959 - DNA, 14 bp, Homo sapiens
atctgttgtttgaa

SEQ ID NO: 2701960 - DNA, 15 bp, Homo sapiens
atctgtttgcttcta

SEQ ID NO: 2701961 - DNA, 18 bp, Homo sapiens
atcttccaggtggggtga

SEQ ID NO: 2701962 - DNA, 15 bp, Homo sapiens
atctttaaatacagt

SEQ ID NO: 2701963 - DNA, 15 bp, Homo sapiens
atctttatctcctgg

SEQ ID NO: 2701964 - DNA, 22 bp, Homo sapiens
atctttcctagtacattttcac

SEQ ID NO: 2701965 - DNA, 15 bp, Homo sapiens
atctttctttccaaa

SEQ ID NO: 2701966 - DNA, 20 bp, Homo sapiens
atctttctttccaaaacatt

SEQ ID NO: 2701967 - DNA, 23 bp, Homo sapiens
atctttctttccaaaacatttct

SEQ ID NO: 2701968 - DNA, 21 bp, Homo sapiens
atgaaaaatagtgtgtccatg

SEQ ID NO: 2701969 - DNA, 12 bp, Homo sapiens
atgaaaacctgc

SEQ ID NO: 2701970 - DNA, 17 bp, Homo sapiens
atgaaaactaaggattt

SEQ ID NO: 2701971 - DNA, 13 bp, Homo sapiens
atgaaaagccata

SEQ ID NO: 2701972 - DNA, 17 bp, Homo sapiens
atgaaaagccatatcta

SEQ ID NO: 2701973 - DNA, 23 bp, Homo sapiens
atgaaattgtctagcagagcagg

SEQ ID NO: 2701974 - DNA, 21 bp, Homo sapiens
atgaagactgttaaatgaaac

SEQ ID NO: 2701975 - DNA, 15 bp, Homo sapiens
atgaagcaatttata

SEQ ID NO: 2701976 - DNA, 17 bp, Homo sapiens
atgaagcaatttatatc

SEQ ID NO: 2701977 - DNA, 17 bp, Homo sapiens
atgaagggtcatttctc

SEQ ID NO: 2701978 - DNA, 16 bp, Homo sapiens
atgaatcttttccact

SEQ ID NO: 2701979 - DNA, 17 bp, Homo sapiens
atgaatgggaaagtatt

SEQ ID NO: 2701980 - DNA, 17 bp, Homo sapiens
atgaattcacaaacaaa

SEQ ID NO: 2701981 - DNA, 20 bp, Homo sapiens
atgaattcacaaacaaatgg

SEQ ID NO: 2701982 - DNA, 15 bp, Homo sapiens
atgaatttgactggt

SEQ ID NO: 2701983 - DNA, 20 bp, Homo sapiens
atgaatttggagactctgtg

SEQ ID NO: 2701984 - DNA, 17 bp, Homo sapiens
atgacacatttggcagt

SEQ ID NO: 2701985 - DNA, 16 bp, Homo sapiens
atgactttttgaatgt

SEQ ID NO: 2701986 - DNA, 16 bp, Homo sapiens
atgagaaaactgagag

SEQ ID NO: 2701987 - DNA, 13 bp, Homo sapiens
atgagaacatggt

SEQ ID NO: 2701988 - DNA, 16 bp, Homo sapiens
atgagcttgtaaatac

SEQ ID NO: 2701989 - DNA, 18 bp, Homo sapiens
atgataatcatcaggttt

SEQ ID NO: 2701990 - DNA, 18 bp, Homo sapiens
atgatactttaattttta

SEQ ID NO: 2701991 - DNA, 16 bp, Homo sapiens
agggatgatgccacac

SEQ ID NO: 2701992 - DNA, 18 bp, Homo sapiens
agggatgatgccacacca

SEQ ID NO: 2701993 - DNA, 16 bp, Homo sapiens
agggatgctgcctgag

SEQ ID NO: 2701994 - DNA, 19 bp, Homo sapiens
agggatgctgcctgagtca

SEQ ID NO: 2701995 - DNA, 18 bp, Homo sapiens
agggcaaagatctcagca

SEQ ID NO: 2701996 - DNA, 15 bp, Homo sapiens
agggcatctctgagt

SEQ ID NO: 2701997 - DNA, 18 bp, Homo sapiens
agggccagcaggcagcgc

SEQ ID NO: 2701998 - DNA, 12 bp, Homo sapiens
agggccagggcc

SEQ ID NO: 2701999 - DNA, 12 bp, Homo sapiens
agggccctgcag

SEQ ID NO: 2702000 - DNA, 22 bp, Homo sapiens
agggcctctgtgcagacagtgt

SEQ ID NO: 2702001 - DNA, 11 bp, Homo sapiens
agggcctgctc

SEQ ID NO: 2702002 - DNA, 17 bp, Homo sapiens
agggcctggccttgtcc

SEQ ID NO: 2702003 - DNA, 13 bp, Homo sapiens
agggcgctcctgt

SEQ ID NO: 2702004 - DNA, 23 bp, Homo sapiens
agggcgtcgctggacaacccaga

SEQ ID NO: 2702005 - DNA, 16 bp, Homo sapiens
agggctccctcctgga

SEQ ID NO: 2702006 - DNA, 20 bp, Homo sapiens
agggctccctcctggagcat

SEQ ID NO: 2702007 - DNA, 22 bp, Homo sapiens
agggctccctcctggagcatcc

SEQ ID NO: 2702008 - DNA, 21 bp, Homo sapiens
aggggaaaccagtgtagcctt

SEQ ID NO: 2702009 - DNA, 17 bp, Homo sapiens
aggggaaacctgtgaaa

SEQ ID NO: 2702010 - DNA, 20 bp, Homo sapiens
aggggacctggagctgccag

SEQ ID NO: 2702011 - DNA, 21 bp, Homo sapiens
aggggacctggagctgccagc

SEQ ID NO: 2702012 - DNA, 14 bp, Homo sapiens
aggggagggaaaag

SEQ ID NO: 2702013 - DNA, 17 bp, Homo sapiens
aggggcaggcacagcac

SEQ ID NO: 2702014 - DNA, 19 bp, Homo sapiens
aggggcaggccctgcactg

SEQ ID NO: 2702015 - DNA, 20 bp, Homo sapiens
aggggcccgttgtctccctg

SEQ ID NO: 2702016 - DNA, 23 bp, Homo sapiens
aggggcgtgtgttccccagctga

SEQ ID NO: 2702017 - DNA, 23 bp, Homo sapiens
aggggctcctggaaaggctcagt

SEQ ID NO: 2702018 - DNA, 19 bp, Homo sapiens
aggggctgcccgctcccag

SEQ ID NO: 2702019 - DNA, 16 bp, Homo sapiens
aggggctgctgggggc

SEQ ID NO: 2702020 - DNA, 17 bp, Homo sapiens
aggggctgctgggggct

SEQ ID NO: 2702021 - DNA, 20 bp, Homo sapiens
aggggctgctgggggctccc

SEQ ID NO: 2702022 - DNA, 16 bp, Homo sapiens
aggggctttctggaga

SEQ ID NO: 2702023 - DNA, 20 bp, Homo sapiens
aggggctttctggagaggag

SEQ ID NO: 2702024 - DNA, 15 bp, Homo sapiens
agggggcaacaaggt

SEQ ID NO: 2702025 - DNA, 19 bp, Homo sapiens
aggggtaatatattgctgc

SEQ ID NO: 2702026 - DNA, 21 bp, Homo sapiens
aggggtgggttcctcttcccc

SEQ ID NO: 2702027 - DNA, 16 bp, Homo sapiens
agggtatgggaagcca

SEQ ID NO: 2702028 - DNA, 12 bp, Homo sapiens
agggtcatttct

SEQ ID NO: 2702029 - DNA, 13 bp, Homo sapiens
agggttgtgccca

SEQ ID NO: 2702030 - DNA, 14 bp, Homo sapiens
agggttgtgcccac

SEQ ID NO: 2702031 - DNA, 15 bp, Homo sapiens
agggttttccaccct

SEQ ID NO: 2702032 - DNA, 19 bp, Homo sapiens
agggttttccaccctggaa

SEQ ID NO: 2702033 - DNA, 19 bp, Homo sapiens
aggtaagcaggaggaggtg

SEQ ID NO: 2702034 - DNA, 17 bp, Homo sapiens
aggtacggtgagactct

SEQ ID NO: 2702035 - DNA, 19 bp, Homo sapiens
aggtagcgagctgctctgc

SEQ ID NO: 2702036 - DNA, 20 bp, Homo sapiens
aggtagcgagctgctctgct

SEQ ID NO: 2702037 - DNA, 16 bp, Homo sapiens
aggtataaggatcttt

SEQ ID NO: 2702038 - DNA, 22 bp, Homo sapiens
aggtataaggatcttttgtaaa

SEQ ID NO: 2702039 - DNA, 15 bp, Homo sapiens
aggtatctggtatct

SEQ ID NO: 2702040 - DNA, 14 bp, Homo sapiens
aggtcattaaaaca

SEQ ID NO: 2702041 - DNA, 21 bp, Homo sapiens
aggtctcacactcctcctgcc

SEQ ID NO: 2702042 - DNA, 21 bp, Homo sapiens
aggtctcccctgatccagaca

SEQ ID NO: 2702043 - DNA, 18 bp, Homo sapiens
aggtcttcttgtgtcctg

SEQ ID NO: 2702044 - DNA, 14 bp, Homo sapiens
aggtcttttacata

SEQ ID NO: 2702045 - DNA, 21 bp, Homo sapiens
aggtcttttacatacagtgat

SEQ ID NO: 2702046 - DNA, 23 bp, Homo sapiens
aggtgacggactcagactcctgg

SEQ ID NO: 2702047 - DNA, 18 bp, Homo sapiens
aggtgacttgcctggggc

SEQ ID NO: 2702048 - DNA, 15 bp, Homo sapiens
aggtgagcagaggag

SEQ ID NO: 2702049 - DNA, 16 bp, Homo sapiens
aggtgcagtggctcac

SEQ ID NO: 2702050 - DNA, 15 bp, Homo sapiens
aggtggcagccctgt

SEQ ID NO: 2702051 - DNA, 19 bp, Homo sapiens
aggtgggcgggcagcacag

SEQ ID NO: 2702052 - DNA, 22 bp, Homo sapiens
aggtgggcgggcagcacagcaa

SEQ ID NO: 2702053 - DNA, 20 bp, Homo sapiens
aggtggtctgctcgggccca

SEQ ID NO: 2702054 - DNA, 18 bp, Homo sapiens
aggtgtcaccctgcagag

SEQ ID NO: 2702055 - DNA, 21 bp, Homo sapiens
aggtgtcaccctgcagagcta

SEQ ID NO: 2702056 - DNA, 18 bp, Homo sapiens
aggttctgcactcctgga

SEQ ID NO: 2702057 - DNA, 21 bp, Homo sapiens
aggttgcagtgaactgagact

SEQ ID NO: 2702058 - DNA, 20 bp, Homo sapiens
aggttgggccatactggcct

SEQ ID NO: 2702059 - DNA, 22 bp, Homo sapiens
aggtttagaatcaagtctgtga

SEQ ID NO: 2702060 - DNA, 17 bp, Homo sapiens
aggtttcactgttcatg

SEQ ID NO: 2702061 - DNA, 18 bp, Homo sapiens
aggtttcccagtgagcct

SEQ ID NO: 2702062 - DNA, 19 bp, Homo sapiens
aggtttctcaaagaaattt

SEQ ID NO: 2702063 - DNA, 14 bp, Homo sapiens
aggttttattttgt

SEQ ID NO: 2702064 - DNA, 19 bp, Homo sapiens
agtaaataaattgtttgac

SEQ ID NO: 2702065 - DNA, 22 bp, Homo sapiens
agtaacaaaagtatagttttga

SEQ ID NO: 2702066 - DNA, 16 bp, Homo sapiens
agtaactcccactcct

SEQ ID NO: 2702067 - DNA, 19 bp, Homo sapiens
agtaactcccactcctaat

SEQ ID NO: 2702068 - DNA, 18 bp, Homo sapiens
agtaagcagagttctttg

SEQ ID NO: 2702069 - DNA, 17 bp, Homo sapiens
agtaagtaccactcagg

SEQ ID NO: 2702070 - DNA, 16 bp, Homo sapiens
agcagagttctttgca

SEQ ID NO: 2702071 - DNA, 18 bp, Homo sapiens
agcagccagctcctggta

SEQ ID NO: 2702072 - DNA, 17 bp, Homo sapiens
agcagcctccagtgctg

SEQ ID NO: 2702073 - DNA, 18 bp, Homo sapiens
agcagcctccagtgctgg

SEQ ID NO: 2702074 - DNA, 15 bp, Homo sapiens
agcagcttctgccac

SEQ ID NO: 2702075 - DNA, 22 bp, Homo sapiens
agcagcttctgccacttcccag

SEQ ID NO: 2702076 - DNA, 22 bp, Homo sapiens
agcaggcagcgcctgtcccctc

SEQ ID NO: 2702077 - DNA, 13 bp, Homo sapiens
agcaggggctgct

SEQ ID NO: 2702078 - DNA, 14 bp, Homo sapiens
agcaggggctgctg

SEQ ID NO: 2702079 - DNA, 15 bp, Homo sapiens
agcaggtgctgctac

SEQ ID NO: 2702080 - DNA, 22 bp, Homo sapiens
agcaggttgaggggctcctgga

SEQ ID NO: 2702081 - DNA, 11 bp, Homo sapiens
agcatatataa

SEQ ID NO: 2702082 - DNA, 17 bp, Homo sapiens
agcatcaaacatgaaaa

SEQ ID NO: 2702083 - DNA, 20 bp, Homo sapiens
agcatcctccccaccagagc

SEQ ID NO: 2702084 - DNA, 21 bp, Homo sapiens
agcatccttttctgcagaggg

SEQ ID NO: 2702085 - DNA, 15 bp, Homo sapiens
agcatctcagagtcc

SEQ ID NO: 2702086 - DNA, 15 bp, Homo sapiens
agcatgagtggcctt

SEQ ID NO: 2702087 - DNA, 21 bp, Homo sapiens
agcatgggactgtgcctttgg

SEQ ID NO: 2702088 - DNA, 22 bp, Homo sapiens
agcatgtactgtacttcccaat

SEQ ID NO: 2702089 - DNA, 15 bp, Homo sapiens
agcatgtttaaaaca

SEQ ID NO: 2702090 - DNA, 22 bp, Homo sapiens
agcattagctacttttcagaat

SEQ ID NO: 2702091 - DNA, 18 bp, Homo sapiens
agcattctgagctgggct

SEQ ID NO: 2702092 - DNA, 14 bp, Homo sapiens
agcattttcacatt

SEQ ID NO: 2702093 - DNA, 21 bp, Homo sapiens
agcattttcagcatcaaacat

SEQ ID NO: 2702094 - DNA, 14 bp, Homo sapiens
agccaaactctgcc

SEQ ID NO: 2702095 - DNA, 15 bp, Homo sapiens
agccaaactctgcca

SEQ ID NO: 2702096 - DNA, 13 bp, Homo sapiens
agccaacagcagc

SEQ ID NO: 2702097 - DNA, 23 bp, Homo sapiens
agccacatcatctttatctcctg

SEQ ID NO: 2702098 - DNA, 14 bp, Homo sapiens
agccaccgcagctg

SEQ ID NO: 2702099 - DNA, 16 bp, Homo sapiens
agccaccgcagctgct

SEQ ID NO: 2702100 - DNA, 17 bp, Homo sapiens
agccaccgcagctgctg

SEQ ID NO: 2702101 - DNA, 19 bp, Homo sapiens
agccaccgcagctgctgcc

SEQ ID NO: 2702102 - DNA, 21 bp, Homo sapiens
agccaccgcagctgctgccac

SEQ ID NO: 2702103 - DNA, 22 bp, Homo sapiens
agccacgaacacgcatgcctca

SEQ ID NO: 2702104 - DNA, 12 bp, Homo sapiens
agccactgcagc

SEQ ID NO: 2702105 - DNA, 19 bp, Homo sapiens
agccacttatttccatgga

SEQ ID NO: 2702106 - DNA, 17 bp, Homo sapiens
agccagccctggaggct

SEQ ID NO: 2702107 - DNA, 22 bp, Homo sapiens
agccagccctggaggctggatg

SEQ ID NO: 2702108 - DNA, 18 bp, Homo sapiens
agccatattcacacctca

SEQ ID NO: 2702109 - DNA, 20 bp, Homo sapiens
agccatccctttttttacat

SEQ ID NO: 2702110 - DNA, 23 bp, Homo sapiens
agccatgtcatgtgccacgacct

SEQ ID NO: 2702111 - DNA, 20 bp, Homo sapiens
agccattaccatggagacaa

SEQ ID NO: 2702112 - DNA, 22 bp, Homo sapiens
agcccacgcccgactagcaggc

SEQ ID NO: 2702113 - DNA, 14 bp, Homo sapiens
agcccacgtcctgt

SEQ ID NO: 2702114 - DNA, 21 bp, Homo sapiens
agcccacgtcctgtcagtgcc

SEQ ID NO: 2702115 - DNA, 23 bp, Homo sapiens
agcccagccattaccatggagac

SEQ ID NO: 2702116 - DNA, 21 bp, Homo sapiens
agcccattgtggaggcggtgg

SEQ ID NO: 2702117 - DNA, 20 bp, Homo sapiens
agccccacagcccacgtcct

SEQ ID NO: 2702118 - DNA, 14 bp, Homo sapiens
agcccgtgggggca

SEQ ID NO: 2702119 - DNA, 15 bp, Homo sapiens
agccctcggcctcca

SEQ ID NO: 2702120 - DNA, 18 bp, Homo sapiens
agccctcggcctccagac

SEQ ID NO: 2702121 - DNA, 18 bp, Homo sapiens
agccctggaggctggatg

SEQ ID NO: 2702122 - DNA, 13 bp, Homo sapiens
agccctggcagga

SEQ ID NO: 2702123 - DNA, 18 bp, Homo sapiens
agccctggggcccctcga

SEQ ID NO: 2702124 - DNA, 14 bp, Homo sapiens
agccgcagcctccc

SEQ ID NO: 2702125 - DNA, 13 bp, Homo sapiens
agccgcctccctt

SEQ ID NO: 2702126 - DNA, 14 bp, Homo sapiens
agccgcctccctta

SEQ ID NO: 2702127 - DNA, 22 bp, Homo sapiens
agccgctgcccggcgccctctg

SEQ ID NO: 2702128 - DNA, 17 bp, Homo sapiens
agccggcagaaatagct

SEQ ID NO: 2702129 - DNA, 15 bp, Homo sapiens
agccgggaaagctgt

SEQ ID NO: 2702130 - DNA, 15 bp, Homo sapiens
agcctagaccctcct

SEQ ID NO: 2702131 - DNA, 14 bp, Homo sapiens
aggaagggagggag

SEQ ID NO: 2702132 - DNA, 19 bp, Homo sapiens
aggaataaggcccagagcg

SEQ ID NO: 2702133 - DNA, 18 bp, Homo sapiens
aggacaaacagtgaattt

SEQ ID NO: 2702134 - DNA, 15 bp, Homo sapiens
aggacaacctgcccc

SEQ ID NO: 2702135 - DNA, 13 bp, Homo sapiens
aggacaggtcctg

SEQ ID NO: 2702136 - DNA, 18 bp, Homo sapiens
aggacagtgcttcagcct

SEQ ID NO: 2702137 - DNA, 20 bp, Homo sapiens
aggacagtgcttcagcctga

SEQ ID NO: 2702138 - DNA, 21 bp, Homo sapiens
aggacagtgcttcagcctgag

SEQ ID NO: 2702139 - DNA, 20 bp, Homo sapiens
aggacggggccggccaggtg

SEQ ID NO: 2702140 - DNA, 16 bp, Homo sapiens
aggacggttgtaagca

SEQ ID NO: 2702141 - DNA, 21 bp, Homo sapiens
aggactcagggactcaggcca

SEQ ID NO: 2702142 - DNA, 13 bp, Homo sapiens
aggactctgcaga

SEQ ID NO: 2702143 - DNA, 20 bp, Homo sapiens
aggactggggcttgccaggc

SEQ ID NO: 2702144 - DNA, 19 bp, Homo sapiens
aggagagccctctgctgct

SEQ ID NO: 2702145 - DNA, 14 bp, Homo sapiens
aggagatagacggg

SEQ ID NO: 2702146 - DNA, 14 bp, Homo sapiens
aggagattttcctt

SEQ ID NO: 2702147 - DNA, 22 bp, Homo sapiens
aggagcaaccgtgcagccacga

SEQ ID NO: 2702148 - DNA, 20 bp, Homo sapiens
aggagcagcttcagttgttt

SEQ ID NO: 2702149 - DNA, 19 bp, Homo sapiens
aggagctgacagagccaga

SEQ ID NO: 2702150 - DNA, 18 bp, Homo sapiens
aggaggaggtgccaacag

SEQ ID NO: 2702151 - DNA, 16 bp, Homo sapiens
aggaggctccgtgagc

SEQ ID NO: 2702152 - DNA, 18 bp, Homo sapiens
aggaggctccgtgagccc

SEQ ID NO: 2702153 - DNA, 20 bp, Homo sapiens
aggaggctccgtgagccctt

SEQ ID NO: 2702154 - DNA, 19 bp, Homo sapiens
aggaggctgaggcaccaga

SEQ ID NO: 2702155 - DNA, 14 bp, Homo sapiens
aggaggctggctgg

SEQ ID NO: 2702156 - DNA, 20 bp, Homo sapiens
aggaggcttggaaagcatca

SEQ ID NO: 2702157 - DNA, 19 bp, Homo sapiens
aggagggatgctgcctgag

SEQ ID NO: 2702158 - DNA, 15 bp, Homo sapiens
aggaggtccttggag

SEQ ID NO: 2702159 - DNA, 17 bp, Homo sapiens
aggaggtccttggagtg

SEQ ID NO: 2702160 - DNA, 16 bp, Homo sapiens
aggaggtgccaacagt

SEQ ID NO: 2702161 - DNA, 20 bp, Homo sapiens
aggaggtggcagccctgtag

SEQ ID NO: 2702162 - DNA, 23 bp, Homo sapiens
aggaggtggcagccctgtaggga

SEQ ID NO: 2702163 - DNA, 18 bp, Homo sapiens
aggagtcaccatgcaagg

SEQ ID NO: 2702164 - DNA, 14 bp, Homo sapiens
aggagtccagggcg

SEQ ID NO: 2702165 - DNA, 18 bp, Homo sapiens
aggagtgactaggtgggt

SEQ ID NO: 2702166 - DNA, 21 bp, Homo sapiens
aggagtgtcctgtctgctggg

SEQ ID NO: 2702167 - DNA, 19 bp, Homo sapiens
aggagtttgaggctgcagc

SEQ ID NO: 2702168 - DNA, 19 bp, Homo sapiens
aggataaattaatgagttt

SEQ ID NO: 2702169 - DNA, 20 bp, Homo sapiens
aggataaattaatgagtttt

SEQ ID NO: 2702170 - DNA, 15 bp, Homo sapiens
aggatatccccaggg

SEQ ID NO: 2702171 - DNA, 15 bp, Homo sapiens
aggatcactggagcc

SEQ ID NO: 2702172 - DNA, 20 bp, Homo sapiens
aggatcactggagcccagga

SEQ ID NO: 2702173 - DNA, 14 bp, Homo sapiens
aggatcccctgtcc

SEQ ID NO: 2702174 - DNA, 15 bp, Homo sapiens
aggatcttttgtaaa

SEQ ID NO: 2702175 - DNA, 17 bp, Homo sapiens
aggatcttttgtaaatg

SEQ ID NO: 2702176 - DNA, 16 bp, Homo sapiens
aggatgtggatggagg

SEQ ID NO: 2702177 - DNA, 22 bp, Homo sapiens
aggatgtggatggaggtgatga

SEQ ID NO: 2702178 - DNA, 19 bp, Homo sapiens
aggattaggtttagaatca

SEQ ID NO: 2702179 - DNA, 15 bp, Homo sapiens
aggattcctccccca

SEQ ID NO: 2702180 - DNA, 17 bp, Homo sapiens
aggattttaccaaagca

SEQ ID NO: 2702181 - DNA, 20 bp, Homo sapiens
aggcactaagtcatggtcct

SEQ ID NO: 2702182 - DNA, 15 bp, Homo sapiens
aggcagatctttaaa

SEQ ID NO: 2702183 - DNA, 11 bp, Homo sapiens
aggcagcctgc

SEQ ID NO: 2702184 - DNA, 16 bp, Homo sapiens
aggcagcgcctgtccc

SEQ ID NO: 2702185 - DNA, 21 bp, Homo sapiens
aggcagttctgtgtcctcgca

SEQ ID NO: 2702186 - DNA, 14 bp, Homo sapiens
aggccaagagcaga

SEQ ID NO: 2702187 - DNA, 18 bp, Homo sapiens
aggccaagagcagaggca

SEQ ID NO: 2702188 - DNA, 20 bp, Homo sapiens
aggccaagagcagaggcagc

SEQ ID NO: 2702189 - DNA, 23 bp, Homo sapiens
aggccacactggcatctccctga

SEQ ID NO: 2702190 - DNA, 22 bp, Homo sapiens
aggccaccatattcagtgctgt

SEQ ID NO: 2702191 - DNA, 12 bp, Homo sapiens
aggccactcagg

SEQ ID NO: 2702192 - DNA, 14 bp, Homo sapiens
aggccaggtgcagt

SEQ ID NO: 2702193 - DNA, 16 bp, Homo sapiens
aggccagtcaccctgt

SEQ ID NO: 2702194 - DNA, 19 bp, Homo sapiens
aggccatcttccaggtggg

SEQ ID NO: 2702195 - DNA, 16 bp, Homo sapiens
aggcccagagcgagga

SEQ ID NO: 2702196 - DNA, 13 bp, Homo sapiens
aggcccagcagac

SEQ ID NO: 2702197 - DNA, 14 bp, Homo sapiens
aggcccagcctgtc

SEQ ID NO: 2702198 - DNA, 21 bp, Homo sapiens
aggcccagcctgtcctggtac

SEQ ID NO: 2702199 - DNA, 16 bp, Homo sapiens
aggcccggtgaggcca

SEQ ID NO: 2702200 - DNA, 17 bp, Homo sapiens
aggccctaggattcctc

SEQ ID NO: 2702201 - DNA, 22 bp, Homo sapiens
aggccctaggattcctccccca

SEQ ID NO: 2702202 - DNA, 16 bp, Homo sapiens
aggccctgcactgtcc

SEQ ID NO: 2702203 - DNA, 18 bp, Homo sapiens
aggccctgcactgtcctg

SEQ ID NO: 2702204 - DNA, 15 bp, Homo sapiens
agacgggttgaaaga

SEQ ID NO: 2702205 - DNA, 22 bp, Homo sapiens
agacgggttgaaagacatcaat

SEQ ID NO: 2702206 - DNA, 15 bp, Homo sapiens
agacgtcctggaatg

SEQ ID NO: 2702207 - DNA, 19 bp, Homo sapiens
agacgtcctggaatgaagc

SEQ ID NO: 2702208 - DNA, 18 bp, Homo sapiens
agactagattctcacctg

SEQ ID NO: 2702209 - DNA, 17 bp, Homo sapiens
agactatttaagtacta

SEQ ID NO: 2702210 - DNA, 13 bp, Homo sapiens
agactcctggctt

SEQ ID NO: 2702211 - DNA, 22 bp, Homo sapiens
agactctttttgtacctggtga

SEQ ID NO: 2702212 - DNA, 21 bp, Homo sapiens
agactgcaagaggctcctgtc

SEQ ID NO: 2702213 - DNA, 23 bp, Homo sapiens
agactgcgccacggcactccagc

SEQ ID NO: 2702214 - DNA, 14 bp, Homo sapiens
agactgctgggact

SEQ ID NO: 2702215 - DNA, 14 bp, Homo sapiens
agactggctggctg

SEQ ID NO: 2702216 - DNA, 22 bp, Homo sapiens
agactggtttatccacccacaa

SEQ ID NO: 2702217 - DNA, 18 bp, Homo sapiens
agacttagtttttataaa

SEQ ID NO: 2702218 - DNA, 15 bp, Homo sapiens
agacttcactgcagc

SEQ ID NO: 2702219 - DNA, 18 bp, Homo sapiens
agagaaaacttatttgag

SEQ ID NO: 2702220 - DNA, 22 bp, Homo sapiens
agagaaattatgttttcatcca

SEQ ID NO: 2702221 - DNA, 22 bp, Homo sapiens
agagaaggaatcttcagaacaa

SEQ ID NO: 2702222 - DNA, 14 bp, Homo sapiens
agagaatagaacaa

SEQ ID NO: 2702223 - DNA, 17 bp, Homo sapiens
agagaccctacagacag

SEQ ID NO: 2702224 - DNA, 19 bp, Homo sapiens
agagagaaaacttatttga

SEQ ID NO: 2702225 - DNA, 17 bp, Homo sapiens
agagagcagcttctgcc

SEQ ID NO: 2702226 - DNA, 20 bp, Homo sapiens
agagagcatcttttcctccc

SEQ ID NO: 2702227 - DNA, 16 bp, Homo sapiens
agagagctcatcatca

SEQ ID NO: 2702228 - DNA, 21 bp, Homo sapiens
agagagctcatcatcagtctt

SEQ ID NO: 2702229 - DNA, 15 bp, Homo sapiens
agagaggaggagaga

SEQ ID NO: 2702230 - DNA, 17 bp, Homo sapiens
agagaggcacctgctgg

SEQ ID NO: 2702231 - DNA, 19 bp, Homo sapiens
agagaggcacctgctggaa

SEQ ID NO: 2702232 - DNA, 16 bp, Homo sapiens
agagaggtagcgagct

SEQ ID NO: 2702233 - DNA, 20 bp, Homo sapiens
agagagttgacccctcctga

SEQ ID NO: 2702234 - DNA, 21 bp, Homo sapiens
agagagttgacccctcctgaa

SEQ ID NO: 2702235 - DNA, 19 bp, Homo sapiens
agagatctttctttccaaa

SEQ ID NO: 2702236 - DNA, 13 bp, Homo sapiens
agagcacagccct

SEQ ID NO: 2702237 - DNA, 14 bp, Homo sapiens
agagcacagccctc

SEQ ID NO: 2702238 - DNA, 15 bp, Homo sapiens
agagcacagccctcc

SEQ ID NO: 2702239 - DNA, 12 bp, Homo sapiens
agagcagctggc

SEQ ID NO: 2702240 - DNA, 13 bp, Homo sapiens
agagcagcttctg

SEQ ID NO: 2702241 - DNA, 23 bp, Homo sapiens
agagcagcttctgccacttccca

SEQ ID NO: 2702242 - DNA, 16 bp, Homo sapiens
agagcaggggctgctg

SEQ ID NO: 2702243 - DNA, 22 bp, Homo sapiens
agagccctctgctgctttccaa

SEQ ID NO: 2702244 - DNA, 13 bp, Homo sapiens
agagccgggaagc

SEQ ID NO: 2702245 - DNA, 11 bp, Homo sapiens
agagcctcagc

SEQ ID NO: 2702246 - DNA, 20 bp, Homo sapiens
agagccttcacatgaaatta

SEQ ID NO: 2702247 - DNA, 21 bp, Homo sapiens
agagcgaggaaaggattttac

SEQ ID NO: 2702248 - DNA, 16 bp, Homo sapiens
agagctcctgtcccta

SEQ ID NO: 2702249 - DNA, 21 bp, Homo sapiens
agagctcctgtccctacccac

SEQ ID NO: 2702250 - DNA, 22 bp, Homo sapiens
agagctcctgtccctacccact

SEQ ID NO: 2702251 - DNA, 23 bp, Homo sapiens
agagctcctgtccctacccactc

SEQ ID NO: 2702252 - DNA, 21 bp, Homo sapiens
agagctgcctccccaatccat

SEQ ID NO: 2702253 - DNA, 17 bp, Homo sapiens
agagctgcgggctgagg

SEQ ID NO: 2702254 - DNA, 14 bp, Homo sapiens
agagctgctgagca

SEQ ID NO: 2702255 - DNA, 20 bp, Homo sapiens
agagcttcccccaaggctga

SEQ ID NO: 2702256 - DNA, 21 bp, Homo sapiens
agaggaataaggcccagagcg

SEQ ID NO: 2702257 - DNA, 13 bp, Homo sapiens
agaggaggagaaa

SEQ ID NO: 2702258 - DNA, 19 bp, Homo sapiens
agaggagtccagggcggga

SEQ ID NO: 2702259 - DNA, 22 bp, Homo sapiens
agaggccaaattaatcttttaa

SEQ ID NO: 2702260 - DNA, 17 bp, Homo sapiens
agagggcccaggcaggc

SEQ ID NO: 2702261 - DNA, 19 bp, Homo sapiens
agaggtggaggttgcagtg

SEQ ID NO: 2702262 - DNA, 18 bp, Homo sapiens
agaggtggtggggaccag

SEQ ID NO: 2702263 - DNA, 13 bp, Homo sapiens
agaggttctgcac

SEQ ID NO: 2702264 - DNA, 18 bp, Homo sapiens
agagtcagccttccccct

SEQ ID NO: 2702265 - DNA, 14 bp, Homo sapiens
agagtctctccagc

SEQ ID NO: 2702266 - DNA, 17 bp, Homo sapiens
agagtctctccagcctc

SEQ ID NO: 2702267 - DNA, 15 bp, Homo sapiens
agagtgagaccctgt

SEQ ID NO: 2702268 - DNA, 14 bp, Homo sapiens
agagttatatgtgt

SEQ ID NO: 2702269 - DNA, 13 bp, Homo sapiens
agagttctttgca

SEQ ID NO: 2702270 - DNA, 19 bp, Homo sapiens
agagttggtgttcataatt

SEQ ID NO: 2702271 - DNA, 17 bp, Homo sapiens
agatactgaagtgcagc

SEQ ID NO: 2702272 - DNA, 15 bp, Homo sapiens
actcttccaccagag

SEQ ID NO: 2702273 - DNA, 18 bp, Homo sapiens
actcttccaccagagcag

SEQ ID NO: 2702274 - DNA, 20 bp, Homo sapiens
actcttgtattgctccattt

SEQ ID NO: 2702275 - DNA, 15 bp, Homo sapiens
actctttgctacaat

SEQ ID NO: 2702276 - DNA, 16 bp, Homo sapiens
actctttttgtacctg

SEQ ID NO: 2702277 - DNA, 20 bp, Homo sapiens
actctttttgtacctggtga

SEQ ID NO: 2702278 - DNA, 22 bp, Homo sapiens
actgaaacctcttcggttgtct

SEQ ID NO: 2702279 - DNA, 15 bp, Homo sapiens
actgaaggcttctgc

SEQ ID NO: 2702280 - DNA, 17 bp, Homo sapiens
actgaagtgcagctcag

SEQ ID NO: 2702281 - DNA, 16 bp, Homo sapiens
actgaatacttgaagt

SEQ ID NO: 2702282 - DNA, 23 bp, Homo sapiens
actgaccgccgcttccagcttcc

SEQ ID NO: 2702283 - DNA, 21 bp, Homo sapiens
actgagtctggcaaacatgtg

SEQ ID NO: 2702284 - DNA, 17 bp, Homo sapiens
actgcaagaggctcctg

SEQ ID NO: 2702285 - DNA, 17 bp, Homo sapiens
actgcaccccctcctgc

SEQ ID NO: 2702286 - DNA, 21 bp, Homo sapiens
actgcaccccctcctgctgca

SEQ ID NO: 2702287 - DNA, 22 bp, Homo sapiens
actgcaccccctcctgctgcag

SEQ ID NO: 2702288 - DNA, 16 bp, Homo sapiens
actgccaaaacaatgc

SEQ ID NO: 2702289 - DNA, 23 bp, Homo sapiens
actgcccagggaagccctcggcc

SEQ ID NO: 2702290 - DNA, 14 bp, Homo sapiens
actgccgcctcctt

SEQ ID NO: 2702291 - DNA, 20 bp, Homo sapiens
actgcgccacggcactccag

SEQ ID NO: 2702292 - DNA, 19 bp, Homo sapiens
actgcggagcagcctccag

SEQ ID NO: 2702293 - DNA, 15 bp, Homo sapiens
actgcggtgtctgca

SEQ ID NO: 2702294 - DNA, 17 bp, Homo sapiens
actgctggggctggtga

SEQ ID NO: 2702295 - DNA, 16 bp, Homo sapiens
actgctgggtggccca

SEQ ID NO: 2702296 - DNA, 17 bp, Homo sapiens
actgctgggtggcccat

SEQ ID NO: 2702297 - DNA, 23 bp, Homo sapiens
actggagagtggcaaaagtctga

SEQ ID NO: 2702298 - DNA, 14 bp, Homo sapiens
actggagcccagga

SEQ ID NO: 2702299 - DNA, 16 bp, Homo sapiens
actggagcccaggagt

SEQ ID NO: 2702300 - DNA, 16 bp, Homo sapiens
actggcatctccctga

SEQ ID NO: 2702301 - DNA, 17 bp, Homo sapiens
actggcatctccctgac

SEQ ID NO: 2702302 - DNA, 18 bp, Homo sapiens
actggccagtcctagagc

SEQ ID NO: 2702303 - DNA, 22 bp, Homo sapiens
actggccagtcctagagctcct

SEQ ID NO: 2702304 - DNA, 18 bp, Homo sapiens
actggccgtggctccaga

SEQ ID NO: 2702305 - DNA, 17 bp, Homo sapiens
actggcctcgcctggcc

SEQ ID NO: 2702306 - DNA, 12 bp, Homo sapiens
actggctgcctc

SEQ ID NO: 2702307 - DNA, 14 bp, Homo sapiens
actggctgcctcca

SEQ ID NO: 2702308 - DNA, 16 bp, Homo sapiens
actggctgcctccact

SEQ ID NO: 2702309 - DNA, 14 bp, Homo sapiens
actgggccatgggt

SEQ ID NO: 2702310 - DNA, 22 bp, Homo sapiens
actgggccatgggtcctcggcc

SEQ ID NO: 2702311 - DNA, 13 bp, Homo sapiens
actgggcccctca

SEQ ID NO: 2702312 - DNA, 15 bp, Homo sapiens
actgggcccctcagg

SEQ ID NO: 2702313 - DNA, 16 bp, Homo sapiens
actgggcccctcaggg

SEQ ID NO: 2702314 - DNA, 14 bp, Homo sapiens
actgggctctgagg

SEQ ID NO: 2702315 - DNA, 16 bp, Homo sapiens
actgggctctgaggag

SEQ ID NO: 2702316 - DNA, 15 bp, Homo sapiens
actggggcttgccag

SEQ ID NO: 2702317 - DNA, 13 bp, Homo sapiens
actgggtgagaga

SEQ ID NO: 2702318 - DNA, 16 bp, Homo sapiens
gcctcccaaagtgctg

SEQ ID NO: 2702319 - DNA, 13 bp, Homo sapiens
gcctcccacagtg

SEQ ID NO: 2702320 - DNA, 14 bp, Homo sapiens
gcctcccacagtga

SEQ ID NO: 2702321 - DNA, 22 bp, Homo sapiens
gcctcccctgaggatcccctgt

SEQ ID NO: 2702322 - DNA, 12 bp, Homo sapiens
gcctccctctga

SEQ ID NO: 2702323 - DNA, 21 bp, Homo sapiens
gcctccctctgacctgcaggc

SEQ ID NO: 2702324 - DNA, 23 bp, Homo sapiens
gcctcccttgagtaggccctgct

SEQ ID NO: 2702325 - DNA, 19 bp, Homo sapiens
gcctccttcttaactctgc

SEQ ID NO: 2702326 - DNA, 15 bp, Homo sapiens
gcctcgcccaccgca

SEQ ID NO: 2702327 - DNA, 13 bp, Homo sapiens
gcctcgcctggcc

SEQ ID NO: 2702328 - DNA, 15 bp, Homo sapiens
gcctcgcctggcctg

SEQ ID NO: 2702329 - DNA, 17 bp, Homo sapiens
gcctcggaggctcctcc

SEQ ID NO: 2702330 - DNA, 20 bp, Homo sapiens
gcctcggaggctcctccctc

SEQ ID NO: 2702331 - DNA, 23 bp, Homo sapiens
gcctcggaggctcctccctctgc

SEQ ID NO: 2702332 - DNA, 14 bp, Homo sapiens
gcctcggcctccca

SEQ ID NO: 2702333 - DNA, 14 bp, Homo sapiens
gcctcggctcctgc

SEQ ID NO: 2702334 - DNA, 17 bp, Homo sapiens
gcctcggctcctgctgc

SEQ ID NO: 2702335 - DNA, 16 bp, Homo sapiens
gcctctaactccctcc

SEQ ID NO: 2702336 - DNA, 22 bp, Homo sapiens
gcctctgcccagcctgccccag

SEQ ID NO: 2702337 - DNA, 13 bp, Homo sapiens
gcctctgcccgca

SEQ ID NO: 2702338 - DNA, 16 bp, Homo sapiens
gcctctgcccgcagag

SEQ ID NO: 2702339 - DNA, 19 bp, Homo sapiens
gcctctgtgtcactggctg

SEQ ID NO: 2702340 - DNA, 22 bp, Homo sapiens
gcctctgtgtcactggctgcct

SEQ ID NO: 2702341 - DNA, 14 bp, Homo sapiens
gcctcttggcacct

SEQ ID NO: 2702342 - DNA, 15 bp, Homo sapiens
gcctcttggcacctg

SEQ ID NO: 2702343 - DNA, 18 bp, Homo sapiens
gcctcttggcacctgcct

SEQ ID NO: 2702344 - DNA, 18 bp, Homo sapiens
gcctgacctccagtcctg

SEQ ID NO: 2702345 - DNA, 21 bp, Homo sapiens
gcctgagattctttaaggaga

SEQ ID NO: 2702346 - DNA, 13 bp, Homo sapiens
gcctgcctgggcc

SEQ ID NO: 2702347 - DNA, 23 bp, Homo sapiens
gcctgctcttacttcccccaccc

SEQ ID NO: 2702348 - DNA, 12 bp, Homo sapiens
gcctgctgtgga

SEQ ID NO: 2702349 - DNA, 14 bp, Homo sapiens
gcctgctgtggagc

SEQ ID NO: 2702350 - DNA, 16 bp, Homo sapiens
gcctggcacagtgtct

SEQ ID NO: 2702351 - DNA, 21 bp, Homo sapiens
gcctggcacagtgtctgggct

SEQ ID NO: 2702352 - DNA, 23 bp, Homo sapiens
gcctggcacagtgtctgggctga

SEQ ID NO: 2702353 - DNA, 13 bp, Homo sapiens
gcctggcccagct

SEQ ID NO: 2702354 - DNA, 16 bp, Homo sapiens
gcctggcccagctccc

SEQ ID NO: 2702355 - DNA, 23 bp, Homo sapiens
gcctggccttgtccccagctcca

SEQ ID NO: 2702356 - DNA, 18 bp, Homo sapiens
gcctggcttctggagccc

SEQ ID NO: 2702357 - DNA, 12 bp, Homo sapiens
gcctgggcaaga

SEQ ID NO: 2702358 - DNA, 20 bp, Homo sapiens
gcctgggcgacagagcgaga

SEQ ID NO: 2702359 - DNA, 19 bp, Homo sapiens
gcctgggtgacccccactg

SEQ ID NO: 2702360 - DNA, 14 bp, Homo sapiens
gcctgtaatcccag

SEQ ID NO: 2702361 - DNA, 19 bp, Homo sapiens
gcctgtacagaagaaactg

SEQ ID NO: 2702362 - DNA, 13 bp, Homo sapiens
gcctgtcccctca

SEQ ID NO: 2702363 - DNA, 14 bp, Homo sapiens
gcctgtcccctcac

SEQ ID NO: 2702364 - DNA, 17 bp, Homo sapiens
gcctgtcccctcacaga

SEQ ID NO: 2702365 - DNA, 18 bp, Homo sapiens
gcctgtcccctcacagac

SEQ ID NO: 2702366 - DNA, 19 bp, Homo sapiens
gcctgtcccctcacagact

SEQ ID NO: 2702367 - DNA, 20 bp, Homo sapiens
gcctgtcctggtacagcagg

SEQ ID NO: 2702368 - DNA, 21 bp, Homo sapiens
gcctgtcctggtacagcaggg

SEQ ID NO: 2702369 - DNA, 19 bp, Homo sapiens
ggaaagcaccgcagcatgt

SEQ ID NO: 2702370 - DNA, 19 bp, Homo sapiens
ggaaagcatcacctcaggc

SEQ ID NO: 2702371 - DNA, 19 bp, Homo sapiens
ggaaaggattttaccaaag

SEQ ID NO: 2702372 - DNA, 12 bp, Homo sapiens
ggaaaggctcag

SEQ ID NO: 2702373 - DNA, 19 bp, Homo sapiens
ggaaaggctcagtctcagg

SEQ ID NO: 2702374 - DNA, 23 bp, Homo sapiens
ggaaaggctcagtctcaggagca

SEQ ID NO: 2702375 - DNA, 14 bp, Homo sapiens
ggaaatcagagctg

SEQ ID NO: 2702376 - DNA, 16 bp, Homo sapiens
ggaacaatcacaaaag

SEQ ID NO: 2702377 - DNA, 20 bp, Homo sapiens
ggaaccggagggtgacccat

SEQ ID NO: 2702378 - DNA, 14 bp, Homo sapiens
ggaactccccaggg

SEQ ID NO: 2702379 - DNA, 14 bp, Homo sapiens
ggaagagaggcacc

SEQ ID NO: 2702380 - DNA, 18 bp, Homo sapiens
ggaagagaggcacctgct

SEQ ID NO: 2702381 - DNA, 14 bp, Homo sapiens
ggaagagcacagcc

SEQ ID NO: 2702382 - DNA, 17 bp, Homo sapiens
ggaagagcacagccctc

SEQ ID NO: 2702383 - DNA, 18 bp, Homo sapiens
ggaagcaagacgtcctgg

SEQ ID NO: 2702384 - DNA, 11 bp, Homo sapiens
ggaagcaggga

SEQ ID NO: 2702385 - DNA, 16 bp, Homo sapiens
ggaagcatcctcccca

SEQ ID NO: 2702386 - DNA, 17 bp, Homo sapiens
ggaagcatcctccccac

SEQ ID NO: 2702387 - DNA, 18 bp, Homo sapiens
ggaagcatcctccccacc

SEQ ID NO: 2702388 - DNA, 19 bp, Homo sapiens
ggaagcatcctccccacca

SEQ ID NO: 2702389 - DNA, 20 bp, Homo sapiens
ggaagccatcccttttttta

SEQ ID NO: 2702390 - DNA, 22 bp, Homo sapiens
ggaagcggaggttgcagggagc

SEQ ID NO: 2702391 - DNA, 16 bp, Homo sapiens
ggaagctgctagggga

SEQ ID NO: 2702392 - DNA, 19 bp, Homo sapiens
ggaaggaagcaagccggca

SEQ ID NO: 2702393 - DNA, 14 bp, Homo sapiens
ggaaggctggctgg

SEQ ID NO: 2702394 - DNA, 14 bp, Homo sapiens
ggaagggagggagc

SEQ ID NO: 2702395 - DNA, 18 bp, Homo sapiens
ggaataaggcccagagcg

SEQ ID NO: 2702396 - DNA, 19 bp, Homo sapiens
ggaatggaaggctttgcca

SEQ ID NO: 2702397 - DNA, 11 bp, Homo sapiens
ggaattttctt

SEQ ID NO: 2702398 - DNA, 23 bp, Homo sapiens
ggaattttctttcatacattata

SEQ ID NO: 2702399 - DNA, 19 bp, Homo sapiens
ggaattttgtaaaaagaaa

SEQ ID NO: 2702400 - DNA, 20 bp, Homo sapiens
ggaattttgtaaaaagaaat

SEQ ID NO: 2702401 - DNA, 12 bp, Homo sapiens
ggacaacccaga

SEQ ID NO: 2702402 - DNA, 13 bp, Homo sapiens
ggacaacccagaa

SEQ ID NO: 2702403 - DNA, 19 bp, Homo sapiens
ggacaacctgcccctcccc

SEQ ID NO: 2702404 - DNA, 19 bp, Homo sapiens
ggacagtacctgattgtat

SEQ ID NO: 2702405 - DNA, 16 bp, Homo sapiens
ggacagtcctgggaga

SEQ ID NO: 2702406 - DNA, 19 bp, Homo sapiens
ggacagtcctgggagaacc

SEQ ID NO: 2702407 - DNA, 14 bp, Homo sapiens
ggacagtgcttcag

SEQ ID NO: 2702408 - DNA, 17 bp, Homo sapiens
ggacagtgcttcagcct

SEQ ID NO: 2702409 - DNA, 18 bp, Homo sapiens
ggacagtgcttcagcctg

SEQ ID NO: 2702410 - DNA, 13 bp, Homo sapiens
ggaccactgggcc

SEQ ID NO: 2702411 - DNA, 18 bp, Homo sapiens
ggaccactgggcccctca

SEQ ID NO: 2702412 - DNA, 19 bp, Homo sapiens
ggaccactgggcccctcag

SEQ ID NO: 2702413 - DNA, 21 bp, Homo sapiens
ggaccactgggtgagagagga

SEQ ID NO: 2702414 - DNA, 13 bp, Homo sapiens
ggaccctggccta

SEQ ID NO: 2702415 - DNA, 15 bp, Homo sapiens
ggacctctcttgtga

SEQ ID NO: 2702416 - DNA, 20 bp, Homo sapiens
ggacctggactagggcctcg

SEQ ID NO: 2702417 - DNA, 17 bp, Homo sapiens
ggacctggagctgccag

SEQ ID NO: 2702418 - DNA, 12 bp, Homo sapiens
ggactagggcct

SEQ ID NO: 2702419 - DNA, 16 bp, Homo sapiens
ggactcagactcctgg

SEQ ID NO: 2702420 - DNA, 22 bp, Homo sapiens
ggactcagactcctggcttcat

SEQ ID NO: 2702421 - DNA, 23 bp, Homo sapiens
ggactcagactcctggcttcatg

SEQ ID NO: 2702422 - DNA, 14 bp, Homo sapiens
ggactcaggccagt

SEQ ID NO: 2702423 - DNA, 14 bp, Homo sapiens
ggactccttagact

SEQ ID NO: 2702424 - DNA, 13 bp, Homo sapiens
ggactgctgaccc

SEQ ID NO: 2702425 - DNA, 15 bp, Homo sapiens
ggactgctgacccac

SEQ ID NO: 2702426 - DNA, 17 bp, Homo sapiens
ggactggccgtggctcc

SEQ ID NO: 2702427 - DNA, 19 bp, Homo sapiens
ggactgggccatgggtcct

SEQ ID NO: 2702428 - DNA, 17 bp, Homo sapiens
ggactggggcttgccag

SEQ ID NO: 2702429 - DNA, 18 bp, Homo sapiens
ggacttcacttaaaaaaa

SEQ ID NO: 2702430 - DNA, 15 bp, Homo sapiens
ggagaaaagcacaat

SEQ ID NO: 2702431 - DNA, 18 bp, Homo sapiens
ggagaaaagcacaatcaa

SEQ ID NO: 2702432 - DNA, 15 bp, Homo sapiens
ggagaacctcaggct

SEQ ID NO: 2702433 - DNA, 13 bp, Homo sapiens
ggagaaggcctcc

SEQ ID NO: 2702434 - DNA, 16 bp, Homo sapiens
ggagaaggcctcccct

SEQ ID NO: 2702435 - DNA, 19 bp, Homo sapiens
ggagaagttggtcttactt

SEQ ID NO: 2702436 - DNA, 17 bp, Homo sapiens
ggagaattaaactccta

SEQ ID NO: 2702437 - DNA, 20 bp, Homo sapiens
ggagactctgtggggccttg

SEQ ID NO: 2702438 - DNA, 10 bp, Homo sapiens
ggagagcagc

SEQ ID NO: 2702439 - DNA, 15 bp, Homo sapiens
ggagagcagctggct

SEQ ID NO: 2702440 - DNA, 11 bp, Homo sapiens
ggagagcccag

SEQ ID NO: 2702441 - DNA, 21 bp, Homo sapiens
ggagataaaagaaccccagac

SEQ ID NO: 2702442 - DNA, 21 bp, Homo sapiens
ggagatagacgggttgaaaga

SEQ ID NO: 2702443 - DNA, 15 bp, Homo sapiens
ggagattgctctggg

SEQ ID NO: 2702444 - DNA, 18 bp, Homo sapiens
ggagcagcctccagtgct

SEQ ID NO: 2702445 - DNA, 23 bp, Homo sapiens
ggagcagcctccagtgctggctg

SEQ ID NO: 2702446 - DNA, 13 bp, Homo sapiens
ggagcatcccagg

SEQ ID NO: 2702447 - DNA, 13 bp, Homo sapiens
ggagctgaggcct

SEQ ID NO: 2702448 - DNA, 12 bp, Homo sapiens
ggaggacagagc

SEQ ID NO: 2702449 - DNA, 17 bp, Homo sapiens
ggaggaggtgccaacag

SEQ ID NO: 2702450 - DNA, 20 bp, Homo sapiens
ggaggaggtggcagccctgt

SEQ ID NO: 2702451 - DNA, 20 bp, Homo sapiens
ggaggctccgtgagcccttg

SEQ ID NO: 2702452 - DNA, 22 bp, Homo sapiens
ggaggctcctccctctgcctca

SEQ ID NO: 2702453 - DNA, 13 bp, Homo sapiens
ggagggaaaagct

SEQ ID NO: 2702454 - DNA, 21 bp, Homo sapiens
ggagggagctgaggcctccct

SEQ ID NO: 2702455 - DNA, 20 bp, Homo sapiens
gcaggagtcaccatgcaagg

SEQ ID NO: 2702456 - DNA, 23 bp, Homo sapiens
gcaggagtcaccatgcaagggtg

SEQ ID NO: 2702457 - DNA, 12 bp, Homo sapiens
gcaggcacagca

SEQ ID NO: 2702458 - DNA, 22 bp, Homo sapiens
gcaggcagatttactgtcccag

SEQ ID NO: 2702459 - DNA, 14 bp, Homo sapiens
gcaggcagcgcctg

SEQ ID NO: 2702460 - DNA, 22 bp, Homo sapiens
gcaggccaagagcagaggcagc

SEQ ID NO: 2702461 - DNA, 23 bp, Homo sapiens
gcaggccctgcactgtcctgctc

SEQ ID NO: 2702462 - DNA, 19 bp, Homo sapiens
gcaggctgcaaccctggtg

SEQ ID NO: 2702463 - DNA, 16 bp, Homo sapiens
gcaggcttttgtgttc

SEQ ID NO: 2702464 - DNA, 19 bp, Homo sapiens
gcagggagcaactctccac

SEQ ID NO: 2702465 - DNA, 23 bp, Homo sapiens
gcaggggacctggagctgccagc

SEQ ID NO: 2702466 - DNA, 16 bp, Homo sapiens
gcaggggactgggcca

SEQ ID NO: 2702467 - DNA, 13 bp, Homo sapiens
gcaggggctgctg

SEQ ID NO: 2702468 - DNA, 18 bp, Homo sapiens
gcaggggctgctgggggc

SEQ ID NO: 2702469 - DNA, 21 bp, Homo sapiens
gcaggggctgctgggggctcc

SEQ ID NO: 2702470 - DNA, 21 bp, Homo sapiens
gcaggtgctgctaccctccct

SEQ ID NO: 2702471 - DNA, 19 bp, Homo sapiens
gcaggttgaggggctcctg

SEQ ID NO: 2702472 - DNA, 14 bp, Homo sapiens
gcagtgaactgaga

SEQ ID NO: 2702473 - DNA, 18 bp, Homo sapiens
gcagtgacgtgcacctgt

SEQ ID NO: 2702474 - DNA, 15 bp, Homo sapiens
gcagtgccctctgga

SEQ ID NO: 2702475 - DNA, 14 bp, Homo sapiens
gcagttgacttttt

SEQ ID NO: 2702476 - DNA, 15 bp, Homo sapiens
gcagttttccaggaa

SEQ ID NO: 2702477 - DNA, 21 bp, Homo sapiens
gcataatgaaccgtttacagt

SEQ ID NO: 2702478 - DNA, 22 bp, Homo sapiens
gcataatgaaccgtttacagtg

SEQ ID NO: 2702479 - DNA, 19 bp, Homo sapiens
gcatatctctagtccctgt

SEQ ID NO: 2702480 - DNA, 12 bp, Homo sapiens
gcatcaaacatg

SEQ ID NO: 2702481 - DNA, 22 bp, Homo sapiens
gcatcaaacatgaaaacattga

SEQ ID NO: 2702482 - DNA, 15 bp, Homo sapiens
gcatcacagggcaga

SEQ ID NO: 2702483 - DNA, 13 bp, Homo sapiens
gcatcatttaaac

SEQ ID NO: 2702484 - DNA, 12 bp, Homo sapiens
gcatcctcccca

SEQ ID NO: 2702485 - DNA, 16 bp, Homo sapiens
gcatcctccccaccag

SEQ ID NO: 2702486 - DNA, 20 bp, Homo sapiens
gcatcctccccaccagagct

SEQ ID NO: 2702487 - DNA, 13 bp, Homo sapiens
gcatcctggctgg

SEQ ID NO: 2702488 - DNA, 13 bp, Homo sapiens
gcatccttctgcc

SEQ ID NO: 2702489 - DNA, 20 bp, Homo sapiens
gcatccttttctgcagaggg

SEQ ID NO: 2702490 - DNA, 17 bp, Homo sapiens
gcatctccctgaccttc

SEQ ID NO: 2702491 - DNA, 12 bp, Homo sapiens
gcatctctgagt

SEQ ID NO: 2702492 - DNA, 21 bp, Homo sapiens
gcatgatgggccgagccacct

SEQ ID NO: 2702493 - DNA, 12 bp, Homo sapiens
gcatgccccctc

SEQ ID NO: 2702494 - DNA, 19 bp, Homo sapiens
gcatgccccctcgtgccag

SEQ ID NO: 2702495 - DNA, 15 bp, Homo sapiens
gcatgctggggcaag

SEQ ID NO: 2702496 - DNA, 12 bp, Homo sapiens
gcatggcagctg

SEQ ID NO: 2702497 - DNA, 18 bp, Homo sapiens
gcatggcagctgggccca

SEQ ID NO: 2702498 - DNA, 20 bp, Homo sapiens
gcatggcagctgggcccaca

SEQ ID NO: 2702499 - DNA, 22 bp, Homo sapiens
gcatggggataaaggagaaggc

SEQ ID NO: 2702500 - DNA, 19 bp, Homo sapiens
gcatgtaaaatcttcagct

SEQ ID NO: 2702501 - DNA, 19 bp, Homo sapiens
gcattaaattttaaggtag

SEQ ID NO: 2702502 - DNA, 11 bp, Homo sapiens
gcattcatgtt

SEQ ID NO: 2702503 - DNA, 23 bp, Homo sapiens
gcattcatgttttaaaagtttgt

SEQ ID NO: 2702504 - DNA, 16 bp, Homo sapiens
gcattctagtgcagaa

SEQ ID NO: 2702505 - DNA, 21 bp, Homo sapiens
gcattggcagcaggtgctgct

SEQ ID NO: 2702506 - DNA, 21 bp, Homo sapiens
gcatttggtgagagtcaaagc

SEQ ID NO: 2702507 - DNA, 12 bp, Homo sapiens
gcattttgaatg

SEQ ID NO: 2702508 - DNA, 18 bp, Homo sapiens
gccaaactctgccagcca

SEQ ID NO: 2702509 - DNA, 12 bp, Homo sapiens
gccaacagcagc

SEQ ID NO: 2702510 - DNA, 20 bp, Homo sapiens
gccaacagtgttaggcctgg

SEQ ID NO: 2702511 - DNA, 14 bp, Homo sapiens
gccaacgacaaagc

SEQ ID NO: 2702512 - DNA, 16 bp, Homo sapiens
gccaagagcagaggca

SEQ ID NO: 2702513 - DNA, 14 bp, Homo sapiens
gccaagccctccgc

SEQ ID NO: 2702514 - DNA, 23 bp, Homo sapiens
gccaaggtgggctgagccctggc

SEQ ID NO: 2702515 - DNA, 15 bp, Homo sapiens
gccaagttcctctag

SEQ ID NO: 2702516 - DNA, 11 bp, Homo sapiens
gaggacagagc

SEQ ID NO: 2702517 - DNA, 18 bp, Homo sapiens
gaggacatgatggagcgc

SEQ ID NO: 2702518 - DNA, 16 bp, Homo sapiens
gaggagattgctctgg

SEQ ID NO: 2702519 - DNA, 17 bp, Homo sapiens
gaggagattgctctggg

SEQ ID NO: 2702520 - DNA, 12 bp, Homo sapiens
gaggaggagaaa

SEQ ID NO: 2702521 - DNA, 15 bp, Homo sapiens
gaggaggtggcagcc

SEQ ID NO: 2702522 - DNA, 22 bp, Homo sapiens
gaggaggtggcagccctgtagg

SEQ ID NO: 2702523 - DNA, 19 bp, Homo sapiens
gaggagtccagggcgggag

SEQ ID NO: 2702524 - DNA, 17 bp, Homo sapiens
gaggagtgtcctgtctg

SEQ ID NO: 2702525 - DNA, 17 bp, Homo sapiens
gaggatcactggagccc

SEQ ID NO: 2702526 - DNA, 20 bp, Homo sapiens
gaggatcactggagcccagg

SEQ ID NO: 2702527 - DNA, 18 bp, Homo sapiens
gaggatcccctgtcccct

SEQ ID NO: 2702528 - DNA, 17 bp, Homo sapiens
gaggcaaaggccagcag

SEQ ID NO: 2702529 - DNA, 22 bp, Homo sapiens
gaggcaggatatccccagggaa

SEQ ID NO: 2702530 - DNA, 23 bp, Homo sapiens
gaggcaggatatccccagggaaa

SEQ ID NO: 2702531 - DNA, 14 bp, Homo sapiens
gaggcccagcctgt

SEQ ID NO: 2702532 - DNA, 15 bp, Homo sapiens
gaggcccagcctgtc

SEQ ID NO: 2702533 - DNA, 16 bp, Homo sapiens
gaggcccagcctgtcc

SEQ ID NO: 2702534 - DNA, 18 bp, Homo sapiens
gaggcccagcctgtcctg

SEQ ID NO: 2702535 - DNA, 21 bp, Homo sapiens
gaggctagtctcttctcagag

SEQ ID NO: 2702536 - DNA, 23 bp, Homo sapiens
gaggctagtctcttctcagagca

SEQ ID NO: 2702537 - DNA, 17 bp, Homo sapiens
gaggctccgtgagccct

SEQ ID NO: 2702538 - DNA, 13 bp, Homo sapiens
gaggctcctccct

SEQ ID NO: 2702539 - DNA, 15 bp, Homo sapiens
gaggctcctccctct

SEQ ID NO: 2702540 - DNA, 18 bp, Homo sapiens
gaggctcctccctctgcc

SEQ ID NO: 2702541 - DNA, 22 bp, Homo sapiens
gaggctcctccctctgcctcat

SEQ ID NO: 2702542 - DNA, 16 bp, Homo sapiens
gaggctctttctgggc

SEQ ID NO: 2702543 - DNA, 15 bp, Homo sapiens
gaggctgcgtcctga

SEQ ID NO: 2702544 - DNA, 13 bp, Homo sapiens
gaggctggctggg

SEQ ID NO: 2702545 - DNA, 16 bp, Homo sapiens
gaggctggctggggcc

SEQ ID NO: 2702546 - DNA, 18 bp, Homo sapiens
gagggaaaagctaagagg

SEQ ID NO: 2702547 - DNA, 16 bp, Homo sapiens
gagggagctgaggcct

SEQ ID NO: 2702548 - DNA, 18 bp, Homo sapiens
gagggagctgaggcctcc

SEQ ID NO: 2702549 - DNA, 19 bp, Homo sapiens
gagggagctgaggcctccc

SEQ ID NO: 2702550 - DNA, 16 bp, Homo sapiens
gagggatctaggtctt

SEQ ID NO: 2702551 - DNA, 17 bp, Homo sapiens
gagggatgatgccacac

SEQ ID NO: 2702552 - DNA, 15 bp, Homo sapiens
gagggatgctgcctg

SEQ ID NO: 2702553 - DNA, 13 bp, Homo sapiens
gagggctgcctga

SEQ ID NO: 2702554 - DNA, 17 bp, Homo sapiens
gaggggcaggccctgca

SEQ ID NO: 2702555 - DNA, 16 bp, Homo sapiens
gagggtaataaactta

SEQ ID NO: 2702556 - DNA, 23 bp, Homo sapiens
gagggtgacccatttcaggaggt

SEQ ID NO: 2702557 - DNA, 19 bp, Homo sapiens
gagggtgggagagcccagc

SEQ ID NO: 2702558 - DNA, 18 bp, Homo sapiens
gaggtcccctcacgtgac

SEQ ID NO: 2702559 - DNA, 23 bp, Homo sapiens
gaggtccttggagtgctgcagct

SEQ ID NO: 2702560 - DNA, 22 bp, Homo sapiens
gaggtctcgctgatgctgggct

SEQ ID NO: 2702561 - DNA, 17 bp, Homo sapiens
gaggtgacttgcctggg

SEQ ID NO: 2702562 - DNA, 15 bp, Homo sapiens
gaggtggcagccctg

SEQ ID NO: 2702563 - DNA, 18 bp, Homo sapiens
gaggtggcagccctgtag

SEQ ID NO: 2702564 - DNA, 15 bp, Homo sapiens
gaggtggtggggacc

SEQ ID NO: 2702565 - DNA, 16 bp, Homo sapiens
gaggtggtggggacca

SEQ ID NO: 2702566 - DNA, 15 bp, Homo sapiens
gaggtgtcaccctgc

SEQ ID NO: 2702567 - DNA, 21 bp, Homo sapiens
ctttgagtaccaaatccacaa

SEQ ID NO: 2702568 - DNA, 16 bp, Homo sapiens
ctttgatctctgctta

SEQ ID NO: 2702569 - DNA, 13 bp, Homo sapiens
ctttgcaagctta

SEQ ID NO: 2702570 - DNA, 18 bp, Homo sapiens
ctttgcaccaaagacatc

SEQ ID NO: 2702571 - DNA, 21 bp, Homo sapiens
ctttgcatggaatttgtaagt

SEQ ID NO: 2702572 - DNA, 22 bp, Homo sapiens
ctttgcccacacacactccttc

SEQ ID NO: 2702573 - DNA, 20 bp, Homo sapiens
ctttgcgcaaactttaacag

SEQ ID NO: 2702574 - DNA, 14 bp, Homo sapiens
ctttgctgctgtgg

SEQ ID NO: 2702575 - DNA, 16 bp, Homo sapiens
ctttgctgctgtggaa

SEQ ID NO: 2702576 - DNA, 17 bp, Homo sapiens
ctttgcttgattaaaca

SEQ ID NO: 2702577 - DNA, 20 bp, Homo sapiens
ctttggctgcacgtcaccct

SEQ ID NO: 2702578 - DNA, 17 bp, Homo sapiens
ctttgggaggctgaggc

SEQ ID NO: 2702579 - DNA, 18 bp, Homo sapiens
ctttgggaggctgaggcg

SEQ ID NO: 2702580 - DNA, 16 bp, Homo sapiens
ctttgggatcagcctc

SEQ ID NO: 2702581 - DNA, 17 bp, Homo sapiens
ctttgggatcagcctcc

SEQ ID NO: 2702582 - DNA, 12 bp, Homo sapiens
ctttgtgcaaaa

SEQ ID NO: 2702583 - DNA, 15 bp, Homo sapiens
ctttgttcttgtcat

SEQ ID NO: 2702584 - DNA, 20 bp, Homo sapiens
cttttagttttaaaactctt

SEQ ID NO: 2702585 - DNA, 19 bp, Homo sapiens
cttttatattcaaattcat

SEQ ID NO: 2702586 - DNA, 16 bp, Homo sapiens
cttttcagcttctgct

SEQ ID NO: 2702587 - DNA, 17 bp, Homo sapiens
cttttcagcttctgctg

SEQ ID NO: 2702588 - DNA, 11 bp, Homo sapiens
cttttccagaa

SEQ ID NO: 2702589 - DNA, 15 bp, Homo sapiens
cttttcctgtctgta

SEQ ID NO: 2702590 - DNA, 23 bp, Homo sapiens
cttttctcttgccccaaatcaca

SEQ ID NO: 2702591 - DNA, 14 bp, Homo sapiens
cttttgctgtgctg

SEQ ID NO: 2702592 - DNA, 11 bp, Homo sapiens
cttttgtaaat

SEQ ID NO: 2702593 - DNA, 21 bp, Homo sapiens
cttttgtaaatgagacacata

SEQ ID NO: 2702594 - DNA, 21 bp, Homo sapiens
ctttttgaatgtcataaagaa

SEQ ID NO: 2702595 - DNA, 22 bp, Homo sapiens
ctttttgcaggggactgggcca

SEQ ID NO: 2702596 - DNA, 14 bp, Homo sapiens
ctttttgtacctgg

SEQ ID NO: 2702597 - DNA, 16 bp, Homo sapiens
ctttttgtacctggtg

SEQ ID NO: 2702598 - DNA, 17 bp, Homo sapiens
ctttttgttttgttctt

SEQ ID NO: 2702599 - DNA, 17 bp, Homo sapiens
ctttttttttttctgcc

SEQ ID NO: 2702600 - DNA, 21 bp, Homo sapiens
gaaaaaaaaagtcagactgct

SEQ ID NO: 2702601 - DNA, 14 bp, Homo sapiens
gaaaaaaagcaaaa

SEQ ID NO: 2702602 - DNA, 12 bp, Homo sapiens
ctgtcccctggg

SEQ ID NO: 2702603 - DNA, 15 bp, Homo sapiens
ctgtcccctggggct

SEQ ID NO: 2702604 - DNA, 18 bp, Homo sapiens
ctgtcccctggggctggt

SEQ ID NO: 2702605 - DNA, 16 bp, Homo sapiens
ctgtcccggttcacct

SEQ ID NO: 2702606 - DNA, 19 bp, Homo sapiens
ctgtcccggttcaccttgc

SEQ ID NO: 2702607 - DNA, 13 bp, Homo sapiens
ctgtccctaccca

SEQ ID NO: 2702608 - DNA, 17 bp, Homo sapiens
ctgtccctacccactct

SEQ ID NO: 2702609 - DNA, 14 bp, Homo sapiens
ctgtccgcctctgc

SEQ ID NO: 2702610 - DNA, 18 bp, Homo sapiens
ctgtccgcctctgcccgc

SEQ ID NO: 2702611 - DNA, 21 bp, Homo sapiens
ctgtccgcctctgcccgcaga

SEQ ID NO: 2702612 - DNA, 17 bp, Homo sapiens
ctgtccggagcgaccct

SEQ ID NO: 2702613 - DNA, 21 bp, Homo sapiens
ctgtccggagcgaccctggct

SEQ ID NO: 2702614 - DNA, 16 bp, Homo sapiens
ctgtcctgctccacag

SEQ ID NO: 2702615 - DNA, 20 bp, Homo sapiens
ctgtcctggtacagcagggt

SEQ ID NO: 2702616 - DNA, 18 bp, Homo sapiens
ctgtccttactcagagct

SEQ ID NO: 2702617 - DNA, 20 bp, Homo sapiens
ctgtcggtgtgctgtcagcc

SEQ ID NO: 2702618 - DNA, 14 bp, Homo sapiens
ctgtcgtgtccagc

SEQ ID NO: 2702619 - DNA, 13 bp, Homo sapiens
ctgtctctgcttg

SEQ ID NO: 2702620 - DNA, 17 bp, Homo sapiens
ctgtctctgcttggctt

SEQ ID NO: 2702621 - DNA, 20 bp, Homo sapiens
ctgtctgctcttatttttgt

SEQ ID NO: 2702622 - DNA, 22 bp, Homo sapiens
ctgtctgctcttatttttgtac

SEQ ID NO: 2702623 - DNA, 13 bp, Homo sapiens
ctgtgaaagctgc

SEQ ID NO: 2702624 - DNA, 18 bp, Homo sapiens
ctgtgaaagtctcctgta

SEQ ID NO: 2702625 - DNA, 22 bp, Homo sapiens
ctgtgaaagtctcctgtatcat

SEQ ID NO: 2702626 - DNA, 22 bp, Homo sapiens
ctgtgacctgccccgcccagct

SEQ ID NO: 2702627 - DNA, 15 bp, Homo sapiens
ctgccactctgctgc

SEQ ID NO: 2702628 - DNA, 16 bp, Homo sapiens
ctgccactctgctgcc

SEQ ID NO: 2702629 - DNA, 16 bp, Homo sapiens
ctgccacttcccaggt

SEQ ID NO: 2702630 - DNA, 17 bp, Homo sapiens
ctgccagcaccaagcgt

SEQ ID NO: 2702631 - DNA, 20 bp, Homo sapiens
ctgccagcctggcttctgga

SEQ ID NO: 2702632 - DNA, 22 bp, Homo sapiens
ctgccagcctggcttctggagc

SEQ ID NO: 2702633 - DNA, 21 bp, Homo sapiens
ctgccagctctgtcaccctgg

SEQ ID NO: 2702634 - DNA, 14 bp, Homo sapiens
ctgccatggcgtgt

SEQ ID NO: 2702635 - DNA, 21 bp, Homo sapiens
ctgccatggcgtgtccctctc

SEQ ID NO: 2702636 - DNA, 22 bp, Homo sapiens
ctgccatggcgtgtccctctcg

SEQ ID NO: 2702637 - DNA, 19 bp, Homo sapiens
ctgccatttgcaccctccg

SEQ ID NO: 2702638 - DNA, 19 bp, Homo sapiens
ctgcccaactttcattggt

SEQ ID NO: 2702639 - DNA, 15 bp, Homo sapiens
ctgcccagcctgccc

SEQ ID NO: 2702640 - DNA, 19 bp, Homo sapiens
ctgcccagcctgccccagc

SEQ ID NO: 2702641 - DNA, 15 bp, Homo sapiens
ctgcccagggaagcc

SEQ ID NO: 2702642 - DNA, 19 bp, Homo sapiens
ctgcccagggaagccctcg

SEQ ID NO: 2702643 - DNA, 22 bp, Homo sapiens
ctgcccagggtcagtgtatcta

SEQ ID NO: 2702644 - DNA, 18 bp, Homo sapiens
ctgccccagcctcccagc

SEQ ID NO: 2702645 - DNA, 15 bp, Homo sapiens
ctgccccagctctgg

SEQ ID NO: 2702646 - DNA, 13 bp, Homo sapiens
ctgccccctggtg

SEQ ID NO: 2702647 - DNA, 15 bp, Homo sapiens
ctgccccgcccagct

SEQ ID NO: 2702648 - DNA, 16 bp, Homo sapiens
ctgccccgcccagctg

SEQ ID NO: 2702649 - DNA, 14 bp, Homo sapiens
ctgcccctccccct

SEQ ID NO: 2702650 - DNA, 19 bp, Homo sapiens
ctgcccctccctagatcca

SEQ ID NO: 2702651 - DNA, 20 bp, Homo sapiens
ctgcccctccctagatccag

SEQ ID NO: 2702652 - DNA, 18 bp, Homo sapiens
ctgcccgcctcggcctcc

SEQ ID NO: 2702653 - DNA, 17 bp, Homo sapiens
ctgcccgctcccagtgt

SEQ ID NO: 2702654 - DNA, 15 bp, Homo sapiens
ctgcccggcgccctc

SEQ ID NO: 2702655 - DNA, 13 bp, Homo sapiens
ctgccgcctcctt

SEQ ID NO: 2702656 - DNA, 20 bp, Homo sapiens
ctgccgggtggggggagggc

SEQ ID NO: 2702657 - DNA, 22 bp, Homo sapiens
ctgccgggtggggggagggcac

SEQ ID NO: 2702658 - DNA, 23 bp, Homo sapiens
ctgccgggtggggggagggcacc

SEQ ID NO: 2702659 - DNA, 16 bp, Homo sapiens
ctgccgtccctcctgt

SEQ ID NO: 2702660 - DNA, 17 bp, Homo sapiens
ctgccgtccctcctgtt

SEQ ID NO: 2702661 - DNA, 20 bp, Homo sapiens
ctgcctagctcttgggcctg

SEQ ID NO: 2702662 - DNA, 15 bp, Homo sapiens
ctgcctcagcttccc

SEQ ID NO: 2702663 - DNA, 15 bp, Homo sapiens
ctgcctccactccca

SEQ ID NO: 2702664 - DNA, 14 bp, Homo sapiens
ctgcctctaactcc

SEQ ID NO: 2702665 - DNA, 19 bp, Homo sapiens
ctgcctctaactccctcct

SEQ ID NO: 2702666 - DNA, 17 bp, Homo sapiens
ctgcctgagattcttta

SEQ ID NO: 2702667 - DNA, 15 bp, Homo sapiens
ctgcctgctgggctc

SEQ ID NO: 2702668 - DNA, 12 bp, Homo sapiens
ctgcctgctgtg

SEQ ID NO: 2702669 - DNA, 14 bp, Homo sapiens
ctgcctgctgtgga

SEQ ID NO: 2702670 - DNA, 11 bp, Homo sapiens
ctgcctgcttc

SEQ ID NO: 2702671 - DNA, 14 bp, Homo sapiens
ctgcctgcttcctg

SEQ ID NO: 2702672 - DNA, 17 bp, Homo sapiens
ctgcctgcttcctggac

SEQ ID NO: 2702673 - DNA, 18 bp, Homo sapiens
ctgcctgcttcctggacc

SEQ ID NO: 2702674 - DNA, 15 bp, Homo sapiens
ctgcctggagcaggg

SEQ ID NO: 2702675 - DNA, 17 bp, Homo sapiens
ctgcctggagcaggggt

SEQ ID NO: 2702676 - DNA, 14 bp, Homo sapiens
ctgcctgggcctcc

SEQ ID NO: 2702677 - DNA, 15 bp, Homo sapiens
ctgcctgggcctccc

SEQ ID NO: 2702678 - DNA, 17 bp, Homo sapiens
ctgcctgggcctcccaa

SEQ ID NO: 2702679 - DNA, 21 bp, Homo sapiens
ctgcctgggcctcccaaagtg

SEQ ID NO: 2702680 - DNA, 22 bp, Homo sapiens
ctgcgggatggtcctggggctc

SEQ ID NO: 2702681 - DNA, 20 bp, Homo sapiens
ctgcgggctgagggcatctc

SEQ ID NO: 2702682 - DNA, 15 bp, Homo sapiens
ctgcggggcttggct

SEQ ID NO: 2702683 - DNA, 18 bp, Homo sapiens
ctgcgtaggagagaacag

SEQ ID NO: 2702684 - DNA, 23 bp, Homo sapiens
ctgcgtcctgaggagtgtcctgt

SEQ ID NO: 2702685 - DNA, 20 bp, Homo sapiens
ctgctaatcctgaggctggt

SEQ ID NO: 2702686 - DNA, 13 bp, Homo sapiens
ctgctaccctccc

SEQ ID NO: 2702687 - DNA, 16 bp, Homo sapiens
ctgctaccctccctgc

SEQ ID NO: 2702688 - DNA, 19 bp, Homo sapiens
ctgctatattttcatgact

SEQ ID NO: 2702689 - DNA, 13 bp, Homo sapiens
ctgctcagtgatc

SEQ ID NO: 2702690 - DNA, 16 bp, Homo sapiens
ctgctccacagtgttg

SEQ ID NO: 2702691 - DNA, 18 bp, Homo sapiens
ctgctcccaattcacctc

SEQ ID NO: 2702692 - DNA, 15 bp, Homo sapiens
ctgctcgggcccagg

SEQ ID NO: 2702693 - DNA, 17 bp, Homo sapiens
ctgctcgggcccaggcc

SEQ ID NO: 2702694 - DNA, 19 bp, Homo sapiens
ctgctcgggcccaggccat

SEQ ID NO: 2702695 - DNA, 18 bp, Homo sapiens
ctgctcttacttccccca

SEQ ID NO: 2702696 - DNA, 22 bp, Homo sapiens
ctgctcttacttcccccaccct

SEQ ID NO: 2702697 - DNA, 15 bp, Homo sapiens
ctgctgccactctgc

SEQ ID NO: 2702698 - DNA, 17 bp, Homo sapiens
ctgctgccactctgctg

SEQ ID NO: 2702699 - DNA, 22 bp, Homo sapiens
ctgctgccatggcgtgtccctc

SEQ ID NO: 2702700 - DNA, 20 bp, Homo sapiens
ctgctgcccaggctagagtg

SEQ ID NO: 2702701 - DNA, 14 bp, Homo sapiens
ctgctgcctgtaca

SEQ ID NO: 2702702 - DNA, 14 bp, Homo sapiens
ctgctggaaaccac

SEQ ID NO: 2702703 - DNA, 22 bp, Homo sapiens
ctgctggaagaactgcatgggg

SEQ ID NO: 2702704 - DNA, 20 bp, Homo sapiens
ctgctggcccacagctctgc

SEQ ID NO: 2702705 - DNA, 23 bp, Homo sapiens
ctgctgggctacaaaccaggagc

SEQ ID NO: 2702706 - DNA, 24 bp, Homo sapiens
ctgctgggctacaaaccaggagca

SEQ ID NO: 2702707 - DNA, 21 bp, Homo sapiens
ctgctgggctggggcctgatg

SEQ ID NO: 2702708 - DNA, 15 bp, Homo sapiens
ctgctggggctggtg

SEQ ID NO: 2702709 - DNA, 16 bp, Homo sapiens
ctgctgggggctcccc

SEQ ID NO: 2702710 - DNA, 18 bp, Homo sapiens
ctgctgggggctcccctt

SEQ ID NO: 2702711 - DNA, 23 bp, Homo sapiens
ctgctgggggctccccttgccct

SEQ ID NO: 2702712 - DNA, 11 bp, Homo sapiens
ctgctgggtgg

SEQ ID NO: 2702713 - DNA, 12 bp, Homo sapiens
ctgctgggtggc

SEQ ID NO: 2702714 - DNA, 13 bp, Homo sapiens
ctgctgtcccctc

SEQ ID NO: 2702715 - DNA, 14 bp, Homo sapiens
ctgctgtcccctct

SEQ ID NO: 2702716 - DNA, 19 bp, Homo sapiens
ctgctgtcccctcttgccc

SEQ ID NO: 2702717 - DNA, 21 bp, Homo sapiens
ctgctgtcccctcttgcccca

SEQ ID NO: 2702718 - DNA, 22 bp, Homo sapiens
ctgctgtcccctcttgccccaa

SEQ ID NO: 2702719 - DNA, 23 bp, Homo sapiens
ctgctgtcccctcttgccccaac

SEQ ID NO: 2702720 - DNA, 14 bp, Homo sapiens
ctgctgtggagccc

SEQ ID NO: 2702721 - DNA, 23 bp, Homo sapiens
ctgctgtggcatcaggaaaggaa

SEQ ID NO: 2702722 - DNA, 12 bp, Homo sapiens
ctgcttccctgg

SEQ ID NO: 2702723 - DNA, 14 bp, Homo sapiens
ctgcttccctgggg

SEQ ID NO: 2702724 - DNA, 12 bp, Homo sapiens
ctgcttcctgga

SEQ ID NO: 2702725 - DNA, 17 bp, Homo sapiens
ctgctttatcaggggac

SEQ ID NO: 2702726 - DNA, 17 bp, Homo sapiens
ctgcttttcctgtctgt

SEQ ID NO: 2702727 - DNA, 20 bp, Homo sapiens
ctggaaaattcctattgatt

SEQ ID NO: 2702728 - DNA, 17 bp, Homo sapiens
ctggaaaggctcagtct

SEQ ID NO: 2702729 - DNA, 20 bp, Homo sapiens
ctggaaaggctcagtctcag

SEQ ID NO: 2702730 - DNA, 19 bp, Homo sapiens
ctggaaggagccagccagg

SEQ ID NO: 2702731 - DNA, 22 bp, Homo sapiens
ctggaaggtactgaaggcttct

SEQ ID NO: 2702732 - DNA, 21 bp, Homo sapiens
ctggaatacgatcctgcaggg

SEQ ID NO: 2702733 - DNA, 16 bp, Homo sapiens
ctggaatctactagaa

SEQ ID NO: 2702734 - DNA, 14 bp, Homo sapiens
ctggaatgaagcat

SEQ ID NO: 2702735 - DNA, 20 bp, Homo sapiens
ctggaatgaagcatgtagct

SEQ ID NO: 2702736 - DNA, 15 bp, Homo sapiens
ctggacaacccagaa

SEQ ID NO: 2702737 - DNA, 14 bp, Homo sapiens
ctggacatattccc

SEQ ID NO: 2702738 - DNA, 18 bp, Homo sapiens
ctggaccggggccttggt

SEQ ID NO: 2702739 - DNA, 22 bp, Homo sapiens
ctggacgcccagctgaggctgg

SEQ ID NO: 2702740 - DNA, 20 bp, Homo sapiens
ctggacggcattcctgctta

SEQ ID NO: 2702741 - DNA, 19 bp, Homo sapiens
ctggactagggcctcggag

SEQ ID NO: 2702742 - DNA, 16 bp, Homo sapiens
ctggagactatttaag

SEQ ID NO: 2702743 - DNA, 16 bp, Homo sapiens
ctggagagtggcaaaa

SEQ ID NO: 2702744 - DNA, 14 bp, Homo sapiens
ctggaggctgcgtc

SEQ ID NO: 2702745 - DNA, 17 bp, Homo sapiens
ctggaggctgcgtcctg

SEQ ID NO: 2702746 - DNA, 20 bp, Homo sapiens
ctggaggctgcgtcctgagg

SEQ ID NO: 2702747 - DNA, 16 bp, Homo sapiens
ctggaggctggatggc

SEQ ID NO: 2702748 - DNA, 14 bp, Homo sapiens
ctggattcctgtca

SEQ ID NO: 2702749 - DNA, 23 bp, Homo sapiens
ctggatttttacaaataaagatg

SEQ ID NO: 2702750 - DNA, 18 bp, Homo sapiens
ctggcaaacatgtgcaac

SEQ ID NO: 2702751 - DNA, 19 bp, Homo sapiens
ctggcaaagttatatttac

SEQ ID NO: 2702752 - DNA, 21 bp, Homo sapiens
ctggcaatgccctacctgcct

SEQ ID NO: 2702753 - DNA, 14 bp, Homo sapiens
ctggcagcctccag

SEQ ID NO: 2702754 - DNA, 15 bp, Homo sapiens
ctggcagcctccagt

SEQ ID NO: 2702755 - DNA, 18 bp, Homo sapiens
ctggcagcctccagtggg

SEQ ID NO: 2702756 - DNA, 19 bp, Homo sapiens
ctggcatcctggctggctg

SEQ ID NO: 2702757 - DNA, 23 bp, Homo sapiens
ctggcatcctggctggctgtgtc

SEQ ID NO: 2702758 - DNA, 15 bp, Homo sapiens
ctggcatctccctga

SEQ ID NO: 2702759 - DNA, 16 bp, Homo sapiens
ctggcatctccctgac

SEQ ID NO: 2702760 - DNA, 17 bp, Homo sapiens
ctggcatgacactctag

SEQ ID NO: 2702761 - DNA, 13 bp, Homo sapiens
ctggccacactgg

SEQ ID NO: 2702762 - DNA, 14 bp, Homo sapiens
ctggccacactggg

SEQ ID NO: 2702763 - DNA, 18 bp, Homo sapiens
ctggccaccacccaacct

SEQ ID NO: 2702764 - DNA, 19 bp, Homo sapiens
ctggccaccacccaacctg

SEQ ID NO: 2702765 - DNA, 22 bp, Homo sapiens
ctggccaccacccaacctgtcc

SEQ ID NO: 2702766 - DNA, 19 bp, Homo sapiens
ctggccagccccacagccc

SEQ ID NO: 2702767 - DNA, 22 bp, Homo sapiens
ctcttgccccaacccccagcac

SEQ ID NO: 2702768 - DNA, 15 bp, Homo sapiens
ctcttggcacctgcc

SEQ ID NO: 2702769 - DNA, 17 bp, Homo sapiens
ctcttggcacctgccta

SEQ ID NO: 2702770 - DNA, 20 bp, Homo sapiens
ctcttggcacctgcctagct

SEQ ID NO: 2702771 - DNA, 15 bp, Homo sapiens
ctcttggccagagct

SEQ ID NO: 2702772 - DNA, 18 bp, Homo sapiens
ctcttggccagagctgag

SEQ ID NO: 2702773 - DNA, 16 bp, Homo sapiens
ctcttgggcctgacct

SEQ ID NO: 2702774 - DNA, 18 bp, Homo sapiens
ctcttgggcctgacctcc

SEQ ID NO: 2702775 - DNA, 15 bp, Homo sapiens
cctgtctgctgggct

SEQ ID NO: 2702776 - DNA, 15 bp, Homo sapiens
cctgtctgtccaacc

SEQ ID NO: 2702777 - DNA, 20 bp, Homo sapiens
cctgtctgtccaacccctcc

SEQ ID NO: 2702778 - DNA, 16 bp, Homo sapiens
cctgtcttctctccca

SEQ ID NO: 2702779 - DNA, 14 bp, Homo sapiens
cctgtgaaagctgc

SEQ ID NO: 2702780 - DNA, 20 bp, Homo sapiens
cctgtgctatgctggacatt

SEQ ID NO: 2702781 - DNA, 17 bp, Homo sapiens
cctgtggggcctgatgg

SEQ ID NO: 2702782 - DNA, 20 bp, Homo sapiens
cctgtgggggaagagcacag

SEQ ID NO: 2702783 - DNA, 23 bp, Homo sapiens
cctgtgggggaagagcacagccc

SEQ ID NO: 2702784 - DNA, 11 bp, Homo sapiens
cctgtgtctta

SEQ ID NO: 2702785 - DNA, 23 bp, Homo sapiens
cctgttattttttatttccacat

SEQ ID NO: 2702786 - DNA, 19 bp, Homo sapiens
cctgttctaactcttagaa

SEQ ID NO: 2702787 - DNA, 13 bp, Homo sapiens
cctgttctccaga

SEQ ID NO: 2702788 - DNA, 18 bp, Homo sapiens
cctgtttttaacatgtga

SEQ ID NO: 2702789 - DNA, 14 bp, Homo sapiens
ccttaactcagcca

SEQ ID NO: 2702790 - DNA, 19 bp, Homo sapiens
ccttaaggccacactggca

SEQ ID NO: 2702791 - DNA, 12 bp, Homo sapiens
ccttaagtttcc

SEQ ID NO: 2702792 - DNA, 23 bp, Homo sapiens
ccttaataaatatagttgtcttt

SEQ ID NO: 2702793 - DNA, 21 bp, Homo sapiens
ctcagctgtggtcccacccag

SEQ ID NO: 2702794 - DNA, 14 bp, Homo sapiens
ctcaggaggctgag

SEQ ID NO: 2702795 - DNA, 15 bp, Homo sapiens
ctcagggaccacagc

SEQ ID NO: 2702796 - DNA, 21 bp, Homo sapiens
ctcaggtagggagctaaggaa

SEQ ID NO: 2702797 - DNA, 15 bp, Homo sapiens
ctcaggtcctgctgc

SEQ ID NO: 2702798 - DNA, 15 bp, Homo sapiens
ctcaggtctgttttc

SEQ ID NO: 2702799 - DNA, 14 bp, Homo sapiens
ctcagtctcaggag

SEQ ID NO: 2702800 - DNA, 21 bp, Homo sapiens
ctcatacagaaagtgacaagg

SEQ ID NO: 2702801 - DNA, 16 bp, Homo sapiens
ctcatcatcagtctta

SEQ ID NO: 2702802 - DNA, 15 bp, Homo sapiens
ctcatcccaaaagct

SEQ ID NO: 2702803 - DNA, 17 bp, Homo sapiens
ctcatcctcctcctcat

SEQ ID NO: 2702804 - DNA, 13 bp, Homo sapiens
ctcatctgtgcct

SEQ ID NO: 2702805 - DNA, 14 bp, Homo sapiens
ctcatctgtgcctg

SEQ ID NO: 2702806 - DNA, 23 bp, Homo sapiens
ctcattccccggggcgtttcttt

SEQ ID NO: 2702807 - DNA, 14 bp, Homo sapiens
ctccaaacactggg

SEQ ID NO: 2702808 - DNA, 16 bp, Homo sapiens
ctccaaacactgggct

SEQ ID NO: 2702809 - DNA, 14 bp, Homo sapiens
ctccaagaggctgg

SEQ ID NO: 2702810 - DNA, 16 bp, Homo sapiens
ctccaagaggctggaa

SEQ ID NO: 2702811 - DNA, 22 bp, Homo sapiens
ctccaagtccacagtggaacca

SEQ ID NO: 2702812 - DNA, 15 bp, Homo sapiens
ctccacagccgcagc

SEQ ID NO: 2702813 - DNA, 19 bp, Homo sapiens
ctccaccctaaagtctcag

SEQ ID NO: 2702814 - DNA, 15 bp, Homo sapiens
ctccacctagtggct

SEQ ID NO: 2702815 - DNA, 21 bp, Homo sapiens
ctccacctagtggctgtccag

SEQ ID NO: 2702816 - DNA, 22 bp, Homo sapiens
ctccacctagtggctgtccagt

SEQ ID NO: 2702817 - DNA, 20 bp, Homo sapiens
ctccaccttgttacacatta

SEQ ID NO: 2702818 - DNA, 13 bp, Homo sapiens
ctccactcccact

SEQ ID NO: 2702819 - DNA, 15 bp, Homo sapiens
ctccagaatgtgctg

SEQ ID NO: 2702820 - DNA, 16 bp, Homo sapiens
ctccagaatgtgctgc

SEQ ID NO: 2702821 - DNA, 18 bp, Homo sapiens
ctccagaatgtgctgcct

SEQ ID NO: 2702822 - DNA, 18 bp, Homo sapiens
ctccagaattacccttcc

SEQ ID NO: 2702823 - DNA, 23 bp, Homo sapiens
ctccagaattacccttcctcatc

SEQ ID NO: 2702824 - DNA, 14 bp, Homo sapiens
ctccagactgcgga

SEQ ID NO: 2702825 - DNA, 21 bp, Homo sapiens
ctccagactgcggagcagcct

SEQ ID NO: 2702826 - DNA, 18 bp, Homo sapiens
ctccagatggagaaacag

SEQ ID NO: 2702827 - DNA, 18 bp, Homo sapiens
ctccagccacttatttcc

SEQ ID NO: 2702828 - DNA, 18 bp, Homo sapiens
ctccagcctgggcgacag

SEQ ID NO: 2702829 - DNA, 18 bp, Homo sapiens
ctccagggacagaagcag

SEQ ID NO: 2702830 - DNA, 16 bp, Homo sapiens
ctccagtcctgctggc

SEQ ID NO: 2702831 - DNA, 19 bp, Homo sapiens
ctccagtcctgctggcctg

SEQ ID NO: 2702832 - DNA, 14 bp, Homo sapiens
ctccagtgctggct

SEQ ID NO: 2702833 - DNA, 16 bp, Homo sapiens
ctccatcggggaatga

SEQ ID NO: 2702834 - DNA, 14 bp, Homo sapiens
ctccattttcttgt

SEQ ID NO: 2702835 - DNA, 15 bp, Homo sapiens
ctccattttcttgtc

SEQ ID NO: 2702836 - DNA, 13 bp, Homo sapiens
ctccatttttgtt

SEQ ID NO: 2702837 - DNA, 16 bp, Homo sapiens
ctcccaaagtgctggg

SEQ ID NO: 2702838 - DNA, 11 bp, Homo sapiens
ctcccacagtg

SEQ ID NO: 2702839 - DNA, 22 bp, Homo sapiens
ctcccacagtgactcgggctcc

SEQ ID NO: 2702840 - DNA, 22 bp, Homo sapiens
ctcccaccaggcagctccagct

SEQ ID NO: 2702841 - DNA, 14 bp, Homo sapiens
ctcccaccaggcta

SEQ ID NO: 2702842 - DNA, 20 bp, Homo sapiens
ctcccacggggaccactggg

SEQ ID NO: 2702843 - DNA, 22 bp, Homo sapiens
ctcccacggggaccactgggcc

SEQ ID NO: 2702844 - DNA, 23 bp, Homo sapiens
ctcccacggggaccactgggccc

SEQ ID NO: 2702845 - DNA, 11 bp, Homo sapiens
ctcccactcct

SEQ ID NO: 2702846 - DNA, 12 bp, Homo sapiens
ctcccactccta

SEQ ID NO: 2702847 - DNA, 13 bp, Homo sapiens
ctcccactcctaa

SEQ ID NO: 2702848 - DNA, 18 bp, Homo sapiens
ctcccagctgacagtcct

SEQ ID NO: 2702849 - DNA, 20 bp, Homo sapiens
ctcccagctgacagtcctct

SEQ ID NO: 2702850 - DNA, 19 bp, Homo sapiens
ctcccagggccagggccct

SEQ ID NO: 2702851 - DNA, 23 bp, Homo sapiens
ctcccagggccagggccctgcag

SEQ ID NO: 2702852 - DNA, 20 bp, Homo sapiens
ctcccagtgagaagggcctg

SEQ ID NO: 2702853 - DNA, 19 bp, Homo sapiens
ctcccagtgtcttcctgtg

SEQ ID NO: 2702854 - DNA, 17 bp, Homo sapiens
ctcccatggccttccct

SEQ ID NO: 2702855 - DNA, 14 bp, Homo sapiens
ctccccaccagagc

SEQ ID NO: 2702856 - DNA, 17 bp, Homo sapiens
ctccccaccagagctgc

SEQ ID NO: 2702857 - DNA, 19 bp, Homo sapiens
ctccccaccagagctgcct

SEQ ID NO: 2702858 - DNA, 21 bp, Homo sapiens
ctcccccacgtctctctgcct

SEQ ID NO: 2702859 - DNA, 22 bp, Homo sapiens
ctcccccacgtctctctgcctg

SEQ ID NO: 2702860 - DNA, 13 bp, Homo sapiens
ctcccccccgggg

SEQ ID NO: 2702861 - DNA, 14 bp, Homo sapiens
ctcccccccggggc

SEQ ID NO: 2702862 - DNA, 18 bp, Homo sapiens
ctcccccccggggctggg

SEQ ID NO: 2702863 - DNA, 21 bp, Homo sapiens
ctcccccccggggctgggttg

SEQ ID NO: 2702864 - DNA, 13 bp, Homo sapiens
ctcccccgggagg

SEQ ID NO: 2702865 - DNA, 23 bp, Homo sapiens
ctccccctaccgcatggcagctg

SEQ ID NO: 2702866 - DNA, 20 bp, Homo sapiens
ctcccctgaggatcccctgt

SEQ ID NO: 2702867 - DNA, 18 bp, Homo sapiens
ctcccctgccgcctcccg

SEQ ID NO: 2702868 - DNA, 20 bp, Homo sapiens
ctcccctgccgcctcccggg

SEQ ID NO: 2702869 - DNA, 18 bp, Homo sapiens
ctccccttgcccttcctg

SEQ ID NO: 2702870 - DNA, 21 bp, Homo sapiens
ctcccgccccttccccgaggg

SEQ ID NO: 2702871 - DNA, 23 bp, Homo sapiens
ctcccggacctggactagggcct

SEQ ID NO: 2702872 - DNA, 22 bp, Homo sapiens
ctcccggaggtgtcaccttcct

SEQ ID NO: 2702873 - DNA, 18 bp, Homo sapiens
ctcccgggaagcatcctc

SEQ ID NO: 2702874 - DNA, 22 bp, Homo sapiens
ctccctagatccaggcttctcc

SEQ ID NO: 2702875 - DNA, 12 bp, Homo sapiens
ctccctcccaca

SEQ ID NO: 2702876 - DNA, 13 bp, Homo sapiens
ctccctcctcaca

SEQ ID NO: 2702877 - DNA, 16 bp, Homo sapiens
ctccctcctcacactc

SEQ ID NO: 2702878 - DNA, 19 bp, Homo sapiens
ctccctcctcacactccag

SEQ ID NO: 2702879 - DNA, 14 bp, Homo sapiens
ctccctctgcctca

SEQ ID NO: 2702880 - DNA, 21 bp, Homo sapiens
ctccctctgcctcatcctcct

SEQ ID NO: 2702881 - DNA, 11 bp, Homo sapiens
ctccctgctgt

SEQ ID NO: 2702882 - DNA, 16 bp, Homo sapiens
ctccctgctgtcccct

SEQ ID NO: 2702883 - DNA, 18 bp, Homo sapiens
ctccctgctgtcccctct

SEQ ID NO: 2702884 - DNA, 21 bp, Homo sapiens
ctccctggtgagggagcctcg

SEQ ID NO: 2702885 - DNA, 20 bp, Homo sapiens
ctccctgttatctgctagat

SEQ ID NO: 2702886 - DNA, 21 bp, Homo sapiens
ctcccttgagtaggccctgct

SEQ ID NO: 2702887 - DNA, 18 bp, Homo sapiens
ctccgccttcactccggt

SEQ ID NO: 2702888 - DNA, 14 bp, Homo sapiens
ctccgtgagccctt

SEQ ID NO: 2702889 - DNA, 23 bp, Homo sapiens
ctcctaatcaagagtctctccag

SEQ ID NO: 2702890 - DNA, 14 bp, Homo sapiens
ctcctacccctccc

SEQ ID NO: 2702891 - DNA, 16 bp, Homo sapiens
ctcctacctcagccta

SEQ ID NO: 2702892 - DNA, 18 bp, Homo sapiens
ctcctacctcagcctaga

SEQ ID NO: 2702893 - DNA, 14 bp, Homo sapiens
ctcctatccttgga

SEQ ID NO: 2702894 - DNA, 16 bp, Homo sapiens
ctcctcacactccaga

SEQ ID NO: 2702895 - DNA, 18 bp, Homo sapiens
ctcctcacactccagaat

SEQ ID NO: 2702896 - DNA, 13 bp, Homo sapiens
ctcctccaccgcc

SEQ ID NO: 2702897 - DNA, 19 bp, Homo sapiens
ctcctccaccgccatggct

SEQ ID NO: 2702898 - DNA, 22 bp, Homo sapiens
ctcctccaccgccatggcttcc

SEQ ID NO: 2702899 - DNA, 14 bp, Homo sapiens
ctcctccactccac

SEQ ID NO: 2702900 - DNA, 14 bp, Homo sapiens
ctcctcccatggcc

SEQ ID NO: 2702901 - DNA, 15 bp, Homo sapiens
ctcctcccatggcct

SEQ ID NO: 2702902 - DNA, 17 bp, Homo sapiens
ctcctcccctgccgcct

SEQ ID NO: 2702903 - DNA, 12 bp, Homo sapiens
ctcctcctgcca

SEQ ID NO: 2702904 - DNA, 14 bp, Homo sapiens
ctcctcctgccagc

SEQ ID NO: 2702905 - DNA, 16 bp, Homo sapiens
ctcctcctgccagctc

SEQ ID NO: 2702906 - DNA, 14 bp, Homo sapiens
ctcctctatttctt

SEQ ID NO: 2702907 - DNA, 13 bp, Homo sapiens
ctcctctccatgc

SEQ ID NO: 2702908 - DNA, 16 bp, Homo sapiens
ctcctctccatgcaag

SEQ ID NO: 2702909 - DNA, 23 bp, Homo sapiens
ctcctctccatgcaagtgctgtt

SEQ ID NO: 2702910 - DNA, 14 bp, Homo sapiens
ctcctgacctcgtg

SEQ ID NO: 2702911 - DNA, 13 bp, Homo sapiens
ctcctgagcctca

SEQ ID NO: 2702912 - DNA, 14 bp, Homo sapiens
ctcctgccagctct

SEQ ID NO: 2702913 - DNA, 16 bp, Homo sapiens
ctcctgccagctctgt

SEQ ID NO: 2702914 - DNA, 12 bp, Homo sapiens
ctcctgcctcag

SEQ ID NO: 2702915 - DNA, 13 bp, Homo sapiens
ctcctgcctcagc

SEQ ID NO: 2702916 - DNA, 18 bp, Homo sapiens
ctcctgcctcagcctcct

SEQ ID NO: 2702917 - DNA, 23 bp, Homo sapiens
ctcctgcctcagcctcctgagta

SEQ ID NO: 2702918 - DNA, 18 bp, Homo sapiens
cagtcgcgctgcctgtgt

SEQ ID NO: 2702919 - DNA, 14 bp, Homo sapiens
cagtctcaattttg

SEQ ID NO: 2702920 - DNA, 16 bp, Homo sapiens
cagtctcaattttgta

SEQ ID NO: 2702921 - DNA, 20 bp, Homo sapiens
cagtctcaattttgtattta

SEQ ID NO: 2702922 - DNA, 20 bp, Homo sapiens
cagtgacgtgactcagagct

SEQ ID NO: 2702923 - DNA, 18 bp, Homo sapiens
cagtgacgtgcacctgta

SEQ ID NO: 2702924 - DNA, 17 bp, Homo sapiens
cagtgactcgggctcct

SEQ ID NO: 2702925 - DNA, 19 bp, Homo sapiens
cagtgactcgggctcctgt

SEQ ID NO: 2702926 - DNA, 20 bp, Homo sapiens
cagtgactcgggctcctgtg

SEQ ID NO: 2702927 - DNA, 18 bp, Homo sapiens
cagtgagaagggcctgct

SEQ ID NO: 2702928 - DNA, 13 bp, Homo sapiens
cagtgagcctctg

SEQ ID NO: 2702929 - DNA, 15 bp, Homo sapiens
cagtgagcctctgcg

SEQ ID NO: 2702930 - DNA, 18 bp, Homo sapiens
cagtgagcctctgcgcct

SEQ ID NO: 2702931 - DNA, 20 bp, Homo sapiens
cagtgagcctctgcgcctct

SEQ ID NO: 2702932 - DNA, 23 bp, Homo sapiens
cagtgagcctctgcgcctctcca

SEQ ID NO: 2702933 - DNA, 19 bp, Homo sapiens
cagtgccgccgcctcgccc

SEQ ID NO: 2702934 - DNA, 22 bp, Homo sapiens
cagtgccgccgcctcgcccacc

SEQ ID NO: 2702935 - DNA, 18 bp, Homo sapiens
cagtgcctcagtgctgca

SEQ ID NO: 2702936 - DNA, 16 bp, Homo sapiens
cagtgcctggcaaggc

SEQ ID NO: 2702937 - DNA, 20 bp, Homo sapiens
cagtgctgcaattgagggct

SEQ ID NO: 2702938 - DNA, 14 bp, Homo sapiens
cagtgctggctgct

SEQ ID NO: 2702939 - DNA, 16 bp, Homo sapiens
cagtgctggctgctgg

SEQ ID NO: 2702940 - DNA, 15 bp, Homo sapiens
cagtgctgtggcctg

SEQ ID NO: 2702941 - DNA, 19 bp, Homo sapiens
cagtgctgtggcctgggca

SEQ ID NO: 2702942 - DNA, 15 bp, Homo sapiens
cagtgcttcagcctg

SEQ ID NO: 2702943 - DNA, 17 bp, Homo sapiens
cagtgcttcagcctgag

SEQ ID NO: 2702944 - DNA, 18 bp, Homo sapiens
cagtgcttcagcctgagg

SEQ ID NO: 2702945 - DNA, 17 bp, Homo sapiens
cagtggcaagaatgaaa

SEQ ID NO: 2702946 - DNA, 15 bp, Homo sapiens
cagtggcactaaaat

SEQ ID NO: 2702947 - DNA, 19 bp, Homo sapiens
cagtggcactaaaatgttt

SEQ ID NO: 2702948 - DNA, 16 bp, Homo sapiens
cagtgggaggacagag

SEQ ID NO: 2702949 - DNA, 17 bp, Homo sapiens
cagtgggtcccacttcc

SEQ ID NO: 2702950 - DNA, 16 bp, Homo sapiens
cagtgtacccccgccc

SEQ ID NO: 2702951 - DNA, 21 bp, Homo sapiens
cagtgtacccccgcccaggct

SEQ ID NO: 2702952 - DNA, 13 bp, Homo sapiens
cagtgtatttaag

SEQ ID NO: 2702953 - DNA, 13 bp, Homo sapiens
cagtgtcagagtc

SEQ ID NO: 2702954 - DNA, 16 bp, Homo sapiens
cagtgtcgtgtctgct

SEQ ID NO: 2702955 - DNA, 14 bp, Homo sapiens
cagtgtctgggctg

SEQ ID NO: 2702956 - DNA, 13 bp, Homo sapiens
cagtgtcttcctg

SEQ ID NO: 2702957 - DNA, 19 bp, Homo sapiens
cagtgtgatcccaagtgcc

SEQ ID NO: 2702958 - DNA, 14 bp, Homo sapiens
cagtgtgcccccca

SEQ ID NO: 2702959 - DNA, 15 bp, Homo sapiens
cagtgtgccccccat

SEQ ID NO: 2702960 - DNA, 20 bp, Homo sapiens
cagtgtgccccccatcctgg

SEQ ID NO: 2702961 - DNA, 23 bp, Homo sapiens
cagtgtgccccccatcctggccc

SEQ ID NO: 2702962 - DNA, 14 bp, Homo sapiens
cagtgtgtgctcag

SEQ ID NO: 2702963 - DNA, 22 bp, Homo sapiens
cagtgtgtgctcagcagcccca

SEQ ID NO: 2702964 - DNA, 17 bp, Homo sapiens
cagtgttaggcctggca

SEQ ID NO: 2702965 - DNA, 21 bp, Homo sapiens
cagtgttaggcctggcacagt

SEQ ID NO: 2702966 - DNA, 22 bp, Homo sapiens
cagtgttaggcctggcacagtg

SEQ ID NO: 2702967 - DNA, 23 bp, Homo sapiens
cagtgttaggcctggcacagtgt

SEQ ID NO: 2702968 - DNA, 13 bp, Homo sapiens
cagtgtttatgac

SEQ ID NO: 2702969 - DNA, 23 bp, Homo sapiens
cagtgtttcctgagtagcagtga

SEQ ID NO: 2702970 - DNA, 15 bp, Homo sapiens
cagtgtttgtatacc

SEQ ID NO: 2702971 - DNA, 16 bp, Homo sapiens
cagttctagttgattg

SEQ ID NO: 2702972 - DNA, 14 bp, Homo sapiens
cagttctgtgtcct

SEQ ID NO: 2702973 - DNA, 15 bp, Homo sapiens
cagttctgtgtcctc

SEQ ID NO: 2702974 - DNA, 21 bp, Homo sapiens
cagttctgtgtcctcgcactg

SEQ ID NO: 2702975 - DNA, 14 bp, Homo sapiens
cagttgttatttag

SEQ ID NO: 2702976 - DNA, 23 bp, Homo sapiens
cataaaggtatttagaatatatt

SEQ ID NO: 2702977 - DNA, 14 bp, Homo sapiens
cataaattatttct

SEQ ID NO: 2702978 - DNA, 18 bp, Homo sapiens
cataaattatttctaaaa

SEQ ID NO: 2702979 - DNA, 16 bp, Homo sapiens
cataaatttgttgtca

SEQ ID NO: 2702980 - DNA, 22 bp, Homo sapiens
cataacatagttgaaaaaagaa

SEQ ID NO: 2702981 - DNA, 19 bp, Homo sapiens
cataatgaaccgtttacag

SEQ ID NO: 2702982 - DNA, 21 bp, Homo sapiens
cataatgaaccgtttacagtg

SEQ ID NO: 2702983 - DNA, 14 bp, Homo sapiens
cataattttatcta

SEQ ID NO: 2702984 - DNA, 16 bp, Homo sapiens
catacaacagaaacca

SEQ ID NO: 2702985 - DNA, 21 bp, Homo sapiens
catacatgttgggcatgattc

SEQ ID NO: 2702986 - DNA, 13 bp, Homo sapiens
catacattatatt

SEQ ID NO: 2702987 - DNA, 12 bp, Homo sapiens
catactggcctc

SEQ ID NO: 2702988 - DNA, 20 bp, Homo sapiens
catactggcctcgcctggcc

SEQ ID NO: 2702989 - DNA, 17 bp, Homo sapiens
catagatgagaaaactg

SEQ ID NO: 2702990 - DNA, 14 bp, Homo sapiens
catataatttaaag

SEQ ID NO: 2702991 - DNA, 14 bp, Homo sapiens
catatatgtatatg

SEQ ID NO: 2702992 - DNA, 15 bp, Homo sapiens
catatctaatttacc

SEQ ID NO: 2702993 - DNA, 15 bp, Homo sapiens
catatctagtcaata

SEQ ID NO: 2702994 - DNA, 18 bp, Homo sapiens
catatctctagtccctgt

SEQ ID NO: 2702995 - DNA, 15 bp, Homo sapiens
catatgtatctttgg

SEQ ID NO: 2702996 - DNA, 15 bp, Homo sapiens
catatgtctgtcttt

SEQ ID NO: 2702997 - DNA, 18 bp, Homo sapiens
catatgtctgtctttgca

SEQ ID NO: 2702998 - DNA, 20 bp, Homo sapiens
catattaagaatagtctctg

SEQ ID NO: 2702999 - DNA, 15 bp, Homo sapiens
catattctaaattca

SEQ ID NO: 2703000 - DNA, 17 bp, Homo sapiens
catattctaaattcact

SEQ ID NO: 2703001 - DNA, 14 bp, Homo sapiens
catattgctcttaa

SEQ ID NO: 2703002 - DNA, 11 bp, Homo sapiens
catatttttaa

SEQ ID NO: 2703003 - DNA, 13 bp, Homo sapiens
catcaaacatgaa

SEQ ID NO: 2703004 - DNA, 14 bp, Homo sapiens
catcaaacatgaaa

SEQ ID NO: 2703005 - DNA, 21 bp, Homo sapiens
cagctgggcccacagccccca

SEQ ID NO: 2703006 - DNA, 14 bp, Homo sapiens
cagctggtggatgg

SEQ ID NO: 2703007 - DNA, 14 bp, Homo sapiens
cagcttcacttaaa

SEQ ID NO: 2703008 - DNA, 22 bp, Homo sapiens
cagcttcacttaaaatcaaatt

SEQ ID NO: 2703009 - DNA, 20 bp, Homo sapiens
cagcttcctctgagccgcag

SEQ ID NO: 2703010 - DNA, 13 bp, Homo sapiens
cagcttcctgtca

SEQ ID NO: 2703011 - DNA, 13 bp, Homo sapiens
cagcttctgccac

SEQ ID NO: 2703012 - DNA, 14 bp, Homo sapiens
cagcttctgccact

SEQ ID NO: 2703013 - DNA, 17 bp, Homo sapiens
cagcttctgccacttcc

SEQ ID NO: 2703014 - DNA, 20 bp, Homo sapiens
cagcttctgccacttcccag

SEQ ID NO: 2703015 - DNA, 23 bp, Homo sapiens
cagcttctgccacttcccaggta

SEQ ID NO: 2703016 - DNA, 16 bp, Homo sapiens
cagcttctgctgggct

SEQ ID NO: 2703017 - DNA, 18 bp, Homo sapiens
cagcttctgctgggctgg

SEQ ID NO: 2703018 - DNA, 17 bp, Homo sapiens
caggaaaagcctctgtg

SEQ ID NO: 2703019 - DNA, 13 bp, Homo sapiens
caggaaccggagg

SEQ ID NO: 2703020 - DNA, 22 bp, Homo sapiens
caggaagggagggagctgaggc

SEQ ID NO: 2703021 - DNA, 23 bp, Homo sapiens
caggaatttaatttataggcaga

SEQ ID NO: 2703022 - DNA, 16 bp, Homo sapiens
caggacagtgcttcag

SEQ ID NO: 2703023 - DNA, 21 bp, Homo sapiens
caggacagtgcttcagcctga

SEQ ID NO: 2703024 - DNA, 22 bp, Homo sapiens
caggacggggccggccaggtgg

SEQ ID NO: 2703025 - DNA, 15 bp, Homo sapiens
caggactctgcagat

SEQ ID NO: 2703026 - DNA, 20 bp, Homo sapiens
caggactggggcttgccagg

SEQ ID NO: 2703027 - DNA, 22 bp, Homo sapiens
caggagagccctctgctgcttt

SEQ ID NO: 2703028 - DNA, 14 bp, Homo sapiens
caggagagcttccc

SEQ ID NO: 2703029 - DNA, 19 bp, Homo sapiens
caggagctgacagagccag

SEQ ID NO: 2703030 - DNA, 15 bp, Homo sapiens
caggaggaggtgcca

SEQ ID NO: 2703031 - DNA, 15 bp, Homo sapiens
caggaggcaggatat

SEQ ID NO: 2703032 - DNA, 21 bp, Homo sapiens
caggaggctccgtgagccctt

SEQ ID NO: 2703033 - DNA, 21 bp, Homo sapiens
caggaggcttggaaagcatca

SEQ ID NO: 2703034 - DNA, 21 bp, Homo sapiens
caggaggtgccggtaccagcc

SEQ ID NO: 2703035 - DNA, 18 bp, Homo sapiens
caggagtcaccatgcaag

SEQ ID NO: 2703036 - DNA, 22 bp, Homo sapiens
caggagtttgaggctgcagcga

SEQ ID NO: 2703037 - DNA, 16 bp, Homo sapiens
caggattcccagagag

SEQ ID NO: 2703038 - DNA, 22 bp, Homo sapiens
caggattggcacaagctccctg

SEQ ID NO: 2703039 - DNA, 20 bp, Homo sapiens
caggattgggccaacaagga

SEQ ID NO: 2703040 - DNA, 13 bp, Homo sapiens
caggcaagcttgt

SEQ ID NO: 2703041 - DNA, 13 bp, Homo sapiens
caggcacatggct

SEQ ID NO: 2703042 - DNA, 16 bp, Homo sapiens
caggcacatggctggg

SEQ ID NO: 2703043 - DNA, 17 bp, Homo sapiens
caggcacatggctgggg

SEQ ID NO: 2703044 - DNA, 20 bp, Homo sapiens
caggcagcgcctgtcccctc

SEQ ID NO: 2703045 - DNA, 21 bp, Homo sapiens
caggccaagagcagaggcagc

SEQ ID NO: 2703046 - DNA, 18 bp, Homo sapiens
caggcccggtgaggccaa

SEQ ID NO: 2703047 - DNA, 12 bp, Homo sapiens
caggccctgcac

SEQ ID NO: 2703048 - DNA, 13 bp, Homo sapiens
caggccctgcact

SEQ ID NO: 2703049 - DNA, 16 bp, Homo sapiens
caggccctgcactgtc

SEQ ID NO: 2703050 - DNA, 18 bp, Homo sapiens
caggccctgcactgtcct

SEQ ID NO: 2703051 - DNA, 19 bp, Homo sapiens
caggcccttggtagagctg

SEQ ID NO: 2703052 - DNA, 19 bp, Homo sapiens
caggccggtgtgggctgtg

SEQ ID NO: 2703053 - DNA, 12 bp, Homo sapiens
caggctctgaga

SEQ ID NO: 2703054 - DNA, 13 bp, Homo sapiens
caggctgcaaccc

SEQ ID NO: 2703055 - DNA, 12 bp, Homo sapiens
caggctggccag

SEQ ID NO: 2703056 - DNA, 13 bp, Homo sapiens
caggctggccagc

SEQ ID NO: 2703057 - DNA, 18 bp, Homo sapiens
caggctgggttgtcactg

SEQ ID NO: 2703058 - DNA, 21 bp, Homo sapiens
caggctgggttgtcactgaga

SEQ ID NO: 2703059 - DNA, 15 bp, Homo sapiens
caggctgtaagcatt

SEQ ID NO: 2703060 - DNA, 22 bp, Homo sapiens
caggctgtaagcattctgagct

SEQ ID NO: 2703061 - DNA, 24 bp, Homo sapiens
cagggaagccctcggcctccagac

SEQ ID NO: 2703062 - DNA, 14 bp, Homo sapiens
cagggaccacagca

SEQ ID NO: 2703063 - DNA, 15 bp, Homo sapiens
cagggaccacagcaa

SEQ ID NO: 2703064 - DNA, 17 bp, Homo sapiens
cagggaccacagcaagg

SEQ ID NO: 2703065 - DNA, 20 bp, Homo sapiens
cagggaccacagcaaggcac

SEQ ID NO: 2703066 - DNA, 24 bp, Homo sapiens
cagggaccactgggtgagagagga

SEQ ID NO: 2703067 - DNA, 23 bp, Homo sapiens
cagggagcaactctccactccat

SEQ ID NO: 2703068 - DNA, 19 bp, Homo sapiens
cagggaggaggtggcagcc

SEQ ID NO: 2703069 - DNA, 20 bp, Homo sapiens
cagggaggaggtggcagccc

SEQ ID NO: 2703070 - DNA, 21 bp, Homo sapiens
cagggaggaggtggcagccct

SEQ ID NO: 2703071 - DNA, 22 bp, Homo sapiens
cagggaggaggtggcagccctg

SEQ ID NO: 2703072 - DNA, 14 bp, Homo sapiens
cagggaggctgcag

SEQ ID NO: 2703073 - DNA, 13 bp, Homo sapiens
cagggatttgagg

SEQ ID NO: 2703074 - DNA, 14 bp, Homo sapiens
cagggcacagctgg

SEQ ID NO: 2703075 - DNA, 15 bp, Homo sapiens
cagggcacagctgga

SEQ ID NO: 2703076 - DNA, 15 bp, Homo sapiens
cagggcagcaggctt

SEQ ID NO: 2703077 - DNA, 21 bp, Homo sapiens
cagggccagcaggcagcgcct

SEQ ID NO: 2703078 - DNA, 13 bp, Homo sapiens
cagggccagggcc

SEQ ID NO: 2703079 - DNA, 15 bp, Homo sapiens
cagggccagggccct

SEQ ID NO: 2703080 - DNA, 19 bp, Homo sapiens
cagggccagggccctgcag

SEQ ID NO: 2703081 - DNA, 22 bp, Homo sapiens
cagggccatctcctcccaccag

SEQ ID NO: 2703082 - DNA, 13 bp, Homo sapiens
cagggccctgcag

SEQ ID NO: 2703083 - DNA, 15 bp, Homo sapiens
cagggccctgcagag

SEQ ID NO: 2703084 - DNA, 20 bp, Homo sapiens
cagggcctctgtgcagacag

SEQ ID NO: 2703085 - DNA, 12 bp, Homo sapiens
cagggctccctc

SEQ ID NO: 2703086 - DNA, 21 bp, Homo sapiens
cagggctccctcctggagcat

SEQ ID NO: 2703087 - DNA, 14 bp, Homo sapiens
caggggaagctgct

SEQ ID NO: 2703088 - DNA, 18 bp, Homo sapiens
caggggaagctgctaggg

SEQ ID NO: 2703089 - DNA, 19 bp, Homo sapiens
caggggaagctgctagggg

SEQ ID NO: 2703090 - DNA, 18 bp, Homo sapiens
caggggacaaaccagggg

SEQ ID NO: 2703091 - DNA, 19 bp, Homo sapiens
caggggacctggagctgcc

SEQ ID NO: 2703092 - DNA, 20 bp, Homo sapiens
caggggagggaaaagctaag

SEQ ID NO: 2703093 - DNA, 21 bp, Homo sapiens
caggggagggaaaagctaaga

SEQ ID NO: 2703094 - DNA, 16 bp, Homo sapiens
caggggcaccctccaa

SEQ ID NO: 2703095 - DNA, 17 bp, Homo sapiens
caggggcaggcacagca

SEQ ID NO: 2703096 - DNA, 18 bp, Homo sapiens
caggggctgcccgctccc

SEQ ID NO: 2703097 - DNA, 23 bp, Homo sapiens
caggggctgctgggggctcccct

SEQ ID NO: 2703098 - DNA, 16 bp, Homo sapiens
caacctgcctgtgcat

SEQ ID NO: 2703099 - DNA, 22 bp, Homo sapiens
caacctgtccttactcagagct

SEQ ID NO: 2703100 - DNA, 13 bp, Homo sapiens
caacgacaaagcc

SEQ ID NO: 2703101 - DNA, 22 bp, Homo sapiens
caactcctgttctttgggctca

SEQ ID NO: 2703102 - DNA, 14 bp, Homo sapiens
caactcttgtattg

SEQ ID NO: 2703103 - DNA, 16 bp, Homo sapiens
caactgaatacttgaa

SEQ ID NO: 2703104 - DNA, 22 bp, Homo sapiens
caagaagaaatgctttccaaaa

SEQ ID NO: 2703105 - DNA, 22 bp, Homo sapiens
caagaagggttttccaccctgg

SEQ ID NO: 2703106 - DNA, 18 bp, Homo sapiens
caagacagtggcactaaa

SEQ ID NO: 2703107 - DNA, 23 bp, Homo sapiens
caagaccttacaaccacatttct

SEQ ID NO: 2703108 - DNA, 20 bp, Homo sapiens
caagacgtcctggaatgaag

SEQ ID NO: 2703109 - DNA, 22 bp, Homo sapiens
caagacgtcctggaatgaagca

SEQ ID NO: 2703110 - DNA, 13 bp, Homo sapiens
caagagtctctcc

SEQ ID NO: 2703111 - DNA, 20 bp, Homo sapiens
caagagtctctccagcctca

SEQ ID NO: 2703112 - DNA, 20 bp, Homo sapiens
caagatccaaatgctgtgca

SEQ ID NO: 2703113 - DNA, 22 bp, Homo sapiens
caagatccaaatgctgtgcaaa

SEQ ID NO: 2703114 - DNA, 18 bp, Homo sapiens
caagatggctggaaggag

SEQ ID NO: 2703115 - DNA, 13 bp, Homo sapiens
caagcaagcaaaa

SEQ ID NO: 2703116 - DNA, 20 bp, Homo sapiens
caagcatgtttaaaacaaat

SEQ ID NO: 2703117 - DNA, 19 bp, Homo sapiens
caagccaacgacaaagcca

SEQ ID NO: 2703118 - DNA, 15 bp, Homo sapiens
caagccaccgcagct

SEQ ID NO: 2703119 - DNA, 16 bp, Homo sapiens
caagccaccgcagctg

SEQ ID NO: 2703120 - DNA, 20 bp, Homo sapiens
caagccaccgcagctgctgc

SEQ ID NO: 2703121 - DNA, 21 bp, Homo sapiens
caagccaccgcagctgctgcc

SEQ ID NO: 2703122 - DNA, 17 bp, Homo sapiens
caagcgtgctgcctctc

SEQ ID NO: 2703123 - DNA, 19 bp, Homo sapiens
caagctcaggtcctgctgc

SEQ ID NO: 2703124 - DNA, 16 bp, Homo sapiens
caagctctgcctcccg

SEQ ID NO: 2703125 - DNA, 16 bp, Homo sapiens
caagctgtgccaccct

SEQ ID NO: 2703126 - DNA, 16 bp, Homo sapiens
caaggacaacctgccc

SEQ ID NO: 2703127 - DNA, 15 bp, Homo sapiens
caaggcacctgcagg

SEQ ID NO: 2703128 - DNA, 15 bp, Homo sapiens
caaggcagttctgtg

SEQ ID NO: 2703129 - DNA, 18 bp, Homo sapiens
caaggcagttctgtgtcc

SEQ ID NO: 2703130 - DNA, 20 bp, Homo sapiens
caaggccagggcacagctgg

SEQ ID NO: 2703131 - DNA, 13 bp, Homo sapiens
caaggcctcccac

SEQ ID NO: 2703132 - DNA, 14 bp, Homo sapiens
caaggcctcccaca

SEQ ID NO: 2703133 - DNA, 15 bp, Homo sapiens
caaggcctcccacag

SEQ ID NO: 2703134 - DNA, 19 bp, Homo sapiens
caagggtatgggaagccat

SEQ ID NO: 2703135 - DNA, 12 bp, Homo sapiens
caaggtctcaca

SEQ ID NO: 2703136 - DNA, 21 bp, Homo sapiens
caaggtctcacactcctcctg

SEQ ID NO: 2703137 - DNA, 20 bp, Homo sapiens
caaggtgggctgagccctgg

SEQ ID NO: 2703138 - DNA, 21 bp, Homo sapiens
caaggtgggctgagccctggc

SEQ ID NO: 2703139 - DNA, 24 bp, Homo sapiens
caaggtgggctgagccctggcagg

SEQ ID NO: 2703140 - DNA, 17 bp, Homo sapiens
caaggttcagtctgaat

SEQ ID NO: 2703141 - DNA, 14 bp, Homo sapiens
caagtccaacctgc

SEQ ID NO: 2703142 - DNA, 21 bp, Homo sapiens
caagtccctgactctctgtga

SEQ ID NO: 2703143 - DNA, 12 bp, Homo sapiens
caagtctgtgaa

SEQ ID NO: 2703144 - DNA, 18 bp, Homo sapiens
caagtgctgtttgggcag

SEQ ID NO: 2703145 - DNA, 21 bp, Homo sapiens
caagtgctgtttgggcaggag

SEQ ID NO: 2703146 - DNA, 22 bp, Homo sapiens
caagtgctgtttgggcaggagt

SEQ ID NO: 2703147 - DNA, 19 bp, Homo sapiens
caagtggaaacatgctgaa

SEQ ID NO: 2703148 - DNA, 15 bp, Homo sapiens
caagtgtcctggacc

SEQ ID NO: 2703149 - DNA, 22 bp, Homo sapiens
caagtgtcctggaccctggcct

SEQ ID NO: 2703150 - DNA, 23 bp, Homo sapiens
caagtgtggaattggagaaaagc

SEQ ID NO: 2703151 - DNA, 22 bp, Homo sapiens
caagttaaggtatctggtatct

SEQ ID NO: 2703152 - DNA, 14 bp, Homo sapiens
caagttagctcagg

SEQ ID NO: 2703153 - DNA, 16 bp, Homo sapiens
caagttagctcaggag

SEQ ID NO: 2703154 - DNA, 17 bp, Homo sapiens
caagttagctcaggagg

SEQ ID NO: 2703155 - DNA, 12 bp, Homo sapiens
caagttcaatct

SEQ ID NO: 2703156 - DNA, 19 bp, Homo sapiens
caagttccctcctgcagcc

SEQ ID NO: 2703157 - DNA, 16 bp, Homo sapiens
caagtttaaagtcatg

SEQ ID NO: 2703158 - DNA, 14 bp, Homo sapiens
caataaagcagagt

SEQ ID NO: 2703159 - DNA, 14 bp, Homo sapiens
caataaatgctgaa

SEQ ID NO: 2703160 - DNA, 17 bp, Homo sapiens
caataaatgctgaatga

SEQ ID NO: 2703161 - DNA, 20 bp, Homo sapiens
caataaatgctgaatgaatc

SEQ ID NO: 2703162 - DNA, 17 bp, Homo sapiens
caatacatgctgctaat

SEQ ID NO: 2703163 - DNA, 16 bp, Homo sapiens
caatagttttttactt

SEQ ID NO: 2703164 - DNA, 18 bp, Homo sapiens
caatatgattgcactaaa

SEQ ID NO: 2703165 - DNA, 16 bp, Homo sapiens
caatatttactcatca

SEQ ID NO: 2703166 - DNA, 16 bp, Homo sapiens
caatcacaaaagctgt

SEQ ID NO: 2703167 - DNA, 19 bp, Homo sapiens
caatccatttggcagaact

SEQ ID NO: 2703168 - DNA, 20 bp, Homo sapiens
caatccatttggcagaactg

SEQ ID NO: 2703169 - DNA, 21 bp, Homo sapiens
caatccatttggcagaactgc

SEQ ID NO: 2703170 - DNA, 10 bp, Homo sapiens
caatgaagga

SEQ ID NO: 2703171 - DNA, 15 bp, Homo sapiens
caatgcagtgcagca

SEQ ID NO: 2703172 - DNA, 21 bp, Homo sapiens
caatgcccgtaagatggctta

SEQ ID NO: 2703173 - DNA, 17 bp, Homo sapiens
caatgccctacctgcct

SEQ ID NO: 2703174 - DNA, 22 bp, Homo sapiens
caatgcgtggcacatctaaatt

SEQ ID NO: 2703175 - DNA, 20 bp, Homo sapiens
caatggcacgatctcagctc

SEQ ID NO: 2703176 - DNA, 15 bp, Homo sapiens
caatgtacaaggtat

SEQ ID NO: 2703177 - DNA, 14 bp, Homo sapiens
caatgtcagaaact

SEQ ID NO: 2703178 - DNA, 19 bp, Homo sapiens
caattaactccgtttccaa

SEQ ID NO: 2703179 - DNA, 13 bp, Homo sapiens
caattcctgggcc

SEQ ID NO: 2703180 - DNA, 13 bp, Homo sapiens
caattgccacatt

SEQ ID NO: 2703181 - DNA, 13 bp, Homo sapiens
caattgctgccaa

SEQ ID NO: 2703182 - DNA, 18 bp, Homo sapiens
caatttactttttaaaca

SEQ ID NO: 2703183 - DNA, 19 bp, Homo sapiens
caatttactttttaaacag

SEQ ID NO: 2703184 - DNA, 22 bp, Homo sapiens
caatttactttttaaacagtgt

SEQ ID NO: 2703185 - DNA, 14 bp, Homo sapiens
cacaaatgtgtccc

SEQ ID NO: 2703186 - DNA, 18 bp, Homo sapiens
cacaacctcctcctccag

SEQ ID NO: 2703187 - DNA, 21 bp, Homo sapiens
cacaacgctctaccctgcagc

SEQ ID NO: 2703188 - DNA, 15 bp, Homo sapiens
cacaagctccctggt

SEQ ID NO: 2703189 - DNA, 17 bp, Homo sapiens
cacaatgttgcactgaa

SEQ ID NO: 2703190 - DNA, 17 bp, Homo sapiens
cacacactccttcccct

SEQ ID NO: 2703191 - DNA, 17 bp, Homo sapiens
cacacagtattaagtga

SEQ ID NO: 2703192 - DNA, 18 bp, Homo sapiens
cacacatggctaattttt

SEQ ID NO: 2703193 - DNA, 17 bp, Homo sapiens
cacaccaagctgtgcca

SEQ ID NO: 2703194 - DNA, 20 bp, Homo sapiens
cacaccaagctgtgccaccc

SEQ ID NO: 2703195 - DNA, 19 bp, Homo sapiens
cacaccattgcatgaattc

SEQ ID NO: 2703196 - DNA, 18 bp, Homo sapiens
cacacccccaagccacag

SEQ ID NO: 2703197 - DNA, 14 bp, Homo sapiens
cacacctcacgctc

SEQ ID NO: 2703198 - DNA, 13 bp, Homo sapiens
cacactccagaat

SEQ ID NO: 2703199 - DNA, 10 bp, Homo sapiens
cacactccta

SEQ ID NO: 2703200 - DNA, 19 bp, Homo sapiens
cacactggcatctccctga

SEQ ID NO: 2703201 - DNA, 15 bp, Homo sapiens
cacagactcttccac

SEQ ID NO: 2703202 - DNA, 16 bp, Homo sapiens
cacagactcttccacc

SEQ ID NO: 2703203 - DNA, 19 bp, Homo sapiens
cacagactcttccaccaga

SEQ ID NO: 2703204 - DNA, 13 bp, Homo sapiens
cacagagggcgct

SEQ ID NO: 2703205 - DNA, 15 bp, Homo sapiens
cacagagggcgctcc

SEQ ID NO: 2703206 - DNA, 15 bp, Homo sapiens
cacagatgctggcct

SEQ ID NO: 2703207 - DNA, 19 bp, Homo sapiens
cacagatgctggcctcttg

SEQ ID NO: 2703208 - DNA, 21 bp, Homo sapiens
cacagatgctggcctcttggc

SEQ ID NO: 2703209 - DNA, 22 bp, Homo sapiens
cacagatgctggcctcttggca

SEQ ID NO: 2703210 - DNA, 21 bp, Homo sapiens
cacagatggaagaagttttaa

SEQ ID NO: 2703211 - DNA, 18 bp, Homo sapiens
cacagcaaggaggctggc

SEQ ID NO: 2703212 - DNA, 15 bp, Homo sapiens
cacagcaaggcacct

SEQ ID NO: 2703213 - DNA, 18 bp, Homo sapiens
cacagcccacgtcctgtc

SEQ ID NO: 2703214 - DNA, 20 bp, Homo sapiens
cacagcccacgtcctgtcag

SEQ ID NO: 2703215 - DNA, 18 bp, Homo sapiens
cacagcccagacaagatg

SEQ ID NO: 2703216 - DNA, 20 bp, Homo sapiens
cacagcccccaccccagcac

SEQ ID NO: 2703217 - DNA, 18 bp, Homo sapiens
cacagccctcccgcccct

SEQ ID NO: 2703218 - DNA, 20 bp, Homo sapiens
cacagccctcccgccccttc

SEQ ID NO: 2703219 - DNA, 22 bp, Homo sapiens
cacagccgcagcctccctctga

SEQ ID NO: 2703220 - DNA, 14 bp, Homo sapiens
aaatatgtgaaaat

SEQ ID NO: 2703221 - DNA, 20 bp, Homo sapiens
aaatcaatgaaggatttctt

SEQ ID NO: 2703222 - DNA, 12 bp, Homo sapiens
aaatcaattttt

SEQ ID NO: 2703223 - DNA, 15 bp, Homo sapiens
aaatcacaaacatat

SEQ ID NO: 2703224 - DNA, 15 bp, Homo sapiens
aaatcagagctggca

SEQ ID NO: 2703225 - DNA, 19 bp, Homo sapiens
aaatcagcgatgtgtcacc

SEQ ID NO: 2703226 - DNA, 13 bp, Homo sapiens
aaatcccaagtgt

SEQ ID NO: 2703227 - DNA, 17 bp, Homo sapiens
aaatctggcaaagttat

SEQ ID NO: 2703228 - DNA, 16 bp, Homo sapiens
aaatcttcagctggtg

SEQ ID NO: 2703229 - DNA, 19 bp, Homo sapiens
aaatcttcagctggtggat

SEQ ID NO: 2703230 - DNA, 22 bp, Homo sapiens
aaatgaagcaatttatatcttt

SEQ ID NO: 2703231 - DNA, 16 bp, Homo sapiens
aaatgaatttgactgg

SEQ ID NO: 2703232 - DNA, 22 bp, Homo sapiens
aaatgagcattagctacttttc

SEQ ID NO: 2703233 - DNA, 18 bp, Homo sapiens
aaatgcattcatgtttta

SEQ ID NO: 2703234 - DNA, 14 bp, Homo sapiens
aaatggcttactta

SEQ ID NO: 2703235 - DNA, 23 bp, Homo sapiens
aaatgggaattctgacttactta

SEQ ID NO: 2703236 - DNA, 15 bp, Homo sapiens
aaatgtttaattcat

SEQ ID NO: 2703237 - DNA, 17 bp, Homo sapiens
aaatgtttttggcaaca

SEQ ID NO: 2703238 - DNA, 12 bp, Homo sapiens
aaattaatcttt

SEQ ID NO: 2703239 - DNA, 21 bp, Homo sapiens
aaattagcaatcattttatat

SEQ ID NO: 2703240 - DNA, 15 bp, Homo sapiens
aaattagcttttagt

SEQ ID NO: 2703241 - DNA, 20 bp, Homo sapiens
aaattagcttttagttttaa

SEQ ID NO: 2703242 - DNA, 15 bp, Homo sapiens
aaattagtagtgtgt

SEQ ID NO: 2703243 - DNA, 21 bp, Homo sapiens
aaattagtagtgtgttgataa

SEQ ID NO: 2703244 - DNA, 13 bp, Homo sapiens
aaattagtttaaa

SEQ ID NO: 2703245 - DNA, 14 bp, Homo sapiens
aaattatttctaaa

SEQ ID NO: 2703246 - DNA, 17 bp, Homo sapiens
aaattatttctaaaaca

SEQ ID NO: 2703247 - DNA, 23 bp, Homo sapiens
aaattattttttgcatcatttaa

SEQ ID NO: 2703248 - DNA, 17 bp, Homo sapiens
aaattcactgttgaatg

SEQ ID NO: 2703249 - DNA, 14 bp, Homo sapiens
aaattgtctgtctg

SEQ ID NO: 2703250 - DNA, 16 bp, Homo sapiens
aaattgtgaaaaatga

SEQ ID NO: 2703251 - DNA, 17 bp, Homo sapiens
aaattgtgaaaaatgag

SEQ ID NO: 2703252 - DNA, 14 bp, Homo sapiens
aaatttccactcag

SEQ ID NO: 2703253 - DNA, 17 bp, Homo sapiens
aaatttctctactgtct

SEQ ID NO: 2703254 - DNA, 21 bp, Homo sapiens
aaatttgttgtcatgtgtatg

SEQ ID NO: 2703255 - DNA, 18 bp, Homo sapiens
aaattttactgacagaaa

SEQ ID NO: 2703256 - DNA, 23 bp, Homo sapiens
aaattttgtcccttccatttcta

SEQ ID NO: 2703257 - DNA, 21 bp, Homo sapiens
aaattttgttttttaagtttt

SEQ ID NO: 2703258 - DNA, 19 bp, Homo sapiens
aaatttttttccagaattg

SEQ ID NO: 2703259 - DNA, 13 bp, Homo sapiens
aacaaaaggcttt

SEQ ID NO: 2703260 - DNA, 13 bp, Homo sapiens
aacaaagaaaaga

SEQ ID NO: 2703261 - DNA, 19 bp, Homo sapiens
aacaaagttactggctctt

SEQ ID NO: 2703262 - DNA, 22 bp, Homo sapiens
aacaacttgaaacccattttaa

SEQ ID NO: 2703263 - DNA, 17 bp, Homo sapiens
aacaagatcattatctt

SEQ ID NO: 2703264 - DNA, 18 bp, Homo sapiens
aacaaggtgcacagacct

SEQ ID NO: 2703265 - DNA, 14 bp, Homo sapiens
aacaataaagagct

SEQ ID NO: 2703266 - DNA, 23 bp, Homo sapiens
aacaatccaaatgcattcatgtt

SEQ ID NO: 2703267 - DNA, 11 bp, Homo sapiens
aacacccactg

SEQ ID NO: 2703268 - DNA, 16 bp, Homo sapiens
aacacccactggccag

SEQ ID NO: 2703269 - DNA, 14 bp, Homo sapiens
aacacccggaaaga

SEQ ID NO: 2703270 - DNA, 19 bp, Homo sapiens
aacactcgtgtgcccacca

SEQ ID NO: 2703271 - DNA, 18 bp, Homo sapiens
aacactgggctctgagga

SEQ ID NO: 2703272 - DNA, 13 bp, Homo sapiens
aacagaagcaaat

SEQ ID NO: 2703273 - DNA, 13 bp, Homo sapiens
aacagactattta

SEQ ID NO: 2703274 - DNA, 14 bp, Homo sapiens
aacagcaaagccat

SEQ ID NO: 2703275 - DNA, 9 bp, Homo sapiens
aacagcagc

SEQ ID NO: 2703276 - DNA, 17 bp, Homo sapiens
aacagcttaaagagaaa

SEQ ID NO: 2703277 - DNA, 20 bp, Homo sapiens
aacagggacactacaaacat

SEQ ID NO: 2703278 - DNA, 20 bp, Homo sapiens
aacagtgaatttaagcatga

SEQ ID NO: 2703279 - DNA, 14 bp, Homo sapiens
aacagtgctctgcc

SEQ ID NO: 2703280 - DNA, 22 bp, Homo sapiens
aacagtgttaggcctggcacag

SEQ ID NO: 2703281 - DNA, 17 bp, Homo sapiens
aacagtgtttatgacga

SEQ ID NO: 2703282 - DNA, 17 bp, Homo sapiens
aacagtttctcaagttt

SEQ ID NO: 2703283 - DNA, 20 bp, Homo sapiens
aacagtttctcaagtttaaa

SEQ ID NO: 2703284 - DNA, 15 bp, Homo sapiens
aacatagttgaaaaa

SEQ ID NO: 2703285 - DNA, 13 bp, Homo sapiens
aacatatgtctgt

SEQ ID NO: 2703286 - DNA, 20 bp, Homo sapiens
aacatatgtctgtctttgca

SEQ ID NO: 2703287 - DNA, 22 bp, Homo sapiens
aacatatgtctgtctttgcaaa

SEQ ID NO: 2703288 - DNA, 23 bp, Homo sapiens
aacatgaaaaacacggcagctgt

SEQ ID NO: 2703289 - DNA, 12 bp, Homo sapiens
aacatgaaaaca

SEQ ID NO: 2703290 - DNA, 20 bp, Homo sapiens
aacatgaaaacattgatgaa

SEQ ID NO: 2703291 - DNA, 13 bp, Homo sapiens
aacatgcagctct

SEQ ID NO: 2703292 - DNA, 18 bp, Homo sapiens
aacatgcagctctgcagc

SEQ ID NO: 2703293 - DNA, 16 bp, Homo sapiens
aacattgcaatagaaa

SEQ ID NO: 2703294 - DNA, 20 bp, Homo sapiens
aacatttaggagaagttggt

SEQ ID NO: 2703295 - DNA, 22 bp, Homo sapiens
aacattttgaaaacccctggct

SEQ ID NO: 2703296 - DNA, 11 bp, Homo sapiens
aacattttgtt

SEQ ID NO: 2703297 - DNA, 17 bp, Homo sapiens
aacatttttgtacatta

SEQ ID NO: 2703298 - DNA, 21 bp, Homo sapiens
aaccaaagagtctctggctca

SEQ ID NO: 2703299 - DNA, 15 bp, Homo sapiens
aaccaacccatgtat

SEQ ID NO: 2703300 - DNA, 22 bp, Homo sapiens
aaccacgtaccaagccaccgca

SEQ ID NO: 2703301 - DNA, 22 bp, Homo sapiens
aaccactaatgcttgccaagaa

SEQ ID NO: 2703302 - DNA, 20 bp, Homo sapiens
aaccatccatctgtggaaat

SEQ ID NO: 2703303 - DNA, 10 bp, Homo sapiens
aacccagccg

SEQ ID NO: 2703304 - DNA, 23 bp, Homo sapiens
aaccccagcggcagatgggcctg

SEQ ID NO: 2703305 - DNA, 13 bp, Homo sapiens
aaccccagctggc

SEQ ID NO: 2703306 - DNA, 15 bp, Homo sapiens
aaccccagctggcct

SEQ ID NO: 2703307 - DNA, 16 bp, Homo sapiens
aaccccagctggcctc

SEQ ID NO: 2703308 - DNA, 19 bp, Homo sapiens
aacccccagcacccgggct

SEQ ID NO: 2703309 - DNA, 12 bp, Homo sapiens
aacccctccccc

SEQ ID NO: 2703310 - DNA, 16 bp, Homo sapiens
aaccctggaaactacc

SEQ ID NO: 2703311 - DNA, 13 bp, Homo sapiens
aaccgtgtgctcc

SEQ ID NO: 2703312 - DNA, 13 bp, Homo sapiens
aaccgtttacagt

SEQ ID NO: 2703313 - DNA, 20 bp, Homo sapiens
aacctatgtaatttttaaag

SEQ ID NO: 2703314 - DNA, 17 bp, Homo sapiens
aacctccacctcctggg

SEQ ID NO: 2703315 - DNA, 18 bp, Homo sapiens
aacctccacctcctgggt

SEQ ID NO: 2703316 - DNA, 21 bp, Homo sapiens
aacctgtccttactcagagct

SEQ ID NO: 2703317 - DNA, 13 bp, Homo sapiens
aacctgtgtctta

SEQ ID NO: 2703318 - DNA, 15 bp, Homo sapiens
aacgggctgccctgc

SEQ ID NO: 2703319 - DNA, 12 bp, Homo sapiens
aacgtattttga

SEQ ID NO: 2703320 - DNA, 14 bp, Homo sapiens
aactaacaatatga

SEQ ID NO: 2703321 - DNA, 21 bp, Homo sapiens
aactaaggaaccctggaaact

SEQ ID NO: 2703322 - DNA, 15 bp, Homo sapiens
aactaaggatttttc

SEQ ID NO: 2703323 - DNA, 20 bp, Homo sapiens
aactaaggtacggtgagact

SEQ ID NO: 2703324 - DNA, 22 bp, Homo sapiens
aactaccagtgggcatgtatta

SEQ ID NO: 2703325 - DNA, 22 bp, Homo sapiens
aactactcagctctcctgctgc

SEQ ID NO: 2703326 - DNA, 23 bp, Homo sapiens
aactatgccgtgtagtttctggt

SEQ ID NO: 2703327 - DNA, 21 bp, Homo sapiens
aactatgtaatgcttatgtgt

SEQ ID NO: 2703328 - DNA, 19 bp, Homo sapiens
aactcatgactgagtctgg

SEQ ID NO: 2703329 - DNA, 16 bp, Homo sapiens
aactccccagggcctc

SEQ ID NO: 2703330 - DNA, 15 bp, Homo sapiens
aactccgtttccaaa

SEQ ID NO: 2703331 - DNA, 15 bp, Homo sapiens
aactcctactgcttc

SEQ ID NO: 2703332 - DNA, 22 bp, Homo sapiens
aactcctactgcttcctctgaa

SEQ ID NO: 2703333 - DNA, 13 bp, Homo sapiens
aactcctgttctt

SEQ ID NO: 2703334 - DNA, 22 bp, Homo sapiens
aactctaccctggtaggaaagc

SEQ ID NO: 2703335 - DNA, 15 bp, Homo sapiens
aactctgattttgat

SEQ ID NO: 2703336 - DNA, 23 bp, Homo sapiens
aactctgcaactgaatacttgaa

SEQ ID NO: 2703337 - DNA, 20 bp, Homo sapiens
aactcttggccagagctgag

SEQ ID NO: 2703338 - DNA, 19 bp, Homo sapiens
ccactgtttcatgagccca

SEQ ID NO: 2703339 - DNA, 17 bp, Homo sapiens
ccacttcaagtgaccac

SEQ ID NO: 2703340 - DNA, 16 bp, Homo sapiens
ccacttcatgcccact

SEQ ID NO: 2703341 - DNA, 19 bp, Homo sapiens
ccacttcatgcccactgcc

SEQ ID NO: 2703342 - DNA, 13 bp, Homo sapiens
ccacttcccctcc

SEQ ID NO: 2703343 - DNA, 19 bp, Homo sapiens
ccacttcccctcctacccc

SEQ ID NO: 2703344 - DNA, 15 bp, Homo sapiens
ccacttccctgacac

SEQ ID NO: 2703345 - DNA, 16 bp, Homo sapiens
ccacttccctgctttt

SEQ ID NO: 2703346 - DNA, 16 bp, Homo sapiens
ccacttttattcattt

SEQ ID NO: 2703347 - DNA, 17 bp, Homo sapiens
ccactttttttttttct

SEQ ID NO: 2703348 - DNA, 19 bp, Homo sapiens
ccactttttttttttctgc

SEQ ID NO: 2703349 - DNA, 20 bp, Homo sapiens
ccactttttttttttctgcc

SEQ ID NO: 2703350 - DNA, 19 bp, Homo sapiens
ccagaaggctgggtccagg

SEQ ID NO: 2703351 - DNA, 17 bp, Homo sapiens
ccagaatgtgctgcctt

SEQ ID NO: 2703352 - DNA, 18 bp, Homo sapiens
ccagaatgtgctgccttt

SEQ ID NO: 2703353 - DNA, 16 bp, Homo sapiens
ccagacagctggaccc

SEQ ID NO: 2703354 - DNA, 14 bp, Homo sapiens
ccagaccattgtct

SEQ ID NO: 2703355 - DNA, 22 bp, Homo sapiens
ccagaccattgtcttccaaccc

SEQ ID NO: 2703356 - DNA, 21 bp, Homo sapiens
ccagacctctgaatgtcccag

SEQ ID NO: 2703357 - DNA, 15 bp, Homo sapiens
ccagactgcggagca

SEQ ID NO: 2703358 - DNA, 19 bp, Homo sapiens
ccagactgcggagcagcct

SEQ ID NO: 2703359 - DNA, 19 bp, Homo sapiens
ccagagacctttgcccaca

SEQ ID NO: 2703360 - DNA, 14 bp, Homo sapiens
ccagagcaggggct

SEQ ID NO: 2703361 - DNA, 17 bp, Homo sapiens
ccagagcaggggctgct

SEQ ID NO: 2703362 - DNA, 23 bp, Homo sapiens
ccagagcaggggctgctgggggc

SEQ ID NO: 2703363 - DNA, 17 bp, Homo sapiens
ccagagccactaccttt

SEQ ID NO: 2703364 - DNA, 23 bp, Homo sapiens
ccagagcgaggaaaggattttac

SEQ ID NO: 2703365 - DNA, 13 bp, Homo sapiens
ccagagctgcctc

SEQ ID NO: 2703366 - DNA, 16 bp, Homo sapiens
ccagagctgcctcccc

SEQ ID NO: 2703367 - DNA, 20 bp, Homo sapiens
ccagagctgcctccccaatc

SEQ ID NO: 2703368 - DNA, 19 bp, Homo sapiens
ccagagttcttgcaccctc

SEQ ID NO: 2703369 - DNA, 11 bp, Homo sapiens
ccagatgctgg

SEQ ID NO: 2703370 - DNA, 17 bp, Homo sapiens
ccagcaagcagtgccct

SEQ ID NO: 2703371 - DNA, 16 bp, Homo sapiens
ccagcacagctcctcc

SEQ ID NO: 2703372 - DNA, 17 bp, Homo sapiens
ccagcacagctcctccc

SEQ ID NO: 2703373 - DNA, 22 bp, Homo sapiens
ccagcacagctcctcccctgcc

SEQ ID NO: 2703374 - DNA, 14 bp, Homo sapiens
ccagcacccgggct

SEQ ID NO: 2703375 - DNA, 20 bp, Homo sapiens
ccagcacccgggctcaggga

SEQ ID NO: 2703376 - DNA, 21 bp, Homo sapiens
ccagcactttgggaggctgag

SEQ ID NO: 2703377 - DNA, 16 bp, Homo sapiens
ccagcaggcagcgcct

SEQ ID NO: 2703378 - DNA, 21 bp, Homo sapiens
ccagcaggcagcgcctgtccc

SEQ ID NO: 2703379 - DNA, 22 bp, Homo sapiens
ccagcaggcagcgcctgtcccc

SEQ ID NO: 2703380 - DNA, 15 bp, Homo sapiens
ccagcattacgatcc

SEQ ID NO: 2703381 - DNA, 13 bp, Homo sapiens
ccagccactgcag

SEQ ID NO: 2703382 - DNA, 15 bp, Homo sapiens
ccagccactgcagca

SEQ ID NO: 2703383 - DNA, 16 bp, Homo sapiens
ccagccagctcctgca

SEQ ID NO: 2703384 - DNA, 17 bp, Homo sapiens
ccagccaggactcctta

SEQ ID NO: 2703385 - DNA, 14 bp, Homo sapiens
ccagccgctgcccg

SEQ ID NO: 2703386 - DNA, 11 bp, Homo sapiens
ccagcctgagc

SEQ ID NO: 2703387 - DNA, 10 bp, Homo sapiens
ccagcctggc

SEQ ID NO: 2703388 - DNA, 12 bp, Homo sapiens
ccagcctggccc

SEQ ID NO: 2703389 - DNA, 18 bp, Homo sapiens
ccagcctggcccagctcc

SEQ ID NO: 2703390 - DNA, 19 bp, Homo sapiens
ccagcctggcccagctccc

SEQ ID NO: 2703391 - DNA, 19 bp, Homo sapiens
ccagcctggcttctggagc

SEQ ID NO: 2703392 - DNA, 14 bp, Homo sapiens
ccagcctgtcctgg

SEQ ID NO: 2703393 - DNA, 20 bp, Homo sapiens
ccagcctgtcgtgtccagcc

SEQ ID NO: 2703394 - DNA, 17 bp, Homo sapiens
ccagctactcagaagcc

SEQ ID NO: 2703395 - DNA, 20 bp, Homo sapiens
ccagctactcagaagcctga

SEQ ID NO: 2703396 - DNA, 21 bp, Homo sapiens
ccagctactcagaagcctgag

SEQ ID NO: 2703397 - DNA, 20 bp, Homo sapiens
ccagctagggctggactctg

SEQ ID NO: 2703398 - DNA, 23 bp, Homo sapiens
ccagctattcaggaggctgaggc

SEQ ID NO: 2703399 - DNA, 12 bp, Homo sapiens
catctggaggct

SEQ ID NO: 2703400 - DNA, 13 bp, Homo sapiens
catctggaggctg

SEQ ID NO: 2703401 - DNA, 15 bp, Homo sapiens
catctggaggctgcg

SEQ ID NO: 2703402 - DNA, 15 bp, Homo sapiens
catctgtgcctgtct

SEQ ID NO: 2703403 - DNA, 21 bp, Homo sapiens
catcttatgctaactgtagat

SEQ ID NO: 2703404 - DNA, 20 bp, Homo sapiens
catgaaaaacacggcagctg

SEQ ID NO: 2703405 - DNA, 13 bp, Homo sapiens
catgaaaacattg

SEQ ID NO: 2703406 - DNA, 12 bp, Homo sapiens
catgaagaagct

SEQ ID NO: 2703407 - DNA, 16 bp, Homo sapiens
catgaagacaggacag

SEQ ID NO: 2703408 - DNA, 22 bp, Homo sapiens
catgactgagtctggcaaacat

SEQ ID NO: 2703409 - DNA, 16 bp, Homo sapiens
catgagcaattctcct

SEQ ID NO: 2703410 - DNA, 14 bp, Homo sapiens
catgatactttaat

SEQ ID NO: 2703411 - DNA, 16 bp, Homo sapiens
catgatactttaattt

SEQ ID NO: 2703412 - DNA, 19 bp, Homo sapiens
catgatttagggaagcagg

SEQ ID NO: 2703413 - DNA, 20 bp, Homo sapiens
catgatttagggaagcaggg

SEQ ID NO: 2703414 - DNA, 22 bp, Homo sapiens
catgcaagacttcactgcagcc

SEQ ID NO: 2703415 - DNA, 13 bp, Homo sapiens
catgcaggtctcc

SEQ ID NO: 2703416 - DNA, 17 bp, Homo sapiens
catgcaggtctccatga

SEQ ID NO: 2703417 - DNA, 18 bp, Homo sapiens
catgcaggtctccatgaa

SEQ ID NO: 2703418 - DNA, 21 bp, Homo sapiens
catgcaggtctccatgaagaa

SEQ ID NO: 2703419 - DNA, 19 bp, Homo sapiens
catgcattctagtgcagaa

SEQ ID NO: 2703420 - DNA, 13 bp, Homo sapiens
catgcccactgcc

SEQ ID NO: 2703421 - DNA, 22 bp, Homo sapiens
catgcccagtcgatatctcact

SEQ ID NO: 2703422 - DNA, 17 bp, Homo sapiens
catgccccctcgtgcca

SEQ ID NO: 2703423 - DNA, 20 bp, Homo sapiens
catgcctcagccagccctgg

SEQ ID NO: 2703424 - DNA, 21 bp, Homo sapiens
catgcctcagccagccctgga

SEQ ID NO: 2703425 - DNA, 16 bp, Homo sapiens
catgctctccccacag

SEQ ID NO: 2703426 - DNA, 23 bp, Homo sapiens
catgctggcggcgcagagggaag

SEQ ID NO: 2703427 - DNA, 20 bp, Homo sapiens
catgctggggcaagtccctg

SEQ ID NO: 2703428 - DNA, 20 bp, Homo sapiens
catgctttcctaaagtctct

SEQ ID NO: 2703429 - DNA, 13 bp, Homo sapiens
catgctttctcct

SEQ ID NO: 2703430 - DNA, 19 bp, Homo sapiens
catggaatttgtaagttta

SEQ ID NO: 2703431 - DNA, 15 bp, Homo sapiens
catggatgagagtcc

SEQ ID NO: 2703432 - DNA, 13 bp, Homo sapiens
catggcagctggg

SEQ ID NO: 2703433 - DNA, 17 bp, Homo sapiens
catggcagctgggccca

SEQ ID NO: 2703434 - DNA, 22 bp, Homo sapiens
catggcagctgggcccacagcc

SEQ ID NO: 2703435 - DNA, 15 bp, Homo sapiens
catggcccgggcctt

SEQ ID NO: 2703436 - DNA, 14 bp, Homo sapiens
catggcgtgtccct

SEQ ID NO: 2703437 - DNA, 18 bp, Homo sapiens
catggctgggggagggac

SEQ ID NO: 2703438 - DNA, 23 bp, Homo sapiens
catggctgggggagggactgctg

SEQ ID NO: 2703439 - DNA, 13 bp, Homo sapiens
catgggcactgct

SEQ ID NO: 2703440 - DNA, 14 bp, Homo sapiens
catgggcactgctg

SEQ ID NO: 2703441 - DNA, 18 bp, Homo sapiens
catgggcactgctgggtg

SEQ ID NO: 2703442 - DNA, 19 bp, Homo sapiens
catgggcactgctgggtgg

SEQ ID NO: 2703443 - DNA, 23 bp, Homo sapiens
catgggcactgctgggtggccca

SEQ ID NO: 2703444 - DNA, 20 bp, Homo sapiens
catgggtcctcggcccatct

SEQ ID NO: 2703445 - DNA, 23 bp, Homo sapiens
catgggtcctcggcccatctgtc

SEQ ID NO: 2703446 - DNA, 18 bp, Homo sapiens
catgtaaaatcttcagct

SEQ ID NO: 2703447 - DNA, 23 bp, Homo sapiens
catgtaaaatcttcagctggtgg

SEQ ID NO: 2703448 - DNA, 16 bp, Homo sapiens
catgtaaattttgtat

SEQ ID NO: 2703449 - DNA, 19 bp, Homo sapiens
catgtactgtacttcccaa

SEQ ID NO: 2703450 - DNA, 21 bp, Homo sapiens
catgtatgtggatacagtcat

SEQ ID NO: 2703451 - DNA, 19 bp, Homo sapiens
catgtccaagtccaacctg

SEQ ID NO: 2703452 - DNA, 22 bp, Homo sapiens
catgtccaagtccaacctgcct

SEQ ID NO: 2703453 - DNA, 24 bp, Homo sapiens
catgtccaagtccaacctgcctgt

SEQ ID NO: 2703454 - DNA, 20 bp, Homo sapiens
catgtctttggcttcagaat

SEQ ID NO: 2703455 - DNA, 17 bp, Homo sapiens
catgtgattatggacat

SEQ ID NO: 2703456 - DNA, 19 bp, Homo sapiens
catgtgcaactcttgtatt

SEQ ID NO: 2703457 - DNA, 20 bp, Homo sapiens
catgtgcacctatggcccag

SEQ ID NO: 2703458 - DNA, 21 bp, Homo sapiens
catgtgcatggaaatgtcctc

SEQ ID NO: 2703459 - DNA, 17 bp, Homo sapiens
catgtgctgctgtggca

SEQ ID NO: 2703460 - DNA, 22 bp, Homo sapiens
catgtggcattctctctgctca

SEQ ID NO: 2703461 - DNA, 14 bp, Homo sapiens
catgtggggaagca

SEQ ID NO: 2703462 - DNA, 21 bp, Homo sapiens
catgtgggttgtgatattgac

SEQ ID NO: 2703463 - DNA, 14 bp, Homo sapiens
catgtgttccaagg

SEQ ID NO: 2703464 - DNA, 14 bp, Homo sapiens
catgttcctgttcc

SEQ ID NO: 2703465 - DNA, 12 bp, Homo sapiens
catgttttgtat

SEQ ID NO: 2703466 - DNA, 20 bp, Homo sapiens
cattaaaatagcacatgatt

SEQ ID NO: 2703467 - DNA, 22 bp, Homo sapiens
cattaagcgggatcccagcatc

SEQ ID NO: 2703468 - DNA, 14 bp, Homo sapiens
cattaatattcttt

SEQ ID NO: 2703469 - DNA, 20 bp, Homo sapiens
cattactgtatgtataaatt

SEQ ID NO: 2703470 - DNA, 23 bp, Homo sapiens
cattagtgaattacactcaagga

SEQ ID NO: 2703471 - DNA, 20 bp, Homo sapiens
cattatattcctctaaaact

SEQ ID NO: 2703472 - DNA, 16 bp, Homo sapiens
cattatgttagagagg

SEQ ID NO: 2703473 - DNA, 20 bp, Homo sapiens
cattatgttagagaggtagc

SEQ ID NO: 2703474 - DNA, 21 bp, Homo sapiens
cattattattactttttaaaa

SEQ ID NO: 2703475 - DNA, 17 bp, Homo sapiens
cattatttgataacatt

SEQ ID NO: 2703476 - DNA, 14 bp, Homo sapiens
cattattttacagt

SEQ ID NO: 2703477 - DNA, 20 bp, Homo sapiens
cattatttttgttagcaaag

SEQ ID NO: 2703478 - DNA, 21 bp, Homo sapiens
ccaaattgtctgtctgctctt

SEQ ID NO: 2703479 - DNA, 15 bp, Homo sapiens
ccaacaataaagagc

SEQ ID NO: 2703480 - DNA, 15 bp, Homo sapiens
ccaacccagcctgag

SEQ ID NO: 2703481 - DNA, 13 bp, Homo sapiens
ccaaccccagctg

SEQ ID NO: 2703482 - DNA, 15 bp, Homo sapiens
ccaaccccagctggc

SEQ ID NO: 2703483 - DNA, 16 bp, Homo sapiens
ccaaccccagctggcc

SEQ ID NO: 2703484 - DNA, 13 bp, Homo sapiens
ccaacccccagca

SEQ ID NO: 2703485 - DNA, 14 bp, Homo sapiens
ccaacccccagcac

SEQ ID NO: 2703486 - DNA, 18 bp, Homo sapiens
ccaacctgcctgtgcatg

SEQ ID NO: 2703487 - DNA, 15 bp, Homo sapiens
ccaacggcaacagca

SEQ ID NO: 2703488 - DNA, 23 bp, Homo sapiens
ccaactacacacccccaagccac

SEQ ID NO: 2703489 - DNA, 15 bp, Homo sapiens
ccaagccaccgcagc

SEQ ID NO: 2703490 - DNA, 18 bp, Homo sapiens
ccaagccaccgcagctgc

SEQ ID NO: 2703491 - DNA, 19 bp, Homo sapiens
ccaagccaccgcagctgct

SEQ ID NO: 2703492 - DNA, 14 bp, Homo sapiens
ccaagctgtgccac

SEQ ID NO: 2703493 - DNA, 16 bp, Homo sapiens
ccaagctgtgccaccc

SEQ ID NO: 2703494 - DNA, 18 bp, Homo sapiens
ccaagctgtgccaccctg

SEQ ID NO: 2703495 - DNA, 13 bp, Homo sapiens
ccaaggcagttct

SEQ ID NO: 2703496 - DNA, 15 bp, Homo sapiens
ccaaggtctcacact

SEQ ID NO: 2703497 - DNA, 23 bp, Homo sapiens
ccaaggtctcacactcctcctgc

SEQ ID NO: 2703498 - DNA, 17 bp, Homo sapiens
ccaaggtgggctgagcc

SEQ ID NO: 2703499 - DNA, 23 bp, Homo sapiens
ccaaggtgggctgagccctggca

SEQ ID NO: 2703500 - DNA, 13 bp, Homo sapiens
ccaaggtggtctg

SEQ ID NO: 2703501 - DNA, 15 bp, Homo sapiens
ccaaggtttcccagt

SEQ ID NO: 2703502 - DNA, 23 bp, Homo sapiens
ccaaggtttcccagtgagcctct

SEQ ID NO: 2703503 - DNA, 17 bp, Homo sapiens
ccaagtcaacactcttc

SEQ ID NO: 2703504 - DNA, 18 bp, Homo sapiens
ccaagtcaacactcttct

SEQ ID NO: 2703505 - DNA, 19 bp, Homo sapiens
ccaagtccaacctgcctgt

SEQ ID NO: 2703506 - DNA, 19 bp, Homo sapiens
ccaagtgtcctggaccctg

SEQ ID NO: 2703507 - DNA, 18 bp, Homo sapiens
ccaagtgtggaattggag

SEQ ID NO: 2703508 - DNA, 12 bp, Homo sapiens
ccaatccaggcc

SEQ ID NO: 2703509 - DNA, 13 bp, Homo sapiens
ccaatccaggccc

SEQ ID NO: 2703510 - DNA, 17 bp, Homo sapiens
ccaatccatttggcaga

SEQ ID NO: 2703511 - DNA, 18 bp, Homo sapiens
ccaatcccccagcgctta

SEQ ID NO: 2703512 - DNA, 16 bp, Homo sapiens
ccaattcacctcgtta

SEQ ID NO: 2703513 - DNA, 14 bp, Homo sapiens
ccacaaatgctatt

SEQ ID NO: 2703514 - DNA, 15 bp, Homo sapiens
ccacaaatgctattc

SEQ ID NO: 2703515 - DNA, 12 bp, Homo sapiens
ccacacacactc

SEQ ID NO: 2703516 - DNA, 14 bp, Homo sapiens
ccacacacactcct

SEQ ID NO: 2703517 - DNA, 15 bp, Homo sapiens
ccacacacactcctt

SEQ ID NO: 2703518 - DNA, 18 bp, Homo sapiens
ccacacacactccttccc

SEQ ID NO: 2703519 - DNA, 13 bp, Homo sapiens
ccacaccaagctg

SEQ ID NO: 2703520 - DNA, 14 bp, Homo sapiens
ccacaccctgcctg

SEQ ID NO: 2703521 - DNA, 17 bp, Homo sapiens
ccacaccctgcctgctg

SEQ ID NO: 2703522 - DNA, 20 bp, Homo sapiens
ccacagcaaggcacctgcag

SEQ ID NO: 2703523 - DNA, 14 bp, Homo sapiens
ccacagcccacgtc

SEQ ID NO: 2703524 - DNA, 21 bp, Homo sapiens
ccacagcccacgtcctgtcag

SEQ ID NO: 2703525 - DNA, 16 bp, Homo sapiens
ccacagcccccacccc

SEQ ID NO: 2703526 - DNA, 19 bp, Homo sapiens
ccacagcccccaccccagc

SEQ ID NO: 2703527 - DNA, 18 bp, Homo sapiens
ccacagctctgctggaag

SEQ ID NO: 2703528 - DNA, 16 bp, Homo sapiens
ccacaggggggaggca

SEQ ID NO: 2703529 - DNA, 18 bp, Homo sapiens
ccacagtcctcacagcct

SEQ ID NO: 2703530 - DNA, 21 bp, Homo sapiens
ccacagtgactcgggctcctg

SEQ ID NO: 2703531 - DNA, 21 bp, Homo sapiens
ccacagtgttggcgagaggag

SEQ ID NO: 2703532 - DNA, 11 bp, Homo sapiens
ccacataaagg

SEQ ID NO: 2703533 - DNA, 19 bp, Homo sapiens
ccacatagctcataagctg

SEQ ID NO: 2703534 - DNA, 21 bp, Homo sapiens
ccacatcatctttatctcctg

SEQ ID NO: 2703535 - DNA, 22 bp, Homo sapiens
ccacatcatctttatctcctgg

SEQ ID NO: 2703536 - DNA, 19 bp, Homo sapiens
ccacattctgtctctgctt

SEQ ID NO: 2703537 - DNA, 23 bp, Homo sapiens
ccacatttctggccatttaacta

SEQ ID NO: 2703538 - DNA, 20 bp, Homo sapiens
ccaccaaggtctcacactcc

SEQ ID NO: 2703539 - DNA, 19 bp, Homo sapiens
ccaccacccaacctgtcct

SEQ ID NO: 2703540 - DNA, 14 bp, Homo sapiens
ccaccagagcaggg

SEQ ID NO: 2703541 - DNA, 15 bp, Homo sapiens
ccaccagagcagggg

SEQ ID NO: 2703542 - DNA, 18 bp, Homo sapiens
ccaccagagcaggggctg

SEQ ID NO: 2703543 - DNA, 19 bp, Homo sapiens
ccaccagagcaggggctgc

SEQ ID NO: 2703544 - DNA, 21 bp, Homo sapiens
ccaccagagcaggggctgctg

SEQ ID NO: 2703545 - DNA, 16 bp, Homo sapiens
ccaccatgccaggcta

SEQ ID NO: 2703546 - DNA, 15 bp, Homo sapiens
ccacccaacctgtcc

SEQ ID NO: 2703547 - DNA, 15 bp, Homo sapiens
ccacccactgtccgc

SEQ ID NO: 2703548 - DNA, 13 bp, Homo sapiens
ccaccccaccctg

SEQ ID NO: 2703549 - DNA, 16 bp, Homo sapiens
ccaccccagcacagct

SEQ ID NO: 2703550 - DNA, 18 bp, Homo sapiens
ccaccccagcacagctcc

SEQ ID NO: 2703551 - DNA, 17 bp, Homo sapiens
cctctgtgtcactggct

SEQ ID NO: 2703552 - DNA, 12 bp, Homo sapiens
cctcttgcccca

SEQ ID NO: 2703553 - DNA, 15 bp, Homo sapiens
cctcttggcacctgc

SEQ ID NO: 2703554 - DNA, 17 bp, Homo sapiens
cctcttggcacctgcct

SEQ ID NO: 2703555 - DNA, 21 bp, Homo sapiens
cctcttggcacctgcctagct

SEQ ID NO: 2703556 - DNA, 15 bp, Homo sapiens
cctgaaccgtgtgct

SEQ ID NO: 2703557 - DNA, 16 bp, Homo sapiens
cctgaactctgcaact

SEQ ID NO: 2703558 - DNA, 14 bp, Homo sapiens
cctgaactggccac

SEQ ID NO: 2703559 - DNA, 14 bp, Homo sapiens
cctgaagtgtcgag

SEQ ID NO: 2703560 - DNA, 22 bp, Homo sapiens
cctgacactgcggggcttggct

SEQ ID NO: 2703561 - DNA, 20 bp, Homo sapiens
cctgacccggattggccctg

SEQ ID NO: 2703562 - DNA, 22 bp, Homo sapiens
cctgacccggattggccctgcc

SEQ ID NO: 2703563 - DNA, 22 bp, Homo sapiens
cctgacctccagtcctgctggc

SEQ ID NO: 2703564 - DNA, 18 bp, Homo sapiens
cctgaccttctccaggga

SEQ ID NO: 2703565 - DNA, 21 bp, Homo sapiens
cctgaccttctccagggacag

SEQ ID NO: 2703566 - DNA, 20 bp, Homo sapiens
cctgacttcaggggctgccc

SEQ ID NO: 2703567 - DNA, 11 bp, Homo sapiens
cctgagcctca

SEQ ID NO: 2703568 - DNA, 12 bp, Homo sapiens
cctgagcctcac

SEQ ID NO: 2703569 - DNA, 22 bp, Homo sapiens
cctgagctcgtgatctgcccgc

SEQ ID NO: 2703570 - DNA, 17 bp, Homo sapiens
cctgagctgtcccctgg

SEQ ID NO: 2703571 - DNA, 17 bp, Homo sapiens
cctgaggagtgtcctgt

SEQ ID NO: 2703572 - DNA, 20 bp, Homo sapiens
cctgaggatcccctgtcccc

SEQ ID NO: 2703573 - DNA, 14 bp, Homo sapiens
cctgaggctgagac

SEQ ID NO: 2703574 - DNA, 15 bp, Homo sapiens
cctgaggctggcatc

SEQ ID NO: 2703575 - DNA, 23 bp, Homo sapiens
cctgaggctggcatcctggctgg

SEQ ID NO: 2703576 - DNA, 24 bp, Homo sapiens
cctgaggctggcatcctggctggc

SEQ ID NO: 2703577 - DNA, 16 bp, Homo sapiens
cctgaggtctcgctga

SEQ ID NO: 2703578 - DNA, 15 bp, Homo sapiens
cctgagtagcagtga

SEQ ID NO: 2703579 - DNA, 18 bp, Homo sapiens
cctgagtcacccatgaag

SEQ ID NO: 2703580 - DNA, 23 bp, Homo sapiens
cctgagtcacccctctgtccagc

SEQ ID NO: 2703581 - DNA, 23 bp, Homo sapiens
cctgagtctgctatattttcatg

SEQ ID NO: 2703582 - DNA, 23 bp, Homo sapiens
cctgagttgcaccattctttctt

SEQ ID NO: 2703583 - DNA, 15 bp, Homo sapiens
cctgcaaaccttttt

SEQ ID NO: 2703584 - DNA, 12 bp, Homo sapiens
cctgcactgtcc

SEQ ID NO: 2703585 - DNA, 18 bp, Homo sapiens
cctgcagcctgaccccag

SEQ ID NO: 2703586 - DNA, 19 bp, Homo sapiens
cctgcagcctgaccccagg

SEQ ID NO: 2703587 - DNA, 16 bp, Homo sapiens
cctgcaggccaagagc

SEQ ID NO: 2703588 - DNA, 15 bp, Homo sapiens
cctgccagcctggct

SEQ ID NO: 2703589 - DNA, 21 bp, Homo sapiens
cctgccagcctggcttctgga

SEQ ID NO: 2703590 - DNA, 13 bp, Homo sapiens
cctgccagctctg

SEQ ID NO: 2703591 - DNA, 13 bp, Homo sapiens
cctgccccctggt

SEQ ID NO: 2703592 - DNA, 14 bp, Homo sapiens
cctgccccctggtg

SEQ ID NO: 2703593 - DNA, 15 bp, Homo sapiens
cctgccccctggtgg

SEQ ID NO: 2703594 - DNA, 14 bp, Homo sapiens
cctgcccctccccc

SEQ ID NO: 2703595 - DNA, 16 bp, Homo sapiens
cctgccgcctcccggg

SEQ ID NO: 2703596 - DNA, 17 bp, Homo sapiens
cctgccgcctcccggga

SEQ ID NO: 2703597 - DNA, 16 bp, Homo sapiens
cctgcctagctcttgg

SEQ ID NO: 2703598 - DNA, 16 bp, Homo sapiens
cctgcctcagcctcct

SEQ ID NO: 2703599 - DNA, 17 bp, Homo sapiens
cctgcctcagcctcctg

SEQ ID NO: 2703600 - DNA, 23 bp, Homo sapiens
cctgcctgctgtggagcccattg

SEQ ID NO: 2703601 - DNA, 13 bp, Homo sapiens
cctgcctgttctc

SEQ ID NO: 2703602 - DNA, 17 bp, Homo sapiens
cctgccttgaagccact

SEQ ID NO: 2703603 - DNA, 15 bp, Homo sapiens
cctgcgaaggggccc

SEQ ID NO: 2703604 - DNA, 17 bp, Homo sapiens
cctgcgaaggggccctg

SEQ ID NO: 2703605 - DNA, 20 bp, Homo sapiens
cctgcgaaggggccctggtc

SEQ ID NO: 2703606 - DNA, 22 bp, Homo sapiens
cctgcgctaacactgtcctgtc

SEQ ID NO: 2703607 - DNA, 16 bp, Homo sapiens
  misc_feature (6)..(6): n is a, c, g or t
cctgcnttgtccctgg

SEQ ID NO: 2703608 - DNA, 13 bp, Homo sapiens
cctgctcattgtg

SEQ ID NO: 2703609 - DNA, 12 bp, Homo sapiens
cctgctccacag

SEQ ID NO: 2703610 - DNA, 16 bp, Homo sapiens
cctgctgcaccaaccc

SEQ ID NO: 2703611 - DNA, 23 bp, Homo sapiens
cctgctgcagaggggcaggccct

SEQ ID NO: 2703612 - DNA, 20 bp, Homo sapiens
cctgctggaaaccacacttc

SEQ ID NO: 2703613 - DNA, 22 bp, Homo sapiens
cctgctggaaaccacacttctt

SEQ ID NO: 2703614 - DNA, 19 bp, Homo sapiens
cctgctgtcccctcttgcc

SEQ ID NO: 2703615 - DNA, 22 bp, Homo sapiens
cctgctgtcccctcttgcccca

SEQ ID NO: 2703616 - DNA, 16 bp, Homo sapiens
cctgctgtggagccca

SEQ ID NO: 2703617 - DNA, 16 bp, Homo sapiens
cctgcttttctcccag

SEQ ID NO: 2703618 - DNA, 18 bp, Homo sapiens
cctgcttttctcccagaa

SEQ ID NO: 2703619 - DNA, 20 bp, Homo sapiens
cctggaaaggctcagtctca

SEQ ID NO: 2703620 - DNA, 14 bp, Homo sapiens
cctggaacctttcc

SEQ ID NO: 2703621 - DNA, 12 bp, Homo sapiens
cctggaatgaag

SEQ ID NO: 2703622 - DNA, 16 bp, Homo sapiens
cctggacatattccca

SEQ ID NO: 2703623 - DNA, 15 bp, Homo sapiens
cctggactagggcct

SEQ ID NO: 2703624 - DNA, 13 bp, Homo sapiens
cctggagcagggg

SEQ ID NO: 2703625 - DNA, 15 bp, Homo sapiens
cctggagcaggggtg

SEQ ID NO: 2703626 - DNA, 16 bp, Homo sapiens
cctggagcatcccagg

SEQ ID NO: 2703627 - DNA, 17 bp, Homo sapiens
cctggagcatcccaggc

SEQ ID NO: 2703628 - DNA, 21 bp, Homo sapiens
cctggagctgccagcaccaag

SEQ ID NO: 2703629 - DNA, 17 bp, Homo sapiens
cctggcatgacactcta

SEQ ID NO: 2703630 - DNA, 14 bp, Homo sapiens
cctggccagggcct

SEQ ID NO: 2703631 - DNA, 15 bp, Homo sapiens
cctggccagggcctc

SEQ ID NO: 2703632 - DNA, 12 bp, Homo sapiens
cctggcccagct

SEQ ID NO: 2703633 - DNA, 13 bp, Homo sapiens
cctggcccagctc

SEQ ID NO: 2703634 - DNA, 17 bp, Homo sapiens
cctggcccatcagtgta

SEQ ID NO: 2703635 - DNA, 20 bp, Homo sapiens
cctggcccatcagtgtaccc

SEQ ID NO: 2703636 - DNA, 16 bp, Homo sapiens
cctggccccttctcca

SEQ ID NO: 2703637 - DNA, 18 bp, Homo sapiens
cctggccccttctccagc

SEQ ID NO: 2703638 - DNA, 21 bp, Homo sapiens
cctggccccttctccagcaag

SEQ ID NO: 2703639 - DNA, 16 bp, Homo sapiens
cctggcctgaggtctc

SEQ ID NO: 2703640 - DNA, 13 bp, Homo sapiens
cctggctctgcca

SEQ ID NO: 2703641 - DNA, 13 bp, Homo sapiens
cctggctggctgt

SEQ ID NO: 2703642 - DNA, 20 bp, Homo sapiens
cctggctggctgtgtcctct

SEQ ID NO: 2703643 - DNA, 14 bp, Homo sapiens
cctggcttctggag

SEQ ID NO: 2703644 - DNA, 15 bp, Homo sapiens
cctggcttctggagc

SEQ ID NO: 2703645 - DNA, 22 bp, Homo sapiens
cctggcttctggagcccttggg

SEQ ID NO: 2703646 - DNA, 23 bp, Homo sapiens
cctggcttctggagcccttgggt

SEQ ID NO: 2703647 - DNA, 18 bp, Homo sapiens
cctgggcaatgcagtgca

SEQ ID NO: 2703648 - DNA, 12 bp, Homo sapiens
cctgggccccca

SEQ ID NO: 2703649 - DNA, 23 bp, Homo sapiens
cctgggcccccagagacctttgc

SEQ ID NO: 2703650 - DNA, 12 bp, Homo sapiens
cctgggctctgt

SEQ ID NO: 2703651 - DNA, 20 bp, Homo sapiens
cctggggccacatagctcat

SEQ ID NO: 2703652 - DNA, 15 bp, Homo sapiens
cctggggctctgtgc

SEQ ID NO: 2703653 - DNA, 14 bp, Homo sapiens
cctggggctggtgg

SEQ ID NO: 2703654 - DNA, 18 bp, Homo sapiens
cctggggtctctgctgca

SEQ ID NO: 2703655 - DNA, 23 bp, Homo sapiens
cctgggtggtatagggcgtttgg

SEQ ID NO: 2703656 - DNA, 15 bp, Homo sapiens
cctgggtttggcccc

SEQ ID NO: 2703657 - DNA, 16 bp, Homo sapiens
cctgggtttggcccct

SEQ ID NO: 2703658 - DNA, 18 bp, Homo sapiens
cctgggtttggcccctgg

SEQ ID NO: 2703659 - DNA, 16 bp, Homo sapiens
cctggtacagcagggt

SEQ ID NO: 2703660 - DNA, 14 bp, Homo sapiens
cctggtgacccctt

SEQ ID NO: 2703661 - DNA, 17 bp, Homo sapiens
cctggtgaggcccagcc

SEQ ID NO: 2703662 - DNA, 18 bp, Homo sapiens
cctggtgaggcccagcct

SEQ ID NO: 2703663 - DNA, 20 bp, Homo sapiens
cctggtgaggcccagcctgt

SEQ ID NO: 2703664 - DNA, 12 bp, Homo sapiens
cctggtggacag

SEQ ID NO: 2703665 - DNA, 14 bp, Homo sapiens
cctgtaatcccagc

SEQ ID NO: 2703666 - DNA, 17 bp, Homo sapiens
cctgtaatcccagctat

SEQ ID NO: 2703667 - DNA, 13 bp, Homo sapiens
cctgtactcagga

SEQ ID NO: 2703668 - DNA, 15 bp, Homo sapiens
cctgtactcaggagg

SEQ ID NO: 2703669 - DNA, 13 bp, Homo sapiens
cctgtcagtgccg

SEQ ID NO: 2703670 - DNA, 16 bp, Homo sapiens
cctgtccataaagtaa

SEQ ID NO: 2703671 - DNA, 14 bp, Homo sapiens
cctgtcccctgggg

SEQ ID NO: 2703672 - DNA, 15 bp, Homo sapiens
cctgtcccctggggc

SEQ ID NO: 2703673 - DNA, 19 bp, Homo sapiens
cctgtccctacccactctt

SEQ ID NO: 2703674 - DNA, 20 bp, Homo sapiens
cctgtccctacccactcttt

SEQ ID NO: 2703675 - DNA, 16 bp, Homo sapiens
cctgtcctggtacagc

SEQ ID NO: 2703676 - DNA, 17 bp, Homo sapiens
cctgtccttactcagag

SEQ ID NO: 2703677 - DNA, 15 bp, Homo sapiens
cctgtcgtgtccagc

SEQ ID NO: 2703678 - DNA, 13 bp, Homo sapiens
cctgtctgctggg

SEQ ID NO: 2703679 - DNA, 18 bp, Homo sapiens
cctatccttggagagcag

SEQ ID NO: 2703680 - DNA, 20 bp, Homo sapiens
cctatccttggagagcagct

SEQ ID NO: 2703681 - DNA, 16 bp, Homo sapiens
cctatggcccagccac

SEQ ID NO: 2703682 - DNA, 22 bp, Homo sapiens
cctatggcccagccactgcagc

SEQ ID NO: 2703683 - DNA, 19 bp, Homo sapiens
cctcaacgttgctccccat

SEQ ID NO: 2703684 - DNA, 15 bp, Homo sapiens
cctcaaggcctccca

SEQ ID NO: 2703685 - DNA, 18 bp, Homo sapiens
cctcaaggcctcccacag

SEQ ID NO: 2703686 - DNA, 14 bp, Homo sapiens
cctcacactccaga

SEQ ID NO: 2703687 - DNA, 13 bp, Homo sapiens
cctcacagactct

SEQ ID NO: 2703688 - DNA, 13 bp, Homo sapiens
cctcacagatgct

SEQ ID NO: 2703689 - DNA, 15 bp, Homo sapiens
cctcacagatgctgg

SEQ ID NO: 2703690 - DNA, 12 bp, Homo sapiens
cctcacagcctc

SEQ ID NO: 2703691 - DNA, 13 bp, Homo sapiens
cctcacagcctct

SEQ ID NO: 2703692 - DNA, 17 bp, Homo sapiens
cctcacagcctctccct

SEQ ID NO: 2703693 - DNA, 18 bp, Homo sapiens
cctcacagcctctccctt

SEQ ID NO: 2703694 - DNA, 13 bp, Homo sapiens
cctcaccaggggc

SEQ ID NO: 2703695 - DNA, 23 bp, Homo sapiens
cctcaccaggggcaggcacagca

SEQ ID NO: 2703696 - DNA, 17 bp, Homo sapiens
cctcactattcaagtat

SEQ ID NO: 2703697 - DNA, 14 bp, Homo sapiens
cctcagatgtgttg

SEQ ID NO: 2703698 - DNA, 16 bp, Homo sapiens
cctcagccagccctgg

SEQ ID NO: 2703699 - DNA, 21 bp, Homo sapiens
cctcagccagccctggaggct

SEQ ID NO: 2703700 - DNA, 14 bp, Homo sapiens
cctcagcctccagg

SEQ ID NO: 2703701 - DNA, 15 bp, Homo sapiens
cctcagcctcctgag

SEQ ID NO: 2703702 - DNA, 17 bp, Homo sapiens
cctcaggcttccttggc

SEQ ID NO: 2703703 - DNA, 14 bp, Homo sapiens
cctcatcctcctcc

SEQ ID NO: 2703704 - DNA, 18 bp, Homo sapiens
cctcatcgtggctgggaa

SEQ ID NO: 2703705 - DNA, 22 bp, Homo sapiens
cctcatctgctcctagcccagc

SEQ ID NO: 2703706 - DNA, 15 bp, Homo sapiens
cctcatctgtgcctg

SEQ ID NO: 2703707 - DNA, 15 bp, Homo sapiens
cctcattcagaccaa

SEQ ID NO: 2703708 - DNA, 23 bp, Homo sapiens
cctccaaacactgggctctgagg

SEQ ID NO: 2703709 - DNA, 19 bp, Homo sapiens
cctccaacaataaagagct

SEQ ID NO: 2703710 - DNA, 18 bp, Homo sapiens
cctccaagtccacagtgg

SEQ ID NO: 2703711 - DNA, 14 bp, Homo sapiens
tgctgacccaccaa

SEQ ID NO: 2703712 - DNA, 20 bp, Homo sapiens
tggccaccacccaacctgtc

SEQ ID NO: 2703713 - DNA, 22 bp, Homo sapiens
tggccaccacccaacctgtcct

SEQ ID NO: 2703714 - DNA, 11 bp, Homo sapiens
atcctgggccc

SEQ ID NO: 2703715 - DNA, 17 bp, Homo sapiens
atcctgggcccccagag

SEQ ID NO: 2703716 - DNA, 19 bp, Homo sapiens
atcctgggcccccagagac

SEQ ID NO: 2703717 - DNA, 15 bp, Homo sapiens
atcctggtttgtaat

SEQ ID NO: 2703718 - DNA, 13 bp, Homo sapiens
atccttctgcctt

SEQ ID NO: 2703719 - DNA, 15 bp, Homo sapiens
atccttggagagcag

SEQ ID NO: 2703720 - DNA, 15 bp, Homo sapiens
atcgccttatgagaa

SEQ ID NO: 2703721 - DNA, 21 bp, Homo sapiens
atcgccttatgagaacatggt

SEQ ID NO: 2703722 - DNA, 22 bp, Homo sapiens
atcgccttatgagaacatggtg

SEQ ID NO: 2703723 - DNA, 15 bp, Homo sapiens
atcggagcctcctct

SEQ ID NO: 2703724 - DNA, 16 bp, Homo sapiens
atcggagcctcctctc

SEQ ID NO: 2703725 - DNA, 13 bp, Homo sapiens
atctaaaagctgt

SEQ ID NO: 2703726 - DNA, 15 bp, Homo sapiens
atctaagctgcagct

SEQ ID NO: 2703727 - DNA, 18 bp, Homo sapiens
atctaagctgcagcttcc

SEQ ID NO: 2703728 - DNA, 19 bp, Homo sapiens
atctactagaaccttctaa

SEQ ID NO: 2703729 - DNA, 21 bp, Homo sapiens
atctagtcaataactctgatt

SEQ ID NO: 2703730 - DNA, 22 bp, Homo sapiens
atctattgtgttggctttacaa

SEQ ID NO: 2703731 - DNA, 18 bp, Homo sapiens
atctcaaaaaaaaacaaa

SEQ ID NO: 2703732 - DNA, 20 bp, Homo sapiens
atctcctcccatggccttcc

SEQ ID NO: 2703733 - DNA, 14 bp, Homo sapiens
atctcggctcactg

SEQ ID NO: 2703734 - DNA, 13 bp, Homo sapiens
atctctgagtgtc

SEQ ID NO: 2703735 - DNA, 17 bp, Homo sapiens
atctctgagtgtctctg

SEQ ID NO: 2703736 - DNA, 19 bp, Homo sapiens
atctgagaagtgtatatag

SEQ ID NO: 2703737 - DNA, 21 bp, Homo sapiens
atctgcaatgtttttgtgtag

SEQ ID NO: 2703738 - DNA, 22 bp, Homo sapiens
atctgcaatgtttttgtgtaga

SEQ ID NO: 2703739 - DNA, 14 bp, Homo sapiens
atctgcagggagca

SEQ ID NO: 2703740 - DNA, 22 bp, Homo sapiens
atctgcatgtaaaatcttcagc

SEQ ID NO: 2703741 - DNA, 12 bp, Homo sapiens
atctgcccagga

SEQ ID NO: 2703742 - DNA, 21 bp, Homo sapiens
atctgcccgcctcggcctccc

SEQ ID NO: 2703743 - DNA, 21 bp, Homo sapiens
atctgctcctagcccagcaga

SEQ ID NO: 2703744 - DNA, 14 bp, Homo sapiens
atctgcttccctgg

SEQ ID NO: 2703745 - DNA, 18 bp, Homo sapiens
atctgcttccctggggcc

SEQ ID NO: 2703746 - DNA, 13 bp, Homo sapiens
atctgtccatcct

SEQ ID NO: 2703747 - DNA, 16 bp, Homo sapiens
atctgtccatcctcct

SEQ ID NO: 2703748 - DNA, 17 bp, Homo sapiens
atctgtccatcctcctc

SEQ ID NO: 2703749 - DNA, 18 bp, Homo sapiens
atctgtccatcctcctct

SEQ ID NO: 2703750 - DNA, 19 bp, Homo sapiens
atctgtccatcctcctctc

SEQ ID NO: 2703751 - DNA, 21 bp, Homo sapiens
atctgtccatcctcctctcca

SEQ ID NO: 2703752 - DNA, 22 bp, Homo sapiens
atctgtccatcctcctctccat

SEQ ID NO: 2703753 - DNA, 20 bp, Homo sapiens
atctgtgcctgtctgtccaa

SEQ ID NO: 2703754 - DNA, 22 bp, Homo sapiens
atctgtggattcagcttctgtt

SEQ ID NO: 2703755 - DNA, 16 bp, Homo sapiens
atctgtttgcttctaa

SEQ ID NO: 2703756 - DNA, 16 bp, Homo sapiens
atcttaggatttacca

SEQ ID NO: 2703757 - DNA, 19 bp, Homo sapiens
atcttcagctggtggatgg

SEQ ID NO: 2703758 - DNA, 16 bp, Homo sapiens
atcttgaatttcatgc

SEQ ID NO: 2703759 - DNA, 13 bp, Homo sapiens
atcttgctgctaa

SEQ ID NO: 2703760 - DNA, 15 bp, Homo sapiens
atcttggctcactgc

SEQ ID NO: 2703761 - DNA, 15 bp, Homo sapiens
atcttggtttggtac

SEQ ID NO: 2703762 - DNA, 23 bp, Homo sapiens
atcttggtttggtacagttcata

SEQ ID NO: 2703763 - DNA, 12 bp, Homo sapiens
atctttaaatac

SEQ ID NO: 2703764 - DNA, 17 bp, Homo sapiens
atctttatgcaaaaaca

SEQ ID NO: 2703765 - DNA, 18 bp, Homo sapiens
atctttatgcaaaaacat

SEQ ID NO: 2703766 - DNA, 20 bp, Homo sapiens
atcttttcctcccattttag

SEQ ID NO: 2703767 - DNA, 14 bp, Homo sapiens
atgaaaagccatat

SEQ ID NO: 2703768 - DNA, 22 bp, Homo sapiens
atgaaattgtctagcagagcag

SEQ ID NO: 2703769 - DNA, 17 bp, Homo sapiens
atgaaccgtttacagtg

SEQ ID NO: 2703770 - DNA, 16 bp, Homo sapiens
atgaagacaggacagt

SEQ ID NO: 2703771 - DNA, 23 bp, Homo sapiens
atgaagcaaacacacagactctg

SEQ ID NO: 2703772 - DNA, 12 bp, Homo sapiens
atgaagcatgta

SEQ ID NO: 2703773 - DNA, 13 bp, Homo sapiens
atgaagcatgtag

SEQ ID NO: 2703774 - DNA, 22 bp, Homo sapiens
atgaagctgtataattaattgt

SEQ ID NO: 2703775 - DNA, 16 bp, Homo sapiens
atgaagggaaaattag

SEQ ID NO: 2703776 - DNA, 14 bp, Homo sapiens
atgaagtgtttcct

SEQ ID NO: 2703777 - DNA, 20 bp, Homo sapiens
atgaatacgtaaactgcgta

SEQ ID NO: 2703778 - DNA, 22 bp, Homo sapiens
atgaatgggaaagtatttttga

SEQ ID NO: 2703779 - DNA, 13 bp, Homo sapiens
atgaattgcattt

SEQ ID NO: 2703780 - DNA, 14 bp, Homo sapiens
atgaatttgactgg

SEQ ID NO: 2703781 - DNA, 15 bp, Homo sapiens
atgaatttggagact

SEQ ID NO: 2703782 - DNA, 23 bp, Homo sapiens
atgaccctgcgaaggggccctgg

SEQ ID NO: 2703783 - DNA, 23 bp, Homo sapiens
atgactgagtctggcaaacatgt

SEQ ID NO: 2703784 - DNA, 17 bp, Homo sapiens
atgactgtgattttcag

SEQ ID NO: 2703785 - DNA, 17 bp, Homo sapiens
atgagacacatacaaaa

SEQ ID NO: 2703786 - DNA, 20 bp, Homo sapiens
atgaggcacgcctgccttct

SEQ ID NO: 2703787 - DNA, 15 bp, Homo sapiens
atgaggtccctctag

SEQ ID NO: 2703788 - DNA, 22 bp, Homo sapiens
atgatgccacaccaagctgtgc

SEQ ID NO: 2703789 - DNA, 13 bp, Homo sapiens
atgatggaaagga

SEQ ID NO: 2703790 - DNA, 14 bp, Homo sapiens
atgatggaaaggaa

SEQ ID NO: 2703791 - DNA, 22 bp, Homo sapiens
atgatggaagggccttctccac

SEQ ID NO: 2703792 - DNA, 18 bp, Homo sapiens
atgatgttaaatgccttg

SEQ ID NO: 2703793 - DNA, 17 bp, Homo sapiens
atgattaaaaagaataa

SEQ ID NO: 2703794 - DNA, 22 bp, Homo sapiens
atgattccttgatggagatatt

SEQ ID NO: 2703795 - DNA, 15 bp, Homo sapiens
atgattgcactaaat

SEQ ID NO: 2703796 - DNA, 16 bp, Homo sapiens
atgattgcactaaata

SEQ ID NO: 2703797 - DNA, 14 bp, Homo sapiens
atgatttttaaaga

SEQ ID NO: 2703798 - DNA, 18 bp, Homo sapiens
atgcaaaaacatatgtct

SEQ ID NO: 2703799 - DNA, 17 bp, Homo sapiens
atgcaacaatgtgtgta

SEQ ID NO: 2703800 - DNA, 22 bp, Homo sapiens
atgcaacaatgtgtgtatgtta

SEQ ID NO: 2703801 - DNA, 23 bp, Homo sapiens
atgcaagacttcactgcagcctt

SEQ ID NO: 2703802 - DNA, 19 bp, Homo sapiens
atgcaagtgggagatgaaa

SEQ ID NO: 2703803 - DNA, 19 bp, Homo sapiens
atgcaatcctacttctata

SEQ ID NO: 2703804 - DNA, 22 bp, Homo sapiens
atgcaatgtatggcttttctct

SEQ ID NO: 2703805 - DNA, 19 bp, Homo sapiens
atgcacattggaagctccc

SEQ ID NO: 2703806 - DNA, 21 bp, Homo sapiens
atgcacattggaagctcccac

SEQ ID NO: 2703807 - DNA, 18 bp, Homo sapiens
atgcacgttaacagcgtg

SEQ ID NO: 2703808 - DNA, 13 bp, Homo sapiens
atgcagaaggaag

SEQ ID NO: 2703809 - DNA, 17 bp, Homo sapiens
atgcaggagagcttccc

SEQ ID NO: 2703810 - DNA, 18 bp, Homo sapiens
atgcattctagtgcagaa

SEQ ID NO: 2703811 - DNA, 15 bp, Homo sapiens
atgccacaccaagct

SEQ ID NO: 2703812 - DNA, 22 bp, Homo sapiens
atgccacaccaagctgtgccac

SEQ ID NO: 2703813 - DNA, 23 bp, Homo sapiens
atgccacaccaagctgtgccacc

SEQ ID NO: 2703814 - DNA, 16 bp, Homo sapiens
atgcccaatccaggcc

SEQ ID NO: 2703815 - DNA, 19 bp, Homo sapiens
atgccgtgtagtttctggt

SEQ ID NO: 2703816 - DNA, 14 bp, Homo sapiens
atgcctcagccagc

SEQ ID NO: 2703817 - DNA, 15 bp, Homo sapiens
atgcctcagccagcc

SEQ ID NO: 2703818 - DNA, 20 bp, Homo sapiens
atgcctgatgtgacgctact

SEQ ID NO: 2703819 - DNA, 21 bp, Homo sapiens
atgccttcataaattatttct

SEQ ID NO: 2703820 - DNA, 22 bp, Homo sapiens
atgccttcataaattatttcta

SEQ ID NO: 2703821 - DNA, 18 bp, Homo sapiens
atgctatctcgctagcca

SEQ ID NO: 2703822 - DNA, 11 bp, Homo sapiens
atgctggcctc

SEQ ID NO: 2703823 - DNA, 23 bp, Homo sapiens
atgctggcctcttggcacctgcc

SEQ ID NO: 2703824 - DNA, 12 bp, Homo sapiens
atgctgggctgg

SEQ ID NO: 2703825 - DNA, 14 bp, Homo sapiens
atgctgggctgggt

SEQ ID NO: 2703826 - DNA, 22 bp, Homo sapiens
atgctggggcaagtccctgact

SEQ ID NO: 2703827 - DNA, 17 bp, Homo sapiens
atgcttgccaagaaatc

SEQ ID NO: 2703828 - DNA, 16 bp, Homo sapiens
atgctttctccttttt

SEQ ID NO: 2703829 - DNA, 18 bp, Homo sapiens
atggaactccccagggcc

SEQ ID NO: 2703830 - DNA, 19 bp, Homo sapiens
atggaagggccttctccac

SEQ ID NO: 2703831 - DNA, 19 bp, Homo sapiens
atggacatcgatatgaaaa

SEQ ID NO: 2703832 - DNA, 20 bp, Homo sapiens
atggagaatacagaaacatt

SEQ ID NO: 2703833 - DNA, 18 bp, Homo sapiens
atggaggtgatgaaaacc

SEQ ID NO: 2703834 - DNA, 23 bp, Homo sapiens
atggagtgtttgacgaagaaaca

SEQ ID NO: 2703835 - DNA, 19 bp, Homo sapiens
atggataagatgatgttaa

SEQ ID NO: 2703836 - DNA, 17 bp, Homo sapiens
atggattccaaagcatt

SEQ ID NO: 2703837 - DNA, 11 bp, Homo sapiens
atggcagctgg

SEQ ID NO: 2703838 - DNA, 12 bp, Homo sapiens
atggcagctggg

SEQ ID NO: 2703839 - DNA, 19 bp, Homo sapiens
atggcagctgggcccacag

SEQ ID NO: 2703840 - DNA, 22 bp, Homo sapiens
atggcagctgggcccacagccc

SEQ ID NO: 2703841 - DNA, 14 bp, Homo sapiens
atggcccagccact

SEQ ID NO: 2703842 - DNA, 20 bp, Homo sapiens
atggcccgggccttatccag

SEQ ID NO: 2703843 - DNA, 19 bp, Homo sapiens
atggcctgccttgaagcca

SEQ ID NO: 2703844 - DNA, 14 bp, Homo sapiens
atggccttccctcc

SEQ ID NO: 2703845 - DNA, 21 bp, Homo sapiens
atggctcccctgaggctggca

SEQ ID NO: 2703846 - DNA, 17 bp, Homo sapiens
atggctgggggagggac

SEQ ID NO: 2703847 - DNA, 22 bp, Homo sapiens
atgggaagccatattcacacct

SEQ ID NO: 2703848 - DNA, 18 bp, Homo sapiens
atgggactgtgcctttgg

SEQ ID NO: 2703849 - DNA, 17 bp, Homo sapiens
atgggatgggctttctc

SEQ ID NO: 2703850 - DNA, 18 bp, Homo sapiens
atgggcactgctgggtgg

SEQ ID NO: 2703851 - DNA, 15 bp, Homo sapiens
atgggctttctcagt

SEQ ID NO: 2703852 - DNA, 15 bp, Homo sapiens
atgggtcctcggccc

SEQ ID NO: 2703853 - DNA, 14 bp, Homo sapiens
atggtaaagtaaat

SEQ ID NO: 2703854 - DNA, 16 bp, Homo sapiens
atggtactaaggagaa

SEQ ID NO: 2703855 - DNA, 13 bp, Homo sapiens
atggtcctggctg

SEQ ID NO: 2703856 - DNA, 20 bp, Homo sapiens
atggtcctggggctctgtgc

SEQ ID NO: 2703857 - DNA, 20 bp, Homo sapiens
atggtcttgatctcctgagc

SEQ ID NO: 2703858 - DNA, 14 bp, Homo sapiens
atggtgacttttga

SEQ ID NO: 2703859 - DNA, 15 bp, Homo sapiens
atggtgacttttgaa

SEQ ID NO: 2703860 - DNA, 9 bp, Homo sapiens
atggtgcct

SEQ ID NO: 2703861 - DNA, 22 bp, Homo sapiens
atggtgtgaaagtcagatgccc

SEQ ID NO: 2703862 - DNA, 18 bp, Homo sapiens
atgtaaaatcttcagctg

SEQ ID NO: 2703863 - DNA, 21 bp, Homo sapiens
atgtaaaatcttcagctggtg

SEQ ID NO: 2703864 - DNA, 24 bp, Homo sapiens
atgtaaaatcttcagctggtggat

SEQ ID NO: 2703865 - DNA, 21 bp, Homo sapiens
atgtaatttttaaagcaaata

SEQ ID NO: 2703866 - DNA, 15 bp, Homo sapiens
atgtacaaggtatgt

SEQ ID NO: 2703867 - DNA, 16 bp, Homo sapiens
atgtacaaggtatgta

SEQ ID NO: 2703868 - DNA, 19 bp, Homo sapiens
atgtacaaggtatgtacag

SEQ ID NO: 2703869 - DNA, 22 bp, Homo sapiens
atgtacagtctcaattttgtat

SEQ ID NO: 2703870 - DNA, 15 bp, Homo sapiens
atgtacagttcataa

SEQ ID NO: 2703871 - DNA, 23 bp, Homo sapiens
atgtacagttcataaatttgttg

SEQ ID NO: 2703872 - DNA, 12 bp, Homo sapiens
atgtatctttgg

SEQ ID NO: 2703873 - DNA, 19 bp, Homo sapiens
atgtatctttggggaaact

SEQ ID NO: 2703874 - DNA, 17 bp, Homo sapiens
atgtatgtgccaatttt

SEQ ID NO: 2703875 - DNA, 19 bp, Homo sapiens
atgtcactgaagtgattga

SEQ ID NO: 2703876 - DNA, 21 bp, Homo sapiens
atgtcagaaactcgatgaatg

SEQ ID NO: 2703877 - DNA, 12 bp, Homo sapiens
atgtcagccttg

SEQ ID NO: 2703878 - DNA, 15 bp, Homo sapiens
atgtcataaagaaga

SEQ ID NO: 2703879 - DNA, 17 bp, Homo sapiens
atgtcataaagaagagc

SEQ ID NO: 2703880 - DNA, 22 bp, Homo sapiens
atgtcattatttgataacattt

SEQ ID NO: 2703881 - DNA, 19 bp, Homo sapiens
atgtccctgaagtcttgca

SEQ ID NO: 2703882 - DNA, 14 bp, Homo sapiens
atgtcccttctcat

SEQ ID NO: 2703883 - DNA, 16 bp, Homo sapiens
atgtcctttctccagt

SEQ ID NO: 2703884 - DNA, 11 bp, Homo sapiens
atgtctaaaga

SEQ ID NO: 2703885 - DNA, 13 bp, Homo sapiens
atgtctaaagagc

SEQ ID NO: 2703886 - DNA, 20 bp, Homo sapiens
atgtctgtctttgcaaagga

SEQ ID NO: 2703887 - DNA, 22 bp, Homo sapiens
atgtctttggcttcagaattgt

SEQ ID NO: 2703888 - DNA, 23 bp, Homo sapiens
atgtgacaacatttttgtacatt

SEQ ID NO: 2703889 - DNA, 17 bp, Homo sapiens
atgtgatcatctttgct

SEQ ID NO: 2703890 - DNA, 22 bp, Homo sapiens
atgtgcctttttgtttttgtaa

SEQ ID NO: 2703891 - DNA, 15 bp, Homo sapiens
atgtgctcccaccag

SEQ ID NO: 2703892 - DNA, 22 bp, Homo sapiens
atgtgggctcagatcctgggca

SEQ ID NO: 2703893 - DNA, 14 bp, Homo sapiens
atgtgggttgtgat

SEQ ID NO: 2703894 - DNA, 15 bp, Homo sapiens
atgtgggttgtgata

SEQ ID NO: 2703895 - DNA, 13 bp, Homo sapiens
atgtgtctgcaac

SEQ ID NO: 2703896 - DNA, 16 bp, Homo sapiens
atgtgtctgcaacatg

SEQ ID NO: 2703897 - DNA, 18 bp, Homo sapiens
atgtgtctgcaacatgga

SEQ ID NO: 2703898 - DNA, 17 bp, Homo sapiens
atgttaaatgccttggt

SEQ ID NO: 2703899 - DNA, 12 bp, Homo sapiens
atgttattggaa

SEQ ID NO: 2703900 - DNA, 19 bp, Homo sapiens
atgttattggaattttctt

SEQ ID NO: 2703901 - DNA, 17 bp, Homo sapiens
atgttccaataaaactt

SEQ ID NO: 2703902 - DNA, 13 bp, Homo sapiens
attaaacagcaaa

SEQ ID NO: 2703903 - DNA, 18 bp, Homo sapiens
attaaacagcaaagccat

SEQ ID NO: 2703904 - DNA, 16 bp, Homo sapiens
attaaatgtgtcattg

SEQ ID NO: 2703905 - DNA, 17 bp, Homo sapiens
attaagaatagtctctg

SEQ ID NO: 2703906 - DNA, 11 bp, Homo sapiens
attaattgagg

SEQ ID NO: 2703907 - DNA, 14 bp, Homo sapiens
attaattgtcatta

SEQ ID NO: 2703908 - DNA, 17 bp, Homo sapiens
attaccagagttgttct

SEQ ID NO: 2703909 - DNA, 12 bp, Homo sapiens
attacccttcct

SEQ ID NO: 2703910 - DNA, 14 bp, Homo sapiens
attacccttcctca

SEQ ID NO: 2703911 - DNA, 17 bp, Homo sapiens
attaccttgtctttcaa

SEQ ID NO: 2703912 - DNA, 18 bp, Homo sapiens
attaccttgtctttcaaa

SEQ ID NO: 2703913 - DNA, 19 bp, Homo sapiens
attacgatcccccaagtgt

SEQ ID NO: 2703914 - DNA, 14 bp, Homo sapiens
attactgtatgtat

SEQ ID NO: 2703915 - DNA, 17 bp, Homo sapiens
attactgtatgtataaa

SEQ ID NO: 2703916 - DNA, 19 bp, Homo sapiens
attactttttaaaatgttg

SEQ ID NO: 2703917 - DNA, 15 bp, Homo sapiens
attagagtcagcctt

SEQ ID NO: 2703918 - DNA, 15 bp, Homo sapiens
attagcaatcatttt

SEQ ID NO: 2703919 - DNA, 22 bp, Homo sapiens
attagctacttttcagaattga

SEQ ID NO: 2703920 - DNA, 20 bp, Homo sapiens
attagtttgatttaatatct

SEQ ID NO: 2703921 - DNA, 12 bp, Homo sapiens
attatatatcat

SEQ ID NO: 2703922 - DNA, 14 bp, Homo sapiens
attatcttcatgtt

SEQ ID NO: 2703923 - DNA, 14 bp, Homo sapiens
attattacttttta

SEQ ID NO: 2703924 - DNA, 16 bp, Homo sapiens
attattctgattccac

SEQ ID NO: 2703925 - DNA, 14 bp, Homo sapiens
attattttacagtc

SEQ ID NO: 2703926 - DNA, 18 bp, Homo sapiens
attattttccaaaatcta

SEQ ID NO: 2703927 - DNA, 15 bp, Homo sapiens
attattttgtatgga

SEQ ID NO: 2703928 - DNA, 20 bp, Homo sapiens
attatttttgttagcaaaga

SEQ ID NO: 2703929 - DNA, 14 bp, Homo sapiens
attattttttgcat

SEQ ID NO: 2703930 - DNA, 19 bp, Homo sapiens
attcacacctcacgctctg

SEQ ID NO: 2703931 - DNA, 20 bp, Homo sapiens
attcacacctcacgctctgg

SEQ ID NO: 2703932 - DNA, 21 bp, Homo sapiens
attcacatttcaagatccaaa

SEQ ID NO: 2703933 - DNA, 16 bp, Homo sapiens
attcaccaaaagttca

SEQ ID NO: 2703934 - DNA, 14 bp, Homo sapiens
attcactgttgaat

SEQ ID NO: 2703935 - DNA, 20 bp, Homo sapiens
attcactgttgaatgcctgt

SEQ ID NO: 2703936 - DNA, 19 bp, Homo sapiens
attcaggaaaagcctctgt

SEQ ID NO: 2703937 - DNA, 12 bp, Homo sapiens
attcatcaaata

SEQ ID NO: 2703938 - DNA, 20 bp, Homo sapiens
attcatcaaataaaccttgt

SEQ ID NO: 2703939 - DNA, 17 bp, Homo sapiens
attcatgcaacttgatt

SEQ ID NO: 2703940 - DNA, 14 bp, Homo sapiens
attcatgctttctc

SEQ ID NO: 2703941 - DNA, 17 bp, Homo sapiens
attcatgttttaaaagt

SEQ ID NO: 2703942 - DNA, 21 bp, Homo sapiens
attcatgttttaaaagtttgt

SEQ ID NO: 2703943 - DNA, 22 bp, Homo sapiens
attccaagggtatgggaagcca

SEQ ID NO: 2703944 - DNA, 19 bp, Homo sapiens
attccaagtcaacactctt

SEQ ID NO: 2703945 - DNA, 21 bp, Homo sapiens
attccaagtcaacactcttct

SEQ ID NO: 2703946 - DNA, 12 bp, Homo sapiens
attccactggac

SEQ ID NO: 2703947 - DNA, 12 bp, Homo sapiens
attcccagagag

SEQ ID NO: 2703948 - DNA, 15 bp, Homo sapiens
attcctagctgtaaa

SEQ ID NO: 2703949 - DNA, 17 bp, Homo sapiens
attcctcccccagagcc

SEQ ID NO: 2703950 - DNA, 14 bp, Homo sapiens
attcctctaaaact

SEQ ID NO: 2703951 - DNA, 13 bp, Homo sapiens
attcctgctgcct

SEQ ID NO: 2703952 - DNA, 16 bp, Homo sapiens
attcctggcatgacac

SEQ ID NO: 2703953 - DNA, 20 bp, Homo sapiens
attcctggcatgacactcta

SEQ ID NO: 2703954 - DNA, 10 bp, Homo sapiens
attcctgggc

SEQ ID NO: 2703955 - DNA, 13 bp, Homo sapiens
attcctgttgtgt

SEQ ID NO: 2703956 - DNA, 19 bp, Homo sapiens
attcgaggtgtcaccctgc

SEQ ID NO: 2703957 - DNA, 22 bp, Homo sapiens
attcgaggtgtcaccctgcaga

SEQ ID NO: 2703958 - DNA, 12 bp, Homo sapiens
attctaaacaga

SEQ ID NO: 2703959 - DNA, 21 bp, Homo sapiens
attctaaacagatgtccctga

SEQ ID NO: 2703960 - DNA, 15 bp, Homo sapiens
attctaaatgttcat

SEQ ID NO: 2703961 - DNA, 18 bp, Homo sapiens
attctaataaatcaatgt

SEQ ID NO: 2703962 - DNA, 19 bp, Homo sapiens
attctacacatatatgtat

SEQ ID NO: 2703963 - DNA, 15 bp, Homo sapiens
attctctctgctcag

SEQ ID NO: 2703964 - DNA, 22 bp, Homo sapiens
attcttctattaacaaattatt

SEQ ID NO: 2703965 - DNA, 23 bp, Homo sapiens
attcttctcgacttcaggagctg

SEQ ID NO: 2703966 - DNA, 19 bp, Homo sapiens
attcttgtgattgactttt

SEQ ID NO: 2703967 - DNA, 20 bp, Homo sapiens
attctttcttggtgcattcg

SEQ ID NO: 2703968 - DNA, 16 bp, Homo sapiens
attgaaggagaaaatg

SEQ ID NO: 2703969 - DNA, 18 bp, Homo sapiens
attgaatttttaagcaaa

SEQ ID NO: 2703970 - DNA, 19 bp, Homo sapiens
attgaatttttaagcaaat

SEQ ID NO: 2703971 - DNA, 16 bp, Homo sapiens
attgagctagaaatca

SEQ ID NO: 2703972 - DNA, 19 bp, Homo sapiens
attgatcggagcctcctct

SEQ ID NO: 2703973 - DNA, 12 bp, Homo sapiens
attgcactaaat

SEQ ID NO: 2703974 - DNA, 20 bp, Homo sapiens
attgcatgaattcacaaaca

SEQ ID NO: 2703975 - DNA, 20 bp, Homo sapiens
attgctccattttcttgtca

SEQ ID NO: 2703976 - DNA, 21 bp, Homo sapiens
attgctctggggcttgctatt

SEQ ID NO: 2703977 - DNA, 14 bp, Homo sapiens
attgctcttaaaaa

SEQ ID NO: 2703978 - DNA, 21 bp, Homo sapiens
attgctcttaaaaatcttggt

SEQ ID NO: 2703979 - DNA, 15 bp, Homo sapiens
attgctgctggtaat

SEQ ID NO: 2703980 - DNA, 14 bp, Homo sapiens
attggaattttctt

SEQ ID NO: 2703981 - DNA, 22 bp, Homo sapiens
attggagggtgggagagcccag

SEQ ID NO: 2703982 - DNA, 23 bp, Homo sapiens
attggagggtgggagagcccagc

SEQ ID NO: 2703983 - DNA, 16 bp, Homo sapiens
attggatttgtctttg

SEQ ID NO: 2703984 - DNA, 18 bp, Homo sapiens
attggcagcaggtgctgc

SEQ ID NO: 2703985 - DNA, 22 bp, Homo sapiens
attggcagcaggtgctgctacc

SEQ ID NO: 2703986 - DNA, 13 bp, Homo sapiens
attggccctgccc

SEQ ID NO: 2703987 - DNA, 18 bp, Homo sapiens
attgggcagaatcctggg

SEQ ID NO: 2703988 - DNA, 19 bp, Homo sapiens
attgggcagaatcctgggc

SEQ ID NO: 2703989 - DNA, 21 bp, Homo sapiens
attgggcagaatcctgggccc

SEQ ID NO: 2703990 - DNA, 21 bp, Homo sapiens
attggtccaacccagcctgag

SEQ ID NO: 2703991 - DNA, 15 bp, Homo sapiens
attgtaaaattgtat

SEQ ID NO: 2703992 - DNA, 17 bp, Homo sapiens
attgtaaaattgtatag

SEQ ID NO: 2703993 - DNA, 18 bp, Homo sapiens
attgtaaaggtaggtgca

SEQ ID NO: 2703994 - DNA, 15 bp, Homo sapiens
attgtatagagatat

SEQ ID NO: 2703995 - DNA, 18 bp, Homo sapiens
attgtctgtctgctctta

SEQ ID NO: 2703996 - DNA, 16 bp, Homo sapiens
attgtcttccaacccc

SEQ ID NO: 2703997 - DNA, 18 bp, Homo sapiens
attgtcttccaaccccag

SEQ ID NO: 2703998 - DNA, 23 bp, Homo sapiens
attgtcttccaaccccagctggc

SEQ ID NO: 2703999 - DNA, 14 bp, Homo sapiens
attgtgatttcccg

SEQ ID NO: 2704000 - DNA, 16 bp, Homo sapiens
attgtgatttcccgtg

SEQ ID NO: 2704001 - DNA, 20 bp, Homo sapiens
attgtgttggctttacaaat

SEQ ID NO: 2704002 - DNA, 23 bp, Homo sapiens
attgtgttggctttacaaataat

SEQ ID NO: 2704003 - DNA, 14 bp, Homo sapiens
attgtttattcttt

SEQ ID NO: 2704004 - DNA, 23 bp, Homo sapiens
attgtttttagaaatttattctt

SEQ ID NO: 2704005 - DNA, 14 bp, Homo sapiens
atttaaaagacaaa

SEQ ID NO: 2704006 - DNA, 16 bp, Homo sapiens
atttaaaagacaaaca

SEQ ID NO: 2704007 - DNA, 21 bp, Homo sapiens
atttaaaatgtgtttcttaca

SEQ ID NO: 2704008 - DNA, 16 bp, Homo sapiens
atttaaacatgcagaa

SEQ ID NO: 2704009 - DNA, 17 bp, Homo sapiens
atttaaacatgcagaag

SEQ ID NO: 2704010 - DNA, 17 bp, Homo sapiens
atttaactagcacttta

SEQ ID NO: 2704011 - DNA, 18 bp, Homo sapiens
atttaacttgagggtaat

SEQ ID NO: 2704012 - DNA, 14 bp, Homo sapiens
atttaagcatgagt

SEQ ID NO: 2704013 - DNA, 19 bp, Homo sapiens
atttaagcatgagtggcct

SEQ ID NO: 2704014 - DNA, 15 bp, Homo sapiens
atttaagtactatct

SEQ ID NO: 2704015 - DNA, 22 bp, Homo sapiens
atttaatatctgagaagtgtat

SEQ ID NO: 2704016 - DNA, 20 bp, Homo sapiens
atttaccattattttacagt

SEQ ID NO: 2704017 - DNA, 18 bp, Homo sapiens
atttacctgcgaacttgt

SEQ ID NO: 2704018 - DNA, 22 bp, Homo sapiens
atttactcattcatttattcat

SEQ ID NO: 2704019 - DNA, 19 bp, Homo sapiens
atttactttttaaacagtg

SEQ ID NO: 2704020 - DNA, 14 bp, Homo sapiens
atttagggaagcag

SEQ ID NO: 2704021 - DNA, 20 bp, Homo sapiens
atttataggcagatctttaa

SEQ ID NO: 2704022 - DNA, 22 bp, Homo sapiens
atttataggcagatctttaaat

SEQ ID NO: 2704023 - DNA, 13 bp, Homo sapiens
atttatatcttta

SEQ ID NO: 2704024 - DNA, 17 bp, Homo sapiens
atttatatctttatgca

SEQ ID NO: 2704025 - DNA, 16 bp, Homo sapiens
atttatcatatttaat

SEQ ID NO: 2704026 - DNA, 13 bp, Homo sapiens
atttatttatgta

SEQ ID NO: 2704027 - DNA, 14 bp, Homo sapiens
atttatttatgtag

SEQ ID NO: 2704028 - DNA, 21 bp, Homo sapiens
atttcaaaatggacgtactgg

SEQ ID NO: 2704029 - DNA, 14 bp, Homo sapiens
atttcaagatccaa

SEQ ID NO: 2704030 - DNA, 16 bp, Homo sapiens
atttcaagatccaaat

SEQ ID NO: 2704031 - DNA, 12 bp, Homo sapiens
atttcatgcatt

SEQ ID NO: 2704032 - DNA, 15 bp, Homo sapiens
atttccacataaagg

SEQ ID NO: 2704033 - DNA, 21 bp, Homo sapiens
atttccacataaaggtattta

SEQ ID NO: 2704034 - DNA, 22 bp, Homo sapiens
atttccactcaggtctgttttc

SEQ ID NO: 2704035 - DNA, 18 bp, Homo sapiens
atttcccgtggccccagc

SEQ ID NO: 2704036 - DNA, 20 bp, Homo sapiens
atttcccgtggccccagcct

SEQ ID NO: 2704037 - DNA, 21 bp, Homo sapiens
atttcccgtggccccagcctg

SEQ ID NO: 2704038 - DNA, 15 bp, Homo sapiens
atttcgatgtacagt

SEQ ID NO: 2704039 - DNA, 13 bp, Homo sapiens
atttcgtgtaata

SEQ ID NO: 2704040 - DNA, 20 bp, Homo sapiens
atttctaaaacattaattga

SEQ ID NO: 2704041 - DNA, 23 bp, Homo sapiens
atttctactgtataaacaaatta

SEQ ID NO: 2704042 - DNA, 14 bp, Homo sapiens
atttctatgtatgt

SEQ ID NO: 2704043 - DNA, 22 bp, Homo sapiens
atttctgaacaaagagagctca

SEQ ID NO: 2704044 - DNA, 23 bp, Homo sapiens
atttctttctttgcaccaaagac

SEQ ID NO: 2704045 - DNA, 19 bp, Homo sapiens
atttgaggagcagcttcag

SEQ ID NO: 2704046 - DNA, 17 bp, Homo sapiens
atttgcctgcctgggcc

SEQ ID NO: 2704047 - DNA, 21 bp, Homo sapiens
atttgcctgcctgggcctccc

SEQ ID NO: 2704048 - DNA, 23 bp, Homo sapiens
atttgctatattttaatattgtt

SEQ ID NO: 2704049 - DNA, 19 bp, Homo sapiens
atttggcagaactgctggg

SEQ ID NO: 2704050 - DNA, 20 bp, Homo sapiens
atttggcagaactgctgggg

SEQ ID NO: 2704051 - DNA, 23 bp, Homo sapiens
atttggcagaactgctggggctg

SEQ ID NO: 2704052 - DNA, 14 bp, Homo sapiens
atttgttgtcatgt

SEQ ID NO: 2704053 - DNA, 16 bp, Homo sapiens
atttgttgtcatgtgt

SEQ ID NO: 2704054 - DNA, 20 bp, Homo sapiens
attttaataaagattctatt

SEQ ID NO: 2704055 - DNA, 15 bp, Homo sapiens
attttaatgtatttt

SEQ ID NO: 2704056 - DNA, 15 bp, Homo sapiens
attttaccaaagcat

SEQ ID NO: 2704057 - DNA, 16 bp, Homo sapiens
attttaccaaagcatc

SEQ ID NO: 2704058 - DNA, 22 bp, Homo sapiens
attttaccaaagcatcaataca

SEQ ID NO: 2704059 - DNA, 16 bp, Homo sapiens
attttactgacagaaa

SEQ ID NO: 2704060 - DNA, 18 bp, Homo sapiens
attttactgacagaaatg

SEQ ID NO: 2704061 - DNA, 17 bp, Homo sapiens
attttaggcagggattt

SEQ ID NO: 2704062 - DNA, 17 bp, Homo sapiens
attttatataaagaaaa

SEQ ID NO: 2704063 - DNA, 13 bp, Homo sapiens
attttcacagatg

SEQ ID NO: 2704064 - DNA, 23 bp, Homo sapiens
attttccaaaatctaaaagctgt

SEQ ID NO: 2704065 - DNA, 17 bp, Homo sapiens
attttctgtaaatgaag

SEQ ID NO: 2704066 - DNA, 19 bp, Homo sapiens
attttctgtgttgttcata

SEQ ID NO: 2704067 - DNA, 18 bp, Homo sapiens
attttcttggaattttgt

SEQ ID NO: 2704068 - DNA, 22 bp, Homo sapiens
attttcttggaattttgtaaaa

SEQ ID NO: 2704069 - DNA, 14 bp, Homo sapiens
attttcttgtcaat

SEQ ID NO: 2704070 - DNA, 19 bp, Homo sapiens
attttctttcatacattat

SEQ ID NO: 2704071 - DNA, 13 bp, Homo sapiens
caaacagtgaatt

SEQ ID NO: 2704072 - DNA, 20 bp, Homo sapiens
caaacagtgaatttaagcat

SEQ ID NO: 2704073 - DNA, 13 bp, Homo sapiens
caaacatgaaaac

SEQ ID NO: 2704074 - DNA, 14 bp, Homo sapiens
caaacatgaaaaca

SEQ ID NO: 2704075 - DNA, 19 bp, Homo sapiens
caaacatgaaaacattgat

SEQ ID NO: 2704076 - DNA, 14 bp, Homo sapiens
caaacatgtgcaac

SEQ ID NO: 2704077 - DNA, 19 bp, Homo sapiens
caaacatgtgcaactcttg

SEQ ID NO: 2704078 - DNA, 13 bp, Homo sapiens
caaaccaggagca

SEQ ID NO: 2704079 - DNA, 16 bp, Homo sapiens
caaactaaggagtgac

SEQ ID NO: 2704080 - DNA, 13 bp, Homo sapiens
caaagaaaaccct

SEQ ID NO: 2704081 - DNA, 22 bp, Homo sapiens
caaagaaaagacattgaaagct

SEQ ID NO: 2704082 - DNA, 12 bp, Homo sapiens
caaagaaatttc

SEQ ID NO: 2704083 - DNA, 19 bp, Homo sapiens
caaagaaatttccactcag

SEQ ID NO: 2704084 - DNA, 13 bp, Homo sapiens
caaagaagtggtt

SEQ ID NO: 2704085 - DNA, 17 bp, Homo sapiens
caaagagtctctggctc

SEQ ID NO: 2704086 - DNA, 18 bp, Homo sapiens
caaagagtctctggctca

SEQ ID NO: 2704087 - DNA, 19 bp, Homo sapiens
caaagagtctctggctcag

SEQ ID NO: 2704088 - DNA, 21 bp, Homo sapiens
caaagattaaatgtgtcattg

SEQ ID NO: 2704089 - DNA, 16 bp, Homo sapiens
caaaggactgtaagca

SEQ ID NO: 2704090 - DNA, 16 bp, Homo sapiens
caaagggcagtaaagt

SEQ ID NO: 2704091 - DNA, 20 bp, Homo sapiens
caaagggcagtaaagttttc

SEQ ID NO: 2704092 - DNA, 19 bp, Homo sapiens
caaagtgctgggattacag

SEQ ID NO: 2704093 - DNA, 18 bp, Homo sapiens
caaagttactggctcttt

SEQ ID NO: 2704094 - DNA, 19 bp, Homo sapiens
caaagttactggctctttg

SEQ ID NO: 2704095 - DNA, 13 bp, Homo sapiens
caaagttatattt

SEQ ID NO: 2704096 - DNA, 14 bp, Homo sapiens
caaagttccagttt

SEQ ID NO: 2704097 - DNA, 13 bp, Homo sapiens
caaagttttcaga

SEQ ID NO: 2704098 - DNA, 15 bp, Homo sapiens
caaagttttcagatt

SEQ ID NO: 2704099 - DNA, 21 bp, Homo sapiens
caaataatggacttttttcta

SEQ ID NO: 2704100 - DNA, 15 bp, Homo sapiens
caaatacattccagt

SEQ ID NO: 2704101 - DNA, 20 bp, Homo sapiens
caaatagggcaaagaatcaa

SEQ ID NO: 2704102 - DNA, 15 bp, Homo sapiens
caaatccacaagcca

SEQ ID NO: 2704103 - DNA, 22 bp, Homo sapiens
caaatgagaaaatgtctttatt

SEQ ID NO: 2704104 - DNA, 16 bp, Homo sapiens
caaatgagcattagct

SEQ ID NO: 2704105 - DNA, 19 bp, Homo sapiens
caaatgcattcatgtttta

SEQ ID NO: 2704106 - DNA, 21 bp, Homo sapiens
caaatgctgtgcaaacagtgt

SEQ ID NO: 2704107 - DNA, 12 bp, Homo sapiens
caaattaagaca

SEQ ID NO: 2704108 - DNA, 17 bp, Homo sapiens
caaattttattaaaaga

SEQ ID NO: 2704109 - DNA, 19 bp, Homo sapiens
caaatttttctgggaagaa

SEQ ID NO: 2704110 - DNA, 15 bp, Homo sapiens
caacaaacactgtga

SEQ ID NO: 2704111 - DNA, 16 bp, Homo sapiens
caacaataaagagctc

SEQ ID NO: 2704112 - DNA, 22 bp, Homo sapiens
caacactcttcttgagcagacc

SEQ ID NO: 2704113 - DNA, 14 bp, Homo sapiens
caacagaaaacaat

SEQ ID NO: 2704114 - DNA, 10 bp, Homo sapiens
caacagcagc

SEQ ID NO: 2704115 - DNA, 21 bp, Homo sapiens
caacagtttctcaagtttaaa

SEQ ID NO: 2704116 - DNA, 17 bp, Homo sapiens
caacatgtatgtggata

SEQ ID NO: 2704117 - DNA, 23 bp, Homo sapiens
caacatttttgtacattatgtta

SEQ ID NO: 2704118 - DNA, 14 bp, Homo sapiens
caacccagccgctg

SEQ ID NO: 2704119 - DNA, 15 bp, Homo sapiens
caaccccagctggcc

SEQ ID NO: 2704120 - DNA, 23 bp, Homo sapiens
caaccccagctggcctctagaac

SEQ ID NO: 2704121 - DNA, 17 bp, Homo sapiens
caaccccccacctgcca

SEQ ID NO: 2704122 - DNA, 11 bp, Homo sapiens
caacccctccc

SEQ ID NO: 2704123 - DNA, 16 bp, Homo sapiens
caaccctcagctgcct

SEQ ID NO: 2704124 - DNA, 20 bp, Homo sapiens
caacctccacctcctgggtt

SEQ ID NO: 2704125 - DNA, 12 bp, Homo sapiens
caacctgcccct

SEQ ID NO: 2704126 - DNA, 17 bp, Homo sapiens
caacctgcccctcccca

SEQ ID NO: 2704127 - DNA, 14 bp, Homo sapiens
caacctgcctgtgc

SEQ ID NO: 2704128 - DNA, 21 bp, Homo sapiens
caacctgtccttactcagagc

SEQ ID NO: 2704129 - DNA, 17 bp, Homo sapiens
caacgctctaccctgca

SEQ ID NO: 2704130 - DNA, 19 bp, Homo sapiens
caacgctctaccctgcagc

SEQ ID NO: 2704131 - DNA, 22 bp, Homo sapiens
caactactcagctctcctgctg

SEQ ID NO: 2704132 - DNA, 22 bp, Homo sapiens
caactcttgtattgctccattt

SEQ ID NO: 2704133 - DNA, 15 bp, Homo sapiens
caactttcatttgaa

SEQ ID NO: 2704134 - DNA, 23 bp, Homo sapiens
caagaaatcgccttatgagaaca

SEQ ID NO: 2704135 - DNA, 23 bp, Homo sapiens
caagaagggttttccaccctgga

SEQ ID NO: 2704136 - DNA, 17 bp, Homo sapiens
caagacaaagcaaagcc

SEQ ID NO: 2704137 - DNA, 16 bp, Homo sapiens
caagacagtggcacta

SEQ ID NO: 2704138 - DNA, 19 bp, Homo sapiens
caagacagtggcactaaaa

SEQ ID NO: 2704139 - DNA, 14 bp, Homo sapiens
caagacgtcctgga

SEQ ID NO: 2704140 - DNA, 15 bp, Homo sapiens
caagacgtcctggaa

SEQ ID NO: 2704141 - DNA, 17 bp, Homo sapiens
caagacttcactgcagc

SEQ ID NO: 2704142 - DNA, 19 bp, Homo sapiens
caagacttcactgcagcct

SEQ ID NO: 2704143 - DNA, 21 bp, Homo sapiens
caagagatctttctttccaaa

SEQ ID NO: 2704144 - DNA, 15 bp, Homo sapiens
caagagcagaggcag

SEQ ID NO: 2704145 - DNA, 18 bp, Homo sapiens
caagagtctctccagcct

SEQ ID NO: 2704146 - DNA, 20 bp, Homo sapiens
caagatcattatcttcatgt

SEQ ID NO: 2704147 - DNA, 16 bp, Homo sapiens
caagatgtcagactgg

SEQ ID NO: 2704148 - DNA, 17 bp, Homo sapiens
caagattttctactttt

SEQ ID NO: 2704149 - DNA, 17 bp, Homo sapiens
caagccaccgcagctgc

SEQ ID NO: 2704150 - DNA, 19 bp, Homo sapiens
caagccaccgcagctgctg

SEQ ID NO: 2704151 - DNA, 22 bp, Homo sapiens
caagccaccgcagctgctgcca

SEQ ID NO: 2704152 - DNA, 20 bp, Homo sapiens
caagccattttttgaggaga

SEQ ID NO: 2704153 - DNA, 21 bp, Homo sapiens
caagccattttttgaggagag

SEQ ID NO: 2704154 - DNA, 17 bp, Homo sapiens
caagccggcagaaatag

SEQ ID NO: 2704155 - DNA, 16 bp, Homo sapiens
caagcgtgctgcctct

SEQ ID NO: 2704156 - DNA, 19 bp, Homo sapiens
caatcaccttgcatttcaa

SEQ ID NO: 2704157 - DNA, 15 bp, Homo sapiens
caatcattttatata

SEQ ID NO: 2704158 - DNA, 22 bp, Homo sapiens
caatccaggcccggtgaggcca

SEQ ID NO: 2704159 - DNA, 23 bp, Homo sapiens
caatccatttggcagaactgctg

SEQ ID NO: 2704160 - DNA, 17 bp, Homo sapiens
caatgaaagtttgcact

SEQ ID NO: 2704161 - DNA, 23 bp, Homo sapiens
caatgccctacctgcctgttctc

SEQ ID NO: 2704162 - DNA, 16 bp, Homo sapiens
caatgcttctgcctca

SEQ ID NO: 2704163 - DNA, 19 bp, Homo sapiens
caatgcttctgcctcagct

SEQ ID NO: 2704164 - DNA, 20 bp, Homo sapiens
caatgcttctgcctcagctt

SEQ ID NO: 2704165 - DNA, 19 bp, Homo sapiens
caatggcacgatctcagct

SEQ ID NO: 2704166 - DNA, 22 bp, Homo sapiens
caatgtgtgtatgttaatatct

SEQ ID NO: 2704167 - DNA, 19 bp, Homo sapiens
caatgttgcactgaaaacc

SEQ ID NO: 2704168 - DNA, 12 bp, Homo sapiens
caattatttatt

SEQ ID NO: 2704169 - DNA, 13 bp, Homo sapiens
caattcattgtgt

SEQ ID NO: 2704170 - DNA, 14 bp, Homo sapiens
caattcattgtgta

SEQ ID NO: 2704171 - DNA, 19 bp, Homo sapiens
caatttcaggaatttaatt

SEQ ID NO: 2704172 - DNA, 23 bp, Homo sapiens
caatttcaggaatttaatttata

SEQ ID NO: 2704173 - DNA, 16 bp, Homo sapiens
caattttgtatttaat

SEQ ID NO: 2704174 - DNA, 18 bp, Homo sapiens
cacaaaagctgtgtctct

SEQ ID NO: 2704175 - DNA, 20 bp, Homo sapiens
cacaaaagctgtgtctctgt

SEQ ID NO: 2704176 - DNA, 15 bp, Homo sapiens
cacaaacaaatggct

SEQ ID NO: 2704177 - DNA, 19 bp, Homo sapiens
cacaaacatatgtatcttt

SEQ ID NO: 2704178 - DNA, 20 bp, Homo sapiens
cacaaatgtgtcccagtgaa

SEQ ID NO: 2704179 - DNA, 19 bp, Homo sapiens
cacaacctccacctcctgg

SEQ ID NO: 2704180 - DNA, 22 bp, Homo sapiens
cacaacctccacctcctgggtt

SEQ ID NO: 2704181 - DNA, 23 bp, Homo sapiens
cacaagccattttttgaggagag

SEQ ID NO: 2704182 - DNA, 17 bp, Homo sapiens
cacaagctcaggtcctg

SEQ ID NO: 2704183 - DNA, 17 bp, Homo sapiens
cacaagctccctggtga

SEQ ID NO: 2704184 - DNA, 20 bp, Homo sapiens
cacaatgttgcactgaaaac

SEQ ID NO: 2704185 - DNA, 21 bp, Homo sapiens
cacaatgttgcactgaaaacc

SEQ ID NO: 2704186 - DNA, 14 bp, Homo sapiens
cacacacactcctt

SEQ ID NO: 2704187 - DNA, 14 bp, Homo sapiens
cacacactccttcc

SEQ ID NO: 2704188 - DNA, 15 bp, Homo sapiens
cacacactccttccc

SEQ ID NO: 2704189 - DNA, 16 bp, Homo sapiens
cacacactccttcccc

SEQ ID NO: 2704190 - DNA, 21 bp, Homo sapiens
cacacagtattaagtgacagt

SEQ ID NO: 2704191 - DNA, 14 bp, Homo sapiens
cacaccattctcct

SEQ ID NO: 2704192 - DNA, 18 bp, Homo sapiens
cacaccattctcctgcct

SEQ ID NO: 2704193 - DNA, 22 bp, Homo sapiens
cacaccattctcctgcctcagc

SEQ ID NO: 2704194 - DNA, 16 bp, Homo sapiens
cacacctcacgctctg

SEQ ID NO: 2704195 - DNA, 17 bp, Homo sapiens
cacacctcacgctctgg

SEQ ID NO: 2704196 - DNA, 19 bp, Homo sapiens
cacacctcacgctctggac

SEQ ID NO: 2704197 - DNA, 15 bp, Homo sapiens
cacacctgggcattt

SEQ ID NO: 2704198 - DNA, 14 bp, Homo sapiens
cacactcctcctgc

SEQ ID NO: 2704199 - DNA, 18 bp, Homo sapiens
cacactcctcctgccagc

SEQ ID NO: 2704200 - DNA, 19 bp, Homo sapiens
cacactcctcctgccagct

SEQ ID NO: 2704201 - DNA, 22 bp, Homo sapiens
cacactcctcctgccagctctg

SEQ ID NO: 2704202 - DNA, 13 bp, Homo sapiens
cacactccttccc

SEQ ID NO: 2704203 - DNA, 14 bp, Homo sapiens
cacactccttcccc

SEQ ID NO: 2704204 - DNA, 15 bp, Homo sapiens
cacactccttcccct

SEQ ID NO: 2704205 - DNA, 23 bp, Homo sapiens
cacactccttccccttgtccctg

SEQ ID NO: 2704206 - DNA, 19 bp, Homo sapiens
cacactgaaacctcttcgg

SEQ ID NO: 2704207 - DNA, 20 bp, Homo sapiens
cacagaaaggccactcagga

SEQ ID NO: 2704208 - DNA, 16 bp, Homo sapiens
cacagacctcagagat

SEQ ID NO: 2704209 - DNA, 20 bp, Homo sapiens
cacagactctgtgagattct

SEQ ID NO: 2704210 - DNA, 17 bp, Homo sapiens
cacagagggcgctcctg

SEQ ID NO: 2704211 - DNA, 22 bp, Homo sapiens
cacagatggaagaagttttaac

SEQ ID NO: 2704212 - DNA, 22 bp, Homo sapiens
cacagcaaggaggctggctggg

SEQ ID NO: 2704213 - DNA, 23 bp, Homo sapiens
cacagcaaggaggctggctgggg

SEQ ID NO: 2704214 - DNA, 17 bp, Homo sapiens
cacagcaaggcacctgc

SEQ ID NO: 2704215 - DNA, 13 bp, Homo sapiens
cacagcatgcaga

SEQ ID NO: 2704216 - DNA, 16 bp, Homo sapiens
cacagcccacgtcctg

SEQ ID NO: 2704217 - DNA, 17 bp, Homo sapiens
cacagcccacgtcctgt

SEQ ID NO: 2704218 - DNA, 12 bp, Homo sapiens
cacagcccagac

SEQ ID NO: 2704219 - DNA, 14 bp, Homo sapiens
cacagcccccaccc

SEQ ID NO: 2704220 - DNA, 11 bp, Homo sapiens
cacagccctcc

SEQ ID NO: 2704221 - DNA, 12 bp, Homo sapiens
cacagccctccc

SEQ ID NO: 2704222 - DNA, 15 bp, Homo sapiens
cacagccctcccgcc

SEQ ID NO: 2704223 - DNA, 13 bp, Homo sapiens
cacagcctctccc

SEQ ID NO: 2704224 - DNA, 15 bp, Homo sapiens
cacagcctctccctt

SEQ ID NO: 2704225 - DNA, 13 bp, Homo sapiens
cacagctcctccc

SEQ ID NO: 2704226 - DNA, 14 bp, Homo sapiens
cacagctcctcccc

SEQ ID NO: 2704227 - DNA, 20 bp, Homo sapiens
cacagctcctcccctgccgc

SEQ ID NO: 2704228 - DNA, 21 bp, Homo sapiens
cacagctcctcccctgccgcc

SEQ ID NO: 2704229 - DNA, 15 bp, Homo sapiens
cacagctctgctgga

SEQ ID NO: 2704230 - DNA, 13 bp, Homo sapiens
cacagctcttgtt

SEQ ID NO: 2704231 - DNA, 17 bp, Homo sapiens
cacagctgagctggcct

SEQ ID NO: 2704232 - DNA, 20 bp, Homo sapiens
cacaggaacgcacagatcat

SEQ ID NO: 2704233 - DNA, 21 bp, Homo sapiens
cacaggaacgcacagatcatg

SEQ ID NO: 2704234 - DNA, 14 bp, Homo sapiens
cacaggactctgca

SEQ ID NO: 2704235 - DNA, 14 bp, Homo sapiens
cacagtcctcacag

SEQ ID NO: 2704236 - DNA, 20 bp, Homo sapiens
cacagtgactcgggctcctg

SEQ ID NO: 2704237 - DNA, 21 bp, Homo sapiens
cacagtgactcgggctcctgt

SEQ ID NO: 2704238 - DNA, 19 bp, Homo sapiens
cacagtggaaccagcccag

SEQ ID NO: 2704239 - DNA, 16 bp, Homo sapiens
cacagtgtctgggctg

SEQ ID NO: 2704240 - DNA, 21 bp, Homo sapiens
cacatcatctttatctcctgg

SEQ ID NO: 2704241 - DNA, 13 bp, Homo sapiens
cacatggctgggg

SEQ ID NO: 2704242 - DNA, 14 bp, Homo sapiens
cacatggctggggg

SEQ ID NO: 2704243 - DNA, 21 bp, Homo sapiens
cacattatgttagagaggtag

SEQ ID NO: 2704244 - DNA, 23 bp, Homo sapiens
cacattctgtctctgcttggctt

SEQ ID NO: 2704245 - DNA, 19 bp, Homo sapiens
cacatttctggccatttaa

SEQ ID NO: 2704246 - DNA, 21 bp, Homo sapiens
cacattttgcctttctcgtgg

SEQ ID NO: 2704247 - DNA, 20 bp, Homo sapiens
cacattttgtacaaagatat

SEQ ID NO: 2704248 - DNA, 19 bp, Homo sapiens
caccaaaagttcatataat

SEQ ID NO: 2704249 - DNA, 14 bp, Homo sapiens
caccaacccagccg

SEQ ID NO: 2704250 - DNA, 14 bp, Homo sapiens
caccaagctgtgcc

SEQ ID NO: 2704251 - DNA, 15 bp, Homo sapiens
caccaagctgtgcca

SEQ ID NO: 2704252 - DNA, 21 bp, Homo sapiens
caccaagctgtgccaccctgg

SEQ ID NO: 2704253 - DNA, 23 bp, Homo sapiens
caccaagctgtgccaccctgggc

SEQ ID NO: 2704254 - DNA, 17 bp, Homo sapiens
caccaaggtctcacact

SEQ ID NO: 2704255 - DNA, 22 bp, Homo sapiens
caccaaggtctcacactcctcc

SEQ ID NO: 2704256 - DNA, 15 bp, Homo sapiens
caccaagtgtggaat

SEQ ID NO: 2704257 - DNA, 17 bp, Homo sapiens
caccacccaacctgtcc

SEQ ID NO: 2704258 - DNA, 13 bp, Homo sapiens
caccactagggtc

SEQ ID NO: 2704259 - DNA, 16 bp, Homo sapiens
caccagagcaggggct

SEQ ID NO: 2704260 - DNA, 20 bp, Homo sapiens
caccagagcaggggctgctg

SEQ ID NO: 2704261 - DNA, 22 bp, Homo sapiens
caccagagcaggggctgctggg

SEQ ID NO: 2704262 - DNA, 11 bp, Homo sapiens
caccagagctg

SEQ ID NO: 2704263 - DNA, 16 bp, Homo sapiens
caccagagctgcctcc

SEQ ID NO: 2704264 - DNA, 17 bp, Homo sapiens
caccagagctgcctccc

SEQ ID NO: 2704265 - DNA, 23 bp, Homo sapiens
caccagagctgcctccccaatcc

SEQ ID NO: 2704266 - DNA, 16 bp, Homo sapiens
caccaggggcaggcac

SEQ ID NO: 2704267 - DNA, 21 bp, Homo sapiens
caccaggggcaggcacagcac

SEQ ID NO: 2704268 - DNA, 22 bp, Homo sapiens
caccagtgcctcagtgctgcaa

SEQ ID NO: 2704269 - DNA, 11 bp, Homo sapiens
caccatgaaac

SEQ ID NO: 2704270 - DNA, 13 bp, Homo sapiens
caccatgcaaggg

SEQ ID NO: 2704271 - DNA, 21 bp, Homo sapiens
caccatgccaggctaattttt

SEQ ID NO: 2704272 - DNA, 15 bp, Homo sapiens
cacccaacctgtcct

SEQ ID NO: 2704273 - DNA, 14 bp, Homo sapiens
cacccaacgtgatg

SEQ ID NO: 2704274 - DNA, 13 bp, Homo sapiens
cacccactggcca

SEQ ID NO: 2704275 - DNA, 18 bp, Homo sapiens
cacccactggccagtcct

SEQ ID NO: 2704276 - DNA, 14 bp, Homo sapiens
cacccagaaggacc

SEQ ID NO: 2704277 - DNA, 20 bp, Homo sapiens
cacccaggctggagtacagt

SEQ ID NO: 2704278 - DNA, 15 bp, Homo sapiens
cacccagggctccct

SEQ ID NO: 2704279 - DNA, 15 bp, Homo sapiens
caccccaccctgccc

SEQ ID NO: 2704280 - DNA, 21 bp, Homo sapiens
caccccagcacagctcctccc

SEQ ID NO: 2704281 - DNA, 23 bp, Homo sapiens
caccccagcacagctcctcccct

SEQ ID NO: 2704282 - DNA, 17 bp, Homo sapiens
cacttcttgaaacagcc

SEQ ID NO: 2704283 - DNA, 21 bp, Homo sapiens
cacttcttgaaacagcctggg

SEQ ID NO: 2704284 - DNA, 14 bp, Homo sapiens
cacttgggtctctg

SEQ ID NO: 2704285 - DNA, 16 bp, Homo sapiens
cacttgggtcttccct

SEQ ID NO: 2704286 - DNA, 19 bp, Homo sapiens
cactttggtacatggccag

SEQ ID NO: 2704287 - DNA, 14 bp, Homo sapiens
cagaaaaccccagc

SEQ ID NO: 2704288 - DNA, 16 bp, Homo sapiens
cagaaagaaaatgaat

SEQ ID NO: 2704289 - DNA, 17 bp, Homo sapiens
cagaaattattttctat

SEQ ID NO: 2704290 - DNA, 16 bp, Homo sapiens
cagaactgctggggct

SEQ ID NO: 2704291 - DNA, 19 bp, Homo sapiens
cagaactggacgcccagct

SEQ ID NO: 2704292 - DNA, 14 bp, Homo sapiens
cagaagcctgaggc

SEQ ID NO: 2704293 - DNA, 20 bp, Homo sapiens
cagaagtaactcccactcct

SEQ ID NO: 2704294 - DNA, 13 bp, Homo sapiens
cagaatcctgggc

SEQ ID NO: 2704295 - DNA, 15 bp, Homo sapiens
cagaatcctgggccc

SEQ ID NO: 2704296 - DNA, 16 bp, Homo sapiens
cagaatcctgggcccc

SEQ ID NO: 2704297 - DNA, 19 bp, Homo sapiens
cagaatcctgggcccccag

SEQ ID NO: 2704298 - DNA, 14 bp, Homo sapiens
cagaatgtgctgcc

SEQ ID NO: 2704299 - DNA, 15 bp, Homo sapiens
cagaatgtgctgcct

SEQ ID NO: 2704300 - DNA, 16 bp, Homo sapiens
cagaatgtgctgcctt

SEQ ID NO: 2704301 - DNA, 15 bp, Homo sapiens
cagaattaactccat

SEQ ID NO: 2704302 - DNA, 13 bp, Homo sapiens
cagcctccaggca

SEQ ID NO: 2704303 - DNA, 13 bp, Homo sapiens
cagcctccagtgc

SEQ ID NO: 2704304 - DNA, 23 bp, Homo sapiens
cagcctccagtgctggctgctgg

SEQ ID NO: 2704305 - DNA, 21 bp, Homo sapiens
cagcctccctctgacctgcag

SEQ ID NO: 2704306 - DNA, 13 bp, Homo sapiens
cagcctcctgagt

SEQ ID NO: 2704307 - DNA, 18 bp, Homo sapiens
cagcctgaccccaggcag

SEQ ID NO: 2704308 - DNA, 17 bp, Homo sapiens
cagcctgacgcctactg

SEQ ID NO: 2704309 - DNA, 22 bp, Homo sapiens
cagcctgacgcctactggggca

SEQ ID NO: 2704310 - DNA, 17 bp, Homo sapiens
cagcctggccaccagct

SEQ ID NO: 2704311 - DNA, 12 bp, Homo sapiens
cagcctggccca

SEQ ID NO: 2704312 - DNA, 16 bp, Homo sapiens
cagcctggcccagctc

SEQ ID NO: 2704313 - DNA, 17 bp, Homo sapiens
cagcctggcccagctcc

SEQ ID NO: 2704314 - DNA, 18 bp, Homo sapiens
cagcctggcccagctccc

SEQ ID NO: 2704315 - DNA, 15 bp, Homo sapiens
cagtttagagttcta

SEQ ID NO: 2704316 - DNA, 20 bp, Homo sapiens
catgtattagccagtcattg

SEQ ID NO: 2704317 - DNA, 15 bp, Homo sapiens
catgtcatgtgccac

SEQ ID NO: 2704318 - DNA, 23 bp, Homo sapiens
ccacccaggaagggagggagctg

SEQ ID NO: 2704319 - DNA, 18 bp, Homo sapiens
ccacccagggctccctcc

SEQ ID NO: 2704320 - DNA, 12 bp, Homo sapiens
ccaccccaacat

SEQ ID NO: 2704321 - DNA, 22 bp, Homo sapiens
ccaccccagcacagctcctccc

SEQ ID NO: 2704322 - DNA, 11 bp, Homo sapiens
ccaccctggaa

SEQ ID NO: 2704323 - DNA, 13 bp, Homo sapiens
ccaccctgggctc

SEQ ID NO: 2704324 - DNA, 18 bp, Homo sapiens
ccaccctgggctctgtgg

SEQ ID NO: 2704325 - DNA, 15 bp, Homo sapiens
ccaccgcagctgctg

SEQ ID NO: 2704326 - DNA, 19 bp, Homo sapiens
ccaccgcagctgctgccac

SEQ ID NO: 2704327 - DNA, 21 bp, Homo sapiens
ccaccgcagctgctgccactc

SEQ ID NO: 2704328 - DNA, 14 bp, Homo sapiens
ccaccgccatggct

SEQ ID NO: 2704329 - DNA, 17 bp, Homo sapiens
ccaccgccatggcttcc

SEQ ID NO: 2704330 - DNA, 15 bp, Homo sapiens
ccacctagtggctgt

SEQ ID NO: 2704331 - DNA, 21 bp, Homo sapiens
ccacctcggatcccactgatt

SEQ ID NO: 2704332 - DNA, 17 bp, Homo sapiens
ccaccttcaattcctgg

SEQ ID NO: 2704333 - DNA, 18 bp, Homo sapiens
ccaccttcaattcctggg

SEQ ID NO: 2704334 - DNA, 19 bp, Homo sapiens
ccaccttcaattcctgggc

SEQ ID NO: 2704335 - DNA, 19 bp, Homo sapiens
ccacctttgggatcagcct

SEQ ID NO: 2704336 - DNA, 22 bp, Homo sapiens
ccacctttgggatcagcctccg

SEQ ID NO: 2704337 - DNA, 14 bp, Homo sapiens
ccacggggaccact

SEQ ID NO: 2704338 - DNA, 17 bp, Homo sapiens
ccacggggaccactggg

SEQ ID NO: 2704339 - DNA, 18 bp, Homo sapiens
ccacggggaccactgggc

SEQ ID NO: 2704340 - DNA, 23 bp, Homo sapiens
ccacggggaccactgggcccctc

SEQ ID NO: 2704341 - DNA, 22 bp, Homo sapiens
ccacgtaccaagccaccgcagc

SEQ ID NO: 2704342 - DNA, 15 bp, Homo sapiens
ccacgtctctctgcc

SEQ ID NO: 2704343 - DNA, 16 bp, Homo sapiens
ccacgtctctctgcct

SEQ ID NO: 2704344 - DNA, 21 bp, Homo sapiens
ccacgtctctctgcctgctgg

SEQ ID NO: 2704345 - DNA, 22 bp, Homo sapiens
ccacgtctctctgcctgctggg

SEQ ID NO: 2704346 - DNA, 17 bp, Homo sapiens
ccactaagctttctcct

SEQ ID NO: 2704347 - DNA, 19 bp, Homo sapiens
ccactaagctttctccttt

SEQ ID NO: 2704348 - DNA, 19 bp, Homo sapiens
ccactacactccagcctga

SEQ ID NO: 2704349 - DNA, 19 bp, Homo sapiens
ccactaggactctgaggct

SEQ ID NO: 2704350 - DNA, 14 bp, Homo sapiens
ccactctgctgcct

SEQ ID NO: 2704351 - DNA, 15 bp, Homo sapiens
ccactctgctgcctg

SEQ ID NO: 2704352 - DNA, 16 bp, Homo sapiens
ccactctgctgcctgt

SEQ ID NO: 2704353 - DNA, 19 bp, Homo sapiens
ccactgcaccccctcctgc

SEQ ID NO: 2704354 - DNA, 23 bp, Homo sapiens
ccactgcaccccctcctgctgca

SEQ ID NO: 2704355 - DNA, 14 bp, Homo sapiens
ccactgcactccag

SEQ ID NO: 2704356 - DNA, 18 bp, Homo sapiens
ccactgcactccagcctg

SEQ ID NO: 2704357 - DNA, 16 bp, Homo sapiens
ccactgccgatgccca

SEQ ID NO: 2704358 - DNA, 17 bp, Homo sapiens
ccactgccgcctccttc

SEQ ID NO: 2704359 - DNA, 20 bp, Homo sapiens
ccactggacttgagcttggc

SEQ ID NO: 2704360 - DNA, 22 bp, Homo sapiens
ccactggacttgagcttggcag

SEQ ID NO: 2704361 - DNA, 20 bp, Homo sapiens
ccactggccagtcctagagc

SEQ ID NO: 2704362 - DNA, 12 bp, Homo sapiens
ccactgggcccc

SEQ ID NO: 2704363 - DNA, 13 bp, Homo sapiens
ccactgggcccct

SEQ ID NO: 2704364 - DNA, 16 bp, Homo sapiens
ccactgggcccctcag

SEQ ID NO: 2704365 - DNA, 13 bp, Homo sapiens
ccactgtccgcct

SEQ ID NO: 2704366 - DNA, 15 bp, Homo sapiens
ccactgtccgcctct

SEQ ID NO: 2704367 - DNA, 23 bp, Homo sapiens
ccactgtccgcctctgcccgcag

SEQ ID NO: 2704368 - DNA, 17 bp, Homo sapiens
ccacttcatgcccactg

SEQ ID NO: 2704369 - DNA, 23 bp, Homo sapiens
ccacttcccaggtaagcaggagg

SEQ ID NO: 2704370 - DNA, 14 bp, Homo sapiens
ccacttcccctcct

SEQ ID NO: 2704371 - DNA, 17 bp, Homo sapiens
ccacttccctgacactg

SEQ ID NO: 2704372 - DNA, 12 bp, Homo sapiens
ccacttccctgc

SEQ ID NO: 2704373 - DNA, 16 bp, Homo sapiens
ccacttgggtcttccc

SEQ ID NO: 2704374 - DNA, 21 bp, Homo sapiens
ccactttggtacatggccagt

SEQ ID NO: 2704375 - DNA, 23 bp, Homo sapiens
ccactttttttttttctgcctga

SEQ ID NO: 2704376 - DNA, 16 bp, Homo sapiens
ccagaaagaaaatgaa

SEQ ID NO: 2704377 - DNA, 16 bp, Homo sapiens
ccagaaatacaacaga

SEQ ID NO: 2704378 - DNA, 16 bp, Homo sapiens
ccagaatgtgctgcct

SEQ ID NO: 2704379 - DNA, 17 bp, Homo sapiens
ccagaattacccttcct

SEQ ID NO: 2704380 - DNA, 18 bp, Homo sapiens
ccagaattacccttcctc

SEQ ID NO: 2704381 - DNA, 12 bp, Homo sapiens
ccagaattgaga

SEQ ID NO: 2704382 - DNA, 22 bp, Homo sapiens
ccagaattgcttgaacccagga

SEQ ID NO: 2704383 - DNA, 18 bp, Homo sapiens
ccagaccattgtcttcca

SEQ ID NO: 2704384 - DNA, 23 bp, Homo sapiens
ccagacctctgaatgtcccagag

SEQ ID NO: 2704385 - DNA, 12 bp, Homo sapiens
ccagactgcgga

SEQ ID NO: 2704386 - DNA, 18 bp, Homo sapiens
ccagactgcggagcagcc

SEQ ID NO: 2704387 - DNA, 20 bp, Homo sapiens
ccagactgcggagcagcctc

SEQ ID NO: 2704388 - DNA, 13 bp, Homo sapiens
ccagagcaggggc

SEQ ID NO: 2704389 - DNA, 18 bp, Homo sapiens
ccagagcaggggctgctg

SEQ ID NO: 2704390 - DNA, 19 bp, Homo sapiens
ccagagcaggggctgctgg

SEQ ID NO: 2704391 - DNA, 22 bp, Homo sapiens
ccagagcaggggctgctggggg

SEQ ID NO: 2704392 - DNA, 20 bp, Homo sapiens
ccagagcctcaaatgagaaa

SEQ ID NO: 2704393 - DNA, 23 bp, Homo sapiens
ccagagcctcaaatgagaaaatg

SEQ ID NO: 2704394 - DNA, 11 bp, Homo sapiens
ccagagctgcc

SEQ ID NO: 2704395 - DNA, 14 bp, Homo sapiens
ccagagctgcctcc

SEQ ID NO: 2704396 - DNA, 15 bp, Homo sapiens
ccagagctgcctccc

SEQ ID NO: 2704397 - DNA, 12 bp, Homo sapiens
ccagagttcttg

SEQ ID NO: 2704398 - DNA, 16 bp, Homo sapiens
ccagagttcttgcacc

SEQ ID NO: 2704399 - DNA, 16 bp, Homo sapiens
ccagatggagaaacag

SEQ ID NO: 2704400 - DNA, 23 bp, Homo sapiens
ccagatgggatgggctttctcag

SEQ ID NO: 2704401 - DNA, 12 bp, Homo sapiens
ccagcacagctc

SEQ ID NO: 2704402 - DNA, 15 bp, Homo sapiens
ccagcacagctcctc

SEQ ID NO: 2704403 - DNA, 20 bp, Homo sapiens
ccagcacagctcctcccctg

SEQ ID NO: 2704404 - DNA, 17 bp, Homo sapiens
ccagcacccgggctcag

SEQ ID NO: 2704405 - DNA, 18 bp, Homo sapiens
ccagcacccgggctcagg

SEQ ID NO: 2704406 - DNA, 23 bp, Homo sapiens
ccagcacgttttctggcttctgc

SEQ ID NO: 2704407 - DNA, 14 bp, Homo sapiens
ccagcactttggga

SEQ ID NO: 2704408 - DNA, 14 bp, Homo sapiens
ccagcaggcagcgc

SEQ ID NO: 2704409 - DNA, 15 bp, Homo sapiens
ccagcaggcagcgcc

SEQ ID NO: 2704410 - DNA, 19 bp, Homo sapiens
ccagcaggcagcgcctgtc

SEQ ID NO: 2704411 - DNA, 15 bp, Homo sapiens
ccagcatctcagagt

SEQ ID NO: 2704412 - DNA, 16 bp, Homo sapiens
ccagcatctcagagtc

SEQ ID NO: 2704413 - DNA, 15 bp, Homo sapiens
ccagccagctcctgc

SEQ ID NO: 2704414 - DNA, 21 bp, Homo sapiens
ccagccattaccatggagaca

SEQ ID NO: 2704415 - DNA, 13 bp, Homo sapiens
ccagccccacagc

SEQ ID NO: 2704416 - DNA, 15 bp, Homo sapiens
ccagccccacagccc

SEQ ID NO: 2704417 - DNA, 21 bp, Homo sapiens
ccagccccacagcccacgtcc

SEQ ID NO: 2704418 - DNA, 18 bp, Homo sapiens
ccagccctggaggctgga

SEQ ID NO: 2704419 - DNA, 23 bp, Homo sapiens
ccagccctttgcaggcccagcag

SEQ ID NO: 2704420 - DNA, 23 bp, Homo sapiens
ccagccgctgcccggcgccctct

SEQ ID NO: 2704421 - DNA, 16 bp, Homo sapiens
ccagcctcacagatgc

SEQ ID NO: 2704422 - DNA, 18 bp, Homo sapiens
ccagcctcacagatgctg

SEQ ID NO: 2704423 - DNA, 13 bp, Homo sapiens
ccagcctcccagc

SEQ ID NO: 2704424 - DNA, 14 bp, Homo sapiens
ccagcctggcccag

SEQ ID NO: 2704425 - DNA, 15 bp, Homo sapiens
ccagcctggcccagc

SEQ ID NO: 2704426 - DNA, 20 bp, Homo sapiens
ccagcctggcccagctcccc

SEQ ID NO: 2704427 - DNA, 17 bp, Homo sapiens
ccagcctggcttctgga

SEQ ID NO: 2704428 - DNA, 18 bp, Homo sapiens
ccagcctggcttctggag

SEQ ID NO: 2704429 - DNA, 21 bp, Homo sapiens
ccagcctgggcgacagagcaa

SEQ ID NO: 2704430 - DNA, 16 bp, Homo sapiens
ccagcctgtcctggta

SEQ ID NO: 2704431 - DNA, 18 bp, Homo sapiens
ctcggcaccagtgcctca

SEQ ID NO: 2704432 - DNA, 15 bp, Homo sapiens
ctcggcccatctgtc

SEQ ID NO: 2704433 - DNA, 16 bp, Homo sapiens
ctcggcctccagactg

SEQ ID NO: 2704434 - DNA, 17 bp, Homo sapiens
ctcggctcctgctgcac

SEQ ID NO: 2704435 - DNA, 16 bp, Homo sapiens
ctcggcttcaccaggg

SEQ ID NO: 2704436 - DNA, 12 bp, Homo sapiens
ctcgggcccagg

SEQ ID NO: 2704437 - DNA, 14 bp, Homo sapiens
ctcgggcccaggcc

SEQ ID NO: 2704438 - DNA, 23 bp, Homo sapiens
ctcgggcccaggccatcttccag

SEQ ID NO: 2704439 - DNA, 14 bp, Homo sapiens
ctcgggctcctgtg

SEQ ID NO: 2704440 - DNA, 17 bp, Homo sapiens
ctcgggctcctgtgccc

SEQ ID NO: 2704441 - DNA, 11 bp, Homo sapiens
ctcggtggtac

SEQ ID NO: 2704442 - DNA, 19 bp, Homo sapiens
ctcgtccaaggcagttctg

SEQ ID NO: 2704443 - DNA, 21 bp, Homo sapiens
ctcgtccaaggcagttctgtg

SEQ ID NO: 2704444 - DNA, 18 bp, Homo sapiens
ctcgtgatttgcctgcct

SEQ ID NO: 2704445 - DNA, 24 bp, Homo sapiens
ctcgtgccagtcgcgctgcctgtg

SEQ ID NO: 2704446 - DNA, 23 bp, Homo sapiens
ctcgtggcgtggggcagcagctg

SEQ ID NO: 2704447 - DNA, 16 bp, Homo sapiens
ctcgtggtagaagcca

SEQ ID NO: 2704448 - DNA, 17 bp, Homo sapiens
ctcgtggtagaagccag

SEQ ID NO: 2704449 - DNA, 17 bp, Homo sapiens
ctcgtttgatagtgctt

SEQ ID NO: 2704450 - DNA, 15 bp, Homo sapiens
ctctaactccctcct

SEQ ID NO: 2704451 - DNA, 17 bp, Homo sapiens
ctctaactccctcctca

SEQ ID NO: 2704452 - DNA, 21 bp, Homo sapiens
ctctaactccctcctcacact

SEQ ID NO: 2704453 - DNA, 17 bp, Homo sapiens
ctctacacaacatgtat

SEQ ID NO: 2704454 - DNA, 13 bp, Homo sapiens
ctctactcccagc

SEQ ID NO: 2704455 - DNA, 16 bp, Homo sapiens
ctctagaacacccact

SEQ ID NO: 2704456 - DNA, 18 bp, Homo sapiens
ctctagaacacccactgg

SEQ ID NO: 2704457 - DNA, 20 bp, Homo sapiens
ctctagaacacccactggcc

SEQ ID NO: 2704458 - DNA, 19 bp, Homo sapiens
ctctagctttagctggagg

SEQ ID NO: 2704459 - DNA, 15 bp, Homo sapiens
ctctagtgacttcct

SEQ ID NO: 2704460 - DNA, 21 bp, Homo sapiens
ctctagtgccctccacagccg

SEQ ID NO: 2704461 - DNA, 17 bp, Homo sapiens
ctctcagagcctcagct

SEQ ID NO: 2704462 - DNA, 19 bp, Homo sapiens
ctctcagagcctcagcttc

SEQ ID NO: 2704463 - DNA, 20 bp, Homo sapiens
ctctccacctagtggctgtc

SEQ ID NO: 2704464 - DNA, 13 bp, Homo sapiens
ctctccactccat

SEQ ID NO: 2704465 - DNA, 11 bp, Homo sapiens
ctctccagcct

SEQ ID NO: 2704466 - DNA, 13 bp, Homo sapiens
ctctccagcctca

SEQ ID NO: 2704467 - DNA, 21 bp, Homo sapiens
ctctccagctttccctcccca

SEQ ID NO: 2704468 - DNA, 12 bp, Homo sapiens
ctctccatgcaa

SEQ ID NO: 2704469 - DNA, 20 bp, Homo sapiens
ctctccatgcaagtgctgtt

SEQ ID NO: 2704470 - DNA, 17 bp, Homo sapiens
ctctcgccctggccagg

SEQ ID NO: 2704471 - DNA, 16 bp, Homo sapiens
ctctcggcttcaccag

SEQ ID NO: 2704472 - DNA, 16 bp, Homo sapiens
ctctctgcctgctggg

SEQ ID NO: 2704473 - DNA, 14 bp, Homo sapiens
ctctctgcctgctt

SEQ ID NO: 2704474 - DNA, 19 bp, Homo sapiens
ctctctgcctgcttcctgg

SEQ ID NO: 2704475 - DNA, 20 bp, Homo sapiens
ctctctgcctgcttcctgga

SEQ ID NO: 2704476 - DNA, 21 bp, Homo sapiens
ctctctgctcagtgatctcac

SEQ ID NO: 2704477 - DNA, 21 bp, Homo sapiens
ctctcttgtgagccatagaga

SEQ ID NO: 2704478 - DNA, 17 bp, Homo sapiens
ctctgaatgtcccagag

SEQ ID NO: 2704479 - DNA, 18 bp, Homo sapiens
ctctgaatgtcccagagg

SEQ ID NO: 2704480 - DNA, 18 bp, Homo sapiens
ctctgagccgcagggcct

SEQ ID NO: 2704481 - DNA, 23 bp, Homo sapiens
ctctgaggagtggagttctctgt

SEQ ID NO: 2704482 - DNA, 20 bp, Homo sapiens
ctctgaggctctttctgggc

SEQ ID NO: 2704483 - DNA, 16 bp, Homo sapiens
ctctgagtgtctctgc

SEQ ID NO: 2704484 - DNA, 23 bp, Homo sapiens
ctctgagtgtctctgcctggagc

SEQ ID NO: 2704485 - DNA, 17 bp, Homo sapiens
ctctgatccttcttcct

SEQ ID NO: 2704486 - DNA, 18 bp, Homo sapiens
ctctgattttgatatttt

SEQ ID NO: 2704487 - DNA, 20 bp, Homo sapiens
ctctgcaaagactagatcct

SEQ ID NO: 2704488 - DNA, 21 bp, Homo sapiens
ctctgcaactgaatacttgaa

SEQ ID NO: 2704489 - DNA, 14 bp, Homo sapiens
ctctgccagccaca

SEQ ID NO: 2704490 - DNA, 13 bp, Homo sapiens
ctctgccagcgtc

SEQ ID NO: 2704491 - DNA, 13 bp, Homo sapiens
ctctgcctcatcc

SEQ ID NO: 2704492 - DNA, 17 bp, Homo sapiens
ctctgcctcatcctcct

SEQ ID NO: 2704493 - DNA, 22 bp, Homo sapiens
ctctgcctctaactccctcctc

SEQ ID NO: 2704494 - DNA, 23 bp, Homo sapiens
ctctgcctctaactccctcctca

SEQ ID NO: 2704495 - DNA, 13 bp, Homo sapiens
ctctgcctgctgg

SEQ ID NO: 2704496 - DNA, 18 bp, Homo sapiens
ctctgcctgctgggctct

SEQ ID NO: 2704497 - DNA, 12 bp, Homo sapiens
ctctgcctgctt

SEQ ID NO: 2704498 - DNA, 18 bp, Homo sapiens
ctctgcctggagcagggg

SEQ ID NO: 2704499 - DNA, 18 bp, Homo sapiens
ctctgcgcctctccactg

SEQ ID NO: 2704500 - DNA, 20 bp, Homo sapiens
ctctgcgcctctccactgtt

SEQ ID NO: 2704501 - DNA, 13 bp, Homo sapiens
ctctgctgcccag

SEQ ID NO: 2704502 - DNA, 21 bp, Homo sapiens
ctctgcttactaatgtgcccc

SEQ ID NO: 2704503 - DNA, 20 bp, Homo sapiens
ctctgcttggcttcccctcc

SEQ ID NO: 2704504 - DNA, 23 bp, Homo sapiens
ctctggacatgatttagggaagc

SEQ ID NO: 2704505 - DNA, 12 bp, Homo sapiens
ctctggattcct

SEQ ID NO: 2704506 - DNA, 13 bp, Homo sapiens
ctctggcacccag

SEQ ID NO: 2704507 - DNA, 16 bp, Homo sapiens
ctctggctcagctgtg

SEQ ID NO: 2704508 - DNA, 15 bp, Homo sapiens
ctctggggcttgcta

SEQ ID NO: 2704509 - DNA, 23 bp, Homo sapiens
ctctgtatatagctctacacaac

SEQ ID NO: 2704510 - DNA, 15 bp, Homo sapiens
ctctgtccagccagc

SEQ ID NO: 2704511 - DNA, 11 bp, Homo sapiens
ctctgtcctga

SEQ ID NO: 2704512 - DNA, 13 bp, Homo sapiens
ctctgtcctgact

SEQ ID NO: 2704513 - DNA, 23 bp, Homo sapiens
ctctgtgcccatgggcactgctg

SEQ ID NO: 2704514 - DNA, 16 bp, Homo sapiens
ctctgtgggctgcact

SEQ ID NO: 2704515 - DNA, 16 bp, Homo sapiens
ctctgtgtcactggct

SEQ ID NO: 2704516 - DNA, 16 bp, Homo sapiens
ctctgttaaagatcag

SEQ ID NO: 2704517 - DNA, 12 bp, Homo sapiens
ctcttaaaaatc

SEQ ID NO: 2704518 - DNA, 15 bp, Homo sapiens
ctcttacttccccca

SEQ ID NO: 2704519 - DNA, 19 bp, Homo sapiens
ctcttccaccagagcaggg

SEQ ID NO: 2704520 - DNA, 22 bp, Homo sapiens
ctcttccaccagagcaggggct

SEQ ID NO: 2704521 - DNA, 18 bp, Homo sapiens
ctcttctacacgtccttt

SEQ ID NO: 2704522 - DNA, 22 bp, Homo sapiens
ctcttctcagagcagcactggg

SEQ ID NO: 2704523 - DNA, 17 bp, Homo sapiens
ctcttcttgagcagacc

SEQ ID NO: 2704524 - DNA, 22 bp, Homo sapiens
ctcttgccccaaatcacaaaca

SEQ ID NO: 2704525 - DNA, 14 bp, Homo sapiens
ctcttgccccaacc

SEQ ID NO: 2704526 - DNA, 19 bp, Homo sapiens
ctcttgccccaacccccag

SEQ ID NO: 2704527 - DNA, 23 bp, Homo sapiens
ctcttgccccaacccccagcacc

SEQ ID NO: 2704528 - DNA, 16 bp, Homo sapiens
ctcttggcacctgcct

SEQ ID NO: 2704529 - DNA, 22 bp, Homo sapiens
ctcttggcacctgcctagctct

SEQ ID NO: 2704530 - DNA, 13 bp, Homo sapiens
ctcttggccagag

SEQ ID NO: 2704531 - DNA, 17 bp, Homo sapiens
ctcttggccagagctga

SEQ ID NO: 2704532 - DNA, 16 bp, Homo sapiens
ctctttgctacaataa

SEQ ID NO: 2704533 - DNA, 21 bp, Homo sapiens
ctctttttttttttttttaaa

SEQ ID NO: 2704534 - DNA, 16 bp, Homo sapiens
ctgaacagtgctctgc

SEQ ID NO: 2704535 - DNA, 17 bp, Homo sapiens
ctgaacagtgctctgcc

SEQ ID NO: 2704536 - DNA, 18 bp, Homo sapiens
ctgaacatcctaaatatt

SEQ ID NO: 2704537 - DNA, 16 bp, Homo sapiens
ctgaaccgtgtgctcc

SEQ ID NO: 2704538 - DNA, 18 bp, Homo sapiens
ctgaactctgcaactgaa

SEQ ID NO: 2704539 - DNA, 17 bp, Homo sapiens
ctgaaggcttctgcagc

SEQ ID NO: 2704540 - DNA, 16 bp, Homo sapiens
ctgaagtcttgcattg

SEQ ID NO: 2704541 - DNA, 21 bp, Homo sapiens
ctgaagtcttgcattgaattt

SEQ ID NO: 2704542 - DNA, 16 bp, Homo sapiens
ctgaagtgattgaaag

SEQ ID NO: 2704543 - DNA, 17 bp, Homo sapiens
ctgaagtgcagctcagg

SEQ ID NO: 2704544 - DNA, 19 bp, Homo sapiens
ctgaagtgtcgagtccagt

SEQ ID NO: 2704545 - DNA, 23 bp, Homo sapiens
ctgaagtgtcgagtccagtcctt

SEQ ID NO: 2704546 - DNA, 14 bp, Homo sapiens
ctgaatacttgaag

SEQ ID NO: 2704547 - DNA, 20 bp, Homo sapiens
ctgaatattaagaaacaatt

SEQ ID NO: 2704548 - DNA, 15 bp, Homo sapiens
ctgaatgtcattatt

SEQ ID NO: 2704549 - DNA, 17 bp, Homo sapiens
ctgaatgtcccagaggc

SEQ ID NO: 2704550 - DNA, 16 bp, Homo sapiens
ctgaatgtcctttctc

SEQ ID NO: 2704551 - DNA, 21 bp, Homo sapiens
ctgacactgcggggcttggct

SEQ ID NO: 2704552 - DNA, 13 bp, Homo sapiens
ctgacagaaatgc

SEQ ID NO: 2704553 - DNA, 17 bp, Homo sapiens
ctgacagtcctctccac

SEQ ID NO: 2704554 - DNA, 12 bp, Homo sapiens
ctgacccagtgt

SEQ ID NO: 2704555 - DNA, 19 bp, Homo sapiens
ctgacccggattggccctg

SEQ ID NO: 2704556 - DNA, 23 bp, Homo sapiens
ctgacccggattggccctgcccc

SEQ ID NO: 2704557 - DNA, 20 bp, Homo sapiens
ctgaccgacgatccctcgac

SEQ ID NO: 2704558 - DNA, 12 bp, Homo sapiens
ctgacctccagt

SEQ ID NO: 2704559 - DNA, 23 bp, Homo sapiens
ctgacctccagtcctgctggcct

SEQ ID NO: 2704560 - DNA, 17 bp, Homo sapiens
ctgaccttctccaggga

SEQ ID NO: 2704561 - DNA, 21 bp, Homo sapiens
ctgaccttctccagggacaga

SEQ ID NO: 2704562 - DNA, 18 bp, Homo sapiens
ctgactctctgtgacctg

SEQ ID NO: 2704563 - DNA, 19 bp, Homo sapiens
ctgacttcaggggctgccc

SEQ ID NO: 2704564 - DNA, 24 bp, Homo sapiens
ctgagactgcgccacggcactcca

SEQ ID NO: 2704565 - DNA, 24 bp, Homo sapiens
ctgagagagtggcattggcagcag

SEQ ID NO: 2704566 - DNA, 22 bp, Homo sapiens
ctgagagctctctcttctctgt

SEQ ID NO: 2704567 - DNA, 20 bp, Homo sapiens
ctgagattctttaaggagat

SEQ ID NO: 2704568 - DNA, 11 bp, Homo sapiens
ctgagccctgg

SEQ ID NO: 2704569 - DNA, 12 bp, Homo sapiens
ctgagccctggc

SEQ ID NO: 2704570 - DNA, 13 bp, Homo sapiens
ctgagcctcacct

SEQ ID NO: 2704571 - DNA, 23 bp, Homo sapiens
ctgagctcgtgatctgcccgcct

SEQ ID NO: 2704572 - DNA, 21 bp, Homo sapiens
ctgaggagtggagttctctgt

SEQ ID NO: 2704573 - DNA, 17 bp, Homo sapiens
ctgaggagtgtcctgtc

SEQ ID NO: 2704574 - DNA, 18 bp, Homo sapiens
ctgaggccccaggcccta

SEQ ID NO: 2704575 - DNA, 11 bp, Homo sapiens
ctgaggcctcc

SEQ ID NO: 2704576 - DNA, 13 bp, Homo sapiens
ctgaggcctccct

SEQ ID NO: 2704577 - DNA, 18 bp, Homo sapiens
ctgaggctggcatcctgg

SEQ ID NO: 2704578 - DNA, 21 bp, Homo sapiens
ctgaggctggcatcctggctg

SEQ ID NO: 2704579 - DNA, 22 bp, Homo sapiens
ctgaggctggcatcctggctgg

SEQ ID NO: 2704580 - DNA, 18 bp, Homo sapiens
ctgagggcatctctgagt

SEQ ID NO: 2704581 - DNA, 12 bp, Homo sapiens
ctgagtacaatt

SEQ ID NO: 2704582 - DNA, 22 bp, Homo sapiens
ctgagtcacccctctgtccagc

SEQ ID NO: 2704583 - DNA, 19 bp, Homo sapiens
ctgagtctggcaaacatgt

SEQ ID NO: 2704584 - DNA, 13 bp, Homo sapiens
ctgagtgtctctg

SEQ ID NO: 2704585 - DNA, 15 bp, Homo sapiens
ctgagtgtctctgcc

SEQ ID NO: 2704586 - DNA, 14 bp, Homo sapiens
ctgataatgtattg

SEQ ID NO: 2704587 - DNA, 17 bp, Homo sapiens
ctgatgaggatcagagc

SEQ ID NO: 2704588 - DNA, 13 bp, Homo sapiens
ctgatgctgggct

SEQ ID NO: 2704589 - DNA, 19 bp, Homo sapiens
ctgatgctgggctgggtgc

SEQ ID NO: 2704590 - DNA, 23 bp, Homo sapiens
ctgattcggctgtctcagactct

SEQ ID NO: 2704591 - DNA, 14 bp, Homo sapiens
ctgcaaccctggtg

SEQ ID NO: 2704592 - DNA, 23 bp, Homo sapiens
ctgcaaccctggtgtgctgggcg

SEQ ID NO: 2704593 - DNA, 15 bp, Homo sapiens
ctgcaagaggctcct

SEQ ID NO: 2704594 - DNA, 16 bp, Homo sapiens
ctgcaagctctgcctc

SEQ ID NO: 2704595 - DNA, 17 bp, Homo sapiens
ctgcaatgtttttgtgt

SEQ ID NO: 2704596 - DNA, 23 bp, Homo sapiens
ctgcaccaacccagccgctgccc

SEQ ID NO: 2704597 - DNA, 18 bp, Homo sapiens
ctgcacctgccagcctgg

SEQ ID NO: 2704598 - DNA, 18 bp, Homo sapiens
ctgcacgtcaccctcctg

SEQ ID NO: 2704599 - DNA, 23 bp, Homo sapiens
ctgcacgtcaccctcctgagcct

SEQ ID NO: 2704600 - DNA, 14 bp, Homo sapiens
ctgcactccagcct

SEQ ID NO: 2704601 - DNA, 14 bp, Homo sapiens
ctgcactctgtgcc

SEQ ID NO: 2704602 - DNA, 18 bp, Homo sapiens
ctgcactctgtgcccatg

SEQ ID NO: 2704603 - DNA, 20 bp, Homo sapiens
ctgcactctgtgcccatggg

SEQ ID NO: 2704604 - DNA, 11 bp, Homo sapiens
ctgcactgtcc

SEQ ID NO: 2704605 - DNA, 17 bp, Homo sapiens
ctgcactgtcctgctcc

SEQ ID NO: 2704606 - DNA, 18 bp, Homo sapiens
ctgcactgtcctgctcca

SEQ ID NO: 2704607 - DNA, 21 bp, Homo sapiens
ctgcactgtcctgctccacag

SEQ ID NO: 2704608 - DNA, 23 bp, Homo sapiens
ctgcactgtcctgctccacagtg

SEQ ID NO: 2704609 - DNA, 23 bp, Homo sapiens
ctgcagaggggaaaccagtgtag

SEQ ID NO: 2704610 - DNA, 17 bp, Homo sapiens
ctgcagaggggcaggcc

SEQ ID NO: 2704611 - DNA, 22 bp, Homo sapiens
ctgcagaggggcaggccctgca

SEQ ID NO: 2704612 - DNA, 20 bp, Homo sapiens
ctgcagaggggctttctgga

SEQ ID NO: 2704613 - DNA, 23 bp, Homo sapiens
ctgcagaggggctttctggagag

SEQ ID NO: 2704614 - DNA, 19 bp, Homo sapiens
ctgcagatagtgcctctgc

SEQ ID NO: 2704615 - DNA, 20 bp, Homo sapiens
ctgcagatagtgcctctgca

SEQ ID NO: 2704616 - DNA, 17 bp, Homo sapiens
ctgcagcacaggaggct

SEQ ID NO: 2704617 - DNA, 15 bp, Homo sapiens
ctgcagcatgaaggc

SEQ ID NO: 2704618 - DNA, 22 bp, Homo sapiens
ctgcagctcctggaaggtgtca

SEQ ID NO: 2704619 - DNA, 20 bp, Homo sapiens
ctgcagctttggctgcacgt

SEQ ID NO: 2704620 - DNA, 21 bp, Homo sapiens
ctgcaggccaagagcagaggc

SEQ ID NO: 2704621 - DNA, 22 bp, Homo sapiens
ctgcaggccaagagcagaggca

SEQ ID NO: 2704622 - DNA, 24 bp, Homo sapiens
ctgcaggccaagagcagaggcagc

SEQ ID NO: 2704623 - DNA, 15 bp, Homo sapiens
ctgcaggttgggcca

SEQ ID NO: 2704624 - DNA, 20 bp, Homo sapiens
ctgcaggttgggccatactg

SEQ ID NO: 2704625 - DNA, 15 bp, Homo sapiens
ctgcatcagcttttt

SEQ ID NO: 2704626 - DNA, 18 bp, Homo sapiens
ctgcatcagctttttgta

SEQ ID NO: 2704627 - DNA, 22 bp, Homo sapiens
ctgcattcacagcgcctcctgg

SEQ ID NO: 2704628 - DNA, 18 bp, Homo sapiens
ctgcatttttaaaggaca

SEQ ID NO: 2704629 - DNA, 17 bp, Homo sapiens
ctgccacacatgctcat

SEQ ID NO: 2704630 - DNA, 13 bp, Homo sapiens
ctgccactctgct

SEQ ID NO: 2704631 - DNA, 19 bp, Homo sapiens
ctgccactctgctgcctgt

SEQ ID NO: 2704632 - DNA, 23 bp, Homo sapiens
ctgccactttggtacatggccag

SEQ ID NO: 2704633 - DNA, 11 bp, Homo sapiens
ctgccagcacc

SEQ ID NO: 2704634 - DNA, 15 bp, Homo sapiens
ctgccagcctggctt

SEQ ID NO: 2704635 - DNA, 19 bp, Homo sapiens
ctgccagcctggcttctgg

SEQ ID NO: 2704636 - DNA, 23 bp, Homo sapiens
ctgccagcctggcttctggagcc

SEQ ID NO: 2704637 - DNA, 12 bp, Homo sapiens
ctgccagctctg

SEQ ID NO: 2704638 - DNA, 14 bp, Homo sapiens
ctgccagctctgtc

SEQ ID NO: 2704639 - DNA, 15 bp, Homo sapiens
ctgccagctctgtca

SEQ ID NO: 2704640 - DNA, 21 bp, Homo sapiens
ctgccatttgcaccctccgcc

SEQ ID NO: 2704641 - DNA, 20 bp, Homo sapiens
ctgcccaggacggggccggc

SEQ ID NO: 2704642 - DNA, 21 bp, Homo sapiens
ctgcccaggacggggccggcc

SEQ ID NO: 2704643 - DNA, 11 bp, Homo sapiens
ctgccccaccc

SEQ ID NO: 2704644 - DNA, 17 bp, Homo sapiens
ctgccccagcctcccag

SEQ ID NO: 2704645 - DNA, 14 bp, Homo sapiens
ctgccccagctctg

SEQ ID NO: 2704646 - DNA, 13 bp, Homo sapiens
ctgccccatctcc

SEQ ID NO: 2704647 - DNA, 22 bp, Homo sapiens
ctgccccctggtggacagtcct

SEQ ID NO: 2704648 - DNA, 18 bp, Homo sapiens
ctgcccctccccctaccg

SEQ ID NO: 2704649 - DNA, 22 bp, Homo sapiens
ctgcccctccccctaccgcatg

SEQ ID NO: 2704650 - DNA, 21 bp, Homo sapiens
ctgcccctccctagatccagg

SEQ ID NO: 2704651 - DNA, 23 bp, Homo sapiens
ctgcccctccctagatccaggct

SEQ ID NO: 2704652 - DNA, 15 bp, Homo sapiens
ctgcccgcagagccc

SEQ ID NO: 2704653 - DNA, 19 bp, Homo sapiens
ctgcccgctcccagtgtct

SEQ ID NO: 2704654 - DNA, 16 bp, Homo sapiens
ctgcccggcgccctct

SEQ ID NO: 2704655 - DNA, 22 bp, Homo sapiens
ctgcccggcgccctctgtcctg

SEQ ID NO: 2704656 - DNA, 16 bp, Homo sapiens
ctgccctgccactttg

SEQ ID NO: 2704657 - DNA, 15 bp, Homo sapiens
ctgccgggtgggggg

SEQ ID NO: 2704658 - DNA, 18 bp, Homo sapiens
ctgcctagctcttgggcc

SEQ ID NO: 2704659 - DNA, 23 bp, Homo sapiens
ctgcctagctcttgggcctgacc

SEQ ID NO: 2704660 - DNA, 14 bp, Homo sapiens
ctgcctcagcctcc

SEQ ID NO: 2704661 - DNA, 16 bp, Homo sapiens
ctgcctcagcctcctg

SEQ ID NO: 2704662 - DNA, 18 bp, Homo sapiens
ctgcctcagcctcctgag

SEQ ID NO: 2704663 - DNA, 18 bp, Homo sapiens
ctgcctcagcttcccaag

SEQ ID NO: 2704664 - DNA, 12 bp, Homo sapiens
ctgcctcatcct

SEQ ID NO: 2704665 - DNA, 15 bp, Homo sapiens
ctgcctcatcctcct

SEQ ID NO: 2704666 - DNA, 21 bp, Homo sapiens
ctgcctcatcctcctcctcat

SEQ ID NO: 2704667 - DNA, 21 bp, Homo sapiens
ctgcctcatcgtggctgggaa

SEQ ID NO: 2704668 - DNA, 18 bp, Homo sapiens
ctgcctccactcccactt

SEQ ID NO: 2704669 - DNA, 17 bp, Homo sapiens
ctgcctctaactccctc

SEQ ID NO: 2704670 - DNA, 23 bp, Homo sapiens
ctgcctctaactccctcctcaca

SEQ ID NO: 2704671 - DNA, 17 bp, Homo sapiens
ctgcctgaccccaggcc

SEQ ID NO: 2704672 - DNA, 13 bp, Homo sapiens
ctgcctgagattc

SEQ ID NO: 2704673 - DNA, 21 bp, Homo sapiens
ctgcctgagattctttaagga

SEQ ID NO: 2704674 - DNA, 12 bp, Homo sapiens
ctgcctgctggg

SEQ ID NO: 2704675 - DNA, 16 bp, Homo sapiens
ctgcctgctgggctct

SEQ ID NO: 2704676 - DNA, 20 bp, Homo sapiens
ctgcctgctgggctcttaac

SEQ ID NO: 2704677 - DNA, 13 bp, Homo sapiens
ctgcctgctgtgg

SEQ ID NO: 2704678 - DNA, 16 bp, Homo sapiens
ctgcctgcttcctgga

SEQ ID NO: 2704679 - DNA, 12 bp, Homo sapiens
ctgcctggagca

SEQ ID NO: 2704680 - DNA, 12 bp, Homo sapiens
ctgcctgggcct

SEQ ID NO: 2704681 - DNA, 18 bp, Homo sapiens
ctgcctgggcctcccaaa

SEQ ID NO: 2704682 - DNA, 18 bp, Homo sapiens
ctgcctgtacagaagaaa

SEQ ID NO: 2704683 - DNA, 18 bp, Homo sapiens
ctgcctgtgcatgacctg

SEQ ID NO: 2704684 - DNA, 18 bp, Homo sapiens
ctaagtcatggtcctggc

SEQ ID NO: 2704685 - DNA, 17 bp, Homo sapiens
ctaataaatcaatgtga

SEQ ID NO: 2704686 - DNA, 23 bp, Homo sapiens
ctaatattagttcccttaacaaa

SEQ ID NO: 2704687 - DNA, 21 bp, Homo sapiens
ctaatcataacatagttgaaa

SEQ ID NO: 2704688 - DNA, 21 bp, Homo sapiens
ctaatgcttgccaagaaatcg

SEQ ID NO: 2704689 - DNA, 23 bp, Homo sapiens
ctaattggtccaacccagcctga

SEQ ID NO: 2704690 - DNA, 10 bp, Homo sapiens
ctacaaacat

SEQ ID NO: 2704691 - DNA, 19 bp, Homo sapiens
ctacaaaccaggagcaacc

SEQ ID NO: 2704692 - DNA, 12 bp, Homo sapiens
ctacaataaatg

SEQ ID NO: 2704693 - DNA, 13 bp, Homo sapiens
ctacaataaatgc

SEQ ID NO: 2704694 - DNA, 14 bp, Homo sapiens
ctacaataaatgct

SEQ ID NO: 2704695 - DNA, 19 bp, Homo sapiens
ctacaataaatgctgaatg

SEQ ID NO: 2704696 - DNA, 22 bp, Homo sapiens
ctacaataaatgctgaatgaat

SEQ ID NO: 2704697 - DNA, 15 bp, Homo sapiens
ctacacaacatgtat

SEQ ID NO: 2704698 - DNA, 14 bp, Homo sapiens
ctacacatatatgt

SEQ ID NO: 2704699 - DNA, 16 bp, Homo sapiens
ctacacccttggactt

SEQ ID NO: 2704700 - DNA, 16 bp, Homo sapiens
ctacactccagcctga

SEQ ID NO: 2704701 - DNA, 15 bp, Homo sapiens
ctaccagtgggcatg

SEQ ID NO: 2704702 - DNA, 15 bp, Homo sapiens
cctctgcctcatcct

SEQ ID NO: 2704703 - DNA, 17 bp, Homo sapiens
cctctgcctcatcctcc

SEQ ID NO: 2704704 - DNA, 20 bp, Homo sapiens
cctctgcctcatcctcctcc

SEQ ID NO: 2704705 - DNA, 14 bp, Homo sapiens
cctctggacagctt

SEQ ID NO: 2704706 - DNA, 15 bp, Homo sapiens
cctctggacagcttg

SEQ ID NO: 2704707 - DNA, 16 bp, Homo sapiens
cctctgggccaggttg

SEQ ID NO: 2704708 - DNA, 20 bp, Homo sapiens
cctctgtccagccagctcct

SEQ ID NO: 2704709 - DNA, 13 bp, Homo sapiens
cctctgtcctgac

SEQ ID NO: 2704710 - DNA, 16 bp, Homo sapiens
cctctgtgtcactggc

SEQ ID NO: 2704711 - DNA, 19 bp, Homo sapiens
cctctgtgtcactggctgc

SEQ ID NO: 2704712 - DNA, 22 bp, Homo sapiens
cctcttgccccaacccccagca

SEQ ID NO: 2704713 - DNA, 14 bp, Homo sapiens
cctgaactctgcaa

SEQ ID NO: 2704714 - DNA, 14 bp, Homo sapiens
cctgaccccaggca

SEQ ID NO: 2704715 - DNA, 13 bp, Homo sapiens
cctgacctccagt

SEQ ID NO: 2704716 - DNA, 15 bp, Homo sapiens
cctgacctccagtcc

SEQ ID NO: 2704717 - DNA, 17 bp, Homo sapiens
cctgacctccagtcctg

SEQ ID NO: 2704718 - DNA, 19 bp, Homo sapiens
cctgacctccagtcctgct

SEQ ID NO: 2704719 - DNA, 21 bp, Homo sapiens
cctgacctcgtgatttgcctg

SEQ ID NO: 2704720 - DNA, 15 bp, Homo sapiens
cctgaccttctccag

SEQ ID NO: 2704721 - DNA, 19 bp, Homo sapiens
cctgaccttctccagggac

SEQ ID NO: 2704722 - DNA, 22 bp, Homo sapiens
cctgaccttctccagggacaga

SEQ ID NO: 2704723 - DNA, 17 bp, Homo sapiens
cctgactctctgtgacc

SEQ ID NO: 2704724 - DNA, 18 bp, Homo sapiens
cctgactctctgtgacct

SEQ ID NO: 2704725 - DNA, 22 bp, Homo sapiens
cctgacttcaggggctgcccgc

SEQ ID NO: 2704726 - DNA, 20 bp, Homo sapiens
cctgagagaaactgaggtca

SEQ ID NO: 2704727 - DNA, 22 bp, Homo sapiens
cctgagattctttaaggagata

SEQ ID NO: 2704728 - DNA, 23 bp, Homo sapiens
cctgagcaacagagtgagaccct

SEQ ID NO: 2704729 - DNA, 18 bp, Homo sapiens
cctgaggagtgtcctgtc

SEQ ID NO: 2704730 - DNA, 20 bp, Homo sapiens
cctgaggagtgtcctgtctg

SEQ ID NO: 2704731 - DNA, 16 bp, Homo sapiens
cctgaggatcccctgt

SEQ ID NO: 2704732 - DNA, 18 bp, Homo sapiens
cctgaggatcccctgtcc

SEQ ID NO: 2704733 - DNA, 22 bp, Homo sapiens
cctgaggatcccctgtcccctg

SEQ ID NO: 2704734 - DNA, 18 bp, Homo sapiens
cctgaggctggcatcctg

SEQ ID NO: 2704735 - DNA, 15 bp, Homo sapiens
cctgagtcacccatg

SEQ ID NO: 2704736 - DNA, 22 bp, Homo sapiens
cctgatcattacatggctgtgg

SEQ ID NO: 2704737 - DNA, 15 bp, Homo sapiens
cctgatccagacaag

SEQ ID NO: 2704738 - DNA, 20 bp, Homo sapiens
ccttcaattcctgggcccca

SEQ ID NO: 2704739 - DNA, 14 bp, Homo sapiens
ccttcactccggtg

SEQ ID NO: 2704740 - DNA, 19 bp, Homo sapiens
ccttcataaattatttcta

SEQ ID NO: 2704741 - DNA, 20 bp, Homo sapiens
ccttccccctcccagggcca

SEQ ID NO: 2704742 - DNA, 23 bp, Homo sapiens
ccttccccgagggatgatgccac

SEQ ID NO: 2704743 - DNA, 12 bp, Homo sapiens
ccttccccttgt

SEQ ID NO: 2704744 - DNA, 16 bp, Homo sapiens
ccttccccttgtccct

SEQ ID NO: 2704745 - DNA, 20 bp, Homo sapiens
ccttccccttgtccctgggg

SEQ ID NO: 2704746 - DNA, 18 bp, Homo sapiens
ccttccctccccacagtc

SEQ ID NO: 2704747 - DNA, 23 bp, Homo sapiens
ccttcctcatctgtgcctgtctg

SEQ ID NO: 2704748 - DNA, 20 bp, Homo sapiens
ccttccttgctgtcctaggc

SEQ ID NO: 2704749 - DNA, 22 bp, Homo sapiens
ccttctaatccatgtgctgctg

SEQ ID NO: 2704750 - DNA, 12 bp, Homo sapiens
ccttctccacag

SEQ ID NO: 2704751 - DNA, 13 bp, Homo sapiens
ccttctccagcaa

SEQ ID NO: 2704752 - DNA, 14 bp, Homo sapiens
ccttctcccccccg

SEQ ID NO: 2704753 - DNA, 16 bp, Homo sapiens
ccttctcccccccggg

SEQ ID NO: 2704754 - DNA, 12 bp, Homo sapiens
ccttctcccctc

SEQ ID NO: 2704755 - DNA, 14 bp, Homo sapiens
ccttgaagccactg

SEQ ID NO: 2704756 - DNA, 19 bp, Homo sapiens
ccttgaagccactgaagct

SEQ ID NO: 2704757 - DNA, 11 bp, Homo sapiens
ccttgcatcaa

SEQ ID NO: 2704758 - DNA, 18 bp, Homo sapiens
ccttgcccggattctggg

SEQ ID NO: 2704759 - DNA, 19 bp, Homo sapiens
ccttgcccggattctggga

SEQ ID NO: 2704760 - DNA, 14 bp, Homo sapiens
ccttgcccttcctg

SEQ ID NO: 2704761 - DNA, 17 bp, Homo sapiens
ccttgcccttcctgacc

SEQ ID NO: 2704762 - DNA, 18 bp, Homo sapiens
ccttgcccttcctgaccc

SEQ ID NO: 2704763 - DNA, 14 bp, Homo sapiens
ccttgccttcctgc

SEQ ID NO: 2704764 - DNA, 22 bp, Homo sapiens
ccttggagtgctgcagctttgg

SEQ ID NO: 2704765 - DNA, 17 bp, Homo sapiens
ccttggttcccttgtgt

SEQ ID NO: 2704766 - DNA, 15 bp, Homo sapiens
ccttggttcctcccc

SEQ ID NO: 2704767 - DNA, 23 bp, Homo sapiens
ccttggtttgatttctagtatct

SEQ ID NO: 2704768 - DNA, 16 bp, Homo sapiens
ccttgtccccagctcc

SEQ ID NO: 2704769 - DNA, 13 bp, Homo sapiens
ccttgtccctggg

SEQ ID NO: 2704770 - DNA, 14 bp, Homo sapiens
ccttgtccctgggg

SEQ ID NO: 2704771 - DNA, 15 bp, Homo sapiens
ccttgtccctggggc

SEQ ID NO: 2704772 - DNA, 17 bp, Homo sapiens
ccttgtccctggggcac

SEQ ID NO: 2704773 - DNA, 20 bp, Homo sapiens
ccttgtcctctcagagcctc

SEQ ID NO: 2704774 - DNA, 16 bp, Homo sapiens
ccttgtgtgtaccaca

SEQ ID NO: 2704775 - DNA, 15 bp, Homo sapiens
ccttgtttctttctg

SEQ ID NO: 2704776 - DNA, 14 bp, Homo sapiens
cctttaccccacat

SEQ ID NO: 2704777 - DNA, 12 bp, Homo sapiens
cctttcagctgt

SEQ ID NO: 2704778 - DNA, 12 bp, Homo sapiens
cctttcagggaa

SEQ ID NO: 2704779 - DNA, 15 bp, Homo sapiens
cctttcccatttcgt

SEQ ID NO: 2704780 - DNA, 21 bp, Homo sapiens
cctttcctgccgtccctcctg

SEQ ID NO: 2704781 - DNA, 14 bp, Homo sapiens
cctttctccagtgt

SEQ ID NO: 2704782 - DNA, 15 bp, Homo sapiens
cctttctccagtgta

SEQ ID NO: 2704783 - DNA, 22 bp, Homo sapiens
cctttgagggcagtggggagca

SEQ ID NO: 2704784 - DNA, 16 bp, Homo sapiens
cctttgccccggcttg

SEQ ID NO: 2704785 - DNA, 19 bp, Homo sapiens
cctttgccccggcttgcct

SEQ ID NO: 2704786 - DNA, 19 bp, Homo sapiens
ccttttgtaccatggtgtg

SEQ ID NO: 2704787 - DNA, 12 bp, Homo sapiens
cctttttgtaac

SEQ ID NO: 2704788 - DNA, 20 bp, Homo sapiens
ccttttttatgatgctattt

SEQ ID NO: 2704789 - DNA, 21 bp, Homo sapiens
cgaacacgcatgcctcagcca

SEQ ID NO: 2704790 - DNA, 17 bp, Homo sapiens
cgaactgtgctcccacg

SEQ ID NO: 2704791 - DNA, 14 bp, Homo sapiens
cgaagaaacaaaaa

SEQ ID NO: 2704792 - DNA, 15 bp, Homo sapiens
cgaccccatctgccc

SEQ ID NO: 2704793 - DNA, 14 bp, Homo sapiens
cgaccctggctctg

SEQ ID NO: 2704794 - DNA, 17 bp, Homo sapiens
cgactagcaggcatgcc

SEQ ID NO: 2704795 - DNA, 14 bp, Homo sapiens
cgactcttcctgca

SEQ ID NO: 2704796 - DNA, 18 bp, Homo sapiens
cgactcttcctgcaaagg

SEQ ID NO: 2704797 - DNA, 20 bp, Homo sapiens
cgacttgaattttcccactg

SEQ ID NO: 2704798 - DNA, 18 bp, Homo sapiens
cgactttgagctggaaag

SEQ ID NO: 2704799 - DNA, 17 bp, Homo sapiens
cgagaccagcctggcca

SEQ ID NO: 2704800 - DNA, 12 bp, Homo sapiens
cgagagaggcgc

SEQ ID NO: 2704801 - DNA, 22 bp, Homo sapiens
cgagagaggcgcgtctgcccca

SEQ ID NO: 2704802 - DNA, 15 bp, Homo sapiens
cgagaggaggggccc

SEQ ID NO: 2704803 - DNA, 19 bp, Homo sapiens
cgagcaaagtctaaagttt

SEQ ID NO: 2704804 - DNA, 22 bp, Homo sapiens
cgagctactctcttgccagcat

SEQ ID NO: 2704805 - DNA, 15 bp, Homo sapiens
cgagctgctctgcta

SEQ ID NO: 2704806 - DNA, 19 bp, Homo sapiens
cgaggaagcagcaattaat

SEQ ID NO: 2704807 - DNA, 20 bp, Homo sapiens
cgaggtggagggtagccctg

SEQ ID NO: 2704808 - DNA, 16 bp, Homo sapiens
cgaggtgtcaccctgc

SEQ ID NO: 2704809 - DNA, 19 bp, Homo sapiens
cgaggtgtcaccctgcaga

SEQ ID NO: 2704810 - DNA, 21 bp, Homo sapiens
cgaggtttctcaaagaaattt

SEQ ID NO: 2704811 - DNA, 22 bp, Homo sapiens
cgagttgtggaaagcctctgct

SEQ ID NO: 2704812 - DNA, 16 bp, Homo sapiens
cgcaccctcccctccc

SEQ ID NO: 2704813 - DNA, 16 bp, Homo sapiens
cgcacctgccccctgg

SEQ ID NO: 2704814 - DNA, 12 bp, Homo sapiens
cgcagagcccac

SEQ ID NO: 2704815 - DNA, 16 bp, Homo sapiens
cgcagcctccctctga

SEQ ID NO: 2704816 - DNA, 16 bp, Homo sapiens
cgcagctgctgccact

SEQ ID NO: 2704817 - DNA, 20 bp, Homo sapiens
cgcagctgctgccactctgc

SEQ ID NO: 2704818 - DNA, 12 bp, Homo sapiens
cgcatcatatgc

SEQ ID NO: 2704819 - DNA, 13 bp, Homo sapiens
cgcatgccccctc

SEQ ID NO: 2704820 - DNA, 16 bp, Homo sapiens
cgcatgccccctcgtg

SEQ ID NO: 2704821 - DNA, 21 bp, Homo sapiens
cgcatgccccctcgtgccagt

SEQ ID NO: 2704822 - DNA, 14 bp, Homo sapiens
cgcatgcctcagcc

SEQ ID NO: 2704823 - DNA, 22 bp, Homo sapiens
cgcatgcctcagccagccctgg

SEQ ID NO: 2704824 - DNA, 14 bp, Homo sapiens
cgccaacagccccc

SEQ ID NO: 2704825 - DNA, 17 bp, Homo sapiens
cgccacggcactccagc

SEQ ID NO: 2704826 - DNA, 20 bp, Homo sapiens
cgccacggcactccagcctg

SEQ ID NO: 2704827 - DNA, 21 bp, Homo sapiens
cgccactgcactccagcctgg

SEQ ID NO: 2704828 - DNA, 23 bp, Homo sapiens
cgccactgcactccagcctgggc

SEQ ID NO: 2704829 - DNA, 20 bp, Homo sapiens
cgccatggcttccaaggtgg

SEQ ID NO: 2704830 - DNA, 13 bp, Homo sapiens
cgcccaccgcatg

SEQ ID NO: 2704831 - DNA, 18 bp, Homo sapiens
cgcccaccgcatgccccc

SEQ ID NO: 2704832 - DNA, 20 bp, Homo sapiens
cgcccagctgcacctgccag

SEQ ID NO: 2704833 - DNA, 14 bp, Homo sapiens
cgccccacccaggg

SEQ ID NO: 2704834 - DNA, 13 bp, Homo sapiens
cgccccccacctt

SEQ ID NO: 2704835 - DNA, 21 bp, Homo sapiens
cgcccgactagcaggcatgcc

SEQ ID NO: 2704836 - DNA, 17 bp, Homo sapiens
ccagctttctgtgtgca

SEQ ID NO: 2704837 - DNA, 18 bp, Homo sapiens
ccaggacggggccggcca

SEQ ID NO: 2704838 - DNA, 20 bp, Homo sapiens
ccaggactccttagactgat

SEQ ID NO: 2704839 - DNA, 20 bp, Homo sapiens
ccaggactggggcttgccag

SEQ ID NO: 2704840 - DNA, 18 bp, Homo sapiens
ccaggagcaaatgctgga

SEQ ID NO: 2704841 - DNA, 15 bp, Homo sapiens
ccaggattcccagag

SEQ ID NO: 2704842 - DNA, 17 bp, Homo sapiens
ccaggattcccagagag

SEQ ID NO: 2704843 - DNA, 18 bp, Homo sapiens
ccaggattcccagagaga

SEQ ID NO: 2704844 - DNA, 19 bp, Homo sapiens
ccaggattcccagagagac

SEQ ID NO: 2704845 - DNA, 17 bp, Homo sapiens
ccaggcacatggctggg

SEQ ID NO: 2704846 - DNA, 18 bp, Homo sapiens
ccaggcacatggctgggg

SEQ ID NO: 2704847 - DNA, 19 bp, Homo sapiens
ccaggcacatggctggggg

SEQ ID NO: 2704848 - DNA, 15 bp, Homo sapiens
ccaggcagctccagc

SEQ ID NO: 2704849 - DNA, 16 bp, Homo sapiens
ccaggccatcttccag

SEQ ID NO: 2704850 - DNA, 14 bp, Homo sapiens
ccaggctggccagc

SEQ ID NO: 2704851 - DNA, 16 bp, Homo sapiens
ccaggcttctcccgga

SEQ ID NO: 2704852 - DNA, 16 bp, Homo sapiens
ccagggacagaagcag

SEQ ID NO: 2704853 - DNA, 15 bp, Homo sapiens
ccagggcacagctgg

SEQ ID NO: 2704854 - DNA, 16 bp, Homo sapiens
ccagggcacagctgga

SEQ ID NO: 2704855 - DNA, 14 bp, Homo sapiens
ccagggccagggcc

SEQ ID NO: 2704856 - DNA, 16 bp, Homo sapiens
ccagggccagggccct

SEQ ID NO: 2704857 - DNA, 17 bp, Homo sapiens
ccagggccagggccctg

SEQ ID NO: 2704858 - DNA, 17 bp, Homo sapiens
ccagggcctctgtgcag

SEQ ID NO: 2704859 - DNA, 18 bp, Homo sapiens
ccagggctccctcctgga

SEQ ID NO: 2704860 - DNA, 21 bp, Homo sapiens
ccagggctccctcctggagca

SEQ ID NO: 2704861 - DNA, 17 bp, Homo sapiens
ccaggggcaggcacagc

SEQ ID NO: 2704862 - DNA, 20 bp, Homo sapiens
ccaggggtaccaggcacatg

SEQ ID NO: 2704863 - DNA, 14 bp, Homo sapiens
ccaggtctcctcca

SEQ ID NO: 2704864 - DNA, 19 bp, Homo sapiens
ccaggtctcctccaccgcc

SEQ ID NO: 2704865 - DNA, 21 bp, Homo sapiens
ccaggtcttgacctgaactct

SEQ ID NO: 2704866 - DNA, 19 bp, Homo sapiens
ccaggtgggcgggcagcac

SEQ ID NO: 2704867 - DNA, 20 bp, Homo sapiens
ccaggtgggcgggcagcaca

SEQ ID NO: 2704868 - DNA, 20 bp, Homo sapiens
ccaggtggggtgaggcagtg

SEQ ID NO: 2704869 - DNA, 21 bp, Homo sapiens
ccagtcctagagctcctgtcc

SEQ ID NO: 2704870 - DNA, 12 bp, Homo sapiens
ccagtcctgctg

SEQ ID NO: 2704871 - DNA, 14 bp, Homo sapiens
ccagtcctgctggc

SEQ ID NO: 2704872 - DNA, 16 bp, Homo sapiens
ccagtcgcgctgcctg

SEQ ID NO: 2704873 - DNA, 20 bp, Homo sapiens
ccagtcgcgctgcctgtgtg

SEQ ID NO: 2704874 - DNA, 21 bp, Homo sapiens
ccagtcgcgctgcctgtgtgg

SEQ ID NO: 2704875 - DNA, 14 bp, Homo sapiens
ccagtgacaacatc

SEQ ID NO: 2704876 - DNA, 19 bp, Homo sapiens
ccagtgagaagggcctgct

SEQ ID NO: 2704877 - DNA, 20 bp, Homo sapiens
ccagtgagaagggcctgctc

SEQ ID NO: 2704878 - DNA, 14 bp, Homo sapiens
ccagtgagcctctg

SEQ ID NO: 2704879 - DNA, 18 bp, Homo sapiens
ccagtgcccattcctcac

SEQ ID NO: 2704880 - DNA, 15 bp, Homo sapiens
ccagtgctggctgct

SEQ ID NO: 2704881 - DNA, 17 bp, Homo sapiens
ccagtgggaggacagag

SEQ ID NO: 2704882 - DNA, 14 bp, Homo sapiens
ccagtgtagccttg

SEQ ID NO: 2704883 - DNA, 18 bp, Homo sapiens
ccagtgtccccacgtatg

SEQ ID NO: 2704884 - DNA, 21 bp, Homo sapiens
ccagtgtcgtgtctgctgttg

SEQ ID NO: 2704885 - DNA, 23 bp, Homo sapiens
ccagtgtcgtgtctgctgttgtg

SEQ ID NO: 2704886 - DNA, 17 bp, Homo sapiens
ccagtgtcttcctgtgg

SEQ ID NO: 2704887 - DNA, 17 bp, Homo sapiens
ccagtgtgtgctcagca

SEQ ID NO: 2704888 - DNA, 23 bp, Homo sapiens
ccagtgtgtgctcagcagcccca

SEQ ID NO: 2704889 - DNA, 23 bp, Homo sapiens
ccagtttatgattgaatttttaa

SEQ ID NO: 2704890 - DNA, 11 bp, Homo sapiens
ccataaatcaa

SEQ ID NO: 2704891 - DNA, 18 bp, Homo sapiens
ccatactggcctcgcctg

SEQ ID NO: 2704892 - DNA, 20 bp, Homo sapiens
ccatactggcctcgcctggc

SEQ ID NO: 2704893 - DNA, 15 bp, Homo sapiens
ccatattcacacctc

SEQ ID NO: 2704894 - DNA, 13 bp, Homo sapiens
ccatattgctctt

SEQ ID NO: 2704895 - DNA, 14 bp, Homo sapiens
ccatcctcctctcc

SEQ ID NO: 2704896 - DNA, 16 bp, Homo sapiens
ccatcctcctctccat

SEQ ID NO: 2704897 - DNA, 23 bp, Homo sapiens
ccatcctcctctccatgcaagtg

SEQ ID NO: 2704898 - DNA, 14 bp, Homo sapiens
ccatcctggcccat

SEQ ID NO: 2704899 - DNA, 16 bp, Homo sapiens
ccatctaagctgcagc

SEQ ID NO: 2704900 - DNA, 21 bp, Homo sapiens
ccatctaagctgcagcttcct

SEQ ID NO: 2704901 - DNA, 13 bp, Homo sapiens
ccatctcctccca

SEQ ID NO: 2704902 - DNA, 16 bp, Homo sapiens
ccatctcctttcaggg

SEQ ID NO: 2704903 - DNA, 17 bp, Homo sapiens
ccatctcctttcaggga

SEQ ID NO: 2704904 - DNA, 12 bp, Homo sapiens
ccatctgcccag

SEQ ID NO: 2704905 - DNA, 15 bp, Homo sapiens
ccatctgcccaggac

SEQ ID NO: 2704906 - DNA, 17 bp, Homo sapiens
ccatctgtccatcctcc

SEQ ID NO: 2704907 - DNA, 18 bp, Homo sapiens
ccatctgtccatcctcct

SEQ ID NO: 2704908 - DNA, 17 bp, Homo sapiens
ccatgaagacaggacag

SEQ ID NO: 2704909 - DNA, 17 bp, Homo sapiens
ccatgatgcatggagtg

SEQ ID NO: 2704910 - DNA, 16 bp, Homo sapiens
ccatgcaagtgctgtt

SEQ ID NO: 2704911 - DNA, 18 bp, Homo sapiens
ccatgcaagtgctgtttg

SEQ ID NO: 2704912 - DNA, 21 bp, Homo sapiens
ccatgctggcggcgcagaggg

SEQ ID NO: 2704913 - DNA, 16 bp, Homo sapiens
ccatggccacgaggaa

SEQ ID NO: 2704914 - DNA, 15 bp, Homo sapiens
ccatgggcactgctg

SEQ ID NO: 2704915 - DNA, 16 bp, Homo sapiens
ccatgggcactgctgg

SEQ ID NO: 2704916 - DNA, 20 bp, Homo sapiens
ccatgggcctgctgcgtcag

SEQ ID NO: 2704917 - DNA, 16 bp, Homo sapiens
ccatggtagactgtga

SEQ ID NO: 2704918 - DNA, 16 bp, Homo sapiens
ccatgtcatgtgccac

SEQ ID NO: 2704919 - DNA, 23 bp, Homo sapiens
ccatgtccaagtccaacctgcct

SEQ ID NO: 2704920 - DNA, 20 bp, Homo sapiens
ccatgtgcacctatggccca

SEQ ID NO: 2704921 - DNA, 15 bp, Homo sapiens
ccattattttacagt

SEQ ID NO: 2704922 - DNA, 19 bp, Homo sapiens
ccattattttacagtctct

SEQ ID NO: 2704923 - DNA, 21 bp, Homo sapiens
ccattattttattttatagtc

SEQ ID NO: 2704924 - DNA, 22 bp, Homo sapiens
ccattcctcaccttttcccggg

SEQ ID NO: 2704925 - DNA, 16 bp, Homo sapiens
ccattctcctgcctca

SEQ ID NO: 2704926 - DNA, 12 bp, Homo sapiens
ccattctttctt

SEQ ID NO: 2704927 - DNA, 21 bp, Homo sapiens
ccattgctcacactacttgag

SEQ ID NO: 2704928 - DNA, 17 bp, Homo sapiens
ccattgtcttccaaccc

SEQ ID NO: 2704929 - DNA, 21 bp, Homo sapiens
ccattgtcttccaaccccagc

SEQ ID NO: 2704930 - DNA, 14 bp, Homo sapiens
ccatttcaggaggt

SEQ ID NO: 2704931 - DNA, 15 bp, Homo sapiens
ccatttctactgtat

SEQ ID NO: 2704932 - DNA, 17 bp, Homo sapiens
ccatttcttatttaatt

SEQ ID NO: 2704933 - DNA, 21 bp, Homo sapiens
ccatttgatttcgatgtacag

SEQ ID NO: 2704934 - DNA, 21 bp, Homo sapiens
ccatttggcagaactgctggg

SEQ ID NO: 2704935 - DNA, 23 bp, Homo sapiens
ccatttggcagaactgctggggc

SEQ ID NO: 2704936 - DNA, 14 bp, Homo sapiens
cccaaatcacaaac

SEQ ID NO: 2704937 - DNA, 13 bp, Homo sapiens
cccaacctgtcct

SEQ ID NO: 2704938 - DNA, 17 bp, Homo sapiens
cccaacctgtccttact

SEQ ID NO: 2704939 - DNA, 15 bp, Homo sapiens
cccaacgtgatgcta

SEQ ID NO: 2704940 - DNA, 20 bp, Homo sapiens
cccaactgatttttgtattt

SEQ ID NO: 2704941 - DNA, 15 bp, Homo sapiens
cccaagtgccagtct

SEQ ID NO: 2704942 - DNA, 13 bp, Homo sapiens
ccctgcagagcta

SEQ ID NO: 2704943 - DNA, 21 bp, Homo sapiens
ccctgcagagctatggtgagg

SEQ ID NO: 2704944 - DNA, 21 bp, Homo sapiens
ccctgcagcttggagaactcc

SEQ ID NO: 2704945 - DNA, 12 bp, Homo sapiens
ccctgcccctcc

SEQ ID NO: 2704946 - DNA, 17 bp, Homo sapiens
ccctgccccttgtcctc

SEQ ID NO: 2704947 - DNA, 20 bp, Homo sapiens
ccctgcgaaggggccctggt

SEQ ID NO: 2704948 - DNA, 10 bp, Homo sapiens
ccctgctgtc

SEQ ID NO: 2704949 - DNA, 12 bp, Homo sapiens
ccctgctgtccc

SEQ ID NO: 2704950 - DNA, 16 bp, Homo sapiens
ccctgctgtcccctct

SEQ ID NO: 2704951 - DNA, 18 bp, Homo sapiens
ccctgctgtcccctcttg

SEQ ID NO: 2704952 - DNA, 23 bp, Homo sapiens
ccctgctgtcccctcttgcccca

SEQ ID NO: 2704953 - DNA, 20 bp, Homo sapiens
ccctgcttttctcccagaag

SEQ ID NO: 2704954 - DNA, 21 bp, Homo sapiens
ccctgcttttctcccagaagg

SEQ ID NO: 2704955 - DNA, 24 bp, Homo sapiens
ccctgcttttctcccagaaggctg

SEQ ID NO: 2704956 - DNA, 14 bp, Homo sapiens
ccctggaacctttc

SEQ ID NO: 2704957 - DNA, 14 bp, Homo sapiens
ccctggccaccacc

SEQ ID NO: 2704958 - DNA, 20 bp, Homo sapiens
ccctggccaccacccaacct

SEQ ID NO: 2704959 - DNA, 21 bp, Homo sapiens
ccctggccaccacccaacctg

SEQ ID NO: 2704960 - DNA, 23 bp, Homo sapiens
ccctggccctcaaggcctcccac

SEQ ID NO: 2704961 - DNA, 15 bp, Homo sapiens
ccctggctctgccag

SEQ ID NO: 2704962 - DNA, 19 bp, Homo sapiens
ccctggctgaacagtgctc

SEQ ID NO: 2704963 - DNA, 21 bp, Homo sapiens
ccctggctgaacagtgctctg

SEQ ID NO: 2704964 - DNA, 22 bp, Homo sapiens
ccctggctgaacagtgctctgc

SEQ ID NO: 2704965 - DNA, 17 bp, Homo sapiens
ccctgggcaatgcagtg

SEQ ID NO: 2704966 - DNA, 23 bp, Homo sapiens
ccctgggcctcagcctccaggca

SEQ ID NO: 2704967 - DNA, 15 bp, Homo sapiens
ccctgggctctgccc

SEQ ID NO: 2704968 - DNA, 17 bp, Homo sapiens
ccctgggctctgtgggc

SEQ ID NO: 2704969 - DNA, 16 bp, Homo sapiens
ccctggggcactcccc

SEQ ID NO: 2704970 - DNA, 18 bp, Homo sapiens
ccctggggcactccccca

SEQ ID NO: 2704971 - DNA, 19 bp, Homo sapiens
ccctggggcactcccccag

SEQ ID NO: 2704972 - DNA, 21 bp, Homo sapiens
ccctggggcactcccccagga

SEQ ID NO: 2704973 - DNA, 13 bp, Homo sapiens
ccctggggcccca

SEQ ID NO: 2704974 - DNA, 18 bp, Homo sapiens
ccctgggtttggcccctg

SEQ ID NO: 2704975 - DNA, 17 bp, Homo sapiens
ccctggtccttccaggc

SEQ ID NO: 2704976 - DNA, 20 bp, Homo sapiens
ccctggtggacagtcctggg

SEQ ID NO: 2704977 - DNA, 21 bp, Homo sapiens
ccctggtggacagtcctggga

SEQ ID NO: 2704978 - DNA, 19 bp, Homo sapiens
ccctgtcccctggggctgg

SEQ ID NO: 2704979 - DNA, 18 bp, Homo sapiens
ccctgtggggcctgatgg

SEQ ID NO: 2704980 - DNA, 22 bp, Homo sapiens
cccttaaaaattaaattctctc

SEQ ID NO: 2704981 - DNA, 18 bp, Homo sapiens
cccttagaagatctgctt

SEQ ID NO: 2704982 - DNA, 12 bp, Homo sapiens
cccttcctcatc

SEQ ID NO: 2704983 - DNA, 20 bp, Homo sapiens
cccttcctcatctgtgcctg

SEQ ID NO: 2704984 - DNA, 23 bp, Homo sapiens
cccttcctcatctgtgcctgtct

SEQ ID NO: 2704985 - DNA, 12 bp, Homo sapiens
cccttcctgacc

SEQ ID NO: 2704986 - DNA, 18 bp, Homo sapiens
cccttcctgacccggatt

SEQ ID NO: 2704987 - DNA, 13 bp, Homo sapiens
cccttctccagca

SEQ ID NO: 2704988 - DNA, 19 bp, Homo sapiens
cccttgagtaggccctgct

SEQ ID NO: 2704989 - DNA, 20 bp, Homo sapiens
cccttgagtaggccctgctt

SEQ ID NO: 2704990 - DNA, 14 bp, Homo sapiens
cccttgtccctggg

SEQ ID NO: 2704991 - DNA, 17 bp, Homo sapiens
cccttgtccctggggca

SEQ ID NO: 2704992 - DNA, 20 bp, Homo sapiens
cccttgtcctctcagagcct

SEQ ID NO: 2704993 - DNA, 22 bp, Homo sapiens
cccttgtcctctcagagcctca

SEQ ID NO: 2704994 - DNA, 19 bp, Homo sapiens
cccttgtgtgtaccacacc

SEQ ID NO: 2704995 - DNA, 21 bp, Homo sapiens
cccttgtgtgtaccacaccct

SEQ ID NO: 2704996 - DNA, 15 bp, Homo sapiens
ccctttttgcagggg

SEQ ID NO: 2704997 - DNA, 15 bp, Homo sapiens
ccgactagcaggcat

SEQ ID NO: 2704998 - DNA, 21 bp, Homo sapiens
ccgacttgaattttcccactg

SEQ ID NO: 2704999 - DNA, 22 bp, Homo sapiens
ccgacttgaattttcccactgc

SEQ ID NO: 2705000 - DNA, 13 bp, Homo sapiens
ccgacttttctaa

SEQ ID NO: 2705001 - DNA, 13 bp, Homo sapiens
ccgagagaggcgc

SEQ ID NO: 2705002 - DNA, 22 bp, Homo sapiens
ccgagagaggcgcgtctgcccc

SEQ ID NO: 2705003 - DNA, 18 bp, Homo sapiens
ccgagcaaagtctaaagt

SEQ ID NO: 2705004 - DNA, 16 bp, Homo sapiens
ccgagctactctcttg

SEQ ID NO: 2705005 - DNA, 21 bp, Homo sapiens
ccgagctactctcttgccagc

SEQ ID NO: 2705006 - DNA, 22 bp, Homo sapiens
ccgagctactctcttgccagca

SEQ ID NO: 2705007 - DNA, 23 bp, Homo sapiens
ccgagctactctcttgccagcat

SEQ ID NO: 2705008 - DNA, 19 bp, Homo sapiens
ccgatgcccaatccaggcc

SEQ ID NO: 2705009 - DNA, 20 bp, Homo sapiens
ccgatgcccaatccaggccc

SEQ ID NO: 2705010 - DNA, 18 bp, Homo sapiens
ccgcagctgctgccactc

SEQ ID NO: 2705011 - DNA, 22 bp, Homo sapiens
ccgcagctgctgccactctgct

SEQ ID NO: 2705012 - DNA, 15 bp, Homo sapiens
ccgcagggcctgcta

SEQ ID NO: 2705013 - DNA, 14 bp, Homo sapiens
ccgcatggcagctg

SEQ ID NO: 2705014 - DNA, 16 bp, Homo sapiens
ccgcccaggctggcca

SEQ ID NO: 2705015 - DNA, 22 bp, Homo sapiens
ccgcccaggctggccagcccca

SEQ ID NO: 2705016 - DNA, 14 bp, Homo sapiens
ccgccgcctcgccc

SEQ ID NO: 2705017 - DNA, 21 bp, Homo sapiens
ccgccggaccgcgtagagagc

SEQ ID NO: 2705018 - DNA, 14 bp, Homo sapiens
ccgcctcggcctcc

SEQ ID NO: 2705019 - DNA, 18 bp, Homo sapiens
ccgcctctgcccgcagag

SEQ ID NO: 2705020 - DNA, 20 bp, Homo sapiens
ccgcggtaggtaagggccgc

SEQ ID NO: 2705021 - DNA, 20 bp, Homo sapiens
ccgctgcccggcgccctctg

SEQ ID NO: 2705022 - DNA, 23 bp, Homo sapiens
ccgctgcccggcgccctctgtcc

SEQ ID NO: 2705023 - DNA, 21 bp, Homo sapiens
ccgctggatggggagtctcat

SEQ ID NO: 2705024 - DNA, 22 bp, Homo sapiens
ccgcttgcctcggctcctgctg

SEQ ID NO: 2705025 - DNA, 23 bp, Homo sapiens
ccggacggacgttggttctgcac

SEQ ID NO: 2705026 - DNA, 16 bp, Homo sapiens
ccggagcgaccctggc

SEQ ID NO: 2705027 - DNA, 19 bp, Homo sapiens
ccggaggtgtcaccttcct

SEQ ID NO: 2705028 - DNA, 14 bp, Homo sapiens
ccggattggccctg

SEQ ID NO: 2705029 - DNA, 17 bp, Homo sapiens
ccggccacgtctgtgct

SEQ ID NO: 2705030 - DNA, 21 bp, Homo sapiens
ccggccacgtctgtgctctgt

SEQ ID NO: 2705031 - DNA, 16 bp, Homo sapiens
ccggccctgcccctcc

SEQ ID NO: 2705032 - DNA, 12 bp, Homo sapiens
ccggcttgcctg

SEQ ID NO: 2705033 - DNA, 13 bp, Homo sapiens
ccgggaaagctgt

SEQ ID NO: 2705034 - DNA, 21 bp, Homo sapiens
ccgggaagcatcctccccacc

SEQ ID NO: 2705035 - DNA, 16 bp, Homo sapiens
ccgggaggggcccgct

SEQ ID NO: 2705036 - DNA, 20 bp, Homo sapiens
ccgggctcagggaccacagc

SEQ ID NO: 2705037 - DNA, 23 bp, Homo sapiens
ccggggaggagagagcagcttct

SEQ ID NO: 2705038 - DNA, 23 bp, Homo sapiens
ccggggccttggtcccagacagc

SEQ ID NO: 2705039 - DNA, 14 bp, Homo sapiens
ccggtgaggccaag

SEQ ID NO: 2705040 - DNA, 14 bp, Homo sapiens
ccggtgcagaacag

SEQ ID NO: 2705041 - DNA, 22 bp, Homo sapiens
ccggtgcatgcaggtctccatg

SEQ ID NO: 2705042 - DNA, 15 bp, Homo sapiens
ccggtgtgcctgcag

SEQ ID NO: 2705043 - DNA, 20 bp, Homo sapiens
ccgtcattgatggagcctga

SEQ ID NO: 2705044 - DNA, 13 bp, Homo sapiens
ccgtccctcctgt

SEQ ID NO: 2705045 - DNA, 11 bp, Homo sapiens
ccgtgagccct

SEQ ID NO: 2705046 - DNA, 19 bp, Homo sapiens
ccgtgatttggaagagagg

SEQ ID NO: 2705047 - DNA, 16 bp, Homo sapiens
ccgtggcaaccctcag

SEQ ID NO: 2705048 - DNA, 17 bp, Homo sapiens
ccgtggccccagcctgg

SEQ ID NO: 2705049 - DNA, 23 bp, Homo sapiens
ccgtggctccagaatgtgctgcc

SEQ ID NO: 2705050 - DNA, 20 bp, Homo sapiens
ccgtgggggcaggggacctg

SEQ ID NO: 2705051 - DNA, 17 bp, Homo sapiens
ccgtgtgctcctcggca

SEQ ID NO: 2705052 - DNA, 14 bp, Homo sapiens
ccgttgtctccctg

SEQ ID NO: 2705053 - DNA, 18 bp, Homo sapiens
ccgttgtctccctggccc

SEQ ID NO: 2705054 - DNA, 19 bp, Homo sapiens
ccgttgtctccctggccct

SEQ ID NO: 2705055 - DNA, 21 bp, Homo sapiens
ccgttgtctccctggccctca

SEQ ID NO: 2705056 - DNA, 19 bp, Homo sapiens
ccgtttacagtgtatttaa

SEQ ID NO: 2705057 - DNA, 18 bp, Homo sapiens
cctaatcatataccagag

SEQ ID NO: 2705058 - DNA, 20 bp, Homo sapiens
cctacccactctttgctaca

SEQ ID NO: 2705059 - DNA, 18 bp, Homo sapiens
cctacccctcccagctga

SEQ ID NO: 2705060 - DNA, 20 bp, Homo sapiens
cctaccgcatggcagctggg

SEQ ID NO: 2705061 - DNA, 21 bp, Homo sapiens
cctaccgcatggcagctgggc

SEQ ID NO: 2705062 - DNA, 20 bp, Homo sapiens
cctagagctcctgtccctac

SEQ ID NO: 2705063 - DNA, 22 bp, Homo sapiens
cctagagctcctgtccctaccc

SEQ ID NO: 2705064 - DNA, 16 bp, Homo sapiens
cctagaggtcccctca

SEQ ID NO: 2705065 - DNA, 20 bp, Homo sapiens
cctagaggtcccctcacgtg

SEQ ID NO: 2705066 - DNA, 22 bp, Homo sapiens
cctagatccaggcttctcccgg

SEQ ID NO: 2705067 - DNA, 15 bp, Homo sapiens
tttttagcttcatat

SEQ ID NO: 2705068 - DNA, 18 bp, Homo sapiens
tttttagcttcatatcta

SEQ ID NO: 2705069 - DNA, 13 bp, Homo sapiens
tttttattatttg

SEQ ID NO: 2705070 - DNA, 14 bp, Homo sapiens
tttttattatttgt

SEQ ID NO: 2705071 - DNA, 15 bp, Homo sapiens
tttttccagaattga

SEQ ID NO: 2705072 - DNA, 22 bp, Homo sapiens
tttttgaatgtcataaagaaga

SEQ ID NO: 2705073 - DNA, 16 bp, Homo sapiens
tttttgcaggggactg

SEQ ID NO: 2705074 - DNA, 13 bp, Homo sapiens
tttttgtacatta

SEQ ID NO: 2705075 - DNA, 16 bp, Homo sapiens
tttttgtacctggtga

SEQ ID NO: 2705076 - DNA, 13 bp, Homo sapiens
ttttttttgtaaa

SEQ ID NO: 2705077 - DNA, 18 bp, Homo sapiens
ttgcctcggctcctgctg

SEQ ID NO: 2705078 - DNA, 19 bp, Homo sapiens
ttgcctcggctcctgctgc

SEQ ID NO: 2705079 - DNA, 20 bp, Homo sapiens
ttgcctcggctcctgctgca

SEQ ID NO: 2705080 - DNA, 22 bp, Homo sapiens
ttgctaccaaaaactagacatt

SEQ ID NO: 2705081 - DNA, 14 bp, Homo sapiens
ttgctcttaaaaat

SEQ ID NO: 2705082 - DNA, 16 bp, Homo sapiens
ttgctgacacatcagt

SEQ ID NO: 2705083 - DNA, 11 bp, Homo sapiens
ttgctgtccta

SEQ ID NO: 2705084 - DNA, 18 bp, Homo sapiens
ttgctgtgctgtacatta

SEQ ID NO: 2705085 - DNA, 13 bp, Homo sapiens
ttgctgttgctgt

SEQ ID NO: 2705086 - DNA, 23 bp, Homo sapiens
ttgcttctggctttgttcttgtc

SEQ ID NO: 2705087 - DNA, 16 bp, Homo sapiens
ttggaaaagaaatcaa

SEQ ID NO: 2705088 - DNA, 16 bp, Homo sapiens
ttggaaagaggttctg

SEQ ID NO: 2705089 - DNA, 19 bp, Homo sapiens
ttggaaagaggttctgcac

SEQ ID NO: 2705090 - DNA, 20 bp, Homo sapiens
ttggaaagcatcacctcagg

SEQ ID NO: 2705091 - DNA, 21 bp, Homo sapiens
ttggaagagaggcacctgctg

SEQ ID NO: 2705092 - DNA, 14 bp, Homo sapiens
ttggaattttcttt

SEQ ID NO: 2705093 - DNA, 23 bp, Homo sapiens
ttggaattttctttcatacatta

SEQ ID NO: 2705094 - DNA, 23 bp, Homo sapiens
ttggaattttgtaaaaagaaatt

SEQ ID NO: 2705095 - DNA, 20 bp, Homo sapiens
ttggagactctgtggggcct

SEQ ID NO: 2705096 - DNA, 14 bp, Homo sapiens
ttggagagcagctg

SEQ ID NO: 2705097 - DNA, 17 bp, Homo sapiens
ttggagtgctgcagctt

SEQ ID NO: 2705098 - DNA, 23 bp, Homo sapiens
ttggcacctgcctagctcttggg

SEQ ID NO: 2705099 - DNA, 19 bp, Homo sapiens
ttggcagaactgctggggc

SEQ ID NO: 2705100 - DNA, 22 bp, Homo sapiens
ttggcagcaggtgctgctaccc

SEQ ID NO: 2705101 - DNA, 16 bp, Homo sapiens
ttggcaggaggcagga

SEQ ID NO: 2705102 - DNA, 12 bp, Homo sapiens
ttggccctgccc

SEQ ID NO: 2705103 - DNA, 14 bp, Homo sapiens
ttggccctgcccct

SEQ ID NO: 2705104 - DNA, 15 bp, Homo sapiens
ttggcgcaccctccc

SEQ ID NO: 2705105 - DNA, 14 bp, Homo sapiens
ttggcttcccctcc

SEQ ID NO: 2705106 - DNA, 19 bp, Homo sapiens
ttgggaagctatttccttt

SEQ ID NO: 2705107 - DNA, 20 bp, Homo sapiens
ttgggcagaatcctgggccc

SEQ ID NO: 2705108 - DNA, 16 bp, Homo sapiens
ttgggccatactggcc

SEQ ID NO: 2705109 - DNA, 19 bp, Homo sapiens
ttgggggttaccaaaaata

SEQ ID NO: 2705110 - DNA, 21 bp, Homo sapiens
ttggtaccttaatttgactgt

SEQ ID NO: 2705111 - DNA, 17 bp, Homo sapiens
ttggtcttactttgtgc

SEQ ID NO: 2705112 - DNA, 13 bp, Homo sapiens
ttggtttggtaca

SEQ ID NO: 2705113 - DNA, 17 bp, Homo sapiens
ttgtaaaggtaggtgca

SEQ ID NO: 2705114 - DNA, 21 bp, Homo sapiens
ttgtaaataaccacactgaaa

SEQ ID NO: 2705115 - DNA, 12 bp, Homo sapiens
ttgtaaatactc

SEQ ID NO: 2705116 - DNA, 18 bp, Homo sapiens
ttgtaaatgagacacata

SEQ ID NO: 2705117 - DNA, 14 bp, Homo sapiens
ttgtaaatttctct

SEQ ID NO: 2705118 - DNA, 22 bp, Homo sapiens
ttgtaatgtttgtcagtaaata

SEQ ID NO: 2705119 - DNA, 18 bp, Homo sapiens
ttgtacaaagatatgcta

SEQ ID NO: 2705120 - DNA, 11 bp, Homo sapiens
ttgtacagttc

SEQ ID NO: 2705121 - DNA, 11 bp, Homo sapiens
ttgtacattat

SEQ ID NO: 2705122 - DNA, 15 bp, Homo sapiens
ttgtacattatgtta

SEQ ID NO: 2705123 - DNA, 20 bp, Homo sapiens
ttgtacattatgttattgga

SEQ ID NO: 2705124 - DNA, 12 bp, Homo sapiens
ttgtaccatatt

SEQ ID NO: 2705125 - DNA, 17 bp, Homo sapiens
ttgtaccatattgctct

SEQ ID NO: 2705126 - DNA, 23 bp, Homo sapiens
ttgtataccatgatgcatggagt

SEQ ID NO: 2705127 - DNA, 22 bp, Homo sapiens
ttgtcaaatagcaaggccaggg

SEQ ID NO: 2705128 - DNA, 13 bp, Homo sapiens
ttgtccccagctc

SEQ ID NO: 2705129 - DNA, 12 bp, Homo sapiens
ttgtccctgggg

SEQ ID NO: 2705130 - DNA, 21 bp, Homo sapiens
ttgtccctggggcactccccc

SEQ ID NO: 2705131 - DNA, 22 bp, Homo sapiens
ttgtccctggggcactccccca

SEQ ID NO: 2705132 - DNA, 17 bp, Homo sapiens
ttgtctccctggccctc

SEQ ID NO: 2705133 - DNA, 18 bp, Homo sapiens
ttgtcttccaaccccagc

SEQ ID NO: 2705134 - DNA, 17 bp, Homo sapiens
ttgtctttcaaaagaca

SEQ ID NO: 2705135 - DNA, 11 bp, Homo sapiens
ttgtctttctt

SEQ ID NO: 2705136 - DNA, 16 bp, Homo sapiens
ttgtctttctttgctg

SEQ ID NO: 2705137 - DNA, 13 bp, Homo sapiens
ttgtgaaagaagg

SEQ ID NO: 2705138 - DNA, 13 bp, Homo sapiens
ttgtggaaactgg

SEQ ID NO: 2705139 - DNA, 18 bp, Homo sapiens
ttgtgtatgagactgtgt

SEQ ID NO: 2705140 - DNA, 18 bp, Homo sapiens
ttgtgttggctttacaaa

SEQ ID NO: 2705141 - DNA, 19 bp, Homo sapiens
ttgttaggagatgtcatca

SEQ ID NO: 2705142 - DNA, 21 bp, Homo sapiens
ttgttattaaaaaaacacaaa

SEQ ID NO: 2705143 - DNA, 17 bp, Homo sapiens
ttgttattcttttccag

SEQ ID NO: 2705144 - DNA, 14 bp, Homo sapiens
ttgttcaacagttt

SEQ ID NO: 2705145 - DNA, 16 bp, Homo sapiens
ttgttcaacagtttct

SEQ ID NO: 2705146 - DNA, 13 bp, Homo sapiens
ttgttctgggtga

SEQ ID NO: 2705147 - DNA, 13 bp, Homo sapiens
ttgttcttgtcat

SEQ ID NO: 2705148 - DNA, 16 bp, Homo sapiens
ttgttgagtctctgaa

SEQ ID NO: 2705149 - DNA, 11 bp, Homo sapiens
ttgttgctgtt

SEQ ID NO: 2705150 - DNA, 20 bp, Homo sapiens
ttgttgttattttttgagaa

SEQ ID NO: 2705151 - DNA, 14 bp, Homo sapiens
ttgtttgcacagag

SEQ ID NO: 2705152 - DNA, 13 bp, Homo sapiens
ttgttttaaaagg

SEQ ID NO: 2705153 - DNA, 17 bp, Homo sapiens
ttgttttcccgccaagc

SEQ ID NO: 2705154 - DNA, 22 bp, Homo sapiens
tttaaaaaaagtatatattcta

SEQ ID NO: 2705155 - DNA, 20 bp, Homo sapiens
tttaaaagggttcaaggact

SEQ ID NO: 2705156 - DNA, 17 bp, Homo sapiens
tttaaaatgaagcaatt

SEQ ID NO: 2705157 - DNA, 15 bp, Homo sapiens
tttaaagaaacacta

SEQ ID NO: 2705158 - DNA, 13 bp, Homo sapiens
tttaaaggacaaa

SEQ ID NO: 2705159 - DNA, 21 bp, Homo sapiens
tttaaaggacaaacagtgaat

SEQ ID NO: 2705160 - DNA, 19 bp, Homo sapiens
tttaaataaaagcacaagt

SEQ ID NO: 2705161 - DNA, 17 bp, Homo sapiens
tttaaataaaatagagt

SEQ ID NO: 2705162 - DNA, 21 bp, Homo sapiens
tttaacaggttttcttctaat

SEQ ID NO: 2705163 - DNA, 12 bp, Homo sapiens
tttaacatgtga

SEQ ID NO: 2705164 - DNA, 14 bp, Homo sapiens
tttaactgccttgt

SEQ ID NO: 2705165 - DNA, 19 bp, Homo sapiens
tttaacttgagggtaataa

SEQ ID NO: 2705166 - DNA, 17 bp, Homo sapiens
tttaagtactatctttg

SEQ ID NO: 2705167 - DNA, 23 bp, Homo sapiens
tttaagtactatctttgtctaaa

SEQ ID NO: 2705168 - DNA, 22 bp, Homo sapiens
tttaagttttgtttgttcacac

SEQ ID NO: 2705169 - DNA, 23 bp, Homo sapiens
tttaatatctgagaagtgtatat

SEQ ID NO: 2705170 - DNA, 18 bp, Homo sapiens
tttaatgatttttgtgta

SEQ ID NO: 2705171 - DNA, 18 bp, Homo sapiens
tttaattagaatggataa

SEQ ID NO: 2705172 - DNA, 20 bp, Homo sapiens
tttaatttataggcagatct

SEQ ID NO: 2705173 - DNA, 22 bp, Homo sapiens
tttaatttataggcagatcttt

SEQ ID NO: 2705174 - DNA, 14 bp, Homo sapiens
tttacaaataattt

SEQ ID NO: 2705175 - DNA, 17 bp, Homo sapiens
tttacaacaaacactgt

SEQ ID NO: 2705176 - DNA, 15 bp, Homo sapiens
tttacagtaaataaa

SEQ ID NO: 2705177 - DNA, 19 bp, Homo sapiens
tttacagtaaataaattgt

SEQ ID NO: 2705178 - DNA, 20 bp, Homo sapiens
tttacagtctctgttgtaaa

SEQ ID NO: 2705179 - DNA, 18 bp, Homo sapiens
tttacagtgtatttaaga

SEQ ID NO: 2705180 - DNA, 11 bp, Homo sapiens
tttaccaaagc

SEQ ID NO: 2705181 - DNA, 14 bp, Homo sapiens
tttaccaaagcatc

SEQ ID NO: 2705182 - DNA, 15 bp, Homo sapiens
tttaccctcctctat

SEQ ID NO: 2705183 - DNA, 15 bp, Homo sapiens
tttactttttaaaca

SEQ ID NO: 2705184 - DNA, 18 bp, Homo sapiens
tttagaaaatttactaat

SEQ ID NO: 2705185 - DNA, 19 bp, Homo sapiens
tttagaatcaagtctgtga

SEQ ID NO: 2705186 - DNA, 16 bp, Homo sapiens
tttagttttaaaactc

SEQ ID NO: 2705187 - DNA, 16 bp, Homo sapiens
tttataaacctctaat

SEQ ID NO: 2705188 - DNA, 17 bp, Homo sapiens
tttataaacctctaatt

SEQ ID NO: 2705189 - DNA, 14 bp, Homo sapiens
tttatacataaaca

SEQ ID NO: 2705190 - DNA, 21 bp, Homo sapiens
tttataggcagatctttaaat

SEQ ID NO: 2705191 - DNA, 23 bp, Homo sapiens
tttatattcatcaaataaacctt

SEQ ID NO: 2705192 - DNA, 19 bp, Homo sapiens
tttatgtctaaagagcttt

SEQ ID NO: 2705193 - DNA, 19 bp, Homo sapiens
tttattaaatgtagaaagt

SEQ ID NO: 2705194 - DNA, 20 bp, Homo sapiens
tttcaaactcctgactttgt

SEQ ID NO: 2705195 - DNA, 15 bp, Homo sapiens
tttcaccacattcgt

SEQ ID NO: 2705196 - DNA, 17 bp, Homo sapiens
tttcagcatcaaacatg

SEQ ID NO: 2705197 - DNA, 20 bp, Homo sapiens
tttcagcatcaaacatgaaa

SEQ ID NO: 2705198 - DNA, 21 bp, Homo sapiens
tttcagcatcaaacatgaaaa

SEQ ID NO: 2705199 - DNA, 22 bp, Homo sapiens
tttcagcatcaaacatgaaaac

SEQ ID NO: 2705200 - DNA, 17 bp, Homo sapiens
tttcagctatgcagaaa

SEQ ID NO: 2705201 - DNA, 14 bp, Homo sapiens
tttcagctgtgaac

SEQ ID NO: 2705202 - DNA, 21 bp, Homo sapiens
tttcagctgtgaacatggact

SEQ ID NO: 2705203 - DNA, 13 bp, Homo sapiens
tttcatgagccca

SEQ ID NO: 2705204 - DNA, 14 bp, Homo sapiens
tttccacataaagg

SEQ ID NO: 2705205 - DNA, 17 bp, Homo sapiens
tttccactcaggtctgt

SEQ ID NO: 2705206 - DNA, 21 bp, Homo sapiens
tttccagaaagaaaatgaatt

SEQ ID NO: 2705207 - DNA, 19 bp, Homo sapiens
tttcccgtggccccagcct

SEQ ID NO: 2705208 - DNA, 20 bp, Homo sapiens
tttcccgtggccccagcctg

SEQ ID NO: 2705209 - DNA, 21 bp, Homo sapiens
tttcccgtggccccagcctgg

SEQ ID NO: 2705210 - DNA, 22 bp, Homo sapiens
tttccgtggcaaccctcagctg

SEQ ID NO: 2705211 - DNA, 20 bp, Homo sapiens
tttcgtgtaatattctctga

SEQ ID NO: 2705212 - DNA, 16 bp, Homo sapiens
tttctaacataagtaa

SEQ ID NO: 2705213 - DNA, 16 bp, Homo sapiens
tttctacggtgacagt

SEQ ID NO: 2705214 - DNA, 16 bp, Homo sapiens
tttctacttttaaaga

SEQ ID NO: 2705215 - DNA, 16 bp, Homo sapiens
tttctagaatggtttt

SEQ ID NO: 2705216 - DNA, 16 bp, Homo sapiens
tttctagtatctattg

SEQ ID NO: 2705217 - DNA, 19 bp, Homo sapiens
tttctagtatctattgtgt

SEQ ID NO: 2705218 - DNA, 18 bp, Homo sapiens
tttctatgtatgtgccaa

SEQ ID NO: 2705219 - DNA, 13 bp, Homo sapiens
tttctcaagttta

SEQ ID NO: 2705220 - DNA, 20 bp, Homo sapiens
tttctctatgaaaagcaact

SEQ ID NO: 2705221 - DNA, 16 bp, Homo sapiens
tttctgcctgagattc

SEQ ID NO: 2705222 - DNA, 17 bp, Homo sapiens
tttctgcctgagattct

SEQ ID NO: 2705223 - DNA, 20 bp, Homo sapiens
tttctggtatcgttcgcttg

SEQ ID NO: 2705224 - DNA, 17 bp, Homo sapiens
tgagtggcagccgcctc

SEQ ID NO: 2705225 - DNA, 13 bp, Homo sapiens
tgagtggcatgtg

SEQ ID NO: 2705226 - DNA, 21 bp, Homo sapiens
tgagtggtgttggcagtgttt

SEQ ID NO: 2705227 - DNA, 16 bp, Homo sapiens
tgagtgtctctgcctg

SEQ ID NO: 2705228 - DNA, 17 bp, Homo sapiens
tgagtgtgactttttga

SEQ ID NO: 2705229 - DNA, 15 bp, Homo sapiens
tgataacattttgtt

SEQ ID NO: 2705230 - DNA, 19 bp, Homo sapiens
tgataactgcaattttaat

SEQ ID NO: 2705231 - DNA, 16 bp, Homo sapiens
tgatagtgcttcttgt

SEQ ID NO: 2705232 - DNA, 20 bp, Homo sapiens
tgatatccacaaatgctatt

SEQ ID NO: 2705233 - DNA, 16 bp, Homo sapiens
tgatatcccccagcct

SEQ ID NO: 2705234 - DNA, 19 bp, Homo sapiens
tgatatctgtttgcttcta

SEQ ID NO: 2705235 - DNA, 18 bp, Homo sapiens
tgatattgaccatgtgat

SEQ ID NO: 2705236 - DNA, 14 bp, Homo sapiens
tgatattttcacag

SEQ ID NO: 2705237 - DNA, 14 bp, Homo sapiens
tgatcagtgttaca

SEQ ID NO: 2705238 - DNA, 16 bp, Homo sapiens
tgatcatctttgctga

SEQ ID NO: 2705239 - DNA, 22 bp, Homo sapiens
tgatcattcataattttatcta

SEQ ID NO: 2705240 - DNA, 12 bp, Homo sapiens
tgatcccagcac

SEQ ID NO: 2705241 - DNA, 15 bp, Homo sapiens
tgatcgccttattta

SEQ ID NO: 2705242 - DNA, 18 bp, Homo sapiens
tgatcggagcctcctctc

SEQ ID NO: 2705243 - DNA, 13 bp, Homo sapiens
tgatctcctgagc

SEQ ID NO: 2705244 - DNA, 18 bp, Homo sapiens
tgatctcggctcactgca

SEQ ID NO: 2705245 - DNA, 19 bp, Homo sapiens
tgatgaaaactaaggattt

SEQ ID NO: 2705246 - DNA, 15 bp, Homo sapiens
tgatgaatgaggaac

SEQ ID NO: 2705247 - DNA, 20 bp, Homo sapiens
tgatgcatggagtgtttgac

SEQ ID NO: 2705248 - DNA, 24 bp, Homo sapiens
tgatgcattcccggtgcagaacag

SEQ ID NO: 2705249 - DNA, 22 bp, Homo sapiens
tgatgccacaccaagctgtgcc

SEQ ID NO: 2705250 - DNA, 23 bp, Homo sapiens
tgatgccacaccaagctgtgcca

SEQ ID NO: 2705251 - DNA, 15 bp, Homo sapiens
tgatgctgggctggg

SEQ ID NO: 2705252 - DNA, 13 bp, Homo sapiens
tgatgggccgagc

SEQ ID NO: 2705253 - DNA, 19 bp, Homo sapiens
tgatgggccgagccacctc

SEQ ID NO: 2705254 - DNA, 13 bp, Homo sapiens
tgatgtcagcctt

SEQ ID NO: 2705255 - DNA, 15 bp, Homo sapiens
tgatgtcagccttgc

SEQ ID NO: 2705256 - DNA, 16 bp, Homo sapiens
tgatgtcagccttgca

SEQ ID NO: 2705257 - DNA, 16 bp, Homo sapiens
tgattaaacagcaaag

SEQ ID NO: 2705258 - DNA, 22 bp, Homo sapiens
tgattatggacatcgatatgaa

SEQ ID NO: 2705259 - DNA, 15 bp, Homo sapiens
tgattcagcaaaaat

SEQ ID NO: 2705260 - DNA, 15 bp, Homo sapiens
tgattccacttttat

SEQ ID NO: 2705261 - DNA, 19 bp, Homo sapiens
tgattccattttacttcca

SEQ ID NO: 2705262 - DNA, 13 bp, Homo sapiens
tgattctgttcta

SEQ ID NO: 2705263 - DNA, 21 bp, Homo sapiens
tgattgaatttttaagcaaat

SEQ ID NO: 2705264 - DNA, 17 bp, Homo sapiens
tgattgcgagaattttc

SEQ ID NO: 2705265 - DNA, 23 bp, Homo sapiens
tgatttcccgtggccccagcctg

SEQ ID NO: 2705266 - DNA, 22 bp, Homo sapiens
tgatttcgatgtacagtctcaa

SEQ ID NO: 2705267 - DNA, 19 bp, Homo sapiens
tgatttttaaagaaaagtt

SEQ ID NO: 2705268 - DNA, 22 bp, Homo sapiens
tgcaaaaacatatgtctgtctt

SEQ ID NO: 2705269 - DNA, 21 bp, Homo sapiens
tgcaaaggactgtaagcagat

SEQ ID NO: 2705270 - DNA, 22 bp, Homo sapiens
tgcaacaagacaaagcaaagcc

SEQ ID NO: 2705271 - DNA, 14 bp, Homo sapiens
tgcaacaatgtgtg

SEQ ID NO: 2705272 - DNA, 22 bp, Homo sapiens
tgcaacatggattccaaagcat

SEQ ID NO: 2705273 - DNA, 20 bp, Homo sapiens
tgcaagacttcactgcagcc

SEQ ID NO: 2705274 - DNA, 12 bp, Homo sapiens
tgcaagctctgc

SEQ ID NO: 2705275 - DNA, 14 bp, Homo sapiens
tgcaagcttattta

SEQ ID NO: 2705276 - DNA, 15 bp, Homo sapiens
tgcaagggtgctgtg

SEQ ID NO: 2705277 - DNA, 17 bp, Homo sapiens
tgcaagtgggagatgaa

SEQ ID NO: 2705278 - DNA, 22 bp, Homo sapiens
tgcaatgtatggcttttctctt

SEQ ID NO: 2705279 - DNA, 12 bp, Homo sapiens
tgcaatgttttt

SEQ ID NO: 2705280 - DNA, 17 bp, Homo sapiens
tgcaattaactctggac

SEQ ID NO: 2705281 - DNA, 19 bp, Homo sapiens
tgcacagacctcagagatg

SEQ ID NO: 2705282 - DNA, 18 bp, Homo sapiens
tgcacagagggcgctcct

SEQ ID NO: 2705283 - DNA, 23 bp, Homo sapiens
tgcaccaacccagccgctgcccg

SEQ ID NO: 2705284 - DNA, 12 bp, Homo sapiens
tgcaccccctcc

SEQ ID NO: 2705285 - DNA, 14 bp, Homo sapiens
tgcaccccctcctg

SEQ ID NO: 2705286 - DNA, 17 bp, Homo sapiens
tgcaccccctcctgctg

SEQ ID NO: 2705287 - DNA, 19 bp, Homo sapiens
tgcaccccctcctgctgca

SEQ ID NO: 2705288 - DNA, 18 bp, Homo sapiens
tgcaccctcattccctcg

SEQ ID NO: 2705289 - DNA, 14 bp, Homo sapiens
tgcaccctccgcct

SEQ ID NO: 2705290 - DNA, 16 bp, Homo sapiens
tgcaccctccgccttc

SEQ ID NO: 2705291 - DNA, 21 bp, Homo sapiens
tgcacctatggcccagccact

SEQ ID NO: 2705292 - DNA, 15 bp, Homo sapiens
tgcacctgccagcct

SEQ ID NO: 2705293 - DNA, 17 bp, Homo sapiens
tgcacctgccagcctgg

SEQ ID NO: 2705294 - DNA, 18 bp, Homo sapiens
tgcacctgccagcctggc

SEQ ID NO: 2705295 - DNA, 19 bp, Homo sapiens
tgcacctgccagcctggct

SEQ ID NO: 2705296 - DNA, 22 bp, Homo sapiens
tgcacctgccagcctggcttct

SEQ ID NO: 2705297 - DNA, 19 bp, Homo sapiens
  misc_feature (10)..(10): n is a, c, g or t
tgcacctgcnttgtccctg

SEQ ID NO: 2705298 - DNA, 20 bp, Homo sapiens
  misc_feature (10)..(10): n is a, c, g or t
tgcacctgcnttgtccctgg

SEQ ID NO: 2705299 - DNA, 17 bp, Homo sapiens
tgcacgtcaccctcctg

SEQ ID NO: 2705300 - DNA, 23 bp, Homo sapiens
tgcacgtcaccctcctgagcctc

SEQ ID NO: 2705301 - DNA, 22 bp, Homo sapiens
tgcactaaaacccatcttcccc

SEQ ID NO: 2705302 - DNA, 13 bp, Homo sapiens
tgcactccagcct

SEQ ID NO: 2705303 - DNA, 16 bp, Homo sapiens
tgcactctgtgcccat

SEQ ID NO: 2705304 - DNA, 16 bp, Homo sapiens
tgcactgtatgctgga

SEQ ID NO: 2705305 - DNA, 13 bp, Homo sapiens
tgcactgtcctgc

SEQ ID NO: 2705306 - DNA, 18 bp, Homo sapiens
tgcactgtcctgctccac

SEQ ID NO: 2705307 - DNA, 20 bp, Homo sapiens
tgcactgtcctgctccacag

SEQ ID NO: 2705308 - DNA, 18 bp, Homo sapiens
tgcagaacaggggcaccc

SEQ ID NO: 2705309 - DNA, 19 bp, Homo sapiens
tgcagagctatggtgaggt

SEQ ID NO: 2705310 - DNA, 18 bp, Homo sapiens
tgcagaggggcaggccct

SEQ ID NO: 2705311 - DNA, 20 bp, Homo sapiens
tgcagaggggcaggccctgc

SEQ ID NO: 2705312 - DNA, 22 bp, Homo sapiens
tgcagaggggctttctggagag

SEQ ID NO: 2705313 - DNA, 13 bp, Homo sapiens
tgcagctcctgga

SEQ ID NO: 2705314 - DNA, 13 bp, Homo sapiens
tgcagctctgcag

SEQ ID NO: 2705315 - DNA, 20 bp, Homo sapiens
tgcagctctgcagcaatatt

SEQ ID NO: 2705316 - DNA, 13 bp, Homo sapiens
tgcagcttcctgt

SEQ ID NO: 2705317 - DNA, 16 bp, Homo sapiens
tgcagctttggctgca

SEQ ID NO: 2705318 - DNA, 17 bp, Homo sapiens
tgcagctttgggaaagc

SEQ ID NO: 2705319 - DNA, 20 bp, Homo sapiens
tgcaggccaagagcagaggc

SEQ ID NO: 2705320 - DNA, 13 bp, Homo sapiens
tgcaggggactgg

SEQ ID NO: 2705321 - DNA, 20 bp, Homo sapiens
tgcaggggactgggccatgg

SEQ ID NO: 2705322 - DNA, 18 bp, Homo sapiens
tgcagtgacgtgcacctg

SEQ ID NO: 2705323 - DNA, 19 bp, Homo sapiens
tgcataaacaatccaaatg

SEQ ID NO: 2705324 - DNA, 23 bp, Homo sapiens
tgcataaacaatccaaatgcatt

SEQ ID NO: 2705325 - DNA, 18 bp, Homo sapiens
tgcatatctctagtccct

SEQ ID NO: 2705326 - DNA, 19 bp, Homo sapiens
tgcatcaagggctttatca

SEQ ID NO: 2705327 - DNA, 11 bp, Homo sapiens
tgcatgaaaat

SEQ ID NO: 2705328 - DNA, 15 bp, Homo sapiens
tgcatgcataatgaa

SEQ ID NO: 2705329 - DNA, 17 bp, Homo sapiens
tgcatgcataatgaacc

SEQ ID NO: 2705330 - DNA, 15 bp, Homo sapiens
tgcatggagtgtttg

SEQ ID NO: 2705331 - DNA, 17 bp, Homo sapiens
tgcatggagtgtttgac

SEQ ID NO: 2705332 - DNA, 16 bp, Homo sapiens
tgcatggcactgaccg

SEQ ID NO: 2705333 - DNA, 19 bp, Homo sapiens
tgcatgtaaaatcttcagc

SEQ ID NO: 2705334 - DNA, 20 bp, Homo sapiens
tgaaagtgggtttcaattta

SEQ ID NO: 2705335 - DNA, 18 bp, Homo sapiens
tgaaatacttattatttt

SEQ ID NO: 2705336 - DNA, 22 bp, Homo sapiens
tgaacaatacgtgaaagatgca

SEQ ID NO: 2705337 - DNA, 15 bp, Homo sapiens
tgaacagcttcactt

SEQ ID NO: 2705338 - DNA, 17 bp, Homo sapiens
tgaacagtgctctgcct

SEQ ID NO: 2705339 - DNA, 18 bp, Homo sapiens
tgaacagtgctctgcctc

SEQ ID NO: 2705340 - DNA, 21 bp, Homo sapiens
tgaacagtttggatgtcctca

SEQ ID NO: 2705341 - DNA, 22 bp, Homo sapiens
tgaacagtttggatgtcctcaa

SEQ ID NO: 2705342 - DNA, 12 bp, Homo sapiens
tgaacccaggag

SEQ ID NO: 2705343 - DNA, 13 bp, Homo sapiens
tgaacccaggagg

SEQ ID NO: 2705344 - DNA, 20 bp, Homo sapiens
tgaaccgtgtgctcctcggc

SEQ ID NO: 2705345 - DNA, 16 bp, Homo sapiens
tgaaccgtttacagtg

SEQ ID NO: 2705346 - DNA, 17 bp, Homo sapiens
tgaaccgtttacagtgt

SEQ ID NO: 2705347 - DNA, 17 bp, Homo sapiens
tgaactctgcaactgaa

SEQ ID NO: 2705348 - DNA, 13 bp, Homo sapiens
tgaactggccact

SEQ ID NO: 2705349 - DNA, 13 bp, Homo sapiens
tgaagaagctggg

SEQ ID NO: 2705350 - DNA, 14 bp, Homo sapiens
tgaagcaaacacac

SEQ ID NO: 2705351 - DNA, 20 bp, Homo sapiens
tgaaggatttcttattttct

SEQ ID NO: 2705352 - DNA, 18 bp, Homo sapiens
tgaaggcttctgcagctt

SEQ ID NO: 2705353 - DNA, 18 bp, Homo sapiens
tgaagtcttgcattgaat

SEQ ID NO: 2705354 - DNA, 14 bp, Homo sapiens
tgaagtgattgaaa

SEQ ID NO: 2705355 - DNA, 13 bp, Homo sapiens
tgaataaacttca

SEQ ID NO: 2705356 - DNA, 18 bp, Homo sapiens
tgaataaacttcagcacc

SEQ ID NO: 2705357 - DNA, 19 bp, Homo sapiens
tgaataaacttcagcacca

SEQ ID NO: 2705358 - DNA, 22 bp, Homo sapiens
tgaataaagggaacatgcagct

SEQ ID NO: 2705359 - DNA, 23 bp, Homo sapiens
tgaataaagggaacatgcagctc

SEQ ID NO: 2705360 - DNA, 15 bp, Homo sapiens
tgaatggcctgcctt

SEQ ID NO: 2705361 - DNA, 17 bp, Homo sapiens
tgaatggcctgccttga

SEQ ID NO: 2705362 - DNA, 14 bp, Homo sapiens
tgaatgtcattatt

SEQ ID NO: 2705363 - DNA, 23 bp, Homo sapiens
tgaatgtgatcatctttgctgaa

SEQ ID NO: 2705364 - DNA, 17 bp, Homo sapiens
tgaattcacaaacaaat

SEQ ID NO: 2705365 - DNA, 17 bp, Homo sapiens
tgaatttaagcatgagt

SEQ ID NO: 2705366 - DNA, 15 bp, Homo sapiens
tgaatttggagactc

SEQ ID NO: 2705367 - DNA, 20 bp, Homo sapiens
tgaatttggagactctgtgg

SEQ ID NO: 2705368 - DNA, 17 bp, Homo sapiens
tgaatttttaagcaaat

SEQ ID NO: 2705369 - DNA, 14 bp, Homo sapiens
tgacaagggcacaa

SEQ ID NO: 2705370 - DNA, 20 bp, Homo sapiens
tgacactgcggggcttggct

SEQ ID NO: 2705371 - DNA, 22 bp, Homo sapiens
tgacagatcctccatttttgtt

SEQ ID NO: 2705372 - DNA, 18 bp, Homo sapiens
tgacagtcctctccacct

SEQ ID NO: 2705373 - DNA, 22 bp, Homo sapiens
tgacagtgacgtgactcagagc

SEQ ID NO: 2705374 - DNA, 23 bp, Homo sapiens
tgacagtgacgtgactcagagct

SEQ ID NO: 2705375 - DNA, 24 bp, Homo sapiens
tgacatcagaagtaactcccactc

SEQ ID NO: 2705376 - DNA, 18 bp, Homo sapiens
tgacattgtaagaggtgg

SEQ ID NO: 2705377 - DNA, 23 bp, Homo sapiens
tgaccagccccgtgtagccccgg

SEQ ID NO: 2705378 - DNA, 20 bp, Homo sapiens
tgacccagtgtgtgctcagc

SEQ ID NO: 2705379 - DNA, 21 bp, Homo sapiens
tgacccagtgtgtgctcagca

SEQ ID NO: 2705380 - DNA, 18 bp, Homo sapiens
tgacccatttcaggaggt

SEQ ID NO: 2705381 - DNA, 18 bp, Homo sapiens
tgacccggattggccctg

SEQ ID NO: 2705382 - DNA, 20 bp, Homo sapiens
tgacccggattggccctgcc

SEQ ID NO: 2705383 - DNA, 20 bp, Homo sapiens
tgaccctgcgaaggggccct

SEQ ID NO: 2705384 - DNA, 21 bp, Homo sapiens
tgaccctgcgaaggggccctg

SEQ ID NO: 2705385 - DNA, 23 bp, Homo sapiens
tgaccctgcgaaggggccctggt

SEQ ID NO: 2705386 - DNA, 22 bp, Homo sapiens
tgaccgacgatccctcgaccag

SEQ ID NO: 2705387 - DNA, 19 bp, Homo sapiens
tgaccgccgcttccagctt

SEQ ID NO: 2705388 - DNA, 23 bp, Homo sapiens
tgaccgccgcttccagcttcctc

SEQ ID NO: 2705389 - DNA, 16 bp, Homo sapiens
tgacctccagtcctgc

SEQ ID NO: 2705390 - DNA, 24 bp, Homo sapiens
tgacctcgtgatttgcctgcctgg

SEQ ID NO: 2705391 - DNA, 17 bp, Homo sapiens
tgacgcctactggggca

SEQ ID NO: 2705392 - DNA, 15 bp, Homo sapiens
tgacggactcagact

SEQ ID NO: 2705393 - DNA, 20 bp, Homo sapiens
tgacggactcagactcctgg

SEQ ID NO: 2705394 - DNA, 23 bp, Homo sapiens
tgacggtcctttaggcagcctgc

SEQ ID NO: 2705395 - DNA, 20 bp, Homo sapiens
tgacgtaagctctatctgca

SEQ ID NO: 2705396 - DNA, 13 bp, Homo sapiens
tgacgtgactcag

SEQ ID NO: 2705397 - DNA, 18 bp, Homo sapiens
tgacgtgactcagagctt

SEQ ID NO: 2705398 - DNA, 18 bp, Homo sapiens
tgacgtgcacctgtactc

SEQ ID NO: 2705399 - DNA, 12 bp, Homo sapiens
tgactcagagct

SEQ ID NO: 2705400 - DNA, 13 bp, Homo sapiens
tgactcagagctt

SEQ ID NO: 2705401 - DNA, 15 bp, Homo sapiens
tgactcgggctcctg

SEQ ID NO: 2705402 - DNA, 17 bp, Homo sapiens
tgactcgggctcctgtg

SEQ ID NO: 2705403 - DNA, 18 bp, Homo sapiens
tgactcgggctcctgtgc

SEQ ID NO: 2705404 - DNA, 21 bp, Homo sapiens
tgactcgggctcctgtgccct

SEQ ID NO: 2705405 - DNA, 18 bp, Homo sapiens
tgactggccaaaaatatc

SEQ ID NO: 2705406 - DNA, 11 bp, Homo sapiens
tgactggctca

SEQ ID NO: 2705407 - DNA, 14 bp, Homo sapiens
tgacttcctggtga

SEQ ID NO: 2705408 - DNA, 17 bp, Homo sapiens
tgacttcctggtgaggc

SEQ ID NO: 2705409 - DNA, 16 bp, Homo sapiens
tgacttgcctggggcc

SEQ ID NO: 2705410 - DNA, 13 bp, Homo sapiens
tgacttttccatg

SEQ ID NO: 2705411 - DNA, 22 bp, Homo sapiens
tgacttttccatgtatctacct

SEQ ID NO: 2705412 - DNA, 23 bp, Homo sapiens
tgagaacatggtgtgtgtctctg

SEQ ID NO: 2705413 - DNA, 17 bp, Homo sapiens
tgagaagggcctgctct

SEQ ID NO: 2705414 - DNA, 19 bp, Homo sapiens
tgagaagtactttgtgctg

SEQ ID NO: 2705415 - DNA, 18 bp, Homo sapiens
tgagaagtgtatatagtt

SEQ ID NO: 2705416 - DNA, 18 bp, Homo sapiens
tgagactatgcgttttta

SEQ ID NO: 2705417 - DNA, 23 bp, Homo sapiens
tgagactgcgccacggcactcca

SEQ ID NO: 2705418 - DNA, 14 bp, Homo sapiens
tgagagttccagat

SEQ ID NO: 2705419 - DNA, 18 bp, Homo sapiens
tgagattactttgtcccg

SEQ ID NO: 2705420 - DNA, 19 bp, Homo sapiens
tgagattctaaatgttcat

SEQ ID NO: 2705421 - DNA, 22 bp, Homo sapiens
tgagattctttaaggagataga

SEQ ID NO: 2705422 - DNA, 14 bp, Homo sapiens
tgagatttcacagg

SEQ ID NO: 2705423 - DNA, 20 bp, Homo sapiens
tgagcagaggagtccagggc

SEQ ID NO: 2705424 - DNA, 16 bp, Homo sapiens
tgagcagtagaagcct

SEQ ID NO: 2705425 - DNA, 19 bp, Homo sapiens
tgagcattagctacttttc

SEQ ID NO: 2705426 - DNA, 23 bp, Homo sapiens
tgagccaccgcgcccagccaaga

SEQ ID NO: 2705427 - DNA, 22 bp, Homo sapiens
tgagcccaaacaccctcctggc

SEQ ID NO: 2705428 - DNA, 22 bp, Homo sapiens
tgagccgcagggcctgctacgc

SEQ ID NO: 2705429 - DNA, 14 bp, Homo sapiens
tgagcctctgcgcc

SEQ ID NO: 2705430 - DNA, 13 bp, Homo sapiens
tgagcgtgattct

SEQ ID NO: 2705431 - DNA, 16 bp, Homo sapiens
tgagctgtcccctgga

SEQ ID NO: 2705432 - DNA, 20 bp, Homo sapiens
tgagcttggcagctgaacta

SEQ ID NO: 2705433 - DNA, 22 bp, Homo sapiens
tgaggagtggagttctctgttc

SEQ ID NO: 2705434 - DNA, 16 bp, Homo sapiens
tgaggattttgagtat

SEQ ID NO: 2705435 - DNA, 20 bp, Homo sapiens
tgaggcaaaggccagcagca

SEQ ID NO: 2705436 - DNA, 18 bp, Homo sapiens
tcggaggctcctccctct

SEQ ID NO: 2705437 - DNA, 21 bp, Homo sapiens
tcggaggctcctccctctgcc

SEQ ID NO: 2705438 - DNA, 16 bp, Homo sapiens
tcggcccatctgtcca

SEQ ID NO: 2705439 - DNA, 14 bp, Homo sapiens
tcggctcctgctgc

SEQ ID NO: 2705440 - DNA, 18 bp, Homo sapiens
tcggctcctgctgcacca

SEQ ID NO: 2705441 - DNA, 16 bp, Homo sapiens
tcgggaccctcccagt

SEQ ID NO: 2705442 - DNA, 17 bp, Homo sapiens
tcgggcccaggccatct

SEQ ID NO: 2705443 - DNA, 15 bp, Homo sapiens
tcgggctcctgtgcc

SEQ ID NO: 2705444 - DNA, 16 bp, Homo sapiens
tcggggcatgctgggg

SEQ ID NO: 2705445 - DNA, 13 bp, Homo sapiens
tcggtactcccat

SEQ ID NO: 2705446 - DNA, 21 bp, Homo sapiens
tcgtccaaggcagttctgtgt

SEQ ID NO: 2705447 - DNA, 19 bp, Homo sapiens
tcgtgagctggaggaacat

SEQ ID NO: 2705448 - DNA, 23 bp, Homo sapiens
tcgtgatctgcccgcctcggcct

SEQ ID NO: 2705449 - DNA, 20 bp, Homo sapiens
tcgtgccagtcgcgctgcct

SEQ ID NO: 2705450 - DNA, 23 bp, Homo sapiens
tcgtgccagtcgcgctgcctgtg

SEQ ID NO: 2705451 - DNA, 22 bp, Homo sapiens
tcgtgggtgtgtgtagccaagg

SEQ ID NO: 2705452 - DNA, 17 bp, Homo sapiens
tcgtggtagaagccagt

SEQ ID NO: 2705453 - DNA, 14 bp, Homo sapiens
tcgtgtgcccacca

SEQ ID NO: 2705454 - DNA, 21 bp, Homo sapiens
tctaaacagaaattattttct

SEQ ID NO: 2705455 - DNA, 12 bp, Homo sapiens
tctaaagtttac

SEQ ID NO: 2705456 - DNA, 15 bp, Homo sapiens
tctaaagtttacagt

SEQ ID NO: 2705457 - DNA, 22 bp, Homo sapiens
tctaaagtttacagtaaataaa

SEQ ID NO: 2705458 - DNA, 14 bp, Homo sapiens
tctaacattttcta

SEQ ID NO: 2705459 - DNA, 21 bp, Homo sapiens
tctaaccaaagagtctctggc

SEQ ID NO: 2705460 - DNA, 14 bp, Homo sapiens
tctaactccctcct

SEQ ID NO: 2705461 - DNA, 14 bp, Homo sapiens
tctaagctgcagct

SEQ ID NO: 2705462 - DNA, 15 bp, Homo sapiens
tctaagctgcagctt

SEQ ID NO: 2705463 - DNA, 21 bp, Homo sapiens
tctacacatatatgtatatgt

SEQ ID NO: 2705464 - DNA, 19 bp, Homo sapiens
tctacacgtcctttcctga

SEQ ID NO: 2705465 - DNA, 14 bp, Homo sapiens
tctaccctgcagct

SEQ ID NO: 2705466 - DNA, 19 bp, Homo sapiens
tctacctttttttctctcc

SEQ ID NO: 2705467 - DNA, 19 bp, Homo sapiens
tctactcctacctcagcct

SEQ ID NO: 2705468 - DNA, 22 bp, Homo sapiens
tctactcctacctcagcctaga

SEQ ID NO: 2705469 - DNA, 14 bp, Homo sapiens
tctacttttaaaga

SEQ ID NO: 2705470 - DNA, 16 bp, Homo sapiens
tctagaacacccactg

SEQ ID NO: 2705471 - DNA, 17 bp, Homo sapiens
tctagaacacccactgg

SEQ ID NO: 2705472 - DNA, 12 bp, Homo sapiens
tctagaatggtt

SEQ ID NO: 2705473 - DNA, 21 bp, Homo sapiens
tctaggtcttggttagagaag

SEQ ID NO: 2705474 - DNA, 16 bp, Homo sapiens
tctagtagaacaatgt

SEQ ID NO: 2705475 - DNA, 17 bp, Homo sapiens
tctagtagaacaatgta

SEQ ID NO: 2705476 - DNA, 16 bp, Homo sapiens
tctagtgacttcctgg

SEQ ID NO: 2705477 - DNA, 20 bp, Homo sapiens
tctagtgccctccacagccg

SEQ ID NO: 2705478 - DNA, 13 bp, Homo sapiens
tctagttgcattt

SEQ ID NO: 2705479 - DNA, 15 bp, Homo sapiens
tctataaacatgaag

SEQ ID NO: 2705480 - DNA, 23 bp, Homo sapiens
tctatctgcaatgtttttgtgta

SEQ ID NO: 2705481 - DNA, 15 bp, Homo sapiens
tctatgaagagaagg

SEQ ID NO: 2705482 - DNA, 19 bp, Homo sapiens
tctatgtgggaaaaaagaa

SEQ ID NO: 2705483 - DNA, 16 bp, Homo sapiens
tctattaagatttcca

SEQ ID NO: 2705484 - DNA, 12 bp, Homo sapiens
tctattttgctg

SEQ ID NO: 2705485 - DNA, 22 bp, Homo sapiens
tctattttgctggagactattt

SEQ ID NO: 2705486 - DNA, 14 bp, Homo sapiens
tctcaaactggggc

SEQ ID NO: 2705487 - DNA, 21 bp, Homo sapiens
tctcaaagaaatttccactca

SEQ ID NO: 2705488 - DNA, 22 bp, Homo sapiens
tctcaaagaaatttccactcag

SEQ ID NO: 2705489 - DNA, 22 bp, Homo sapiens
tctcaaatggacaataccagaa

SEQ ID NO: 2705490 - DNA, 21 bp, Homo sapiens
tcagctggtggatggtgactt

SEQ ID NO: 2705491 - DNA, 22 bp, Homo sapiens
tcagctgtggtcccacccagga

SEQ ID NO: 2705492 - DNA, 22 bp, Homo sapiens
tcagcttcccaagtagctgaga

SEQ ID NO: 2705493 - DNA, 14 bp, Homo sapiens
tcagcttctgctgg

SEQ ID NO: 2705494 - DNA, 15 bp, Homo sapiens
tcagcttctgctggg

SEQ ID NO: 2705495 - DNA, 23 bp, Homo sapiens
tcagcttctgctgggctggggcc

SEQ ID NO: 2705496 - DNA, 13 bp, Homo sapiens
tcagctttttgta

SEQ ID NO: 2705497 - DNA, 21 bp, Homo sapiens
tcagctttttgtattaacaaa

SEQ ID NO: 2705498 - DNA, 16 bp, Homo sapiens
tcaggaaaagcctctg

SEQ ID NO: 2705499 - DNA, 17 bp, Homo sapiens
tcaggaaaagcctctgt

SEQ ID NO: 2705500 - DNA, 19 bp, Homo sapiens
tcaggaaaagcctctgtgt

SEQ ID NO: 2705501 - DNA, 22 bp, Homo sapiens
tcaggaaaggaagatgtaagaa

SEQ ID NO: 2705502 - DNA, 22 bp, Homo sapiens
tcaggagctgacagagccagag

SEQ ID NO: 2705503 - DNA, 14 bp, Homo sapiens
tcaggaggctgagg

SEQ ID NO: 2705504 - DNA, 18 bp, Homo sapiens
tcaggaggctgaggggag

SEQ ID NO: 2705505 - DNA, 17 bp, Homo sapiens
tcaggccaggtgcagtg

SEQ ID NO: 2705506 - DNA, 18 bp, Homo sapiens
tcaggccaggtgcagtgg

SEQ ID NO: 2705507 - DNA, 21 bp, Homo sapiens
tcaggctttgtctgctcccaa

SEQ ID NO: 2705508 - DNA, 22 bp, Homo sapiens
tcagggaatttcaggaactaga

SEQ ID NO: 2705509 - DNA, 13 bp, Homo sapiens
tcagggaccacag

SEQ ID NO: 2705510 - DNA, 19 bp, Homo sapiens
tcaggggacaaaccagggg

SEQ ID NO: 2705511 - DNA, 20 bp, Homo sapiens
tcaggggacaaaccaggggt

SEQ ID NO: 2705512 - DNA, 14 bp, Homo sapiens
tcaggggctgcccg

SEQ ID NO: 2705513 - DNA, 19 bp, Homo sapiens
tcaggtagggagctaagga

SEQ ID NO: 2705514 - DNA, 14 bp, Homo sapiens
tcaggtagtactgg

SEQ ID NO: 2705515 - DNA, 16 bp, Homo sapiens
tcagtgccgccgcctc

SEQ ID NO: 2705516 - DNA, 20 bp, Homo sapiens
tcagtgccgccgcctcgccc

SEQ ID NO: 2705517 - DNA, 23 bp, Homo sapiens
tcagtgccgccgcctcgcccacc

SEQ ID NO: 2705518 - DNA, 14 bp, Homo sapiens
tcagtgctgtggcc

SEQ ID NO: 2705519 - DNA, 16 bp, Homo sapiens
tcagtggcaagaatga

SEQ ID NO: 2705520 - DNA, 13 bp, Homo sapiens
tcagtgtgccccc

SEQ ID NO: 2705521 - DNA, 20 bp, Homo sapiens
tcagtgtgccccccatcctg

SEQ ID NO: 2705522 - DNA, 22 bp, Homo sapiens
tcagttaggattaggtttagaa

SEQ ID NO: 2705523 - DNA, 18 bp, Homo sapiens
tcagttcctctttgcatg

SEQ ID NO: 2705524 - DNA, 15 bp, Homo sapiens
tcagttctagttgat

SEQ ID NO: 2705525 - DNA, 17 bp, Homo sapiens
tcataaattatttctaa

SEQ ID NO: 2705526 - DNA, 22 bp, Homo sapiens
tcataagctgtagaactctgca

SEQ ID NO: 2705527 - DNA, 12 bp, Homo sapiens
tcatacattata

SEQ ID NO: 2705528 - DNA, 14 bp, Homo sapiens
tcatacattatatt

SEQ ID NO: 2705529 - DNA, 18 bp, Homo sapiens
tcatataagcaagacagt

SEQ ID NO: 2705530 - DNA, 14 bp, Homo sapiens
tcatataatttaaa

SEQ ID NO: 2705531 - DNA, 23 bp, Homo sapiens
tcatataatttaaagaaacacta

SEQ ID NO: 2705532 - DNA, 16 bp, Homo sapiens
tcatatattgctttat

SEQ ID NO: 2705533 - DNA, 14 bp, Homo sapiens
tcatattgtttcct

SEQ ID NO: 2705534 - DNA, 19 bp, Homo sapiens
tcatcaaaacctgcgcagt

SEQ ID NO: 2705535 - DNA, 22 bp, Homo sapiens
tcatcaggtttactcagtgaaa

SEQ ID NO: 2705536 - DNA, 12 bp, Homo sapiens
tcatcctcctcc

SEQ ID NO: 2705537 - DNA, 14 bp, Homo sapiens
tcatcctcctcctc

SEQ ID NO: 2705538 - DNA, 15 bp, Homo sapiens
tcatcctcctcctca

SEQ ID NO: 2705539 - DNA, 22 bp, Homo sapiens
tcatctccagtatcctgctggt

SEQ ID NO: 2705540 - DNA, 21 bp, Homo sapiens
tcatctgctcctagcccagca

SEQ ID NO: 2705541 - DNA, 16 bp, Homo sapiens
tcatctgtgcctgtct

SEQ ID NO: 2705542 - DNA, 17 bp, Homo sapiens
tcatctgtgcctgtctg

SEQ ID NO: 2705543 - DNA, 19 bp, Homo sapiens
tcatgactgagtctggcaa

SEQ ID NO: 2705544 - DNA, 18 bp, Homo sapiens
tcatgacttttccatgta

SEQ ID NO: 2705545 - DNA, 21 bp, Homo sapiens
tcatgcattctagtgcagaag

SEQ ID NO: 2705546 - DNA, 13 bp, Homo sapiens
tcatgcccactgc

SEQ ID NO: 2705547 - DNA, 23 bp, Homo sapiens
tcatgctttcctaaagtctctgc

SEQ ID NO: 2705548 - DNA, 14 bp, Homo sapiens
tcatggtcctggct

SEQ ID NO: 2705549 - DNA, 16 bp, Homo sapiens
tcatgtaaattttgta

SEQ ID NO: 2705550 - DNA, 17 bp, Homo sapiens
tcatgtaaattttgtat

SEQ ID NO: 2705551 - DNA, 14 bp, Homo sapiens
tcatgtcatttctc

SEQ ID NO: 2705552 - DNA, 12 bp, Homo sapiens
tcattaatctgt

SEQ ID NO: 2705553 - DNA, 23 bp, Homo sapiens
tcattagggcaaagatctcagca

SEQ ID NO: 2705554 - DNA, 16 bp, Homo sapiens
tcattatcttcatgtt

SEQ ID NO: 2705555 - DNA, 16 bp, Homo sapiens
tcattatttgataaca

SEQ ID NO: 2705556 - DNA, 18 bp, Homo sapiens
tcattatttgataacatt

SEQ ID NO: 2705557 - DNA, 20 bp, Homo sapiens
tcattatttttgttagcaaa

SEQ ID NO: 2705558 - DNA, 22 bp, Homo sapiens
tcattatttttgttagcaaaga

SEQ ID NO: 2705559 - DNA, 16 bp, Homo sapiens
tcattcctaatgcatt

SEQ ID NO: 2705560 - DNA, 17 bp, Homo sapiens
tcattcctaatgcatta

SEQ ID NO: 2705561 - DNA, 15 bp, Homo sapiens
tcattgtcgctcagc

SEQ ID NO: 2705562 - DNA, 16 bp, Homo sapiens
tcattgtcgctcagca

SEQ ID NO: 2705563 - DNA, 23 bp, Homo sapiens
tcattgtgtatgagactgtgttt

SEQ ID NO: 2705564 - DNA, 18 bp, Homo sapiens
tcatttctcatggatttg

SEQ ID NO: 2705565 - DNA, 15 bp, Homo sapiens
tcatttctctttttt

SEQ ID NO: 2705566 - DNA, 13 bp, Homo sapiens
tcatttgaaagtg

SEQ ID NO: 2705567 - DNA, 20 bp, Homo sapiens
tcattttatataaagaaaat

SEQ ID NO: 2705568 - DNA, 20 bp, Homo sapiens
tccaaaacatttctggacag

SEQ ID NO: 2705569 - DNA, 13 bp, Homo sapiens
tccaaacactggg

SEQ ID NO: 2705570 - DNA, 22 bp, Homo sapiens
tccaaacactgggctctgagga

SEQ ID NO: 2705571 - DNA, 13 bp, Homo sapiens
tccaaatgcattc

SEQ ID NO: 2705572 - DNA, 14 bp, Homo sapiens
tccaaatgcattca

SEQ ID NO: 2705573 - DNA, 18 bp, Homo sapiens
tccaaatgcattcatgtt

SEQ ID NO: 2705574 - DNA, 18 bp, Homo sapiens
tccaaatgctgtgcaaac

SEQ ID NO: 2705575 - DNA, 17 bp, Homo sapiens
tccaacccagcctgagt

SEQ ID NO: 2705576 - DNA, 13 bp, Homo sapiens
tccaaccccagct

SEQ ID NO: 2705577 - DNA, 20 bp, Homo sapiens
tccaaccccagctggcctct

SEQ ID NO: 2705578 - DNA, 13 bp, Homo sapiens
tccaacccctccc

SEQ ID NO: 2705579 - DNA, 18 bp, Homo sapiens
tccaagaccttacaacca

SEQ ID NO: 2705580 - DNA, 21 bp, Homo sapiens
tccaagggtatgggaagccat

SEQ ID NO: 2705581 - DNA, 14 bp, Homo sapiens
tccaagtcaacact

SEQ ID NO: 2705582 - DNA, 15 bp, Homo sapiens
tccaagtcaacactc

SEQ ID NO: 2705583 - DNA, 18 bp, Homo sapiens
tccaagtccaacctgcct

SEQ ID NO: 2705584 - DNA, 15 bp, Homo sapiens
tccacaaatgctatt

SEQ ID NO: 2705585 - DNA, 20 bp, Homo sapiens
tccacagaaacattttcatt

SEQ ID NO: 2705586 - DNA, 16 bp, Homo sapiens
tccacagccgcagcct

SEQ ID NO: 2705587 - DNA, 18 bp, Homo sapiens
tccacagccgcagcctcc

SEQ ID NO: 2705588 - DNA, 21 bp, Homo sapiens
tccacagggacacagtctggt

SEQ ID NO: 2705589 - DNA, 16 bp, Homo sapiens
tccacagtggaaccag

SEQ ID NO: 2705590 - DNA, 15 bp, Homo sapiens
tccaccagagcaggg

SEQ ID NO: 2705591 - DNA, 12 bp, Homo sapiens
tccaccctggaa

SEQ ID NO: 2705592 - DNA, 17 bp, Homo sapiens
tccacctagtggctgtc

SEQ ID NO: 2705593 - DNA, 15 bp, Homo sapiens
tccacggtcttctgc

SEQ ID NO: 2705594 - DNA, 17 bp, Homo sapiens
tccacggtcttctgcat

SEQ ID NO: 2705595 - DNA, 20 bp, Homo sapiens
tccacgtgctcgcctctgcc

SEQ ID NO: 2705596 - DNA, 14 bp, Homo sapiens
tccacgtgtatgca

SEQ ID NO: 2705597 - DNA, 16 bp, Homo sapiens
tccactccatatttat

SEQ ID NO: 2705598 - DNA, 16 bp, Homo sapiens
tccactgccaaaacaa

SEQ ID NO: 2705599 - DNA, 12 bp, Homo sapiens
tccactggactt

SEQ ID NO: 2705600 - DNA, 16 bp, Homo sapiens
tccactggacttgagc

SEQ ID NO: 2705601 - DNA, 17 bp, Homo sapiens
tccactggacttgagct

SEQ ID NO: 2705602 - DNA, 15 bp, Homo sapiens
tccacttttaaaact

SEQ ID NO: 2705603 - DNA, 21 bp, Homo sapiens
tccacttttaaaactatattt

SEQ ID NO: 2705604 - DNA, 18 bp, Homo sapiens
tccagaaaaccccagcat

SEQ ID NO: 2705605 - DNA, 15 bp, Homo sapiens
tccagaatgtgctgc

SEQ ID NO: 2705606 - DNA, 19 bp, Homo sapiens
tccagaatgtgctgccttt

SEQ ID NO: 2705607 - DNA, 18 bp, Homo sapiens
tccagaattacccttcct

SEQ ID NO: 2705608 - DNA, 20 bp, Homo sapiens
ctcagcctcctgagtagctg

SEQ ID NO: 2705609 - DNA, 19 bp, Homo sapiens
ctcagctgcctcatcgtgg

SEQ ID NO: 2705610 - DNA, 16 bp, Homo sapiens
ctcagctgtggtccca

SEQ ID NO: 2705611 - DNA, 16 bp, Homo sapiens
ctcaggaggctgaggg

SEQ ID NO: 2705612 - DNA, 16 bp, Homo sapiens
ctcaggattgtttctc

SEQ ID NO: 2705613 - DNA, 17 bp, Homo sapiens
ctcaggcttccttggca

SEQ ID NO: 2705614 - DNA, 17 bp, Homo sapiens
ctcagggaccacagcaa

SEQ ID NO: 2705615 - DNA, 18 bp, Homo sapiens
ctcagggaccacagcaag

SEQ ID NO: 2705616 - DNA, 18 bp, Homo sapiens
ctcagggactcaggccag

SEQ ID NO: 2705617 - DNA, 17 bp, Homo sapiens
ctcaggggaagctgcta

SEQ ID NO: 2705618 - DNA, 20 bp, Homo sapiens
ctcaggggaagctgctaggg

SEQ ID NO: 2705619 - DNA, 15 bp, Homo sapiens
ctcaggtagtactgg

SEQ ID NO: 2705620 - DNA, 12 bp, Homo sapiens
ctggcctgctct

SEQ ID NO: 2705621 - DNA, 13 bp, Homo sapiens
ctggcctgctctt

SEQ ID NO: 2705622 - DNA, 21 bp, Homo sapiens
ctggcctgctcttacttcccc

SEQ ID NO: 2705623 - DNA, 21 bp, Homo sapiens
ctggctcaagaattagggccc

SEQ ID NO: 2705624 - DNA, 15 bp, Homo sapiens
ctggctcagctgtgg

SEQ ID NO: 2705625 - DNA, 14 bp, Homo sapiens
ctggctctccacct

SEQ ID NO: 2705626 - DNA, 15 bp, Homo sapiens
ctggctctccacctt

SEQ ID NO: 2705627 - DNA, 20 bp, Homo sapiens
ctggctctttgtgtgtctcc

SEQ ID NO: 2705628 - DNA, 18 bp, Homo sapiens
ctggctgaacagtgctct

SEQ ID NO: 2705629 - DNA, 20 bp, Homo sapiens
ctggctgaacagtgctctgc

SEQ ID NO: 2705630 - DNA, 13 bp, Homo sapiens
ctggctgcagtga

SEQ ID NO: 2705631 - DNA, 18 bp, Homo sapiens
ctggctgcctccactccc

SEQ ID NO: 2705632 - DNA, 22 bp, Homo sapiens
ctggctgcctccactcccactt

SEQ ID NO: 2705633 - DNA, 12 bp, Homo sapiens
ctggctgctggc

SEQ ID NO: 2705634 - DNA, 18 bp, Homo sapiens
ctggctggctgtgtcctc

SEQ ID NO: 2705635 - DNA, 14 bp, Homo sapiens
ctggctgggcatgg

SEQ ID NO: 2705636 - DNA, 15 bp, Homo sapiens
ctggctgggcatgga

SEQ ID NO: 2705637 - DNA, 13 bp, Homo sapiens
ctggctggggcct

SEQ ID NO: 2705638 - DNA, 19 bp, Homo sapiens
ctggctgtgtcctctccag

SEQ ID NO: 2705639 - DNA, 20 bp, Homo sapiens
ctggctgtgtcctctccagc

SEQ ID NO: 2705640 - DNA, 14 bp, Homo sapiens
ctggcttcatgtgg

SEQ ID NO: 2705641 - DNA, 16 bp, Homo sapiens
ctggcttctggagccc

SEQ ID NO: 2705642 - DNA, 20 bp, Homo sapiens
ctggcttctggagcccttgg

SEQ ID NO: 2705643 - DNA, 18 bp, Homo sapiens
ctggctttgttcttgtca

SEQ ID NO: 2705644 - DNA, 15 bp, Homo sapiens
ctgggaatgggagag

SEQ ID NO: 2705645 - DNA, 18 bp, Homo sapiens
ctgggaatgggagagggg

SEQ ID NO: 2705646 - DNA, 22 bp, Homo sapiens
ctgggaccccagctagggctgg

SEQ ID NO: 2705647 - DNA, 12 bp, Homo sapiens
ctgggagaacct

SEQ ID NO: 2705648 - DNA, 14 bp, Homo sapiens
ctgggagaacctca

SEQ ID NO: 2705649 - DNA, 16 bp, Homo sapiens
gagcaggggctgctgg

SEQ ID NO: 2705650 - DNA, 19 bp, Homo sapiens
gagcaggggctgctggggg

SEQ ID NO: 2705651 - DNA, 23 bp, Homo sapiens
gagcccacgcccgactagcaggc

SEQ ID NO: 2705652 - DNA, 14 bp, Homo sapiens
gagcccattgtgga

SEQ ID NO: 2705653 - DNA, 19 bp, Homo sapiens
gagcctcgtccaaggcagt

SEQ ID NO: 2705654 - DNA, 13 bp, Homo sapiens
gagcctctgcgcc

SEQ ID NO: 2705655 - DNA, 16 bp, Homo sapiens
gagcctctgcgcctct

SEQ ID NO: 2705656 - DNA, 21 bp, Homo sapiens
gagcctgaaccgtgtgctcct

SEQ ID NO: 2705657 - DNA, 12 bp, Homo sapiens
gagcgaccctgg

SEQ ID NO: 2705658 - DNA, 13 bp, Homo sapiens
gagcgaccctggc

SEQ ID NO: 2705659 - DNA, 19 bp, Homo sapiens
gagcgagaaccaggctgct

SEQ ID NO: 2705660 - DNA, 20 bp, Homo sapiens
gagcgcacctgccccctggt

SEQ ID NO: 2705661 - DNA, 18 bp, Homo sapiens
gagctaaggaagacacag

SEQ ID NO: 2705662 - DNA, 14 bp, Homo sapiens
gagctcctgtccct

SEQ ID NO: 2705663 - DNA, 16 bp, Homo sapiens
gagctgaggcctccct

SEQ ID NO: 2705664 - DNA, 14 bp, Homo sapiens
gagctgcctcccca

SEQ ID NO: 2705665 - DNA, 20 bp, Homo sapiens
gatgcccagagggcccaggc

SEQ ID NO: 2705666 - DNA, 23 bp, Homo sapiens
gatgcccagagggcccaggcagg

SEQ ID NO: 2705667 - DNA, 21 bp, Homo sapiens
gatgctacaaaacaccttgtc

SEQ ID NO: 2705668 - DNA, 12 bp, Homo sapiens
gatgctgcctga

SEQ ID NO: 2705669 - DNA, 16 bp, Homo sapiens
gatgctggccacagaa

SEQ ID NO: 2705670 - DNA, 14 bp, Homo sapiens
gatgctggcctctt

SEQ ID NO: 2705671 - DNA, 21 bp, Homo sapiens
gatgctggcctcttggcacct

SEQ ID NO: 2705672 - DNA, 23 bp, Homo sapiens
gatgctggcctcttggcacctgc

SEQ ID NO: 2705673 - DNA, 21 bp, Homo sapiens
gatggagaaacaggctctgag

SEQ ID NO: 2705674 - DNA, 20 bp, Homo sapiens
gatggagccagctctgcatt

SEQ ID NO: 2705675 - DNA, 19 bp, Homo sapiens
gatggctggaaggagccag

SEQ ID NO: 2705676 - DNA, 14 bp, Homo sapiens
gatgggcctgtgtg

SEQ ID NO: 2705677 - DNA, 15 bp, Homo sapiens
gatgtataatatgca

SEQ ID NO: 2705678 - DNA, 11 bp, Homo sapiens
gatgtcagcct

SEQ ID NO: 2705679 - DNA, 14 bp, Homo sapiens
gatgtcagccttgc

SEQ ID NO: 2705680 - DNA, 15 bp, Homo sapiens
gatgtcagccttgca

SEQ ID NO: 2705681 - DNA, 12 bp, Homo sapiens
gatgtgggctca

SEQ ID NO: 2705682 - DNA, 15 bp, Homo sapiens
gatgttaaatgcctt

SEQ ID NO: 2705683 - DNA, 16 bp, Homo sapiens
gatgttcagaattttg

SEQ ID NO: 2705684 - DNA, 21 bp, Homo sapiens
gattaactttcaaaagcaaac

SEQ ID NO: 2705685 - DNA, 16 bp, Homo sapiens
gattacaataaatcct

SEQ ID NO: 2705686 - DNA, 21 bp, Homo sapiens
gattatttgttatttgtacag

SEQ ID NO: 2705687 - DNA, 23 bp, Homo sapiens
gattatttgttatttgtacagtt

SEQ ID NO: 2705688 - DNA, 15 bp, Homo sapiens
gattcaggagctcag

SEQ ID NO: 2705689 - DNA, 12 bp, Homo sapiens
gattcccagaga

SEQ ID NO: 2705690 - DNA, 22 bp, Homo sapiens
gattctaaacagatgtccctga

SEQ ID NO: 2705691 - DNA, 17 bp, Homo sapiens
gattctcacctgccttc

SEQ ID NO: 2705692 - DNA, 15 bp, Homo sapiens
gattctgggaggaag

SEQ ID NO: 2705693 - DNA, 22 bp, Homo sapiens
gattctgggaggaagcaggttg

SEQ ID NO: 2705694 - DNA, 14 bp, Homo sapiens
gattctttaaggag

SEQ ID NO: 2705695 - DNA, 19 bp, Homo sapiens
gattctttaaggagataga

SEQ ID NO: 2705696 - DNA, 12 bp, Homo sapiens
gattgcactaaa

SEQ ID NO: 2705697 - DNA, 16 bp, Homo sapiens
gattgcgagaattttc

SEQ ID NO: 2705698 - DNA, 20 bp, Homo sapiens
gattggcacaagctccctgg

SEQ ID NO: 2705699 - DNA, 21 bp, Homo sapiens
gattggcacaagctccctggt

SEQ ID NO: 2705700 - DNA, 13 bp, Homo sapiens
gattggccagccg

SEQ ID NO: 2705701 - DNA, 21 bp, Homo sapiens
gattggccctgcccctccccc

SEQ ID NO: 2705702 - DNA, 21 bp, Homo sapiens
gattgttctgtccagtttcca

SEQ ID NO: 2705703 - DNA, 16 bp, Homo sapiens
gattgtttgcacagag

SEQ ID NO: 2705704 - DNA, 22 bp, Homo sapiens
gatttcaccgtattagccagga

SEQ ID NO: 2705705 - DNA, 18 bp, Homo sapiens
gatttcagctatgcagaa

SEQ ID NO: 2705706 - DNA, 18 bp, Homo sapiens
gatttctagaatggtttt

SEQ ID NO: 2705707 - DNA, 16 bp, Homo sapiens
gatttctagtatctat

SEQ ID NO: 2705708 - DNA, 22 bp, Homo sapiens
gatttctttctttgcaccaaag

SEQ ID NO: 2705709 - DNA, 14 bp, Homo sapiens
gatttgcctgcctg

SEQ ID NO: 2705710 - DNA, 21 bp, Homo sapiens
gatttggaagagaggcacctg

SEQ ID NO: 2705711 - DNA, 20 bp, Homo sapiens
gatttgtctttggtgaacat

SEQ ID NO: 2705712 - DNA, 15 bp, Homo sapiens
gattttatctgtgga

SEQ ID NO: 2705713 - DNA, 12 bp, Homo sapiens
gcaaactttaac

SEQ ID NO: 2705714 - DNA, 11 bp, Homo sapiens
gcaaagccata

SEQ ID NO: 2705715 - DNA, 12 bp, Homo sapiens
gcaaagccatat

SEQ ID NO: 2705716 - DNA, 14 bp, Homo sapiens
gcaaagtctaaagt

SEQ ID NO: 2705717 - DNA, 14 bp, Homo sapiens
gcaacagagtgaga

SEQ ID NO: 2705718 - DNA, 19 bp, Homo sapiens
gcaacattaccttgtcttt

SEQ ID NO: 2705719 - DNA, 20 bp, Homo sapiens
gcaaccctggtgtgctgggc

SEQ ID NO: 2705720 - DNA, 13 bp, Homo sapiens
gcaactcttgtat

SEQ ID NO: 2705721 - DNA, 20 bp, Homo sapiens
gcaagacagtggcactaaaa

SEQ ID NO: 2705722 - DNA, 18 bp, Homo sapiens
gcaagacttcactgcagc

SEQ ID NO: 2705723 - DNA, 20 bp, Homo sapiens
gcaagacttcactgcagcct

SEQ ID NO: 2705724 - DNA, 23 bp, Homo sapiens
gcaagacttcactgcagcctttc

SEQ ID NO: 2705725 - DNA, 13 bp, Homo sapiens
gcaagagaacatt

SEQ ID NO: 2705726 - DNA, 15 bp, Homo sapiens
gcaagccggcagaaa

SEQ ID NO: 2705727 - DNA, 16 bp, Homo sapiens
gcaagcttatttagca

SEQ ID NO: 2705728 - DNA, 21 bp, Homo sapiens
gcaagcttatttagcacattt

SEQ ID NO: 2705729 - DNA, 14 bp, Homo sapiens
gcaaggaggctggc

SEQ ID NO: 2705730 - DNA, 14 bp, Homo sapiens
gcaaggccagggca

SEQ ID NO: 2705731 - DNA, 15 bp, Homo sapiens
gcaaggccagggcac

SEQ ID NO: 2705732 - DNA, 20 bp, Homo sapiens
gcaagtccctgactctctgt

SEQ ID NO: 2705733 - DNA, 14 bp, Homo sapiens
gcaagtgctgtttg

SEQ ID NO: 2705734 - DNA, 20 bp, Homo sapiens
gcaagtgggagatgaaaacc

SEQ ID NO: 2705735 - DNA, 16 bp, Homo sapiens
gcaatagttttttact

SEQ ID NO: 2705736 - DNA, 14 bp, Homo sapiens
gcaatcattttata

SEQ ID NO: 2705737 - DNA, 21 bp, Homo sapiens
gcaatcattttatataaagaa

SEQ ID NO: 2705738 - DNA, 23 bp, Homo sapiens
gcaatcattttatataaagaaaa

SEQ ID NO: 2705739 - DNA, 20 bp, Homo sapiens
gcaatgcttctgcctcagct

SEQ ID NO: 2705740 - DNA, 20 bp, Homo sapiens
gcaatggcacgatctcagct

SEQ ID NO: 2705741 - DNA, 16 bp, Homo sapiens
gcaatgtcctgcatgc

SEQ ID NO: 2705742 - DNA, 18 bp, Homo sapiens
gcacaagctccctggtga

SEQ ID NO: 2705743 - DNA, 22 bp, Homo sapiens
gcacaccagtgtcgtgtctgct

SEQ ID NO: 2705744 - DNA, 19 bp, Homo sapiens
gcacagagggcgctcctgt

SEQ ID NO: 2705745 - DNA, 14 bp, Homo sapiens
gcacagcaaggagg

SEQ ID NO: 2705746 - DNA, 19 bp, Homo sapiens
gcacagcaaggaggctggc

SEQ ID NO: 2705747 - DNA, 23 bp, Homo sapiens
gcacagcaaggaggctggctggg

SEQ ID NO: 2705748 - DNA, 21 bp, Homo sapiens
gcacagccctcccgccccttc

SEQ ID NO: 2705749 - DNA, 13 bp, Homo sapiens
gcacagctcctcc

SEQ ID NO: 2705750 - DNA, 15 bp, Homo sapiens
gcacagctcctcccc

SEQ ID NO: 2705751 - DNA, 17 bp, Homo sapiens
gcacagctcctcccctg

SEQ ID NO: 2705752 - DNA, 21 bp, Homo sapiens
gcacagctcctcccctgccgc

SEQ ID NO: 2705753 - DNA, 24 bp, Homo sapiens
gcacagctcctcccctgccgcctc

SEQ ID NO: 2705754 - DNA, 12 bp, Homo sapiens
gcacagcttcct

SEQ ID NO: 2705755 - DNA, 21 bp, Homo sapiens
gcacagtaatatgaaagccac

SEQ ID NO: 2705756 - DNA, 23 bp, Homo sapiens
gcacagtgtctgggctgactggg

SEQ ID NO: 2705757 - DNA, 14 bp, Homo sapiens
gcacatgattttct

SEQ ID NO: 2705758 - DNA, 23 bp, Homo sapiens
gcacatggctgggggagggactg

SEQ ID NO: 2705759 - DNA, 18 bp, Homo sapiens
gcacattggaagctccca

SEQ ID NO: 2705760 - DNA, 20 bp, Homo sapiens
gcacattggaagctcccacc

SEQ ID NO: 2705761 - DNA, 18 bp, Homo sapiens
gcacattttgacacaatg

SEQ ID NO: 2705762 - DNA, 20 bp, Homo sapiens
gcaccaacccagccgctgcc

SEQ ID NO: 2705763 - DNA, 15 bp, Homo sapiens
gcccctccctagatc

SEQ ID NO: 2705764 - DNA, 20 bp, Homo sapiens
gcccctccctagatccaggc

SEQ ID NO: 2705765 - DNA, 10 bp, Homo sapiens
gccccttcca

SEQ ID NO: 2705766 - DNA, 13 bp, Homo sapiens
gcccgcagagccc

SEQ ID NO: 2705767 - DNA, 16 bp, Homo sapiens
gcccggattctgggag

SEQ ID NO: 2705768 - DNA, 17 bp, Homo sapiens
gcccggattctgggagg

SEQ ID NO: 2705769 - DNA, 15 bp, Homo sapiens
gcccggcgccctctg

SEQ ID NO: 2705770 - DNA, 14 bp, Homo sapiens
gcccggtgaggcca

SEQ ID NO: 2705771 - DNA, 21 bp, Homo sapiens
gcccgttgtctccctggccct

SEQ ID NO: 2705772 - DNA, 22 bp, Homo sapiens
gcccgttgtctccctggccctc

SEQ ID NO: 2705773 - DNA, 13 bp, Homo sapiens
gccctaagaactt

SEQ ID NO: 2705774 - DNA, 18 bp, Homo sapiens
gccctcaaggcctcccac

SEQ ID NO: 2705775 - DNA, 19 bp, Homo sapiens
gccctcaaggcctcccaca

SEQ ID NO: 2705776 - DNA, 14 bp, Homo sapiens
gccctctgtcctga

SEQ ID NO: 2705777 - DNA, 16 bp, Homo sapiens
gccctgcactgtcctg

SEQ ID NO: 2705778 - DNA, 19 bp, Homo sapiens
gccctgcactgtcctgctc

SEQ ID NO: 2705779 - DNA, 22 bp, Homo sapiens
gccctgcactgtcctgctccac

SEQ ID NO: 2705780 - DNA, 23 bp, Homo sapiens
gccctgcactgtcctgctccaca

SEQ ID NO: 2705781 - DNA, 21 bp, Homo sapiens
gccctgcagaggggaaaccag

SEQ ID NO: 2705782 - DNA, 13 bp, Homo sapiens
gccctgcccctcc

SEQ ID NO: 2705783 - DNA, 14 bp, Homo sapiens
gccctgcccctccc

SEQ ID NO: 2705784 - DNA, 22 bp, Homo sapiens
gccctgcccctccccctaccgc

SEQ ID NO: 2705785 - DNA, 15 bp, Homo sapiens
gccctgcccctccct

SEQ ID NO: 2705786 - DNA, 13 bp, Homo sapiens
gccctggaggctg

SEQ ID NO: 2705787 - DNA, 14 bp, Homo sapiens
gccctggaggctgg

SEQ ID NO: 2705788 - DNA, 19 bp, Homo sapiens
gccctggcaggatgaccct

SEQ ID NO: 2705789 - DNA, 18 bp, Homo sapiens
gccctggggcccctcgac

SEQ ID NO: 2705790 - DNA, 15 bp, Homo sapiens
gccctttgcaggccc

SEQ ID NO: 2705791 - DNA, 18 bp, Homo sapiens
gccgcagcctccctctga

SEQ ID NO: 2705792 - DNA, 13 bp, Homo sapiens
gccgccgcctcgc

SEQ ID NO: 2705793 - DNA, 16 bp, Homo sapiens
gccgccgcctcgccca

SEQ ID NO: 2705794 - DNA, 13 bp, Homo sapiens
gccgcctcccggg

SEQ ID NO: 2705795 - DNA, 15 bp, Homo sapiens
gccgcctcgcccacc

SEQ ID NO: 2705796 - DNA, 20 bp, Homo sapiens
gccgcggtaggtaagggccg

SEQ ID NO: 2705797 - DNA, 17 bp, Homo sapiens
gccgcttccagcttcct

SEQ ID NO: 2705798 - DNA, 22 bp, Homo sapiens
gccgcttccagcttcctctgag

SEQ ID NO: 2705799 - DNA, 20 bp, Homo sapiens
gccggaccgcgtagagagcc

SEQ ID NO: 2705800 - DNA, 16 bp, Homo sapiens
gccggcagaaatagct

SEQ ID NO: 2705801 - DNA, 13 bp, Homo sapiens
gccggccctgccc

SEQ ID NO: 2705802 - DNA, 14 bp, Homo sapiens
gccggccctgcccc

SEQ ID NO: 2705803 - DNA, 17 bp, Homo sapiens
gccggccctgcccctcc

SEQ ID NO: 2705804 - DNA, 11 bp, Homo sapiens
gccgggaaagc

SEQ ID NO: 2705805 - DNA, 19 bp, Homo sapiens
gccgggcgtggtggcgggc

SEQ ID NO: 2705806 - DNA, 12 bp, Homo sapiens
gccgtggctcca

SEQ ID NO: 2705807 - DNA, 13 bp, Homo sapiens
gccgtggctccag

SEQ ID NO: 2705808 - DNA, 22 bp, Homo sapiens
gccgtggctccagaatgtgctg

SEQ ID NO: 2705809 - DNA, 18 bp, Homo sapiens
gcctagaggtcccctcac

SEQ ID NO: 2705810 - DNA, 18 bp, Homo sapiens
gcctagctcttgggcctg

SEQ ID NO: 2705811 - DNA, 19 bp, Homo sapiens
gcctagctcttgggcctga

SEQ ID NO: 2705812 - DNA, 23 bp, Homo sapiens
gcctagctcttgggcctgacctc

SEQ ID NO: 2705813 - DNA, 13 bp, Homo sapiens
gcctatcagtgtg

SEQ ID NO: 2705814 - DNA, 15 bp, Homo sapiens
gcctatcagtgtgcc

SEQ ID NO: 2705815 - DNA, 18 bp, Homo sapiens
gcctatcagtgtgccccc

SEQ ID NO: 2705816 - DNA, 15 bp, Homo sapiens
gcctatgatcccagc

SEQ ID NO: 2705817 - DNA, 15 bp, Homo sapiens
gcctcacagatgctg

SEQ ID NO: 2705818 - DNA, 17 bp, Homo sapiens
gcctcacagatgctggc

SEQ ID NO: 2705819 - DNA, 23 bp, Homo sapiens
gcctcacagatgctggcctcttg

SEQ ID NO: 2705820 - DNA, 13 bp, Homo sapiens
gcctcagccagcc

SEQ ID NO: 2705821 - DNA, 20 bp, Homo sapiens
gcctcagccagccctggagg

SEQ ID NO: 2705822 - DNA, 21 bp, Homo sapiens
gcctcagccagccctggaggc

SEQ ID NO: 2705823 - DNA, 16 bp, Homo sapiens
gcctcagcctcctgag

SEQ ID NO: 2705824 - DNA, 14 bp, Homo sapiens
gcctcagcttctgg

SEQ ID NO: 2705825 - DNA, 14 bp, Homo sapiens
gcctcagtgctgca

SEQ ID NO: 2705826 - DNA, 14 bp, Homo sapiens
gcctcatcctcctc

SEQ ID NO: 2705827 - DNA, 16 bp, Homo sapiens
gcctcatgccccaggc

SEQ ID NO: 2705828 - DNA, 12 bp, Homo sapiens
gcctccactccc

SEQ ID NO: 2705829 - DNA, 14 bp, Homo sapiens
gcctccactcccac

SEQ ID NO: 2705830 - DNA, 18 bp, Homo sapiens
gcctccagtgctggctgc

SEQ ID NO: 2705831 - DNA, 22 bp, Homo sapiens
gcctccagtgctggctgctggc

SEQ ID NO: 2705832 - DNA, 12 bp, Homo sapiens
gcctcccacagt

SEQ ID NO: 2705833 - DNA, 16 bp, Homo sapiens
gcctcccacagtgact

SEQ ID NO: 2705834 - DNA, 20 bp, Homo sapiens
gcctcccgggaagcatcctc

SEQ ID NO: 2705835 - DNA, 21 bp, Homo sapiens
gcctcccgggaagcatcctcc

SEQ ID NO: 2705836 - DNA, 21 bp, Homo sapiens
gcctcccttgagtaggccctg

SEQ ID NO: 2705837 - DNA, 22 bp, Homo sapiens
gcctcccttgagtaggccctgc

SEQ ID NO: 2705838 - DNA, 20 bp, Homo sapiens
gcctccttccttgctgtcct

SEQ ID NO: 2705839 - DNA, 14 bp, Homo sapiens
gcctcgcccaccgc

SEQ ID NO: 2705840 - DNA, 16 bp, Homo sapiens
gcctcgcccaccgcat

SEQ ID NO: 2705841 - DNA, 20 bp, Homo sapiens
gcctcgcccaccgcatgccc

SEQ ID NO: 2705842 - DNA, 18 bp, Homo sapiens
gcctcggaggctcctccc

SEQ ID NO: 2705843 - DNA, 16 bp, Homo sapiens
gcctcggctcctgctg

SEQ ID NO: 2705844 - DNA, 21 bp, Homo sapiens
gcctctaactccctcctcaca

SEQ ID NO: 2705845 - DNA, 15 bp, Homo sapiens
gcctctagaacaccc

SEQ ID NO: 2705846 - DNA, 21 bp, Homo sapiens
gcctctagaacacccactggc

SEQ ID NO: 2705847 - DNA, 16 bp, Homo sapiens
gcctctcttctgtgtc

SEQ ID NO: 2705848 - DNA, 16 bp, Homo sapiens
gcctctgcaaactaag

SEQ ID NO: 2705849 - DNA, 15 bp, Homo sapiens
gcctctgcccgcaga

SEQ ID NO: 2705850 - DNA, 17 bp, Homo sapiens
gcctctgcccgcagagc

SEQ ID NO: 2705851 - DNA, 18 bp, Homo sapiens
gcctctgcccgcagagcc

SEQ ID NO: 2705852 - DNA, 22 bp, Homo sapiens
gcctctgcgcctctccactgtt

SEQ ID NO: 2705853 - DNA, 15 bp, Homo sapiens
gcctctgctgccatg

SEQ ID NO: 2705854 - DNA, 12 bp, Homo sapiens
gcctctgtgtca

SEQ ID NO: 2705855 - DNA, 15 bp, Homo sapiens
gcctctgtgtcactg

SEQ ID NO: 2705856 - DNA, 20 bp, Homo sapiens
gcctctgtgtcactggctgc

SEQ ID NO: 2705857 - DNA, 19 bp, Homo sapiens
gcctcttggcacctgccta

SEQ ID NO: 2705858 - DNA, 21 bp, Homo sapiens
gcctcttggcacctgcctagc

SEQ ID NO: 2705859 - DNA, 14 bp, Homo sapiens
gcctgaccccaggc

SEQ ID NO: 2705860 - DNA, 17 bp, Homo sapiens
gcctgaccccaggcagc

SEQ ID NO: 2705861 - DNA, 13 bp, Homo sapiens
gcctgacctccag

SEQ ID NO: 2705862 - DNA, 16 bp, Homo sapiens
gcctgacctccagtcc

SEQ ID NO: 2705863 - DNA, 17 bp, Homo sapiens
gcctgacctccagtcct

SEQ ID NO: 2705864 - DNA, 20 bp, Homo sapiens
gcctgacctccagtcctgct

SEQ ID NO: 2705865 - DNA, 22 bp, Homo sapiens
gcctgacctccagtcctgctgg

SEQ ID NO: 2705866 - DNA, 15 bp, Homo sapiens
gcctgagattcttta

SEQ ID NO: 2705867 - DNA, 22 bp, Homo sapiens
gcctgagcaacagagtgagacc

SEQ ID NO: 2705868 - DNA, 15 bp, Homo sapiens
gcctgaggctgagac

SEQ ID NO: 2705869 - DNA, 18 bp, Homo sapiens
gcctgaggctgagactgc

SEQ ID NO: 2705870 - DNA, 13 bp, Homo sapiens
gcctgaggctggg

SEQ ID NO: 2705871 - DNA, 21 bp, Homo sapiens
gcctgaggtctcgctgatgct

SEQ ID NO: 2705872 - DNA, 23 bp, Homo sapiens
gcctgagtgcaccaccctttgaa

SEQ ID NO: 2705873 - DNA, 11 bp, Homo sapiens
gcctgcagccc

SEQ ID NO: 2705874 - DNA, 18 bp, Homo sapiens
gcctgcagcggcacaaat

SEQ ID NO: 2705875 - DNA, 20 bp, Homo sapiens
gcctgccgccgtctctgtcc

SEQ ID NO: 2705876 - DNA, 21 bp, Homo sapiens
gcctgccgccgtctctgtccc

SEQ ID NO: 2705877 - DNA, 23 bp, Homo sapiens
gcctgccttgaagccactgaagc

SEQ ID NO: 2705878 - DNA, 12 bp, Homo sapiens
gcctgcgagaga

SEQ ID NO: 2705879 - DNA, 12 bp, Homo sapiens
gcctgctctgct

SEQ ID NO: 2705880 - DNA, 23 bp, Homo sapiens
gcctgctctgcttttcctgtctg

SEQ ID NO: 2705881 - DNA, 22 bp, Homo sapiens
gcctgctcttacttcccccacc

SEQ ID NO: 2705882 - DNA, 19 bp, Homo sapiens
gcctgctgcgtcagaccag

SEQ ID NO: 2705883 - DNA, 15 bp, Homo sapiens
gcctgctgggctctt

SEQ ID NO: 2705884 - DNA, 18 bp, Homo sapiens
gcctggcaagtgggtgaa

SEQ ID NO: 2705885 - DNA, 22 bp, Homo sapiens
gcctggcacagtgtctgggctg

SEQ ID NO: 2705886 - DNA, 12 bp, Homo sapiens
gcctggcccagc

SEQ ID NO: 2705887 - DNA, 14 bp, Homo sapiens
gcctggcccagctc

SEQ ID NO: 2705888 - DNA, 15 bp, Homo sapiens
gcctggcccagctcc

SEQ ID NO: 2705889 - DNA, 17 bp, Homo sapiens
gcctggcccagctcccc

SEQ ID NO: 2705890 - DNA, 14 bp, Homo sapiens
gcctggcctgaggt

SEQ ID NO: 2705891 - DNA, 13 bp, Homo sapiens
gcctggcttctgg

SEQ ID NO: 2705892 - DNA, 16 bp, Homo sapiens
gcctggcttctggagc

SEQ ID NO: 2705893 - DNA, 23 bp, Homo sapiens
gcctggcttctggagcccttggg

SEQ ID NO: 2705894 - DNA, 13 bp, Homo sapiens
gcctgggcctccc

SEQ ID NO: 2705895 - DNA, 14 bp, Homo sapiens
gcctgggcctccca

SEQ ID NO: 2705896 - DNA, 20 bp, Homo sapiens
gcctgggcgacagagcaaga

SEQ ID NO: 2705897 - DNA, 15 bp, Homo sapiens
gcctgtcgtgtccag

SEQ ID NO: 2705898 - DNA, 13 bp, Homo sapiens
gcctgtctgtcca

SEQ ID NO: 2705899 - DNA, 16 bp, Homo sapiens
gcctgtctgtccaacc

SEQ ID NO: 2705900 - DNA, 17 bp, Homo sapiens
gcctgtctgtccaaccc

SEQ ID NO: 2705901 - DNA, 17 bp, Homo sapiens
gcctgttctccagatgg

SEQ ID NO: 2705902 - DNA, 19 bp, Homo sapiens
gccttaaacagtgtccagg

SEQ ID NO: 2705903 - DNA, 18 bp, Homo sapiens
gccttaaggccacactgg

SEQ ID NO: 2705904 - DNA, 13 bp, Homo sapiens
gccttatgagaac

SEQ ID NO: 2705905 - DNA, 19 bp, Homo sapiens
gccttccctccccacagtc

SEQ ID NO: 2705906 - DNA, 13 bp, Homo sapiens
gccttctcccctc

SEQ ID NO: 2705907 - DNA, 14 bp, Homo sapiens
gccttctcccctcc

SEQ ID NO: 2705908 - DNA, 20 bp, Homo sapiens
gccttgaagaggcaggtctg

SEQ ID NO: 2705909 - DNA, 14 bp, Homo sapiens
gccttgaagccact

SEQ ID NO: 2705910 - DNA, 22 bp, Homo sapiens
gcctttcacaggactctgcaga

SEQ ID NO: 2705911 - DNA, 20 bp, Homo sapiens
gcctttgaggcaaaggccag

SEQ ID NO: 2705912 - DNA, 14 bp, Homo sapiens
gcgaaggggccctg

SEQ ID NO: 2705913 - DNA, 19 bp, Homo sapiens
gcgacagagcgagagtctg

SEQ ID NO: 2705914 - DNA, 23 bp, Homo sapiens
gcgacagagcgagagtctgtctc

SEQ ID NO: 2705915 - DNA, 13 bp, Homo sapiens
gcgaccctggctc

SEQ ID NO: 2705916 - DNA, 16 bp, Homo sapiens
gcgagagtctgtctca

SEQ ID NO: 2705917 - DNA, 17 bp, Homo sapiens
gcgagttgtggaaagcc

SEQ ID NO: 2705918 - DNA, 18 bp, Homo sapiens
gcgcaccctcccctcccg

SEQ ID NO: 2705919 - DNA, 21 bp, Homo sapiens
gcgcaccctcccctcccgtct

SEQ ID NO: 2705920 - DNA, 17 bp, Homo sapiens
gcgcacctgccccctgg

SEQ ID NO: 2705921 - DNA, 15 bp, Homo sapiens
gcgcctccttccttg

SEQ ID NO: 2705922 - DNA, 16 bp, Homo sapiens
gcgcctctccactgtt

SEQ ID NO: 2705923 - DNA, 14 bp, Homo sapiens
gcgcctgtcccctc

SEQ ID NO: 2705924 - DNA, 16 bp, Homo sapiens
gcgcctgtcccctcac

SEQ ID NO: 2705925 - DNA, 13 bp, Homo sapiens
gcgcgtctgcccc

SEQ ID NO: 2705926 - DNA, 14 bp, Homo sapiens
gcgctgcctgtgtg

SEQ ID NO: 2705927 - DNA, 15 bp, Homo sapiens
gcgctggctccaggc

SEQ ID NO: 2705928 - DNA, 23 bp, Homo sapiens
gcgggatcccagcatctcagagt

SEQ ID NO: 2705929 - DNA, 13 bp, Homo sapiens
gcgggctgagggc

SEQ ID NO: 2705930 - DNA, 12 bp, Homo sapiens
gcgtaggagaga

SEQ ID NO: 2705931 - DNA, 20 bp, Homo sapiens
gcgtcgctggacaacccaga

SEQ ID NO: 2705932 - DNA, 13 bp, Homo sapiens
gctaaatcccaag

SEQ ID NO: 2705933 - DNA, 11 bp, Homo sapiens
gctaacattta

SEQ ID NO: 2705934 - DNA, 18 bp, Homo sapiens
gctaagagggtgaacaaa

SEQ ID NO: 2705935 - DNA, 20 bp, Homo sapiens
gctaagagggtgaacaaaga

SEQ ID NO: 2705936 - DNA, 16 bp, Homo sapiens
gctaaggaagacacag

SEQ ID NO: 2705937 - DNA, 16 bp, Homo sapiens
gctacaaaccaggagc

SEQ ID NO: 2705938 - DNA, 19 bp, Homo sapiens
gctacatgttgcaacaaat

SEQ ID NO: 2705939 - DNA, 14 bp, Homo sapiens
gctaccctccctgc

SEQ ID NO: 2705940 - DNA, 23 bp, Homo sapiens
gctaccctccctgctgtcccctc

SEQ ID NO: 2705941 - DNA, 14 bp, Homo sapiens
gctactctcttgcc

SEQ ID NO: 2705942 - DNA, 22 bp, Homo sapiens
gctagcattaccacttccctgc

SEQ ID NO: 2705943 - DNA, 19 bp, Homo sapiens
gctagtctcttctcagagc

SEQ ID NO: 2705944 - DNA, 20 bp, Homo sapiens
gctagtctcttctcagagca

SEQ ID NO: 2705945 - DNA, 22 bp, Homo sapiens
gctagtctcttctcagagcagc

SEQ ID NO: 2705946 - DNA, 22 bp, Homo sapiens
gctatattttcatgacttttcc

SEQ ID NO: 2705947 - DNA, 17 bp, Homo sapiens
gctatgatcgcgccact

SEQ ID NO: 2705948 - DNA, 12 bp, Homo sapiens
gctattaagaaa

SEQ ID NO: 2705949 - DNA, 21 bp, Homo sapiens
gctcacacggggtattttagg

SEQ ID NO: 2705950 - DNA, 18 bp, Homo sapiens
gctcaccacaacctccac

SEQ ID NO: 2705951 - DNA, 23 bp, Homo sapiens
gctcacgactcttcctgcaaagg

SEQ ID NO: 2705952 - DNA, 21 bp, Homo sapiens
gctcacgcctatgatcccagc

SEQ ID NO: 2705953 - DNA, 22 bp, Homo sapiens
gctcacgcctatgatcccagca

SEQ ID NO: 2705954 - DNA, 18 bp, Homo sapiens
gctcactgcaagctctgc

SEQ ID NO: 2705955 - DNA, 23 bp, Homo sapiens
gctcactgcaagctctgcctccc

SEQ ID NO: 2705956 - DNA, 12 bp, Homo sapiens
gctcagagctgc

SEQ ID NO: 2705957 - DNA, 16 bp, Homo sapiens
gctcagagctgctgag

SEQ ID NO: 2705958 - DNA, 18 bp, Homo sapiens
gctcagagctgctgagca

SEQ ID NO: 2705959 - DNA, 15 bp, Homo sapiens
gctcagatcctgggc

SEQ ID NO: 2705960 - DNA, 15 bp, Homo sapiens
gctcagcagccccac

SEQ ID NO: 2705961 - DNA, 17 bp, Homo sapiens
gctcagctgtggtccca

SEQ ID NO: 2705962 - DNA, 16 bp, Homo sapiens
gctcagggaccacagc

SEQ ID NO: 2705963 - DNA, 17 bp, Homo sapiens
gctcagggaccacagca

SEQ ID NO: 2705964 - DNA, 20 bp, Homo sapiens
gctccagaatgtgctgcctt

SEQ ID NO: 2705965 - DNA, 16 bp, Homo sapiens
gctcccaattcacctc

SEQ ID NO: 2705966 - DNA, 14 bp, Homo sapiens
gctcccacggggac

SEQ ID NO: 2705967 - DNA, 13 bp, Homo sapiens
gctcccagtgtct

SEQ ID NO: 2705968 - DNA, 22 bp, Homo sapiens
gctcccagtgtcttcctgtggg

SEQ ID NO: 2705969 - DNA, 18 bp, Homo sapiens
gctccccttgcccttcct

SEQ ID NO: 2705970 - DNA, 20 bp, Homo sapiens
gctccccttgcccttcctga

SEQ ID NO: 2705971 - DNA, 14 bp, Homo sapiens
gctcccgagctact

SEQ ID NO: 2705972 - DNA, 14 bp, Homo sapiens
gctccgtgagccct

SEQ ID NO: 2705973 - DNA, 15 bp, Homo sapiens
gctccgtgagccctt

SEQ ID NO: 2705974 - DNA, 19 bp, Homo sapiens
gctcctagcccagcagaga

SEQ ID NO: 2705975 - DNA, 18 bp, Homo sapiens
gctcctcccctgccgcct

SEQ ID NO: 2705976 - DNA, 20 bp, Homo sapiens
gctcctcccctgccgcctcc

SEQ ID NO: 2705977 - DNA, 11 bp, Homo sapiens
gctcctccctc

SEQ ID NO: 2705978 - DNA, 16 bp, Homo sapiens
gctcctccctctgcct

SEQ ID NO: 2705979 - DNA, 20 bp, Homo sapiens
gctcctccctctgcctcatc

SEQ ID NO: 2705980 - DNA, 21 bp, Homo sapiens
gctcctggaaaggctcagtct

SEQ ID NO: 2705981 - DNA, 14 bp, Homo sapiens
gctcctgtccctac

SEQ ID NO: 2705982 - DNA, 16 bp, Homo sapiens
gctcctgtccctaccc

SEQ ID NO: 2705983 - DNA, 15 bp, Homo sapiens
gctcgaagactgtga

SEQ ID NO: 2705984 - DNA, 15 bp, Homo sapiens
gctcgagcatgccct

SEQ ID NO: 2705985 - DNA, 18 bp, Homo sapiens
gctcgccccacccagggc

SEQ ID NO: 2705986 - DNA, 13 bp, Homo sapiens
gctcgggcccagg

SEQ ID NO: 2705987 - DNA, 14 bp, Homo sapiens
gctcgggcccaggc

SEQ ID NO: 2705988 - DNA, 17 bp, Homo sapiens
gctctacacaacatgta

SEQ ID NO: 2705989 - DNA, 18 bp, Homo sapiens
gctctacacaacatgtat

SEQ ID NO: 2705990 - DNA, 15 bp, Homo sapiens
gctctaccctgcagc

SEQ ID NO: 2705991 - DNA, 18 bp, Homo sapiens
gctctaccctgcagcttg

SEQ ID NO: 2705992 - DNA, 16 bp, Homo sapiens
gctctatctgcaatgt

SEQ ID NO: 2705993 - DNA, 22 bp, Homo sapiens
gctctatttcctcccccagtta

SEQ ID NO: 2705994 - DNA, 13 bp, Homo sapiens
gctctcacagata

SEQ ID NO: 2705995 - DNA, 13 bp, Homo sapiens
gctctgccccagc

SEQ ID NO: 2705996 - DNA, 15 bp, Homo sapiens
gctctgccccagctc

SEQ ID NO: 2705997 - DNA, 13 bp, Homo sapiens
gctctgcctcccg

SEQ ID NO: 2705998 - DNA, 20 bp, Homo sapiens
gctctgcctctaactccctc

SEQ ID NO: 2705999 - DNA, 21 bp, Homo sapiens
gctctgcctctaactccctcc

SEQ ID NO: 2706000 - DNA, 11 bp, Homo sapiens
gctctgctgga

SEQ ID NO: 2706001 - DNA, 13 bp, Homo sapiens
gctctgctggaag

SEQ ID NO: 2706002 - DNA, 21 bp, Homo sapiens
gctctgtcaccctggccacca

SEQ ID NO: 2706003 - DNA, 22 bp, Homo sapiens
gctctgtcaccctggccaccac

SEQ ID NO: 2706004 - DNA, 14 bp, Homo sapiens
gctctgtgcaggga

SEQ ID NO: 2706005 - DNA, 14 bp, Homo sapiens
gctcttaaaaatct

SEQ ID NO: 2706006 - DNA, 16 bp, Homo sapiens
gctcttacttccccca

SEQ ID NO: 2706007 - DNA, 19 bp, Homo sapiens
gctcttacttcccccaccc

SEQ ID NO: 2706008 - DNA, 20 bp, Homo sapiens
gctcttacttcccccaccct

SEQ ID NO: 2706009 - DNA, 17 bp, Homo sapiens
gctcttatttttgtacc

SEQ ID NO: 2706010 - DNA, 12 bp, Homo sapiens
gctcttgggcct

SEQ ID NO: 2706011 - DNA, 21 bp, Homo sapiens
gctcttgggcctgacctccag

SEQ ID NO: 2706012 - DNA, 17 bp, Homo sapiens
gctgaaatctattaaac

SEQ ID NO: 2706013 - DNA, 17 bp, Homo sapiens
gctgaacagtgctctgc

SEQ ID NO: 2706014 - DNA, 17 bp, Homo sapiens
gctgacagagccagagg

SEQ ID NO: 2706015 - DNA, 19 bp, Homo sapiens
gctgacagtcctctccacc

SEQ ID NO: 2706016 - DNA, 15 bp, Homo sapiens
gctgacccaccaagg

SEQ ID NO: 2706017 - DNA, 20 bp, Homo sapiens
gctgacccagtgtgtgctca

SEQ ID NO: 2706018 - DNA, 22 bp, Homo sapiens
gctgacccagtgtgtgctcagc

SEQ ID NO: 2706019 - DNA, 11 bp, Homo sapiens
gctgagccctg

SEQ ID NO: 2706020 - DNA, 14 bp, Homo sapiens
gctgagccctggca

SEQ ID NO: 2706021 - DNA, 16 bp, Homo sapiens
gctgagccctggcagg

SEQ ID NO: 2706022 - DNA, 15 bp, Homo sapiens
gctgaggcctccctt

SEQ ID NO: 2706023 - DNA, 13 bp, Homo sapiens
gctgagtggcagc

SEQ ID NO: 2706024 - DNA, 17 bp, Homo sapiens
gctgatgcattcccggt

SEQ ID NO: 2706025 - DNA, 20 bp, Homo sapiens
gctgatgctgggctgggtgc

SEQ ID NO: 2706026 - DNA, 13 bp, Homo sapiens
gctgcaccaaccc

SEQ ID NO: 2706027 - DNA, 18 bp, Homo sapiens
gctgcaccaacccagccg

SEQ ID NO: 2706028 - DNA, 19 bp, Homo sapiens
gctgcacctgccagcctgg

SEQ ID NO: 2706029 - DNA, 21 bp, Homo sapiens
gctgcacgtcaccctcctgag

SEQ ID NO: 2706030 - DNA, 15 bp, Homo sapiens
gctgcactctgtgcc

SEQ ID NO: 2706031 - DNA, 17 bp, Homo sapiens
gctgcactctgtgccca

SEQ ID NO: 2706032 - DNA, 20 bp, Homo sapiens
gctgcactctgtgcccatgg

SEQ ID NO: 2706033 - DNA, 22 bp, Homo sapiens
gctgcactctgtgcccatgggc

SEQ ID NO: 2706034 - DNA, 18 bp, Homo sapiens
gctgcagcatgaaggcag

SEQ ID NO: 2706035 - DNA, 13 bp, Homo sapiens
gctgcagcttcct

SEQ ID NO: 2706036 - DNA, 15 bp, Homo sapiens
gctgccagcaccaag

SEQ ID NO: 2706037 - DNA, 15 bp, Homo sapiens
gctgcccgctcccag

SEQ ID NO: 2706038 - DNA, 16 bp, Homo sapiens
gctgcccgctcccagt

SEQ ID NO: 2706039 - DNA, 20 bp, Homo sapiens
gctgcccgctcccagtgtct

SEQ ID NO: 2706040 - DNA, 20 bp, Homo sapiens
gctgcccggcgccctctgtc

SEQ ID NO: 2706041 - DNA, 23 bp, Homo sapiens
gctgcccggcgccctctgtcctg

SEQ ID NO: 2706042 - DNA, 22 bp, Homo sapiens
gctgccgggtggggggagggca

SEQ ID NO: 2706043 - DNA, 14 bp, Homo sapiens
gctgcctccactcc

SEQ ID NO: 2706044 - DNA, 15 bp, Homo sapiens
gctgcctccactccc

SEQ ID NO: 2706045 - DNA, 16 bp, Homo sapiens
gctgcctccactccca

SEQ ID NO: 2706046 - DNA, 18 bp, Homo sapiens
gctgcctccactcccact

SEQ ID NO: 2706047 - DNA, 21 bp, Homo sapiens
gctgcctccactcccacttcc

SEQ ID NO: 2706048 - DNA, 14 bp, Homo sapiens
gctgcctgaaaacc

SEQ ID NO: 2706049 - DNA, 13 bp, Homo sapiens
gctgcctgtgtgg

SEQ ID NO: 2706050 - DNA, 21 bp, Homo sapiens
gctgcgggctgagggcatctc

SEQ ID NO: 2706051 - DNA, 19 bp, Homo sapiens
gctgctaccctccctgctg

SEQ ID NO: 2706052 - DNA, 18 bp, Homo sapiens
gctgctaggggaaggact

SEQ ID NO: 2706053 - DNA, 20 bp, Homo sapiens
gctgctaggggaaggactgg

SEQ ID NO: 2706054 - DNA, 21 bp, Homo sapiens
gctgctctgctatatgcctta

SEQ ID NO: 2706055 - DNA, 14 bp, Homo sapiens
gctgctgagcagga

SEQ ID NO: 2706056 - DNA, 22 bp, Homo sapiens
gctgctggcccacagctctgct

SEQ ID NO: 2706057 - DNA, 13 bp, Homo sapiens
gctgctttccaac

SEQ ID NO: 2706058 - DNA, 16 bp, Homo sapiens
gctggacaacccagaa

SEQ ID NO: 2706059 - DNA, 20 bp, Homo sapiens
gctggacccatttgccagga

SEQ ID NO: 2706060 - DNA, 18 bp, Homo sapiens
gctggagactatttaagt

SEQ ID NO: 2706061 - DNA, 20 bp, Homo sapiens
gctggagttcagtggtgtga

SEQ ID NO: 2706062 - DNA, 12 bp, Homo sapiens
gctggatgagca

SEQ ID NO: 2706063 - DNA, 21 bp, Homo sapiens
gctggatgagcaactcctgtt

SEQ ID NO: 2706064 - DNA, 19 bp, Homo sapiens
gctggcagcctccagtggg

SEQ ID NO: 2706065 - DNA, 16 bp, Homo sapiens
gctggcatcctggctg

SEQ ID NO: 2706066 - DNA, 19 bp, Homo sapiens
gctggcatcctggctggct

SEQ ID NO: 2706067 - DNA, 13 bp, Homo sapiens
gctggccagcccc

SEQ ID NO: 2706068 - DNA, 19 bp, Homo sapiens
gctggccagccccacagcc

SEQ ID NO: 2706069 - DNA, 17 bp, Homo sapiens
gctggcccacagctctg

SEQ ID NO: 2706070 - DNA, 19 bp, Homo sapiens
gctggcccacagctctgct

SEQ ID NO: 2706071 - DNA, 21 bp, Homo sapiens
gctggcccacagctctgctgg

SEQ ID NO: 2706072 - DNA, 13 bp, Homo sapiens
gctggcctctaga

SEQ ID NO: 2706073 - DNA, 21 bp, Homo sapiens
gctggcctcttggcacctgcc

SEQ ID NO: 2706074 - DNA, 12 bp, Homo sapiens
gctggcctgctc

SEQ ID NO: 2706075 - DNA, 13 bp, Homo sapiens
gctggctgctggc

SEQ ID NO: 2706076 - DNA, 14 bp, Homo sapiens
gctggctgtgtcct

SEQ ID NO: 2706077 - DNA, 19 bp, Homo sapiens
gctgggaagggaaggaagc

SEQ ID NO: 2706078 - DNA, 14 bp, Homo sapiens
gctgggactggcca

SEQ ID NO: 2706079 - DNA, 22 bp, Homo sapiens
gctgggcccacagcccccaccc

SEQ ID NO: 2706080 - DNA, 20 bp, Homo sapiens
gctgggctacaaaccaggag

SEQ ID NO: 2706081 - DNA, 21 bp, Homo sapiens
gctgggctacaaaccaggagc

SEQ ID NO: 2706082 - DNA, 12 bp, Homo sapiens
gctgggctgggg

SEQ ID NO: 2706083 - DNA, 16 bp, Homo sapiens
gctggggctggtgagg

SEQ ID NO: 2706084 - DNA, 18 bp, Homo sapiens
gctgggggctccccttgc

SEQ ID NO: 2706085 - DNA, 20 bp, Homo sapiens
gctgggggctccccttgccc

SEQ ID NO: 2706086 - DNA, 17 bp, Homo sapiens
gctgggtccaggggagg

SEQ ID NO: 2706087 - DNA, 21 bp, Homo sapiens
gctgggtgcgaccccatctgc

SEQ ID NO: 2706088 - DNA, 14 bp, Homo sapiens
gctgggtggcccat

SEQ ID NO: 2706089 - DNA, 16 bp, Homo sapiens
gctgggtggcccatcc

SEQ ID NO: 2706090 - DNA, 20 bp, Homo sapiens
gctgggtggcccatcccccc

SEQ ID NO: 2706091 - DNA, 22 bp, Homo sapiens
gctgggtggcccatcccccctc

SEQ ID NO: 2706092 - DNA, 16 bp, Homo sapiens
gctggtctcgaactcc

SEQ ID NO: 2706093 - DNA, 18 bp, Homo sapiens
gctggtctcgaactcctg

SEQ ID NO: 2706094 - DNA, 12 bp, Homo sapiens
gctggtgaggcc

SEQ ID NO: 2706095 - DNA, 13 bp, Homo sapiens
gctggtgaggccg

SEQ ID NO: 2706096 - DNA, 21 bp, Homo sapiens
gctggtgaggccggccctgcc

SEQ ID NO: 2706097 - DNA, 17 bp, Homo sapiens
gctggtggatggtgact

SEQ ID NO: 2706098 - DNA, 18 bp, Homo sapiens
gctggtggatggtgactt

SEQ ID NO: 2706099 - DNA, 13 bp, Homo sapiens
gctggttcactct

SEQ ID NO: 2706100 - DNA, 22 bp, Homo sapiens
gctgtaagcattctgagctggg

SEQ ID NO: 2706101 - DNA, 16 bp, Homo sapiens
gctgtacattactgta

SEQ ID NO: 2706102 - DNA, 14 bp, Homo sapiens
gctgtatacaaaca

SEQ ID NO: 2706103 - DNA, 20 bp, Homo sapiens
gctgtatacaaacaggtgct

SEQ ID NO: 2706104 - DNA, 12 bp, Homo sapiens
gctgtccagtgc

SEQ ID NO: 2706105 - DNA, 15 bp, Homo sapiens
gctgtccagtgccca

SEQ ID NO: 2706106 - DNA, 12 bp, Homo sapiens
gctgtcccctct

SEQ ID NO: 2706107 - DNA, 21 bp, Homo sapiens
gctgtcggtgtgctgtcagcc

SEQ ID NO: 2706108 - DNA, 18 bp, Homo sapiens
gctgtgaacatggactct

SEQ ID NO: 2706109 - DNA, 19 bp, Homo sapiens
gctgtggcatcaggaaagg

SEQ ID NO: 2706110 - DNA, 13 bp, Homo sapiens
gctgttgctgttg

SEQ ID NO: 2706111 - DNA, 18 bp, Homo sapiens
gctgttgctgttgctgtt

SEQ ID NO: 2706112 - DNA, 21 bp, Homo sapiens
gctgttgttgttacttccctc

SEQ ID NO: 2706113 - DNA, 18 bp, Homo sapiens
gcttacttacaaaagcag

SEQ ID NO: 2706114 - DNA, 17 bp, Homo sapiens
gcttagattttctgtaa

SEQ ID NO: 2706115 - DNA, 20 bp, Homo sapiens
gcttatgtgttgcataaaca

SEQ ID NO: 2706116 - DNA, 13 bp, Homo sapiens
gcttcagaattgt

SEQ ID NO: 2706117 - DNA, 20 bp, Homo sapiens
gcttcagcctgaggctgaga

SEQ ID NO: 2706118 - DNA, 21 bp, Homo sapiens
gcttcagcctgaggctgagac

SEQ ID NO: 2706119 - DNA, 18 bp, Homo sapiens
gcttcagttgttttcccg

SEQ ID NO: 2706120 - DNA, 16 bp, Homo sapiens
gcttcatatctaattt

SEQ ID NO: 2706121 - DNA, 19 bp, Homo sapiens
gcttccagaaaaccccagc

SEQ ID NO: 2706122 - DNA, 13 bp, Homo sapiens
gcttcctctgaat

SEQ ID NO: 2706123 - DNA, 17 bp, Homo sapiens
gcttctcccggacctgg

SEQ ID NO: 2706124 - DNA, 18 bp, Homo sapiens
gcttctcccggacctgga

SEQ ID NO: 2706125 - DNA, 14 bp, Homo sapiens
gcttctgctgggct

SEQ ID NO: 2706126 - DNA, 15 bp, Homo sapiens
gcttctgctgggctg

SEQ ID NO: 2706127 - DNA, 23 bp, Homo sapiens
gcttgattaaacagcaaagccat

SEQ ID NO: 2706128 - DNA, 14 bp, Homo sapiens
gcttgcctcggctc

SEQ ID NO: 2706129 - DNA, 16 bp, Homo sapiens
gcttgcctcggctcct

SEQ ID NO: 2706130 - DNA, 13 bp, Homo sapiens
gcttggcagctga

SEQ ID NO: 2706131 - DNA, 18 bp, Homo sapiens
gcttggcttcccctccac

SEQ ID NO: 2706132 - DNA, 17 bp, Homo sapiens
gcttgtggactctctgc

SEQ ID NO: 2706133 - DNA, 14 bp, Homo sapiens
gctttacaaataat

SEQ ID NO: 2706134 - DNA, 16 bp, Homo sapiens
gctttccaacacacaa

SEQ ID NO: 2706135 - DNA, 19 bp, Homo sapiens
gctttcctaaagtctctgc

SEQ ID NO: 2706136 - DNA, 23 bp, Homo sapiens
gctttcttttctctatgaaaagc

SEQ ID NO: 2706137 - DNA, 21 bp, Homo sapiens
gctttgccatgggcctgctgc

SEQ ID NO: 2706138 - DNA, 19 bp, Homo sapiens
gctttgggaaagctgcctc

SEQ ID NO: 2706139 - DNA, 22 bp, Homo sapiens
gctttgttcttgtcatcagtaa

SEQ ID NO: 2706140 - DNA, 17 bp, Homo sapiens
gcttttcgaactgtgct

SEQ ID NO: 2706141 - DNA, 13 bp, Homo sapiens
gcttttctcccag

SEQ ID NO: 2706142 - DNA, 17 bp, Homo sapiens
gcttttctcccagaagg

SEQ ID NO: 2706143 - DNA, 20 bp, Homo sapiens
gcttttctcccagaaggctg

SEQ ID NO: 2706144 - DNA, 13 bp, Homo sapiens
ggaaaagaaatca

SEQ ID NO: 2706145 - DNA, 18 bp, Homo sapiens
ggaaaaggttttattttg

SEQ ID NO: 2706146 - DNA, 23 bp, Homo sapiens
ggaaacccatcttcacgcctggg

SEQ ID NO: 2706147 - DNA, 16 bp, Homo sapiens
ggaaagccaaatttta

SEQ ID NO: 2706148 - DNA, 16 bp, Homo sapiens
ggaaagcctctgctgc

SEQ ID NO: 2706149 - DNA, 16 bp, Homo sapiens
ggaaatgacagcgggg

SEQ ID NO: 2706150 - DNA, 15 bp, Homo sapiens
ggaacattgggaagg

SEQ ID NO: 2706151 - DNA, 13 bp, Homo sapiens
ggaacctttccct

SEQ ID NO: 2706152 - DNA, 23 bp, Homo sapiens
ggaagaactgcatggggagtaca

SEQ ID NO: 2706153 - DNA, 18 bp, Homo sapiens
ggaagacacagcccagac

SEQ ID NO: 2706154 - DNA, 12 bp, Homo sapiens
ggaagagaggca

SEQ ID NO: 2706155 - DNA, 19 bp, Homo sapiens
ggaagagaggcacctgctg

SEQ ID NO: 2706156 - DNA, 16 bp, Homo sapiens
ggaagagcacagccct

SEQ ID NO: 2706157 - DNA, 18 bp, Homo sapiens
ggaagagcacagccctcc

SEQ ID NO: 2706158 - DNA, 15 bp, Homo sapiens
ggaagcatcctcccc

SEQ ID NO: 2706159 - DNA, 21 bp, Homo sapiens
ggaagcatcctccccaccaga

SEQ ID NO: 2706160 - DNA, 17 bp, Homo sapiens
ggaagcccgcggggaga

SEQ ID NO: 2706161 - DNA, 19 bp, Homo sapiens
ggaagcccgcggggagaga

SEQ ID NO: 2706162 - DNA, 22 bp, Homo sapiens
ggaagccctcggcctccagact

SEQ ID NO: 2706163 - DNA, 13 bp, Homo sapiens
ggaagctgctagg

SEQ ID NO: 2706164 - DNA, 13 bp, Homo sapiens
ggaagggagggag

SEQ ID NO: 2706165 - DNA, 16 bp, Homo sapiens
ggaagggagggagctg

SEQ ID NO: 2706166 - DNA, 19 bp, Homo sapiens
ggaaggtatatcaggaggg

SEQ ID NO: 2706167 - DNA, 18 bp, Homo sapiens
ggaatacgatcctgcagg

SEQ ID NO: 2706168 - DNA, 13 bp, Homo sapiens
ggaatgaagcatg

SEQ ID NO: 2706169 - DNA, 15 bp, Homo sapiens
ggaatgaagcatgta

SEQ ID NO: 2706170 - DNA, 21 bp, Homo sapiens
ggaatggaaggctttgccatg

SEQ ID NO: 2706171 - DNA, 20 bp, Homo sapiens
ggacaacctgcccctcccca

SEQ ID NO: 2706172 - DNA, 14 bp, Homo sapiens
ggacagaagcagga

SEQ ID NO: 2706173 - DNA, 20 bp, Homo sapiens
ggacagtgcttcagcctgag

SEQ ID NO: 2706174 - DNA, 22 bp, Homo sapiens
ggacagtgcttcagcctgaggc

SEQ ID NO: 2706175 - DNA, 22 bp, Homo sapiens
ggacatatgttaggaatactct

SEQ ID NO: 2706176 - DNA, 20 bp, Homo sapiens
ggacatgatttagggaagca

SEQ ID NO: 2706177 - DNA, 17 bp, Homo sapiens
ggaccactgggcccctc

SEQ ID NO: 2706178 - DNA, 20 bp, Homo sapiens
ggaccactgggcccctcagg

SEQ ID NO: 2706179 - DNA, 17 bp, Homo sapiens
ggaccccctcaggattg

SEQ ID NO: 2706180 - DNA, 22 bp, Homo sapiens
ggaccccctcaggattgtttct

SEQ ID NO: 2706181 - DNA, 16 bp, Homo sapiens
ggaccgcgtagagagc

SEQ ID NO: 2706182 - DNA, 17 bp, Homo sapiens
ggacctgagtctgctat

SEQ ID NO: 2706183 - DNA, 19 bp, Homo sapiens
ggacctggagctgccagca

SEQ ID NO: 2706184 - DNA, 13 bp, Homo sapiens
ggacggggccggc

SEQ ID NO: 2706185 - DNA, 15 bp, Homo sapiens
ggacggttgtaagca

SEQ ID NO: 2706186 - DNA, 18 bp, Homo sapiens
ggactcagactcctggct

SEQ ID NO: 2706187 - DNA, 20 bp, Homo sapiens
ggactcagactcctggcttc

SEQ ID NO: 2706188 - DNA, 20 bp, Homo sapiens
gatcattggtatctgatatc

SEQ ID NO: 2706189 - DNA, 15 bp, Homo sapiens
gatccaaatgctgtg

SEQ ID NO: 2706190 - DNA, 18 bp, Homo sapiens
gatccaggcttctcccgg

SEQ ID NO: 2706191 - DNA, 12 bp, Homo sapiens
gatcccagcatc

SEQ ID NO: 2706192 - DNA, 12 bp, Homo sapiens
gatccctcgacc

SEQ ID NO: 2706193 - DNA, 17 bp, Homo sapiens
gatcggagcctcctctc

SEQ ID NO: 2706194 - DNA, 13 bp, Homo sapiens
gatctaggtcttg

SEQ ID NO: 2706195 - DNA, 15 bp, Homo sapiens
gatctcagcagccag

SEQ ID NO: 2706196 - DNA, 20 bp, Homo sapiens
gatctcagcagccagctcct

SEQ ID NO: 2706197 - DNA, 11 bp, Homo sapiens
gatctcctgag

SEQ ID NO: 2706198 - DNA, 12 bp, Homo sapiens
gatctctgctta

SEQ ID NO: 2706199 - DNA, 18 bp, Homo sapiens
gatctgcttccctggggc

SEQ ID NO: 2706200 - DNA, 22 bp, Homo sapiens
gatctgcttccctggggcccca

SEQ ID NO: 2706201 - DNA, 15 bp, Homo sapiens
gatctttaaatacag

SEQ ID NO: 2706202 - DNA, 19 bp, Homo sapiens
gatctttctttccaaaaca

SEQ ID NO: 2706203 - DNA, 11 bp, Homo sapiens
gatcttttgta

SEQ ID NO: 2706204 - DNA, 13 bp, Homo sapiens
gatgaaaagccat

SEQ ID NO: 2706205 - DNA, 15 bp, Homo sapiens
gatgaaaagccatat

SEQ ID NO: 2706206 - DNA, 15 bp, Homo sapiens
gatgaatgggaaagt

SEQ ID NO: 2706207 - DNA, 17 bp, Homo sapiens
gatgactgagtcctcgt

SEQ ID NO: 2706208 - DNA, 16 bp, Homo sapiens
gatgatgaaaactaag

SEQ ID NO: 2706209 - DNA, 16 bp, Homo sapiens
gatgccacaccaagct

SEQ ID NO: 2706210 - DNA, 22 bp, Homo sapiens
gatgccacaccaagctgtgcca

SEQ ID NO: 2706211 - DNA, 13 bp, Homo sapiens
ggactctctgcct

SEQ ID NO: 2706212 - DNA, 15 bp, Homo sapiens
ggactctctgcctgc

SEQ ID NO: 2706213 - DNA, 16 bp, Homo sapiens
ggactctctgcctgct

SEQ ID NO: 2706214 - DNA, 17 bp, Homo sapiens
ggactctctgcctgctt

SEQ ID NO: 2706215 - DNA, 11 bp, Homo sapiens
ggactctgagg

SEQ ID NO: 2706216 - DNA, 13 bp, Homo sapiens
ggactctgcagat

SEQ ID NO: 2706217 - DNA, 24 bp, Homo sapiens
ggactctgcagatagtgcctctgc

SEQ ID NO: 2706218 - DNA, 17 bp, Homo sapiens
ggactgctgacccacca

SEQ ID NO: 2706219 - DNA, 20 bp, Homo sapiens
ggactgggccatgggtcctc

SEQ ID NO: 2706220 - DNA, 15 bp, Homo sapiens
ggactgttctcacct

SEQ ID NO: 2706221 - DNA, 18 bp, Homo sapiens
ggacttgaggattttgag

SEQ ID NO: 2706222 - DNA, 16 bp, Homo sapiens
ggagaaaaattacaga

SEQ ID NO: 2706223 - DNA, 19 bp, Homo sapiens
ggagaactccgctggatgg

SEQ ID NO: 2706224 - DNA, 14 bp, Homo sapiens
ggagaaggcctccc

SEQ ID NO: 2706225 - DNA, 23 bp, Homo sapiens
ggagagacaggattgggccaaca

SEQ ID NO: 2706226 - DNA, 22 bp, Homo sapiens
ggagagagcagcttctgccact

SEQ ID NO: 2706227 - DNA, 12 bp, Homo sapiens
ggagagcagctg

SEQ ID NO: 2706228 - DNA, 14 bp, Homo sapiens
ggagagcagctggc

SEQ ID NO: 2706229 - DNA, 17 bp, Homo sapiens
ggagagcagctggctct

SEQ ID NO: 2706230 - DNA, 19 bp, Homo sapiens
ggagaggaggtccttggag

SEQ ID NO: 2706231 - DNA, 23 bp, Homo sapiens
ggagatagacgggttgaaagaca

SEQ ID NO: 2706232 - DNA, 19 bp, Homo sapiens
ggagatggaggaaagtgat

SEQ ID NO: 2706233 - DNA, 17 bp, Homo sapiens
ggagattttccttccta

SEQ ID NO: 2706234 - DNA, 22 bp, Homo sapiens
ggagcagcctccagtgctggct

SEQ ID NO: 2706235 - DNA, 13 bp, Homo sapiens
ggagcaggggtgg

SEQ ID NO: 2706236 - DNA, 15 bp, Homo sapiens
ggagcatcccaggcg

SEQ ID NO: 2706237 - DNA, 14 bp, Homo sapiens
ggagccaacagcag

SEQ ID NO: 2706238 - DNA, 21 bp, Homo sapiens
ggagccgagatcacgccactg

SEQ ID NO: 2706239 - DNA, 16 bp, Homo sapiens
ggagcgaccctggctc

SEQ ID NO: 2706240 - DNA, 19 bp, Homo sapiens
ggagcgcacctgccccctg

SEQ ID NO: 2706241 - DNA, 17 bp, Homo sapiens
ggagctaaggaagacac

SEQ ID NO: 2706242 - DNA, 17 bp, Homo sapiens
ggagctgacagagccag

SEQ ID NO: 2706243 - DNA, 17 bp, Homo sapiens
ggagctgaggcctccct

SEQ ID NO: 2706244 - DNA, 18 bp, Homo sapiens
ggagctgaggcctccctt

SEQ ID NO: 2706245 - DNA, 20 bp, Homo sapiens
ggaggatcactggagcccag

SEQ ID NO: 2706246 - DNA, 17 bp, Homo sapiens
ggaggctccgtgagccc

SEQ ID NO: 2706247 - DNA, 18 bp, Homo sapiens
ggaggctccgtgagccct

SEQ ID NO: 2706248 - DNA, 19 bp, Homo sapiens
ggaggctccgtgagccctt

SEQ ID NO: 2706249 - DNA, 19 bp, Homo sapiens
ggaggctcctccctctgcc

SEQ ID NO: 2706250 - DNA, 14 bp, Homo sapiens
ggagggactgctga

SEQ ID NO: 2706251 - DNA, 15 bp, Homo sapiens
ggagggactgctgac

SEQ ID NO: 2706252 - DNA, 17 bp, Homo sapiens
ggagggactgctgaccc

SEQ ID NO: 2706253 - DNA, 20 bp, Homo sapiens
ggagggactgctgacccacc

SEQ ID NO: 2706254 - DNA, 19 bp, Homo sapiens
ggagggagctgaggcctcc

SEQ ID NO: 2706255 - DNA, 12 bp, Homo sapiens
ggagggcacccc

SEQ ID NO: 2706256 - DNA, 14 bp, Homo sapiens
ggaggggaagaggc

SEQ ID NO: 2706257 - DNA, 12 bp, Homo sapiens
ggaggttgcagg

SEQ ID NO: 2706258 - DNA, 17 bp, Homo sapiens
ggaggttgttgcagtga

SEQ ID NO: 2706259 - DNA, 16 bp, Homo sapiens
ggagtgagaaattttt

SEQ ID NO: 2706260 - DNA, 21 bp, Homo sapiens
ggagtgggggctgtgccgtga

SEQ ID NO: 2706261 - DNA, 20 bp, Homo sapiens
ggagtgtcctgtctgctggg

SEQ ID NO: 2706262 - DNA, 12 bp, Homo sapiens
ggagtgtttgac

SEQ ID NO: 2706263 - DNA, 18 bp, Homo sapiens
ggagttcaagaccagcct

SEQ ID NO: 2706264 - DNA, 13 bp, Homo sapiens
ggagtttgaggct

SEQ ID NO: 2706265 - DNA, 19 bp, Homo sapiens
ggagtttgaggctgcagcg

SEQ ID NO: 2706266 - DNA, 14 bp, Homo sapiens
ggatcactggagcc

SEQ ID NO: 2706267 - DNA, 17 bp, Homo sapiens
ggatcactggagcccag

SEQ ID NO: 2706268 - DNA, 19 bp, Homo sapiens
ggatcactggagcccagga

SEQ ID NO: 2706269 - DNA, 12 bp, Homo sapiens
ggatcagcctcc

SEQ ID NO: 2706270 - DNA, 22 bp, Homo sapiens
ggatcagcctccgccattccaa

SEQ ID NO: 2706271 - DNA, 19 bp, Homo sapiens
ggatcccagcatctcagag

SEQ ID NO: 2706272 - DNA, 21 bp, Homo sapiens
ggcatttggtgagagtcaaag

SEQ ID NO: 2706273 - DNA, 20 bp, Homo sapiens
ggcattttgaatgtgatcat

SEQ ID NO: 2706274 - DNA, 17 bp, Homo sapiens
ggccaccacccaacctg

SEQ ID NO: 2706275 - DNA, 22 bp, Homo sapiens
ggccaccacccaacctgtcctt

SEQ ID NO: 2706276 - DNA, 13 bp, Homo sapiens
ggccagcaggcag

SEQ ID NO: 2706277 - DNA, 17 bp, Homo sapiens
ggccagggccctgcaga

SEQ ID NO: 2706278 - DNA, 17 bp, Homo sapiens
ggccagggcctctgtgc

SEQ ID NO: 2706279 - DNA, 14 bp, Homo sapiens
ggccaggtgcagtg

SEQ ID NO: 2706280 - DNA, 17 bp, Homo sapiens
ggccaggtttctgccca

SEQ ID NO: 2706281 - DNA, 21 bp, Homo sapiens
ggccagtcctagagctcctgt

SEQ ID NO: 2706282 - DNA, 22 bp, Homo sapiens
ggccagtcctagagctcctgtc

SEQ ID NO: 2706283 - DNA, 17 bp, Homo sapiens
ggccatcttccaggtgg

SEQ ID NO: 2706284 - DNA, 14 bp, Homo sapiens
ggccatgggtcctc

SEQ ID NO: 2706285 - DNA, 20 bp, Homo sapiens
ggccatgggtcctcggccca

SEQ ID NO: 2706286 - DNA, 11 bp, Homo sapiens
ggcccacagct

SEQ ID NO: 2706287 - DNA, 16 bp, Homo sapiens
ggcccacagctctgct

SEQ ID NO: 2706288 - DNA, 17 bp, Homo sapiens
ggcccacagctctgctg

SEQ ID NO: 2706289 - DNA, 18 bp, Homo sapiens
ggcccagccactgcagca

SEQ ID NO: 2706290 - DNA, 17 bp, Homo sapiens
ggcccagcctgtcctgg

SEQ ID NO: 2706291 - DNA, 15 bp, Homo sapiens
ggcccagctcccccg

SEQ ID NO: 2706292 - DNA, 16 bp, Homo sapiens
ggcccagctcccccgg

SEQ ID NO: 2706293 - DNA, 15 bp, Homo sapiens
ggcccaggcaggcca

SEQ ID NO: 2706294 - DNA, 16 bp, Homo sapiens
ggcccatcccccctca

SEQ ID NO: 2706295 - DNA, 13 bp, Homo sapiens
ggcccatctgtcc

SEQ ID NO: 2706296 - DNA, 14 bp, Homo sapiens
ggcccatctgtcca

SEQ ID NO: 2706297 - DNA, 13 bp, Homo sapiens
ggccccagcctgg

SEQ ID NO: 2706298 - DNA, 14 bp, Homo sapiens
ggccccagcctggc

SEQ ID NO: 2706299 - DNA, 17 bp, Homo sapiens
ggccccagcctggccca

SEQ ID NO: 2706300 - DNA, 19 bp, Homo sapiens
ggccccagcctggcccagc

SEQ ID NO: 2706301 - DNA, 23 bp, Homo sapiens
ggccccagcctggcccagctccc

SEQ ID NO: 2706302 - DNA, 19 bp, Homo sapiens
ggcccccagagacctttgc

SEQ ID NO: 2706303 - DNA, 12 bp, Homo sapiens
ggcccctcaggg

SEQ ID NO: 2706304 - DNA, 22 bp, Homo sapiens
ggcccctcaggggaagctgcta

SEQ ID NO: 2706305 - DNA, 10 bp, Homo sapiens
ggcccctgga

SEQ ID NO: 2706306 - DNA, 13 bp, Homo sapiens
ggcccgcttgcct

SEQ ID NO: 2706307 - DNA, 22 bp, Homo sapiens
ggcccgcttgcctcggctcctg

SEQ ID NO: 2706308 - DNA, 18 bp, Homo sapiens
ggcccgttgtctccctgg

SEQ ID NO: 2706309 - DNA, 18 bp, Homo sapiens
ggccctcaaggcctccca

SEQ ID NO: 2706310 - DNA, 19 bp, Homo sapiens
ggccctcaaggcctcccac

SEQ ID NO: 2706311 - DNA, 20 bp, Homo sapiens
ggccctcaaggcctcccaca

SEQ ID NO: 2706312 - DNA, 14 bp, Homo sapiens
ggccctgcactgtc

SEQ ID NO: 2706313 - DNA, 16 bp, Homo sapiens
ggccctgcactgtcct

SEQ ID NO: 2706314 - DNA, 17 bp, Homo sapiens
ggccctgcactgtcctg

SEQ ID NO: 2706315 - DNA, 18 bp, Homo sapiens
ggccctgcactgtcctgc

SEQ ID NO: 2706316 - DNA, 20 bp, Homo sapiens
ggccctgcactgtcctgctc

SEQ ID NO: 2706317 - DNA, 21 bp, Homo sapiens
ggccctgcactgtcctgctcc

SEQ ID NO: 2706318 - DNA, 22 bp, Homo sapiens
ggccctgcactgtcctgctcca

SEQ ID NO: 2706319 - DNA, 11 bp, Homo sapiens
ggccctgcccc

SEQ ID NO: 2706320 - DNA, 16 bp, Homo sapiens
ggccctgcccctccct

SEQ ID NO: 2706321 - DNA, 15 bp, Homo sapiens
ggccctggtccttcc

SEQ ID NO: 2706322 - DNA, 23 bp, Homo sapiens
ggcccttggtagagctggtgcca

SEQ ID NO: 2706323 - DNA, 17 bp, Homo sapiens
ggccggccaggtgggcg

SEQ ID NO: 2706324 - DNA, 15 bp, Homo sapiens
ggcctatcagtgtgc

SEQ ID NO: 2706325 - DNA, 18 bp, Homo sapiens
ggcctcagcctccaggca

SEQ ID NO: 2706326 - DNA, 11 bp, Homo sapiens
ggcctcccaca

SEQ ID NO: 2706327 - DNA, 20 bp, Homo sapiens
gggcactgctgggtggccca

SEQ ID NO: 2706328 - DNA, 22 bp, Homo sapiens
gggcactgctgggtggcccatc

SEQ ID NO: 2706329 - DNA, 15 bp, Homo sapiens
gggcagaatcctggg

SEQ ID NO: 2706330 - DNA, 22 bp, Homo sapiens
gggcagaatcctgggcccccag

SEQ ID NO: 2706331 - DNA, 13 bp, Homo sapiens
gggcagagccggg

SEQ ID NO: 2706332 - DNA, 13 bp, Homo sapiens
gggcagcacagca

SEQ ID NO: 2706333 - DNA, 14 bp, Homo sapiens
gggcagcacagcaa

SEQ ID NO: 2706334 - DNA, 17 bp, Homo sapiens
gggcaggccctgcactg

SEQ ID NO: 2706335 - DNA, 13 bp, Homo sapiens
gggcatctctgag

SEQ ID NO: 2706336 - DNA, 14 bp, Homo sapiens
gggcatgctggggc

SEQ ID NO: 2706337 - DNA, 17 bp, Homo sapiens
gggcatgctggggcaag

SEQ ID NO: 2706338 - DNA, 22 bp, Homo sapiens
gggcatggacgttcggggcatg

SEQ ID NO: 2706339 - DNA, 16 bp, Homo sapiens
gggccagggccctgca

SEQ ID NO: 2706340 - DNA, 14 bp, Homo sapiens
gggccatactggcc

SEQ ID NO: 2706341 - DNA, 23 bp, Homo sapiens
gggccatgggtcctcggcccatc

SEQ ID NO: 2706342 - DNA, 22 bp, Homo sapiens
gggccccaaacgggctgccctg

SEQ ID NO: 2706343 - DNA, 20 bp, Homo sapiens
gggcccccagagacctttgc

SEQ ID NO: 2706344 - DNA, 12 bp, Homo sapiens
gggcccctcagg

SEQ ID NO: 2706345 - DNA, 23 bp, Homo sapiens
gggcccgcttgcctcggctcctg

SEQ ID NO: 2706346 - DNA, 16 bp, Homo sapiens
gggcccgttgtctccc

SEQ ID NO: 2706347 - DNA, 20 bp, Homo sapiens
gggcccgttgtctccctggc

SEQ ID NO: 2706348 - DNA, 21 bp, Homo sapiens
gggcccgttgtctccctggcc

SEQ ID NO: 2706349 - DNA, 23 bp, Homo sapiens
gggcccgttgtctccctggccct

SEQ ID NO: 2706350 - DNA, 21 bp, Homo sapiens
gggccggccaggtgggcgggc

SEQ ID NO: 2706351 - DNA, 22 bp, Homo sapiens
gggcctatcagtgtgcccccca

SEQ ID NO: 2706352 - DNA, 16 bp, Homo sapiens
gggcctcagcctccag

SEQ ID NO: 2706353 - DNA, 16 bp, Homo sapiens
gggcctccaggactgg

SEQ ID NO: 2706354 - DNA, 15 bp, Homo sapiens
gggcctgacctccag

SEQ ID NO: 2706355 - DNA, 13 bp, Homo sapiens
gggcctgctctgc

SEQ ID NO: 2706356 - DNA, 21 bp, Homo sapiens
gggcctggccttgtccccagc

SEQ ID NO: 2706357 - DNA, 12 bp, Homo sapiens
gggcctgtgtgc

SEQ ID NO: 2706358 - DNA, 13 bp, Homo sapiens
gggcgaccagggc

SEQ ID NO: 2706359 - DNA, 15 bp, Homo sapiens
gggcgggcagcacag

SEQ ID NO: 2706360 - DNA, 14 bp, Homo sapiens
gggcgggggagcca

SEQ ID NO: 2706361 - DNA, 20 bp, Homo sapiens
gggcgtcgctggacaaccca

SEQ ID NO: 2706362 - DNA, 21 bp, Homo sapiens
gggcgtcgctggacaacccag

SEQ ID NO: 2706363 - DNA, 22 bp, Homo sapiens
gggcgtcgctggacaacccaga

SEQ ID NO: 2706364 - DNA, 20 bp, Homo sapiens
gggctaacatttaggagaag

SEQ ID NO: 2706365 - DNA, 13 bp, Homo sapiens
gggctccccttgc

SEQ ID NO: 2706366 - DNA, 19 bp, Homo sapiens
gggctccccttgcccttcc

SEQ ID NO: 2706367 - DNA, 20 bp, Homo sapiens
gggctccccttgcccttcct

SEQ ID NO: 2706368 - DNA, 21 bp, Homo sapiens
gggctccctcctggagcatcc

SEQ ID NO: 2706369 - DNA, 18 bp, Homo sapiens
gggctcgccccacccagg

SEQ ID NO: 2706370 - DNA, 19 bp, Homo sapiens
gggctctgccccagctctg

SEQ ID NO: 2706371 - DNA, 15 bp, Homo sapiens
gggctgagccctggc

SEQ ID NO: 2706372 - DNA, 18 bp, Homo sapiens
gggctgcactctgtgccc

SEQ ID NO: 2706373 - DNA, 14 bp, Homo sapiens
gggctgcccgctcc

SEQ ID NO: 2706374 - DNA, 11 bp, Homo sapiens
gggctgctggg

SEQ ID NO: 2706375 - DNA, 14 bp, Homo sapiens
gggctgctgggggc

SEQ ID NO: 2706376 - DNA, 16 bp, Homo sapiens
gggctgggttggcgca

SEQ ID NO: 2706377 - DNA, 21 bp, Homo sapiens
gggctgggttggcgcaccctc

SEQ ID NO: 2706378 - DNA, 22 bp, Homo sapiens
gggctggtgaggccggccctgc

SEQ ID NO: 2706379 - DNA, 22 bp, Homo sapiens
gggcttccctgggcctcagcct

SEQ ID NO: 2706380 - DNA, 21 bp, Homo sapiens
gggcttgtggactctctgcct

SEQ ID NO: 2706381 - DNA, 14 bp, Homo sapiens
gggctttctggaga

SEQ ID NO: 2706382 - DNA, 15 bp, Homo sapiens
gggctttctggagag

SEQ ID NO: 2706383 - DNA, 18 bp, Homo sapiens
ggggaagagcacagccct

SEQ ID NO: 2706384 - DNA, 12 bp, Homo sapiens
ggggaagatgaa

SEQ ID NO: 2706385 - DNA, 15 bp, Homo sapiens
ggggaaggactggcc

SEQ ID NO: 2706386 - DNA, 22 bp, Homo sapiens
ggggactgggccatgggtcctc

SEQ ID NO: 2706387 - DNA, 19 bp, Homo sapiens
ggggagaaggcctcccctg

SEQ ID NO: 2706388 - DNA, 18 bp, Homo sapiens
ggggagggctgcctgaaa

SEQ ID NO: 2706389 - DNA, 13 bp, Homo sapiens
ggggcaggcacag

SEQ ID NO: 2706390 - DNA, 15 bp, Homo sapiens
ggggcaggccctgca

SEQ ID NO: 2706391 - DNA, 18 bp, Homo sapiens
ggggcaggccctgcactg

SEQ ID NO: 2706392 - DNA, 23 bp, Homo sapiens
ggggcaggccctgcactgtcctg

SEQ ID NO: 2706393 - DNA, 15 bp, Homo sapiens
ggggcccgcttgcct

SEQ ID NO: 2706394 - DNA, 20 bp, Homo sapiens
ggggcccgcttgcctcggct

SEQ ID NO: 2706395 - DNA, 22 bp, Homo sapiens
ggggcccgttgtctccctggcc

SEQ ID NO: 2706396 - DNA, 23 bp, Homo sapiens
ggggcccgttgtctccctggccc

SEQ ID NO: 2706397 - DNA, 12 bp, Homo sapiens
ggggccctggtc

SEQ ID NO: 2706398 - DNA, 21 bp, Homo sapiens
ggggccctggtccttccaggc

SEQ ID NO: 2706399 - DNA, 13 bp, Homo sapiens
ggggctgcccgct

SEQ ID NO: 2706400 - DNA, 16 bp, Homo sapiens
ggggctgcccgctccc

SEQ ID NO: 2706401 - DNA, 21 bp, Homo sapiens
ggggctgctgggggctcccct

SEQ ID NO: 2706402 - DNA, 22 bp, Homo sapiens
ggggctgctgggggctcccctt

SEQ ID NO: 2706403 - DNA, 22 bp, Homo sapiens
ggggctgggttggcgcaccctc

SEQ ID NO: 2706404 - DNA, 21 bp, Homo sapiens
ggtctcgctgatgctgggctg

SEQ ID NO: 2706405 - DNA, 23 bp, Homo sapiens
ggtctcgctgatgctgggctggg

SEQ ID NO: 2706406 - DNA, 17 bp, Homo sapiens
ggtctctggattcctgt

SEQ ID NO: 2706407 - DNA, 16 bp, Homo sapiens
ggtctgctcgggccca

SEQ ID NO: 2706408 - DNA, 23 bp, Homo sapiens
ggtcttactttgtgcaaaagcag

SEQ ID NO: 2706409 - DNA, 17 bp, Homo sapiens
ggtcttgttcaagcagc

SEQ ID NO: 2706410 - DNA, 22 bp, Homo sapiens
ggtcttttacatacagtgatat

SEQ ID NO: 2706411 - DNA, 23 bp, Homo sapiens
ggtgacagtgacgtgactcagag

SEQ ID NO: 2706412 - DNA, 22 bp, Homo sapiens
ggtgacggactcagactcctgg

SEQ ID NO: 2706413 - DNA, 17 bp, Homo sapiens
ggtgagagtcaaagctg

SEQ ID NO: 2706414 - DNA, 14 bp, Homo sapiens
ggtgaggcccagcc

SEQ ID NO: 2706415 - DNA, 21 bp, Homo sapiens
ggtgcacagacctcagagatg

SEQ ID NO: 2706416 - DNA, 18 bp, Homo sapiens
ggtgcagttttccaggaa

SEQ ID NO: 2706417 - DNA, 22 bp, Homo sapiens
ggtgccaacagtgttaggcctg

SEQ ID NO: 2706418 - DNA, 21 bp, Homo sapiens
ggtgcctgattcggctgtctc

SEQ ID NO: 2706419 - DNA, 14 bp, Homo sapiens
ggtgcgaccccatc

SEQ ID NO: 2706420 - DNA, 16 bp, Homo sapiens
ggtgctgctaccctcc

SEQ ID NO: 2706421 - DNA, 17 bp, Homo sapiens
ggtgctgctaccctccc

SEQ ID NO: 2706422 - DNA, 20 bp, Homo sapiens
ggtgctgctaccctccctgc

SEQ ID NO: 2706423 - DNA, 23 bp, Homo sapiens
ggtgctgctaccctccctgctgt

SEQ ID NO: 2706424 - DNA, 17 bp, Homo sapiens
ggtggacagtcctggga

SEQ ID NO: 2706425 - DNA, 22 bp, Homo sapiens
ggtggatggtgacttttgaaga

SEQ ID NO: 2706426 - DNA, 14 bp, Homo sapiens
ggtggattgggcag

SEQ ID NO: 2706427 - DNA, 15 bp, Homo sapiens
ggtggcagccctgta

SEQ ID NO: 2706428 - DNA, 13 bp, Homo sapiens
ggtggcccatccc

SEQ ID NO: 2706429 - DNA, 22 bp, Homo sapiens
ggtggcccatcccccctcacca

SEQ ID NO: 2706430 - DNA, 23 bp, Homo sapiens
ggtggctctgggaatgggagagg

SEQ ID NO: 2706431 - DNA, 15 bp, Homo sapiens
ggtgggagagcccag

SEQ ID NO: 2706432 - DNA, 17 bp, Homo sapiens
ggtgggctgagccctgg

SEQ ID NO: 2706433 - DNA, 18 bp, Homo sapiens
ggtgggctgagccctggc

SEQ ID NO: 2706434 - DNA, 13 bp, Homo sapiens
ggtggtctgctcg

SEQ ID NO: 2706435 - DNA, 19 bp, Homo sapiens
ggtggtctgctcgggccca

SEQ ID NO: 2706436 - DNA, 23 bp, Homo sapiens
ggtgtcatttgacaacacatgtg

SEQ ID NO: 2706437 - DNA, 15 bp, Homo sapiens
ggtgtgtgtctctga

SEQ ID NO: 2706438 - DNA, 14 bp, Homo sapiens
ggttcaccttgccg

SEQ ID NO: 2706439 - DNA, 22 bp, Homo sapiens
ggttcaccttgccgagagaggc

SEQ ID NO: 2706440 - DNA, 19 bp, Homo sapiens
ggttgaggggctcctggaa

SEQ ID NO: 2706441 - DNA, 18 bp, Homo sapiens
ggttggcgcaccctcccc

SEQ ID NO: 2706442 - DNA, 21 bp, Homo sapiens
ggttgtcttgaaacctttcta

SEQ ID NO: 2706443 - DNA, 12 bp, Homo sapiens
ggttgtgatatt

SEQ ID NO: 2706444 - DNA, 16 bp, Homo sapiens
ggtttacaacaaacac

SEQ ID NO: 2706445 - DNA, 21 bp, Homo sapiens
ggtttgaaagtgaataaactt

SEQ ID NO: 2706446 - DNA, 14 bp, Homo sapiens
ggtttggcccctgg

SEQ ID NO: 2706447 - DNA, 21 bp, Homo sapiens
ggtttgggggcttccctgggc

SEQ ID NO: 2706448 - DNA, 21 bp, Homo sapiens
ggtttggtacagttcataatt

SEQ ID NO: 2706449 - DNA, 20 bp, Homo sapiens
ggttttagatttttaaaagg

SEQ ID NO: 2706450 - DNA, 20 bp, Homo sapiens
gtaaaacaaaaatgtaatga

SEQ ID NO: 2706451 - DNA, 15 bp, Homo sapiens
gtaaaggtaggtgca

SEQ ID NO: 2706452 - DNA, 22 bp, Homo sapiens
gtaaatactccattattttatt

SEQ ID NO: 2706453 - DNA, 16 bp, Homo sapiens
gtaaatgagacacata

SEQ ID NO: 2706454 - DNA, 13 bp, Homo sapiens
gtaactcccactc

SEQ ID NO: 2706455 - DNA, 18 bp, Homo sapiens
gtaagcagagttctttgc

SEQ ID NO: 2706456 - DNA, 23 bp, Homo sapiens
gtaagttgaatggcctgccttga

SEQ ID NO: 2706457 - DNA, 21 bp, Homo sapiens
gtaatatacaagcaagcaaaa

SEQ ID NO: 2706458 - DNA, 16 bp, Homo sapiens
gtaatatattgctgct

SEQ ID NO: 2706459 - DNA, 18 bp, Homo sapiens
gtaatatattgctgctgg

SEQ ID NO: 2706460 - DNA, 18 bp, Homo sapiens
gtaatattctctgatgtt

SEQ ID NO: 2706461 - DNA, 19 bp, Homo sapiens
gtaatattctctgatgttt

SEQ ID NO: 2706462 - DNA, 19 bp, Homo sapiens
gtaatatttcttcaagtga

SEQ ID NO: 2706463 - DNA, 23 bp, Homo sapiens
gtaatcccagctattcaggaggc

SEQ ID NO: 2706464 - DNA, 12 bp, Homo sapiens
gtaattattgtg

SEQ ID NO: 2706465 - DNA, 13 bp, Homo sapiens
gtaatttgtatct

SEQ ID NO: 2706466 - DNA, 15 bp, Homo sapiens
gtaatttgtatctga

SEQ ID NO: 2706467 - DNA, 16 bp, Homo sapiens
gtaatttttttttgta

SEQ ID NO: 2706468 - DNA, 19 bp, Homo sapiens
gtaatttttttttgtaaag

SEQ ID NO: 2706469 - DNA, 16 bp, Homo sapiens
gtacaaagatatgcta

SEQ ID NO: 2706470 - DNA, 12 bp, Homo sapiens
gtacagcagggt

SEQ ID NO: 2706471 - DNA, 22 bp, Homo sapiens
gtacagttcagttcctctttgc

SEQ ID NO: 2706472 - DNA, 23 bp, Homo sapiens
gtacagttcagttcctctttgca

SEQ ID NO: 2706473 - DNA, 16 bp, Homo sapiens
gtaccaagccaccgca

SEQ ID NO: 2706474 - DNA, 19 bp, Homo sapiens
gtaccaagccaccgcagct

SEQ ID NO: 2706475 - DNA, 22 bp, Homo sapiens
gtaccaagccaccgcagctgct

SEQ ID NO: 2706476 - DNA, 18 bp, Homo sapiens
gtaccacaccctgcctgc

SEQ ID NO: 2706477 - DNA, 19 bp, Homo sapiens
gtaccacaccctgcctgct

SEQ ID NO: 2706478 - DNA, 14 bp, Homo sapiens
gtaccactcaggcc

SEQ ID NO: 2706479 - DNA, 14 bp, Homo sapiens
gtaccagcctgact

SEQ ID NO: 2706480 - DNA, 17 bp, Homo sapiens
gtaccaggcacatggct

SEQ ID NO: 2706481 - DNA, 19 bp, Homo sapiens
gtaccaggtctcctccacc

SEQ ID NO: 2706482 - DNA, 22 bp, Homo sapiens
gtaccaggtctcctccaccgcc

SEQ ID NO: 2706483 - DNA, 18 bp, Homo sapiens
gtaccatattgctcttaa

SEQ ID NO: 2706484 - DNA, 21 bp, Homo sapiens
gtaccatgctggcggcgcaga

SEQ ID NO: 2706485 - DNA, 20 bp, Homo sapiens
gtacccccgcccaggctggc

SEQ ID NO: 2706486 - DNA, 14 bp, Homo sapiens
gtactaaggagaat

SEQ ID NO: 2706487 - DNA, 18 bp, Homo sapiens
gtactatctttgtctaaa

SEQ ID NO: 2706488 - DNA, 17 bp, Homo sapiens
gtactcaggaggctgag

SEQ ID NO: 2706489 - DNA, 16 bp, Homo sapiens
gtactgaaggcttctg

SEQ ID NO: 2706490 - DNA, 21 bp, Homo sapiens
gtactgaaggcttctgcagct

SEQ ID NO: 2706491 - DNA, 14 bp, Homo sapiens
gtacttcagtcttg

SEQ ID NO: 2706492 - DNA, 13 bp, Homo sapiens
gtactttttgttt

SEQ ID NO: 2706493 - DNA, 14 bp, Homo sapiens
gtagaacctcacct

SEQ ID NO: 2706494 - DNA, 12 bp, Homo sapiens
gtagaactctgc

SEQ ID NO: 2706495 - DNA, 13 bp, Homo sapiens
gtagactgtgaca

SEQ ID NO: 2706496 - DNA, 13 bp, Homo sapiens
gtagcatatataa

SEQ ID NO: 2706497 - DNA, 19 bp, Homo sapiens
gtagccaaggtgggctgag

SEQ ID NO: 2706498 - DNA, 18 bp, Homo sapiens
gtagccccgggctgaccc

SEQ ID NO: 2706499 - DNA, 20 bp, Homo sapiens
gtagccccgggctgacccag

SEQ ID NO: 2706500 - DNA, 15 bp, Homo sapiens
gtagcgagctgctct

SEQ ID NO: 2706501 - DNA, 16 bp, Homo sapiens
gtagtcacctctgggc

SEQ ID NO: 2706502 - DNA, 21 bp, Homo sapiens
gtagtgtcttcctagtatatt

SEQ ID NO: 2706503 - DNA, 16 bp, Homo sapiens
gtataagctgtctgaa

SEQ ID NO: 2706504 - DNA, 13 bp, Homo sapiens
gtataatatgcaa

SEQ ID NO: 2706505 - DNA, 11 bp, Homo sapiens
gtatacaaaca

SEQ ID NO: 2706506 - DNA, 14 bp, Homo sapiens
gtatataacttatt

SEQ ID NO: 2706507 - DNA, 15 bp, Homo sapiens
gtatataacttattt

SEQ ID NO: 2706508 - DNA, 18 bp, Homo sapiens
gtatatctatatctctaa

SEQ ID NO: 2706509 - DNA, 18 bp, Homo sapiens
gtatctattgtgttggct

SEQ ID NO: 2706510 - DNA, 20 bp, Homo sapiens
gtatctcggacctttcagct

SEQ ID NO: 2706511 - DNA, 14 bp, Homo sapiens
gtatctgaaggaga

SEQ ID NO: 2706512 - DNA, 18 bp, Homo sapiens
gtatctgggctgattttt

SEQ ID NO: 2706513 - DNA, 20 bp, Homo sapiens
gtatgcaagtgggagatgaa

SEQ ID NO: 2706514 - DNA, 18 bp, Homo sapiens
gtatgccttcctgtttaa

SEQ ID NO: 2706515 - DNA, 15 bp, Homo sapiens
gtatgtacagttcat

SEQ ID NO: 2706516 - DNA, 22 bp, Homo sapiens
gtatgtacagttcataaatttg

SEQ ID NO: 2706517 - DNA, 15 bp, Homo sapiens
gtatgtggatacagt

SEQ ID NO: 2706518 - DNA, 21 bp, Homo sapiens
gtatgtggatacagtcattat

SEQ ID NO: 2706519 - DNA, 15 bp, Homo sapiens
gtattagccagtcat

SEQ ID NO: 2706520 - DNA, 20 bp, Homo sapiens
gtatttaatgatttttgtgt

SEQ ID NO: 2706521 - DNA, 17 bp, Homo sapiens
gtattttgatcagtgtt

SEQ ID NO: 2706522 - DNA, 14 bp, Homo sapiens
gtcaacactcttct

SEQ ID NO: 2706523 - DNA, 16 bp, Homo sapiens
gtcaataactctgatt

SEQ ID NO: 2706524 - DNA, 20 bp, Homo sapiens
tagtttgatttaatatctga

SEQ ID NO: 2706525 - DNA, 19 bp, Homo sapiens
tagttttaaaactctttat

SEQ ID NO: 2706526 - DNA, 13 bp, Homo sapiens
tataaaaaatggt

SEQ ID NO: 2706527 - DNA, 19 bp, Homo sapiens
tataaacctctaatttatt

SEQ ID NO: 2706528 - DNA, 16 bp, Homo sapiens
tataaattatgaagga

SEQ ID NO: 2706529 - DNA, 17 bp, Homo sapiens
tataaggatcttttgta

SEQ ID NO: 2706530 - DNA, 19 bp, Homo sapiens
tataaggatcttttgtaaa

SEQ ID NO: 2706531 - DNA, 20 bp, Homo sapiens
tataataaatgaggaaacat

SEQ ID NO: 2706532 - DNA, 21 bp, Homo sapiens
tataatttagtcccttaaaaa

SEQ ID NO: 2706533 - DNA, 16 bp, Homo sapiens
tatacaaacaggtgct

SEQ ID NO: 2706534 - DNA, 18 bp, Homo sapiens
tatacagattcctgttgt

SEQ ID NO: 2706535 - DNA, 15 bp, Homo sapiens
tatacataaacagtt

SEQ ID NO: 2706536 - DNA, 13 bp, Homo sapiens
tatagctagctat

SEQ ID NO: 2706537 - DNA, 19 bp, Homo sapiens
tatagctagctatttctat

SEQ ID NO: 2706538 - DNA, 21 bp, Homo sapiens
tatagctctacacaacatgta

SEQ ID NO: 2706539 - DNA, 13 bp, Homo sapiens
tataggataaatt

SEQ ID NO: 2706540 - DNA, 14 bp, Homo sapiens
tataggataaatta

SEQ ID NO: 2706541 - DNA, 11 bp, Homo sapiens
tatagtcaata

SEQ ID NO: 2706542 - DNA, 22 bp, Homo sapiens
tatagtctcaaatcaaatacat

SEQ ID NO: 2706543 - DNA, 20 bp, Homo sapiens
tatagttgtctttctttgct

SEQ ID NO: 2706544 - DNA, 22 bp, Homo sapiens
tatagttgtctttctttgctgc

SEQ ID NO: 2706545 - DNA, 13 bp, Homo sapiens
tatagttttgaca

SEQ ID NO: 2706546 - DNA, 14 bp, Homo sapiens
tatatatataaaca

SEQ ID NO: 2706547 - DNA, 20 bp, Homo sapiens
tatatatttatcatatttaa

SEQ ID NO: 2706548 - DNA, 13 bp, Homo sapiens
tatatcataaagt

SEQ ID NO: 2706549 - DNA, 18 bp, Homo sapiens
tatatctatatctctaaa

SEQ ID NO: 2706550 - DNA, 15 bp, Homo sapiens
tatatctttatgcaa

SEQ ID NO: 2706551 - DNA, 13 bp, Homo sapiens
tatatgtatatct

SEQ ID NO: 2706552 - DNA, 14 bp, Homo sapiens
tatatgtatatcta

SEQ ID NO: 2706553 - DNA, 14 bp, Homo sapiens
tatatgtatgtagt

SEQ ID NO: 2706554 - DNA, 18 bp, Homo sapiens
tatcaaaaagtataaatt

SEQ ID NO: 2706555 - DNA, 17 bp, Homo sapiens
tatcagtgtgcccccca

SEQ ID NO: 2706556 - DNA, 14 bp, Homo sapiens
tatcataaagtatg

SEQ ID NO: 2706557 - DNA, 13 bp, Homo sapiens
tatcatatttaat

SEQ ID NO: 2706558 - DNA, 16 bp, Homo sapiens
tatccacaaatgctat

SEQ ID NO: 2706559 - DNA, 19 bp, Homo sapiens
tatccattgtggaaactgg

SEQ ID NO: 2706560 - DNA, 18 bp, Homo sapiens
tatccttggagagcagct

SEQ ID NO: 2706561 - DNA, 16 bp, Homo sapiens
tatctacccagaatta

SEQ ID NO: 2706562 - DNA, 13 bp, Homo sapiens
tatctagtcaata

SEQ ID NO: 2706563 - DNA, 14 bp, Homo sapiens
tatctatatctcta

SEQ ID NO: 2706564 - DNA, 17 bp, Homo sapiens
tatctatatctctaaac

SEQ ID NO: 2706565 - DNA, 23 bp, Homo sapiens
tatctatatctctaaactgctgt

SEQ ID NO: 2706566 - DNA, 10 bp, Homo sapiens
tatctcctgg

SEQ ID NO: 2706567 - DNA, 16 bp, Homo sapiens
tatctctaaactgctg

SEQ ID NO: 2706568 - DNA, 18 bp, Homo sapiens
tatctgagaagtgtatat

SEQ ID NO: 2706569 - DNA, 19 bp, Homo sapiens
tatctggccacactgggct

SEQ ID NO: 2706570 - DNA, 16 bp, Homo sapiens
tatctggtatctgcat

SEQ ID NO: 2706571 - DNA, 17 bp, Homo sapiens
tatctgtttgcttctaa

SEQ ID NO: 2706572 - DNA, 13 bp, Homo sapiens
tatcttcatgttt

SEQ ID NO: 2706573 - DNA, 15 bp, Homo sapiens
tatctttatgcaaaa

SEQ ID NO: 2706574 - DNA, 18 bp, Homo sapiens
tatctttatgcaaaaaca

SEQ ID NO: 2706575 - DNA, 20 bp, Homo sapiens
tatgacagtgaattttgcac

SEQ ID NO: 2706576 - DNA, 14 bp, Homo sapiens
tatgagaacatggt

SEQ ID NO: 2706577 - DNA, 18 bp, Homo sapiens
tatgagaagtactttgtg

SEQ ID NO: 2706578 - DNA, 21 bp, Homo sapiens
tatgagaagtactttgtgctg

SEQ ID NO: 2706579 - DNA, 15 bp, Homo sapiens
tatgagactgtgttt

SEQ ID NO: 2706580 - DNA, 15 bp, Homo sapiens
tatgatcccagcact

SEQ ID NO: 2706581 - DNA, 15 bp, Homo sapiens
tatgatcgcgccact

SEQ ID NO: 2706582 - DNA, 15 bp, Homo sapiens
tatgattgcactaaa

SEQ ID NO: 2706583 - DNA, 12 bp, Homo sapiens
tatgatttttaa

SEQ ID NO: 2706584 - DNA, 14 bp, Homo sapiens
tatgcaaaaacata

SEQ ID NO: 2706585 - DNA, 21 bp, Homo sapiens
tatgcaaaaacatatgtctgt

SEQ ID NO: 2706586 - DNA, 22 bp, Homo sapiens
tatgcaaaaacatatgtctgtc

SEQ ID NO: 2706587 - DNA, 19 bp, Homo sapiens
tatgcaaggggaaacctgt

SEQ ID NO: 2706588 - DNA, 15 bp, Homo sapiens
tatgcacgttaacag

SEQ ID NO: 2706589 - DNA, 16 bp, Homo sapiens
tatgcctctgtattta

SEQ ID NO: 2706590 - DNA, 17 bp, Homo sapiens
tatgccttcctgtttaa

SEQ ID NO: 2706591 - DNA, 14 bp, Homo sapiens
tatgccttgctatt

SEQ ID NO: 2706592 - DNA, 17 bp, Homo sapiens
tatggcccagccactgc

SEQ ID NO: 2706593 - DNA, 20 bp, Homo sapiens
tatggcccagccactgcagc

SEQ ID NO: 2706594 - DNA, 13 bp, Homo sapiens
tatgggaagccat

SEQ ID NO: 2706595 - DNA, 16 bp, Homo sapiens
tatgtaatgcttatgt

SEQ ID NO: 2706596 - DNA, 23 bp, Homo sapiens
tatgtataaattatgaaggacct

SEQ ID NO: 2706597 - DNA, 18 bp, Homo sapiens
tatgtatatgtatatcta

SEQ ID NO: 2706598 - DNA, 13 bp, Homo sapiens
tatgtatctttgg

SEQ ID NO: 2706599 - DNA, 21 bp, Homo sapiens
tatgtatctttggggaaacta

SEQ ID NO: 2706600 - DNA, 19 bp, Homo sapiens
tatgtatgtgccaattttg

SEQ ID NO: 2706601 - DNA, 16 bp, Homo sapiens
tatgtctaaagagctt

SEQ ID NO: 2706602 - DNA, 13 bp, Homo sapiens
tatgtctgtcttt

SEQ ID NO: 2706603 - DNA, 22 bp, Homo sapiens
tatgtgacaacatttttgtaca

SEQ ID NO: 2706604 - DNA, 15 bp, Homo sapiens
tatgtggatacagtc

SEQ ID NO: 2706605 - DNA, 18 bp, Homo sapiens
tatgtggatacagtcatt

SEQ ID NO: 2706606 - DNA, 18 bp, Homo sapiens
tatgtgggaaaaaagaaa

SEQ ID NO: 2706607 - DNA, 12 bp, Homo sapiens
tatgttacttaa

SEQ ID NO: 2706608 - DNA, 15 bp, Homo sapiens
tatgttacttaaaca

SEQ ID NO: 2706609 - DNA, 20 bp, Homo sapiens
tatgttattggaattttctt

SEQ ID NO: 2706610 - DNA, 21 bp, Homo sapiens
tattaaaaaaacacaaaaaaa

SEQ ID NO: 2706611 - DNA, 16 bp, Homo sapiens
tattaacaaagttact

SEQ ID NO: 2706612 - DNA, 15 bp, Homo sapiens
tattagcaactgtgc

SEQ ID NO: 2706613 - DNA, 21 bp, Homo sapiens
tattagtttgatttaatatct

SEQ ID NO: 2706614 - DNA, 14 bp, Homo sapiens
tattcagagaaaac

SEQ ID NO: 2706615 - DNA, 15 bp, Homo sapiens
tattcagtgctgtgg

SEQ ID NO: 2706616 - DNA, 18 bp, Homo sapiens
tattcagtgctgtggcct

SEQ ID NO: 2706617 - DNA, 22 bp, Homo sapiens
tattcagtgctgtggcctgggc

SEQ ID NO: 2706618 - DNA, 18 bp, Homo sapiens
tattcatcaaataaacct

SEQ ID NO: 2706619 - DNA, 14 bp, Homo sapiens
tattctgattccac

SEQ ID NO: 2706620 - DNA, 12 bp, Homo sapiens
tattcttttgtt

SEQ ID NO: 2706621 - DNA, 20 bp, Homo sapiens
tattcttttgttattaaaaa

SEQ ID NO: 2706622 - DNA, 16 bp, Homo sapiens
tattgctcttaaaaat

SEQ ID NO: 2706623 - DNA, 19 bp, Homo sapiens
tattgtgttggctttacaa

SEQ ID NO: 2706624 - DNA, 20 bp, Homo sapiens
tattgtgttggctttacaaa

SEQ ID NO: 2706625 - DNA, 14 bp, Homo sapiens
tatttaaaagacaa

SEQ ID NO: 2706626 - DNA, 17 bp, Homo sapiens
tatttaaaagacaaaca

SEQ ID NO: 2706627 - DNA, 18 bp, Homo sapiens
tatttaaaagacaaacac

SEQ ID NO: 2706628 - DNA, 21 bp, Homo sapiens
tatttaaacctgcccttgttt

SEQ ID NO: 2706629 - DNA, 21 bp, Homo sapiens
tatttaacttgagggtaataa

SEQ ID NO: 2706630 - DNA, 18 bp, Homo sapiens
tatttaatgatttttgtg

SEQ ID NO: 2706631 - DNA, 13 bp, Homo sapiens
tatttagaatata

SEQ ID NO: 2706632 - DNA, 20 bp, Homo sapiens
tatttagaatatattaaatc

SEQ ID NO: 2706633 - DNA, 18 bp, Homo sapiens
tatttatattcatcaaat

SEQ ID NO: 2706634 - DNA, 20 bp, Homo sapiens
tatttatgcctctgtattta

SEQ ID NO: 2706635 - DNA, 22 bp, Homo sapiens
tatttattgtatatatggatat

SEQ ID NO: 2706636 - DNA, 14 bp, Homo sapiens
tatttatttatgta

SEQ ID NO: 2706637 - DNA, 19 bp, Homo sapiens
tatttattttaatgtattt

SEQ ID NO: 2706638 - DNA, 17 bp, Homo sapiens
tatttcttcaagtgagt

SEQ ID NO: 2706639 - DNA, 21 bp, Homo sapiens
tatttctttaatctgttgttt

SEQ ID NO: 2706640 - DNA, 18 bp, Homo sapiens
tatttgataacattttgt

SEQ ID NO: 2706641 - DNA, 11 bp, Homo sapiens
tattttacagt

SEQ ID NO: 2706642 - DNA, 18 bp, Homo sapiens
tattttaggcagggattt

SEQ ID NO: 2706643 - DNA, 22 bp, Homo sapiens
tattttaggcagggatttgagg

SEQ ID NO: 2706644 - DNA, 23 bp, Homo sapiens
tattttatagtctcaaatcaaat

SEQ ID NO: 2706645 - DNA, 22 bp, Homo sapiens
tattttcacagatggaagaagt

SEQ ID NO: 2706646 - DNA, 14 bp, Homo sapiens
tattttcatttcta

SEQ ID NO: 2706647 - DNA, 23 bp, Homo sapiens
tattttgctggagactatttaag

SEQ ID NO: 2706648 - DNA, 16 bp, Homo sapiens
tattttgtaattattg

SEQ ID NO: 2706649 - DNA, 12 bp, Homo sapiens
tatttttgaaag

SEQ ID NO: 2706650 - DNA, 22 bp, Homo sapiens
tatttttgtaccatattgctct

SEQ ID NO: 2706651 - DNA, 23 bp, Homo sapiens
tcaaaaaaaaacaaaaaaaatca

SEQ ID NO: 2706652 - DNA, 17 bp, Homo sapiens
tcaaaacttctgctttt

SEQ ID NO: 2706653 - DNA, 12 bp, Homo sapiens
tcaaaagcaaac

SEQ ID NO: 2706654 - DNA, 16 bp, Homo sapiens
tcaaaatgtccagctt

SEQ ID NO: 2706655 - DNA, 18 bp, Homo sapiens
tcaaaattactggacata

SEQ ID NO: 2706656 - DNA, 22 bp, Homo sapiens
tcaaacagggacactacaaaca

SEQ ID NO: 2706657 - DNA, 15 bp, Homo sapiens
tcaaacatgaaaaca

SEQ ID NO: 2706658 - DNA, 19 bp, Homo sapiens
tcaaagcggatgctggcca

SEQ ID NO: 2706659 - DNA, 20 bp, Homo sapiens
tcaaagcggatgctggccac

SEQ ID NO: 2706660 - DNA, 13 bp, Homo sapiens
tcaaataaacctt

SEQ ID NO: 2706661 - DNA, 16 bp, Homo sapiens
tcaaatagcaaggcca

SEQ ID NO: 2706662 - DNA, 19 bp, Homo sapiens
tcaaatagcaaggccaggg

SEQ ID NO: 2706663 - DNA, 22 bp, Homo sapiens
tcaaatttttctgggaagaaaa

SEQ ID NO: 2706664 - DNA, 16 bp, Homo sapiens
tcaacactcttcttga

SEQ ID NO: 2706665 - DNA, 21 bp, Homo sapiens
tcaacactcttcttgagcaga

SEQ ID NO: 2706666 - DNA, 16 bp, Homo sapiens
tcaacagtgaacagct

SEQ ID NO: 2706667 - DNA, 15 bp, Homo sapiens
tcaacctgtgtctta

SEQ ID NO: 2706668 - DNA, 13 bp, Homo sapiens
tcaacttttctga

SEQ ID NO: 2706669 - DNA, 22 bp, Homo sapiens
tcaagaaaagcatgaaaactga

SEQ ID NO: 2706670 - DNA, 21 bp, Homo sapiens
tcaagagtctctccagcctca

SEQ ID NO: 2706671 - DNA, 18 bp, Homo sapiens
tcaagcatgtttaaaaca

SEQ ID NO: 2706672 - DNA, 14 bp, Homo sapiens
tcaagccaaaaaag

SEQ ID NO: 2706673 - DNA, 15 bp, Homo sapiens
tcaaggcctcccaca

SEQ ID NO: 2706674 - DNA, 16 bp, Homo sapiens
tcaaggcctcccacag

SEQ ID NO: 2706675 - DNA, 19 bp, Homo sapiens
tcaaggcctcccacagtga

SEQ ID NO: 2706676 - DNA, 14 bp, Homo sapiens
tcaagtctgtgaaa

SEQ ID NO: 2706677 - DNA, 13 bp, Homo sapiens
tcaagtgagtggc

SEQ ID NO: 2706678 - DNA, 16 bp, Homo sapiens
tcaagtgagtggcatg

SEQ ID NO: 2706679 - DNA, 23 bp, Homo sapiens
tcaagttccctcctgcagcctga

SEQ ID NO: 2706680 - DNA, 15 bp, Homo sapiens
tcaataactctgatt

SEQ ID NO: 2706681 - DNA, 18 bp, Homo sapiens
tcaatatggggcattaat

SEQ ID NO: 2706682 - DNA, 23 bp, Homo sapiens
tcaatatggggcattaatattct

SEQ ID NO: 2706683 - DNA, 15 bp, Homo sapiens
tcaatcactgctccc

SEQ ID NO: 2706684 - DNA, 16 bp, Homo sapiens
tcaatctgtttttcat

SEQ ID NO: 2706685 - DNA, 18 bp, Homo sapiens
tcaatgtggtgatgaaat

SEQ ID NO: 2706686 - DNA, 13 bp, Homo sapiens
tcaattcattgtg

SEQ ID NO: 2706687 - DNA, 17 bp, Homo sapiens
tcaattcctgggcccca

SEQ ID NO: 2706688 - DNA, 14 bp, Homo sapiens
tcaattttgtattt

SEQ ID NO: 2706689 - DNA, 15 bp, Homo sapiens
tcaattttttaaacc

SEQ ID NO: 2706690 - DNA, 21 bp, Homo sapiens
tcaattttttaaaccactaat

SEQ ID NO: 2706691 - DNA, 14 bp, Homo sapiens
tcacaaacatatgt

SEQ ID NO: 2706692 - DNA, 19 bp, Homo sapiens
tcacacctcacgctctgga

SEQ ID NO: 2706693 - DNA, 20 bp, Homo sapiens
tcacactacttgagaaaatg

SEQ ID NO: 2706694 - DNA, 12 bp, Homo sapiens
tcacactccaga

SEQ ID NO: 2706695 - DNA, 24 bp, Homo sapiens
tcacactccagaattacccttcct

SEQ ID NO: 2706696 - DNA, 11 bp, Homo sapiens
tcacactccta

SEQ ID NO: 2706697 - DNA, 13 bp, Homo sapiens
tcacactcctcct

SEQ ID NO: 2706698 - DNA, 15 bp, Homo sapiens
tcacactcctcctgc

SEQ ID NO: 2706699 - DNA, 16 bp, Homo sapiens
tcacactcctcctgcc

SEQ ID NO: 2706700 - DNA, 15 bp, Homo sapiens
tcacagactcttcca

SEQ ID NO: 2706701 - DNA, 16 bp, Homo sapiens
tcacagatgctggcct

SEQ ID NO: 2706702 - DNA, 19 bp, Homo sapiens
tcacagatgctggcctctt

SEQ ID NO: 2706703 - DNA, 23 bp, Homo sapiens
tcacagatgctggcctcttggca

SEQ ID NO: 2706704 - DNA, 14 bp, Homo sapiens
tcacagcctctccc

SEQ ID NO: 2706705 - DNA, 15 bp, Homo sapiens
tcacagcgcctcctg

SEQ ID NO: 2706706 - DNA, 16 bp, Homo sapiens
tcacagcgcctcctgg

SEQ ID NO: 2706707 - DNA, 16 bp, Homo sapiens
tcacaggactctgcag

SEQ ID NO: 2706708 - DNA, 18 bp, Homo sapiens
tcacagggcagagccggg

SEQ ID NO: 2706709 - DNA, 19 bp, Homo sapiens
tcacagggcagagccggga

SEQ ID NO: 2706710 - DNA, 19 bp, Homo sapiens
tcacattttgcctttctcg

SEQ ID NO: 2706711 - DNA, 17 bp, Homo sapiens
tcaccacattctgtctc

SEQ ID NO: 2706712 - DNA, 18 bp, Homo sapiens
tcaccacctcatgtcatt

SEQ ID NO: 2706713 - DNA, 21 bp, Homo sapiens
tcaccacctcatgtcatttct

SEQ ID NO: 2706714 - DNA, 21 bp, Homo sapiens
tcaccaggggcaggcacagca

SEQ ID NO: 2706715 - DNA, 11 bp, Homo sapiens
tcaccatgcaa

SEQ ID NO: 2706716 - DNA, 17 bp, Homo sapiens
tcacccctctgtccagc

SEQ ID NO: 2706717 - DNA, 12 bp, Homo sapiens
tcaccctgcaga

SEQ ID NO: 2706718 - DNA, 23 bp, Homo sapiens
tcaccctgcagagctatggtgag

SEQ ID NO: 2706719 - DNA, 16 bp, Homo sapiens
tcaccctggccaccac

SEQ ID NO: 2706720 - DNA, 23 bp, Homo sapiens
tcaccctggccaccacccaacct

SEQ ID NO: 2706721 - DNA, 19 bp, Homo sapiens
tcacctcctctgtgatttc

SEQ ID NO: 2706722 - DNA, 23 bp, Homo sapiens
tcacctgttactgaaagtggttt

SEQ ID NO: 2706723 - DNA, 17 bp, Homo sapiens
tcaccttcctagttctt

SEQ ID NO: 2706724 - DNA, 13 bp, Homo sapiens
tcacgactcttcc

SEQ ID NO: 2706725 - DNA, 14 bp, Homo sapiens
tcacgccactgcac

SEQ ID NO: 2706726 - DNA, 22 bp, Homo sapiens
tcacgccactgcactccagcct

SEQ ID NO: 2706727 - DNA, 15 bp, Homo sapiens
tcacgctctggacat

SEQ ID NO: 2706728 - DNA, 16 bp, Homo sapiens
tcacgctctggacatg

SEQ ID NO: 2706729 - DNA, 17 bp, Homo sapiens
tcacgtgaccagccccg

SEQ ID NO: 2706730 - DNA, 19 bp, Homo sapiens
tcactccggtgtgcctgca

SEQ ID NO: 2706731 - DNA, 18 bp, Homo sapiens
tcactgaagtgattgaaa

SEQ ID NO: 2706732 - DNA, 13 bp, Homo sapiens
tcactgagactag

SEQ ID NO: 2706733 - DNA, 13 bp, Homo sapiens
tcactgcagcctt

SEQ ID NO: 2706734 - DNA, 14 bp, Homo sapiens
tcactgcagccttt

SEQ ID NO: 2706735 - DNA, 17 bp, Homo sapiens
tcactgctcccccgtgt

SEQ ID NO: 2706736 - DNA, 13 bp, Homo sapiens
tcactgctctgcc

SEQ ID NO: 2706737 - DNA, 21 bp, Homo sapiens
tcactggctgcctccactccc

SEQ ID NO: 2706738 - DNA, 23 bp, Homo sapiens
tcacttaaaatcaaatttttctg

SEQ ID NO: 2706739 - DNA, 22 bp, Homo sapiens
tcacttgtcctcagtttttcct

SEQ ID NO: 2706740 - DNA, 22 bp, Homo sapiens
tcagaaactcgatgaatgtgtt

SEQ ID NO: 2706741 - DNA, 20 bp, Homo sapiens
tcagaagcctgaggctggga

SEQ ID NO: 2706742 - DNA, 22 bp, Homo sapiens
tcagaagtaactcccactccta

SEQ ID NO: 2706743 - DNA, 17 bp, Homo sapiens
tcagaattgtttttaga

SEQ ID NO: 2706744 - DNA, 12 bp, Homo sapiens
tcagactcctgg

SEQ ID NO: 2706745 - DNA, 14 bp, Homo sapiens
tcagactcctggct

SEQ ID NO: 2706746 - DNA, 20 bp, Homo sapiens
tcagactcctggcttcatgt

SEQ ID NO: 2706747 - DNA, 15 bp, Homo sapiens
tcagactgctgggac

SEQ ID NO: 2706748 - DNA, 16 bp, Homo sapiens
tcagactgctgggact

SEQ ID NO: 2706749 - DNA, 20 bp, Homo sapiens
tcagactggctggctgcagt

SEQ ID NO: 2706750 - DNA, 21 bp, Homo sapiens
tcagacttagtttttataaaa

SEQ ID NO: 2706751 - DNA, 20 bp, Homo sapiens
tcagagaaattatgttttca

SEQ ID NO: 2706752 - DNA, 16 bp, Homo sapiens
tcagagcagcactggg

SEQ ID NO: 2706753 - DNA, 17 bp, Homo sapiens
tcagagctgcgggctga

SEQ ID NO: 2706754 - DNA, 22 bp, Homo sapiens
tcagagctggcagcctccagtg

SEQ ID NO: 2706755 - DNA, 17 bp, Homo sapiens
tcagataggattttctc

SEQ ID NO: 2706756 - DNA, 17 bp, Homo sapiens
tcagatcctgggcatga

SEQ ID NO: 2706757 - DNA, 16 bp, Homo sapiens
tcagattgtaaaggta

SEQ ID NO: 2706758 - DNA, 14 bp, Homo sapiens
tcagatttgtataa

SEQ ID NO: 2706759 - DNA, 15 bp, Homo sapiens
tcagcagccagctcc

SEQ ID NO: 2706760 - DNA, 14 bp, Homo sapiens
tcagcagccccctg

SEQ ID NO: 2706761 - DNA, 17 bp, Homo sapiens
tcagcagccccctgccc

SEQ ID NO: 2706762 - DNA, 23 bp, Homo sapiens
tcagcatcaaacatgaaaacatt

SEQ ID NO: 2706763 - DNA, 14 bp, Homo sapiens
tcagccagccctgg

SEQ ID NO: 2706764 - DNA, 15 bp, Homo sapiens
tcagccagccctgga

SEQ ID NO: 2706765 - DNA, 23 bp, Homo sapiens
tcagccccttaatctattttcag

SEQ ID NO: 2706766 - DNA, 14 bp, Homo sapiens
tcagcctcctgagt

SEQ ID NO: 2706767 - DNA, 20 bp, Homo sapiens
tcagcctcctgagtagctgg

SEQ ID NO: 2706768 - DNA, 21 bp, Homo sapiens
tcagcctcctgagtagctggg

SEQ ID NO: 2706769 - DNA, 12 bp, Homo sapiens
gccagccctgga

SEQ ID NO: 2706770 - DNA, 16 bp, Homo sapiens
gccagccctggaggct

SEQ ID NO: 2706771 - DNA, 19 bp, Homo sapiens
gccagccctggaggctgga

SEQ ID NO: 2706772 - DNA, 19 bp, Homo sapiens
gccagccgagcgagaacca

SEQ ID NO: 2706773 - DNA, 17 bp, Homo sapiens
gccagcctggcttctgg

SEQ ID NO: 2706774 - DNA, 22 bp, Homo sapiens
gccagcctggcttctggagccc

SEQ ID NO: 2706775 - DNA, 18 bp, Homo sapiens
gccaggattggcacaagc

SEQ ID NO: 2706776 - DNA, 16 bp, Homo sapiens
gccagggccctgcaga

SEQ ID NO: 2706777 - DNA, 23 bp, Homo sapiens
gccagggcttgtggactctctgc

SEQ ID NO: 2706778 - DNA, 14 bp, Homo sapiens
gccaggtgcagtgg

SEQ ID NO: 2706779 - DNA, 15 bp, Homo sapiens
gccagtcctagagct

SEQ ID NO: 2706780 - DNA, 18 bp, Homo sapiens
gccagtcctagagctcct

SEQ ID NO: 2706781 - DNA, 17 bp, Homo sapiens
gccagtcgcgctgcctg

SEQ ID NO: 2706782 - DNA, 18 bp, Homo sapiens
gccatactggcctcgcct

SEQ ID NO: 2706783 - DNA, 19 bp, Homo sapiens
gccatactggcctcgcctg

SEQ ID NO: 2706784 - DNA, 20 bp, Homo sapiens
gccatactggcctcgcctgg

SEQ ID NO: 2706785 - DNA, 21 bp, Homo sapiens
gccatactggcctcgcctggc

SEQ ID NO: 2706786 - DNA, 22 bp, Homo sapiens
gccatactggcctcgcctggcc

SEQ ID NO: 2706787 - DNA, 23 bp, Homo sapiens
gccatactggcctcgcctggcct

SEQ ID NO: 2706788 - DNA, 18 bp, Homo sapiens
gccatattctaaattcac

SEQ ID NO: 2706789 - DNA, 18 bp, Homo sapiens
gccatccctttttttaca

SEQ ID NO: 2706790 - DNA, 23 bp, Homo sapiens
gccatccctttttttacatttca

SEQ ID NO: 2706791 - DNA, 17 bp, Homo sapiens
gccatcttccaggtggg

SEQ ID NO: 2706792 - DNA, 19 bp, Homo sapiens
gccatggagttgtgatcat

SEQ ID NO: 2706793 - DNA, 17 bp, Homo sapiens
gccatggcgtgtccctc

SEQ ID NO: 2706794 - DNA, 24 bp, Homo sapiens
gccatggcttccaaggtggtctgc

SEQ ID NO: 2706795 - DNA, 13 bp, Homo sapiens
gccatgggtcctc

SEQ ID NO: 2706796 - DNA, 16 bp, Homo sapiens
gccatgggtcctcggc

SEQ ID NO: 2706797 - DNA, 13 bp, Homo sapiens
gccattaccatgg

SEQ ID NO: 2706798 - DNA, 20 bp, Homo sapiens
gccatttgcaccctccgcct

SEQ ID NO: 2706799 - DNA, 20 bp, Homo sapiens
gcccaaacaccctcctggca

SEQ ID NO: 2706800 - DNA, 19 bp, Homo sapiens
gcccacagcccccacccca

SEQ ID NO: 2706801 - DNA, 23 bp, Homo sapiens
gcccacagcccccaccccagcac

SEQ ID NO: 2706802 - DNA, 16 bp, Homo sapiens
gcccacagctctgctg

SEQ ID NO: 2706803 - DNA, 14 bp, Homo sapiens
gcccaccgcatgcc

SEQ ID NO: 2706804 - DNA, 18 bp, Homo sapiens
gcccaccgcatgccccct

SEQ ID NO: 2706805 - DNA, 19 bp, Homo sapiens
gcccaccgcatgccccctc

SEQ ID NO: 2706806 - DNA, 17 bp, Homo sapiens
gcccagaagaactttgc

SEQ ID NO: 2706807 - DNA, 22 bp, Homo sapiens
gcccagccattaccatggagac

SEQ ID NO: 2706808 - DNA, 21 bp, Homo sapiens
gcccagcctgccccagcctgc

SEQ ID NO: 2706809 - DNA, 12 bp, Homo sapiens
gcccagcctgtc

SEQ ID NO: 2706810 - DNA, 15 bp, Homo sapiens
gcccagcctgtcctg

SEQ ID NO: 2706811 - DNA, 16 bp, Homo sapiens
gcccagcctgtcctgg

SEQ ID NO: 2706812 - DNA, 18 bp, Homo sapiens
gcccagcctgtcctggta

SEQ ID NO: 2706813 - DNA, 15 bp, Homo sapiens
gcccagctgcacctg

SEQ ID NO: 2706814 - DNA, 18 bp, Homo sapiens
gcccaggacggggccggc

SEQ ID NO: 2706815 - DNA, 21 bp, Homo sapiens
gcccaggacggggccggccag

SEQ ID NO: 2706816 - DNA, 22 bp, Homo sapiens
gcccaggccatcttccaggtgg

SEQ ID NO: 2706817 - DNA, 23 bp, Homo sapiens
gcccaggccatcttccaggtggg

SEQ ID NO: 2706818 - DNA, 19 bp, Homo sapiens
gcccaggctagagtgcagt

SEQ ID NO: 2706819 - DNA, 19 bp, Homo sapiens
gcccaggctggagtgcaat

SEQ ID NO: 2706820 - DNA, 23 bp, Homo sapiens
gcccaggctggccagccccacag

SEQ ID NO: 2706821 - DNA, 14 bp, Homo sapiens
gcccagggaagccc

SEQ ID NO: 2706822 - DNA, 15 bp, Homo sapiens
gcccagggaagccct

SEQ ID NO: 2706823 - DNA, 22 bp, Homo sapiens
gcccatcagtgtacccccgccc

SEQ ID NO: 2706824 - DNA, 20 bp, Homo sapiens
gcccatcccccctcaccagg

SEQ ID NO: 2706825 - DNA, 12 bp, Homo sapiens
gcccatctgtcc

SEQ ID NO: 2706826 - DNA, 19 bp, Homo sapiens
gcccatgggcactgctggg

SEQ ID NO: 2706827 - DNA, 20 bp, Homo sapiens
gcccatgggcactgctgggt

SEQ ID NO: 2706828 - DNA, 23 bp, Homo sapiens
gcccatgggcactgctgggtggc

SEQ ID NO: 2706829 - DNA, 14 bp, Homo sapiens
gccccaacccccag

SEQ ID NO: 2706830 - DNA, 16 bp, Homo sapiens
gccccaacccccagca

SEQ ID NO: 2706831 - DNA, 13 bp, Homo sapiens
gccccagcctggc

SEQ ID NO: 2706832 - DNA, 15 bp, Homo sapiens
gccccagcctggccc

SEQ ID NO: 2706833 - DNA, 18 bp, Homo sapiens
gccccagcctggcccagc

SEQ ID NO: 2706834 - DNA, 14 bp, Homo sapiens
gccccagctctggc

SEQ ID NO: 2706835 - DNA, 14 bp, Homo sapiens
gcccccaccccagc

SEQ ID NO: 2706836 - DNA, 16 bp, Homo sapiens
gccccccatcctggcc

SEQ ID NO: 2706837 - DNA, 19 bp, Homo sapiens
gccccccatcctggcccat

SEQ ID NO: 2706838 - DNA, 23 bp, Homo sapiens
gccccccccttgaatctgcaggg

SEQ ID NO: 2706839 - DNA, 16 bp, Homo sapiens
gccccctcgtgccagt

SEQ ID NO: 2706840 - DNA, 21 bp, Homo sapiens
gccccctggtggacagtcctg

SEQ ID NO: 2706841 - DNA, 22 bp, Homo sapiens
gccccctggtggacagtcctgg

SEQ ID NO: 2706842 - DNA, 23 bp, Homo sapiens
gccccggacggacgttggttctg

SEQ ID NO: 2706843 - DNA, 18 bp, Homo sapiens
gcccctcaggggaagctg

SEQ ID NO: 2706844 - DNA, 20 bp, Homo sapiens
gcccctcaggggaagctgct

SEQ ID NO: 2706845 - DNA, 22 bp, Homo sapiens
gcccctcaggggaagctgctag

SEQ ID NO: 2706846 - DNA, 20 bp, Homo sapiens
gcccctccccctaccgcatg

SEQ ID NO: 2706847 - DNA, 21 bp, Homo sapiens
gcccctccctagatccaggct

SEQ ID NO: 2706848 - DNA, 15 bp, Homo sapiens
gcccctgctctggtg

SEQ ID NO: 2706849 - DNA, 21 bp, Homo sapiens
gcccctggaacctttcccttg

SEQ ID NO: 2706850 - DNA, 23 bp, Homo sapiens
gcccctggaacctttcccttgtg

SEQ ID NO: 2706851 - DNA, 16 bp, Homo sapiens
gccccttccccgaggg

SEQ ID NO: 2706852 - DNA, 12 bp, Homo sapiens
gcccgctcccag

SEQ ID NO: 2706853 - DNA, 13 bp, Homo sapiens
gcccgctcccagt

SEQ ID NO: 2706854 - DNA, 18 bp, Homo sapiens
gcccgcttgcctcggctc

SEQ ID NO: 2706855 - DNA, 21 bp, Homo sapiens
gcccgcttgcctcggctcctg

SEQ ID NO: 2706856 - DNA, 14 bp, Homo sapiens
gcccggcgccctct

SEQ ID NO: 2706857 - DNA, 17 bp, Homo sapiens
gcccggcgccctctgtc

SEQ ID NO: 2706858 - DNA, 18 bp, Homo sapiens
gcccggcgccctctgtcc

SEQ ID NO: 2706859 - DNA, 13 bp, Homo sapiens
gcccgggtgcagg

SEQ ID NO: 2706860 - DNA, 17 bp, Homo sapiens
gcccgttgtctccctgg

SEQ ID NO: 2706861 - DNA, 19 bp, Homo sapiens
gcccgttgtctccctggcc

SEQ ID NO: 2706862 - DNA, 20 bp, Homo sapiens
gcccgttgtctccctggccc

SEQ ID NO: 2706863 - DNA, 20 bp, Homo sapiens
gccctaggattcctccccca

SEQ ID NO: 2706864 - DNA, 23 bp, Homo sapiens
gccctaggattcctcccccagag

SEQ ID NO: 2706865 - DNA, 20 bp, Homo sapiens
gccctcaaggcctcccacag

SEQ ID NO: 2706866 - DNA, 20 bp, Homo sapiens
gccctccacagccgcagcct

SEQ ID NO: 2706867 - DNA, 23 bp, Homo sapiens
gccctccacagccgcagcctccc

SEQ ID NO: 2706868 - DNA, 19 bp, Homo sapiens
gccctcggcctccagactg

SEQ ID NO: 2706869 - DNA, 13 bp, Homo sapiens
gccctctgtcctg

SEQ ID NO: 2706870 - DNA, 21 bp, Homo sapiens
gccctgcactgtcctgctcca

SEQ ID NO: 2706871 - DNA, 17 bp, Homo sapiens
gccctgcccctccccct

SEQ ID NO: 2706872 - DNA, 20 bp, Homo sapiens
gccctgctttatcaggggac

SEQ ID NO: 2706873 - DNA, 12 bp, Homo sapiens
gccctggcagga

SEQ ID NO: 2706874 - DNA, 14 bp, Homo sapiens
gccctggccagggc

SEQ ID NO: 2706875 - DNA, 16 bp, Homo sapiens
gccctggccagggcct

SEQ ID NO: 2706876 - DNA, 13 bp, Homo sapiens
gcccttcctgacc

SEQ ID NO: 2706877 - DNA, 20 bp, Homo sapiens
gccgagatcacgccactgca

SEQ ID NO: 2706878 - DNA, 11 bp, Homo sapiens
gccgagccacc

SEQ ID NO: 2706879 - DNA, 15 bp, Homo sapiens
gccgccgcctcgccc

SEQ ID NO: 2706880 - DNA, 18 bp, Homo sapiens
gccgccgtctctgtcccg

SEQ ID NO: 2706881 - DNA, 19 bp, Homo sapiens
gccgctgcccggcgccctc

SEQ ID NO: 2706882 - DNA, 18 bp, Homo sapiens
gccggccaggtgggcggg

SEQ ID NO: 2706883 - DNA, 15 bp, Homo sapiens
gccggccctgcccct

SEQ ID NO: 2706884 - DNA, 16 bp, Homo sapiens
gccggccctgcccctc

SEQ ID NO: 2706885 - DNA, 21 bp, Homo sapiens
gccgggtggggggagggcacc

SEQ ID NO: 2706886 - DNA, 15 bp, Homo sapiens
gccgtccctcctgtt

SEQ ID NO: 2706887 - DNA, 15 bp, Homo sapiens
gccgtggctccagaa

SEQ ID NO: 2706888 - DNA, 15 bp, Homo sapiens
gcctaattcctggca

SEQ ID NO: 2706889 - DNA, 22 bp, Homo sapiens
gcctaattcctggcatgacact

SEQ ID NO: 2706890 - DNA, 15 bp, Homo sapiens
gcctagctcttgggc

SEQ ID NO: 2706891 - DNA, 16 bp, Homo sapiens
gcctatcagtgtgccc

SEQ ID NO: 2706892 - DNA, 16 bp, Homo sapiens
gctgggcccacagccc

SEQ ID NO: 2706893 - DNA, 17 bp, Homo sapiens
gctgggctggggcctga

SEQ ID NO: 2706894 - DNA, 12 bp, Homo sapiens
gctgggctgggt

SEQ ID NO: 2706895 - DNA, 15 bp, Homo sapiens
gctgggctgggtgcg

SEQ ID NO: 2706896 - DNA, 17 bp, Homo sapiens
gctggggcaagtccctg

SEQ ID NO: 2706897 - DNA, 15 bp, Homo sapiens
gctgggggagggact

SEQ ID NO: 2706898 - DNA, 16 bp, Homo sapiens
gctgggggagggactg

SEQ ID NO: 2706899 - DNA, 18 bp, Homo sapiens
gctgggggagggactgct

SEQ ID NO: 2706900 - DNA, 20 bp, Homo sapiens
gctgggggcgggggagccaa

SEQ ID NO: 2706901 - DNA, 13 bp, Homo sapiens
gctgggggctccc

SEQ ID NO: 2706902 - DNA, 16 bp, Homo sapiens
gctgggggctcccctt

SEQ ID NO: 2706903 - DNA, 14 bp, Homo sapiens
gctgggtccagggg

SEQ ID NO: 2706904 - DNA, 23 bp, Homo sapiens
gctgggtgcgaccccatctgccc

SEQ ID NO: 2706905 - DNA, 21 bp, Homo sapiens
gctgggttggcgcaccctccc

SEQ ID NO: 2706906 - DNA, 17 bp, Homo sapiens
gctgggttgtcactgag

SEQ ID NO: 2706907 - DNA, 19 bp, Homo sapiens
gctgggttgtcactgagac

SEQ ID NO: 2706908 - DNA, 19 bp, Homo sapiens
gctggtgaggccggccctg

SEQ ID NO: 2706909 - DNA, 22 bp, Homo sapiens
gctggtgaggccggccctgccc

SEQ ID NO: 2706910 - DNA, 18 bp, Homo sapiens
gctggtggattgggcaga

SEQ ID NO: 2706911 - DNA, 18 bp, Homo sapiens
gctgtaactcagacattc

SEQ ID NO: 2706912 - DNA, 17 bp, Homo sapiens
gctgtatacaaacaggt

SEQ ID NO: 2706913 - DNA, 14 bp, Homo sapiens
gctgtccagtgccc

SEQ ID NO: 2706914 - DNA, 18 bp, Homo sapiens
gctgtccagtgcccattc

SEQ ID NO: 2706915 - DNA, 23 bp, Homo sapiens
gctgtccagtgcccattcctcac

SEQ ID NO: 2706916 - DNA, 15 bp, Homo sapiens
gctgtcccctcttgc

SEQ ID NO: 2706917 - DNA, 16 bp, Homo sapiens
gctgtcccctcttgcc

SEQ ID NO: 2706918 - DNA, 18 bp, Homo sapiens
gctgtcccctcttgcccc

SEQ ID NO: 2706919 - DNA, 19 bp, Homo sapiens
gctgtcccctcttgcccca

SEQ ID NO: 2706920 - DNA, 14 bp, Homo sapiens
gctgtcctaggcca

SEQ ID NO: 2706921 - DNA, 14 bp, Homo sapiens
gctgtgccaccctg

SEQ ID NO: 2706922 - DNA, 17 bp, Homo sapiens
gctgtgccaccctgggc

SEQ ID NO: 2706923 - DNA, 18 bp, Homo sapiens
gctgtgccaccctgggct

SEQ ID NO: 2706924 - DNA, 22 bp, Homo sapiens
gctgtgccaccctgggctctgt

SEQ ID NO: 2706925 - DNA, 17 bp, Homo sapiens
gctgtggagcccattgt

SEQ ID NO: 2706926 - DNA, 14 bp, Homo sapiens
gctgtggcctgggc

SEQ ID NO: 2706927 - DNA, 17 bp, Homo sapiens
gctgtggtcccacccag

SEQ ID NO: 2706928 - DNA, 20 bp, Homo sapiens
gctgtggttcctaagcctgt

SEQ ID NO: 2706929 - DNA, 11 bp, Homo sapiens
gctgtgtctct

SEQ ID NO: 2706930 - DNA, 15 bp, Homo sapiens
gctgtgtctctgtat

SEQ ID NO: 2706931 - DNA, 15 bp, Homo sapiens
gctgttgctgttgct

SEQ ID NO: 2706932 - DNA, 22 bp, Homo sapiens
gcttacttacaaaagcagcttt

SEQ ID NO: 2706933 - DNA, 14 bp, Homo sapiens
gcttagaaacatgt

SEQ ID NO: 2706934 - DNA, 15 bp, Homo sapiens
gcttagaaacatgtt

SEQ ID NO: 2706935 - DNA, 16 bp, Homo sapiens
gcttaggtgccaggct

SEQ ID NO: 2706936 - DNA, 12 bp, Homo sapiens
gcttcagcctga

SEQ ID NO: 2706937 - DNA, 14 bp, Homo sapiens
gcttcagcctgagg

SEQ ID NO: 2706938 - DNA, 15 bp, Homo sapiens
gcttcagcctgaggc

SEQ ID NO: 2706939 - DNA, 12 bp, Homo sapiens
gcttcatatcta

SEQ ID NO: 2706940 - DNA, 16 bp, Homo sapiens
gcttccaaggtggtct

SEQ ID NO: 2706941 - DNA, 20 bp, Homo sapiens
gcttccagcttcctctgagc

SEQ ID NO: 2706942 - DNA, 14 bp, Homo sapiens
gcttccctgggcct

SEQ ID NO: 2706943 - DNA, 13 bp, Homo sapiens
gcttccctggggc

SEQ ID NO: 2706944 - DNA, 14 bp, Homo sapiens
gcttccctggggcc

SEQ ID NO: 2706945 - DNA, 21 bp, Homo sapiens
gcttcctctgaatattaagaa

SEQ ID NO: 2706946 - DNA, 23 bp, Homo sapiens
gcttcctggaccggggccttggt

SEQ ID NO: 2706947 - DNA, 20 bp, Homo sapiens
gcttctcccggacctggact

SEQ ID NO: 2706948 - DNA, 15 bp, Homo sapiens
gcttctgcagctttg

SEQ ID NO: 2706949 - DNA, 14 bp, Homo sapiens
gcttctgccacttc

SEQ ID NO: 2706950 - DNA, 16 bp, Homo sapiens
gcttctgccacttccc

SEQ ID NO: 2706951 - DNA, 21 bp, Homo sapiens
gcttctgccacttcccaggta

SEQ ID NO: 2706952 - DNA, 15 bp, Homo sapiens
gcttctgcctcagct

SEQ ID NO: 2706953 - DNA, 11 bp, Homo sapiens
gcttctgcttc

SEQ ID NO: 2706954 - DNA, 17 bp, Homo sapiens
gcttctggagcccttgg

SEQ ID NO: 2706955 - DNA, 13 bp, Homo sapiens
gcttgaacccagg

SEQ ID NO: 2706956 - DNA, 14 bp, Homo sapiens
gcttgattaaacag

SEQ ID NO: 2706957 - DNA, 19 bp, Homo sapiens
gcttgcctcggctcctgct

SEQ ID NO: 2706958 - DNA, 20 bp, Homo sapiens
gcttgcctcggctcctgctg

SEQ ID NO: 2706959 - DNA, 21 bp, Homo sapiens
gcttgcctcggctcctgctgc

SEQ ID NO: 2706960 - DNA, 23 bp, Homo sapiens
gcttgcctcggctcctgctgcac

SEQ ID NO: 2706961 - DNA, 16 bp, Homo sapiens
gcttgctattaagaaa

SEQ ID NO: 2706962 - DNA, 15 bp, Homo sapiens
gcttggcttcccctc

SEQ ID NO: 2706963 - DNA, 22 bp, Homo sapiens
gcttggcttcccctccacccta

SEQ ID NO: 2706964 - DNA, 23 bp, Homo sapiens
gctttagtcctagaggacctgag

SEQ ID NO: 2706965 - DNA, 15 bp, Homo sapiens
gctttccctccccag

SEQ ID NO: 2706966 - DNA, 20 bp, Homo sapiens
gctttcttttctctatgaaa

SEQ ID NO: 2706967 - DNA, 16 bp, Homo sapiens
gctttgcagaccgcat

SEQ ID NO: 2706968 - DNA, 13 bp, Homo sapiens
gcttttcctgtct

SEQ ID NO: 2706969 - DNA, 17 bp, Homo sapiens
gcttttcctgtctgtat

SEQ ID NO: 2706970 - DNA, 18 bp, Homo sapiens
gcttttcgaactgtgctc

SEQ ID NO: 2706971 - DNA, 22 bp, Homo sapiens
gcttttctcttgccccaaatca

SEQ ID NO: 2706972 - DNA, 13 bp, Homo sapiens
ggaaaaaagaaat

SEQ ID NO: 2706973 - DNA, 14 bp, Homo sapiens
ggaaaaatgtcact

SEQ ID NO: 2706974 - DNA, 15 bp, Homo sapiens
ggaaaaatgtcactg

SEQ ID NO: 2706975 - DNA, 18 bp, Homo sapiens
ggaaaagaaatcaatttt

SEQ ID NO: 2706976 - DNA, 20 bp, Homo sapiens
ggaaagcaccgcagcatgtg

SEQ ID NO: 2706977 - DNA, 23 bp, Homo sapiens
ggaaagcaccgcagcatgtgggg

SEQ ID NO: 2706978 - DNA, 14 bp, Homo sapiens
ggaaagcctctgct

SEQ ID NO: 2706979 - DNA, 18 bp, Homo sapiens
ggaaagctgtgccttttt

SEQ ID NO: 2706980 - DNA, 20 bp, Homo sapiens
ggaaaggctcagtctcagga

SEQ ID NO: 2706981 - DNA, 18 bp, Homo sapiens
ggaacaatcacaaaagct

SEQ ID NO: 2706982 - DNA, 16 bp, Homo sapiens
ggaacatgcagctctg

SEQ ID NO: 2706983 - DNA, 17 bp, Homo sapiens
ggaagagaggcacctgc

SEQ ID NO: 2706984 - DNA, 21 bp, Homo sapiens
ggaagagaggcacctgctgga

SEQ ID NO: 2706985 - DNA, 19 bp, Homo sapiens
ggaagagcacagccctccc

SEQ ID NO: 2706986 - DNA, 19 bp, Homo sapiens
ggaagcaagacgtcctgga

SEQ ID NO: 2706987 - DNA, 20 bp, Homo sapiens
ggaagcaagacgtcctggaa

SEQ ID NO: 2706988 - DNA, 17 bp, Homo sapiens
ggaagcagggacacccc

SEQ ID NO: 2706989 - DNA, 23 bp, Homo sapiens
ggaagccatccctttttttacat

SEQ ID NO: 2706990 - DNA, 17 bp, Homo sapiens
ggaagccctcggcctcc

SEQ ID NO: 2706991 - DNA, 14 bp, Homo sapiens
ggaaggaagcccgc

SEQ ID NO: 2706992 - DNA, 19 bp, Homo sapiens
ggaagggagggagctgagg

SEQ ID NO: 2706993 - DNA, 17 bp, Homo sapiens
ggaagggcatccttctg

SEQ ID NO: 2706994 - DNA, 22 bp, Homo sapiens
ggaatcaagatgtcagactggc

SEQ ID NO: 2706995 - DNA, 14 bp, Homo sapiens
ggaatgaagcatgt

SEQ ID NO: 2706996 - DNA, 17 bp, Homo sapiens
ggaatgaagcatgtagc

SEQ ID NO: 2706997 - DNA, 16 bp, Homo sapiens
ggaatgggagaggggt

SEQ ID NO: 2706998 - DNA, 21 bp, Homo sapiens
ggaattggagaaaagcacaat

SEQ ID NO: 2706999 - DNA, 12 bp, Homo sapiens
ggaatttgtaag

SEQ ID NO: 2707000 - DNA, 13 bp, Homo sapiens
ggaattttgtaaa

SEQ ID NO: 2707001 - DNA, 21 bp, Homo sapiens
ggacaaacagtgaatttaagc

SEQ ID NO: 2707002 - DNA, 14 bp, Homo sapiens
ggacaacccagaac

SEQ ID NO: 2707003 - DNA, 14 bp, Homo sapiens
ggacaacctgcccc

SEQ ID NO: 2707004 - DNA, 21 bp, Homo sapiens
ggacaccccccgccccccacc

SEQ ID NO: 2707005 - DNA, 22 bp, Homo sapiens
ggacaccccccgccccccacct

SEQ ID NO: 2707006 - DNA, 15 bp, Homo sapiens
ggacactacaaacat

SEQ ID NO: 2707007 - DNA, 17 bp, Homo sapiens
ggacagaagcaggagta

SEQ ID NO: 2707008 - DNA, 15 bp, Homo sapiens
ggacagtcctgggag

SEQ ID NO: 2707009 - DNA, 19 bp, Homo sapiens
ggacagtgcttcagcctga

SEQ ID NO: 2707010 - DNA, 23 bp, Homo sapiens
ggacagtgcttcagcctgaggct

SEQ ID NO: 2707011 - DNA, 21 bp, Homo sapiens
ggacatgatttagggaagcag

SEQ ID NO: 2707012 - DNA, 20 bp, Homo sapiens
ggaccacagcaaggcacctg

SEQ ID NO: 2707013 - DNA, 14 bp, Homo sapiens
ggaccactgggccc

SEQ ID NO: 2707014 - DNA, 15 bp, Homo sapiens
ggaccactgggcccc

SEQ ID NO: 2707015 - DNA, 22 bp, Homo sapiens
ggaccaggtcttgttcaagcag

SEQ ID NO: 2707016 - DNA, 19 bp, Homo sapiens
ggggcccgttgtctccctg

SEQ ID NO: 2707017 - DNA, 21 bp, Homo sapiens
ggggcccgttgtctccctggc

SEQ ID NO: 2707018 - DNA, 15 bp, Homo sapiens
ggggctcgccccacc

SEQ ID NO: 2707019 - DNA, 14 bp, Homo sapiens
ggggctgccagggg

SEQ ID NO: 2707020 - DNA, 23 bp, Homo sapiens
ggggctgcccgctcccagtgtct

SEQ ID NO: 2707021 - DNA, 14 bp, Homo sapiens
ggggctgctggggg

SEQ ID NO: 2707022 - DNA, 16 bp, Homo sapiens
ggggctgctgggggct

SEQ ID NO: 2707023 - DNA, 13 bp, Homo sapiens
ggggctgggttgg

SEQ ID NO: 2707024 - DNA, 16 bp, Homo sapiens
gggggagaaggcctcc

SEQ ID NO: 2707025 - DNA, 14 bp, Homo sapiens
gggggagggcaccc

SEQ ID NO: 2707026 - DNA, 21 bp, Homo sapiens
gggtgcgaccccatctgccca

SEQ ID NO: 2707027 - DNA, 13 bp, Homo sapiens
gggtggcccatcc

SEQ ID NO: 2707028 - DNA, 17 bp, Homo sapiens
gggttgaaagacatcaa

SEQ ID NO: 2707029 - DNA, 20 bp, Homo sapiens
gggtttcgtcatgttggcca

SEQ ID NO: 2707030 - DNA, 15 bp, Homo sapiens
gggtttggcccctgg

SEQ ID NO: 2707031 - DNA, 23 bp, Homo sapiens
ggtaaaaagattatatatcataa

SEQ ID NO: 2707032 - DNA, 15 bp, Homo sapiens
ggtaataaacttaga

SEQ ID NO: 2707033 - DNA, 17 bp, Homo sapiens
ggtaatttttttttgta

SEQ ID NO: 2707034 - DNA, 13 bp, Homo sapiens
ggtacagcagggt

SEQ ID NO: 2707035 - DNA, 16 bp, Homo sapiens
ggtactgcacattttg

SEQ ID NO: 2707036 - DNA, 14 bp, Homo sapiens
ggtagagctggtgc

SEQ ID NO: 2707037 - DNA, 13 bp, Homo sapiens
ggtaggaaagcac

SEQ ID NO: 2707038 - DNA, 16 bp, Homo sapiens
ggtagggagctaagga

SEQ ID NO: 2707039 - DNA, 21 bp, Homo sapiens
ggtatctgcatgtaaaatctt

SEQ ID NO: 2707040 - DNA, 13 bp, Homo sapiens
ggtatgggaagcc

SEQ ID NO: 2707041 - DNA, 15 bp, Homo sapiens
ggtcaccatgaaact

SEQ ID NO: 2707042 - DNA, 17 bp, Homo sapiens
ggtccacacctgggcat

SEQ ID NO: 2707043 - DNA, 13 bp, Homo sapiens
ggtcccacttccc

SEQ ID NO: 2707044 - DNA, 17 bp, Homo sapiens
ggtcccacttcccctcc

SEQ ID NO: 2707045 - DNA, 19 bp, Homo sapiens
ggtcccagacagctggacc

SEQ ID NO: 2707046 - DNA, 21 bp, Homo sapiens
ggtcctcggcccatctgtcca

SEQ ID NO: 2707047 - DNA, 14 bp, Homo sapiens
ggtcctggccctct

SEQ ID NO: 2707048 - DNA, 12 bp, Homo sapiens
ggtcctggctgg

SEQ ID NO: 2707049 - DNA, 21 bp, Homo sapiens
ggtccttcaagttagctcagg

SEQ ID NO: 2707050 - DNA, 15 bp, Homo sapiens
ggtccttccaggccc

SEQ ID NO: 2707051 - DNA, 21 bp, Homo sapiens
ggtcctttaggcagcctgccg

SEQ ID NO: 2707052 - DNA, 19 bp, Homo sapiens
ggtctataaacatgaaggg

SEQ ID NO: 2707053 - DNA, 23 bp, Homo sapiens
ggtctataaacatgaagggaaaa

SEQ ID NO: 2707054 - DNA, 16 bp, Homo sapiens
ggtctcacactcctcc

SEQ ID NO: 2707055 - DNA, 18 bp, Homo sapiens
ggtctcacactcctcctg

SEQ ID NO: 2707056 - DNA, 16 bp, Homo sapiens
ggtctcgaactcctga

SEQ ID NO: 2707057 - DNA, 22 bp, Homo sapiens
ggtctcgctgatgctgggctgg

SEQ ID NO: 2707058 - DNA, 22 bp, Homo sapiens
ggtctgctcgggcccaggccat

SEQ ID NO: 2707059 - DNA, 13 bp, Homo sapiens
ggtctgcttctgc

SEQ ID NO: 2707060 - DNA, 21 bp, Homo sapiens
ggtctgggccagatgctgggc

SEQ ID NO: 2707061 - DNA, 21 bp, Homo sapiens
ggtcttcttgtgtcctgatga

SEQ ID NO: 2707062 - DNA, 16 bp, Homo sapiens
ggtcttgatctcctga

SEQ ID NO: 2707063 - DNA, 19 bp, Homo sapiens
ggtcttgatctcctgagct

SEQ ID NO: 2707064 - DNA, 14 bp, Homo sapiens
ggtgaacattgcaa

SEQ ID NO: 2707065 - DNA, 18 bp, Homo sapiens
ggtgagaacgtgcccagc

SEQ ID NO: 2707066 - DNA, 20 bp, Homo sapiens
ggtgagactctgaggtgtca

SEQ ID NO: 2707067 - DNA, 20 bp, Homo sapiens
ggtgaggcagtgggtcccac

SEQ ID NO: 2707068 - DNA, 15 bp, Homo sapiens
ggtgaggcccagcct

SEQ ID NO: 2707069 - DNA, 19 bp, Homo sapiens
ggtgcaattaactctggac

SEQ ID NO: 2707070 - DNA, 10 bp, Homo sapiens
ggtgcacaga

SEQ ID NO: 2707071 - DNA, 16 bp, Homo sapiens
ggtgcagaacaggggc

SEQ ID NO: 2707072 - DNA, 16 bp, Homo sapiens
ggtgcatgcaggtctc

SEQ ID NO: 2707073 - DNA, 21 bp, Homo sapiens
ggtgcgaccccatctgcccag

SEQ ID NO: 2707074 - DNA, 18 bp, Homo sapiens
ggtgctcacgactcttcc

SEQ ID NO: 2707075 - DNA, 13 bp, Homo sapiens
ggtgctgctaccc

SEQ ID NO: 2707076 - DNA, 19 bp, Homo sapiens
ggtgctgctaccctccctg

SEQ ID NO: 2707077 - DNA, 22 bp, Homo sapiens
ggtgctgctaccctccctgctg

SEQ ID NO: 2707078 - DNA, 13 bp, Homo sapiens
ggtggatggtgac

SEQ ID NO: 2707079 - DNA, 23 bp, Homo sapiens
ggtggattgggcagaatcctggg

SEQ ID NO: 2707080 - DNA, 20 bp, Homo sapiens
ggtgggcgggcagcacagca

SEQ ID NO: 2707081 - DNA, 15 bp, Homo sapiens
ggtgggctgagccct

SEQ ID NO: 2707082 - DNA, 17 bp, Homo sapiens
ggtggggggagggcacc

SEQ ID NO: 2707083 - DNA, 22 bp, Homo sapiens
ggtgggggggagaaggcctccc

SEQ ID NO: 2707084 - DNA, 22 bp, Homo sapiens
ggtggtctgctcgggcccaggc

SEQ ID NO: 2707085 - DNA, 15 bp, Homo sapiens
ggtggtggggaccag

SEQ ID NO: 2707086 - DNA, 13 bp, Homo sapiens
ggtgtcaccctgc

SEQ ID NO: 2707087 - DNA, 20 bp, Homo sapiens
ggtgtcaccctgcagagcta

SEQ ID NO: 2707088 - DNA, 13 bp, Homo sapiens
ggtgtgcctgcag

SEQ ID NO: 2707089 - DNA, 14 bp, Homo sapiens
ggtgtgcctgcagc

SEQ ID NO: 2707090 - DNA, 15 bp, Homo sapiens
ggtgtgcctgcagcc

SEQ ID NO: 2707091 - DNA, 13 bp, Homo sapiens
ggttgaaagacat

SEQ ID NO: 2707092 - DNA, 17 bp, Homo sapiens
ggttgaaagacatcaat

SEQ ID NO: 2707093 - DNA, 15 bp, Homo sapiens
ggttggcgcaccctc

SEQ ID NO: 2707094 - DNA, 15 bp, Homo sapiens
ggtttacaacaaaca

SEQ ID NO: 2707095 - DNA, 17 bp, Homo sapiens
ggtttacaacaaacact

SEQ ID NO: 2707096 - DNA, 18 bp, Homo sapiens
ggtttacaacaaacactg

SEQ ID NO: 2707097 - DNA, 19 bp, Homo sapiens
ggtttacaacaaacactgt

SEQ ID NO: 2707098 - DNA, 22 bp, Homo sapiens
ggtttacaatttagcttacatt

SEQ ID NO: 2707099 - DNA, 17 bp, Homo sapiens
ggtttcccagtgagcct

SEQ ID NO: 2707100 - DNA, 16 bp, Homo sapiens
ggtttggtacagttca

SEQ ID NO: 2707101 - DNA, 20 bp, Homo sapiens
ggttttattttgtaattatt

SEQ ID NO: 2707102 - DNA, 17 bp, Homo sapiens
gtaaaaagattatatat

SEQ ID NO: 2707103 - DNA, 21 bp, Homo sapiens
gtaaaatcttcagctggtgga

SEQ ID NO: 2707104 - DNA, 15 bp, Homo sapiens
gtaaaattgtataga

SEQ ID NO: 2707105 - DNA, 14 bp, Homo sapiens
gtaaataaattgtt

SEQ ID NO: 2707106 - DNA, 22 bp, Homo sapiens
gtaactattcacagattgcttc

SEQ ID NO: 2707107 - DNA, 12 bp, Homo sapiens
gtaactcccact

SEQ ID NO: 2707108 - DNA, 15 bp, Homo sapiens
gtaactcccactcct

SEQ ID NO: 2707109 - DNA, 16 bp, Homo sapiens
gtaactcccactccta

SEQ ID NO: 2707110 - DNA, 15 bp, Homo sapiens
gtaactcttggccag

SEQ ID NO: 2707111 - DNA, 21 bp, Homo sapiens
gtaactcttggccagagctga

SEQ ID NO: 2707112 - DNA, 21 bp, Homo sapiens
gtaagcagattacaataaatc

SEQ ID NO: 2707113 - DNA, 15 bp, Homo sapiens
gtaagcattctgagc

SEQ ID NO: 2707114 - DNA, 19 bp, Homo sapiens
gtaagcattctgagctggg

SEQ ID NO: 2707115 - DNA, 23 bp, Homo sapiens
gtaataaatacacagcatgcaga

SEQ ID NO: 2707116 - DNA, 15 bp, Homo sapiens
gtaatatattgctgc

SEQ ID NO: 2707117 - DNA, 14 bp, Homo sapiens
gtaatatttcttca

SEQ ID NO: 2707118 - DNA, 16 bp, Homo sapiens
gtaatgcttatgtgtt

SEQ ID NO: 2707119 - DNA, 16 bp, Homo sapiens
gtaatgcttcaatcag

SEQ ID NO: 2707120 - DNA, 16 bp, Homo sapiens
gtaattttgtgaaaga

SEQ ID NO: 2707121 - DNA, 17 bp, Homo sapiens
gtaatttttttttgtaa

SEQ ID NO: 2707122 - DNA, 16 bp, Homo sapiens
gtacagtctcaatttt

SEQ ID NO: 2707123 - DNA, 22 bp, Homo sapiens
gtacagtctcaattttgtattt

SEQ ID NO: 2707124 - DNA, 14 bp, Homo sapiens
gtacagttcagttc

SEQ ID NO: 2707125 - DNA, 16 bp, Homo sapiens
gtacagttcagttcct

SEQ ID NO: 2707126 - DNA, 15 bp, Homo sapiens
gtacagttcataaat

SEQ ID NO: 2707127 - DNA, 19 bp, Homo sapiens
gtacagttcataattcacc

SEQ ID NO: 2707128 - DNA, 17 bp, Homo sapiens
gtacatcttgtaagaca

SEQ ID NO: 2707129 - DNA, 18 bp, Homo sapiens
gtacattcatctggaggc

SEQ ID NO: 2707130 - DNA, 19 bp, Homo sapiens
gtaccaaatccacaagcca

SEQ ID NO: 2707131 - DNA, 17 bp, Homo sapiens
gtaccacaccctgcctg

SEQ ID NO: 2707132 - DNA, 21 bp, Homo sapiens
gtaccacaccctgcctgctgt

SEQ ID NO: 2707133 - DNA, 16 bp, Homo sapiens
gtaccaggcacatggc

SEQ ID NO: 2707134 - DNA, 18 bp, Homo sapiens
gtaccaggcacatggctg

SEQ ID NO: 2707135 - DNA, 21 bp, Homo sapiens
gtaccaggcacatggctgggg

SEQ ID NO: 2707136 - DNA, 23 bp, Homo sapiens
gtaccaggcacatggctggggga

SEQ ID NO: 2707137 - DNA, 13 bp, Homo sapiens
gtaccatattgct

SEQ ID NO: 2707138 - DNA, 13 bp, Homo sapiens
gtacccccgccca

SEQ ID NO: 2707139 - DNA, 17 bp, Homo sapiens
gtacccccgcccaggct

SEQ ID NO: 2707140 - DNA, 16 bp, Homo sapiens
aaggcctcccacagtg

SEQ ID NO: 2707141 - DNA, 11 bp, Homo sapiens
aaggcctcccc

SEQ ID NO: 2707142 - DNA, 11 bp, Homo sapiens
aaggctgagag

SEQ ID NO: 2707143 - DNA, 12 bp, Homo sapiens
aaggctgagagc

SEQ ID NO: 2707144 - DNA, 18 bp, Homo sapiens
aaggctgggtccagggga

SEQ ID NO: 2707145 - DNA, 20 bp, Homo sapiens
aaggctttgccatgggcctg

SEQ ID NO: 2707146 - DNA, 23 bp, Homo sapiens
aagggacatgtctttggcttcag

SEQ ID NO: 2707147 - DNA, 15 bp, Homo sapiens
aagggagggagctga

SEQ ID NO: 2707148 - DNA, 17 bp, Homo sapiens
aagggcatccttctgcc

SEQ ID NO: 2707149 - DNA, 14 bp, Homo sapiens
aagggcctgctctg

SEQ ID NO: 2707150 - DNA, 18 bp, Homo sapiens
aaggtaataaatacacag

SEQ ID NO: 2707151 - DNA, 20 bp, Homo sapiens
aaggtaatttttttttgtaa

SEQ ID NO: 2707152 - DNA, 19 bp, Homo sapiens
aaggtactgaaggcttctg

SEQ ID NO: 2707153 - DNA, 17 bp, Homo sapiens
aaggtagaacctcacct

SEQ ID NO: 2707154 - DNA, 18 bp, Homo sapiens
aaggtaggtgcatgcctt

SEQ ID NO: 2707155 - DNA, 18 bp, Homo sapiens
aaggtaggttttaaaaat

SEQ ID NO: 2707156 - DNA, 14 bp, Homo sapiens
aaggtatctggtat

SEQ ID NO: 2707157 - DNA, 17 bp, Homo sapiens
aaggtctataaacatga

SEQ ID NO: 2707158 - DNA, 19 bp, Homo sapiens
aaggtctcacactcctcct

SEQ ID NO: 2707159 - DNA, 23 bp, Homo sapiens
aaggtcttcttgtgtcctgatga

SEQ ID NO: 2707160 - DNA, 18 bp, Homo sapiens
aaggtgggctgagccctg

SEQ ID NO: 2707161 - DNA, 19 bp, Homo sapiens
aaggtgggctgagccctgg

SEQ ID NO: 2707162 - DNA, 21 bp, Homo sapiens
aaggtgggctgagccctggca

SEQ ID NO: 2707163 - DNA, 13 bp, Homo sapiens
aaggtgtcatttg

SEQ ID NO: 2707164 - DNA, 14 bp, Homo sapiens
aaggtgtcatttga

SEQ ID NO: 2707165 - DNA, 22 bp, Homo sapiens
aaggtttcccagtgagcctctg

SEQ ID NO: 2707166 - DNA, 16 bp, Homo sapiens
aaggttttattttgta

SEQ ID NO: 2707167 - DNA, 14 bp, Homo sapiens
aagtaactcccact

SEQ ID NO: 2707168 - DNA, 23 bp, Homo sapiens
aagtataggataaattacattaa

SEQ ID NO: 2707169 - DNA, 14 bp, Homo sapiens
aagtatttttgaaa

SEQ ID NO: 2707170 - DNA, 15 bp, Homo sapiens
aagtatttttgaaag

SEQ ID NO: 2707171 - DNA, 20 bp, Homo sapiens
aagtatttttgaaagaattc

SEQ ID NO: 2707172 - DNA, 17 bp, Homo sapiens
aagtcaacactcttctt

SEQ ID NO: 2707173 - DNA, 17 bp, Homo sapiens
aagtcacatataaaagt

SEQ ID NO: 2707174 - DNA, 12 bp, Homo sapiens
aagtcatttaaa

SEQ ID NO: 2707175 - DNA, 19 bp, Homo sapiens
aagtccacagtggaaccag

SEQ ID NO: 2707176 - DNA, 13 bp, Homo sapiens
aagtctaaagttt

SEQ ID NO: 2707177 - DNA, 15 bp, Homo sapiens
aagtctcctgtatca

SEQ ID NO: 2707178 - DNA, 14 bp, Homo sapiens
aagtctctgctgct

SEQ ID NO: 2707179 - DNA, 12 bp, Homo sapiens
aagtcttgcatt

SEQ ID NO: 2707180 - DNA, 16 bp, Homo sapiens
aagtcttttttgatca

SEQ ID NO: 2707181 - DNA, 13 bp, Homo sapiens
aagtgagtggcat

SEQ ID NO: 2707182 - DNA, 17 bp, Homo sapiens
aagtgagtggcatgtgg

SEQ ID NO: 2707183 - DNA, 14 bp, Homo sapiens
aagtgccccagggt

SEQ ID NO: 2707184 - DNA, 20 bp, Homo sapiens
aagtgctaggattacaggca

SEQ ID NO: 2707185 - DNA, 22 bp, Homo sapiens
aagtgtcctggaccctggccta

SEQ ID NO: 2707186 - DNA, 14 bp, Homo sapiens
aagtgtctcttgac

SEQ ID NO: 2707187 - DNA, 20 bp, Homo sapiens
aagtgtggatgttcagaatt

SEQ ID NO: 2707188 - DNA, 22 bp, Homo sapiens
aagtgtggatgttcagaatttt

SEQ ID NO: 2707189 - DNA, 18 bp, Homo sapiens
aagttactggctctttgt

SEQ ID NO: 2707190 - DNA, 14 bp, Homo sapiens
aagttagctcagga

SEQ ID NO: 2707191 - DNA, 15 bp, Homo sapiens
aagttagctcaggag

SEQ ID NO: 2707192 - DNA, 20 bp, Homo sapiens
aagttccagttttgttttga

SEQ ID NO: 2707193 - DNA, 14 bp, Homo sapiens
aagttcctctagtg

SEQ ID NO: 2707194 - DNA, 21 bp, Homo sapiens
aagttgaatggcctgccttga

SEQ ID NO: 2707195 - DNA, 23 bp, Homo sapiens
aagttggtcttactttgtgcaaa

SEQ ID NO: 2707196 - DNA, 20 bp, Homo sapiens
aagtttacagtaaataaatt

SEQ ID NO: 2707197 - DNA, 16 bp, Homo sapiens
aagtttatgtctaaag

SEQ ID NO: 2707198 - DNA, 17 bp, Homo sapiens
aagtttatgtctaaaga

SEQ ID NO: 2707199 - DNA, 18 bp, Homo sapiens
aagtttgtcctttaacta

SEQ ID NO: 2707200 - DNA, 22 bp, Homo sapiens
aagttttcagattgtaaaggta

SEQ ID NO: 2707201 - DNA, 16 bp, Homo sapiens
aataaaactttatgga

SEQ ID NO: 2707202 - DNA, 11 bp, Homo sapiens
aataaaagcac

SEQ ID NO: 2707203 - DNA, 12 bp, Homo sapiens
aataaaagcaca

SEQ ID NO: 2707204 - DNA, 13 bp, Homo sapiens
aataaaagcacaa

SEQ ID NO: 2707205 - DNA, 12 bp, Homo sapiens
aataaaattgta

SEQ ID NO: 2707206 - DNA, 14 bp, Homo sapiens
aataaaccattttt

SEQ ID NO: 2707207 - DNA, 17 bp, Homo sapiens
aataaacttagaataaa

SEQ ID NO: 2707208 - DNA, 19 bp, Homo sapiens
aataaacttagaataaaat

SEQ ID NO: 2707209 - DNA, 13 bp, Homo sapiens
aataaagagctca

SEQ ID NO: 2707210 - DNA, 22 bp, Homo sapiens
aataaatacacagcatgcagac

SEQ ID NO: 2707211 - DNA, 12 bp, Homo sapiens
aataaatgctga

SEQ ID NO: 2707212 - DNA, 10 bp, Homo sapiens
aataacagaa

SEQ ID NO: 2707213 - DNA, 14 bp, Homo sapiens
aataactctgattt

SEQ ID NO: 2707214 - DNA, 16 bp, Homo sapiens
aataaggcccagagcg

SEQ ID NO: 2707215 - DNA, 23 bp, Homo sapiens
aataagttttatacataaacagt

SEQ ID NO: 2707216 - DNA, 19 bp, Homo sapiens
aataatccttaaactagct

SEQ ID NO: 2707217 - DNA, 13 bp, Homo sapiens
aatacactttatt

SEQ ID NO: 2707218 - DNA, 16 bp, Homo sapiens
aatagaaatccaattg

SEQ ID NO: 2707219 - DNA, 19 bp, Homo sapiens
aatagcaaggccagggcac

SEQ ID NO: 2707220 - DNA, 13 bp, Homo sapiens
aatagcacatgat

SEQ ID NO: 2707221 - DNA, 14 bp, Homo sapiens
aatagcacatgatt

SEQ ID NO: 2707222 - DNA, 19 bp, Homo sapiens
aatagcacatgattttctt

SEQ ID NO: 2707223 - DNA, 19 bp, Homo sapiens
aatatacaagcaagcaaaa

SEQ ID NO: 2707224 - DNA, 23 bp, Homo sapiens
aatatatacagattcctgttgtg

SEQ ID NO: 2707225 - DNA, 23 bp, Homo sapiens
aatatccctttttcacatattaa

SEQ ID NO: 2707226 - DNA, 18 bp, Homo sapiens
aatatctgagaagtgtat

SEQ ID NO: 2707227 - DNA, 20 bp, Homo sapiens
aatatctgagaagtgtatat

SEQ ID NO: 2707228 - DNA, 14 bp, Homo sapiens
aatatgaaagccac

SEQ ID NO: 2707229 - DNA, 23 bp, Homo sapiens
aatatgattgcactaaataaact

SEQ ID NO: 2707230 - DNA, 17 bp, Homo sapiens
aatattaatggaaacat

SEQ ID NO: 2707231 - DNA, 13 bp, Homo sapiens
aatattcttttgt

SEQ ID NO: 2707232 - DNA, 15 bp, Homo sapiens
aatatttactcatca

SEQ ID NO: 2707233 - DNA, 16 bp, Homo sapiens
aatcaagagtctctcc

SEQ ID NO: 2707234 - DNA, 18 bp, Homo sapiens
aatcaagtctgtgaaagt

SEQ ID NO: 2707235 - DNA, 14 bp, Homo sapiens
aatcaattttttaa

SEQ ID NO: 2707236 - DNA, 22 bp, Homo sapiens
aatcacaaaagctgtgtctctg

SEQ ID NO: 2707237 - DNA, 21 bp, Homo sapiens
aatcacaaacatatgtatctt

SEQ ID NO: 2707238 - DNA, 23 bp, Homo sapiens
aatcacaagaacaaatacacttt

SEQ ID NO: 2707239 - DNA, 22 bp, Homo sapiens
aatcatattaattattttccaa

SEQ ID NO: 2707240 - DNA, 18 bp, Homo sapiens
aatccacaagccattttt

SEQ ID NO: 2707241 - DNA, 15 bp, Homo sapiens
aatccatgtgctgct

SEQ ID NO: 2707242 - DNA, 21 bp, Homo sapiens
aatcccaattatttattttaa

SEQ ID NO: 2707243 - DNA, 23 bp, Homo sapiens
aatccctggttttaagtatcaat

SEQ ID NO: 2707244 - DNA, 21 bp, Homo sapiens
aatcctgaggctggtagcaga

SEQ ID NO: 2707245 - DNA, 19 bp, Homo sapiens
aatcctggtttgtaatgtt

SEQ ID NO: 2707246 - DNA, 11 bp, Homo sapiens
aatctgcaggg

SEQ ID NO: 2707247 - DNA, 23 bp, Homo sapiens
aatctgcagggagcaactctcca

SEQ ID NO: 2707248 - DNA, 18 bp, Homo sapiens
aatctggcaaagttatat

SEQ ID NO: 2707249 - DNA, 15 bp, Homo sapiens
aatctgttgtttgaa

SEQ ID NO: 2707250 - DNA, 19 bp, Homo sapiens
aatctgttgtttgaagaac

SEQ ID NO: 2707251 - DNA, 20 bp, Homo sapiens
aatctgtttgtttggcactg

SEQ ID NO: 2707252 - DNA, 11 bp, Homo sapiens
aatcttcagct

SEQ ID NO: 2707253 - DNA, 13 bp, Homo sapiens
aatcttcagctgg

SEQ ID NO: 2707254 - DNA, 20 bp, Homo sapiens
aatcttggtttggtacagtt

SEQ ID NO: 2707255 - DNA, 14 bp, Homo sapiens
aatctttaatggtt

SEQ ID NO: 2707256 - DNA, 22 bp, Homo sapiens
aatcttttaaaaatgatgataa

SEQ ID NO: 2707257 - DNA, 19 bp, Homo sapiens
aatgaaccgtttacagtgt

SEQ ID NO: 2707258 - DNA, 15 bp, Homo sapiens
aatgaagcaaacaca

SEQ ID NO: 2707259 - DNA, 18 bp, Homo sapiens
aatgaagcaaacacacag

SEQ ID NO: 2707260 - DNA, 21 bp, Homo sapiens
aatgaagcaatttatatcttt

SEQ ID NO: 2707261 - DNA, 12 bp, Homo sapiens
aatgaagcatgt

SEQ ID NO: 2707262 - DNA, 15 bp, Homo sapiens
aatgaagcatgtagc

SEQ ID NO: 2707263 - DNA, 23 bp, Homo sapiens
aatgacacactgcggtgtctgca

SEQ ID NO: 2707264 - DNA, 20 bp, Homo sapiens
acctccagtcctgctggcct

SEQ ID NO: 2707265 - DNA, 21 bp, Homo sapiens
acctcctatccttggagagca

SEQ ID NO: 2707266 - DNA, 12 bp, Homo sapiens
acctcctgggtt

SEQ ID NO: 2707267 - DNA, 23 bp, Homo sapiens
acctcgtgatatccacaaatgct

SEQ ID NO: 2707268 - DNA, 15 bp, Homo sapiens
acctctgaatgtccc

SEQ ID NO: 2707269 - DNA, 21 bp, Homo sapiens
acctctgaatgtcccagaggc

SEQ ID NO: 2707270 - DNA, 21 bp, Homo sapiens
acctcttcggttgtcttgaaa

SEQ ID NO: 2707271 - DNA, 23 bp, Homo sapiens
acctgattgtattttttttttaa

SEQ ID NO: 2707272 - DNA, 16 bp, Homo sapiens
acctgcaagatttcac

SEQ ID NO: 2707273 - DNA, 17 bp, Homo sapiens
acctgcaggttgggcca

SEQ ID NO: 2707274 - DNA, 15 bp, Homo sapiens
acctgcatatctcta

SEQ ID NO: 2707275 - DNA, 19 bp, Homo sapiens
acctgcctagctcttgggc

SEQ ID NO: 2707276 - DNA, 22 bp, Homo sapiens
acctgcctagctcttgggcctg

SEQ ID NO: 2707277 - DNA, 19 bp, Homo sapiens
acctgcctgttctccagat

SEQ ID NO: 2707278 - DNA, 15 bp, Homo sapiens
acctggactagggcc

SEQ ID NO: 2707279 - DNA, 19 bp, Homo sapiens
acctggtactgcacatttt

SEQ ID NO: 2707280 - DNA, 16 bp, Homo sapiens
acctgtccataaagta

SEQ ID NO: 2707281 - DNA, 21 bp, Homo sapiens
acctgtccttactcagagctg

SEQ ID NO: 2707282 - DNA, 22 bp, Homo sapiens
acctgtccttactcagagctgc

SEQ ID NO: 2707283 - DNA, 12 bp, Homo sapiens
acctgtgtctta

SEQ ID NO: 2707284 - DNA, 13 bp, Homo sapiens
acctgtttttaac

SEQ ID NO: 2707285 - DNA, 16 bp, Homo sapiens
acctgtttttaacatg

SEQ ID NO: 2707286 - DNA, 17 bp, Homo sapiens
accttcaattcctgggc

SEQ ID NO: 2707287 - DNA, 18 bp, Homo sapiens
accttcaattcctgggcc

SEQ ID NO: 2707288 - DNA, 20 bp, Homo sapiens
accttctaatccatgtgctg

SEQ ID NO: 2707289 - DNA, 20 bp, Homo sapiens
accttctccagggacagaag

SEQ ID NO: 2707290 - DNA, 16 bp, Homo sapiens
acctttcccatttcgt

SEQ ID NO: 2707291 - DNA, 20 bp, Homo sapiens
accttttttatgatgctatt

SEQ ID NO: 2707292 - DNA, 23 bp, Homo sapiens
acgacctggggtgggcacaggga

SEQ ID NO: 2707293 - DNA, 11 bp, Homo sapiens
acgactcttcc

SEQ ID NO: 2707294 - DNA, 13 bp, Homo sapiens
acgactcttcctg

SEQ ID NO: 2707295 - DNA, 21 bp, Homo sapiens
acgatcttgctggcagggcct

SEQ ID NO: 2707296 - DNA, 18 bp, Homo sapiens
acgcccagctgaggctgg

SEQ ID NO: 2707297 - DNA, 15 bp, Homo sapiens
acgctctaccctgca

SEQ ID NO: 2707298 - DNA, 17 bp, Homo sapiens
acgctctaccctgcagc

SEQ ID NO: 2707299 - DNA, 13 bp, Homo sapiens
acgctctggacat

SEQ ID NO: 2707300 - DNA, 20 bp, Homo sapiens
acgctgtgattggcaggagg

SEQ ID NO: 2707301 - DNA, 15 bp, Homo sapiens
acggactcagactcc

SEQ ID NO: 2707302 - DNA, 18 bp, Homo sapiens
acggactcagactcctgg

SEQ ID NO: 2707303 - DNA, 20 bp, Homo sapiens
acggactcagactcctggct

SEQ ID NO: 2707304 - DNA, 14 bp, Homo sapiens
acggcaacagcatg

SEQ ID NO: 2707305 - DNA, 13 bp, Homo sapiens
acggcactccagc

SEQ ID NO: 2707306 - DNA, 20 bp, Homo sapiens
acggcactccagcctgggcg

SEQ ID NO: 2707307 - DNA, 20 bp, Homo sapiens
acggcccatcttggcaaggt

SEQ ID NO: 2707308 - DNA, 14 bp, Homo sapiens
acgggctgccctgc

SEQ ID NO: 2707309 - DNA, 14 bp, Homo sapiens
acggtcttctgcat

SEQ ID NO: 2707310 - DNA, 16 bp, Homo sapiens
acggtgagactctgag

SEQ ID NO: 2707311 - DNA, 19 bp, Homo sapiens
acgtcaccctcctgagcct

SEQ ID NO: 2707312 - DNA, 21 bp, Homo sapiens
acgtcctggaatgaagcatgt

SEQ ID NO: 2707313 - DNA, 18 bp, Homo sapiens
acgtcctgtcagtgccgc

SEQ ID NO: 2707314 - DNA, 19 bp, Homo sapiens
acgtctctctgcctgctgg

SEQ ID NO: 2707315 - DNA, 21 bp, Homo sapiens
acgtctctctgcctgctgggc

SEQ ID NO: 2707316 - DNA, 12 bp, Homo sapiens
acgtgcacagct

SEQ ID NO: 2707317 - DNA, 14 bp, Homo sapiens
acgtttatttaaaa

SEQ ID NO: 2707318 - DNA, 16 bp, Homo sapiens
actaaataaactactt

SEQ ID NO: 2707319 - DNA, 23 bp, Homo sapiens
actaaattagtttaaaatgaagc

SEQ ID NO: 2707320 - DNA, 18 bp, Homo sapiens
actaagctttctcctttg

SEQ ID NO: 2707321 - DNA, 19 bp, Homo sapiens
actaagtcatggtcctggc

SEQ ID NO: 2707322 - DNA, 21 bp, Homo sapiens
actaatgcttgccaagaaatc

SEQ ID NO: 2707323 - DNA, 19 bp, Homo sapiens
actacacacccccaagcca

SEQ ID NO: 2707324 - DNA, 19 bp, Homo sapiens
actacactccagcctgagc

SEQ ID NO: 2707325 - DNA, 13 bp, Homo sapiens
actactttgaata

SEQ ID NO: 2707326 - DNA, 17 bp, Homo sapiens
actagaactgaattttg

SEQ ID NO: 2707327 - DNA, 18 bp, Homo sapiens
actagaactgaattttgt

SEQ ID NO: 2707328 - DNA, 19 bp, Homo sapiens
actagaactgaattttgtc

SEQ ID NO: 2707329 - DNA, 23 bp, Homo sapiens
actagaactgaattttgtcttta

SEQ ID NO: 2707330 - DNA, 15 bp, Homo sapiens
actagggcctcggag

SEQ ID NO: 2707331 - DNA, 23 bp, Homo sapiens
actagggcctcggaggctcctcc

SEQ ID NO: 2707332 - DNA, 22 bp, Homo sapiens
actagggtcctggccctcttct

SEQ ID NO: 2707333 - DNA, 16 bp, Homo sapiens
actatatttatttatg

SEQ ID NO: 2707334 - DNA, 18 bp, Homo sapiens
actatgcgtttttataaa

SEQ ID NO: 2707335 - DNA, 17 bp, Homo sapiens
actatgtaatgcttatg

SEQ ID NO: 2707336 - DNA, 20 bp, Homo sapiens
actcaagacttccagagcct

SEQ ID NO: 2707337 - DNA, 13 bp, Homo sapiens
actcaaggcctcc

SEQ ID NO: 2707338 - DNA, 15 bp, Homo sapiens
actcagaagcctgag

SEQ ID NO: 2707339 - DNA, 16 bp, Homo sapiens
actcagaagcctgagg

SEQ ID NO: 2707340 - DNA, 17 bp, Homo sapiens
actcagactcctggctt

SEQ ID NO: 2707341 - DNA, 12 bp, Homo sapiens
actcagagctgc

SEQ ID NO: 2707342 - DNA, 18 bp, Homo sapiens
actcagagctgcgggctg

SEQ ID NO: 2707343 - DNA, 20 bp, Homo sapiens
actcagagctgcgggctgag

SEQ ID NO: 2707344 - DNA, 17 bp, Homo sapiens
actcaggaggctgaggg

SEQ ID NO: 2707345 - DNA, 19 bp, Homo sapiens
actcagtgaaatcatatta

SEQ ID NO: 2707346 - DNA, 23 bp, Homo sapiens
actcatgactgagtctggcaaac

SEQ ID NO: 2707347 - DNA, 22 bp, Homo sapiens
actccagcacgttttctggctt

SEQ ID NO: 2707348 - DNA, 15 bp, Homo sapiens
actccagcctgagca

SEQ ID NO: 2707349 - DNA, 12 bp, Homo sapiens
actccagcctgg

SEQ ID NO: 2707350 - DNA, 21 bp, Homo sapiens
actccagcctgggcgacagag

SEQ ID NO: 2707351 - DNA, 15 bp, Homo sapiens
actccattattttat

SEQ ID NO: 2707352 - DNA, 21 bp, Homo sapiens
actccattattttattttata

SEQ ID NO: 2707353 - DNA, 13 bp, Homo sapiens
actcccactccta

SEQ ID NO: 2707354 - DNA, 14 bp, Homo sapiens
actcccactcctaa

SEQ ID NO: 2707355 - DNA, 14 bp, Homo sapiens
actcccacttccct

SEQ ID NO: 2707356 - DNA, 16 bp, Homo sapiens
actcccacttccctga

SEQ ID NO: 2707357 - DNA, 20 bp, Homo sapiens
actccccagggcctccagga

SEQ ID NO: 2707358 - DNA, 16 bp, Homo sapiens
actccccccttccaaa

SEQ ID NO: 2707359 - DNA, 23 bp, Homo sapiens
actcccggaggtgtcaccttcct

SEQ ID NO: 2707360 - DNA, 10 bp, Homo sapiens
actccctcct

SEQ ID NO: 2707361 - DNA, 21 bp, Homo sapiens
actccctcctcacactccaga

SEQ ID NO: 2707362 - DNA, 15 bp, Homo sapiens
actccggtgtgcctg

SEQ ID NO: 2707363 - DNA, 21 bp, Homo sapiens
actccggtgtgcctgcagccc

SEQ ID NO: 2707364 - DNA, 23 bp, Homo sapiens
actcctaatcaagagtctctcca

SEQ ID NO: 2707365 - DNA, 15 bp, Homo sapiens
actcctacctcagcc

SEQ ID NO: 2707366 - DNA, 14 bp, Homo sapiens
actcctactgcttc

SEQ ID NO: 2707367 - DNA, 22 bp, Homo sapiens
actcctactgcttcctctgaat

SEQ ID NO: 2707368 - DNA, 14 bp, Homo sapiens
actcctcacagcat

SEQ ID NO: 2707369 - DNA, 21 bp, Homo sapiens
actcctcacagcatctctatg

SEQ ID NO: 2707370 - DNA, 13 bp, Homo sapiens
actcctcctgcca

SEQ ID NO: 2707371 - DNA, 19 bp, Homo sapiens
actcctcctgccagctctg

SEQ ID NO: 2707372 - DNA, 21 bp, Homo sapiens
actcctcctgccagctctgtc

SEQ ID NO: 2707373 - DNA, 18 bp, Homo sapiens
actcctcggtactcccat

SEQ ID NO: 2707374 - DNA, 11 bp, Homo sapiens
actcctggctt

SEQ ID NO: 2707375 - DNA, 22 bp, Homo sapiens
actccttccccttgtccctggg

SEQ ID NO: 2707376 - DNA, 14 bp, Homo sapiens
actcgggctcctgt

SEQ ID NO: 2707377 - DNA, 18 bp, Homo sapiens
actcgggctcctgtgccc

SEQ ID NO: 2707378 - DNA, 19 bp, Homo sapiens
actcgggctcctgtgccct

SEQ ID NO: 2707379 - DNA, 21 bp, Homo sapiens
actctacctgcaagatttcac

SEQ ID NO: 2707380 - DNA, 16 bp, Homo sapiens
actctagtgacttcct

SEQ ID NO: 2707381 - DNA, 22 bp, Homo sapiens
actctagtgacttcctggtgag

SEQ ID NO: 2707382 - DNA, 17 bp, Homo sapiens
actctctctctgttaaa

SEQ ID NO: 2707383 - DNA, 14 bp, Homo sapiens
actctctgcctgct

SEQ ID NO: 2707384 - DNA, 16 bp, Homo sapiens
actctctgcctgcttc

SEQ ID NO: 2707385 - DNA, 23 bp, Homo sapiens
actctgaggctctttctgggcca

SEQ ID NO: 2707386 - DNA, 20 bp, Homo sapiens
actctgcagatagtgcctct

SEQ ID NO: 2707387 - DNA, 14 bp, Homo sapiens
aggggaagctgcta

SEQ ID NO: 2707388 - DNA, 15 bp, Homo sapiens
aggggactgggccat

SEQ ID NO: 2707389 - DNA, 19 bp, Homo sapiens
aggggactggtgatgggac

SEQ ID NO: 2707390 - DNA, 19 bp, Homo sapiens
aggggcaaagaactgcccc

SEQ ID NO: 2707391 - DNA, 20 bp, Homo sapiens
aggggcaccctccaaacact

SEQ ID NO: 2707392 - DNA, 15 bp, Homo sapiens
aggggcaggccctgc

SEQ ID NO: 2707393 - DNA, 20 bp, Homo sapiens
aggggcccgcttgcctcggc

SEQ ID NO: 2707394 - DNA, 21 bp, Homo sapiens
aggggcccgttgtctccctgg

SEQ ID NO: 2707395 - DNA, 20 bp, Homo sapiens
aggggcgtgtgttccccagc

SEQ ID NO: 2707396 - DNA, 13 bp, Homo sapiens
aggggctgcccgc

SEQ ID NO: 2707397 - DNA, 12 bp, Homo sapiens
aggggctgctgg

SEQ ID NO: 2707398 - DNA, 14 bp, Homo sapiens
aggggctgctgggg

SEQ ID NO: 2707399 - DNA, 23 bp, Homo sapiens
aggggctgctgggggctcccctt

SEQ ID NO: 2707400 - DNA, 14 bp, Homo sapiens
aggggctttctgga

SEQ ID NO: 2707401 - DNA, 20 bp, Homo sapiens
aggggtgggttcctcttccc

SEQ ID NO: 2707402 - DNA, 20 bp, Homo sapiens
agggtcccagcctggccacc

SEQ ID NO: 2707403 - DNA, 13 bp, Homo sapiens
agggtcttgctgt

SEQ ID NO: 2707404 - DNA, 16 bp, Homo sapiens
agggtgggagagccca

SEQ ID NO: 2707405 - DNA, 17 bp, Homo sapiens
agggtgggagagcccag

SEQ ID NO: 2707406 - DNA, 19 bp, Homo sapiens
agggtgggagagcccagcc

SEQ ID NO: 2707407 - DNA, 18 bp, Homo sapiens
agggttttccaccctgga

SEQ ID NO: 2707408 - DNA, 18 bp, Homo sapiens
aggtaatttttttttgta

SEQ ID NO: 2707409 - DNA, 20 bp, Homo sapiens
aggtaatttttttttgtaaa

SEQ ID NO: 2707410 - DNA, 19 bp, Homo sapiens
aggtactgaaggcttctgc

SEQ ID NO: 2707411 - DNA, 15 bp, Homo sapiens
aggtagcgagctgct

SEQ ID NO: 2707412 - DNA, 21 bp, Homo sapiens
aggtagcgagctgctctgcta

SEQ ID NO: 2707413 - DNA, 14 bp, Homo sapiens
aggtaggttttaaa

SEQ ID NO: 2707414 - DNA, 16 bp, Homo sapiens
aggtaggttttaaaaa

SEQ ID NO: 2707415 - DNA, 16 bp, Homo sapiens
aggtatatcaggaggg

SEQ ID NO: 2707416 - DNA, 11 bp, Homo sapiens
aggtcccctca

SEQ ID NO: 2707417 - DNA, 12 bp, Homo sapiens
aggtcccctcac

SEQ ID NO: 2707418 - DNA, 22 bp, Homo sapiens
aggtccttggagtgctgcagct

SEQ ID NO: 2707419 - DNA, 17 bp, Homo sapiens
aggtctcacactcctcc

SEQ ID NO: 2707420 - DNA, 20 bp, Homo sapiens
aggtctcacactcctcctgc

SEQ ID NO: 2707421 - DNA, 22 bp, Homo sapiens
aggtctcacactcctcctgcca

SEQ ID NO: 2707422 - DNA, 19 bp, Homo sapiens
aggtctcccctgatccaga

SEQ ID NO: 2707423 - DNA, 19 bp, Homo sapiens
aggtctcgctgatgctggg

SEQ ID NO: 2707424 - DNA, 19 bp, Homo sapiens
aggtgacttgcctggggcc

SEQ ID NO: 2707425 - DNA, 11 bp, Homo sapiens
aggtgcagtgg

SEQ ID NO: 2707426 - DNA, 22 bp, Homo sapiens
aggtgcatgccttcataaatta

SEQ ID NO: 2707427 - DNA, 22 bp, Homo sapiens
aggtgctgctaccctccctgct

SEQ ID NO: 2707428 - DNA, 14 bp, Homo sapiens
aggtggcagccctg

SEQ ID NO: 2707429 - DNA, 16 bp, Homo sapiens
aggtgggcgggcagca

SEQ ID NO: 2707430 - DNA, 18 bp, Homo sapiens
aggtgggcgggcagcaca

SEQ ID NO: 2707431 - DNA, 16 bp, Homo sapiens
aggtgggctgagccct

SEQ ID NO: 2707432 - DNA, 21 bp, Homo sapiens
aggtggtctgctcgggcccag

SEQ ID NO: 2707433 - DNA, 15 bp, Homo sapiens
aggtgtcaccctgca

SEQ ID NO: 2707434 - DNA, 17 bp, Homo sapiens
aggtgtcaccctgcaga

SEQ ID NO: 2707435 - DNA, 14 bp, Homo sapiens
aggttctgcactcc

SEQ ID NO: 2707436 - DNA, 21 bp, Homo sapiens
aggttctgcactcctggaacc

SEQ ID NO: 2707437 - DNA, 20 bp, Homo sapiens
aggttgaggggctcctggaa

SEQ ID NO: 2707438 - DNA, 23 bp, Homo sapiens
aggttggaaaagaaatcaatttt

SEQ ID NO: 2707439 - DNA, 21 bp, Homo sapiens
aggttgggccatactggcctc

SEQ ID NO: 2707440 - DNA, 22 bp, Homo sapiens
aggttgggccatactggcctcg

SEQ ID NO: 2707441 - DNA, 20 bp, Homo sapiens
aggtttcccagtgagcctct

SEQ ID NO: 2707442 - DNA, 21 bp, Homo sapiens
aggtttcccagtgagcctctg

SEQ ID NO: 2707443 - DNA, 14 bp, Homo sapiens
aggtttcttgcttc

SEQ ID NO: 2707444 - DNA, 20 bp, Homo sapiens
aggtttggagccgggaaagc

SEQ ID NO: 2707445 - DNA, 21 bp, Homo sapiens
aggttttaaaaataagtttta

SEQ ID NO: 2707446 - DNA, 12 bp, Homo sapiens
agtaaactttct

SEQ ID NO: 2707447 - DNA, 14 bp, Homo sapiens
agtaaataaattgt

SEQ ID NO: 2707448 - DNA, 18 bp, Homo sapiens
agtaaataaattgtttga

SEQ ID NO: 2707449 - DNA, 14 bp, Homo sapiens
agtaatatgaaagc

SEQ ID NO: 2707450 - DNA, 19 bp, Homo sapiens
agtacattcatctggaggc

SEQ ID NO: 2707451 - DNA, 21 bp, Homo sapiens
agtacattcatctggaggctg

SEQ ID NO: 2707452 - DNA, 20 bp, Homo sapiens
agtaccaaatccacaagcca

SEQ ID NO: 2707453 - DNA, 18 bp, Homo sapiens
agtacctgattgtatttt

SEQ ID NO: 2707454 - DNA, 14 bp, Homo sapiens
agtactatctttgt

SEQ ID NO: 2707455 - DNA, 20 bp, Homo sapiens
agtactatctttgtctaaac

SEQ ID NO: 2707456 - DNA, 13 bp, Homo sapiens
agtactttgtgct

SEQ ID NO: 2707457 - DNA, 19 bp, Homo sapiens
agtagaagcctgcagcggc

SEQ ID NO: 2707458 - DNA, 23 bp, Homo sapiens
agtagcagtgattgttatgcctt

SEQ ID NO: 2707459 - DNA, 15 bp, Homo sapiens
agtagtagtgtcttc

SEQ ID NO: 2707460 - DNA, 13 bp, Homo sapiens
agtagttccagga

SEQ ID NO: 2707461 - DNA, 13 bp, Homo sapiens
agtataacaaact

SEQ ID NO: 2707462 - DNA, 13 bp, Homo sapiens
agtatatattcta

SEQ ID NO: 2707463 - DNA, 17 bp, Homo sapiens
agtatttttgaaagaat

SEQ ID NO: 2707464 - DNA, 19 bp, Homo sapiens
agtcaaagcggatgctggc

SEQ ID NO: 2707465 - DNA, 23 bp, Homo sapiens
agtcaatatggggcattaatatt

SEQ ID NO: 2707466 - DNA, 16 bp, Homo sapiens
agtcaatcaaacaggg

SEQ ID NO: 2707467 - DNA, 15 bp, Homo sapiens
agtcacccctctgtc

SEQ ID NO: 2707468 - DNA, 21 bp, Homo sapiens
agtcacccctctgtccagcca

SEQ ID NO: 2707469 - DNA, 23 bp, Homo sapiens
agtcacccctctgtccagccagc

SEQ ID NO: 2707470 - DNA, 14 bp, Homo sapiens
agtcaccctgtgac

SEQ ID NO: 2707471 - DNA, 14 bp, Homo sapiens
agtcagatttgtat

SEQ ID NO: 2707472 - DNA, 12 bp, Homo sapiens
agtcatggtcct

SEQ ID NO: 2707473 - DNA, 17 bp, Homo sapiens
agtcattgtaacctcgt

SEQ ID NO: 2707474 - DNA, 18 bp, Homo sapiens
agtccaaattgtctgtct

SEQ ID NO: 2707475 - DNA, 23 bp, Homo sapiens
agtccaaattgtctgtctgctct

SEQ ID NO: 2707476 - DNA, 18 bp, Homo sapiens
agtccaacctgcctgtgc

SEQ ID NO: 2707477 - DNA, 16 bp, Homo sapiens
agtccacagtggaacc

SEQ ID NO: 2707478 - DNA, 20 bp, Homo sapiens
agtccagtcaagttccctcc

SEQ ID NO: 2707479 - DNA, 22 bp, Homo sapiens
agtccagtcctttgttgctgtt

SEQ ID NO: 2707480 - DNA, 12 bp, Homo sapiens
agtcctagagct

SEQ ID NO: 2707481 - DNA, 18 bp, Homo sapiens
agtcctagagctcctgtc

SEQ ID NO: 2707482 - DNA, 20 bp, Homo sapiens
agtcctagagctcctgtccc

SEQ ID NO: 2707483 - DNA, 17 bp, Homo sapiens
agtcctcgtagccatct

SEQ ID NO: 2707484 - DNA, 17 bp, Homo sapiens
agtcctgctggcctgct

SEQ ID NO: 2707485 - DNA, 19 bp, Homo sapiens
agtcctgctggcctgctct

SEQ ID NO: 2707486 - DNA, 20 bp, Homo sapiens
agtcctgctggcctgctctt

SEQ ID NO: 2707487 - DNA, 15 bp, Homo sapiens
agtcctttgttgctg

SEQ ID NO: 2707488 - DNA, 20 bp, Homo sapiens
agtcctttgttgctgttgct

SEQ ID NO: 2707489 - DNA, 13 bp, Homo sapiens
agtcgcgctgcct

SEQ ID NO: 2707490 - DNA, 14 bp, Homo sapiens
agtcgcgctgcctg

SEQ ID NO: 2707491 - DNA, 18 bp, Homo sapiens
agtcgcgctgcctgtgtg

SEQ ID NO: 2707492 - DNA, 19 bp, Homo sapiens
agtctcaaatcaaatacat

SEQ ID NO: 2707493 - DNA, 22 bp, Homo sapiens
agtctccaacatgtttctgttt

SEQ ID NO: 2707494 - DNA, 14 bp, Homo sapiens
agtctcctgtatca

SEQ ID NO: 2707495 - DNA, 13 bp, Homo sapiens
agtctcgctctgc

SEQ ID NO: 2707496 - DNA, 13 bp, Homo sapiens
agtctctccagcc

SEQ ID NO: 2707497 - DNA, 16 bp, Homo sapiens
agtctctccagcctca

SEQ ID NO: 2707498 - DNA, 17 bp, Homo sapiens
agtctctccagcctcac

SEQ ID NO: 2707499 - DNA, 14 bp, Homo sapiens
agtctctggctcag

SEQ ID NO: 2707500 - DNA, 21 bp, Homo sapiens
agtctctggctcagctgtggt

SEQ ID NO: 2707501 - DNA, 14 bp, Homo sapiens
agtctctgttgtaa

SEQ ID NO: 2707502 - DNA, 14 bp, Homo sapiens
agtctcttctcaga

SEQ ID NO: 2707503 - DNA, 22 bp, Homo sapiens
agtctgaggccccaggccctag

SEQ ID NO: 2707504 - DNA, 17 bp, Homo sapiens
agtctggcaaacatgtg

SEQ ID NO: 2707505 - DNA, 20 bp, Homo sapiens
agtctggcaaacatgtgcaa

SEQ ID NO: 2707506 - DNA, 14 bp, Homo sapiens
agtgaaaaatgaga

SEQ ID NO: 2707507 - DNA, 13 bp, Homo sapiens
agtgaataaactt

SEQ ID NO: 2707508 - DNA, 14 bp, Homo sapiens
agtgaataaacttc

SEQ ID NO: 2707509 - DNA, 19 bp, Homo sapiens
agtgaataaacttcagcac

SEQ ID NO: 2707510 - DNA, 20 bp, Homo sapiens
agtgaatgagtttccagcta

SEQ ID NO: 2707511 - DNA, 21 bp, Homo sapiens
atggctgggggagggactgct

SEQ ID NO: 2707512 - DNA, 20 bp, Homo sapiens
atggcttacttacaaaagca

SEQ ID NO: 2707513 - DNA, 21 bp, Homo sapiens
atggcttacttacaaaagcag

SEQ ID NO: 2707514 - DNA, 16 bp, Homo sapiens
atggcttccaaggtgg

SEQ ID NO: 2707515 - DNA, 21 bp, Homo sapiens
atggcttccaaggtggtctgc

SEQ ID NO: 2707516 - DNA, 16 bp, Homo sapiens
atggcttttctcttgc

SEQ ID NO: 2707517 - DNA, 22 bp, Homo sapiens
atgggaaagtatttttgaaaga

SEQ ID NO: 2707518 - DNA, 12 bp, Homo sapiens
atgggaagccat

SEQ ID NO: 2707519 - DNA, 22 bp, Homo sapiens
atgggcactgctgggtggccca

SEQ ID NO: 2707520 - DNA, 23 bp, Homo sapiens
atgggcactgctgggtggcccat

SEQ ID NO: 2707521 - DNA, 13 bp, Homo sapiens
atgggcgaccagg

SEQ ID NO: 2707522 - DNA, 19 bp, Homo sapiens
atgggtcctcggcccatct

SEQ ID NO: 2707523 - DNA, 12 bp, Homo sapiens
atggtcctggct

SEQ ID NO: 2707524 - DNA, 12 bp, Homo sapiens
atggtcctgggg

SEQ ID NO: 2707525 - DNA, 14 bp, Homo sapiens
atggtcctggggct

SEQ ID NO: 2707526 - DNA, 17 bp, Homo sapiens
atggtcctggggctctg

SEQ ID NO: 2707527 - DNA, 19 bp, Homo sapiens
atggtcctggggctctgtg

SEQ ID NO: 2707528 - DNA, 23 bp, Homo sapiens
atggtctgcatcagctttttgta

SEQ ID NO: 2707529 - DNA, 18 bp, Homo sapiens
atggtcttgatctcctga

SEQ ID NO: 2707530 - DNA, 22 bp, Homo sapiens
atggtgcctgattcggctgtct

SEQ ID NO: 2707531 - DNA, 20 bp, Homo sapiens
atggtgctcacgactcttcc

SEQ ID NO: 2707532 - DNA, 17 bp, Homo sapiens
atggtgtgtgtctctga

SEQ ID NO: 2707533 - DNA, 18 bp, Homo sapiens
atggtgtgtgtctctgac

SEQ ID NO: 2707534 - DNA, 18 bp, Homo sapiens
atggttgattcacacttg

SEQ ID NO: 2707535 - DNA, 13 bp, Homo sapiens
atgtaaaatcttc

SEQ ID NO: 2707536 - DNA, 19 bp, Homo sapiens
atgtaaaatcttcagctgg

SEQ ID NO: 2707537 - DNA, 20 bp, Homo sapiens
atgtaaaatcttcagctggt

SEQ ID NO: 2707538 - DNA, 21 bp, Homo sapiens
atgtaatgcttatgtgttgca

SEQ ID NO: 2707539 - DNA, 15 bp, Homo sapiens
atgtaatttttaaag

SEQ ID NO: 2707540 - DNA, 18 bp, Homo sapiens
atgtaatttttaaagcaa

SEQ ID NO: 2707541 - DNA, 17 bp, Homo sapiens
atgtacaaggtatgtac

SEQ ID NO: 2707542 - DNA, 13 bp, Homo sapiens
atgtatatctata

SEQ ID NO: 2707543 - DNA, 19 bp, Homo sapiens
atgtatatctatatctcta

SEQ ID NO: 2707544 - DNA, 20 bp, Homo sapiens
atgtatatctatatctctaa

SEQ ID NO: 2707545 - DNA, 14 bp, Homo sapiens
atgtatatgtatat

SEQ ID NO: 2707546 - DNA, 17 bp, Homo sapiens
atgtatatgtatatcta

SEQ ID NO: 2707547 - DNA, 18 bp, Homo sapiens
atgtatatgtatatctat

SEQ ID NO: 2707548 - DNA, 20 bp, Homo sapiens
atgtatggcttttctcttgc

SEQ ID NO: 2707549 - DNA, 18 bp, Homo sapiens
atgtatgtgccaattttg

SEQ ID NO: 2707550 - DNA, 17 bp, Homo sapiens
atgtatgtggatacagt

SEQ ID NO: 2707551 - DNA, 21 bp, Homo sapiens
atgtatgtggatacagtcatt

SEQ ID NO: 2707552 - DNA, 16 bp, Homo sapiens
atgtcaagtaccaaaa

SEQ ID NO: 2707553 - DNA, 13 bp, Homo sapiens
atgtcagccttgc

SEQ ID NO: 2707554 - DNA, 14 bp, Homo sapiens
atgtcatgtgccac

SEQ ID NO: 2707555 - DNA, 16 bp, Homo sapiens
atgtcattatttgata

SEQ ID NO: 2707556 - DNA, 23 bp, Homo sapiens
atgtccaagtccaacctgcctgt

SEQ ID NO: 2707557 - DNA, 22 bp, Homo sapiens
atgtcctccaacaataaagagc

SEQ ID NO: 2707558 - DNA, 17 bp, Homo sapiens
atgtcctttctccagtg

SEQ ID NO: 2707559 - DNA, 18 bp, Homo sapiens
atgtctgtctttgcaaag

SEQ ID NO: 2707560 - DNA, 19 bp, Homo sapiens
atgtctttggcttcagaat

SEQ ID NO: 2707561 - DNA, 12 bp, Homo sapiens
atgtgaaaatga

SEQ ID NO: 2707562 - DNA, 16 bp, Homo sapiens
atgtgacaacattttt

SEQ ID NO: 2707563 - DNA, 15 bp, Homo sapiens
atgtgatcatctttg

SEQ ID NO: 2707564 - DNA, 19 bp, Homo sapiens
atgtgcacctatggcccag

SEQ ID NO: 2707565 - DNA, 22 bp, Homo sapiens
atgtgcatggaaatgtcctcca

SEQ ID NO: 2707566 - DNA, 20 bp, Homo sapiens
atgtgccaattttgtcacag

SEQ ID NO: 2707567 - DNA, 17 bp, Homo sapiens
atgtgctcccaccaggc

SEQ ID NO: 2707568 - DNA, 20 bp, Homo sapiens
atgtgctcccaccaggcagc

SEQ ID NO: 2707569 - DNA, 14 bp, Homo sapiens
atgtgctgctgtgg

SEQ ID NO: 2707570 - DNA, 18 bp, Homo sapiens
atgtggatacagtcatta

SEQ ID NO: 2707571 - DNA, 20 bp, Homo sapiens
atgtggcattctctctgctc

SEQ ID NO: 2707572 - DNA, 23 bp, Homo sapiens
atgtggcattctctctgctcagt

SEQ ID NO: 2707573 - DNA, 15 bp, Homo sapiens
atgtgggctcagatc

SEQ ID NO: 2707574 - DNA, 18 bp, Homo sapiens
atgtgggttgtgatattg

SEQ ID NO: 2707575 - DNA, 19 bp, Homo sapiens
atgtgtatgagaagtactt

SEQ ID NO: 2707576 - DNA, 22 bp, Homo sapiens
atgtgtcccagtgaacagtttg

SEQ ID NO: 2707577 - DNA, 19 bp, Homo sapiens
atgttaaatgccttggttt

SEQ ID NO: 2707578 - DNA, 18 bp, Homo sapiens
atgttaatatctgatact

SEQ ID NO: 2707579 - DNA, 15 bp, Homo sapiens
atgttattgcataat

SEQ ID NO: 2707580 - DNA, 16 bp, Homo sapiens
atgttattggaatttt

SEQ ID NO: 2707581 - DNA, 23 bp, Homo sapiens
atgttattggaattttctttcat

SEQ ID NO: 2707582 - DNA, 20 bp, Homo sapiens
atgttcagaattttggaaaa

SEQ ID NO: 2707583 - DNA, 19 bp, Homo sapiens
atgttccaataaaacttta

SEQ ID NO: 2707584 - DNA, 14 bp, Homo sapiens
atgttgcactgaaa

SEQ ID NO: 2707585 - DNA, 20 bp, Homo sapiens
atgttggtgcaattaactct

SEQ ID NO: 2707586 - DNA, 14 bp, Homo sapiens
atgtttaattcatt

SEQ ID NO: 2707587 - DNA, 17 bp, Homo sapiens
attaaaaaaacacaaaa

SEQ ID NO: 2707588 - DNA, 19 bp, Homo sapiens
attaaaaagaataaacaca

SEQ ID NO: 2707589 - DNA, 21 bp, Homo sapiens
attaaaatctggcaaagttat

SEQ ID NO: 2707590 - DNA, 23 bp, Homo sapiens
attaaaatctggcaaagttatat

SEQ ID NO: 2707591 - DNA, 15 bp, Homo sapiens
attaaatgacttttt

SEQ ID NO: 2707592 - DNA, 18 bp, Homo sapiens
attaacaaagttactggc

SEQ ID NO: 2707593 - DNA, 19 bp, Homo sapiens
attaacaaagttactggct

SEQ ID NO: 2707594 - DNA, 23 bp, Homo sapiens
attaactctggacctctcttgtg

SEQ ID NO: 2707595 - DNA, 11 bp, Homo sapiens
attaagaaact

SEQ ID NO: 2707596 - DNA, 18 bp, Homo sapiens
attaatattcttttgtta

SEQ ID NO: 2707597 - DNA, 14 bp, Homo sapiens
attaatctgtttgt

SEQ ID NO: 2707598 - DNA, 16 bp, Homo sapiens
attaattattttccaa

SEQ ID NO: 2707599 - DNA, 17 bp, Homo sapiens
attaattattttccaaa

SEQ ID NO: 2707600 - DNA, 16 bp, Homo sapiens
attacaataaatcctt

SEQ ID NO: 2707601 - DNA, 15 bp, Homo sapiens
attacagatcatata

SEQ ID NO: 2707602 - DNA, 13 bp, Homo sapiens
attaccatggaga

SEQ ID NO: 2707603 - DNA, 15 bp, Homo sapiens
attaccatggagaca

SEQ ID NO: 2707604 - DNA, 21 bp, Homo sapiens
attaccttgtctttcaaaaga

SEQ ID NO: 2707605 - DNA, 20 bp, Homo sapiens
attagaatggataagatgat

SEQ ID NO: 2707606 - DNA, 17 bp, Homo sapiens
attagcaactgtgctac

SEQ ID NO: 2707607 - DNA, 19 bp, Homo sapiens
attagcaatcattttatat

SEQ ID NO: 2707608 - DNA, 23 bp, Homo sapiens
attagtttaaaatgaagcaattt

SEQ ID NO: 2707609 - DNA, 22 bp, Homo sapiens
attagtttgatttaatatctga

SEQ ID NO: 2707610 - DNA, 17 bp, Homo sapiens
attatatatcataaagt

SEQ ID NO: 2707611 - DNA, 19 bp, Homo sapiens
attatatatcataaagtat

SEQ ID NO: 2707612 - DNA, 13 bp, Homo sapiens
attatgttattgg

SEQ ID NO: 2707613 - DNA, 15 bp, Homo sapiens
attatttaaagcaca

SEQ ID NO: 2707614 - DNA, 12 bp, Homo sapiens
attattttacag

SEQ ID NO: 2707615 - DNA, 14 bp, Homo sapiens
attcaaaatgtcca

SEQ ID NO: 2707616 - DNA, 21 bp, Homo sapiens
attcaaagaaaaccctaagtg

SEQ ID NO: 2707617 - DNA, 17 bp, Homo sapiens
attcaaagctctattaa

SEQ ID NO: 2707618 - DNA, 20 bp, Homo sapiens
attcaagtattaggggtaat

SEQ ID NO: 2707619 - DNA, 19 bp, Homo sapiens
attcacacttgttcaacag

SEQ ID NO: 2707620 - DNA, 18 bp, Homo sapiens
attcacagcgcctcctgg

SEQ ID NO: 2707621 - DNA, 17 bp, Homo sapiens
attcaggtgttctcttc

SEQ ID NO: 2707622 - DNA, 17 bp, Homo sapiens
attcagtgctgtggcct

SEQ ID NO: 2707623 - DNA, 22 bp, Homo sapiens
attcagtgctgtggcctgggca

SEQ ID NO: 2707624 - DNA, 14 bp, Homo sapiens
attcatcaaataaa

SEQ ID NO: 2707625 - DNA, 18 bp, Homo sapiens
attcatcaaataaacctt

SEQ ID NO: 2707626 - DNA, 15 bp, Homo sapiens
attcatgctttctcc

SEQ ID NO: 2707627 - DNA, 13 bp, Homo sapiens
attcattaatctg

SEQ ID NO: 2707628 - DNA, 16 bp, Homo sapiens
attcattaatctgttt

SEQ ID NO: 2707629 - DNA, 24 bp, Homo sapiens
attcattaatctgtttgtttggca

SEQ ID NO: 2707630 - DNA, 19 bp, Homo sapiens
attcatttgagttatttta

SEQ ID NO: 2707631 - DNA, 18 bp, Homo sapiens
attccagtgtattttctg

SEQ ID NO: 2707632 - DNA, 20 bp, Homo sapiens
attcccactaagctttctcc

SEQ ID NO: 2707633 - DNA, 23 bp, Homo sapiens
attcccactaagctttctccttt

SEQ ID NO: 2707634 - DNA, 13 bp, Homo sapiens
cacataaaggtat

SEQ ID NO: 2707635 - DNA, 22 bp, Homo sapiens
cacataatgaggtccctctagc

SEQ ID NO: 2707636 - DNA, 19 bp, Homo sapiens
cacatacaaaaaaaatctt

SEQ ID NO: 2707637 - DNA, 12 bp, Homo sapiens
cacatatatgta

SEQ ID NO: 2707638 - DNA, 15 bp, Homo sapiens
cacatatatgtatat

SEQ ID NO: 2707639 - DNA, 17 bp, Homo sapiens
cacatctaaattgatca

SEQ ID NO: 2707640 - DNA, 12 bp, Homo sapiens
cacatggctggg

SEQ ID NO: 2707641 - DNA, 17 bp, Homo sapiens
cacattaagtggctttt

SEQ ID NO: 2707642 - DNA, 19 bp, Homo sapiens
cacattttgtacaaagata

SEQ ID NO: 2707643 - DNA, 21 bp, Homo sapiens
caccaacccagccgctgcccg

SEQ ID NO: 2707644 - DNA, 21 bp, Homo sapiens
caccaagcgtgattcctgctg

SEQ ID NO: 2707645 - DNA, 22 bp, Homo sapiens
caccaagctgtgccaccctggg

SEQ ID NO: 2707646 - DNA, 16 bp, Homo sapiens
caccaaggtctcacac

SEQ ID NO: 2707647 - DNA, 19 bp, Homo sapiens
caccaaggtctcacactcc

SEQ ID NO: 2707648 - DNA, 20 bp, Homo sapiens
caccaaggtctcacactcct

SEQ ID NO: 2707649 - DNA, 18 bp, Homo sapiens
caccacattctgtctctg

SEQ ID NO: 2707650 - DNA, 14 bp, Homo sapiens
caccacccaacctg

SEQ ID NO: 2707651 - DNA, 18 bp, Homo sapiens
caccagagctgcctcccc

SEQ ID NO: 2707652 - DNA, 19 bp, Homo sapiens
caccaggcagctccagctg

SEQ ID NO: 2707653 - DNA, 22 bp, Homo sapiens
caccagggccagcaggcagcgc

SEQ ID NO: 2707654 - DNA, 13 bp, Homo sapiens
caccaggggcagg

SEQ ID NO: 2707655 - DNA, 14 bp, Homo sapiens
caccagtgcctcag

SEQ ID NO: 2707656 - DNA, 23 bp, Homo sapiens
caccagtgtcgtgtctgctgttg

SEQ ID NO: 2707657 - DNA, 21 bp, Homo sapiens
caccatattcagtgctgtggc

SEQ ID NO: 2707658 - DNA, 12 bp, Homo sapiens
caccatgcaagg

SEQ ID NO: 2707659 - DNA, 14 bp, Homo sapiens
caccattctcctgc

SEQ ID NO: 2707660 - DNA, 11 bp, Homo sapiens
cacccactggc

SEQ ID NO: 2707661 - DNA, 12 bp, Homo sapiens
cacccactggcc

SEQ ID NO: 2707662 - DNA, 17 bp, Homo sapiens
cacccactggccagtcc

SEQ ID NO: 2707663 - DNA, 22 bp, Homo sapiens
cacccaggaagggagggagctg

SEQ ID NO: 2707664 - DNA, 23 bp, Homo sapiens
cacccaggaagggagggagctga

SEQ ID NO: 2707665 - DNA, 17 bp, Homo sapiens
cacccagtctgttcccc

SEQ ID NO: 2707666 - DNA, 14 bp, Homo sapiens
cacccatgaagaca

SEQ ID NO: 2707667 - DNA, 15 bp, Homo sapiens
caccccagcacagct

SEQ ID NO: 2707668 - DNA, 20 bp, Homo sapiens
caccccagcacagctcctcc

SEQ ID NO: 2707669 - DNA, 12 bp, Homo sapiens
cacccccaagcc

SEQ ID NO: 2707670 - DNA, 23 bp, Homo sapiens
cacccccacttcatgcccactgc

SEQ ID NO: 2707671 - DNA, 14 bp, Homo sapiens
caccccctcctgct

SEQ ID NO: 2707672 - DNA, 16 bp, Homo sapiens
caccccctcctgctgc

SEQ ID NO: 2707673 - DNA, 14 bp, Homo sapiens
cacccggaaagact

SEQ ID NO: 2707674 - DNA, 23 bp, Homo sapiens
cacccgggctcagggaccacagc

SEQ ID NO: 2707675 - DNA, 16 bp, Homo sapiens
caccctaaagtctcag

SEQ ID NO: 2707676 - DNA, 18 bp, Homo sapiens
caccctcaaaccctgtgg

SEQ ID NO: 2707677 - DNA, 14 bp, Homo sapiens
caccctcccctccc

SEQ ID NO: 2707678 - DNA, 16 bp, Homo sapiens
caccctcctgagcctc

SEQ ID NO: 2707679 - DNA, 14 bp, Homo sapiens
caccctgcagagct

SEQ ID NO: 2707680 - DNA, 12 bp, Homo sapiens
caccctgcctgc

SEQ ID NO: 2707681 - DNA, 14 bp, Homo sapiens
caccctgcctgctg

SEQ ID NO: 2707682 - DNA, 16 bp, Homo sapiens
caccctgcctgctgtg

SEQ ID NO: 2707683 - DNA, 21 bp, Homo sapiens
caccctggattgatcggagcc

SEQ ID NO: 2707684 - DNA, 17 bp, Homo sapiens
caccctgggctctgtgg

SEQ ID NO: 2707685 - DNA, 19 bp, Homo sapiens
caccctgggctctgtgggc

SEQ ID NO: 2707686 - DNA, 22 bp, Homo sapiens
caccctgggtttggcccctgga

SEQ ID NO: 2707687 - DNA, 14 bp, Homo sapiens
caccgcagcatgtg

SEQ ID NO: 2707688 - DNA, 18 bp, Homo sapiens
caccgcagctgctgccac

SEQ ID NO: 2707689 - DNA, 18 bp, Homo sapiens
caccgcatgccccctcgt

SEQ ID NO: 2707690 - DNA, 13 bp, Homo sapiens
caccgccatggct

SEQ ID NO: 2707691 - DNA, 17 bp, Homo sapiens
caccgtattagccagga

SEQ ID NO: 2707692 - DNA, 14 bp, Homo sapiens
cacctagtggctgt

SEQ ID NO: 2707693 - DNA, 15 bp, Homo sapiens
cacctagtggctgtc

SEQ ID NO: 2707694 - DNA, 16 bp, Homo sapiens
cacctatagtcccagc

SEQ ID NO: 2707695 - DNA, 12 bp, Homo sapiens
cacctatggccc

SEQ ID NO: 2707696 - DNA, 17 bp, Homo sapiens
cacctatggcccagcca

SEQ ID NO: 2707697 - DNA, 22 bp, Homo sapiens
cacctatggcccagccactgca

SEQ ID NO: 2707698 - DNA, 19 bp, Homo sapiens
cacctcacgctctggacat

SEQ ID NO: 2707699 - DNA, 15 bp, Homo sapiens
cacctcaggccaggt

SEQ ID NO: 2707700 - DNA, 23 bp, Homo sapiens
cacctcaggccaggtgcagtggc

SEQ ID NO: 2707701 - DNA, 17 bp, Homo sapiens
cacctcctctgtgattt

SEQ ID NO: 2707702 - DNA, 18 bp, Homo sapiens
cacctcggatcccactga

SEQ ID NO: 2707703 - DNA, 20 bp, Homo sapiens
cacctctgggccaggttgga

SEQ ID NO: 2707704 - DNA, 22 bp, Homo sapiens
cacctgcaggttgggccatact

SEQ ID NO: 2707705 - DNA, 13 bp, Homo sapiens
cacctgccagcct

SEQ ID NO: 2707706 - DNA, 17 bp, Homo sapiens
cacctgccatttgcacc

SEQ ID NO: 2707707 - DNA, 15 bp, Homo sapiens
cacctgcctagctct

SEQ ID NO: 2707708 - DNA, 22 bp, Homo sapiens
cacctgcctagctcttgggcct

SEQ ID NO: 2707709 - DNA, 16 bp, Homo sapiens
cacctgccttatgcaa

SEQ ID NO: 2707710 - DNA, 20 bp, Homo sapiens
cacctggccccttctccagc

SEQ ID NO: 2707711 - DNA, 21 bp, Homo sapiens
cacctggccccttctccagca

SEQ ID NO: 2707712 - DNA, 22 bp, Homo sapiens
cacctgtactcaggaggctgag

SEQ ID NO: 2707713 - DNA, 16 bp, Homo sapiens
caccttaactcagcca

SEQ ID NO: 2707714 - DNA, 17 bp, Homo sapiens
caccttgccgagagagg

SEQ ID NO: 2707715 - DNA, 17 bp, Homo sapiens
cacctttgggatcagcc

SEQ ID NO: 2707716 - DNA, 18 bp, Homo sapiens
cacctttgggatcagcct

SEQ ID NO: 2707717 - DNA, 19 bp, Homo sapiens
cacctttgggatcagcctc

SEQ ID NO: 2707718 - DNA, 13 bp, Homo sapiens
cacgatctcagct

SEQ ID NO: 2707719 - DNA, 14 bp, Homo sapiens
cacgatctcagctc

SEQ ID NO: 2707720 - DNA, 16 bp, Homo sapiens
cacgatctcagctcac

SEQ ID NO: 2707721 - DNA, 14 bp, Homo sapiens
cacgccactgcact

SEQ ID NO: 2707722 - DNA, 19 bp, Homo sapiens
cacgcctatgatcccagca

SEQ ID NO: 2707723 - DNA, 22 bp, Homo sapiens
cacgcctatgatcccagcactt

SEQ ID NO: 2707724 - DNA, 12 bp, Homo sapiens
cacggcagctgt

SEQ ID NO: 2707725 - DNA, 18 bp, Homo sapiens
cacggggaccactgggcc

SEQ ID NO: 2707726 - DNA, 20 bp, Homo sapiens
cacggggaccactgggcccc

SEQ ID NO: 2707727 - DNA, 15 bp, Homo sapiens
cacggggtattttag

SEQ ID NO: 2707728 - DNA, 13 bp, Homo sapiens
cacgtcaccctcc

SEQ ID NO: 2707729 - DNA, 23 bp, Homo sapiens
cacgtcaccctcctgagcctcac

SEQ ID NO: 2707730 - DNA, 13 bp, Homo sapiens
cacgtcccatgtg

SEQ ID NO: 2707731 - DNA, 16 bp, Homo sapiens
cacgtcctgtcagtgc

SEQ ID NO: 2707732 - DNA, 14 bp, Homo sapiens
cacgtcctttcctg

SEQ ID NO: 2707733 - DNA, 11 bp, Homo sapiens
cacgtctctct

SEQ ID NO: 2707734 - DNA, 14 bp, Homo sapiens
cacgtctctctgcc

SEQ ID NO: 2707735 - DNA, 20 bp, Homo sapiens
cacgtctgtgctctgtcctt

SEQ ID NO: 2707736 - DNA, 15 bp, Homo sapiens
cacgtgacactgtgg

SEQ ID NO: 2707737 - DNA, 21 bp, Homo sapiens
cacgtgcacagcttcctgagt

SEQ ID NO: 2707738 - DNA, 21 bp, Homo sapiens
cactaaattagtttaaaatga

SEQ ID NO: 2707739 - DNA, 22 bp, Homo sapiens
cactaaattagtttaaaatgaa

SEQ ID NO: 2707740 - DNA, 17 bp, Homo sapiens
cactaagctttctcctt

SEQ ID NO: 2707741 - DNA, 16 bp, Homo sapiens
cactacactccagcct

SEQ ID NO: 2707742 - DNA, 21 bp, Homo sapiens
cactacctttgtccaggcctg

SEQ ID NO: 2707743 - DNA, 17 bp, Homo sapiens
cactaggactctgaggc

SEQ ID NO: 2707744 - DNA, 18 bp, Homo sapiens
cactaggactctgaggct

SEQ ID NO: 2707745 - DNA, 21 bp, Homo sapiens
cactcaaggaaaagatgtgct

SEQ ID NO: 2707746 - DNA, 19 bp, Homo sapiens
cactcaggccaacaagcca

SEQ ID NO: 2707747 - DNA, 16 bp, Homo sapiens
cactcaggtctgtttt

SEQ ID NO: 2707748 - DNA, 16 bp, Homo sapiens
cactccacctccaccc

SEQ ID NO: 2707749 - DNA, 13 bp, Homo sapiens
cactccagcctga

SEQ ID NO: 2707750 - DNA, 23 bp, Homo sapiens
cactccagcctgggcgacagagc

SEQ ID NO: 2707751 - DNA, 20 bp, Homo sapiens
cactcccccaggattgtgca

SEQ ID NO: 2707752 - DNA, 20 bp, Homo sapiens
cactccggtgtgcctgcagc

SEQ ID NO: 2707753 - DNA, 16 bp, Homo sapiens
cactcctaatcaagag

SEQ ID NO: 2707754 - DNA, 14 bp, Homo sapiens
cactcctcctgcca

SEQ ID NO: 2707755 - DNA, 15 bp, Homo sapiens
cactcctcctgccag

SEQ ID NO: 2707756 - DNA, 16 bp, Homo sapiens
cactcctcctgccagc

SEQ ID NO: 2707757 - DNA, 18 bp, Homo sapiens
cactccttccccttgtcc

SEQ ID NO: 2707758 - DNA, 18 bp, Homo sapiens
cagtgtgatcccaagtgc

SEQ ID NO: 2707759 - DNA, 13 bp, Homo sapiens
cagtgtgtgctca

SEQ ID NO: 2707760 - DNA, 15 bp, Homo sapiens
cagtgtgtgctcagc

SEQ ID NO: 2707761 - DNA, 17 bp, Homo sapiens
cagtgtgtgctcagcag

SEQ ID NO: 2707762 - DNA, 18 bp, Homo sapiens
cagtgttaggcctggcac

SEQ ID NO: 2707763 - DNA, 19 bp, Homo sapiens
cagtgttaggcctggcaca

SEQ ID NO: 2707764 - DNA, 20 bp, Homo sapiens
cagtgttaggcctggcacag

SEQ ID NO: 2707765 - DNA, 15 bp, Homo sapiens
cagttcataaatttg

SEQ ID NO: 2707766 - DNA, 15 bp, Homo sapiens
cagttcctctttgca

SEQ ID NO: 2707767 - DNA, 17 bp, Homo sapiens
cagttcctctttgcatg

SEQ ID NO: 2707768 - DNA, 23 bp, Homo sapiens
cagttcctctttgcatggaattt

SEQ ID NO: 2707769 - DNA, 13 bp, Homo sapiens
cagttctgtgtcc

SEQ ID NO: 2707770 - DNA, 18 bp, Homo sapiens
cagttctgtgtcctcgca

SEQ ID NO: 2707771 - DNA, 14 bp, Homo sapiens
cagttgttttcccg

SEQ ID NO: 2707772 - DNA, 13 bp, Homo sapiens
cagttttgttttg

SEQ ID NO: 2707773 - DNA, 20 bp, Homo sapiens
cataaaaaaattagtcaggt

SEQ ID NO: 2707774 - DNA, 20 bp, Homo sapiens
cataaagtatgccttcctgt

SEQ ID NO: 2707775 - DNA, 18 bp, Homo sapiens
cataaatcaattcattgt

SEQ ID NO: 2707776 - DNA, 21 bp, Homo sapiens
cataaatcaattcattgtgta

SEQ ID NO: 2707777 - DNA, 21 bp, Homo sapiens
cataagggacatgtctttggc

SEQ ID NO: 2707778 - DNA, 20 bp, Homo sapiens
cataatgaaccgtttacagt

SEQ ID NO: 2707779 - DNA, 18 bp, Homo sapiens
cataatttcagttctagt

SEQ ID NO: 2707780 - DNA, 12 bp, Homo sapiens
catacaaaaaaa

SEQ ID NO: 2707781 - DNA, 17 bp, Homo sapiens
catacaacagaaaccag

SEQ ID NO: 2707782 - DNA, 22 bp, Homo sapiens
catacaacagaaaccagaaaag

SEQ ID NO: 2707783 - DNA, 20 bp, Homo sapiens
catacatgttgggcatgatt

SEQ ID NO: 2707784 - DNA, 14 bp, Homo sapiens
catacattatattc

SEQ ID NO: 2707785 - DNA, 15 bp, Homo sapiens
catactggcctcgcc

SEQ ID NO: 2707786 - DNA, 21 bp, Homo sapiens
catactggcctcgcctggcct

SEQ ID NO: 2707787 - DNA, 18 bp, Homo sapiens
catataagcaagacagtg

SEQ ID NO: 2707788 - DNA, 13 bp, Homo sapiens
catatattgcttt

SEQ ID NO: 2707789 - DNA, 14 bp, Homo sapiens
catattcacacctc

SEQ ID NO: 2707790 - DNA, 17 bp, Homo sapiens
catattgctcttaaaaa

SEQ ID NO: 2707791 - DNA, 16 bp, Homo sapiens
catcaaataaaccttg

SEQ ID NO: 2707792 - DNA, 18 bp, Homo sapiens
catcacctcaggccaggt

SEQ ID NO: 2707793 - DNA, 22 bp, Homo sapiens
catcagaagtaactcccactcc

SEQ ID NO: 2707794 - DNA, 22 bp, Homo sapiens
catcagtgtacccccgcccagg

SEQ ID NO: 2707795 - DNA, 24 bp, Homo sapiens
catcagtgtacccccgcccaggct

SEQ ID NO: 2707796 - DNA, 18 bp, Homo sapiens
catcatctttatctcctg

SEQ ID NO: 2707797 - DNA, 12 bp, Homo sapiens
catcattggata

SEQ ID NO: 2707798 - DNA, 20 bp, Homo sapiens
catcatttaaacatgcagaa

SEQ ID NO: 2707799 - DNA, 21 bp, Homo sapiens
catcatttaaacatgcagaag

SEQ ID NO: 2707800 - DNA, 16 bp, Homo sapiens
catccaaccccccacc

SEQ ID NO: 2707801 - DNA, 19 bp, Homo sapiens
catcccatctaagctgcag

SEQ ID NO: 2707802 - DNA, 20 bp, Homo sapiens
catcccatctaagctgcagc

SEQ ID NO: 2707803 - DNA, 14 bp, Homo sapiens
catcccccctcacc

SEQ ID NO: 2707804 - DNA, 17 bp, Homo sapiens
catcccccctcaccagg

SEQ ID NO: 2707805 - DNA, 11 bp, Homo sapiens
catcctcctcc

SEQ ID NO: 2707806 - DNA, 14 bp, Homo sapiens
catcctcctcctca

SEQ ID NO: 2707807 - DNA, 11 bp, Homo sapiens
catcctcctct

SEQ ID NO: 2707808 - DNA, 14 bp, Homo sapiens
catcctcctctcca

SEQ ID NO: 2707809 - DNA, 20 bp, Homo sapiens
catcctcctctccatgcaag

SEQ ID NO: 2707810 - DNA, 14 bp, Homo sapiens
catcctggcccatc

SEQ ID NO: 2707811 - DNA, 15 bp, Homo sapiens
catcctggctggctg

SEQ ID NO: 2707812 - DNA, 12 bp, Homo sapiens
catccttctgcc

SEQ ID NO: 2707813 - DNA, 17 bp, Homo sapiens
catccttttctgcagag

SEQ ID NO: 2707814 - DNA, 14 bp, Homo sapiens
catctaagctgcag

SEQ ID NO: 2707815 - DNA, 20 bp, Homo sapiens
catctaagctgcagcttcct

SEQ ID NO: 2707816 - DNA, 23 bp, Homo sapiens
catctccctgaccttctccaggg

SEQ ID NO: 2707817 - DNA, 18 bp, Homo sapiens
catctcctcccaccagtg

SEQ ID NO: 2707818 - DNA, 23 bp, Homo sapiens
catctctctactcctacctcagc

SEQ ID NO: 2707819 - DNA, 11 bp, Homo sapiens
catctgcccag

SEQ ID NO: 2707820 - DNA, 12 bp, Homo sapiens
catctgcccagg

SEQ ID NO: 2707821 - DNA, 13 bp, Homo sapiens
catctgcccagga

SEQ ID NO: 2707822 - DNA, 13 bp, Homo sapiens
catctgtccatcc

SEQ ID NO: 2707823 - DNA, 15 bp, Homo sapiens
catctgtccatcctc

SEQ ID NO: 2707824 - DNA, 16 bp, Homo sapiens
catctgtccatcctcc

SEQ ID NO: 2707825 - DNA, 17 bp, Homo sapiens
catctgtccatcctcct

SEQ ID NO: 2707826 - DNA, 19 bp, Homo sapiens
catctgtccatcctcctct

SEQ ID NO: 2707827 - DNA, 21 bp, Homo sapiens
catctgtccatcctcctctcc

SEQ ID NO: 2707828 - DNA, 22 bp, Homo sapiens
catctgtccatcctcctctcca

SEQ ID NO: 2707829 - DNA, 13 bp, Homo sapiens
catctgtgcctgt

SEQ ID NO: 2707830 - DNA, 20 bp, Homo sapiens
catcttatgctaactgtaga

SEQ ID NO: 2707831 - DNA, 18 bp, Homo sapiens
catcttcacgcctgggtg

SEQ ID NO: 2707832 - DNA, 14 bp, Homo sapiens
catcttccaggtgg

SEQ ID NO: 2707833 - DNA, 16 bp, Homo sapiens
catctttatctcctgg

SEQ ID NO: 2707834 - DNA, 12 bp, Homo sapiens
catctttgctga

SEQ ID NO: 2707835 - DNA, 22 bp, Homo sapiens
catcttttcctcccattttaga

SEQ ID NO: 2707836 - DNA, 23 bp, Homo sapiens
catcttttcctcccattttagaa

SEQ ID NO: 2707837 - DNA, 24 bp, Homo sapiens
catgaaattgtctagcagagcagg

SEQ ID NO: 2707838 - DNA, 14 bp, Homo sapiens
catgaagacaggac

SEQ ID NO: 2707839 - DNA, 21 bp, Homo sapiens
catgaatacgtaaactgcgta

SEQ ID NO: 2707840 - DNA, 22 bp, Homo sapiens
catgaggacatgatggagcgca

SEQ ID NO: 2707841 - DNA, 23 bp, Homo sapiens
catgatactttaatttttataaa

SEQ ID NO: 2707842 - DNA, 19 bp, Homo sapiens
catgatggagcgcacctgc

SEQ ID NO: 2707843 - DNA, 17 bp, Homo sapiens
catgcaagtgctgtttg

SEQ ID NO: 2707844 - DNA, 19 bp, Homo sapiens
catgccccctcgtgccagt

SEQ ID NO: 2707845 - DNA, 19 bp, Homo sapiens
catgccctgagctctctga

SEQ ID NO: 2707846 - DNA, 12 bp, Homo sapiens
catgcctcagcc

SEQ ID NO: 2707847 - DNA, 17 bp, Homo sapiens
catgcctcagccagccc

SEQ ID NO: 2707848 - DNA, 18 bp, Homo sapiens
catgctggcggcgcagag

SEQ ID NO: 2707849 - DNA, 23 bp, Homo sapiens
catgctggtgtggccaaggctga

SEQ ID NO: 2707850 - DNA, 17 bp, Homo sapiens
catgctttctccttttt

SEQ ID NO: 2707851 - DNA, 14 bp, Homo sapiens
catggagtgagcag

SEQ ID NO: 2707852 - DNA, 23 bp, Homo sapiens
catggagtgagcagtagaagcct

SEQ ID NO: 2707853 - DNA, 18 bp, Homo sapiens
catggattccaaagcatt

SEQ ID NO: 2707854 - DNA, 16 bp, Homo sapiens
catggcagctgggccc

SEQ ID NO: 2707855 - DNA, 18 bp, Homo sapiens
catggcagctgggcccac

SEQ ID NO: 2707856 - DNA, 21 bp, Homo sapiens
catggcagctgggcccacagc

SEQ ID NO: 2707857 - DNA, 23 bp, Homo sapiens
catggcagctgggcccacagccc

SEQ ID NO: 2707858 - DNA, 13 bp, Homo sapiens
catggccttccct

SEQ ID NO: 2707859 - DNA, 21 bp, Homo sapiens
catggctgggggagggactgc

SEQ ID NO: 2707860 - DNA, 23 bp, Homo sapiens
catggctgtggttcctaagcctg

SEQ ID NO: 2707861 - DNA, 14 bp, Homo sapiens
catgggcctgctgc

SEQ ID NO: 2707862 - DNA, 22 bp, Homo sapiens
catgggcctgctgcgtcagacc

SEQ ID NO: 2707863 - DNA, 16 bp, Homo sapiens
catgggcgaccagggc

SEQ ID NO: 2707864 - DNA, 17 bp, Homo sapiens
catggtagactgtgaca

SEQ ID NO: 2707865 - DNA, 12 bp, Homo sapiens
catggtcctggc

SEQ ID NO: 2707866 - DNA, 13 bp, Homo sapiens
catggtcctggct

SEQ ID NO: 2707867 - DNA, 16 bp, Homo sapiens
catggtcctggctgga

SEQ ID NO: 2707868 - DNA, 22 bp, Homo sapiens
catggtgtgaaagtcagatgcc

SEQ ID NO: 2707869 - DNA, 14 bp, Homo sapiens
catgtaaaatcttc

SEQ ID NO: 2707870 - DNA, 16 bp, Homo sapiens
catgtaaaatcttcag

SEQ ID NO: 2707871 - DNA, 15 bp, Homo sapiens
catgtatcactcact

SEQ ID NO: 2707872 - DNA, 14 bp, Homo sapiens
catgtatctacctc

SEQ ID NO: 2707873 - DNA, 22 bp, Homo sapiens
catgtcagcctcatgccccagg

SEQ ID NO: 2707874 - DNA, 15 bp, Homo sapiens
catgtcatttctcat

SEQ ID NO: 2707875 - DNA, 17 bp, Homo sapiens
catgtgcaactcttgta

SEQ ID NO: 2707876 - DNA, 20 bp, Homo sapiens
catgtgcaactcttgtattg

SEQ ID NO: 2707877 - DNA, 20 bp, Homo sapiens
catgtggcattctctctgct

SEQ ID NO: 2707878 - DNA, 17 bp, Homo sapiens
catgtggggaagcaaga

SEQ ID NO: 2707879 - DNA, 17 bp, Homo sapiens
catgtgggttgtgatat

SEQ ID NO: 2707880 - DNA, 17 bp, Homo sapiens
catgtgtaacttctaga

SEQ ID NO: 2707881 - DNA, 14 bp, Homo sapiens
catgtgtatgagaa

SEQ ID NO: 2707882 - DNA, 15 bp, Homo sapiens
cccagcacagctcct

SEQ ID NO: 2707883 - DNA, 19 bp, Homo sapiens
cccagcacccgggctcagg

SEQ ID NO: 2707884 - DNA, 12 bp, Homo sapiens
cccagccactgc

SEQ ID NO: 2707885 - DNA, 13 bp, Homo sapiens
cccagccactgca

SEQ ID NO: 2707886 - DNA, 16 bp, Homo sapiens
cccagccactgcagca

SEQ ID NO: 2707887 - DNA, 18 bp, Homo sapiens
cccagccattaccatgga

SEQ ID NO: 2707888 - DNA, 14 bp, Homo sapiens
cccagcctcccagc

SEQ ID NO: 2707889 - DNA, 15 bp, Homo sapiens
cccagcctgccccag

SEQ ID NO: 2707890 - DNA, 16 bp, Homo sapiens
cccagcctgccccagc

SEQ ID NO: 2707891 - DNA, 13 bp, Homo sapiens
cccagcctgtcct

SEQ ID NO: 2707892 - DNA, 20 bp, Homo sapiens
cccagcctgtcctggtacag

SEQ ID NO: 2707893 - DNA, 21 bp, Homo sapiens
cccagcctgtcctggtacagc

SEQ ID NO: 2707894 - DNA, 16 bp, Homo sapiens
cccagctcccccggga

SEQ ID NO: 2707895 - DNA, 12 bp, Homo sapiens
cccagctgcacc

SEQ ID NO: 2707896 - DNA, 12 bp, Homo sapiens
cccagctggcct

SEQ ID NO: 2707897 - DNA, 16 bp, Homo sapiens
cccagctttctgtgtg

SEQ ID NO: 2707898 - DNA, 19 bp, Homo sapiens
cccaggaagggagggagct

SEQ ID NO: 2707899 - DNA, 23 bp, Homo sapiens
cccaggaagggagggagctgagg

SEQ ID NO: 2707900 - DNA, 23 bp, Homo sapiens
cccaggacggggccggccaggtg

SEQ ID NO: 2707901 - DNA, 17 bp, Homo sapiens
cccaggagcaaatgctg

SEQ ID NO: 2707902 - DNA, 18 bp, Homo sapiens
cccaggattcccagagag

SEQ ID NO: 2707903 - DNA, 18 bp, Homo sapiens
cccaggattgtgcaatag

SEQ ID NO: 2707904 - DNA, 14 bp, Homo sapiens
cccaggccatcttc

SEQ ID NO: 2707905 - DNA, 21 bp, Homo sapiens
cccaggccatcttccaggtgg

SEQ ID NO: 2707906 - DNA, 18 bp, Homo sapiens
cccagggccagggccctg

SEQ ID NO: 2707907 - DNA, 20 bp, Homo sapiens
cccagggccagggccctgca

SEQ ID NO: 2707908 - DNA, 16 bp, Homo sapiens
cccagggcctccagga

SEQ ID NO: 2707909 - DNA, 19 bp, Homo sapiens
cccagggctccctcctgga

SEQ ID NO: 2707910 - DNA, 23 bp, Homo sapiens
cccagggtgagaacgtgcccagc

SEQ ID NO: 2707911 - DNA, 15 bp, Homo sapiens
cccagtgacaacatc

SEQ ID NO: 2707912 - DNA, 20 bp, Homo sapiens
cccagtgagaagggcctgct

SEQ ID NO: 2707913 - DNA, 23 bp, Homo sapiens
cccagtgagaagggcctgctctg

SEQ ID NO: 2707914 - DNA, 12 bp, Homo sapiens
cccagtgagcct

SEQ ID NO: 2707915 - DNA, 13 bp, Homo sapiens
cccagtgagcctc

SEQ ID NO: 2707916 - DNA, 15 bp, Homo sapiens
cccagtgagcctctg

SEQ ID NO: 2707917 - DNA, 19 bp, Homo sapiens
cccagtgagcctctgcgcc

SEQ ID NO: 2707918 - DNA, 15 bp, Homo sapiens
cccagtgtcttcctg

SEQ ID NO: 2707919 - DNA, 20 bp, Homo sapiens
cccatcccccctcaccaggg

SEQ ID NO: 2707920 - DNA, 15 bp, Homo sapiens
cccatcctggcccat

SEQ ID NO: 2707921 - DNA, 16 bp, Homo sapiens
cccatcctggcccatc

SEQ ID NO: 2707922 - DNA, 17 bp, Homo sapiens
cccatcctggcccatca

SEQ ID NO: 2707923 - DNA, 18 bp, Homo sapiens
cccatcctggcccatcag

SEQ ID NO: 2707924 - DNA, 21 bp, Homo sapiens
cccatctaagctgcagcttcc

SEQ ID NO: 2707925 - DNA, 13 bp, Homo sapiens
cccatctgcccag

SEQ ID NO: 2707926 - DNA, 19 bp, Homo sapiens
cccatctgtccatcctcct

SEQ ID NO: 2707927 - DNA, 20 bp, Homo sapiens
cccatctgtccatcctcctc

SEQ ID NO: 2707928 - DNA, 23 bp, Homo sapiens
cccatctgtccatcctcctctcc

SEQ ID NO: 2707929 - DNA, 18 bp, Homo sapiens
cccatgaagacaggacag

SEQ ID NO: 2707930 - DNA, 19 bp, Homo sapiens
cccatgaagacaggacagt

SEQ ID NO: 2707931 - DNA, 20 bp, Homo sapiens
cccatggccttccctcccca

SEQ ID NO: 2707932 - DNA, 17 bp, Homo sapiens
cccatgggcactgctgg

SEQ ID NO: 2707933 - DNA, 15 bp, Homo sapiens
cccatttcaggaggt

SEQ ID NO: 2707934 - DNA, 17 bp, Homo sapiens
cccatttcaggaggtgc

SEQ ID NO: 2707935 - DNA, 20 bp, Homo sapiens
cccattttagaaaatcagat

SEQ ID NO: 2707936 - DNA, 21 bp, Homo sapiens
ccccaaatcacaaacatatgt

SEQ ID NO: 2707937 - DNA, 19 bp, Homo sapiens
ccccaacatctccctccca

SEQ ID NO: 2707938 - DNA, 22 bp, Homo sapiens
ccccaacatctccctcccacat

SEQ ID NO: 2707939 - DNA, 19 bp, Homo sapiens
ccccacagcccacgtcctg

SEQ ID NO: 2707940 - DNA, 13 bp, Homo sapiens
ccccaccagagct

SEQ ID NO: 2707941 - DNA, 14 bp, Homo sapiens
ccccaccagagctg

SEQ ID NO: 2707942 - DNA, 15 bp, Homo sapiens
ccccaccagagctgc

SEQ ID NO: 2707943 - DNA, 13 bp, Homo sapiens
ccccaccccagca

SEQ ID NO: 2707944 - DNA, 14 bp, Homo sapiens
ccccaccccagcac

SEQ ID NO: 2707945 - DNA, 14 bp, Homo sapiens
ccccacctttggga

SEQ ID NO: 2707946 - DNA, 15 bp, Homo sapiens
ccccacgtctctctg

SEQ ID NO: 2707947 - DNA, 17 bp, Homo sapiens
ccccacgtctctctgcc

SEQ ID NO: 2707948 - DNA, 19 bp, Homo sapiens
ccccacgtctctctgcctg

SEQ ID NO: 2707949 - DNA, 21 bp, Homo sapiens
ccccacgtctctctgcctgct

SEQ ID NO: 2707950 - DNA, 22 bp, Homo sapiens
ccccacgtctctctgcctgctg

SEQ ID NO: 2707951 - DNA, 21 bp, Homo sapiens
ccccacttcatgcccactgcc

SEQ ID NO: 2707952 - DNA, 22 bp, Homo sapiens
ccccagagacctttgcccacac

SEQ ID NO: 2707953 - DNA, 21 bp, Homo sapiens
ccccagcacagctcctcccct

SEQ ID NO: 2707954 - DNA, 23 bp, Homo sapiens
ccccagcctgccccagcctccca

SEQ ID NO: 2707955 - DNA, 11 bp, Homo sapiens
ccccagcctgg

SEQ ID NO: 2707956 - DNA, 16 bp, Homo sapiens
ccccagcctggcccag

SEQ ID NO: 2707957 - DNA, 17 bp, Homo sapiens
ccccagcctggcccagc

SEQ ID NO: 2707958 - DNA, 17 bp, Homo sapiens
ccccagctagggctgga

SEQ ID NO: 2707959 - DNA, 18 bp, Homo sapiens
ccccaggattgtgcaata

SEQ ID NO: 2707960 - DNA, 14 bp, Homo sapiens
ccccatcctggccc

SEQ ID NO: 2707961 - DNA, 15 bp, Homo sapiens
ccccatcctggccca

SEQ ID NO: 2707962 - DNA, 17 bp, Homo sapiens
ccccatctgcccaggac

SEQ ID NO: 2707963 - DNA, 13 bp, Homo sapiens
ccccatttgattt

SEQ ID NO: 2707964 - DNA, 15 bp, Homo sapiens
cccccaccactagga

SEQ ID NO: 2707965 - DNA, 14 bp, Homo sapiens
cccccaccccagca

SEQ ID NO: 2707966 - DNA, 20 bp, Homo sapiens
cccccacttcatgcccactg

SEQ ID NO: 2707967 - DNA, 12 bp, Homo sapiens
cccccagagacc

SEQ ID NO: 2707968 - DNA, 18 bp, Homo sapiens
cccccagagacctttgcc

SEQ ID NO: 2707969 - DNA, 17 bp, Homo sapiens
cccccatcctggcccat

SEQ ID NO: 2707970 - DNA, 20 bp, Homo sapiens
ccccccttgaatctgcaggg

SEQ ID NO: 2707971 - DNA, 18 bp, Homo sapiens
cccccgcccaggctggcc

SEQ ID NO: 2707972 - DNA, 18 bp, Homo sapiens
cccccgggaggggcccgc

SEQ ID NO: 2707973 - DNA, 16 bp, Homo sapiens
cccccggggctgggtt

SEQ ID NO: 2707974 - DNA, 13 bp, Homo sapiens
ccccctcccaggg

SEQ ID NO: 2707975 - DNA, 16 bp, Homo sapiens
ccccctcctgctgcag

SEQ ID NO: 2707976 - DNA, 13 bp, Homo sapiens
ccccctcgtgcca

SEQ ID NO: 2707977 - DNA, 11 bp, Homo sapiens
ccccctgggct

SEQ ID NO: 2707978 - DNA, 19 bp, Homo sapiens
ccccctggtggacagtcct

SEQ ID NO: 2707979 - DNA, 20 bp, Homo sapiens
ccccctggtggacagtcctg

SEQ ID NO: 2707980 - DNA, 19 bp, Homo sapiens
ccccgagggatgatgccac

SEQ ID NO: 2707981 - DNA, 20 bp, Homo sapiens
ccccgagggatgatgccaca

SEQ ID NO: 2707982 - DNA, 21 bp, Homo sapiens
ccccgagggatgatgccacac

SEQ ID NO: 2707983 - DNA, 23 bp, Homo sapiens
ccccgcccagctgcacctgccag

SEQ ID NO: 2707984 - DNA, 14 bp, Homo sapiens
ccccgcccaggctg

SEQ ID NO: 2707985 - DNA, 15 bp, Homo sapiens
ccccgcccaggctgg

SEQ ID NO: 2707986 - DNA, 19 bp, Homo sapiens
ccccgcccaggctggccag

SEQ ID NO: 2707987 - DNA, 20 bp, Homo sapiens
ccccgggctgacccagtgtg

SEQ ID NO: 2707988 - DNA, 20 bp, Homo sapiens
cccctcacagactcttccac

SEQ ID NO: 2707989 - DNA, 23 bp, Homo sapiens
cccctcacagactcttccaccag

SEQ ID NO: 2707990 - DNA, 18 bp, Homo sapiens
cccctcaggggaagctgc

SEQ ID NO: 2707991 - DNA, 22 bp, Homo sapiens
cccctcaggggaagctgctagg

SEQ ID NO: 2707992 - DNA, 13 bp, Homo sapiens
cccctcccagctg

SEQ ID NO: 2707993 - DNA, 22 bp, Homo sapiens
cccctcccagctgacagtcctc

SEQ ID NO: 2707994 - DNA, 14 bp, Homo sapiens
cccctccccagccc

SEQ ID NO: 2707995 - DNA, 22 bp, Homo sapiens
cccctcccgtctactcattccc

SEQ ID NO: 2707996 - DNA, 16 bp, Homo sapiens
cccctccctagatcca

SEQ ID NO: 2707997 - DNA, 17 bp, Homo sapiens
cccctcgtgccagtcgc

SEQ ID NO: 2707998 - DNA, 18 bp, Homo sapiens
cccctcttgccccaaccc

SEQ ID NO: 2707999 - DNA, 22 bp, Homo sapiens
cccctcttgccccaacccccag

SEQ ID NO: 2708000 - DNA, 15 bp, Homo sapiens
cccctgccgcctccc

SEQ ID NO: 2708001 - DNA, 17 bp, Homo sapiens
cccctggaacctttccc

SEQ ID NO: 2708002 - DNA, 19 bp, Homo sapiens
cccctggaacctttccctt

SEQ ID NO: 2708003 - DNA, 16 bp, Homo sapiens
cccctggctgaacagt

SEQ ID NO: 2708004 - DNA, 19 bp, Homo sapiens
cccctggctgaacagtgct

SEQ ID NO: 2708005 - DNA, 11 bp, Homo sapiens
cccctgggctc

SEQ ID NO: 2708006 - DNA, 12 bp, Homo sapiens
cgtggctgggaa

SEQ ID NO: 2708007 - DNA, 16 bp, Homo sapiens
cgtgtagccccgggct

SEQ ID NO: 2708008 - DNA, 18 bp, Homo sapiens
cgttagcgtccatttctt

SEQ ID NO: 2708009 - DNA, 13 bp, Homo sapiens
cgttgtctccctg

SEQ ID NO: 2708010 - DNA, 21 bp, Homo sapiens
cgtttgatagtgcttcttgta

SEQ ID NO: 2708011 - DNA, 23 bp, Homo sapiens
ctaaaagatgcaattcaaagata

SEQ ID NO: 2708012 - DNA, 19 bp, Homo sapiens
ctaaaatgtttaattcatt

SEQ ID NO: 2708013 - DNA, 17 bp, Homo sapiens
ctaaacaaggtaatttt

SEQ ID NO: 2708014 - DNA, 12 bp, Homo sapiens
ctaaacatacat

SEQ ID NO: 2708015 - DNA, 13 bp, Homo sapiens
ctaaagtctcagg

SEQ ID NO: 2708016 - DNA, 18 bp, Homo sapiens
ctaaagtctctgctgcta

SEQ ID NO: 2708017 - DNA, 18 bp, Homo sapiens
ctaaagtttacagtaaat

SEQ ID NO: 2708018 - DNA, 19 bp, Homo sapiens
ctaaagtttacagtaaata

SEQ ID NO: 2708019 - DNA, 19 bp, Homo sapiens
ctaaataaactactttgaa

SEQ ID NO: 2708020 - DNA, 21 bp, Homo sapiens
ctaaatattggtttgttattc

SEQ ID NO: 2708021 - DNA, 23 bp, Homo sapiens
ctaaatattggtttgttattctt

SEQ ID NO: 2708022 - DNA, 12 bp, Homo sapiens
ctaaatgttcat

SEQ ID NO: 2708023 - DNA, 14 bp, Homo sapiens
ctaaatgttcatgt

SEQ ID NO: 2708024 - DNA, 18 bp, Homo sapiens
ctaaattagtttaaaatg

SEQ ID NO: 2708025 - DNA, 17 bp, Homo sapiens
ctaaattcactgttgaa

SEQ ID NO: 2708026 - DNA, 19 bp, Homo sapiens
ctaaattgatcattcataa

SEQ ID NO: 2708027 - DNA, 20 bp, Homo sapiens
ctaacaatatgattgcacta

SEQ ID NO: 2708028 - DNA, 16 bp, Homo sapiens
ctaacactgtcctgtc

SEQ ID NO: 2708029 - DNA, 21 bp, Homo sapiens
ctaaccaaagagtctctggct

SEQ ID NO: 2708030 - DNA, 22 bp, Homo sapiens
ctaaccaaagagtctctggctc

SEQ ID NO: 2708031 - DNA, 14 bp, Homo sapiens
ctaactccctcctc

SEQ ID NO: 2708032 - DNA, 15 bp, Homo sapiens
ctaactccctcctca

SEQ ID NO: 2708033 - DNA, 16 bp, Homo sapiens
ctaactcttagaagtg

SEQ ID NO: 2708034 - DNA, 11 bp, Homo sapiens
ctaagcctgtt

SEQ ID NO: 2708035 - DNA, 13 bp, Homo sapiens
ctaagcctgttgc

SEQ ID NO: 2708036 - DNA, 13 bp, Homo sapiens
ctaagctgcagct

SEQ ID NO: 2708037 - DNA, 16 bp, Homo sapiens
ctaagctttctccttt

SEQ ID NO: 2708038 - DNA, 21 bp, Homo sapiens
ctaaggaagacacagcccaga

SEQ ID NO: 2708039 - DNA, 13 bp, Homo sapiens
ctaagtgtggatg

SEQ ID NO: 2708040 - DNA, 18 bp, Homo sapiens
ctaagtgtggatgttcag

SEQ ID NO: 2708041 - DNA, 23 bp, Homo sapiens
ctaatcaagagtctctccagcct

SEQ ID NO: 2708042 - DNA, 23 bp, Homo sapiens
ctaatttaccattattttacagt

SEQ ID NO: 2708043 - DNA, 16 bp, Homo sapiens
ctacaaaccaggagca

SEQ ID NO: 2708044 - DNA, 18 bp, Homo sapiens
ctacaaaccaggagcaac

SEQ ID NO: 2708045 - DNA, 15 bp, Homo sapiens
ctacaaccaggtctt

SEQ ID NO: 2708046 - DNA, 17 bp, Homo sapiens
ctacaataaatgctgaa

SEQ ID NO: 2708047 - DNA, 22 bp, Homo sapiens
ctacacaacatgtatgtggata

SEQ ID NO: 2708048 - DNA, 19 bp, Homo sapiens
ctacacatatatgtatatg

SEQ ID NO: 2708049 - DNA, 20 bp, Homo sapiens
ctacacccttggacttgagg

SEQ ID NO: 2708050 - DNA, 17 bp, Homo sapiens
ctacactccagcctgag

SEQ ID NO: 2708051 - DNA, 23 bp, Homo sapiens
ctacccactctttgctacaataa

SEQ ID NO: 2708052 - DNA, 15 bp, Homo sapiens
ctacccctcccagct

SEQ ID NO: 2708053 - DNA, 16 bp, Homo sapiens
ctacccctcccagctg

SEQ ID NO: 2708054 - DNA, 18 bp, Homo sapiens
ctacccctcccagctgac

SEQ ID NO: 2708055 - DNA, 13 bp, Homo sapiens
ctaccctccctgc

SEQ ID NO: 2708056 - DNA, 17 bp, Homo sapiens
ctaccgcatggcagctg

SEQ ID NO: 2708057 - DNA, 15 bp, Homo sapiens
ctactcctcacagca

SEQ ID NO: 2708058 - DNA, 15 bp, Homo sapiens
ctactctcttgccag

SEQ ID NO: 2708059 - DNA, 18 bp, Homo sapiens
ctactctcttgccagcat

SEQ ID NO: 2708060 - DNA, 17 bp, Homo sapiens
ctactgcttcctctgaa

SEQ ID NO: 2708061 - DNA, 17 bp, Homo sapiens
ctacttgagaaaatgca

SEQ ID NO: 2708062 - DNA, 13 bp, Homo sapiens
ctacttttcagaa

SEQ ID NO: 2708063 - DNA, 14 bp, Homo sapiens
ctagaacacccact

SEQ ID NO: 2708064 - DNA, 15 bp, Homo sapiens
ctagaacacccactg

SEQ ID NO: 2708065 - DNA, 18 bp, Homo sapiens
ctagaacacccactggcc

SEQ ID NO: 2708066 - DNA, 21 bp, Homo sapiens
ctagagctcctgtccctaccc

SEQ ID NO: 2708067 - DNA, 22 bp, Homo sapiens
ctagagctcctgtccctaccca

SEQ ID NO: 2708068 - DNA, 14 bp, Homo sapiens
ctagagtgcagtgg

SEQ ID NO: 2708069 - DNA, 13 bp, Homo sapiens
ctagatccaggct

SEQ ID NO: 2708070 - DNA, 21 bp, Homo sapiens
ctagcattaccacttccctgc

SEQ ID NO: 2708071 - DNA, 18 bp, Homo sapiens
ctagcattttcttgaacc

SEQ ID NO: 2708072 - DNA, 13 bp, Homo sapiens
ctagccatatatt

SEQ ID NO: 2708073 - DNA, 14 bp, Homo sapiens
ctagctcttgggcc

SEQ ID NO: 2708074 - DNA, 17 bp, Homo sapiens
ctagctcttgggcctga

SEQ ID NO: 2708075 - DNA, 21 bp, Homo sapiens
ctagctttagctggagggaga

SEQ ID NO: 2708076 - DNA, 18 bp, Homo sapiens
ctagctttatattttgtt

SEQ ID NO: 2708077 - DNA, 22 bp, Homo sapiens
ctaggattacaggcatgagcca

SEQ ID NO: 2708078 - DNA, 14 bp, Homo sapiens
ctaggattcctccc

SEQ ID NO: 2708079 - DNA, 23 bp, Homo sapiens
ctaggattcctcccccagagcca

SEQ ID NO: 2708080 - DNA, 17 bp, Homo sapiens
ctagggtcctggccctc

SEQ ID NO: 2708081 - DNA, 11 bp, Homo sapiens
ctagtatatta

SEQ ID NO: 2708082 - DNA, 16 bp, Homo sapiens
ctagtatctattgtgt

SEQ ID NO: 2708083 - DNA, 19 bp, Homo sapiens
ctagtcaataactctgatt

SEQ ID NO: 2708084 - DNA, 20 bp, Homo sapiens
ctagtcaataactctgattt

SEQ ID NO: 2708085 - DNA, 20 bp, Homo sapiens
ctagtcagcactagatcatg

SEQ ID NO: 2708086 - DNA, 15 bp, Homo sapiens
ctagtggctgtccag

SEQ ID NO: 2708087 - DNA, 17 bp, Homo sapiens
ctagtggctgtccagtg

SEQ ID NO: 2708088 - DNA, 18 bp, Homo sapiens
ctagttctcaatcactgc

SEQ ID NO: 2708089 - DNA, 23 bp, Homo sapiens
ctagttctcaatcactgctcccc

SEQ ID NO: 2708090 - DNA, 21 bp, Homo sapiens
ctataaagaaaagagggagag

SEQ ID NO: 2708091 - DNA, 15 bp, Homo sapiens
ctatatctctaaact

SEQ ID NO: 2708092 - DNA, 19 bp, Homo sapiens
ctatattccgggtgccatt

SEQ ID NO: 2708093 - DNA, 18 bp, Homo sapiens
ctatcaatatataaattt

SEQ ID NO: 2708094 - DNA, 21 bp, Homo sapiens
ctatcagtgtgccccccatcc

SEQ ID NO: 2708095 - DNA, 19 bp, Homo sapiens
ctatctcgctagccatata

SEQ ID NO: 2708096 - DNA, 22 bp, Homo sapiens
ctatctgcaatgtttttgtgta

SEQ ID NO: 2708097 - DNA, 23 bp, Homo sapiens
ctatgccgtgtagtttctggtat

SEQ ID NO: 2708098 - DNA, 13 bp, Homo sapiens
ctatgcgttttta

SEQ ID NO: 2708099 - DNA, 15 bp, Homo sapiens
ctatgctggacatta

SEQ ID NO: 2708100 - DNA, 13 bp, Homo sapiens
ctatggcccagcc

SEQ ID NO: 2708101 - DNA, 15 bp, Homo sapiens
ctatggcccagccac

SEQ ID NO: 2708102 - DNA, 17 bp, Homo sapiens
ctatggcccagccactg

SEQ ID NO: 2708103 - DNA, 18 bp, Homo sapiens
ctatggcccagccactgc

SEQ ID NO: 2708104 - DNA, 15 bp, Homo sapiens
ctatggtgaggtgtg

SEQ ID NO: 2708105 - DNA, 19 bp, Homo sapiens
ctatgtaatgcttatgtgt

SEQ ID NO: 2708106 - DNA, 21 bp, Homo sapiens
ctatgtaatttttaaagcaaa

SEQ ID NO: 2708107 - DNA, 21 bp, Homo sapiens
ctatgtatgtgccaattttgt

SEQ ID NO: 2708108 - DNA, 20 bp, Homo sapiens
ctattaaaccatctttgttt

SEQ ID NO: 2708109 - DNA, 17 bp, Homo sapiens
ctattaagatttccaag

SEQ ID NO: 2708110 - DNA, 16 bp, Homo sapiens
ctatttcctttgcgca

SEQ ID NO: 2708111 - DNA, 18 bp, Homo sapiens
ctatttcctttgcgcaaa

SEQ ID NO: 2708112 - DNA, 18 bp, Homo sapiens
ctcaacgttgctccccat

SEQ ID NO: 2708113 - DNA, 15 bp, Homo sapiens
ctcaagcaggtttct

SEQ ID NO: 2708114 - DNA, 15 bp, Homo sapiens
ctcaaggcctcccac

SEQ ID NO: 2708115 - DNA, 17 bp, Homo sapiens
ctcacactacttgagaa

SEQ ID NO: 2708116 - DNA, 15 bp, Homo sapiens
ctcacactcctcctg

SEQ ID NO: 2708117 - DNA, 17 bp, Homo sapiens
ctcacactcctcctgcc

SEQ ID NO: 2708118 - DNA, 20 bp, Homo sapiens
ctcacactcctcctgccagc

SEQ ID NO: 2708119 - DNA, 19 bp, Homo sapiens
ctcacagactcttccacca

SEQ ID NO: 2708120 - DNA, 20 bp, Homo sapiens
ctcacagactcttccaccag

SEQ ID NO: 2708121 - DNA, 22 bp, Homo sapiens
ctcacagatgctggcctcttgg

SEQ ID NO: 2708122 - DNA, 18 bp, Homo sapiens
ctcacagcctctccctta

SEQ ID NO: 2708123 - DNA, 12 bp, Homo sapiens
ctcacagggagc

SEQ ID NO: 2708124 - DNA, 15 bp, Homo sapiens
ctcacatattattgg

SEQ ID NO: 2708125 - DNA, 17 bp, Homo sapiens
ctcacatgtccctgtcc

SEQ ID NO: 2708126 - DNA, 13 bp, Homo sapiens
ctcaccaggggca

SEQ ID NO: 2708127 - DNA, 13 bp, Homo sapiens
ctcacctttcctg

SEQ ID NO: 2708128 - DNA, 19 bp, Homo sapiens
ctcacgactcttcctgcaa

SEQ ID NO: 2708129 - DNA, 20 bp, Homo sapiens
ctcacgcctatgatcccagc

SEQ ID NO: 2708130 - DNA, 22 bp, Homo sapiens
ctgagttgcaccattctttctt

SEQ ID NO: 2708131 - DNA, 20 bp, Homo sapiens
ctgatcattacatggctgtg

SEQ ID NO: 2708132 - DNA, 19 bp, Homo sapiens
ctgatcttacctttatgag

SEQ ID NO: 2708133 - DNA, 21 bp, Homo sapiens
ctgatgcaatgtatggctttt

SEQ ID NO: 2708134 - DNA, 21 bp, Homo sapiens
ctgatgcattcccggtgcaga

SEQ ID NO: 2708135 - DNA, 23 bp, Homo sapiens
ctgatggtgctcacgactcttcc

SEQ ID NO: 2708136 - DNA, 18 bp, Homo sapiens
ctgatgtgacgctactaa

SEQ ID NO: 2708137 - DNA, 22 bp, Homo sapiens
ctgatgtttgggggttaccaaa

SEQ ID NO: 2708138 - DNA, 15 bp, Homo sapiens
ctgattggccagccg

SEQ ID NO: 2708139 - DNA, 19 bp, Homo sapiens
ctgcaaagggaactgaaga

SEQ ID NO: 2708140 - DNA, 18 bp, Homo sapiens
ctgcaagaggctcctgtc

SEQ ID NO: 2708141 - DNA, 14 bp, Homo sapiens
ctgcaagctctgcc

SEQ ID NO: 2708142 - DNA, 13 bp, Homo sapiens
ctgcaccaaccca

SEQ ID NO: 2708143 - DNA, 14 bp, Homo sapiens
ctgcaccccctcct

SEQ ID NO: 2708144 - DNA, 16 bp, Homo sapiens
ctgcaccccctcctgc

SEQ ID NO: 2708145 - DNA, 17 bp, Homo sapiens
ctgcaccccctcctgct

SEQ ID NO: 2708146 - DNA, 18 bp, Homo sapiens
ctgcaccccctcctgctg

SEQ ID NO: 2708147 - DNA, 20 bp, Homo sapiens
ctgcaccccctcctgctgca

SEQ ID NO: 2708148 - DNA, 19 bp, Homo sapiens
ctgcacctgccagcctggc

SEQ ID NO: 2708149 - DNA, 20 bp, Homo sapiens
ctgcacctgccagcctggct

SEQ ID NO: 2708150 - DNA, 18 bp, Homo sapiens
ctgcacgccgtggagcat

SEQ ID NO: 2708151 - DNA, 16 bp, Homo sapiens
ctgcacgtcaccctcc

SEQ ID NO: 2708152 - DNA, 16 bp, Homo sapiens
ctgcactccagcctgg

SEQ ID NO: 2708153 - DNA, 20 bp, Homo sapiens
ctgcactccagcctgggcga

SEQ ID NO: 2708154 - DNA, 13 bp, Homo sapiens
ctgcactcctgga

SEQ ID NO: 2708155 - DNA, 14 bp, Homo sapiens
ctgcactcctggaa

SEQ ID NO: 2708156 - DNA, 13 bp, Homo sapiens
ctgcactgtcctg

SEQ ID NO: 2708157 - DNA, 16 bp, Homo sapiens
ctgcactgtcctgctc

SEQ ID NO: 2708158 - DNA, 20 bp, Homo sapiens
ctgcactgtcctgctccaca

SEQ ID NO: 2708159 - DNA, 21 bp, Homo sapiens
ctgcagagctatggtgaggtg

SEQ ID NO: 2708160 - DNA, 13 bp, Homo sapiens
ctgcagaggggca

SEQ ID NO: 2708161 - DNA, 19 bp, Homo sapiens
ctgcagaggggcaggccct

SEQ ID NO: 2708162 - DNA, 22 bp, Homo sapiens
ctgcagaggggctttctggaga

SEQ ID NO: 2708163 - DNA, 15 bp, Homo sapiens
ctgcagctcctggaa

SEQ ID NO: 2708164 - DNA, 13 bp, Homo sapiens
ctgcagcttggag

SEQ ID NO: 2708165 - DNA, 14 bp, Homo sapiens
ctgcagcttggaga

SEQ ID NO: 2708166 - DNA, 17 bp, Homo sapiens
ctgcaggaaatcagagc

SEQ ID NO: 2708167 - DNA, 22 bp, Homo sapiens
ctgcaggaaatcagagctggca

SEQ ID NO: 2708168 - DNA, 15 bp, Homo sapiens
ctgcaggccaagagc

SEQ ID NO: 2708169 - DNA, 23 bp, Homo sapiens
ctgcatgcataatgaaccgttta

SEQ ID NO: 2708170 - DNA, 23 bp, Homo sapiens
ctgcatgtaaaatcttcagctgg

SEQ ID NO: 2708171 - DNA, 21 bp, Homo sapiens
ctgcattcacagcgcctcctg

SEQ ID NO: 2708172 - DNA, 12 bp, Homo sapiens
ctgccactctgc

SEQ ID NO: 2708173 - DNA, 18 bp, Homo sapiens
ctgccactctgctgcctg

SEQ ID NO: 2708174 - DNA, 19 bp, Homo sapiens
ctgccactttggtacatgg

SEQ ID NO: 2708175 - DNA, 14 bp, Homo sapiens
ctgccagcctggct

SEQ ID NO: 2708176 - DNA, 13 bp, Homo sapiens
ctgccagctctgt

SEQ ID NO: 2708177 - DNA, 20 bp, Homo sapiens
ctgccatttgcaccctccgc

SEQ ID NO: 2708178 - DNA, 16 bp, Homo sapiens
ctgcccaactttcatt

SEQ ID NO: 2708179 - DNA, 13 bp, Homo sapiens
ctgcccagcctgc

SEQ ID NO: 2708180 - DNA, 18 bp, Homo sapiens
ctgcccagcctgccccag

SEQ ID NO: 2708181 - DNA, 13 bp, Homo sapiens
ctgccccagctct

SEQ ID NO: 2708182 - DNA, 16 bp, Homo sapiens
ctgccccagctctggc

SEQ ID NO: 2708183 - DNA, 18 bp, Homo sapiens
ctgccccagctctggctt

SEQ ID NO: 2708184 - DNA, 19 bp, Homo sapiens
ctgccccagctctggcttc

SEQ ID NO: 2708185 - DNA, 20 bp, Homo sapiens
ctgcccccaactcccggagg

SEQ ID NO: 2708186 - DNA, 14 bp, Homo sapiens
ctgccccctggtgg

SEQ ID NO: 2708187 - DNA, 11 bp, Homo sapiens
ctgcccctccc

SEQ ID NO: 2708188 - DNA, 18 bp, Homo sapiens
ctgcccctccccagccct

SEQ ID NO: 2708189 - DNA, 14 bp, Homo sapiens
ctgcccctccctag

SEQ ID NO: 2708190 - DNA, 22 bp, Homo sapiens
ctgcccctccctagatccaggc

SEQ ID NO: 2708191 - DNA, 14 bp, Homo sapiens
ctgcccgcagagcc

SEQ ID NO: 2708192 - DNA, 22 bp, Homo sapiens
ctgcccgcctcggcctcccaaa

SEQ ID NO: 2708193 - DNA, 13 bp, Homo sapiens
ctgcccgctccca

SEQ ID NO: 2708194 - DNA, 15 bp, Homo sapiens
ctgcccgctcccagt

SEQ ID NO: 2708195 - DNA, 20 bp, Homo sapiens
ctgcccggcgccctctgtcc

SEQ ID NO: 2708196 - DNA, 21 bp, Homo sapiens
ctgcccggcgccctctgtcct

SEQ ID NO: 2708197 - DNA, 13 bp, Homo sapiens
ctgccctgccact

SEQ ID NO: 2708198 - DNA, 13 bp, Homo sapiens
ctgccgatgccca

SEQ ID NO: 2708199 - DNA, 22 bp, Homo sapiens
ctgccgatgcccaatccaggcc

SEQ ID NO: 2708200 - DNA, 13 bp, Homo sapiens
ctgccgcctcccg

SEQ ID NO: 2708201 - DNA, 21 bp, Homo sapiens
ctgccgggtggggggagggca

SEQ ID NO: 2708202 - DNA, 15 bp, Homo sapiens
ctgcctagctcttgg

SEQ ID NO: 2708203 - DNA, 12 bp, Homo sapiens
ctgcctcagcct

SEQ ID NO: 2708204 - DNA, 15 bp, Homo sapiens
ctgcctcagcctcct

SEQ ID NO: 2708205 - DNA, 13 bp, Homo sapiens
ctgcctcatcctc

SEQ ID NO: 2708206 - DNA, 16 bp, Homo sapiens
ctgcctcatcctcctc

SEQ ID NO: 2708207 - DNA, 20 bp, Homo sapiens
ctgcctcatcctcctcctca

SEQ ID NO: 2708208 - DNA, 16 bp, Homo sapiens
ctgcctccactcccac

SEQ ID NO: 2708209 - DNA, 17 bp, Homo sapiens
ctgcctccccaatccat

SEQ ID NO: 2708210 - DNA, 15 bp, Homo sapiens
ctgcctcgtttccct

SEQ ID NO: 2708211 - DNA, 21 bp, Homo sapiens
ctgcctctaactccctcctca

SEQ ID NO: 2708212 - DNA, 22 bp, Homo sapiens
ctgcctctaactccctcctcac

SEQ ID NO: 2708213 - DNA, 14 bp, Homo sapiens
ctgcctctcttctg

SEQ ID NO: 2708214 - DNA, 18 bp, Homo sapiens
ctgcctgagattctttaa

SEQ ID NO: 2708215 - DNA, 13 bp, Homo sapiens
ctgcctgctgggc

SEQ ID NO: 2708216 - DNA, 16 bp, Homo sapiens
ctgcctgctgtggagc

SEQ ID NO: 2708217 - DNA, 14 bp, Homo sapiens
ctgcctggagcagg

SEQ ID NO: 2708218 - DNA, 16 bp, Homo sapiens
ctgcctggagcagggg

SEQ ID NO: 2708219 - DNA, 18 bp, Homo sapiens
ctgcctggagcaggggtg

SEQ ID NO: 2708220 - DNA, 19 bp, Homo sapiens
ctgcctgtgcatgacctga

SEQ ID NO: 2708221 - DNA, 14 bp, Homo sapiens
ctgcctgttctcca

SEQ ID NO: 2708222 - DNA, 16 bp, Homo sapiens
ctgcctgttctccaga

SEQ ID NO: 2708223 - DNA, 20 bp, Homo sapiens
ctgccttgaagccactgaag

SEQ ID NO: 2708224 - DNA, 14 bp, Homo sapiens
ctgccttgtgtaca

SEQ ID NO: 2708225 - DNA, 17 bp, Homo sapiens
ctgcgaaggggccctgg

SEQ ID NO: 2708226 - DNA, 18 bp, Homo sapiens
ctgcgaaggggccctggt

SEQ ID NO: 2708227 - DNA, 17 bp, Homo sapiens
ctgcgcctctccactgt

SEQ ID NO: 2708228 - DNA, 15 bp, Homo sapiens
ctgcggagcagcctc

SEQ ID NO: 2708229 - DNA, 16 bp, Homo sapiens
ctgcggagcagcctcc

SEQ ID NO: 2708230 - DNA, 17 bp, Homo sapiens
ctgcggagcagcctcca

SEQ ID NO: 2708231 - DNA, 19 bp, Homo sapiens
ctgcgggatggtcctgggg

SEQ ID NO: 2708232 - DNA, 20 bp, Homo sapiens
ctgcgggatggtcctggggc

SEQ ID NO: 2708233 - DNA, 14 bp, Homo sapiens
ctgcgggctgaggg

SEQ ID NO: 2708234 - DNA, 14 bp, Homo sapiens
ctgcggtgtctgca

SEQ ID NO: 2708235 - DNA, 13 bp, Homo sapiens
ctgcgtcctgagg

SEQ ID NO: 2708236 - DNA, 14 bp, Homo sapiens
ctgcgtcctgagga

SEQ ID NO: 2708237 - DNA, 21 bp, Homo sapiens
ctgctaggggaaggactggcc

SEQ ID NO: 2708238 - DNA, 23 bp, Homo sapiens
ctgctaggggaaggactggccgt

SEQ ID NO: 2708239 - DNA, 20 bp, Homo sapiens
ctgctatatgccttaagcca

SEQ ID NO: 2708240 - DNA, 17 bp, Homo sapiens
ctgctatattttcatga

SEQ ID NO: 2708241 - DNA, 13 bp, Homo sapiens
ctgctccacagtg

SEQ ID NO: 2708242 - DNA, 14 bp, Homo sapiens
ctgctccacagtgt

SEQ ID NO: 2708243 - DNA, 19 bp, Homo sapiens
ctgctcctagcccagcaga

SEQ ID NO: 2708244 - DNA, 14 bp, Homo sapiens
ctgctcgaagaaca

SEQ ID NO: 2708245 - DNA, 11 bp, Homo sapiens
ctgctctgcta

SEQ ID NO: 2708246 - DNA, 19 bp, Homo sapiens
ctgctcttacttcccccac

SEQ ID NO: 2708247 - DNA, 15 bp, Homo sapiens
ctgctgcaccaaccc

SEQ ID NO: 2708248 - DNA, 17 bp, Homo sapiens
ctgctgcaccaacccag

SEQ ID NO: 2708249 - DNA, 18 bp, Homo sapiens
ctgctgcaccaacccagc

SEQ ID NO: 2708250 - DNA, 19 bp, Homo sapiens
ctgctgcaccaacccagcc

SEQ ID NO: 2708251 - DNA, 17 bp, Homo sapiens
ctgctgcagaggggcag

SEQ ID NO: 2708252 - DNA, 22 bp, Homo sapiens
ctgctgcagaggggcaggccct

SEQ ID NO: 2708253 - DNA, 23 bp, Homo sapiens
ctgctgcagaggggcaggccctg

SEQ ID NO: 2708254 - DNA, 14 bp, Homo sapiens
cttgctgtcctagg

SEQ ID NO: 2708255 - DNA, 15 bp, Homo sapiens
cttgctgtcctaggc

SEQ ID NO: 2708256 - DNA, 21 bp, Homo sapiens
cttggaaagcatcacctcagg

SEQ ID NO: 2708257 - DNA, 21 bp, Homo sapiens
cttggaattttgtaaaaagaa

SEQ ID NO: 2708258 - DNA, 15 bp, Homo sapiens
cttggagagcagctg

SEQ ID NO: 2708259 - DNA, 20 bp, Homo sapiens
cttggagagcagctggctct

SEQ ID NO: 2708260 - DNA, 12 bp, Homo sapiens
cttggcacctgc

SEQ ID NO: 2708261 - DNA, 15 bp, Homo sapiens
cttggcacctgccta

SEQ ID NO: 2708262 - DNA, 15 bp, Homo sapiens
cttggcagctgaact

SEQ ID NO: 2708263 - DNA, 19 bp, Homo sapiens
cttggcatcacagggcaga

SEQ ID NO: 2708264 - DNA, 20 bp, Homo sapiens
cttggcatcacagggcagag

SEQ ID NO: 2708265 - DNA, 15 bp, Homo sapiens
cttggcttcccctcc

SEQ ID NO: 2708266 - DNA, 17 bp, Homo sapiens
cttggcttcccctccac

SEQ ID NO: 2708267 - DNA, 20 bp, Homo sapiens
cttggcttcccctccaccct

SEQ ID NO: 2708268 - DNA, 20 bp, Homo sapiens
cttgggaggacaggtcctga

SEQ ID NO: 2708269 - DNA, 18 bp, Homo sapiens
cttgggcctgacctccag

SEQ ID NO: 2708270 - DNA, 22 bp, Homo sapiens
cttggggctcgccccacccagg

SEQ ID NO: 2708271 - DNA, 22 bp, Homo sapiens
cttggtatatctggccacactg

SEQ ID NO: 2708272 - DNA, 16 bp, Homo sapiens
cttggtcccagacagc

SEQ ID NO: 2708273 - DNA, 21 bp, Homo sapiens
cttggtcccagacagctggac

SEQ ID NO: 2708274 - DNA, 24 bp, Homo sapiens
cttggtcccagacagctggaccca

SEQ ID NO: 2708275 - DNA, 15 bp, Homo sapiens
cttggtcccgtgaaa

SEQ ID NO: 2708276 - DNA, 13 bp, Homo sapiens
cttgtaaatactc

SEQ ID NO: 2708277 - DNA, 15 bp, Homo sapiens
cttgtaatatttctt

SEQ ID NO: 2708278 - DNA, 14 bp, Homo sapiens
cttgtattgctcca

SEQ ID NO: 2708279 - DNA, 20 bp, Homo sapiens
cttgtcaatggaagaaaccc

SEQ ID NO: 2708280 - DNA, 17 bp, Homo sapiens
cttgtccctggggcact

SEQ ID NO: 2708281 - DNA, 21 bp, Homo sapiens
cttgtccctggggcactcccc

SEQ ID NO: 2708282 - DNA, 22 bp, Homo sapiens
cttgtccctggggcactccccc

SEQ ID NO: 2708283 - DNA, 13 bp, Homo sapiens
cttgtcctctcag

SEQ ID NO: 2708284 - DNA, 21 bp, Homo sapiens
cttgtcctctcagagcctcag

SEQ ID NO: 2708285 - DNA, 22 bp, Homo sapiens
cttgtggactctctgcctgctt

SEQ ID NO: 2708286 - DNA, 15 bp, Homo sapiens
cttgttgtttttaag

SEQ ID NO: 2708287 - DNA, 21 bp, Homo sapiens
cttgttgtttttaagtcctgt

SEQ ID NO: 2708288 - DNA, 22 bp, Homo sapiens
ctttaatctgttgtttgaagaa

SEQ ID NO: 2708289 - DNA, 12 bp, Homo sapiens
ctttacaaataa

SEQ ID NO: 2708290 - DNA, 21 bp, Homo sapiens
ctttacaaataattttttgca

SEQ ID NO: 2708291 - DNA, 15 bp, Homo sapiens
ctttaggcagcctgc

SEQ ID NO: 2708292 - DNA, 17 bp, Homo sapiens
ctttataagccaatgaa

SEQ ID NO: 2708293 - DNA, 20 bp, Homo sapiens
ctttataccccatttgattt

SEQ ID NO: 2708294 - DNA, 12 bp, Homo sapiens
ctttatattttg

SEQ ID NO: 2708295 - DNA, 15 bp, Homo sapiens
ctttatcccctcctt

SEQ ID NO: 2708296 - DNA, 20 bp, Homo sapiens
ctttatgaggtcgtataatt

SEQ ID NO: 2708297 - DNA, 16 bp, Homo sapiens
ctttatgcaaaaacat

SEQ ID NO: 2708298 - DNA, 19 bp, Homo sapiens
ctttatgcaaaaacatatg

SEQ ID NO: 2708299 - DNA, 13 bp, Homo sapiens
ctttcaaaagaca

SEQ ID NO: 2708300 - DNA, 17 bp, Homo sapiens
ctttcacaggactctgc

SEQ ID NO: 2708301 - DNA, 13 bp, Homo sapiens
ctttcagctgtga

SEQ ID NO: 2708302 - DNA, 17 bp, Homo sapiens
ctttcatttgaaagtgg

SEQ ID NO: 2708303 - DNA, 19 bp, Homo sapiens
ctttcctgccgtccctcct

SEQ ID NO: 2708304 - DNA, 21 bp, Homo sapiens
ctttcctgccgtccctcctgt

SEQ ID NO: 2708305 - DNA, 21 bp, Homo sapiens
ctttctcgtggtagaagccag

SEQ ID NO: 2708306 - DNA, 18 bp, Homo sapiens
ctttctttgcaccaaaga

SEQ ID NO: 2708307 - DNA, 21 bp, Homo sapiens
ctttctttgcaccaaagacat

SEQ ID NO: 2708308 - DNA, 15 bp, Homo sapiens
ctttctttgctgctg

SEQ ID NO: 2708309 - DNA, 18 bp, Homo sapiens
ctttgaaggtaataaata

SEQ ID NO: 2708310 - DNA, 20 bp, Homo sapiens
ctttgaaggtaataaataca

SEQ ID NO: 2708311 - DNA, 22 bp, Homo sapiens
ctttgatatgtgagcaacattt

SEQ ID NO: 2708312 - DNA, 16 bp, Homo sapiens
ctttgattttaaattt

SEQ ID NO: 2708313 - DNA, 13 bp, Homo sapiens
ctttgcaccaaag

SEQ ID NO: 2708314 - DNA, 14 bp, Homo sapiens
ctttgcaccaaaga

SEQ ID NO: 2708315 - DNA, 17 bp, Homo sapiens
ctttgcaccaaagacat

SEQ ID NO: 2708316 - DNA, 19 bp, Homo sapiens
ctttgccatgggcctgctg

SEQ ID NO: 2708317 - DNA, 20 bp, Homo sapiens
ctttgccatgggcctgctgc

SEQ ID NO: 2708318 - DNA, 15 bp, Homo sapiens
ctttgcccacacaca

SEQ ID NO: 2708319 - DNA, 18 bp, Homo sapiens
ctttgcccacacacactc

SEQ ID NO: 2708320 - DNA, 19 bp, Homo sapiens
ctttgcccacacacactcc

SEQ ID NO: 2708321 - DNA, 19 bp, Homo sapiens
ctttgccccggcttgcctg

SEQ ID NO: 2708322 - DNA, 15 bp, Homo sapiens
ctttgctacaataaa

SEQ ID NO: 2708323 - DNA, 16 bp, Homo sapiens
ctttgctacaataaat

SEQ ID NO: 2708324 - DNA, 19 bp, Homo sapiens
ctttgctacaataaatgct

SEQ ID NO: 2708325 - DNA, 16 bp, Homo sapiens
ctttgctgaatgtcat

SEQ ID NO: 2708326 - DNA, 12 bp, Homo sapiens
ctttgggaaagc

SEQ ID NO: 2708327 - DNA, 22 bp, Homo sapiens
ctttggtacatggccagtgtga

SEQ ID NO: 2708328 - DNA, 16 bp, Homo sapiens
ctttgtctgctcccaa

SEQ ID NO: 2708329 - DNA, 16 bp, Homo sapiens
ctttgtgcaaaagcag

SEQ ID NO: 2708330 - DNA, 17 bp, Homo sapiens
ctttgtgcaaaagcagg

SEQ ID NO: 2708331 - DNA, 22 bp, Homo sapiens
ctttgtgtacttcagtcttgga

SEQ ID NO: 2708332 - DNA, 14 bp, Homo sapiens
cttttcagcttctg

SEQ ID NO: 2708333 - DNA, 19 bp, Homo sapiens
cttttcagcttctgctggg

SEQ ID NO: 2708334 - DNA, 15 bp, Homo sapiens
cttttctgcagaggg

SEQ ID NO: 2708335 - DNA, 15 bp, Homo sapiens
cttttgaagaacaaa

SEQ ID NO: 2708336 - DNA, 22 bp, Homo sapiens
cttttgaagaacaaaaggcttt

SEQ ID NO: 2708337 - DNA, 17 bp, Homo sapiens
cttttgtcctgttattt

SEQ ID NO: 2708338 - DNA, 21 bp, Homo sapiens
cttttgttattaaaaaaacac

SEQ ID NO: 2708339 - DNA, 20 bp, Homo sapiens
cttttgttttcttcatttct

SEQ ID NO: 2708340 - DNA, 12 bp, Homo sapiens
ctttttaaacag

SEQ ID NO: 2708341 - DNA, 21 bp, Homo sapiens
ctttttgcaggggactgggcc

SEQ ID NO: 2708342 - DNA, 19 bp, Homo sapiens
ctttttttttttctgcctg

SEQ ID NO: 2708343 - DNA, 20 bp, Homo sapiens
ctttttttttttctgcctga

SEQ ID NO: 2708344 - DNA, 14 bp, Homo sapiens
gaaaaaagaaatcc

SEQ ID NO: 2708345 - DNA, 14 bp, Homo sapiens
gaaaaaagaagttt

SEQ ID NO: 2708346 - DNA, 11 bp, Homo sapiens
gaaaacccctg

SEQ ID NO: 2708347 - DNA, 14 bp, Homo sapiens
gaaaaccctaagtg

SEQ ID NO: 2708348 - DNA, 16 bp, Homo sapiens
gaaaaccctaagtgtg

SEQ ID NO: 2708349 - DNA, 15 bp, Homo sapiens
gaaaacttatttgag

SEQ ID NO: 2708350 - DNA, 18 bp, Homo sapiens
gaaaagacattgaaagct

SEQ ID NO: 2708351 - DNA, 20 bp, Homo sapiens
gaaaagacattgaaagctct

SEQ ID NO: 2708352 - DNA, 18 bp, Homo sapiens
gaaaagagggagagatga

SEQ ID NO: 2708353 - DNA, 20 bp, Homo sapiens
gaaaatagggtccttgaaac

SEQ ID NO: 2708354 - DNA, 14 bp, Homo sapiens
gaaaatatttaaag

SEQ ID NO: 2708355 - DNA, 21 bp, Homo sapiens
gaaaatcaatgaaggatttct

SEQ ID NO: 2708356 - DNA, 13 bp, Homo sapiens
gaaaatcagattt

SEQ ID NO: 2708357 - DNA, 18 bp, Homo sapiens
gaaaatgcaggagagctt

SEQ ID NO: 2708358 - DNA, 15 bp, Homo sapiens
gaaaatgcattatgt

SEQ ID NO: 2708359 - DNA, 13 bp, Homo sapiens
gaaaatgtgtctg

SEQ ID NO: 2708360 - DNA, 22 bp, Homo sapiens
gaaaatgtgtctgcaacatgga

SEQ ID NO: 2708361 - DNA, 12 bp, Homo sapiens
gaaacactaaat

SEQ ID NO: 2708362 - DNA, 13 bp, Homo sapiens
gaaacattttcat

SEQ ID NO: 2708363 - DNA, 13 bp, Homo sapiens
gaaaccacacttc

SEQ ID NO: 2708364 - DNA, 17 bp, Homo sapiens
gaaaccacacttcttga

SEQ ID NO: 2708365 - DNA, 21 bp, Homo sapiens
gaaaccacacttcttgaaaca

SEQ ID NO: 2708366 - DNA, 19 bp, Homo sapiens
gaaaccagtgtagccttgc

SEQ ID NO: 2708367 - DNA, 20 bp, Homo sapiens
gaaacctgtccataaagtaa

SEQ ID NO: 2708368 - DNA, 21 bp, Homo sapiens
gaaacctttctactttttctg

SEQ ID NO: 2708369 - DNA, 18 bp, Homo sapiens
gaaactaccagtgggcat

SEQ ID NO: 2708370 - DNA, 20 bp, Homo sapiens
gaaactaccagtgggcatgt

SEQ ID NO: 2708371 - DNA, 13 bp, Homo sapiens
gaaagacatcaat

SEQ ID NO: 2708372 - DNA, 15 bp, Homo sapiens
gaaagacatcaatga

SEQ ID NO: 2708373 - DNA, 22 bp, Homo sapiens
gaaagaccatgtggtttgctgt

SEQ ID NO: 2708374 - DNA, 14 bp, Homo sapiens
gaaagactgaaaga

SEQ ID NO: 2708375 - DNA, 16 bp, Homo sapiens
gaaagaggttctgcac

SEQ ID NO: 2708376 - DNA, 19 bp, Homo sapiens
gaaagcaccgcagcatgtg

SEQ ID NO: 2708377 - DNA, 22 bp, Homo sapiens
gaaagcaccgcagcatgtgggg

SEQ ID NO: 2708378 - DNA, 13 bp, Homo sapiens
gagtcaccatgca

SEQ ID NO: 2708379 - DNA, 16 bp, Homo sapiens
gagtcaccatgcaagg

SEQ ID NO: 2708380 - DNA, 18 bp, Homo sapiens
gagtcaccatgcaagggt

SEQ ID NO: 2708381 - DNA, 15 bp, Homo sapiens
gagtccagggcggga

SEQ ID NO: 2708382 - DNA, 13 bp, Homo sapiens
gagtcccttagaa

SEQ ID NO: 2708383 - DNA, 15 bp, Homo sapiens
gagtctcgctctgct

SEQ ID NO: 2708384 - DNA, 16 bp, Homo sapiens
gagtctcgctctgctg

SEQ ID NO: 2708385 - DNA, 22 bp, Homo sapiens
gagtctcgctctgctgcccagg

SEQ ID NO: 2708386 - DNA, 16 bp, Homo sapiens
gagtctctccagcctc

SEQ ID NO: 2708387 - DNA, 20 bp, Homo sapiens
gagtctctccagcctcacag

SEQ ID NO: 2708388 - DNA, 11 bp, Homo sapiens
gagtctctggc

SEQ ID NO: 2708389 - DNA, 14 bp, Homo sapiens
gagtctctggctca

SEQ ID NO: 2708390 - DNA, 18 bp, Homo sapiens
gagtctctggctcagctg

SEQ ID NO: 2708391 - DNA, 19 bp, Homo sapiens
gagtctctggctcagctgt

SEQ ID NO: 2708392 - DNA, 20 bp, Homo sapiens
gagtctggcaaacatgtgca

SEQ ID NO: 2708393 - DNA, 16 bp, Homo sapiens
gagtgacaggcaccag

SEQ ID NO: 2708394 - DNA, 23 bp, Homo sapiens
gagtgagcagtagaagcctgcag

SEQ ID NO: 2708395 - DNA, 23 bp, Homo sapiens
gagtggcattggcagcaggtgct

SEQ ID NO: 2708396 - DNA, 14 bp, Homo sapiens
gagtgtcctgtctg

SEQ ID NO: 2708397 - DNA, 16 bp, Homo sapiens
gagtgtcctgtctgct

SEQ ID NO: 2708398 - DNA, 13 bp, Homo sapiens
gagtgtctctgcc

SEQ ID NO: 2708399 - DNA, 14 bp, Homo sapiens
gagtgtctctgcct

SEQ ID NO: 2708400 - DNA, 16 bp, Homo sapiens
gagtgtctctgcctgg

SEQ ID NO: 2708401 - DNA, 15 bp, Homo sapiens
gagtgtgactttttg

SEQ ID NO: 2708402 - DNA, 18 bp, Homo sapiens
gagttcaagaccagcctg

SEQ ID NO: 2708403 - DNA, 19 bp, Homo sapiens
gagttcgagaccagcctgg

SEQ ID NO: 2708404 - DNA, 21 bp, Homo sapiens
gagttcgagaccagcctggcc

SEQ ID NO: 2708405 - DNA, 16 bp, Homo sapiens
gagttgtggaaagcct

SEQ ID NO: 2708406 - DNA, 13 bp, Homo sapiens
gataaattacatt

SEQ ID NO: 2708407 - DNA, 21 bp, Homo sapiens
gataactgcaattttaattga

SEQ ID NO: 2708408 - DNA, 14 bp, Homo sapiens
gatacagtcattat

SEQ ID NO: 2708409 - DNA, 23 bp, Homo sapiens
gatagacgggttgaaagacatca

SEQ ID NO: 2708410 - DNA, 15 bp, Homo sapiens
gatagtgcctctgca

SEQ ID NO: 2708411 - DNA, 17 bp, Homo sapiens
gatagtgcttcttgtaa

SEQ ID NO: 2708412 - DNA, 19 bp, Homo sapiens
gatataatatcagatttca

SEQ ID NO: 2708413 - DNA, 20 bp, Homo sapiens
gatatctgtttgcttctaaa

SEQ ID NO: 2708414 - DNA, 20 bp, Homo sapiens
gatattggttctatttattt

SEQ ID NO: 2708415 - DNA, 22 bp, Homo sapiens
gatattgtcagagttctgctct

SEQ ID NO: 2708416 - DNA, 14 bp, Homo sapiens
gatcactggagccc

SEQ ID NO: 2708417 - DNA, 17 bp, Homo sapiens
gatcactggagcccagg

SEQ ID NO: 2708418 - DNA, 21 bp, Homo sapiens
gatcagcctccgccattccaa

SEQ ID NO: 2708419 - DNA, 23 bp, Homo sapiens
gatcatcccatctaagctgcagc

SEQ ID NO: 2708420 - DNA, 19 bp, Homo sapiens
gatcatctttgctgaatgt

SEQ ID NO: 2708421 - DNA, 19 bp, Homo sapiens
gatcattacatggctgtgg

SEQ ID NO: 2708422 - DNA, 17 bp, Homo sapiens
gatcattatcttcatgt

SEQ ID NO: 2708423 - DNA, 19 bp, Homo sapiens
gatccaaatgctgtgcaaa

SEQ ID NO: 2708424 - DNA, 14 bp, Homo sapiens
gatccaggcttctc

SEQ ID NO: 2708425 - DNA, 21 bp, Homo sapiens
gatcccccaagtgtcctggac

SEQ ID NO: 2708426 - DNA, 17 bp, Homo sapiens
gatcccctgtcccctgg

SEQ ID NO: 2708427 - DNA, 18 bp, Homo sapiens
gatcccctgtcccctggg

SEQ ID NO: 2708428 - DNA, 21 bp, Homo sapiens
gatcccctgtcccctggggct

SEQ ID NO: 2708429 - DNA, 15 bp, Homo sapiens
gatcctccatttttg

SEQ ID NO: 2708430 - DNA, 16 bp, Homo sapiens
gatcctgggcatgatg

SEQ ID NO: 2708431 - DNA, 21 bp, Homo sapiens
gatctagttctcaatcactgc

SEQ ID NO: 2708432 - DNA, 23 bp, Homo sapiens
gatctgcccgcctcggcctccca

SEQ ID NO: 2708433 - DNA, 16 bp, Homo sapiens
gatctgcttccctggg

SEQ ID NO: 2708434 - DNA, 18 bp, Homo sapiens
gatctttaaatacagtca

SEQ ID NO: 2708435 - DNA, 18 bp, Homo sapiens
gatctttctttccaaaac

SEQ ID NO: 2708436 - DNA, 19 bp, Homo sapiens
gatctttttgtgaaattca

SEQ ID NO: 2708437 - DNA, 14 bp, Homo sapiens
gatgaaaagccata

SEQ ID NO: 2708438 - DNA, 14 bp, Homo sapiens
gatgactgagtcct

SEQ ID NO: 2708439 - DNA, 16 bp, Homo sapiens
gatgagaaaactgaga

SEQ ID NO: 2708440 - DNA, 17 bp, Homo sapiens
gatgatgatgatgatga

SEQ ID NO: 2708441 - DNA, 13 bp, Homo sapiens
gatgatgccacac

SEQ ID NO: 2708442 - DNA, 21 bp, Homo sapiens
gatgcattcccggtgcagaac

SEQ ID NO: 2708443 - DNA, 18 bp, Homo sapiens
gatgcccaatccaggccc

SEQ ID NO: 2708444 - DNA, 18 bp, Homo sapiens
gatgcccagagggcccag

SEQ ID NO: 2708445 - DNA, 19 bp, Homo sapiens
gatgcccagagggcccagg

SEQ ID NO: 2708446 - DNA, 22 bp, Homo sapiens
gatgcccagagggcccaggcag

SEQ ID NO: 2708447 - DNA, 23 bp, Homo sapiens
gatgcgggcattttgaatgtgat

SEQ ID NO: 2708448 - DNA, 16 bp, Homo sapiens
gatgctgcctgagtca

SEQ ID NO: 2708449 - DNA, 15 bp, Homo sapiens
gatgctgggctgggt

SEQ ID NO: 2708450 - DNA, 23 bp, Homo sapiens
gatgctttgtttctttcatatga

SEQ ID NO: 2708451 - DNA, 14 bp, Homo sapiens
gatggaagagtcat

SEQ ID NO: 2708452 - DNA, 16 bp, Homo sapiens
gatggagcctgaaccg

SEQ ID NO: 2708453 - DNA, 16 bp, Homo sapiens
gatggagcgcacctgc

SEQ ID NO: 2708454 - DNA, 18 bp, Homo sapiens
gatggagtctcgctctgc

SEQ ID NO: 2708455 - DNA, 14 bp, Homo sapiens
gatggctggaagga

SEQ ID NO: 2708456 - DNA, 15 bp, Homo sapiens
gatgggatttcaccg

SEQ ID NO: 2708457 - DNA, 23 bp, Homo sapiens
gatgggatttcaccgtattagcc

SEQ ID NO: 2708458 - DNA, 14 bp, Homo sapiens
gatgggccgagcca

SEQ ID NO: 2708459 - DNA, 21 bp, Homo sapiens
gatgggctttctcagtgtcag

SEQ ID NO: 2708460 - DNA, 15 bp, Homo sapiens
gatggtcctggggct

SEQ ID NO: 2708461 - DNA, 24 bp, Homo sapiens
gatggtcctggggctctgtgcagg

SEQ ID NO: 2708462 - DNA, 19 bp, Homo sapiens
gatggtctgcatcagcttt

SEQ ID NO: 2708463 - DNA, 18 bp, Homo sapiens
gatggtcttgatctcctg

SEQ ID NO: 2708464 - DNA, 18 bp, Homo sapiens
gatgtcattcagcagtca

SEQ ID NO: 2708465 - DNA, 19 bp, Homo sapiens
gatgtgctcccaccaggca

SEQ ID NO: 2708466 - DNA, 23 bp, Homo sapiens
gatgtgggctcagatcctgggca

SEQ ID NO: 2708467 - DNA, 20 bp, Homo sapiens
gatgttcagaattttggaaa

SEQ ID NO: 2708468 - DNA, 19 bp, Homo sapiens
gattaaacagcaaagccat

SEQ ID NO: 2708469 - DNA, 20 bp, Homo sapiens
gattaaatgtgtcattggaa

SEQ ID NO: 2708470 - DNA, 16 bp, Homo sapiens
gattaactttcaaaag

SEQ ID NO: 2708471 - DNA, 22 bp, Homo sapiens
gattacaataaatcctttactt

SEQ ID NO: 2708472 - DNA, 13 bp, Homo sapiens
gattatatatcat

SEQ ID NO: 2708473 - DNA, 15 bp, Homo sapiens
gattatatatcataa

SEQ ID NO: 2708474 - DNA, 22 bp, Homo sapiens
gattatatatcataaagtatgc

SEQ ID NO: 2708475 - DNA, 17 bp, Homo sapiens
gattcaggagctcagtt

SEQ ID NO: 2708476 - DNA, 13 bp, Homo sapiens
gattccaaagcat

SEQ ID NO: 2708477 - DNA, 11 bp, Homo sapiens
gattcccagag

SEQ ID NO: 2708478 - DNA, 19 bp, Homo sapiens
gattcccagagagacgctg

SEQ ID NO: 2708479 - DNA, 14 bp, Homo sapiens
gattcctgctgcct

SEQ ID NO: 2708480 - DNA, 17 bp, Homo sapiens
gattctaaacagatgtc

SEQ ID NO: 2708481 - DNA, 15 bp, Homo sapiens
gattcttgtgattga

SEQ ID NO: 2708482 - DNA, 15 bp, Homo sapiens
gattctttaaggaga

SEQ ID NO: 2708483 - DNA, 16 bp, Homo sapiens
gattctttaaggagat

SEQ ID NO: 2708484 - DNA, 14 bp, Homo sapiens
gattgaatgctgcc

SEQ ID NO: 2708485 - DNA, 19 bp, Homo sapiens
gattgaatttttaagcaaa

SEQ ID NO: 2708486 - DNA, 16 bp, Homo sapiens
gattggccctgcccct

SEQ ID NO: 2708487 - DNA, 19 bp, Homo sapiens
gattggccctgcccctccc

SEQ ID NO: 2708488 - DNA, 22 bp, Homo sapiens
gattggccctgcccctccccct

SEQ ID NO: 2708489 - DNA, 19 bp, Homo sapiens
gattgtaaaggtaggtgca

SEQ ID NO: 2708490 - DNA, 22 bp, Homo sapiens
gattgtgcaatagtcagagtgt

SEQ ID NO: 2708491 - DNA, 18 bp, Homo sapiens
gatttagggaagcaggga

SEQ ID NO: 2708492 - DNA, 23 bp, Homo sapiens
gatttcatgcattctagtgcaga

SEQ ID NO: 2708493 - DNA, 18 bp, Homo sapiens
gatttcccgtggccccag

SEQ ID NO: 2708494 - DNA, 23 bp, Homo sapiens
gatttctttctttgcaccaaaga

SEQ ID NO: 2708495 - DNA, 17 bp, Homo sapiens
gatttgcctgcctgggc

SEQ ID NO: 2708496 - DNA, 13 bp, Homo sapiens
gatttggaagaga

SEQ ID NO: 2708497 - DNA, 19 bp, Homo sapiens
gatttggaagagaggcacc

SEQ ID NO: 2708498 - DNA, 15 bp, Homo sapiens
gattttaaatttttt

SEQ ID NO: 2708499 - DNA, 16 bp, Homo sapiens
gattttaccaaagcat

SEQ ID NO: 2708500 - DNA, 14 bp, Homo sapiens
gattttgagtatct

SEQ ID NO: 2708501 - DNA, 19 bp, Homo sapiens
gcctcacagatgctggcct

SEQ ID NO: 2708502 - DNA, 19 bp, Homo sapiens
gcctcagccagccctggag

SEQ ID NO: 2708503 - DNA, 15 bp, Homo sapiens
gcctcagcctccagg

SEQ ID NO: 2708504 - DNA, 16 bp, Homo sapiens
gcctcagcctccaggc

SEQ ID NO: 2708505 - DNA, 13 bp, Homo sapiens
gcctcagcctcct

SEQ ID NO: 2708506 - DNA, 15 bp, Homo sapiens
gcctcatcctcctcc

SEQ ID NO: 2708507 - DNA, 18 bp, Homo sapiens
gcctcatcctcctcctca

SEQ ID NO: 2708508 - DNA, 24 bp, Homo sapiens
gcctcatctgctcctagcccagca

SEQ ID NO: 2708509 - DNA, 22 bp, Homo sapiens
gcctccaaatgccaacttgtcc

SEQ ID NO: 2708510 - DNA, 17 bp, Homo sapiens
gcctccagactgcggag

SEQ ID NO: 2708511 - DNA, 19 bp, Homo sapiens
gcctccagtgctggctgct

SEQ ID NO: 2708512 - DNA, 16 bp, Homo sapiens
gcctcccaaagtgcta

SEQ ID NO: 2708513 - DNA, 19 bp, Homo sapiens
gcctcccagctttctgtgt

SEQ ID NO: 2708514 - DNA, 14 bp, Homo sapiens
gcctccccaatcca

SEQ ID NO: 2708515 - DNA, 22 bp, Homo sapiens
gcctccccaatccatttggcag

SEQ ID NO: 2708516 - DNA, 15 bp, Homo sapiens
gcctcccctgaggat

SEQ ID NO: 2708517 - DNA, 20 bp, Homo sapiens
gcctcccctgaggatcccct

SEQ ID NO: 2708518 - DNA, 21 bp, Homo sapiens
gcctcccctgaggatcccctg

SEQ ID NO: 2708519 - DNA, 18 bp, Homo sapiens
gcctcccttatgcaggac

SEQ ID NO: 2708520 - DNA, 16 bp, Homo sapiens
gcctcctgagtagctg

SEQ ID NO: 2708521 - DNA, 23 bp, Homo sapiens
gcctcgcccaccgcatgccccct

SEQ ID NO: 2708522 - DNA, 14 bp, Homo sapiens
gcctcggaggctcc

SEQ ID NO: 2708523 - DNA, 15 bp, Homo sapiens
gcctcggaggctcct

SEQ ID NO: 2708524 - DNA, 13 bp, Homo sapiens
gcctcggcctccc

SEQ ID NO: 2708525 - DNA, 18 bp, Homo sapiens
gcctcggctcctgctgca

SEQ ID NO: 2708526 - DNA, 21 bp, Homo sapiens
gcctcgtccaaggcagttctg

SEQ ID NO: 2708527 - DNA, 20 bp, Homo sapiens
gcctctaactccctcctcac

SEQ ID NO: 2708528 - DNA, 17 bp, Homo sapiens
gcctctagaacacccac

SEQ ID NO: 2708529 - DNA, 19 bp, Homo sapiens
gcctctagaacacccactg

SEQ ID NO: 2708530 - DNA, 13 bp, Homo sapiens
gcctctccactgt

SEQ ID NO: 2708531 - DNA, 13 bp, Homo sapiens
gcctctcccaccc

SEQ ID NO: 2708532 - DNA, 12 bp, Homo sapiens
gcctctccctta

SEQ ID NO: 2708533 - DNA, 14 bp, Homo sapiens
gcctctgcccagcc

SEQ ID NO: 2708534 - DNA, 14 bp, Homo sapiens
gcctctgcccgcag

SEQ ID NO: 2708535 - DNA, 22 bp, Homo sapiens
gcctctgcccgcagagcccacg

SEQ ID NO: 2708536 - DNA, 16 bp, Homo sapiens
gcctgaccccaggcag

SEQ ID NO: 2708537 - DNA, 14 bp, Homo sapiens
gcctgacctccagt

SEQ ID NO: 2708538 - DNA, 15 bp, Homo sapiens
gcctgacctccagtc

SEQ ID NO: 2708539 - DNA, 12 bp, Homo sapiens
gcctgagattct

SEQ ID NO: 2708540 - DNA, 18 bp, Homo sapiens
gcctgagattctttaagg

SEQ ID NO: 2708541 - DNA, 13 bp, Homo sapiens
gcctgaggctgag

SEQ ID NO: 2708542 - DNA, 14 bp, Homo sapiens
gcctgaggctgaga

SEQ ID NO: 2708543 - DNA, 17 bp, Homo sapiens
gcctgaggctgagactg

SEQ ID NO: 2708544 - DNA, 14 bp, Homo sapiens
gcctgaggctggga

SEQ ID NO: 2708545 - DNA, 17 bp, Homo sapiens
gcctgaggtctcgctga

SEQ ID NO: 2708546 - DNA, 10 bp, Homo sapiens
gcctgcagcc

SEQ ID NO: 2708547 - DNA, 18 bp, Homo sapiens
gcctgccccagcctccca

SEQ ID NO: 2708548 - DNA, 19 bp, Homo sapiens
gcctgccccagcctcccag

SEQ ID NO: 2708549 - DNA, 14 bp, Homo sapiens
gcctgcctgggcct

SEQ ID NO: 2708550 - DNA, 17 bp, Homo sapiens
gcctgctgcgtcagacc

SEQ ID NO: 2708551 - DNA, 12 bp, Homo sapiens
gcctgctgggct

SEQ ID NO: 2708552 - DNA, 14 bp, Homo sapiens
gcctgcttcctgga

SEQ ID NO: 2708553 - DNA, 15 bp, Homo sapiens
gcctgcttcctggac

SEQ ID NO: 2708554 - DNA, 17 bp, Homo sapiens
gcctgcttcctggaccg

SEQ ID NO: 2708555 - DNA, 14 bp, Homo sapiens
gcctggcacagtgt

SEQ ID NO: 2708556 - DNA, 11 bp, Homo sapiens
gcctggccacc

SEQ ID NO: 2708557 - DNA, 11 bp, Homo sapiens
gcctggcccag

SEQ ID NO: 2708558 - DNA, 14 bp, Homo sapiens
gcctggcttctgga

SEQ ID NO: 2708559 - DNA, 15 bp, Homo sapiens
gcctggcttctggag

SEQ ID NO: 2708560 - DNA, 17 bp, Homo sapiens
gcctggcttctggagcc

SEQ ID NO: 2708561 - DNA, 24 bp, Homo sapiens
gcctgggcctcccaaagtgctagg

SEQ ID NO: 2708562 - DNA, 19 bp, Homo sapiens
gcctgggcgacagagcaag

SEQ ID NO: 2708563 - DNA, 16 bp, Homo sapiens
gcctgtcccctcacag

SEQ ID NO: 2708564 - DNA, 16 bp, Homo sapiens
gcctgtcctggtacag

SEQ ID NO: 2708565 - DNA, 13 bp, Homo sapiens
gcctgttctccag

SEQ ID NO: 2708566 - DNA, 15 bp, Homo sapiens
gcctgttctccagat

SEQ ID NO: 2708567 - DNA, 13 bp, Homo sapiens
gccttaagtttcc

SEQ ID NO: 2708568 - DNA, 20 bp, Homo sapiens
gccttcactccggtgtgcct

SEQ ID NO: 2708569 - DNA, 18 bp, Homo sapiens
gccttccccctcccaggg

SEQ ID NO: 2708570 - DNA, 22 bp, Homo sapiens
gccttgcccggattctgggagg

SEQ ID NO: 2708571 - DNA, 21 bp, Homo sapiens
gccttgctattttaataaaga

SEQ ID NO: 2708572 - DNA, 19 bp, Homo sapiens
gccttgggcctcatctgct

SEQ ID NO: 2708573 - DNA, 18 bp, Homo sapiens
gccttggtcccagacagc

SEQ ID NO: 2708574 - DNA, 22 bp, Homo sapiens
gcctttaccctcctctatttct

SEQ ID NO: 2708575 - DNA, 18 bp, Homo sapiens
gccttttataaacctcta

SEQ ID NO: 2708576 - DNA, 21 bp, Homo sapiens
gccttttttagcttcatatct

SEQ ID NO: 2708577 - DNA, 23 bp, Homo sapiens
gcgaaaccccgtctctactaaac

SEQ ID NO: 2708578 - DNA, 20 bp, Homo sapiens
gcgaccccatctgcccagga

SEQ ID NO: 2708579 - DNA, 12 bp, Homo sapiens
gcgaccctggct

SEQ ID NO: 2708580 - DNA, 13 bp, Homo sapiens
gcgagctgctctg

SEQ ID NO: 2708581 - DNA, 14 bp, Homo sapiens
gcgagctgctctgc

SEQ ID NO: 2708582 - DNA, 15 bp, Homo sapiens
gcgagctgctctgct

SEQ ID NO: 2708583 - DNA, 13 bp, Homo sapiens
gcgattgaatgct

SEQ ID NO: 2708584 - DNA, 12 bp, Homo sapiens
gcgcaaacttta

SEQ ID NO: 2708585 - DNA, 16 bp, Homo sapiens
gcgcaccctcccctcc

SEQ ID NO: 2708586 - DNA, 17 bp, Homo sapiens
gcgcaccctcccctccc

SEQ ID NO: 2708587 - DNA, 12 bp, Homo sapiens
gcgcacctgccc

SEQ ID NO: 2708588 - DNA, 23 bp, Homo sapiens
gcgccacggcactccagcctggg

SEQ ID NO: 2708589 - DNA, 21 bp, Homo sapiens
gcgccactacactccagcctg

SEQ ID NO: 2708590 - DNA, 22 bp, Homo sapiens
gcgccactacactccagcctga

SEQ ID NO: 2708591 - DNA, 13 bp, Homo sapiens
gcgccctctgtcc

SEQ ID NO: 2708592 - DNA, 14 bp, Homo sapiens
gcgccctctgtcct

SEQ ID NO: 2708593 - DNA, 15 bp, Homo sapiens
gcgccctctgtcctg

SEQ ID NO: 2708594 - DNA, 11 bp, Homo sapiens
gcgcctcctgg

SEQ ID NO: 2708595 - DNA, 12 bp, Homo sapiens
gcgcctcctgga

SEQ ID NO: 2708596 - DNA, 13 bp, Homo sapiens
gcgcctcctggac

SEQ ID NO: 2708597 - DNA, 21 bp, Homo sapiens
gcgcctgtcccctcacagact

SEQ ID NO: 2708598 - DNA, 15 bp, Homo sapiens
gcgctgcctgtgtgg

SEQ ID NO: 2708599 - DNA, 15 bp, Homo sapiens
gcggaggttgcaggg

SEQ ID NO: 2708600 - DNA, 16 bp, Homo sapiens
gcggaggttgcaggga

SEQ ID NO: 2708601 - DNA, 18 bp, Homo sapiens
gcggcacgccaacagccc

SEQ ID NO: 2708602 - DNA, 20 bp, Homo sapiens
gcggcacgccaacagccccc

SEQ ID NO: 2708603 - DNA, 16 bp, Homo sapiens
gcggcagatgggcctg

SEQ ID NO: 2708604 - DNA, 12 bp, Homo sapiens
gcggcgcagagg

SEQ ID NO: 2708605 - DNA, 16 bp, Homo sapiens
gcgggatggtcctggg

SEQ ID NO: 2708606 - DNA, 18 bp, Homo sapiens
gcgggcaagcgtgctgcc

SEQ ID NO: 2708607 - DNA, 14 bp, Homo sapiens
gcgggcagcacagc

SEQ ID NO: 2708608 - DNA, 18 bp, Homo sapiens
gcggggagagaggaggag

SEQ ID NO: 2708609 - DNA, 17 bp, Homo sapiens
gcgggggagccaacagc

SEQ ID NO: 2708610 - DNA, 14 bp, Homo sapiens
gcgtagagagccgg

SEQ ID NO: 2708611 - DNA, 15 bp, Homo sapiens
gcgtagagagccggg

SEQ ID NO: 2708612 - DNA, 13 bp, Homo sapiens
gcgtctgccccac

SEQ ID NO: 2708613 - DNA, 18 bp, Homo sapiens
gcgtgtcaactttcattt

SEQ ID NO: 2708614 - DNA, 17 bp, Homo sapiens
gctaacatttaggagaa

SEQ ID NO: 2708615 - DNA, 18 bp, Homo sapiens
gctaacatttaggagaag

SEQ ID NO: 2708616 - DNA, 23 bp, Homo sapiens
gctaaggaagacacagcccagac

SEQ ID NO: 2708617 - DNA, 18 bp, Homo sapiens
gctacaataaatgctgaa

SEQ ID NO: 2708618 - DNA, 14 bp, Homo sapiens
gctactcagaagcc

SEQ ID NO: 2708619 - DNA, 16 bp, Homo sapiens
gctactcagaagcctg

SEQ ID NO: 2708620 - DNA, 17 bp, Homo sapiens
gctactcagaagcctga

SEQ ID NO: 2708621 - DNA, 19 bp, Homo sapiens
gctactcagaagcctgagg

SEQ ID NO: 2708622 - DNA, 21 bp, Homo sapiens
gctactcagaagcctgaggct

SEQ ID NO: 2708623 - DNA, 21 bp, Homo sapiens
gctagcatggcccgggcctta

SEQ ID NO: 2708624 - DNA, 22 bp, Homo sapiens
gctagctatttctatgtatgtg

SEQ ID NO: 2708625 - DNA, 13 bp, Homo sapiens
gctagggctggac

SEQ ID NO: 2708626 - DNA, 21 bp, Homo sapiens
ggctgcacgtcaccctcctga

SEQ ID NO: 2708627 - DNA, 22 bp, Homo sapiens
ggctgcacgtcaccctcctgag

SEQ ID NO: 2708628 - DNA, 14 bp, Homo sapiens
ggctgcccgctccc

SEQ ID NO: 2708629 - DNA, 16 bp, Homo sapiens
ggctgcccgctcccag

SEQ ID NO: 2708630 - DNA, 22 bp, Homo sapiens
ggctgcccgctcccagtgtctt

SEQ ID NO: 2708631 - DNA, 17 bp, Homo sapiens
ggctgctgggggctccc

SEQ ID NO: 2708632 - DNA, 22 bp, Homo sapiens
ggctgctgggggctccccttgc

SEQ ID NO: 2708633 - DNA, 20 bp, Homo sapiens
ggctggagttcagtggtgtg

SEQ ID NO: 2708634 - DNA, 15 bp, Homo sapiens
ggctggcatcctggc

SEQ ID NO: 2708635 - DNA, 19 bp, Homo sapiens
ggctggcatcctggctggc

SEQ ID NO: 2708636 - DNA, 20 bp, Homo sapiens
ggctggcatcctggctggct

SEQ ID NO: 2708637 - DNA, 11 bp, Homo sapiens
ggctggccagc

SEQ ID NO: 2708638 - DNA, 20 bp, Homo sapiens
ggctggccagccccacagcc

SEQ ID NO: 2708639 - DNA, 14 bp, Homo sapiens
ggctggctgcagtg

SEQ ID NO: 2708640 - DNA, 15 bp, Homo sapiens
ggctggctgcagtga

SEQ ID NO: 2708641 - DNA, 13 bp, Homo sapiens
ggctggctgggca

SEQ ID NO: 2708642 - DNA, 12 bp, Homo sapiens
ggctggctgggg

SEQ ID NO: 2708643 - DNA, 15 bp, Homo sapiens
ggctggctgtgtcct

SEQ ID NO: 2708644 - DNA, 21 bp, Homo sapiens
ggctggggcctatcagtgtgc

SEQ ID NO: 2708645 - DNA, 15 bp, Homo sapiens
ggctgggggagggac

SEQ ID NO: 2708646 - DNA, 16 bp, Homo sapiens
ggctgggggagggact

SEQ ID NO: 2708647 - DNA, 18 bp, Homo sapiens
ggctgggggcgggggagc

SEQ ID NO: 2708648 - DNA, 10 bp, Homo sapiens
ggctgggtgc

SEQ ID NO: 2708649 - DNA, 16 bp, Homo sapiens
ggctgggttggcgcac

SEQ ID NO: 2708650 - DNA, 21 bp, Homo sapiens
ggctggtgaggccggccctgc

SEQ ID NO: 2708651 - DNA, 22 bp, Homo sapiens
ggctggtgaggccggccctgcc

SEQ ID NO: 2708652 - DNA, 11 bp, Homo sapiens
ggctgtccagt

SEQ ID NO: 2708653 - DNA, 12 bp, Homo sapiens
ggctgtggttcc

SEQ ID NO: 2708654 - DNA, 19 bp, Homo sapiens
ggcttacttacaaaagcag

SEQ ID NO: 2708655 - DNA, 14 bp, Homo sapiens
ggcttccaaggtgg

SEQ ID NO: 2708656 - DNA, 12 bp, Homo sapiens
ggcttcccctcc

SEQ ID NO: 2708657 - DNA, 18 bp, Homo sapiens
ggcttcccctccacccta

SEQ ID NO: 2708658 - DNA, 22 bp, Homo sapiens
ggcttgtggactctctgcctgc

SEQ ID NO: 2708659 - DNA, 18 bp, Homo sapiens
ggctttgccatgggcctg

SEQ ID NO: 2708660 - DNA, 22 bp, Homo sapiens
ggctttgccatgggcctgctgc

SEQ ID NO: 2708661 - DNA, 15 bp, Homo sapiens
ggctttgttcttgtc

SEQ ID NO: 2708662 - DNA, 14 bp, Homo sapiens
gggaaaaaagaaat

SEQ ID NO: 2708663 - DNA, 13 bp, Homo sapiens
gggaaagtatttt

SEQ ID NO: 2708664 - DNA, 15 bp, Homo sapiens
gggaagagcacagcc

SEQ ID NO: 2708665 - DNA, 16 bp, Homo sapiens
gggaagagcacagccc

SEQ ID NO: 2708666 - DNA, 20 bp, Homo sapiens
gggaagagcacagccctccc

SEQ ID NO: 2708667 - DNA, 22 bp, Homo sapiens
gggaagatgaaaccgtccctga

SEQ ID NO: 2708668 - DNA, 12 bp, Homo sapiens
gggaatgggaga

SEQ ID NO: 2708669 - DNA, 14 bp, Homo sapiens
gggaatgggagagg

SEQ ID NO: 2708670 - DNA, 16 bp, Homo sapiens
gggacaccccccgccc

SEQ ID NO: 2708671 - DNA, 16 bp, Homo sapiens
gggacactacaaacat

SEQ ID NO: 2708672 - DNA, 22 bp, Homo sapiens
gggaccacagcaaggcacctgc

SEQ ID NO: 2708673 - DNA, 16 bp, Homo sapiens
gggaccactgggtgag

SEQ ID NO: 2708674 - DNA, 22 bp, Homo sapiens
gggaccactgggtgagagagga

SEQ ID NO: 2708675 - DNA, 15 bp, Homo sapiens
gggactgggccatgg

SEQ ID NO: 2708676 - DNA, 24 bp, Homo sapiens
gggactgggccatgggtcctcggc

SEQ ID NO: 2708677 - DNA, 16 bp, Homo sapiens
gggagaacctcaggct

SEQ ID NO: 2708678 - DNA, 13 bp, Homo sapiens
gggagaaggcctc

SEQ ID NO: 2708679 - DNA, 22 bp, Homo sapiens
gggagataaaagaaccccagac

SEQ ID NO: 2708680 - DNA, 15 bp, Homo sapiens
gggagccaacagcag

SEQ ID NO: 2708681 - DNA, 19 bp, Homo sapiens
gggagctgaggcctccctt

SEQ ID NO: 2708682 - DNA, 23 bp, Homo sapiens
gggagctggcaatgccctacctg

SEQ ID NO: 2708683 - DNA, 20 bp, Homo sapiens
gggaggaggtggcagccctg

SEQ ID NO: 2708684 - DNA, 23 bp, Homo sapiens
gggaggatcactggagcccagga

SEQ ID NO: 2708685 - DNA, 12 bp, Homo sapiens
gggagggactgc

SEQ ID NO: 2708686 - DNA, 13 bp, Homo sapiens
gggagggagctga

SEQ ID NO: 2708687 - DNA, 21 bp, Homo sapiens
gggataggaagtgccccaggg

SEQ ID NO: 2708688 - DNA, 15 bp, Homo sapiens
gggatgaaaagccat

SEQ ID NO: 2708689 - DNA, 22 bp, Homo sapiens
gggatgatgccacaccaagctg

SEQ ID NO: 2708690 - DNA, 22 bp, Homo sapiens
gggcaaagatctcagcagccag

SEQ ID NO: 2708691 - DNA, 15 bp, Homo sapiens
gggcaagcgtgctgc

SEQ ID NO: 2708692 - DNA, 12 bp, Homo sapiens
gggcacagctgg

SEQ ID NO: 2708693 - DNA, 17 bp, Homo sapiens
gggcacagggaggctgc

SEQ ID NO: 2708694 - DNA, 11 bp, Homo sapiens
gggcactcccc

SEQ ID NO: 2708695 - DNA, 12 bp, Homo sapiens
gggcactccccc

SEQ ID NO: 2708696 - DNA, 14 bp, Homo sapiens
gggcactcccccag

SEQ ID NO: 2708697 - DNA, 15 bp, Homo sapiens
gggcactcccccagg

SEQ ID NO: 2708698 - DNA, 17 bp, Homo sapiens
gggcagagccgggaagc

SEQ ID NO: 2708699 - DNA, 12 bp, Homo sapiens
gggcaggcacag

SEQ ID NO: 2708700 - DNA, 14 bp, Homo sapiens
gggcaggcacagca

SEQ ID NO: 2708701 - DNA, 17 bp, Homo sapiens
gggcaggcacagcacag

SEQ ID NO: 2708702 - DNA, 21 bp, Homo sapiens
gggcaggccctgcactgtcct

SEQ ID NO: 2708703 - DNA, 15 bp, Homo sapiens
gggcagtggggagca

SEQ ID NO: 2708704 - DNA, 16 bp, Homo sapiens
gggccaacaaggactc

SEQ ID NO: 2708705 - DNA, 18 bp, Homo sapiens
gggccagatgctgggcag

SEQ ID NO: 2708706 - DNA, 16 bp, Homo sapiens
gggccagcaggcagcg

SEQ ID NO: 2708707 - DNA, 19 bp, Homo sapiens
gggccagcaggcagcgcct

SEQ ID NO: 2708708 - DNA, 14 bp, Homo sapiens
gggccagggccctg

SEQ ID NO: 2708709 - DNA, 22 bp, Homo sapiens
gggccatactggcctcgcctgg

SEQ ID NO: 2708710 - DNA, 13 bp, Homo sapiens
gggccatgggtcc

SEQ ID NO: 2708711 - DNA, 15 bp, Homo sapiens
gggccatgggtcctc

SEQ ID NO: 2708712 - DNA, 19 bp, Homo sapiens
gggcccacagcccccaccc

SEQ ID NO: 2708713 - DNA, 20 bp, Homo sapiens
gggcccacagcccccacccc

SEQ ID NO: 2708714 - DNA, 20 bp, Homo sapiens
gggcccaggccatcttccag

SEQ ID NO: 2708715 - DNA, 12 bp, Homo sapiens
gggcccccagag

SEQ ID NO: 2708716 - DNA, 13 bp, Homo sapiens
gggcccgcttgcc

SEQ ID NO: 2708717 - DNA, 14 bp, Homo sapiens
gggcccgcttgcct

SEQ ID NO: 2708718 - DNA, 20 bp, Homo sapiens
gggcccgcttgcctcggctc

SEQ ID NO: 2708719 - DNA, 18 bp, Homo sapiens
gggcccgttgtctccctg

SEQ ID NO: 2708720 - DNA, 19 bp, Homo sapiens
gggccctggtccttccagg

SEQ ID NO: 2708721 - DNA, 14 bp, Homo sapiens
gggcctatcagtgt

SEQ ID NO: 2708722 - DNA, 15 bp, Homo sapiens
gggcctatcagtgtg

SEQ ID NO: 2708723 - DNA, 17 bp, Homo sapiens
gggcctcagcctccagg

SEQ ID NO: 2708724 - DNA, 19 bp, Homo sapiens
gggcctcagcctccaggca

SEQ ID NO: 2708725 - DNA, 18 bp, Homo sapiens
gggcctcggaggctcctc

SEQ ID NO: 2708726 - DNA, 19 bp, Homo sapiens
gggcctcggaggctcctcc

SEQ ID NO: 2708727 - DNA, 20 bp, Homo sapiens
gggcctcggaggctcctccc

SEQ ID NO: 2708728 - DNA, 14 bp, Homo sapiens
gggcctgacctcca

SEQ ID NO: 2708729 - DNA, 16 bp, Homo sapiens
gggcctgacctccagt

SEQ ID NO: 2708730 - DNA, 21 bp, Homo sapiens
gggcctgacctccagtcctgc

SEQ ID NO: 2708731 - DNA, 14 bp, Homo sapiens
gggcctgctctgct

SEQ ID NO: 2708732 - DNA, 11 bp, Homo sapiens
gggcctgctgc

SEQ ID NO: 2708733 - DNA, 18 bp, Homo sapiens
gggccttggtcccagaca

SEQ ID NO: 2708734 - DNA, 21 bp, Homo sapiens
gggcgggagtgggggctgtgc

SEQ ID NO: 2708735 - DNA, 20 bp, Homo sapiens
gggcgggggagccaacagca

SEQ ID NO: 2708736 - DNA, 23 bp, Homo sapiens
gggcgtcgctggacaacccagaa

SEQ ID NO: 2708737 - DNA, 18 bp, Homo sapiens
gggctacaaaccaggagc

SEQ ID NO: 2708738 - DNA, 21 bp, Homo sapiens
gggctcagagctgctgagcag

SEQ ID NO: 2708739 - DNA, 15 bp, Homo sapiens
gggctcagatcctgg

SEQ ID NO: 2708740 - DNA, 20 bp, Homo sapiens
gggctcctggaaaggctcag

SEQ ID NO: 2708741 - DNA, 23 bp, Homo sapiens
gggctcctggaaaggctcagtct

SEQ ID NO: 2708742 - DNA, 11 bp, Homo sapiens
gggctctgtgg

SEQ ID NO: 2708743 - DNA, 23 bp, Homo sapiens
gggctgacccagtgtgtgctcag

SEQ ID NO: 2708744 - DNA, 13 bp, Homo sapiens
gggctgagccctg

SEQ ID NO: 2708745 - DNA, 18 bp, Homo sapiens
gggctgagccctggcagg

SEQ ID NO: 2708746 - DNA, 16 bp, Homo sapiens
gggctgcactctgtgc

SEQ ID NO: 2708747 - DNA, 19 bp, Homo sapiens
gggctgcactctgtgccca

SEQ ID NO: 2708748 - DNA, 12 bp, Homo sapiens
gggctgccctgc

SEQ ID NO: 2708749 - DNA, 13 bp, Homo sapiens
gggctgctggggg

SEQ ID NO: 2708750 - DNA, 15 bp, Homo sapiens
gggctgctgggggct

SEQ ID NO: 2708751 - DNA, 20 bp, Homo sapiens
gtttgatagtgcttcttgta

SEQ ID NO: 2708752 - DNA, 20 bp, Homo sapiens
gtttgcactgtatgctggac

SEQ ID NO: 2708753 - DNA, 19 bp, Homo sapiens
gtttgctgtatacaaacag

SEQ ID NO: 2708754 - DNA, 14 bp, Homo sapiens
gtttggcccctgga

SEQ ID NO: 2708755 - DNA, 17 bp, Homo sapiens
gtttgtcctttaactat

SEQ ID NO: 2708756 - DNA, 18 bp, Homo sapiens
gtttgtttctccccctgg

SEQ ID NO: 2708757 - DNA, 19 bp, Homo sapiens
gtttgtttctccccctggg

SEQ ID NO: 2708758 - DNA, 21 bp, Homo sapiens
gtttgtttctccccctgggct

SEQ ID NO: 2708759 - DNA, 15 bp, Homo sapiens
gtttgtttggcactg

SEQ ID NO: 2708760 - DNA, 20 bp, Homo sapiens
gtttgttttagaaccagccg

SEQ ID NO: 2708761 - DNA, 18 bp, Homo sapiens
gttttatcctccctttgg

SEQ ID NO: 2708762 - DNA, 16 bp, Homo sapiens
gttttccaccctggaa

SEQ ID NO: 2708763 - DNA, 21 bp, Homo sapiens
gttttgactactagagctcca

SEQ ID NO: 2708764 - DNA, 22 bp, Homo sapiens
gttttggagaaaaattacagat

SEQ ID NO: 2708765 - DNA, 13 bp, Homo sapiens
gttttgttgtttg

SEQ ID NO: 2708766 - DNA, 14 bp, Homo sapiens
gtttttaacatgtg

SEQ ID NO: 2708767 - DNA, 15 bp, Homo sapiens
gtttttaacatgtga

SEQ ID NO: 2708768 - DNA, 23 bp, Homo sapiens
gtttttataaaaaatggtgcctg

SEQ ID NO: 2708769 - DNA, 19 bp, Homo sapiens
taaaaaaaaaactgcttta

SEQ ID NO: 2708770 - DNA, 17 bp, Homo sapiens
taaaaaatggtgcctga

SEQ ID NO: 2708771 - DNA, 23 bp, Homo sapiens
taaaaagaaattgtgaaaaatga

SEQ ID NO: 2708772 - DNA, 19 bp, Homo sapiens
taaaaagagagaaaactta

SEQ ID NO: 2708773 - DNA, 14 bp, Homo sapiens
taaaaagattatat

SEQ ID NO: 2708774 - DNA, 20 bp, Homo sapiens
taaaaataagttttatacat

SEQ ID NO: 2708775 - DNA, 11 bp, Homo sapiens
taaaaatcttg

SEQ ID NO: 2708776 - DNA, 16 bp, Homo sapiens
taaaacagaagcaaat

SEQ ID NO: 2708777 - DNA, 17 bp, Homo sapiens
taaaactaaacatacat

SEQ ID NO: 2708778 - DNA, 14 bp, Homo sapiens
taaaagtcacataa

SEQ ID NO: 2708779 - DNA, 20 bp, Homo sapiens
taaaagtcacataaaatgcg

SEQ ID NO: 2708780 - DNA, 17 bp, Homo sapiens
taaaagtttgtccttta

SEQ ID NO: 2708781 - DNA, 20 bp, Homo sapiens
taaaagtttgtcctttaact

SEQ ID NO: 2708782 - DNA, 15 bp, Homo sapiens
taaaataaagcaaat

SEQ ID NO: 2708783 - DNA, 13 bp, Homo sapiens
taaaatattactg

SEQ ID NO: 2708784 - DNA, 14 bp, Homo sapiens
taaaatcttcagct

SEQ ID NO: 2708785 - DNA, 15 bp, Homo sapiens
taaaatcttcagctg

SEQ ID NO: 2708786 - DNA, 14 bp, Homo sapiens
taaaatgaagcaat

SEQ ID NO: 2708787 - DNA, 23 bp, Homo sapiens
taaaatgcggcactatttctgaa

SEQ ID NO: 2708788 - DNA, 19 bp, Homo sapiens
taaaatgggaattctgact

SEQ ID NO: 2708789 - DNA, 19 bp, Homo sapiens
taaaatgttggtgcaatta

SEQ ID NO: 2708790 - DNA, 22 bp, Homo sapiens
taaaattgtaaaattgtataga

SEQ ID NO: 2708791 - DNA, 14 bp, Homo sapiens
taaaattgtataga

SEQ ID NO: 2708792 - DNA, 16 bp, Homo sapiens
taaaattgtatagaga

SEQ ID NO: 2708793 - DNA, 23 bp, Homo sapiens
taaaattgtatagagatatgcag

SEQ ID NO: 2708794 - DNA, 17 bp, Homo sapiens
taaacaaggtaattttt

SEQ ID NO: 2708795 - DNA, 16 bp, Homo sapiens
taaacagaaattattt

SEQ ID NO: 2708796 - DNA, 20 bp, Homo sapiens
taaacagaaattattttcta

SEQ ID NO: 2708797 - DNA, 17 bp, Homo sapiens
taaacagatgtccctga

SEQ ID NO: 2708798 - DNA, 18 bp, Homo sapiens
taaacagcaaagccatat

SEQ ID NO: 2708799 - DNA, 15 bp, Homo sapiens
taaacagtgtttatg

SEQ ID NO: 2708800 - DNA, 16 bp, Homo sapiens
taaacagtgtttatga

SEQ ID NO: 2708801 - DNA, 14 bp, Homo sapiens
taaacatgaaggga

SEQ ID NO: 2708802 - DNA, 18 bp, Homo sapiens
taaacctctaatttattt

SEQ ID NO: 2708803 - DNA, 19 bp, Homo sapiens
taaaccttgtttctttctg

SEQ ID NO: 2708804 - DNA, 23 bp, Homo sapiens
taaacgtattttgatcagtgtta

SEQ ID NO: 2708805 - DNA, 23 bp, Homo sapiens
taaactcctactgcttcctctga

SEQ ID NO: 2708806 - DNA, 14 bp, Homo sapiens
taaacttcagcacc

SEQ ID NO: 2708807 - DNA, 16 bp, Homo sapiens
taaacttcagcaccat

SEQ ID NO: 2708808 - DNA, 12 bp, Homo sapiens
taaactttctct

SEQ ID NO: 2708809 - DNA, 16 bp, Homo sapiens
taaagaaaatgtgtct

SEQ ID NO: 2708810 - DNA, 15 bp, Homo sapiens
taaagaaacactaaa

SEQ ID NO: 2708811 - DNA, 23 bp, Homo sapiens
taaagaagagccttcacatgaaa

SEQ ID NO: 2708812 - DNA, 14 bp, Homo sapiens
taaagatggctatt

SEQ ID NO: 2708813 - DNA, 20 bp, Homo sapiens
taaagcagagtttgacaccg

SEQ ID NO: 2708814 - DNA, 19 bp, Homo sapiens
taaagcttacccttggttt

SEQ ID NO: 2708815 - DNA, 15 bp, Homo sapiens
taaagtaattttgtg

SEQ ID NO: 2708816 - DNA, 16 bp, Homo sapiens
taaagtcagatttgta

SEQ ID NO: 2708817 - DNA, 14 bp, Homo sapiens
taaagtcctgttta

SEQ ID NO: 2708818 - DNA, 15 bp, Homo sapiens
taaagtgtagcaccc

SEQ ID NO: 2708819 - DNA, 15 bp, Homo sapiens
taaagttatatttgt

SEQ ID NO: 2708820 - DNA, 23 bp, Homo sapiens
taaagtttacagtaaataaattg

SEQ ID NO: 2708821 - DNA, 22 bp, Homo sapiens
taaataaaatagagtctggaat

SEQ ID NO: 2708822 - DNA, 22 bp, Homo sapiens
taaataaatgaagtatttctca

SEQ ID NO: 2708823 - DNA, 13 bp, Homo sapiens
taaataaattgtt

SEQ ID NO: 2708824 - DNA, 15 bp, Homo sapiens
taaataaattgtttg

SEQ ID NO: 2708825 - DNA, 15 bp, Homo sapiens
taaatagcattctct

SEQ ID NO: 2708826 - DNA, 20 bp, Homo sapiens
taaatatatatttatcatat

SEQ ID NO: 2708827 - DNA, 21 bp, Homo sapiens
taaatatatctatattattgt

SEQ ID NO: 2708828 - DNA, 15 bp, Homo sapiens
taaatatgtgaaaat

SEQ ID NO: 2708829 - DNA, 21 bp, Homo sapiens
taaatattggtttgttattct

SEQ ID NO: 2708830 - DNA, 17 bp, Homo sapiens
taaatcaattcattgtg

SEQ ID NO: 2708831 - DNA, 16 bp, Homo sapiens
taaatgagacacatac

SEQ ID NO: 2708832 - DNA, 15 bp, Homo sapiens
taaatggttaagaca

SEQ ID NO: 2708833 - DNA, 21 bp, Homo sapiens
taaattaatgagttttatcca

SEQ ID NO: 2708834 - DNA, 16 bp, Homo sapiens
taaattatgaaggacc

SEQ ID NO: 2708835 - DNA, 21 bp, Homo sapiens
taaattatgttccttctccaa

SEQ ID NO: 2708836 - DNA, 15 bp, Homo sapiens
taaattattttcaaa

SEQ ID NO: 2708837 - DNA, 14 bp, Homo sapiens
taaattccactgga

SEQ ID NO: 2708838 - DNA, 23 bp, Homo sapiens
taaattcgctgtgagtgagtggt

SEQ ID NO: 2708839 - DNA, 14 bp, Homo sapiens
taaattctctctaa

SEQ ID NO: 2708840 - DNA, 18 bp, Homo sapiens
taaattgttataacttca

SEQ ID NO: 2708841 - DNA, 19 bp, Homo sapiens
taaattgttataacttcat

SEQ ID NO: 2708842 - DNA, 12 bp, Homo sapiens
taaattgtttga

SEQ ID NO: 2708843 - DNA, 18 bp, Homo sapiens
taaatttcccaattttct

SEQ ID NO: 2708844 - DNA, 16 bp, Homo sapiens
taaatttgaactccat

SEQ ID NO: 2708845 - DNA, 13 bp, Homo sapiens
taaatttgttgtc

SEQ ID NO: 2708846 - DNA, 15 bp, Homo sapiens
taaatttgttgtcat

SEQ ID NO: 2708847 - DNA, 21 bp, Homo sapiens
taaattttgttttttaagttt

SEQ ID NO: 2708848 - DNA, 20 bp, Homo sapiens
taacaaactacatgtaatcc

SEQ ID NO: 2708849 - DNA, 12 bp, Homo sapiens
taacaaattatt

SEQ ID NO: 2708850 - DNA, 23 bp, Homo sapiens
taacagcgtgtcaactttcattt

SEQ ID NO: 2708851 - DNA, 20 bp, Homo sapiens
taaccaaagagtctctggct

SEQ ID NO: 2708852 - DNA, 21 bp, Homo sapiens
taaccacactgaaacctcttc

SEQ ID NO: 2708853 - DNA, 18 bp, Homo sapiens
taacgaacgttttaaagc

SEQ ID NO: 2708854 - DNA, 12 bp, Homo sapiens
taactagaactg

SEQ ID NO: 2708855 - DNA, 14 bp, Homo sapiens
taactagaactgaa

SEQ ID NO: 2708856 - DNA, 13 bp, Homo sapiens
taactcccactcc

SEQ ID NO: 2708857 - DNA, 15 bp, Homo sapiens
taactccccacccca

SEQ ID NO: 2708858 - DNA, 11 bp, Homo sapiens
taactccctcc

SEQ ID NO: 2708859 - DNA, 15 bp, Homo sapiens
taactccctcctcac

SEQ ID NO: 2708860 - DNA, 18 bp, Homo sapiens
taactttcaaaagcaaac

SEQ ID NO: 2708861 - DNA, 15 bp, Homo sapiens
taagaaaaaaagcaa

SEQ ID NO: 2708862 - DNA, 18 bp, Homo sapiens
taagaaaaaattactaaa

SEQ ID NO: 2708863 - DNA, 19 bp, Homo sapiens
taagaaacatgatgtgaga

SEQ ID NO: 2708864 - DNA, 18 bp, Homo sapiens
taagaaagggaaagctgt

SEQ ID NO: 2708865 - DNA, 20 bp, Homo sapiens
taagaatagtctctgggttt

SEQ ID NO: 2708866 - DNA, 20 bp, Homo sapiens
taagatactcaagcaggttt

SEQ ID NO: 2708867 - DNA, 20 bp, Homo sapiens
taagatgatgttaaatgcct

SEQ ID NO: 2708868 - DNA, 21 bp, Homo sapiens
taagcagagttctttgcaagc

SEQ ID NO: 2708869 - DNA, 18 bp, Homo sapiens
taagcagattacaataaa

SEQ ID NO: 2708870 - DNA, 15 bp, Homo sapiens
taagcaggaggaggt

SEQ ID NO: 2708871 - DNA, 18 bp, Homo sapiens
taagcaggaggaggtgcc

SEQ ID NO: 2708872 - DNA, 15 bp, Homo sapiens
taagcattctgagct

SEQ ID NO: 2708873 - DNA, 16 bp, Homo sapiens
taagcattctgagctg

SEQ ID NO: 2708874 - DNA, 13 bp, Homo sapiens
taagctcagtggc

SEQ ID NO: 2708875 - DNA, 18 bp, Homo sapiens
tatgtgttgcataaacaa

SEQ ID NO: 2708876 - DNA, 14 bp, Homo sapiens
tatgttaatatctg

SEQ ID NO: 2708877 - DNA, 20 bp, Homo sapiens
tatgttacttaaacatcatt

SEQ ID NO: 2708878 - DNA, 23 bp, Homo sapiens
tatgttattggaattttctttca

SEQ ID NO: 2708879 - DNA, 17 bp, Homo sapiens
tattaagatttccaagt

SEQ ID NO: 2708880 - DNA, 21 bp, Homo sapiens
tattaatataataatgatgat

SEQ ID NO: 2708881 - DNA, 12 bp, Homo sapiens
tattaattattt

SEQ ID NO: 2708882 - DNA, 15 bp, Homo sapiens
tattactttttaaaa

SEQ ID NO: 2708883 - DNA, 18 bp, Homo sapiens
tattagccagtcattgta

SEQ ID NO: 2708884 - DNA, 18 bp, Homo sapiens
tattaggggtaatatatt

SEQ ID NO: 2708885 - DNA, 17 bp, Homo sapiens
tattattaatataataa

SEQ ID NO: 2708886 - DNA, 12 bp, Homo sapiens
tattattgttct

SEQ ID NO: 2708887 - DNA, 18 bp, Homo sapiens
tattcatgctttctcctt

SEQ ID NO: 2708888 - DNA, 20 bp, Homo sapiens
tattcatgctttctcctttt

SEQ ID NO: 2708889 - DNA, 21 bp, Homo sapiens
tattcccatggtagactgtga

SEQ ID NO: 2708890 - DNA, 15 bp, Homo sapiens
tattctaaattcact

SEQ ID NO: 2708891 - DNA, 19 bp, Homo sapiens
tattctaaattcactgttg

SEQ ID NO: 2708892 - DNA, 21 bp, Homo sapiens
tattctcttaatttttcttaa

SEQ ID NO: 2708893 - DNA, 13 bp, Homo sapiens
tattctgataatg

SEQ ID NO: 2708894 - DNA, 20 bp, Homo sapiens
tattcttttccagaaagaaa

SEQ ID NO: 2708895 - DNA, 18 bp, Homo sapiens
tattgctggaatctacta

SEQ ID NO: 2708896 - DNA, 12 bp, Homo sapiens
tattggaatttt

SEQ ID NO: 2708897 - DNA, 13 bp, Homo sapiens
tattggaattttc

SEQ ID NO: 2708898 - DNA, 15 bp, Homo sapiens
tattggaattttctt

SEQ ID NO: 2708899 - DNA, 18 bp, Homo sapiens
tattggtcaagaaaagca

SEQ ID NO: 2708900 - DNA, 24 bp, Homo sapiens
tattgtttattctttttaaagtat

SEQ ID NO: 2708901 - DNA, 13 bp, Homo sapiens
tatttaaaagaca

SEQ ID NO: 2708902 - DNA, 14 bp, Homo sapiens
tatttaaagcacat

SEQ ID NO: 2708903 - DNA, 14 bp, Homo sapiens
tatttaaattattt

SEQ ID NO: 2708904 - DNA, 22 bp, Homo sapiens
tatttaagaaagggaaagctgt

SEQ ID NO: 2708905 - DNA, 16 bp, Homo sapiens
tatttaatgatttttg

SEQ ID NO: 2708906 - DNA, 17 bp, Homo sapiens
tatttaatgatttttgt

SEQ ID NO: 2708907 - DNA, 19 bp, Homo sapiens
tatttaattagaatggata

SEQ ID NO: 2708908 - DNA, 19 bp, Homo sapiens
tatttacctgcgaacttgt

SEQ ID NO: 2708909 - DNA, 21 bp, Homo sapiens
tatttacctgcgaacttgtgt

SEQ ID NO: 2708910 - DNA, 22 bp, Homo sapiens
tatttatattcatcaaataaac

SEQ ID NO: 2708911 - DNA, 16 bp, Homo sapiens
tatttccacataaagg

SEQ ID NO: 2708912 - DNA, 18 bp, Homo sapiens
tatttcctcccccagtta

SEQ ID NO: 2708913 - DNA, 12 bp, Homo sapiens
tattttacagtc

SEQ ID NO: 2708914 - DNA, 21 bp, Homo sapiens
tattttaggcagggatttgag

SEQ ID NO: 2708915 - DNA, 13 bp, Homo sapiens
tattttcacagat

SEQ ID NO: 2708916 - DNA, 23 bp, Homo sapiens
tattttcacagatggaagaagtt

SEQ ID NO: 2708917 - DNA, 16 bp, Homo sapiens
tattttccaaaatcta

SEQ ID NO: 2708918 - DNA, 22 bp, Homo sapiens
tattttcttggaattttgtaaa

SEQ ID NO: 2708919 - DNA, 16 bp, Homo sapiens
tattttgatcagtgtt

SEQ ID NO: 2708920 - DNA, 18 bp, Homo sapiens
tatttttaatttatgata

SEQ ID NO: 2708921 - DNA, 23 bp, Homo sapiens
tatttttgaaagaattctatttt

SEQ ID NO: 2708922 - DNA, 19 bp, Homo sapiens
tatttttttaagctgtaaa

SEQ ID NO: 2708923 - DNA, 17 bp, Homo sapiens
tcaaacatgaaaacatt

SEQ ID NO: 2708924 - DNA, 13 bp, Homo sapiens
tcaaagaaatttc

SEQ ID NO: 2708925 - DNA, 18 bp, Homo sapiens
tcaaagggcccacagtga

SEQ ID NO: 2708926 - DNA, 20 bp, Homo sapiens
tcaaataaaccttgtttctt

SEQ ID NO: 2708927 - DNA, 23 bp, Homo sapiens
tcaaataaaccttgtttctttct

SEQ ID NO: 2708928 - DNA, 16 bp, Homo sapiens
tcaaatttttctggga

SEQ ID NO: 2708929 - DNA, 15 bp, Homo sapiens
tcaactttcatttga

SEQ ID NO: 2708930 - DNA, 16 bp, Homo sapiens
tcaactttcatttgaa

SEQ ID NO: 2708931 - DNA, 17 bp, Homo sapiens
tcaactttcatttgaaa

SEQ ID NO: 2708932 - DNA, 22 bp, Homo sapiens
tcaactttcttttgattagtgt

SEQ ID NO: 2708933 - DNA, 16 bp, Homo sapiens
tcaagagatctttctt

SEQ ID NO: 2708934 - DNA, 15 bp, Homo sapiens
tcaagagtctctcca

SEQ ID NO: 2708935 - DNA, 19 bp, Homo sapiens
tcaagagtctctccagcct

SEQ ID NO: 2708936 - DNA, 13 bp, Homo sapiens
tcaagatccaaat

SEQ ID NO: 2708937 - DNA, 22 bp, Homo sapiens
tcaagatccaaatgctgtgcaa

SEQ ID NO: 2708938 - DNA, 17 bp, Homo sapiens
tcaagatgtcagactgg

SEQ ID NO: 2708939 - DNA, 18 bp, Homo sapiens
tcaagatgtcagactggc

SEQ ID NO: 2708940 - DNA, 22 bp, Homo sapiens
tcaagcagacgtgagtgtgact

SEQ ID NO: 2708941 - DNA, 19 bp, Homo sapiens
tcaagcaggtttcttgctt

SEQ ID NO: 2708942 - DNA, 15 bp, Homo sapiens
tcaagcgattcttct

SEQ ID NO: 2708943 - DNA, 18 bp, Homo sapiens
tcaaggcctcccacagtg

SEQ ID NO: 2708944 - DNA, 13 bp, Homo sapiens
tcaataactctga

SEQ ID NO: 2708945 - DNA, 16 bp, Homo sapiens
tcaataactctgattt

SEQ ID NO: 2708946 - DNA, 19 bp, Homo sapiens
tcaataactctgattttga

SEQ ID NO: 2708947 - DNA, 14 bp, Homo sapiens
tcaatcaaacaggg

SEQ ID NO: 2708948 - DNA, 15 bp, Homo sapiens
tcaatccttgttcag

SEQ ID NO: 2708949 - DNA, 18 bp, Homo sapiens
tcaatgaaggatttctta

SEQ ID NO: 2708950 - DNA, 18 bp, Homo sapiens
tcaatggaagaaaccctt

SEQ ID NO: 2708951 - DNA, 13 bp, Homo sapiens
tcaattcctgggc

SEQ ID NO: 2708952 - DNA, 17 bp, Homo sapiens
tcaatttactttttaaa

SEQ ID NO: 2708953 - DNA, 22 bp, Homo sapiens
tcaatttactttttaaacagtg

SEQ ID NO: 2708954 - DNA, 23 bp, Homo sapiens
tcaatttactttttaaacagtgt

SEQ ID NO: 2708955 - DNA, 17 bp, Homo sapiens
tcaattttgtatttaat

SEQ ID NO: 2708956 - DNA, 18 bp, Homo sapiens
tcacaaaagctgtgtctc

SEQ ID NO: 2708957 - DNA, 23 bp, Homo sapiens
tcacaaacaaatggctgtaaaac

SEQ ID NO: 2708958 - DNA, 21 bp, Homo sapiens
tcacaccattctcctgcctca

SEQ ID NO: 2708959 - DNA, 17 bp, Homo sapiens
tcacactcctcctgcca

SEQ ID NO: 2708960 - DNA, 18 bp, Homo sapiens
tcacactcctcctgccag

SEQ ID NO: 2708961 - DNA, 20 bp, Homo sapiens
tcacactcctcctgccagct

SEQ ID NO: 2708962 - DNA, 14 bp, Homo sapiens
tcacagactcttcc

SEQ ID NO: 2708963 - DNA, 17 bp, Homo sapiens
tcacagactcttccacc

SEQ ID NO: 2708964 - DNA, 14 bp, Homo sapiens
tcacagatgctggc

SEQ ID NO: 2708965 - DNA, 18 bp, Homo sapiens
tcacagatgctggcctct

SEQ ID NO: 2708966 - DNA, 22 bp, Homo sapiens
tcacagcgcctcctggacctga

SEQ ID NO: 2708967 - DNA, 14 bp, Homo sapiens
tcacagctcttgtt

SEQ ID NO: 2708968 - DNA, 17 bp, Homo sapiens
tcacaggactctgcaga

SEQ ID NO: 2708969 - DNA, 13 bp, Homo sapiens
tcacagtctcaca

SEQ ID NO: 2708970 - DNA, 21 bp, Homo sapiens
tcacatttcaagatccaaatg

SEQ ID NO: 2708971 - DNA, 19 bp, Homo sapiens
tcaccacaacctccacctc

SEQ ID NO: 2708972 - DNA, 23 bp, Homo sapiens
tcaccacaacctccacctcctgg

SEQ ID NO: 2708973 - DNA, 22 bp, Homo sapiens
tcaccacattctgtctctgctt

SEQ ID NO: 2708974 - DNA, 17 bp, Homo sapiens
tcacccatgaagacagg

SEQ ID NO: 2708975 - DNA, 16 bp, Homo sapiens
tcaccctcctgagcct

SEQ ID NO: 2708976 - DNA, 21 bp, Homo sapiens
tcaccctcctgagcctcacct

SEQ ID NO: 2708977 - DNA, 19 bp, Homo sapiens
tcaccctggccaccaccca

SEQ ID NO: 2708978 - DNA, 23 bp, Homo sapiens
tcaccgagaggaaaaaggcttct

SEQ ID NO: 2708979 - DNA, 18 bp, Homo sapiens
tcaccgtattagccagga

SEQ ID NO: 2708980 - DNA, 19 bp, Homo sapiens
tcaccgtattagccaggat

SEQ ID NO: 2708981 - DNA, 20 bp, Homo sapiens
tcaccgtcattgatggagcc

SEQ ID NO: 2708982 - DNA, 23 bp, Homo sapiens
tcaccgtcattgatggagcctga

SEQ ID NO: 2708983 - DNA, 14 bp, Homo sapiens
tcacgactcttcct

SEQ ID NO: 2708984 - DNA, 14 bp, Homo sapiens
tcactagccatgat

SEQ ID NO: 2708985 - DNA, 14 bp, Homo sapiens
tcactccggtgtgc

SEQ ID NO: 2708986 - DNA, 21 bp, Homo sapiens
tcactccggtgtgcctgcagc

SEQ ID NO: 2708987 - DNA, 21 bp, Homo sapiens
tcactctaattggtcattcct

SEQ ID NO: 2708988 - DNA, 15 bp, Homo sapiens
tcactgcagcctttc

SEQ ID NO: 2708989 - DNA, 11 bp, Homo sapiens
tcactggagcc

SEQ ID NO: 2708990 - DNA, 12 bp, Homo sapiens
tcactggagccc

SEQ ID NO: 2708991 - DNA, 14 bp, Homo sapiens
tcactggagcccag

SEQ ID NO: 2708992 - DNA, 20 bp, Homo sapiens
tcactggctgcctccactcc

SEQ ID NO: 2708993 - DNA, 15 bp, Homo sapiens
tcactggtatacaca

SEQ ID NO: 2708994 - DNA, 14 bp, Homo sapiens
tcactgttcatgaa

SEQ ID NO: 2708995 - DNA, 15 bp, Homo sapiens
tcacttgggtctctg

SEQ ID NO: 2708996 - DNA, 15 bp, Homo sapiens
tcagaagcctgaggc

SEQ ID NO: 2708997 - DNA, 17 bp, Homo sapiens
tcagaattgaaggagaa

SEQ ID NO: 2708998 - DNA, 17 bp, Homo sapiens
tgacatcaccaagtgtg

SEQ ID NO: 2708999 - DNA, 20 bp, Homo sapiens
tgacatcaccaagtgtggaa

SEQ ID NO: 2709000 - DNA, 21 bp, Homo sapiens
tgacatcaccaagtgtggaat

SEQ ID NO: 2709001 - DNA, 20 bp, Homo sapiens
tgacatcagaagtaactccc

SEQ ID NO: 2709002 - DNA, 12 bp, Homo sapiens
tgaccagccccg

SEQ ID NO: 2709003 - DNA, 17 bp, Homo sapiens
tgaccatgtgattatgg

SEQ ID NO: 2709004 - DNA, 21 bp, Homo sapiens
tgacccaccaaggtctcacac

SEQ ID NO: 2709005 - DNA, 22 bp, Homo sapiens
tgaccccttttcagcttctgct

SEQ ID NO: 2709006 - DNA, 22 bp, Homo sapiens
tgaccctgcgaaggggccctgg

SEQ ID NO: 2709007 - DNA, 20 bp, Homo sapiens
tgaccgggtctgcttctgca

SEQ ID NO: 2709008 - DNA, 20 bp, Homo sapiens
tgacctccagtcctgctggc

SEQ ID NO: 2709009 - DNA, 15 bp, Homo sapiens
tgacctgaactctgc

SEQ ID NO: 2709010 - DNA, 20 bp, Homo sapiens
tgacctgccccgcccagctg

SEQ ID NO: 2709011 - DNA, 15 bp, Homo sapiens
tgaccttctccaggg

SEQ ID NO: 2709012 - DNA, 16 bp, Homo sapiens
tgaccttctccaggga

SEQ ID NO: 2709013 - DNA, 21 bp, Homo sapiens
tgacggtcctttaggcagcct

SEQ ID NO: 2709014 - DNA, 22 bp, Homo sapiens
tgacggtcctttaggcagcctg

SEQ ID NO: 2709015 - DNA, 18 bp, Homo sapiens
tgacgtaagctctatctg

SEQ ID NO: 2709016 - DNA, 15 bp, Homo sapiens
tgacgtgactcagag

SEQ ID NO: 2709017 - DNA, 17 bp, Homo sapiens
tgacgtgactcagagct

SEQ ID NO: 2709018 - DNA, 16 bp, Homo sapiens
tgactctactcccagc

SEQ ID NO: 2709019 - DNA, 20 bp, Homo sapiens
tgactgagtctggcaaacat

SEQ ID NO: 2709020 - DNA, 21 bp, Homo sapiens
tgacttacttaaccaggtttg

SEQ ID NO: 2709021 - DNA, 13 bp, Homo sapiens
tgacttcaggggc

SEQ ID NO: 2709022 - DNA, 21 bp, Homo sapiens
tgacttcaggggctgcccgct

SEQ ID NO: 2709023 - DNA, 22 bp, Homo sapiens
tgacttcaggggctgcccgctc

SEQ ID NO: 2709024 - DNA, 19 bp, Homo sapiens
tgacttcctcgcctctccc

SEQ ID NO: 2709025 - DNA, 21 bp, Homo sapiens
tgacttcctcgcctctcccac

SEQ ID NO: 2709026 - DNA, 15 bp, Homo sapiens
tgacttgcctggggc

SEQ ID NO: 2709027 - DNA, 23 bp, Homo sapiens
tgactttctcttctacacgtcct

SEQ ID NO: 2709028 - DNA, 18 bp, Homo sapiens
tgacttttccatgtatct

SEQ ID NO: 2709029 - DNA, 19 bp, Homo sapiens
tgacttttccatgtatcta

SEQ ID NO: 2709030 - DNA, 14 bp, Homo sapiens
tgacttttgaagaa

SEQ ID NO: 2709031 - DNA, 17 bp, Homo sapiens
tgacttttgaagaacaa

SEQ ID NO: 2709032 - DNA, 14 bp, Homo sapiens
tgactttttgaatg

SEQ ID NO: 2709033 - DNA, 14 bp, Homo sapiens
tgagaaaactgaga

SEQ ID NO: 2709034 - DNA, 22 bp, Homo sapiens
tgagaaactttgatctctgctt

SEQ ID NO: 2709035 - DNA, 24 bp, Homo sapiens
tgagaacatggtgtgtgtctctga

SEQ ID NO: 2709036 - DNA, 15 bp, Homo sapiens
tgagaagggcctgct

SEQ ID NO: 2709037 - DNA, 21 bp, Homo sapiens
tgagaagggcctgctctgctt

SEQ ID NO: 2709038 - DNA, 20 bp, Homo sapiens
tgagaagtactttgtgctga

SEQ ID NO: 2709039 - DNA, 13 bp, Homo sapiens
tgagactctgagg

SEQ ID NO: 2709040 - DNA, 22 bp, Homo sapiens
tgagactgcgggatggtcctgg

SEQ ID NO: 2709041 - DNA, 23 bp, Homo sapiens
tgagactgcgggatggtcctggg

SEQ ID NO: 2709042 - DNA, 17 bp, Homo sapiens
tgagactgggaacttga

SEQ ID NO: 2709043 - DNA, 16 bp, Homo sapiens
tgagagctctctcttc

SEQ ID NO: 2709044 - DNA, 13 bp, Homo sapiens
tgagattctaaat

SEQ ID NO: 2709045 - DNA, 19 bp, Homo sapiens
tgagattctttaaggagat

SEQ ID NO: 2709046 - DNA, 18 bp, Homo sapiens
tgagctcctgctcattgt

SEQ ID NO: 2709047 - DNA, 17 bp, Homo sapiens
tgaggaacaatcacaaa

SEQ ID NO: 2709048 - DNA, 21 bp, Homo sapiens
tgaggagtgtcctgtctgctg

SEQ ID NO: 2709049 - DNA, 21 bp, Homo sapiens
tgaggatcccctgtcccctgg

SEQ ID NO: 2709050 - DNA, 21 bp, Homo sapiens
tgaggcaaaggccagcagcag

SEQ ID NO: 2709051 - DNA, 18 bp, Homo sapiens
tgaggcacctgcatatct

SEQ ID NO: 2709052 - DNA, 22 bp, Homo sapiens
tgaggcagtgggtcccacttcc

SEQ ID NO: 2709053 - DNA, 13 bp, Homo sapiens
tgaggcccagcct

SEQ ID NO: 2709054 - DNA, 15 bp, Homo sapiens
tgaggcccagcctgt

SEQ ID NO: 2709055 - DNA, 20 bp, Homo sapiens
tgaggcccagcctgtcctgg

SEQ ID NO: 2709056 - DNA, 16 bp, Homo sapiens
tgaggccccaggccct

SEQ ID NO: 2709057 - DNA, 16 bp, Homo sapiens
tgaggccggccctgcc

SEQ ID NO: 2709058 - DNA, 17 bp, Homo sapiens
tgaggccggccctgccc

SEQ ID NO: 2709059 - DNA, 13 bp, Homo sapiens
tgaggctgagact

SEQ ID NO: 2709060 - DNA, 18 bp, Homo sapiens
tgaggctgagactgcggg

SEQ ID NO: 2709061 - DNA, 13 bp, Homo sapiens
tgaggctgcagcg

SEQ ID NO: 2709062 - DNA, 19 bp, Homo sapiens
tgaggctggcatcctggct

SEQ ID NO: 2709063 - DNA, 21 bp, Homo sapiens
tgaggctggcatcctggctgg

SEQ ID NO: 2709064 - DNA, 21 bp, Homo sapiens
tgaggctgggggcgggggagc

SEQ ID NO: 2709065 - DNA, 14 bp, Homo sapiens
tgaggggctcctgg

SEQ ID NO: 2709066 - DNA, 18 bp, Homo sapiens
tgagggtaataaacttag

SEQ ID NO: 2709067 - DNA, 16 bp, Homo sapiens
tgaggtcttttacata

SEQ ID NO: 2709068 - DNA, 14 bp, Homo sapiens
tgagtaggccctgc

SEQ ID NO: 2709069 - DNA, 17 bp, Homo sapiens
tgagtaggccctgcttt

SEQ ID NO: 2709070 - DNA, 21 bp, Homo sapiens
tgagtataaaataaagcaaat

SEQ ID NO: 2709071 - DNA, 16 bp, Homo sapiens
tgagtcacccatgaag

SEQ ID NO: 2709072 - DNA, 15 bp, Homo sapiens
tgagtctgaggcccc

SEQ ID NO: 2709073 - DNA, 15 bp, Homo sapiens
tgagtctggcaaaca

SEQ ID NO: 2709074 - DNA, 14 bp, Homo sapiens
tgagtgtctctgcc

SEQ ID NO: 2709075 - DNA, 20 bp, Homo sapiens
tgagttgcaccattctttct

SEQ ID NO: 2709076 - DNA, 18 bp, Homo sapiens
tgagtttccagctaagcc

SEQ ID NO: 2709077 - DNA, 19 bp, Homo sapiens
tgataaattccactggact

SEQ ID NO: 2709078 - DNA, 21 bp, Homo sapiens
tgatactttaatttttataaa

SEQ ID NO: 2709079 - DNA, 17 bp, Homo sapiens
tgatagtgcttcttgta

SEQ ID NO: 2709080 - DNA, 20 bp, Homo sapiens
tgatagtgcttcttgtaata

SEQ ID NO: 2709081 - DNA, 14 bp, Homo sapiens
tgatatccacaaat

SEQ ID NO: 2709082 - DNA, 16 bp, Homo sapiens
tgatattgaccatgtg

SEQ ID NO: 2709083 - DNA, 17 bp, Homo sapiens
tgatattgaccatgtga

SEQ ID NO: 2709084 - DNA, 19 bp, Homo sapiens
tgatattgaccatgtgatt

SEQ ID NO: 2709085 - DNA, 21 bp, Homo sapiens
tgatattgaccatgtgattat

SEQ ID NO: 2709086 - DNA, 15 bp, Homo sapiens
tgatatttccttcac

SEQ ID NO: 2709087 - DNA, 12 bp, Homo sapiens
tgatcagtgtta

SEQ ID NO: 2709088 - DNA, 14 bp, Homo sapiens
tgatcatctttgct

SEQ ID NO: 2709089 - DNA, 21 bp, Homo sapiens
tgatcattacatggctgtggt

SEQ ID NO: 2709090 - DNA, 22 bp, Homo sapiens
tgatcattacatggctgtggtt

SEQ ID NO: 2709091 - DNA, 19 bp, Homo sapiens
tgatcccaagtgccagtct

SEQ ID NO: 2709092 - DNA, 22 bp, Homo sapiens
tgatcgccttatttatattcat

SEQ ID NO: 2709093 - DNA, 12 bp, Homo sapiens
tgatctcctgag

SEQ ID NO: 2709094 - DNA, 14 bp, Homo sapiens
tgatctcggctcac

SEQ ID NO: 2709095 - DNA, 19 bp, Homo sapiens
tgatctcggctcactgcaa

SEQ ID NO: 2709096 - DNA, 23 bp, Homo sapiens
tgatctgcccgcctcggcctccc

SEQ ID NO: 2709097 - DNA, 17 bp, Homo sapiens
tgatcttggaaagaggt

SEQ ID NO: 2709098 - DNA, 20 bp, Homo sapiens
tgatgaatgaggaacaatca

SEQ ID NO: 2709099 - DNA, 13 bp, Homo sapiens
tgatgatgatgaa

SEQ ID NO: 2709100 - DNA, 16 bp, Homo sapiens
tgatgatgatgatgaa

SEQ ID NO: 2709101 - DNA, 16 bp, Homo sapiens
tgatgatgatgatgat

SEQ ID NO: 2709102 - DNA, 19 bp, Homo sapiens
tgatgcaatgtatggcttt

SEQ ID NO: 2709103 - DNA, 17 bp, Homo sapiens
tgatgccacaccaagct

SEQ ID NO: 2709104 - DNA, 16 bp, Homo sapiens
tgatgctgggctgggt

SEQ ID NO: 2709105 - DNA, 15 bp, Homo sapiens
tgatggagcctgaac

SEQ ID NO: 2709106 - DNA, 22 bp, Homo sapiens
tgatggctcagagagcatcttt

SEQ ID NO: 2709107 - DNA, 17 bp, Homo sapiens
tgatgtcagccttgcat

SEQ ID NO: 2709108 - DNA, 23 bp, Homo sapiens
tgattcttgtgattgactttttg

SEQ ID NO: 2709109 - DNA, 19 bp, Homo sapiens
tgattgcactaaataaact

SEQ ID NO: 2709110 - DNA, 17 bp, Homo sapiens
tgattggccagccgagc

SEQ ID NO: 2709111 - DNA, 19 bp, Homo sapiens
tgatttcccgtggccccag

SEQ ID NO: 2709112 - DNA, 21 bp, Homo sapiens
tgatttcccgtggccccagcc

SEQ ID NO: 2709113 - DNA, 18 bp, Homo sapiens
tgatttctagaatggttt

SEQ ID NO: 2709114 - DNA, 15 bp, Homo sapiens
tgatttctagtatct

SEQ ID NO: 2709115 - DNA, 19 bp, Homo sapiens
tgatttggaagagaggcac

SEQ ID NO: 2709116 - DNA, 12 bp, Homo sapiens
tgatttttgtgt

SEQ ID NO: 2709117 - DNA, 14 bp, Homo sapiens
tgatttttgtgtat

SEQ ID NO: 2709118 - DNA, 15 bp, Homo sapiens
tgatttttgtgtatc

SEQ ID NO: 2709119 - DNA, 13 bp, Homo sapiens
tgcaaaaacatat

SEQ ID NO: 2709120 - DNA, 19 bp, Homo sapiens
tgcaaaaacatatgtctgt

SEQ ID NO: 2709121 - DNA, 17 bp, Homo sapiens
tggctgtccagtgccca

SEQ ID NO: 2709122 - DNA, 23 bp, Homo sapiens
tggctgtggttcctaagcctgtt

SEQ ID NO: 2709123 - DNA, 13 bp, Homo sapiens
tggcttcagaatt

SEQ ID NO: 2709124 - DNA, 19 bp, Homo sapiens
tggcttcccctccacccta

SEQ ID NO: 2709125 - DNA, 21 bp, Homo sapiens
tgggaagccatattcacacct

SEQ ID NO: 2709126 - DNA, 17 bp, Homo sapiens
tgggaagctatttcctt

SEQ ID NO: 2709127 - DNA, 16 bp, Homo sapiens
tgggaaggaagcccgc

SEQ ID NO: 2709128 - DNA, 14 bp, Homo sapiens
tgggaatgggagag

SEQ ID NO: 2709129 - DNA, 17 bp, Homo sapiens
tgggactgtgcctttgg

SEQ ID NO: 2709130 - DNA, 22 bp, Homo sapiens
tgggagaacctcaggcttcctt

SEQ ID NO: 2709131 - DNA, 15 bp, Homo sapiens
tgggagatgaaaacc

SEQ ID NO: 2709132 - DNA, 23 bp, Homo sapiens
tgggagatgaaaacctgcatttt

SEQ ID NO: 2709133 - DNA, 11 bp, Homo sapiens
tgggaggaagc

SEQ ID NO: 2709134 - DNA, 24 bp, Homo sapiens
tgggaggaagcaggttgaggggct

SEQ ID NO: 2709135 - DNA, 14 bp, Homo sapiens
tgggaggacagagc

SEQ ID NO: 2709136 - DNA, 17 bp, Homo sapiens
tgggaggacagagccgg

SEQ ID NO: 2709137 - DNA, 13 bp, Homo sapiens
tgggaggctgagg

SEQ ID NO: 2709138 - DNA, 14 bp, Homo sapiens
tgggaggctgaggc

SEQ ID NO: 2709139 - DNA, 17 bp, Homo sapiens
tgggcactgctgggtgg

SEQ ID NO: 2709140 - DNA, 22 bp, Homo sapiens
tgggcactgctgggtggcccat

SEQ ID NO: 2709141 - DNA, 17 bp, Homo sapiens
tgggcagaatcctgggc

SEQ ID NO: 2709142 - DNA, 19 bp, Homo sapiens
tgggcagaatcctgggccc

SEQ ID NO: 2709143 - DNA, 20 bp, Homo sapiens
tgggcagaatcctgggcccc

SEQ ID NO: 2709144 - DNA, 20 bp, Homo sapiens
tgggcaggaaaccccagcgg

SEQ ID NO: 2709145 - DNA, 17 bp, Homo sapiens
tgggcaggagtcaccat

SEQ ID NO: 2709146 - DNA, 16 bp, Homo sapiens
tgggcatttggtgaga

SEQ ID NO: 2709147 - DNA, 15 bp, Homo sapiens
tgggccaacaaggac

SEQ ID NO: 2709148 - DNA, 17 bp, Homo sapiens
tgggccagatgctgggc

SEQ ID NO: 2709149 - DNA, 16 bp, Homo sapiens
tgggccatgggtcctc

SEQ ID NO: 2709150 - DNA, 20 bp, Homo sapiens
tgggccatgggtcctcggcc

SEQ ID NO: 2709151 - DNA, 21 bp, Homo sapiens
tgggccatgggtcctcggccc

SEQ ID NO: 2709152 - DNA, 14 bp, Homo sapiens
tgggcccacagccc

SEQ ID NO: 2709153 - DNA, 12 bp, Homo sapiens
tgggcccctcag

SEQ ID NO: 2709154 - DNA, 13 bp, Homo sapiens
tgggccgagccac

SEQ ID NO: 2709155 - DNA, 13 bp, Homo sapiens
tgggcctgctgcg

SEQ ID NO: 2709156 - DNA, 14 bp, Homo sapiens
tgggcctgtgtgca

SEQ ID NO: 2709157 - DNA, 14 bp, Homo sapiens
tgggcgaccagggc

SEQ ID NO: 2709158 - DNA, 19 bp, Homo sapiens
tgggcgggcagcacagcaa

SEQ ID NO: 2709159 - DNA, 20 bp, Homo sapiens
tgggctacaaaccaggagca

SEQ ID NO: 2709160 - DNA, 20 bp, Homo sapiens
tgggctcagatcctgggcat

SEQ ID NO: 2709161 - DNA, 15 bp, Homo sapiens
tgggctctgccccag

SEQ ID NO: 2709162 - DNA, 21 bp, Homo sapiens
tgggctctgccccagctctgg

SEQ ID NO: 2709163 - DNA, 23 bp, Homo sapiens
tgggctctgccccagctctggct

SEQ ID NO: 2709164 - DNA, 17 bp, Homo sapiens
tgggctctgtgggctgc

SEQ ID NO: 2709165 - DNA, 18 bp, Homo sapiens
tgggctgcactctgtgcc

SEQ ID NO: 2709166 - DNA, 15 bp, Homo sapiens
tggggaaactaacaa

SEQ ID NO: 2709167 - DNA, 22 bp, Homo sapiens
tggggaagcaagacgtcctgga

SEQ ID NO: 2709168 - DNA, 19 bp, Homo sapiens
tggggcctatcagtgtgcc

SEQ ID NO: 2709169 - DNA, 20 bp, Homo sapiens
tggggcctatcagtgtgccc

SEQ ID NO: 2709170 - DNA, 12 bp, Homo sapiens
tggggccttggt

SEQ ID NO: 2709171 - DNA, 20 bp, Homo sapiens
tggggctcgccccacccagg

SEQ ID NO: 2709172 - DNA, 22 bp, Homo sapiens
tggggctcgccccacccagggc

SEQ ID NO: 2709173 - DNA, 23 bp, Homo sapiens
tggggctggtgaggccggccctg

SEQ ID NO: 2709174 - DNA, 13 bp, Homo sapiens
tggggctggtgga

SEQ ID NO: 2709175 - DNA, 18 bp, Homo sapiens
tgggggaagagcacagcc

SEQ ID NO: 2709176 - DNA, 20 bp, Homo sapiens
tgggggagacatgctctccc

SEQ ID NO: 2709177 - DNA, 21 bp, Homo sapiens
tgggggagggactgctgaccc

SEQ ID NO: 2709178 - DNA, 22 bp, Homo sapiens
tgggggctccccttgcccttcc

SEQ ID NO: 2709179 - DNA, 22 bp, Homo sapiens
tgggtcccacttcccctcctac

SEQ ID NO: 2709180 - DNA, 16 bp, Homo sapiens
tgggtcctcggcccat

SEQ ID NO: 2709181 - DNA, 19 bp, Homo sapiens
tgggtcctcggcccatctg

SEQ ID NO: 2709182 - DNA, 20 bp, Homo sapiens
tgggtcctctgcttcctgag

SEQ ID NO: 2709183 - DNA, 23 bp, Homo sapiens
tgggtgacggtcctttaggcagc

SEQ ID NO: 2709184 - DNA, 15 bp, Homo sapiens
tgggtgagagaggaa

SEQ ID NO: 2709185 - DNA, 20 bp, Homo sapiens
tgggtgatttctagaatggt

SEQ ID NO: 2709186 - DNA, 17 bp, Homo sapiens
tgggttggcgcaccctc

SEQ ID NO: 2709187 - DNA, 23 bp, Homo sapiens
tgggttggcgcaccctcccctcc

SEQ ID NO: 2709188 - DNA, 13 bp, Homo sapiens
tgggtttcaattt

SEQ ID NO: 2709189 - DNA, 14 bp, Homo sapiens
tgggtttggcccct

SEQ ID NO: 2709190 - DNA, 15 bp, Homo sapiens
tgggtttggcccctg

SEQ ID NO: 2709191 - DNA, 18 bp, Homo sapiens
tggtaaaaagattatata

SEQ ID NO: 2709192 - DNA, 22 bp, Homo sapiens
tggtaatttgtatctgaaggag

SEQ ID NO: 2709193 - DNA, 14 bp, Homo sapiens
tggtacagcagggt

SEQ ID NO: 2709194 - DNA, 15 bp, Homo sapiens
tggtacatggccagt

SEQ ID NO: 2709195 - DNA, 15 bp, Homo sapiens
tggtaccaggtctcc

SEQ ID NO: 2709196 - DNA, 16 bp, Homo sapiens
tggtagaagccagtac

SEQ ID NO: 2709197 - DNA, 22 bp, Homo sapiens
tggtatatctggccacactggg

SEQ ID NO: 2709198 - DNA, 14 bp, Homo sapiens
tggtcaccatgaaa

SEQ ID NO: 2709199 - DNA, 16 bp, Homo sapiens
tggtcaccatgaaact

SEQ ID NO: 2709200 - DNA, 20 bp, Homo sapiens
tggtcccacccaggaaggga

SEQ ID NO: 2709201 - DNA, 20 bp, Homo sapiens
tggtcccagacagctggacc

SEQ ID NO: 2709202 - DNA, 21 bp, Homo sapiens
tggtcccagacagctggaccc

SEQ ID NO: 2709203 - DNA, 12 bp, Homo sapiens
tggtcctggctg

SEQ ID NO: 2709204 - DNA, 13 bp, Homo sapiens
tggtcctggctgg

SEQ ID NO: 2709205 - DNA, 18 bp, Homo sapiens
tggtctgctcgggcccag

SEQ ID NO: 2709206 - DNA, 21 bp, Homo sapiens
tggtcttgatctcctgagctc

SEQ ID NO: 2709207 - DNA, 20 bp, Homo sapiens
tggtgaacattgcaatagaa

SEQ ID NO: 2709208 - DNA, 12 bp, Homo sapiens
tggtgacttcct

SEQ ID NO: 2709209 - DNA, 17 bp, Homo sapiens
tggtgacttttgaagaa

SEQ ID NO: 2709210 - DNA, 16 bp, Homo sapiens
tggtgagagtcaaagc

SEQ ID NO: 2709211 - DNA, 19 bp, Homo sapiens
tggtgaggcccagcctgtc

SEQ ID NO: 2709212 - DNA, 15 bp, Homo sapiens
tggtgagggagcctc

SEQ ID NO: 2709213 - DNA, 18 bp, Homo sapiens
tggtgcaattaactctgg

SEQ ID NO: 2709214 - DNA, 22 bp, Homo sapiens
tggtgcccagactcaaggcctc

SEQ ID NO: 2709215 - DNA, 21 bp, Homo sapiens
tggtgcctgattcggctgtct

SEQ ID NO: 2709216 - DNA, 18 bp, Homo sapiens
tggtgtcgcgccttctcc

SEQ ID NO: 2709217 - DNA, 21 bp, Homo sapiens
tggtgtcgcgccttctccccc

SEQ ID NO: 2709218 - DNA, 15 bp, Homo sapiens
tggtgtgaaagtcag

SEQ ID NO: 2709219 - DNA, 16 bp, Homo sapiens
tggtgtgtgtctctga

SEQ ID NO: 2709220 - DNA, 18 bp, Homo sapiens
tggtgtgtgtctctgaca

SEQ ID NO: 2709221 - DNA, 17 bp, Homo sapiens
tggtgttggcagtgttt

SEQ ID NO: 2709222 - DNA, 18 bp, Homo sapiens
tggtgttggcagtgtttg

SEQ ID NO: 2709223 - DNA, 20 bp, Homo sapiens
tggtttgatggtgacttcct

SEQ ID NO: 2709224 - DNA, 15 bp, Homo sapiens
tggtttgcacataaa

SEQ ID NO: 2709225 - DNA, 19 bp, Homo sapiens
tggtttgcacataaaacgt

SEQ ID NO: 2709226 - DNA, 15 bp, Homo sapiens
tggtttgtaatgttt

SEQ ID NO: 2709227 - DNA, 15 bp, Homo sapiens
tggtttttgttgagt

SEQ ID NO: 2709228 - DNA, 13 bp, Homo sapiens
tgtaaaaagaaat

SEQ ID NO: 2709229 - DNA, 14 bp, Homo sapiens
tgtaaaatcttcag

SEQ ID NO: 2709230 - DNA, 15 bp, Homo sapiens
tgtaaaggtaggtgc

SEQ ID NO: 2709231 - DNA, 17 bp, Homo sapiens
tgtaaaggtaggtgcat

SEQ ID NO: 2709232 - DNA, 22 bp, Homo sapiens
tgtaaaggtaggtgcatgcctt

SEQ ID NO: 2709233 - DNA, 23 bp, Homo sapiens
tgtaaataaccacactgaaacct

SEQ ID NO: 2709234 - DNA, 16 bp, Homo sapiens
tgtaaatgagacacat

SEQ ID NO: 2709235 - DNA, 18 bp, Homo sapiens
tgtaacctcgtgtctagt

SEQ ID NO: 2709236 - DNA, 22 bp, Homo sapiens
tgtaagaagctaaaatgaaaaa

SEQ ID NO: 2709237 - DNA, 17 bp, Homo sapiens
tgtaagcagattacaat

SEQ ID NO: 2709238 - DNA, 21 bp, Homo sapiens
tgtaagcttagattttctgta

SEQ ID NO: 2709239 - DNA, 22 bp, Homo sapiens
tgtaaggtcttcttgtgtcctg

SEQ ID NO: 2709240 - DNA, 18 bp, Homo sapiens
tgtaatattctctgatgt

SEQ ID NO: 2709241 - DNA, 21 bp, Homo sapiens
tgtaatatttcttcaagtgag

SEQ ID NO: 2709242 - DNA, 23 bp, Homo sapiens
tgtaatcccagctattcaggagg

SEQ ID NO: 2709243 - DNA, 13 bp, Homo sapiens
tgtaatgatcata

SEQ ID NO: 2709244 - DNA, 12 bp, Homo sapiens
ttcgatgtacag

SEQ ID NO: 2709245 - DNA, 18 bp, Homo sapiens
ttctaaaggtttcactgt

SEQ ID NO: 2709246 - DNA, 23 bp, Homo sapiens
ttctaaccaaagagtctctggct

SEQ ID NO: 2709247 - DNA, 15 bp, Homo sapiens
ttctaatcataacat

SEQ ID NO: 2709248 - DNA, 14 bp, Homo sapiens
ttctaatccatgtg

SEQ ID NO: 2709249 - DNA, 19 bp, Homo sapiens
ttctacacatatatgtata

SEQ ID NO: 2709250 - DNA, 18 bp, Homo sapiens
ttctactgtataaacaaa

SEQ ID NO: 2709251 - DNA, 15 bp, Homo sapiens
ttctacttttaaaga

SEQ ID NO: 2709252 - DNA, 14 bp, Homo sapiens
ttctagaatggttt

SEQ ID NO: 2709253 - DNA, 18 bp, Homo sapiens
ttctagtatctattgtgt

SEQ ID NO: 2709254 - DNA, 22 bp, Homo sapiens
ttctatatcattaggaaaacat

SEQ ID NO: 2709255 - DNA, 19 bp, Homo sapiens
ttctcaatcactgctcccc

SEQ ID NO: 2709256 - DNA, 14 bp, Homo sapiens
ttctcacctgcctt

SEQ ID NO: 2709257 - DNA, 19 bp, Homo sapiens
ttctccagcaagcagtgcc

SEQ ID NO: 2709258 - DNA, 21 bp, Homo sapiens
ttctccagggacagaagcagg

SEQ ID NO: 2709259 - DNA, 17 bp, Homo sapiens
ttctcccagaaggctgg

SEQ ID NO: 2709260 - DNA, 17 bp, Homo sapiens
ttctcccccccggggct

SEQ ID NO: 2709261 - DNA, 14 bp, Homo sapiens
ttctccccctgggc

SEQ ID NO: 2709262 - DNA, 15 bp, Homo sapiens
ttctcgacttcagga

SEQ ID NO: 2709263 - DNA, 12 bp, Homo sapiens
ttctctgttcta

SEQ ID NO: 2709264 - DNA, 15 bp, Homo sapiens
ttctgataatgtatt

SEQ ID NO: 2709265 - DNA, 17 bp, Homo sapiens
ttctgccacttcccagg

SEQ ID NO: 2709266 - DNA, 14 bp, Homo sapiens
ttctgcctgagatt

SEQ ID NO: 2709267 - DNA, 15 bp, Homo sapiens
ttctgcctgagattc

SEQ ID NO: 2709268 - DNA, 13 bp, Homo sapiens
ttctggagccctt

SEQ ID NO: 2709269 - DNA, 16 bp, Homo sapiens
ttctgggtgatttcta

SEQ ID NO: 2709270 - DNA, 11 bp, Homo sapiens
ttctgtgtcct

SEQ ID NO: 2709271 - DNA, 14 bp, Homo sapiens
ttcttcaaagtgga

SEQ ID NO: 2709272 - DNA, 18 bp, Homo sapiens
ttcttggaattttgtaaa

SEQ ID NO: 2709273 - DNA, 22 bp, Homo sapiens
ttcttggaattttgtaaaaaga

SEQ ID NO: 2709274 - DNA, 23 bp, Homo sapiens
ttcttggaattttgtaaaaagaa

SEQ ID NO: 2709275 - DNA, 13 bp, Homo sapiens
ttctttaaggaga

SEQ ID NO: 2709276 - DNA, 17 bp, Homo sapiens
ttctttcatacattata

SEQ ID NO: 2709277 - DNA, 19 bp, Homo sapiens
ttctttccaaaatcaggct

SEQ ID NO: 2709278 - DNA, 21 bp, Homo sapiens
ttcttttctctatgaaaagca

SEQ ID NO: 2709279 - DNA, 14 bp, Homo sapiens
ttgaaacagcctgg

SEQ ID NO: 2709280 - DNA, 18 bp, Homo sapiens
ttgaaacctttctacttt

SEQ ID NO: 2709281 - DNA, 17 bp, Homo sapiens
ttgaaagaattctattt

SEQ ID NO: 2709282 - DNA, 14 bp, Homo sapiens
ttgaaagacatcaa

SEQ ID NO: 2709283 - DNA, 21 bp, Homo sapiens
ttgaaagtgaataaacttcag

SEQ ID NO: 2709284 - DNA, 22 bp, Homo sapiens
ttgaactccatgggattttatc

SEQ ID NO: 2709285 - DNA, 18 bp, Homo sapiens
ttgaagaacaaaaggctt

SEQ ID NO: 2709286 - DNA, 17 bp, Homo sapiens
ttgaagccactgaagct

SEQ ID NO: 2709287 - DNA, 12 bp, Homo sapiens
ttgaatgtgatc

SEQ ID NO: 2709288 - DNA, 21 bp, Homo sapiens
ttgaatgtgatcatctttgct

SEQ ID NO: 2709289 - DNA, 21 bp, Homo sapiens
ttgacagagttggtgttcata

SEQ ID NO: 2709290 - DNA, 22 bp, Homo sapiens
ttgacagagttggtgttcataa

SEQ ID NO: 2709291 - DNA, 15 bp, Homo sapiens
ttgacccctcctgaa

SEQ ID NO: 2709292 - DNA, 16 bp, Homo sapiens
ttgacctgaactctgc

SEQ ID NO: 2709293 - DNA, 19 bp, Homo sapiens
ttgagaaataattactaat

SEQ ID NO: 2709294 - DNA, 23 bp, Homo sapiens
ttgagatggagtctcgctctgct

SEQ ID NO: 2709295 - DNA, 15 bp, Homo sapiens
ttgagcgtgattctg

SEQ ID NO: 2709296 - DNA, 16 bp, Homo sapiens
ttgaggggctcctgga

SEQ ID NO: 2709297 - DNA, 14 bp, Homo sapiens
ttgagtaggccctg

SEQ ID NO: 2709298 - DNA, 15 bp, Homo sapiens
ttgagtaggccctgc

SEQ ID NO: 2709299 - DNA, 18 bp, Homo sapiens
ttgataaattccactgga

SEQ ID NO: 2709300 - DNA, 14 bp, Homo sapiens
ttgatatttccttc

SEQ ID NO: 2709301 - DNA, 15 bp, Homo sapiens
ttgatattttcacag

SEQ ID NO: 2709302 - DNA, 22 bp, Homo sapiens
ttgatctaatgaagtgtttcct

SEQ ID NO: 2709303 - DNA, 13 bp, Homo sapiens
ttgatgtcagcct

SEQ ID NO: 2709304 - DNA, 19 bp, Homo sapiens
ttgattcacacttgttcaa

SEQ ID NO: 2709305 - DNA, 14 bp, Homo sapiens
ttgattcagcaaaa

SEQ ID NO: 2709306 - DNA, 17 bp, Homo sapiens
ttgattcagcaaaaatc

SEQ ID NO: 2709307 - DNA, 14 bp, Homo sapiens
ttgatttaatatct

SEQ ID NO: 2709308 - DNA, 20 bp, Homo sapiens
ttgatttctagtatctattg

SEQ ID NO: 2709309 - DNA, 13 bp, Homo sapiens
ttgcaaaggactg

SEQ ID NO: 2709310 - DNA, 16 bp, Homo sapiens
ttgcaccattctttct

SEQ ID NO: 2709311 - DNA, 17 bp, Homo sapiens
ttgcaccattctttctt

SEQ ID NO: 2709312 - DNA, 14 bp, Homo sapiens
ttgcaggggactgg

SEQ ID NO: 2709313 - DNA, 21 bp, Homo sapiens
ttgcatgaattcacaaacaaa

SEQ ID NO: 2709314 - DNA, 20 bp, Homo sapiens
ttgccatggagttgtgatca

SEQ ID NO: 2709315 - DNA, 17 bp, Homo sapiens
ttgccatgggcctgctg

SEQ ID NO: 2709316 - DNA, 21 bp, Homo sapiens
ttgcccacacacactccttcc

SEQ ID NO: 2709317 - DNA, 15 bp, Homo sapiens
ttgccccaaccccca

SEQ ID NO: 2709318 - DNA, 16 bp, Homo sapiens
ttgccctaagaacttt

SEQ ID NO: 2709319 - DNA, 15 bp, Homo sapiens
ttgcctcggctcctg

SEQ ID NO: 2709320 - DNA, 15 bp, Homo sapiens
ttgcctgcctgggcc

SEQ ID NO: 2709321 - DNA, 20 bp, Homo sapiens
ttgcctgcctgggcctccca

SEQ ID NO: 2709322 - DNA, 12 bp, Homo sapiens
ttgcctggggcc

SEQ ID NO: 2709323 - DNA, 13 bp, Homo sapiens
ttgccttaagttt

SEQ ID NO: 2709324 - DNA, 13 bp, Homo sapiens
ttgctacaataaa

SEQ ID NO: 2709325 - DNA, 14 bp, Homo sapiens
ttgctacaataaat

SEQ ID NO: 2709326 - DNA, 16 bp, Homo sapiens
ttgctacaataaatgc

SEQ ID NO: 2709327 - DNA, 19 bp, Homo sapiens
ttgctacaataaatgctga

SEQ ID NO: 2709328 - DNA, 20 bp, Homo sapiens
ttgctcacactacttgagaa

SEQ ID NO: 2709329 - DNA, 15 bp, Homo sapiens
ttgctcgaagactgt

SEQ ID NO: 2709330 - DNA, 21 bp, Homo sapiens
ttgctgaatgtcattatttga

SEQ ID NO: 2709331 - DNA, 20 bp, Homo sapiens
ttgctgctaatcctgaggct

SEQ ID NO: 2709332 - DNA, 16 bp, Homo sapiens
ttgctggcagggcctg

SEQ ID NO: 2709333 - DNA, 18 bp, Homo sapiens
ttgctgttgctgttgctg

SEQ ID NO: 2709334 - DNA, 16 bp, Homo sapiens
ttgcttgattaaacag

SEQ ID NO: 2709335 - DNA, 12 bp, Homo sapiens
ttggaaaaatgt

SEQ ID NO: 2709336 - DNA, 16 bp, Homo sapiens
ttggaaaaatgtcact

SEQ ID NO: 2709337 - DNA, 18 bp, Homo sapiens
ttggaaaaatgtcactga

SEQ ID NO: 2709338 - DNA, 13 bp, Homo sapiens
ttggaaaagaaat

SEQ ID NO: 2709339 - DNA, 14 bp, Homo sapiens
ttggaaaagaaatc

SEQ ID NO: 2709340 - DNA, 19 bp, Homo sapiens
ttggaaaagaaatcaattt

SEQ ID NO: 2709341 - DNA, 20 bp, Homo sapiens
ttggaaaagaaatcaatttt

SEQ ID NO: 2709342 - DNA, 19 bp, Homo sapiens
ttggaagagaggcacctgc

SEQ ID NO: 2709343 - DNA, 13 bp, Homo sapiens
ttggagagcagct

SEQ ID NO: 2709344 - DNA, 15 bp, Homo sapiens
ttggagagcagctgg

SEQ ID NO: 2709345 - DNA, 17 bp, Homo sapiens
ttggagagcagctggct

SEQ ID NO: 2709346 - DNA, 17 bp, Homo sapiens
ttggcagaactgctggg

SEQ ID NO: 2709347 - DNA, 20 bp, Homo sapiens
ttggcagaactgctggggct

SEQ ID NO: 2709348 - DNA, 21 bp, Homo sapiens
ttggcatcacagggcagagcc

SEQ ID NO: 2709349 - DNA, 21 bp, Homo sapiens
ttggcccctggaacctttccc

SEQ ID NO: 2709350 - DNA, 19 bp, Homo sapiens
ttggcgcaccctcccctcc

SEQ ID NO: 2709351 - DNA, 15 bp, Homo sapiens
ttggcttcagaattg

SEQ ID NO: 2709352 - DNA, 17 bp, Homo sapiens
ttgggatcagcctccgc

SEQ ID NO: 2709353 - DNA, 21 bp, Homo sapiens
ttgggcctgacctccagtcct

SEQ ID NO: 2709354 - DNA, 15 bp, Homo sapiens
ttgggggcttccctg

SEQ ID NO: 2709355 - DNA, 18 bp, Homo sapiens
ttggtacagttcataatt

SEQ ID NO: 2709356 - DNA, 12 bp, Homo sapiens
ttggtgcattcg

SEQ ID NO: 2709357 - DNA, 16 bp, Homo sapiens
ttggtgtgttttgctc

SEQ ID NO: 2709358 - DNA, 17 bp, Homo sapiens
ttggttagagaagtaag

SEQ ID NO: 2709359 - DNA, 23 bp, Homo sapiens
ttggttatgatggaaaggaagaa

SEQ ID NO: 2709360 - DNA, 14 bp, Homo sapiens
ttggttcccttgtg

SEQ ID NO: 2709361 - DNA, 12 bp, Homo sapiens
ttgtaaaaaagg

SEQ ID NO: 2709362 - DNA, 14 bp, Homo sapiens
ttgtaaaaagaaat

SEQ ID NO: 2709363 - DNA, 19 bp, Homo sapiens
ttgtaaatactccattatt

SEQ ID NO: 2709364 - DNA, 22 bp, Homo sapiens
ttgtaaatactccattatttta

SEQ ID NO: 2709365 - DNA, 17 bp, Homo sapiens
ttgtaaatgagacacat

SEQ ID NO: 2709366 - DNA, 12 bp, Homo sapiens
ttgtaatatttc

SEQ ID NO: 2709367 - DNA, 22 bp, Homo sapiens
ttgtaatatttcttcaagtgag

SEQ ID NO: 2709368 - DNA, 12 bp, Homo sapiens
ttgtaattattg

SEQ ID NO: 2709369 - DNA, 19 bp, Homo sapiens
aacatttttgtacattatg

SEQ ID NO: 2709370 - DNA, 18 bp, Homo sapiens
aaccaaagagtctctggc

SEQ ID NO: 2709371 - DNA, 15 bp, Homo sapiens
aaccagaaaagcaat

SEQ ID NO: 2709372 - DNA, 22 bp, Homo sapiens
aaccagaaaagcaatactgttt

SEQ ID NO: 2709373 - DNA, 14 bp, Homo sapiens
aaccagtgtagcct

SEQ ID NO: 2709374 - DNA, 17 bp, Homo sapiens
aaccccagctggcctct

SEQ ID NO: 2709375 - DNA, 13 bp, Homo sapiens
aacccctccccca

SEQ ID NO: 2709376 - DNA, 19 bp, Homo sapiens
aaccctaagtgtggatgtt

SEQ ID NO: 2709377 - DNA, 12 bp, Homo sapiens
aaccctcagctg

SEQ ID NO: 2709378 - DNA, 19 bp, Homo sapiens
aaccctcagctgcctcatc

SEQ ID NO: 2709379 - DNA, 18 bp, Homo sapiens
aacctcaggcttccttgg

SEQ ID NO: 2709380 - DNA, 21 bp, Homo sapiens
aacctcgaggtttctcaaaga

SEQ ID NO: 2709381 - DNA, 21 bp, Homo sapiens
aacctctaatttattttgtcg

SEQ ID NO: 2709382 - DNA, 11 bp, Homo sapiens
aacctgcattt

SEQ ID NO: 2709383 - DNA, 22 bp, Homo sapiens
aacctgcccctccccagccctt

SEQ ID NO: 2709384 - DNA, 14 bp, Homo sapiens
aacctgcgcagtca

SEQ ID NO: 2709385 - DNA, 20 bp, Homo sapiens
aacctgtccttactcagagc

SEQ ID NO: 2709386 - DNA, 22 bp, Homo sapiens
aacctgtccttactcagagctg

SEQ ID NO: 2709387 - DNA, 23 bp, Homo sapiens
aacctgtccttactcagagctgc

SEQ ID NO: 2709388 - DNA, 17 bp, Homo sapiens
aacctgtttttaacatg

SEQ ID NO: 2709389 - DNA, 18 bp, Homo sapiens
aacctgtttttaacatgt

SEQ ID NO: 2709390 - DNA, 19 bp, Homo sapiens
aacctttctactttttctg

SEQ ID NO: 2709391 - DNA, 20 bp, Homo sapiens
aacctttctactttttctgt

SEQ ID NO: 2709392 - DNA, 23 bp, Homo sapiens
aacgacaaagccaaactctgcca

SEQ ID NO: 2709393 - DNA, 14 bp, Homo sapiens
aacgctctaccctg

SEQ ID NO: 2709394 - DNA, 19 bp, Homo sapiens
aacgctctaccctgcagct

SEQ ID NO: 2709395 - DNA, 14 bp, Homo sapiens
aacggcaacagcat

SEQ ID NO: 2709396 - DNA, 16 bp, Homo sapiens
aactagaaatctgcca

SEQ ID NO: 2709397 - DNA, 20 bp, Homo sapiens
aactagagatgactgagtcc

SEQ ID NO: 2709398 - DNA, 13 bp, Homo sapiens
aactcccggaggt

SEQ ID NO: 2709399 - DNA, 11 bp, Homo sapiens
aactccctcct

SEQ ID NO: 2709400 - DNA, 14 bp, Homo sapiens
aactccctcctcac

SEQ ID NO: 2709401 - DNA, 12 bp, Homo sapiens
aactcctgttct

SEQ ID NO: 2709402 - DNA, 23 bp, Homo sapiens
aactctaccctggtaggaaagca

SEQ ID NO: 2709403 - DNA, 15 bp, Homo sapiens
aactctccactccat

SEQ ID NO: 2709404 - DNA, 12 bp, Homo sapiens
aactctgcagga

SEQ ID NO: 2709405 - DNA, 15 bp, Homo sapiens
aactgaattttgtct

SEQ ID NO: 2709406 - DNA, 15 bp, Homo sapiens
aactgagaggtgagg

SEQ ID NO: 2709407 - DNA, 22 bp, Homo sapiens
aactgcgtgccagtgtccccac

SEQ ID NO: 2709408 - DNA, 16 bp, Homo sapiens
aactgctggggctggt

SEQ ID NO: 2709409 - DNA, 11 bp, Homo sapiens
aactggccact

SEQ ID NO: 2709410 - DNA, 20 bp, Homo sapiens
aactgtagataaagtggttt

SEQ ID NO: 2709411 - DNA, 13 bp, Homo sapiens
aacttatttgagt

SEQ ID NO: 2709412 - DNA, 11 bp, Homo sapiens
aacttcagaga

SEQ ID NO: 2709413 - DNA, 17 bp, Homo sapiens
aactttcaaaagcaaac

SEQ ID NO: 2709414 - DNA, 12 bp, Homo sapiens
aactttgatctc

SEQ ID NO: 2709415 - DNA, 19 bp, Homo sapiens
aactttgcttgattaaaca

SEQ ID NO: 2709416 - DNA, 16 bp, Homo sapiens
aagaaaaaaagcaaaa

SEQ ID NO: 2709417 - DNA, 17 bp, Homo sapiens
aagaaaaccctaagtgt

SEQ ID NO: 2709418 - DNA, 21 bp, Homo sapiens
aagaaaacctgtttttaacat

SEQ ID NO: 2709419 - DNA, 21 bp, Homo sapiens
aagaaaagttttgtaaatttc

SEQ ID NO: 2709420 - DNA, 13 bp, Homo sapiens
aagaaaatcaatg

SEQ ID NO: 2709421 - DNA, 15 bp, Homo sapiens
aagaaaatcaatgaa

SEQ ID NO: 2709422 - DNA, 12 bp, Homo sapiens
aagaaaatgaat

SEQ ID NO: 2709423 - DNA, 14 bp, Homo sapiens
aagaaagggaaagc

SEQ ID NO: 2709424 - DNA, 19 bp, Homo sapiens
aagaaagggaaagctgtgc

SEQ ID NO: 2709425 - DNA, 19 bp, Homo sapiens
aagaagctaaaatgaaaaa

SEQ ID NO: 2709426 - DNA, 12 bp, Homo sapiens
aagaagtttggg

SEQ ID NO: 2709427 - DNA, 19 bp, Homo sapiens
aagaagtttgggctaacat

SEQ ID NO: 2709428 - DNA, 22 bp, Homo sapiens
aagaataaacacagtgtttcct

SEQ ID NO: 2709429 - DNA, 16 bp, Homo sapiens
aagacacagcccagac

SEQ ID NO: 2709430 - DNA, 17 bp, Homo sapiens
aagacagtggcactaaa

SEQ ID NO: 2709431 - DNA, 18 bp, Homo sapiens
aagacagtggcactaaaa

SEQ ID NO: 2709432 - DNA, 23 bp, Homo sapiens
aagacagtggcactaaaatgttt

SEQ ID NO: 2709433 - DNA, 14 bp, Homo sapiens
aagaccaaattttg

SEQ ID NO: 2709434 - DNA, 16 bp, Homo sapiens
aagacttcactgcagc

SEQ ID NO: 2709435 - DNA, 17 bp, Homo sapiens
aagacttcactgcagcc

SEQ ID NO: 2709436 - DNA, 18 bp, Homo sapiens
aagacttcactgcagcct

SEQ ID NO: 2709437 - DNA, 18 bp, Homo sapiens
aagacttccagagcctca

SEQ ID NO: 2709438 - DNA, 14 bp, Homo sapiens
aagacttgctttaa

SEQ ID NO: 2709439 - DNA, 17 bp, Homo sapiens
aagagaggcacctgctg

SEQ ID NO: 2709440 - DNA, 14 bp, Homo sapiens
aagagatctttctt

SEQ ID NO: 2709441 - DNA, 12 bp, Homo sapiens
aagagcacagcc

SEQ ID NO: 2709442 - DNA, 14 bp, Homo sapiens
aagagcacagccct

SEQ ID NO: 2709443 - DNA, 15 bp, Homo sapiens
aagagcacagccctc

SEQ ID NO: 2709444 - DNA, 19 bp, Homo sapiens
aagagcacagccctcccgc

SEQ ID NO: 2709445 - DNA, 13 bp, Homo sapiens
aagagtagaaaag

SEQ ID NO: 2709446 - DNA, 19 bp, Homo sapiens
aagagtctctccagcctca

SEQ ID NO: 2709447 - DNA, 13 bp, Homo sapiens
aagagtctctggc

SEQ ID NO: 2709448 - DNA, 15 bp, Homo sapiens
aagagtgaaaaatga

SEQ ID NO: 2709449 - DNA, 16 bp, Homo sapiens
aagatcgaatttttca

SEQ ID NO: 2709450 - DNA, 15 bp, Homo sapiens
aagatgtaagaagct

SEQ ID NO: 2709451 - DNA, 16 bp, Homo sapiens
aagatgtcagactggc

SEQ ID NO: 2709452 - DNA, 18 bp, Homo sapiens
aagattaaatgtgtcatt

SEQ ID NO: 2709453 - DNA, 21 bp, Homo sapiens
aagattatatatcataaagta

SEQ ID NO: 2709454 - DNA, 15 bp, Homo sapiens
aagcaaattaagaca

SEQ ID NO: 2709455 - DNA, 18 bp, Homo sapiens
aagcaagacgtcctggaa

SEQ ID NO: 2709456 - DNA, 12 bp, Homo sapiens
aagcaagcaaaa

SEQ ID NO: 2709457 - DNA, 13 bp, Homo sapiens
aagcaagccggca

SEQ ID NO: 2709458 - DNA, 16 bp, Homo sapiens
aagcacatgccaggga

SEQ ID NO: 2709459 - DNA, 16 bp, Homo sapiens
aagcaccgcagcatgt

SEQ ID NO: 2709460 - DNA, 13 bp, Homo sapiens
aagcagagcttcc

SEQ ID NO: 2709461 - DNA, 17 bp, Homo sapiens
aagcagagttctttgca

SEQ ID NO: 2709462 - DNA, 22 bp, Homo sapiens
aagcagggacaccccccgcccc

SEQ ID NO: 2709463 - DNA, 20 bp, Homo sapiens
aagcaggtttcttgcttctg

SEQ ID NO: 2709464 - DNA, 17 bp, Homo sapiens
aagcagtgccctctgga

SEQ ID NO: 2709465 - DNA, 19 bp, Homo sapiens
aagcatcacctcaggccag

SEQ ID NO: 2709466 - DNA, 23 bp, Homo sapiens
aagcatcacctcaggccaggtgc

SEQ ID NO: 2709467 - DNA, 15 bp, Homo sapiens
aagcatcctccccac

SEQ ID NO: 2709468 - DNA, 23 bp, Homo sapiens
aagcatcctccccaccagagctg

SEQ ID NO: 2709469 - DNA, 16 bp, Homo sapiens
aagcattctgagctgg

SEQ ID NO: 2709470 - DNA, 16 bp, Homo sapiens
aagccaagccctccgc

SEQ ID NO: 2709471 - DNA, 21 bp, Homo sapiens
aagccaatatttactcatcag

SEQ ID NO: 2709472 - DNA, 13 bp, Homo sapiens
aagccaccgcagc

SEQ ID NO: 2709473 - DNA, 19 bp, Homo sapiens
aagccaccgcagctgctgc

SEQ ID NO: 2709474 - DNA, 13 bp, Homo sapiens
aagccactgaagc

SEQ ID NO: 2709475 - DNA, 17 bp, Homo sapiens
aagccctcggcctccag

SEQ ID NO: 2709476 - DNA, 11 bp, Homo sapiens
aagcctctgct

SEQ ID NO: 2709477 - DNA, 17 bp, Homo sapiens
aagcctctgtgtcactg

SEQ ID NO: 2709478 - DNA, 18 bp, Homo sapiens
aagcctctgtgtcactgg

SEQ ID NO: 2709479 - DNA, 23 bp, Homo sapiens
aagcctctgtgtcactggctgcc

SEQ ID NO: 2709480 - DNA, 20 bp, Homo sapiens
aagcgatgaatttggagact

SEQ ID NO: 2709481 - DNA, 21 bp, Homo sapiens
aagcgatgaatttggagactc

SEQ ID NO: 2709482 - DNA, 21 bp, Homo sapiens
aagcgtgattcctgctgcctg

SEQ ID NO: 2709483 - DNA, 13 bp, Homo sapiens
aagctatttcctt

SEQ ID NO: 2709484 - DNA, 15 bp, Homo sapiens
aagctctattaagat

SEQ ID NO: 2709485 - DNA, 14 bp, Homo sapiens
aagctctgcctccc

SEQ ID NO: 2709486 - DNA, 12 bp, Homo sapiens
aagctgcactca

SEQ ID NO: 2709487 - DNA, 15 bp, Homo sapiens
aagctgcagcttcct

SEQ ID NO: 2709488 - DNA, 18 bp, Homo sapiens
aagctgcagcttcctgtc

SEQ ID NO: 2709489 - DNA, 22 bp, Homo sapiens
aagctgtataattaattgtcat

SEQ ID NO: 2709490 - DNA, 20 bp, Homo sapiens
aagcttgtgtgggcccaaca

SEQ ID NO: 2709491 - DNA, 16 bp, Homo sapiens
aagctttctcctttga

SEQ ID NO: 2709492 - DNA, 18 bp, Homo sapiens
aaggaaagccaaatttta

SEQ ID NO: 2709493 - DNA, 15 bp, Homo sapiens
aaggaacacccggaa

SEQ ID NO: 2709494 - DNA, 16 bp, Homo sapiens
acattactgtatgtat

SEQ ID NO: 2709495 - DNA, 15 bp, Homo sapiens
acattatattcctct

SEQ ID NO: 2709496 - DNA, 22 bp, Homo sapiens
acattctgtctctgcttggctt

SEQ ID NO: 2709497 - DNA, 14 bp, Homo sapiens
acattgaaagctct

SEQ ID NO: 2709498 - DNA, 15 bp, Homo sapiens
acattggaagctccc

SEQ ID NO: 2709499 - DNA, 16 bp, Homo sapiens
acatttcatacaacag

SEQ ID NO: 2709500 - DNA, 18 bp, Homo sapiens
acatttcatacaacagaa

SEQ ID NO: 2709501 - DNA, 14 bp, Homo sapiens
acatttctggacag

SEQ ID NO: 2709502 - DNA, 16 bp, Homo sapiens
acattttataaagtta

SEQ ID NO: 2709503 - DNA, 15 bp, Homo sapiens
acatttttgtacatt

SEQ ID NO: 2709504 - DNA, 17 bp, Homo sapiens
acatttttgtacattat

SEQ ID NO: 2709505 - DNA, 11 bp, Homo sapiens
accaaaaatat

SEQ ID NO: 2709506 - DNA, 16 bp, Homo sapiens
accaaagagtctctgg

SEQ ID NO: 2709507 - DNA, 13 bp, Homo sapiens
accaaatctcagt

SEQ ID NO: 2709508 - DNA, 12 bp, Homo sapiens
accaaattttga

SEQ ID NO: 2709509 - DNA, 21 bp, Homo sapiens
accaaattttgaggtctttta

SEQ ID NO: 2709510 - DNA, 14 bp, Homo sapiens
accaacccatgtat

SEQ ID NO: 2709511 - DNA, 19 bp, Homo sapiens
accaagccaccgcagctgc

SEQ ID NO: 2709512 - DNA, 18 bp, Homo sapiens
accaagctgtgccaccct

SEQ ID NO: 2709513 - DNA, 19 bp, Homo sapiens
accaaggtctcacactcct

SEQ ID NO: 2709514 - DNA, 20 bp, Homo sapiens
accaaggtctcacactcctc

SEQ ID NO: 2709515 - DNA, 14 bp, Homo sapiens
accacaacctccac

SEQ ID NO: 2709516 - DNA, 14 bp, Homo sapiens
accacaccctgcct

SEQ ID NO: 2709517 - DNA, 21 bp, Homo sapiens
accacaccctgcctgctgtgg

SEQ ID NO: 2709518 - DNA, 18 bp, Homo sapiens
accacacttcttgaaaca

SEQ ID NO: 2709519 - DNA, 20 bp, Homo sapiens
accacattctgtctctgctt

SEQ ID NO: 2709520 - DNA, 23 bp, Homo sapiens
accaccctatcatcagttaggat

SEQ ID NO: 2709521 - DNA, 16 bp, Homo sapiens
accacctcatgtcatt

SEQ ID NO: 2709522 - DNA, 19 bp, Homo sapiens
accacctggagcggctcat

SEQ ID NO: 2709523 - DNA, 14 bp, Homo sapiens
accactgggcccct

SEQ ID NO: 2709524 - DNA, 15 bp, Homo sapiens
accactgggcccctc

SEQ ID NO: 2709525 - DNA, 16 bp, Homo sapiens
accactgggcccctca

SEQ ID NO: 2709526 - DNA, 19 bp, Homo sapiens
accactgggcccctcaggg

SEQ ID NO: 2709527 - DNA, 13 bp, Homo sapiens
accagaaaagcaa

SEQ ID NO: 2709528 - DNA, 19 bp, Homo sapiens
accagagcaggggctgctg

SEQ ID NO: 2709529 - DNA, 16 bp, Homo sapiens
accagccgtattttac

SEQ ID NO: 2709530 - DNA, 19 bp, Homo sapiens
accaggagcaaccgtgcag

SEQ ID NO: 2709531 - DNA, 21 bp, Homo sapiens
accaggagcaaccgtgcagcc

SEQ ID NO: 2709532 - DNA, 16 bp, Homo sapiens
accaggcacatggctg

SEQ ID NO: 2709533 - DNA, 17 bp, Homo sapiens
accaggcagctccagct

SEQ ID NO: 2709534 - DNA, 12 bp, Homo sapiens
accaggctgctg

SEQ ID NO: 2709535 - DNA, 17 bp, Homo sapiens
accaggggtaccaggca

SEQ ID NO: 2709536 - DNA, 17 bp, Homo sapiens
accaggtcttgacctga

SEQ ID NO: 2709537 - DNA, 12 bp, Homo sapiens
accaggtcttgt

SEQ ID NO: 2709538 - DNA, 16 bp, Homo sapiens
accaggtttgggatgg

SEQ ID NO: 2709539 - DNA, 20 bp, Homo sapiens
accagtagtcacctctgggc

SEQ ID NO: 2709540 - DNA, 18 bp, Homo sapiens
accagtgcctcagtgctg

SEQ ID NO: 2709541 - DNA, 16 bp, Homo sapiens
accagtgtagccttgc

SEQ ID NO: 2709542 - DNA, 19 bp, Homo sapiens
accatattcagtgctgtgg

SEQ ID NO: 2709543 - DNA, 14 bp, Homo sapiens
accatattgctctt

SEQ ID NO: 2709544 - DNA, 14 bp, Homo sapiens
accatgctggcggc

SEQ ID NO: 2709545 - DNA, 16 bp, Homo sapiens
accatggagacaagaa

SEQ ID NO: 2709546 - DNA, 21 bp, Homo sapiens
accattctcctgcctcagcct

SEQ ID NO: 2709547 - DNA, 19 bp, Homo sapiens
accattctttcttggtgca

SEQ ID NO: 2709548 - DNA, 12 bp, Homo sapiens
accattgtcttc

SEQ ID NO: 2709549 - DNA, 13 bp, Homo sapiens
accattgtcttcc

SEQ ID NO: 2709550 - DNA, 13 bp, Homo sapiens
acccaacctgtcc

SEQ ID NO: 2709551 - DNA, 14 bp, Homo sapiens
acccaacctgtcct

SEQ ID NO: 2709552 - DNA, 23 bp, Homo sapiens
acccaacctgtccttactcagag

SEQ ID NO: 2709553 - DNA, 20 bp, Homo sapiens
acccaagaaaacctgttttt

SEQ ID NO: 2709554 - DNA, 13 bp, Homo sapiens
acccactggccag

SEQ ID NO: 2709555 - DNA, 14 bp, Homo sapiens
acccactggccagt

SEQ ID NO: 2709556 - DNA, 17 bp, Homo sapiens
acccactgtccgcctct

SEQ ID NO: 2709557 - DNA, 23 bp, Homo sapiens
acccaggaggtggaggttgcagt

SEQ ID NO: 2709558 - DNA, 21 bp, Homo sapiens
acccagggctccctcctggag

SEQ ID NO: 2709559 - DNA, 21 bp, Homo sapiens
acccagtgtgtgctcagcagc

SEQ ID NO: 2709560 - DNA, 19 bp, Homo sapiens
acccatgaagacaggacag

SEQ ID NO: 2709561 - DNA, 14 bp, Homo sapiens
accccaccctgccc

SEQ ID NO: 2709562 - DNA, 15 bp, Homo sapiens
accccagcacagctc

SEQ ID NO: 2709563 - DNA, 22 bp, Homo sapiens
accccagcacagctcctcccct

SEQ ID NO: 2709564 - DNA, 15 bp, Homo sapiens
accccagctagggct

SEQ ID NO: 2709565 - DNA, 21 bp, Homo sapiens
accccagctagggctggactc

SEQ ID NO: 2709566 - DNA, 19 bp, Homo sapiens
accccaggcagctcgagca

SEQ ID NO: 2709567 - DNA, 14 bp, Homo sapiens
accccatctgccca

SEQ ID NO: 2709568 - DNA, 21 bp, Homo sapiens
acccccagcacccgggctcag

SEQ ID NO: 2709569 - DNA, 16 bp, Homo sapiens
acccccgcccaggctg

SEQ ID NO: 2709570 - DNA, 13 bp, Homo sapiens
accccctcctgct

SEQ ID NO: 2709571 - DNA, 15 bp, Homo sapiens
accccctcctgctgc

SEQ ID NO: 2709572 - DNA, 16 bp, Homo sapiens
accccctcctgctgca

SEQ ID NO: 2709573 - DNA, 19 bp, Homo sapiens
accccctctttgtgtactt

SEQ ID NO: 2709574 - DNA, 16 bp, Homo sapiens
acccctcccagctgac

SEQ ID NO: 2709575 - DNA, 14 bp, Homo sapiens
acccctcccccacg

SEQ ID NO: 2709576 - DNA, 17 bp, Homo sapiens
acccctggctgaacagt

SEQ ID NO: 2709577 - DNA, 22 bp, Homo sapiens
acccctggctgaacagtgctct

SEQ ID NO: 2709578 - DNA, 23 bp, Homo sapiens
acccctggctgaacagtgctctg

SEQ ID NO: 2709579 - DNA, 13 bp, Homo sapiens
acccggaaagact

SEQ ID NO: 2709580 - DNA, 22 bp, Homo sapiens
acccggattggccctgcccctc

SEQ ID NO: 2709581 - DNA, 23 bp, Homo sapiens
acccggattggccctgcccctcc

SEQ ID NO: 2709582 - DNA, 13 bp, Homo sapiens
acccgggctcagg

SEQ ID NO: 2709583 - DNA, 20 bp, Homo sapiens
accctacagacagtatgtct

SEQ ID NO: 2709584 - DNA, 20 bp, Homo sapiens
accctagctttatattttgt

SEQ ID NO: 2709585 - DNA, 14 bp, Homo sapiens
accctatcatcagt

SEQ ID NO: 2709586 - DNA, 17 bp, Homo sapiens
accctcaaaccctgtgg

SEQ ID NO: 2709587 - DNA, 18 bp, Homo sapiens
accctcaaaccctgtggg

SEQ ID NO: 2709588 - DNA, 11 bp, Homo sapiens
accctccctgc

SEQ ID NO: 2709589 - DNA, 13 bp, Homo sapiens
accctccctgctg

SEQ ID NO: 2709590 - DNA, 21 bp, Homo sapiens
accctccctgctgtcccctct

SEQ ID NO: 2709591 - DNA, 15 bp, Homo sapiens
accctccgccttcac

SEQ ID NO: 2709592 - DNA, 22 bp, Homo sapiens
accctccgccttcactccggtg

SEQ ID NO: 2709593 - DNA, 16 bp, Homo sapiens
accctcctgagcctca

SEQ ID NO: 2709594 - DNA, 14 bp, Homo sapiens
accctcctggcaca

SEQ ID NO: 2709595 - DNA, 14 bp, Homo sapiens
accctgcagagcta

SEQ ID NO: 2709596 - DNA, 22 bp, Homo sapiens
accctgcgaaggggccctggtc

SEQ ID NO: 2709597 - DNA, 16 bp, Homo sapiens
accctggccaccaccc

SEQ ID NO: 2709598 - DNA, 21 bp, Homo sapiens
accctggccaccacccaacct

SEQ ID NO: 2709599 - DNA, 16 bp, Homo sapiens
accctggctctgccag

SEQ ID NO: 2709600 - DNA, 22 bp, Homo sapiens
accctgggcaatgcagtgcagc

SEQ ID NO: 2709601 - DNA, 17 bp, Homo sapiens
accctgggtttggcccc

SEQ ID NO: 2709602 - DNA, 18 bp, Homo sapiens
accctgggtttggcccct

SEQ ID NO: 2709603 - DNA, 20 bp, Homo sapiens
accctgggtttggcccctgg

SEQ ID NO: 2709604 - DNA, 19 bp, Homo sapiens
accctgttcccaagcaaag

SEQ ID NO: 2709605 - DNA, 11 bp, Homo sapiens
acccttcctca

SEQ ID NO: 2709606 - DNA, 18 bp, Homo sapiens
acccttcctcatctgtgc

SEQ ID NO: 2709607 - DNA, 14 bp, Homo sapiens
accgcagcatgtgg

SEQ ID NO: 2709608 - DNA, 13 bp, Homo sapiens
accgcagctgctg

SEQ ID NO: 2709609 - DNA, 15 bp, Homo sapiens
accgcagctgctgcc

SEQ ID NO: 2709610 - DNA, 17 bp, Homo sapiens
accgcagctgctgccac

SEQ ID NO: 2709611 - DNA, 19 bp, Homo sapiens
accgcagctgctgccactc

SEQ ID NO: 2709612 - DNA, 14 bp, Homo sapiens
accgcatgccccct

SEQ ID NO: 2709613 - DNA, 15 bp, Homo sapiens
accgcatggcagctg

SEQ ID NO: 2709614 - DNA, 13 bp, Homo sapiens
accgcgcccagcc

SEQ ID NO: 2709615 - DNA, 17 bp, Homo sapiens
accgcgcccagccaaga

SEQ ID NO: 2709616 - DNA, 14 bp, Homo sapiens
accgggtctgcttc

SEQ ID NO: 2709617 - DNA, 13 bp, Homo sapiens
accgtttacagtg

SEQ ID NO: 2709618 - DNA, 19 bp, Homo sapiens
accgtttacagtgtattta

SEQ ID NO: 2709619 - DNA, 22 bp, Homo sapiens
agatagacgggttgaaagacat

SEQ ID NO: 2709620 - DNA, 23 bp, Homo sapiens
agatagacgggttgaaagacatc

SEQ ID NO: 2709621 - DNA, 19 bp, Homo sapiens
agatatgctaagcagtagt

SEQ ID NO: 2709622 - DNA, 16 bp, Homo sapiens
agatatttaaaagaca

SEQ ID NO: 2709623 - DNA, 22 bp, Homo sapiens
agatcaacacttttctccaggg

SEQ ID NO: 2709624 - DNA, 22 bp, Homo sapiens
agatcacgccactgcactccag

SEQ ID NO: 2709625 - DNA, 17 bp, Homo sapiens
agatcatattaatgaca

SEQ ID NO: 2709626 - DNA, 14 bp, Homo sapiens
agatccaggcttct

SEQ ID NO: 2709627 - DNA, 15 bp, Homo sapiens
agatccaggcttctc

SEQ ID NO: 2709628 - DNA, 12 bp, Homo sapiens
agatcctgggca

SEQ ID NO: 2709629 - DNA, 22 bp, Homo sapiens
agatctcagcagccagctcctg

SEQ ID NO: 2709630 - DNA, 23 bp, Homo sapiens
agatctcagcagccagctcctgg

SEQ ID NO: 2709631 - DNA, 15 bp, Homo sapiens
agatctttaaataca

SEQ ID NO: 2709632 - DNA, 19 bp, Homo sapiens
agatctttaaatacagtca

SEQ ID NO: 2709633 - DNA, 15 bp, Homo sapiens
agatctttttgtgaa

SEQ ID NO: 2709634 - DNA, 11 bp, Homo sapiens
agatgaaaacc

SEQ ID NO: 2709635 - DNA, 21 bp, Homo sapiens
agatgcccagagggcccaggc

SEQ ID NO: 2709636 - DNA, 23 bp, Homo sapiens
agatgctgaaggtgagaggaaat

SEQ ID NO: 2709637 - DNA, 15 bp, Homo sapiens
agatgctggcctctt

SEQ ID NO: 2709638 - DNA, 17 bp, Homo sapiens
agatggagaaacaggct

SEQ ID NO: 2709639 - DNA, 23 bp, Homo sapiens
agatggagaaacaggctctgaga

SEQ ID NO: 2709640 - DNA, 15 bp, Homo sapiens
agatggagtctcgct

SEQ ID NO: 2709641 - DNA, 19 bp, Homo sapiens
agatggagtctcgctctgc

SEQ ID NO: 2709642 - DNA, 20 bp, Homo sapiens
agatggagtctcgctctgct

SEQ ID NO: 2709643 - DNA, 22 bp, Homo sapiens
agatggatccacgtgctcgcct

SEQ ID NO: 2709644 - DNA, 12 bp, Homo sapiens
agatgtccctga

SEQ ID NO: 2709645 - DNA, 15 bp, Homo sapiens
agatgtccctgaagt

SEQ ID NO: 2709646 - DNA, 21 bp, Homo sapiens
agatgtccctgaagtcttgca

SEQ ID NO: 2709647 - DNA, 14 bp, Homo sapiens
agattacaataaat

SEQ ID NO: 2709648 - DNA, 18 bp, Homo sapiens
agattacaggcgcacacc

SEQ ID NO: 2709649 - DNA, 16 bp, Homo sapiens
agattatatatcataa

SEQ ID NO: 2709650 - DNA, 18 bp, Homo sapiens
agattatatatcataaag

SEQ ID NO: 2709651 - DNA, 19 bp, Homo sapiens
agattatatatcataaagt

SEQ ID NO: 2709652 - DNA, 20 bp, Homo sapiens
agattatatatcataaagta

SEQ ID NO: 2709653 - DNA, 22 bp, Homo sapiens
agattatatatcataaagtatg

SEQ ID NO: 2709654 - DNA, 17 bp, Homo sapiens
agattcctgttgtgtaa

SEQ ID NO: 2709655 - DNA, 18 bp, Homo sapiens
agattcctgttgtgtaat

SEQ ID NO: 2709656 - DNA, 13 bp, Homo sapiens
agattctttaagg

SEQ ID NO: 2709657 - DNA, 20 bp, Homo sapiens
agatttactgtcccaggagc

SEQ ID NO: 2709658 - DNA, 15 bp, Homo sapiens
agatttcacatcagc

SEQ ID NO: 2709659 - DNA, 15 bp, Homo sapiens
agattttctcctgtg

SEQ ID NO: 2709660 - DNA, 22 bp, Homo sapiens
agatttttaaaaggtaggtttt

SEQ ID NO: 2709661 - DNA, 18 bp, Homo sapiens
agatttttgctcttctgt

SEQ ID NO: 2709662 - DNA, 13 bp, Homo sapiens
agcaaagccatat

SEQ ID NO: 2709663 - DNA, 15 bp, Homo sapiens
agcaaagttttcaga

SEQ ID NO: 2709664 - DNA, 20 bp, Homo sapiens
agcaaatatataatgcaaca

SEQ ID NO: 2709665 - DNA, 11 bp, Homo sapiens
agcaaatgctg

SEQ ID NO: 2709666 - DNA, 20 bp, Homo sapiens
agcaacagagtgagaccctg

SEQ ID NO: 2709667 - DNA, 23 bp, Homo sapiens
agcaacagagtgagaccctgtct

SEQ ID NO: 2709668 - DNA, 18 bp, Homo sapiens
agcaactctccactccat

SEQ ID NO: 2709669 - DNA, 16 bp, Homo sapiens
agcaagacgtcctgga

SEQ ID NO: 2709670 - DNA, 11 bp, Homo sapiens
agcaagcaaaa

SEQ ID NO: 2709671 - DNA, 16 bp, Homo sapiens
agcaaggaggctggct

SEQ ID NO: 2709672 - DNA, 16 bp, Homo sapiens
agcaaggcacctgcag

SEQ ID NO: 2709673 - DNA, 20 bp, Homo sapiens
agcaatactgtttccatttt

SEQ ID NO: 2709674 - DNA, 15 bp, Homo sapiens
agcaatcattttata

SEQ ID NO: 2709675 - DNA, 13 bp, Homo sapiens
agcaattaattag

SEQ ID NO: 2709676 - DNA, 13 bp, Homo sapiens
agcacaatcaact

SEQ ID NO: 2709677 - DNA, 19 bp, Homo sapiens
agcacagcaaggaggctgg

SEQ ID NO: 2709678 - DNA, 22 bp, Homo sapiens
agcacagcaaggaggctggctg

SEQ ID NO: 2709679 - DNA, 24 bp, Homo sapiens
agcacagcaaggaggctggctggg

SEQ ID NO: 2709680 - DNA, 16 bp, Homo sapiens
agcacagccctcccgc

SEQ ID NO: 2709681 - DNA, 14 bp, Homo sapiens
agcacagctcctcc

SEQ ID NO: 2709682 - DNA, 16 bp, Homo sapiens
agcacagctcctcccc

SEQ ID NO: 2709683 - DNA, 18 bp, Homo sapiens
agcacatgattttctttt

SEQ ID NO: 2709684 - DNA, 20 bp, Homo sapiens
agcacatgccagggaaaaag

SEQ ID NO: 2709685 - DNA, 17 bp, Homo sapiens
agcactagatcatggga

SEQ ID NO: 2709686 - DNA, 22 bp, Homo sapiens
agcactttgggaggctgaggcg

SEQ ID NO: 2709687 - DNA, 14 bp, Homo sapiens
agcagcaattaatt

SEQ ID NO: 2709688 - DNA, 13 bp, Homo sapiens
agcagcactgggg

SEQ ID NO: 2709689 - DNA, 13 bp, Homo sapiens
agcagccagctcc

SEQ ID NO: 2709690 - DNA, 16 bp, Homo sapiens
agcagccagctcctgg

SEQ ID NO: 2709691 - DNA, 16 bp, Homo sapiens
agcagccccctgcccg

SEQ ID NO: 2709692 - DNA, 16 bp, Homo sapiens
agcagcctccagtgct

SEQ ID NO: 2709693 - DNA, 22 bp, Homo sapiens
agcagcctccagtgctggctgc

SEQ ID NO: 2709694 - DNA, 20 bp, Homo sapiens
agcagctggctctccacctt

SEQ ID NO: 2709695 - DNA, 17 bp, Homo sapiens
agcagcttcagttgttt

SEQ ID NO: 2709696 - DNA, 16 bp, Homo sapiens
agcagcttctgccact

SEQ ID NO: 2709697 - DNA, 14 bp, Homo sapiens
agcagggacacccc

SEQ ID NO: 2709698 - DNA, 23 bp, Homo sapiens
agcaggggctgctgggggctccc

SEQ ID NO: 2709699 - DNA, 17 bp, Homo sapiens
agcaggtgctgctaccc

SEQ ID NO: 2709700 - DNA, 19 bp, Homo sapiens
agcagtaaactttctctgc

SEQ ID NO: 2709701 - DNA, 14 bp, Homo sapiens
agcatcaaacatga

SEQ ID NO: 2709702 - DNA, 15 bp, Homo sapiens
agcatcaaacatgaa

SEQ ID NO: 2709703 - DNA, 19 bp, Homo sapiens
agcatcaaacatgaaaaca

SEQ ID NO: 2709704 - DNA, 15 bp, Homo sapiens
agcatcacctcaggc

SEQ ID NO: 2709705 - DNA, 14 bp, Homo sapiens
agcatcctccccac

SEQ ID NO: 2709706 - DNA, 17 bp, Homo sapiens
agcatcctccccaccag

SEQ ID NO: 2709707 - DNA, 19 bp, Homo sapiens
agcatccttttctgcagag

SEQ ID NO: 2709708 - DNA, 15 bp, Homo sapiens
agcatgccctgagct

SEQ ID NO: 2709709 - DNA, 18 bp, Homo sapiens
agcatgccctgagctctc

SEQ ID NO: 2709710 - DNA, 12 bp, Homo sapiens
agcatgtagctc

SEQ ID NO: 2709711 - DNA, 19 bp, Homo sapiens
agcatgtggggaagcaaga

SEQ ID NO: 2709712 - DNA, 12 bp, Homo sapiens
agccaacagcag

SEQ ID NO: 2709713 - DNA, 13 bp, Homo sapiens
agccaagccctcc

SEQ ID NO: 2709714 - DNA, 17 bp, Homo sapiens
agccaagccctccgcct

SEQ ID NO: 2709715 - DNA, 20 bp, Homo sapiens
agccaaggtgggctgagccc

SEQ ID NO: 2709716 - DNA, 18 bp, Homo sapiens
agccaatgaagcaaacac

SEQ ID NO: 2709717 - DNA, 16 bp, Homo sapiens
agccactgaagctggg

SEQ ID NO: 2709718 - DNA, 15 bp, Homo sapiens
agccactgcagcaca

SEQ ID NO: 2709719 - DNA, 14 bp, Homo sapiens
agccagccctggag

SEQ ID NO: 2709720 - DNA, 15 bp, Homo sapiens
agccagccctggagg

SEQ ID NO: 2709721 - DNA, 19 bp, Homo sapiens
agccagccctggaggctgg

SEQ ID NO: 2709722 - DNA, 20 bp, Homo sapiens
agccagccctggaggctgga

SEQ ID NO: 2709723 - DNA, 16 bp, Homo sapiens
agccagctctgcatta

SEQ ID NO: 2709724 - DNA, 13 bp, Homo sapiens
agccaggactcct

SEQ ID NO: 2709725 - DNA, 16 bp, Homo sapiens
agccaggactccttag

SEQ ID NO: 2709726 - DNA, 18 bp, Homo sapiens
agccatagagatatttaa

SEQ ID NO: 2709727 - DNA, 17 bp, Homo sapiens
agccatattcacacctc

SEQ ID NO: 2709728 - DNA, 19 bp, Homo sapiens
agccatattctaaattcac

SEQ ID NO: 2709729 - DNA, 18 bp, Homo sapiens
agccatgtcatgtgccac

SEQ ID NO: 2709730 - DNA, 19 bp, Homo sapiens
agccattttttgaggagag

SEQ ID NO: 2709731 - DNA, 19 bp, Homo sapiens
agcccacgtcctgtcagtg

SEQ ID NO: 2709732 - DNA, 22 bp, Homo sapiens
agcccacgtcctgtcagtgccg

SEQ ID NO: 2709733 - DNA, 11 bp, Homo sapiens
agcccagcaga

SEQ ID NO: 2709734 - DNA, 19 bp, Homo sapiens
agcccaggagtttgaggct

SEQ ID NO: 2709735 - DNA, 15 bp, Homo sapiens
agcccaggggagcag

SEQ ID NO: 2709736 - DNA, 11 bp, Homo sapiens
agccccacagc

SEQ ID NO: 2709737 - DNA, 14 bp, Homo sapiens
agccccacagccca

SEQ ID NO: 2709738 - DNA, 17 bp, Homo sapiens
agccccacagcccacgt

SEQ ID NO: 2709739 - DNA, 17 bp, Homo sapiens
agcccccaccccagcac

SEQ ID NO: 2709740 - DNA, 17 bp, Homo sapiens
agccctcggcctccaga

SEQ ID NO: 2709741 - DNA, 20 bp, Homo sapiens
agccctggaggctggatggc

SEQ ID NO: 2709742 - DNA, 12 bp, Homo sapiens
agcccttgggtt

SEQ ID NO: 2709743 - DNA, 18 bp, Homo sapiens
ataaatggttaagacaaa

SEQ ID NO: 2709744 - DNA, 16 bp, Homo sapiens
ataaattaatgagttt

SEQ ID NO: 2709745 - DNA, 16 bp, Homo sapiens
ataaattatgaaggac

SEQ ID NO: 2709746 - DNA, 13 bp, Homo sapiens
ataaattgtttga

SEQ ID NO: 2709747 - DNA, 12 bp, Homo sapiens
ataacatagttg

SEQ ID NO: 2709748 - DNA, 17 bp, Homo sapiens
ataacatagttgaaaaa

SEQ ID NO: 2709749 - DNA, 23 bp, Homo sapiens
ataacatagttgaaaaaagaagt

SEQ ID NO: 2709750 - DNA, 16 bp, Homo sapiens
ataacattttgtttat

SEQ ID NO: 2709751 - DNA, 22 bp, Homo sapiens
ataacattttgtttatgttact

SEQ ID NO: 2709752 - DNA, 20 bp, Homo sapiens
ataaccaccctagctttata

SEQ ID NO: 2709753 - DNA, 19 bp, Homo sapiens
ataactagaactgaatttt

SEQ ID NO: 2709754 - DNA, 17 bp, Homo sapiens
ataactctgattttgat

SEQ ID NO: 2709755 - DNA, 20 bp, Homo sapiens
ataagaaacatgatgtgaga

SEQ ID NO: 2709756 - DNA, 16 bp, Homo sapiens
ataagatgatgttaaa

SEQ ID NO: 2709757 - DNA, 20 bp, Homo sapiens
ataagatgatgttaaatgcc

SEQ ID NO: 2709758 - DNA, 21 bp, Homo sapiens
ataaggcttaggtgccaggct

SEQ ID NO: 2709759 - DNA, 20 bp, Homo sapiens
ataattcaccaaaagttcat

SEQ ID NO: 2709760 - DNA, 21 bp, Homo sapiens
ataatttaaagaaacactaaa

SEQ ID NO: 2709761 - DNA, 20 bp, Homo sapiens
ataatttgcaatttcaggaa

SEQ ID NO: 2709762 - DNA, 15 bp, Homo sapiens
ataattttttgcagt

SEQ ID NO: 2709763 - DNA, 22 bp, Homo sapiens
ataattttttgcagtcttttgc

SEQ ID NO: 2709764 - DNA, 19 bp, Homo sapiens
atacaaaaaaaatctttaa

SEQ ID NO: 2709765 - DNA, 22 bp, Homo sapiens
atacaaaaaaaatctttaatgg

SEQ ID NO: 2709766 - DNA, 15 bp, Homo sapiens
atacaaacaggtgct

SEQ ID NO: 2709767 - DNA, 21 bp, Homo sapiens
atacaacctatgtaattttta

SEQ ID NO: 2709768 - DNA, 13 bp, Homo sapiens
atacactttatta

SEQ ID NO: 2709769 - DNA, 17 bp, Homo sapiens
atacattttatatctgg

SEQ ID NO: 2709770 - DNA, 21 bp, Homo sapiens
atacattttatatctggattt

SEQ ID NO: 2709771 - DNA, 12 bp, Homo sapiens
atacatttttat

SEQ ID NO: 2709772 - DNA, 16 bp, Homo sapiens
ataccagaagtgaatt

SEQ ID NO: 2709773 - DNA, 15 bp, Homo sapiens
ataccccatttgatt

SEQ ID NO: 2709774 - DNA, 15 bp, Homo sapiens
atacgatcctgcagg

SEQ ID NO: 2709775 - DNA, 14 bp, Homo sapiens
atactcaagcaggt

SEQ ID NO: 2709776 - DNA, 18 bp, Homo sapiens
atactgtatctgggctga

SEQ ID NO: 2709777 - DNA, 22 bp, Homo sapiens
atactttaatttttataaatat

SEQ ID NO: 2709778 - DNA, 20 bp, Homo sapiens
atagaagctataaagaaaag

SEQ ID NO: 2709779 - DNA, 15 bp, Homo sapiens
atagacgggttgaaa

SEQ ID NO: 2709780 - DNA, 17 bp, Homo sapiens
atagacgggttgaaaga

SEQ ID NO: 2709781 - DNA, 19 bp, Homo sapiens
atagacgggttgaaagaca

SEQ ID NO: 2709782 - DNA, 18 bp, Homo sapiens
atagagatatttaaaaga

SEQ ID NO: 2709783 - DNA, 16 bp, Homo sapiens
atagaggggttttaga

SEQ ID NO: 2709784 - DNA, 14 bp, Homo sapiens
atagagtctggaat

SEQ ID NO: 2709785 - DNA, 14 bp, Homo sapiens
atagatgagaaaac

SEQ ID NO: 2709786 - DNA, 21 bp, Homo sapiens
atagatttcagctatgcagaa

SEQ ID NO: 2709787 - DNA, 16 bp, Homo sapiens
atagcacatgattttc

SEQ ID NO: 2709788 - DNA, 23 bp, Homo sapiens
atagcacatgattttcttttgtt

SEQ ID NO: 2709789 - DNA, 21 bp, Homo sapiens
atagctagctatttctatgta

SEQ ID NO: 2709790 - DNA, 22 bp, Homo sapiens
atagctctacacaacatgtatg

SEQ ID NO: 2709791 - DNA, 18 bp, Homo sapiens
ataggaagtgccccaggg

SEQ ID NO: 2709792 - DNA, 17 bp, Homo sapiens
ataggcagatctttaaa

SEQ ID NO: 2709793 - DNA, 22 bp, Homo sapiens
ataggcagatctttaaatacag

SEQ ID NO: 2709794 - DNA, 16 bp, Homo sapiens
atagtcaatcaaacag

SEQ ID NO: 2709795 - DNA, 18 bp, Homo sapiens
atagtcaatcaaacaggg

SEQ ID NO: 2709796 - DNA, 15 bp, Homo sapiens
atagtctcaaatcaa

SEQ ID NO: 2709797 - DNA, 15 bp, Homo sapiens
atagtgcttcttgta

SEQ ID NO: 2709798 - DNA, 19 bp, Homo sapiens
atagttttttacttctctt

SEQ ID NO: 2709799 - DNA, 20 bp, Homo sapiens
atataaagaaaatcaatgaa

SEQ ID NO: 2709800 - DNA, 21 bp, Homo sapiens
atataataaatatatatttat

SEQ ID NO: 2709801 - DNA, 23 bp, Homo sapiens
atataataaatatatatttatca

SEQ ID NO: 2709802 - DNA, 22 bp, Homo sapiens
atataatttaaagaaacactaa

SEQ ID NO: 2709803 - DNA, 21 bp, Homo sapiens
atatagttgtctttctttgct

SEQ ID NO: 2709804 - DNA, 14 bp, Homo sapiens
atatatgtatatgt

SEQ ID NO: 2709805 - DNA, 23 bp, Homo sapiens
atatatgtatatgtatatctata

SEQ ID NO: 2709806 - DNA, 14 bp, Homo sapiens
atatcaaaaagact

SEQ ID NO: 2709807 - DNA, 15 bp, Homo sapiens
atatctaatttacca

SEQ ID NO: 2709808 - DNA, 18 bp, Homo sapiens
atatctatatctctaaac

SEQ ID NO: 2709809 - DNA, 17 bp, Homo sapiens
atatctctaaactgctg

SEQ ID NO: 2709810 - DNA, 23 bp, Homo sapiens
atatctggccacactgggctcac

SEQ ID NO: 2709811 - DNA, 20 bp, Homo sapiens
atatgaaaaaaatgcatttt

SEQ ID NO: 2709812 - DNA, 17 bp, Homo sapiens
atatgattgcactaaat

SEQ ID NO: 2709813 - DNA, 15 bp, Homo sapiens
atatgattgtttgca

SEQ ID NO: 2709814 - DNA, 22 bp, Homo sapiens
atatggtactaaggagaattaa

SEQ ID NO: 2709815 - DNA, 13 bp, Homo sapiens
atatgtatatcta

SEQ ID NO: 2709816 - DNA, 14 bp, Homo sapiens
atatgtatatctat

SEQ ID NO: 2709817 - DNA, 14 bp, Homo sapiens
atatgtatctttgg

SEQ ID NO: 2709818 - DNA, 14 bp, Homo sapiens
atatgtgaaaatga

SEQ ID NO: 2709819 - DNA, 16 bp, Homo sapiens
atattaagaaacaatt

SEQ ID NO: 2709820 - DNA, 18 bp, Homo sapiens
atattaattattttccaa

SEQ ID NO: 2709821 - DNA, 15 bp, Homo sapiens
atattcagagaaaac

SEQ ID NO: 2709822 - DNA, 14 bp, Homo sapiens
atattctaaattca

SEQ ID NO: 2709823 - DNA, 14 bp, Homo sapiens
atattctctgatgt

SEQ ID NO: 2709824 - DNA, 17 bp, Homo sapiens
atattctgataatgtat

SEQ ID NO: 2709825 - DNA, 20 bp, Homo sapiens
atattctgataatgtattgc

SEQ ID NO: 2709826 - DNA, 24 bp, Homo sapiens
atattctgataatgtattgcagtg

SEQ ID NO: 2709827 - DNA, 12 bp, Homo sapiens
atattgctctta

SEQ ID NO: 2709828 - DNA, 18 bp, Homo sapiens
atattgctcttaaaaatc

SEQ ID NO: 2709829 - DNA, 12 bp, Homo sapiens
atattgctttat

SEQ ID NO: 2709830 - DNA, 20 bp, Homo sapiens
atattggtttgttattcttt

SEQ ID NO: 2709831 - DNA, 20 bp, Homo sapiens
atatttaataggataaatta

SEQ ID NO: 2709832 - DNA, 14 bp, Homo sapiens
atatttatttatgt

SEQ ID NO: 2709833 - DNA, 12 bp, Homo sapiens
atattttcacag

SEQ ID NO: 2709834 - DNA, 17 bp, Homo sapiens
atatttttaaattttgt

SEQ ID NO: 2709835 - DNA, 17 bp, Homo sapiens
atcaaacatgaaaacat

SEQ ID NO: 2709836 - DNA, 20 bp, Homo sapiens
atcaacagtgaacagcttca

SEQ ID NO: 2709837 - DNA, 12 bp, Homo sapiens
atcaagagtctc

SEQ ID NO: 2709838 - DNA, 16 bp, Homo sapiens
atcaagagtctctcca

SEQ ID NO: 2709839 - DNA, 16 bp, Homo sapiens
atcaatccttgttcag

SEQ ID NO: 2709840 - DNA, 14 bp, Homo sapiens
atcaattttttaaa

SEQ ID NO: 2709841 - DNA, 15 bp, Homo sapiens
atcacaaacatatgt

SEQ ID NO: 2709842 - DNA, 21 bp, Homo sapiens
atcaccgtcattgatggagcc

SEQ ID NO: 2709843 - DNA, 15 bp, Homo sapiens
atcacctcaggccag

SEQ ID NO: 2709844 - DNA, 18 bp, Homo sapiens
atcacgatccagtctgca

SEQ ID NO: 2709845 - DNA, 23 bp, Homo sapiens
atcacgccactgcactccagcct

SEQ ID NO: 2709846 - DNA, 17 bp, Homo sapiens
atcagaagtaactccca

SEQ ID NO: 2709847 - DNA, 21 bp, Homo sapiens
atcagaagtaactcccactcc

SEQ ID NO: 2709848 - DNA, 21 bp, Homo sapiens
atcagagctggcagcctccag

SEQ ID NO: 2709849 - DNA, 15 bp, Homo sapiens
atcagattttctcct

SEQ ID NO: 2709850 - DNA, 17 bp, Homo sapiens
atcagattttctcctgt

SEQ ID NO: 2709851 - DNA, 15 bp, Homo sapiens
atcagctttttgtat

SEQ ID NO: 2709852 - DNA, 23 bp, Homo sapiens
atcagctttttgtattaacaaag

SEQ ID NO: 2709853 - DNA, 21 bp, Homo sapiens
atcagtcttaatattcagaga

SEQ ID NO: 2709854 - DNA, 21 bp, Homo sapiens
atcagttatatcttgtggcat

SEQ ID NO: 2709855 - DNA, 11 bp, Homo sapiens
atcataaagta

SEQ ID NO: 2709856 - DNA, 15 bp, Homo sapiens
atcatattaattatt

SEQ ID NO: 2709857 - DNA, 16 bp, Homo sapiens
atcatatttaatagga

SEQ ID NO: 2709858 - DNA, 17 bp, Homo sapiens
atcatctttatctcctg

SEQ ID NO: 2709859 - DNA, 13 bp, Homo sapiens
atcatctttgctg

SEQ ID NO: 2709860 - DNA, 17 bp, Homo sapiens
atcattatcttcatgtt

SEQ ID NO: 2709861 - DNA, 16 bp, Homo sapiens
atcattatgtaatgtc

SEQ ID NO: 2709862 - DNA, 15 bp, Homo sapiens
atcattcataatttt

SEQ ID NO: 2709863 - DNA, 18 bp, Homo sapiens
atcattttatataaagaa

SEQ ID NO: 2709864 - DNA, 17 bp, Homo sapiens
atccaaatgcattcatg

SEQ ID NO: 2709865 - DNA, 20 bp, Homo sapiens
atccaaatgcattcatgttt

SEQ ID NO: 2709866 - DNA, 20 bp, Homo sapiens
atccaaatgctgtgcaaaca

SEQ ID NO: 2709867 - DNA, 19 bp, Homo sapiens
atttgtcggggaagatgaa

SEQ ID NO: 2709868 - DNA, 18 bp, Homo sapiens
atttgttgtcatgtgtat

SEQ ID NO: 2709869 - DNA, 18 bp, Homo sapiens
attttaattatcttttct

SEQ ID NO: 2709870 - DNA, 14 bp, Homo sapiens
attttacagtctct

SEQ ID NO: 2709871 - DNA, 16 bp, Homo sapiens
attttacagtctctgt

SEQ ID NO: 2709872 - DNA, 20 bp, Homo sapiens
attttacagtctctgttgta

SEQ ID NO: 2709873 - DNA, 23 bp, Homo sapiens
attttacatgaagctgtataatt

SEQ ID NO: 2709874 - DNA, 12 bp, Homo sapiens
attttaccaaag

SEQ ID NO: 2709875 - DNA, 18 bp, Homo sapiens
attttaccaaagcatcaa

SEQ ID NO: 2709876 - DNA, 20 bp, Homo sapiens
attttacttccatgatactt

SEQ ID NO: 2709877 - DNA, 19 bp, Homo sapiens
attttagaaaatcagattt

SEQ ID NO: 2709878 - DNA, 14 bp, Homo sapiens
attttatataaaga

SEQ ID NO: 2709879 - DNA, 16 bp, Homo sapiens
attttatataaagaaa

SEQ ID NO: 2709880 - DNA, 22 bp, Homo sapiens
attttatctacccagtcatgta

SEQ ID NO: 2709881 - DNA, 14 bp, Homo sapiens
attttattttatag

SEQ ID NO: 2709882 - DNA, 16 bp, Homo sapiens
attttcagcatcaaac

SEQ ID NO: 2709883 - DNA, 19 bp, Homo sapiens
attttcagcatcaaacatg

SEQ ID NO: 2709884 - DNA, 21 bp, Homo sapiens
attttcagcatcaaacatgaa

SEQ ID NO: 2709885 - DNA, 22 bp, Homo sapiens
attttcagcatcaaacatgaaa

SEQ ID NO: 2709886 - DNA, 13 bp, Homo sapiens
attttcatgactt

SEQ ID NO: 2709887 - DNA, 16 bp, Homo sapiens
attttcatttctaaca

SEQ ID NO: 2709888 - DNA, 18 bp, Homo sapiens
attttcatttctaacata

SEQ ID NO: 2709889 - DNA, 15 bp, Homo sapiens
attttctcctgtggg

SEQ ID NO: 2709890 - DNA, 18 bp, Homo sapiens
attttctgagtagcatat

SEQ ID NO: 2709891 - DNA, 20 bp, Homo sapiens
attttctgcccaactttcat

SEQ ID NO: 2709892 - DNA, 16 bp, Homo sapiens
attttctgtaaatgaa

SEQ ID NO: 2709893 - DNA, 19 bp, Homo sapiens
attttcttgtcaatggaag

SEQ ID NO: 2709894 - DNA, 21 bp, Homo sapiens
attttctttcatacattatat

SEQ ID NO: 2709895 - DNA, 21 bp, Homo sapiens
attttcttttgttttcttcat

SEQ ID NO: 2709896 - DNA, 22 bp, Homo sapiens
attttgaaaacccctggctgaa

SEQ ID NO: 2709897 - DNA, 12 bp, Homo sapiens
attttgaatgtg

SEQ ID NO: 2709898 - DNA, 15 bp, Homo sapiens
attttgaatgtgatc

SEQ ID NO: 2709899 - DNA, 17 bp, Homo sapiens
attttgatattttcaca

SEQ ID NO: 2709900 - DNA, 19 bp, Homo sapiens
attttgatattttcacaga

SEQ ID NO: 2709901 - DNA, 13 bp, Homo sapiens
attttggaaaaat

SEQ ID NO: 2709902 - DNA, 16 bp, Homo sapiens
attttggaaaaatgtc

SEQ ID NO: 2709903 - DNA, 21 bp, Homo sapiens
attttggaaaaatgtcactga

SEQ ID NO: 2709904 - DNA, 18 bp, Homo sapiens
attttggacgtgtgagga

SEQ ID NO: 2709905 - DNA, 17 bp, Homo sapiens
attttgtaaaaagaaat

SEQ ID NO: 2709906 - DNA, 18 bp, Homo sapiens
attttgtatatttgtatt

SEQ ID NO: 2709907 - DNA, 21 bp, Homo sapiens
attttgtcccttccatttcta

SEQ ID NO: 2709908 - DNA, 20 bp, Homo sapiens
atttttaaaaggtaggtttt

SEQ ID NO: 2709909 - DNA, 14 bp, Homo sapiens
atttttaaagcaaa

SEQ ID NO: 2709910 - DNA, 15 bp, Homo sapiens
atttttaaagcaaat

SEQ ID NO: 2709911 - DNA, 16 bp, Homo sapiens
atttttaaagcaaata

SEQ ID NO: 2709912 - DNA, 19 bp, Homo sapiens
atttttaaaggacaaacag

SEQ ID NO: 2709913 - DNA, 23 bp, Homo sapiens
atttttaaaggacaaacagtgaa

SEQ ID NO: 2709914 - DNA, 15 bp, Homo sapiens
atttttaatttatga

SEQ ID NO: 2709915 - DNA, 16 bp, Homo sapiens
atttttagtaaagaca

SEQ ID NO: 2709916 - DNA, 21 bp, Homo sapiens
atttttataaatatgtgaaaa

SEQ ID NO: 2709917 - DNA, 15 bp, Homo sapiens
atttttgaatgtgat

SEQ ID NO: 2709918 - DNA, 13 bp, Homo sapiens
atttttgtacatt

SEQ ID NO: 2709919 - DNA, 17 bp, Homo sapiens
atttttgtacattatgt

SEQ ID NO: 2709920 - DNA, 18 bp, Homo sapiens
atttttgtacattatgtt

SEQ ID NO: 2709921 - DNA, 16 bp, Homo sapiens
atttttgtaccatatt

SEQ ID NO: 2709922 - DNA, 12 bp, Homo sapiens
atttttgtgtat

SEQ ID NO: 2709923 - DNA, 16 bp, Homo sapiens
atttttgttagcaaag

SEQ ID NO: 2709924 - DNA, 16 bp, Homo sapiens
attttttatttccaca

SEQ ID NO: 2709925 - DNA, 14 bp, Homo sapiens
attttttgcagtct

SEQ ID NO: 2709926 - DNA, 13 bp, Homo sapiens
atttttttaagct

SEQ ID NO: 2709927 - DNA, 18 bp, Homo sapiens
atttttttaagctgtaaa

SEQ ID NO: 2709928 - DNA, 16 bp, Homo sapiens
atttttttccagaatt

SEQ ID NO: 2709929 - DNA, 18 bp, Homo sapiens
atttttttccagaattga

SEQ ID NO: 2709930 - DNA, 16 bp, Homo sapiens
atttttttttgtaaag

SEQ ID NO: 2709931 - DNA, 13 bp, Homo sapiens
caaaaaaaatctt

SEQ ID NO: 2709932 - DNA, 16 bp, Homo sapiens
caaaaaaataataaaa

SEQ ID NO: 2709933 - DNA, 22 bp, Homo sapiens
caaaaattgcgagcctttaccc

SEQ ID NO: 2709934 - DNA, 11 bp, Homo sapiens
caaaacaatgc

SEQ ID NO: 2709935 - DNA, 21 bp, Homo sapiens
caaaagaaaaaaaaaagcacc

SEQ ID NO: 2709936 - DNA, 21 bp, Homo sapiens
caaaagcaaaccctacattaa

SEQ ID NO: 2709937 - DNA, 15 bp, Homo sapiens
caaaagcagctttta

SEQ ID NO: 2709938 - DNA, 14 bp, Homo sapiens
caaaagctgtgtct

SEQ ID NO: 2709939 - DNA, 22 bp, Homo sapiens
caaaagttcatataatttaaag

SEQ ID NO: 2709940 - DNA, 13 bp, Homo sapiens
caaacaggtgcta

SEQ ID NO: 2709941 - DNA, 22 bp, Homo sapiens
caaacagtgaatttaagcatga

SEQ ID NO: 2709942 - DNA, 21 bp, Homo sapiens
caaacagtgggagggaattcc

SEQ ID NO: 2709943 - DNA, 16 bp, Homo sapiens
caaactacatgtaatc

SEQ ID NO: 2709944 - DNA, 14 bp, Homo sapiens
caaactatgtaatg

SEQ ID NO: 2709945 - DNA, 16 bp, Homo sapiens
caaactctgccagcca

SEQ ID NO: 2709946 - DNA, 15 bp, Homo sapiens
caaactttaacaggt

SEQ ID NO: 2709947 - DNA, 15 bp, Homo sapiens
caaagaactgcccca

SEQ ID NO: 2709948 - DNA, 20 bp, Homo sapiens
caaagaactgccccatctcc

SEQ ID NO: 2709949 - DNA, 22 bp, Homo sapiens
caaagaactgccccatctcctc

SEQ ID NO: 2709950 - DNA, 16 bp, Homo sapiens
caaagagtctctggct

SEQ ID NO: 2709951 - DNA, 20 bp, Homo sapiens
caaagagtctctggctcagc

SEQ ID NO: 2709952 - DNA, 23 bp, Homo sapiens
caaagagtctctggctcagctgt

SEQ ID NO: 2709953 - DNA, 14 bp, Homo sapiens
caaagatctcagca

SEQ ID NO: 2709954 - DNA, 19 bp, Homo sapiens
caaagatctcagcagccag

SEQ ID NO: 2709955 - DNA, 16 bp, Homo sapiens
caaagattaaatgtgt

SEQ ID NO: 2709956 - DNA, 18 bp, Homo sapiens
caaagccaaactctgcca

SEQ ID NO: 2709957 - DNA, 14 bp, Homo sapiens
caaagccacatttt

SEQ ID NO: 2709958 - DNA, 23 bp, Homo sapiens
caaagctctattaagatttccaa

SEQ ID NO: 2709959 - DNA, 13 bp, Homo sapiens
caaagtctaaagt

SEQ ID NO: 2709960 - DNA, 19 bp, Homo sapiens
caaagtgctaggattacag

SEQ ID NO: 2709961 - DNA, 16 bp, Homo sapiens
caaagttactggctct

SEQ ID NO: 2709962 - DNA, 14 bp, Homo sapiens
caaagttatattta

SEQ ID NO: 2709963 - DNA, 21 bp, Homo sapiens
caaagttccagttttgttttg

SEQ ID NO: 2709964 - DNA, 14 bp, Homo sapiens
caaataaaccttgt

SEQ ID NO: 2709965 - DNA, 16 bp, Homo sapiens
caaatagggcaaagaa

SEQ ID NO: 2709966 - DNA, 15 bp, Homo sapiens
caaatcacaaacata

SEQ ID NO: 2709967 - DNA, 21 bp, Homo sapiens
caaatggaactccccagggcc

SEQ ID NO: 2709968 - DNA, 22 bp, Homo sapiens
caaatggaactccccagggcct

SEQ ID NO: 2709969 - DNA, 14 bp, Homo sapiens
caaatgtgtcccag

SEQ ID NO: 2709970 - DNA, 13 bp, Homo sapiens
caaattaatcttt

SEQ ID NO: 2709971 - DNA, 13 bp, Homo sapiens
caaattcaaagaa

SEQ ID NO: 2709972 - DNA, 19 bp, Homo sapiens
caacaaagacttgctttaa

SEQ ID NO: 2709973 - DNA, 16 bp, Homo sapiens
caacaagaaggtttct

SEQ ID NO: 2709974 - DNA, 14 bp, Homo sapiens
caacaataaagagc

SEQ ID NO: 2709975 - DNA, 17 bp, Homo sapiens
caacaataaagagctca

SEQ ID NO: 2709976 - DNA, 23 bp, Homo sapiens
caacagagtgagaccctgtctct

SEQ ID NO: 2709977 - DNA, 15 bp, Homo sapiens
caacaggagagacag

SEQ ID NO: 2709978 - DNA, 23 bp, Homo sapiens
caacaggcccttggtagagctgg

SEQ ID NO: 2709979 - DNA, 20 bp, Homo sapiens
caacagtgttaggcctggca

SEQ ID NO: 2709980 - DNA, 20 bp, Homo sapiens
caacatggattccaaagcat

SEQ ID NO: 2709981 - DNA, 19 bp, Homo sapiens
caacatgtatgtggataca

SEQ ID NO: 2709982 - DNA, 15 bp, Homo sapiens
caacatttattattt

SEQ ID NO: 2709983 - DNA, 17 bp, Homo sapiens
caacatttttgtacatt

SEQ ID NO: 2709984 - DNA, 11 bp, Homo sapiens
caacccagccg

SEQ ID NO: 2709985 - DNA, 14 bp, Homo sapiens
caaccccagctggc

SEQ ID NO: 2709986 - DNA, 17 bp, Homo sapiens
caaccccagctggcctc

SEQ ID NO: 2709987 - DNA, 18 bp, Homo sapiens
caaccccagctggcctct

SEQ ID NO: 2709988 - DNA, 15 bp, Homo sapiens
caacccccagcaccc

SEQ ID NO: 2709989 - DNA, 13 bp, Homo sapiens
caaccctcagctg

SEQ ID NO: 2709990 - DNA, 14 bp, Homo sapiens
caacctgcccctcc

SEQ ID NO: 2709991 - DNA, 24 bp, Homo sapiens
caggaagggagggagctgaggcct

SEQ ID NO: 2709992 - DNA, 13 bp, Homo sapiens
caggaatttaatt

SEQ ID NO: 2709993 - DNA, 18 bp, Homo sapiens
caggacatgtgctctcgg

SEQ ID NO: 2709994 - DNA, 19 bp, Homo sapiens
caggacggggccggccagg

SEQ ID NO: 2709995 - DNA, 20 bp, Homo sapiens
caggacggggccggccaggt

SEQ ID NO: 2709996 - DNA, 14 bp, Homo sapiens
caggactctgcaga

SEQ ID NO: 2709997 - DNA, 19 bp, Homo sapiens
caggactggggcttgccag

SEQ ID NO: 2709998 - DNA, 21 bp, Homo sapiens
caggactggggcttgccaggc

SEQ ID NO: 2709999 - DNA, 15 bp, Homo sapiens
caggagagacaggat

SEQ ID NO: 2710000 - DNA, 19 bp, Homo sapiens
caggagagccctctgctgc

SEQ ID NO: 2710001 - DNA, 21 bp, Homo sapiens
caggagagcttcccccaaggc

SEQ ID NO: 2710002 - DNA, 20 bp, Homo sapiens
caggagcaaccgtgcagcca

SEQ ID NO: 2710003 - DNA, 18 bp, Homo sapiens
caggagctgacagagcca

SEQ ID NO: 2710004 - DNA, 20 bp, Homo sapiens
caggaggctccgtgagccct

SEQ ID NO: 2710005 - DNA, 14 bp, Homo sapiens
caggaggctgaggc

SEQ ID NO: 2710006 - DNA, 15 bp, Homo sapiens
caggaggctgagggg

SEQ ID NO: 2710007 - DNA, 23 bp, Homo sapiens
caggaggggaagaggcctttcta

SEQ ID NO: 2710008 - DNA, 20 bp, Homo sapiens
caggaggtggaggttgcagt

SEQ ID NO: 2710009 - DNA, 23 bp, Homo sapiens
caggaggtggaggttgcagtgaa

SEQ ID NO: 2710010 - DNA, 17 bp, Homo sapiens
caggagtcaccatgcaa

SEQ ID NO: 2710011 - DNA, 20 bp, Homo sapiens
caggagtttgaggctgcagc

SEQ ID NO: 2710012 - DNA, 17 bp, Homo sapiens
caggatatccccaggga

SEQ ID NO: 2710013 - DNA, 12 bp, Homo sapiens
caggattcccag

SEQ ID NO: 2710014 - DNA, 13 bp, Homo sapiens
caggattcccaga

SEQ ID NO: 2710015 - DNA, 15 bp, Homo sapiens
caggattcccagaga

SEQ ID NO: 2710016 - DNA, 14 bp, Homo sapiens
caggcacagcacag

SEQ ID NO: 2710017 - DNA, 16 bp, Homo sapiens
caggcacagcacaggg

SEQ ID NO: 2710018 - DNA, 21 bp, Homo sapiens
caggcagatttactgtcccag

SEQ ID NO: 2710019 - DNA, 19 bp, Homo sapiens
caggcagcgcctgtcccct

SEQ ID NO: 2710020 - DNA, 14 bp, Homo sapiens
caggcagctccagc

SEQ ID NO: 2710021 - DNA, 16 bp, Homo sapiens
caggcagctccagctg

SEQ ID NO: 2710022 - DNA, 23 bp, Homo sapiens
caggccaagagcagaggcagcga

SEQ ID NO: 2710023 - DNA, 23 bp, Homo sapiens
caggccaccatattcagtgctgt

SEQ ID NO: 2710024 - DNA, 13 bp, Homo sapiens
caggccatcttcc

SEQ ID NO: 2710025 - DNA, 15 bp, Homo sapiens
caggcccccaccact

SEQ ID NO: 2710026 - DNA, 17 bp, Homo sapiens
caggcccggtgaggcca

SEQ ID NO: 2710027 - DNA, 15 bp, Homo sapiens
caggccctgcactgt

SEQ ID NO: 2710028 - DNA, 20 bp, Homo sapiens
caggccctgcactgtcctgc

SEQ ID NO: 2710029 - DNA, 22 bp, Homo sapiens
caggccctgcactgtcctgctc

SEQ ID NO: 2710030 - DNA, 21 bp, Homo sapiens
caggcccttggtagagctggt

SEQ ID NO: 2710031 - DNA, 14 bp, Homo sapiens
caggctagagtgca

SEQ ID NO: 2710032 - DNA, 22 bp, Homo sapiens
caggctcctcatgaggccatgc

SEQ ID NO: 2710033 - DNA, 23 bp, Homo sapiens
caggctcctcatgaggccatgca

SEQ ID NO: 2710034 - DNA, 13 bp, Homo sapiens
caggctctgagat

SEQ ID NO: 2710035 - DNA, 11 bp, Homo sapiens
caggctgctgc

SEQ ID NO: 2710036 - DNA, 16 bp, Homo sapiens
caggctgctgcatggc

SEQ ID NO: 2710037 - DNA, 14 bp, Homo sapiens
caggctggccagcc

SEQ ID NO: 2710038 - DNA, 15 bp, Homo sapiens
caggctggccagccc

SEQ ID NO: 2710039 - DNA, 21 bp, Homo sapiens
caggctggccagccccacagc

SEQ ID NO: 2710040 - DNA, 22 bp, Homo sapiens
caggctggtctcgaactcctga

SEQ ID NO: 2710041 - DNA, 23 bp, Homo sapiens
caggctggtctcgaactcctgac

SEQ ID NO: 2710042 - DNA, 14 bp, Homo sapiens
caggcttccttggc

SEQ ID NO: 2710043 - DNA, 12 bp, Homo sapiens
caggcttctccc

SEQ ID NO: 2710044 - DNA, 19 bp, Homo sapiens
cagggaaaaagaccaaatt

SEQ ID NO: 2710045 - DNA, 14 bp, Homo sapiens
cagggaagccctcg

SEQ ID NO: 2710046 - DNA, 14 bp, Homo sapiens
cagggacagaagca

SEQ ID NO: 2710047 - DNA, 17 bp, Homo sapiens
cagggacagaagcagga

SEQ ID NO: 2710048 - DNA, 13 bp, Homo sapiens
cagggaccacagc

SEQ ID NO: 2710049 - DNA, 18 bp, Homo sapiens
cagggaccactgggtgag

SEQ ID NO: 2710050 - DNA, 22 bp, Homo sapiens
cagggaccactgggtgagagag

SEQ ID NO: 2710051 - DNA, 17 bp, Homo sapiens
cagggagcaactctcca

SEQ ID NO: 2710052 - DNA, 20 bp, Homo sapiens
cagggagcaactctccactc

SEQ ID NO: 2710053 - DNA, 15 bp, Homo sapiens
cagggcagagccggg

SEQ ID NO: 2710054 - DNA, 18 bp, Homo sapiens
cagggccagcaggcagcg

SEQ ID NO: 2710055 - DNA, 14 bp, Homo sapiens
cagggccctgcaga

SEQ ID NO: 2710056 - DNA, 14 bp, Homo sapiens
cagggcctccagga

SEQ ID NO: 2710057 - DNA, 23 bp, Homo sapiens
cagggcctggccttgtccccagc

SEQ ID NO: 2710058 - DNA, 22 bp, Homo sapiens
cagggcctggggagatggagga

SEQ ID NO: 2710059 - DNA, 14 bp, Homo sapiens
cagggctccctcct

SEQ ID NO: 2710060 - DNA, 23 bp, Homo sapiens
cagggctccctcctggagcatcc

SEQ ID NO: 2710061 - DNA, 18 bp, Homo sapiens
cagggcttgtggactctc

SEQ ID NO: 2710062 - DNA, 19 bp, Homo sapiens
cagggcttgtggactctct

SEQ ID NO: 2710063 - DNA, 15 bp, Homo sapiens
caggggaagctgcta

SEQ ID NO: 2710064 - DNA, 22 bp, Homo sapiens
caggggacctggagctgccagc

SEQ ID NO: 2710065 - DNA, 11 bp, Homo sapiens
caggggactgg

SEQ ID NO: 2710066 - DNA, 16 bp, Homo sapiens
caggggactgggccat

SEQ ID NO: 2710067 - DNA, 14 bp, Homo sapiens
caggggagggaaaa

SEQ ID NO: 2710068 - DNA, 20 bp, Homo sapiens
caggggcaaagaactgcccc

SEQ ID NO: 2710069 - DNA, 13 bp, Homo sapiens
caggggcaggcac

SEQ ID NO: 2710070 - DNA, 15 bp, Homo sapiens
caggggcaggcacag

SEQ ID NO: 2710071 - DNA, 14 bp, Homo sapiens
caggggctgcccgc

SEQ ID NO: 2710072 - DNA, 16 bp, Homo sapiens
caggggctgcccgctc

SEQ ID NO: 2710073 - DNA, 14 bp, Homo sapiens
caggggggaggcac

SEQ ID NO: 2710074 - DNA, 19 bp, Homo sapiens
caggggtaccaggcacatg

SEQ ID NO: 2710075 - DNA, 20 bp, Homo sapiens
caggggtaccaggcacatgg

SEQ ID NO: 2710076 - DNA, 17 bp, Homo sapiens
cagggtcagtgtatcta

SEQ ID NO: 2710077 - DNA, 13 bp, Homo sapiens
caggtgcagtggc

SEQ ID NO: 2710078 - DNA, 19 bp, Homo sapiens
caggtgctgctaccctccc

SEQ ID NO: 2710079 - DNA, 20 bp, Homo sapiens
caggtgctgctaccctccct

SEQ ID NO: 2710080 - DNA, 22 bp, Homo sapiens
caggtgctgctaccctccctgc

SEQ ID NO: 2710081 - DNA, 23 bp, Homo sapiens
caggtgctgctaccctccctgct

SEQ ID NO: 2710082 - DNA, 21 bp, Homo sapiens
caggtgggcgggcagcacagc

SEQ ID NO: 2710083 - DNA, 14 bp, Homo sapiens
caggttggaaaaga

SEQ ID NO: 2710084 - DNA, 17 bp, Homo sapiens
caggttgggccatactg

SEQ ID NO: 2710085 - DNA, 20 bp, Homo sapiens
caggttttcttctaatcata

SEQ ID NO: 2710086 - DNA, 24 bp, Homo sapiens
caggttttcttctaatcataacat

SEQ ID NO: 2710087 - DNA, 14 bp, Homo sapiens
cagtaaataaattg

SEQ ID NO: 2710088 - DNA, 16 bp, Homo sapiens
cagtaaataaattgtt

SEQ ID NO: 2710089 - DNA, 22 bp, Homo sapiens
cagtacagagaaattctgtggt

SEQ ID NO: 2710090 - DNA, 12 bp, Homo sapiens
cagtactgggaa

SEQ ID NO: 2710091 - DNA, 18 bp, Homo sapiens
cagtagtcacctctgggc

SEQ ID NO: 2710092 - DNA, 23 bp, Homo sapiens
cagtatcctgctggttcactcta

SEQ ID NO: 2710093 - DNA, 20 bp, Homo sapiens
cagtcaagttccctcctgca

SEQ ID NO: 2710094 - DNA, 21 bp, Homo sapiens
cagtcattatttaaagcacat

SEQ ID NO: 2710095 - DNA, 23 bp, Homo sapiens
cagtcctagagctcctgtcccta

SEQ ID NO: 2710096 - DNA, 22 bp, Homo sapiens
cagtcctctccacctagtggct

SEQ ID NO: 2710097 - DNA, 13 bp, Homo sapiens
cagtcctgctggc

SEQ ID NO: 2710098 - DNA, 14 bp, Homo sapiens
cagtcctgctggcc

SEQ ID NO: 2710099 - DNA, 17 bp, Homo sapiens
cagtcctgctggcctgc

SEQ ID NO: 2710100 - DNA, 20 bp, Homo sapiens
cagtcctgctggcctgctct

SEQ ID NO: 2710101 - DNA, 21 bp, Homo sapiens
cagtcctgctggcctgctctt

SEQ ID NO: 2710102 - DNA, 14 bp, Homo sapiens
cagtcgcgctgcct

SEQ ID NO: 2710103 - DNA, 17 bp, Homo sapiens
cagtctctgttgtaaat

SEQ ID NO: 2710104 - DNA, 21 bp, Homo sapiens
cagtctgttccccatggccac

SEQ ID NO: 2710105 - DNA, 13 bp, Homo sapiens
cagtgaacagctt

SEQ ID NO: 2710106 - DNA, 15 bp, Homo sapiens
cagtgaatttaagca

SEQ ID NO: 2710107 - DNA, 18 bp, Homo sapiens
cagtgacgtgactcagag

SEQ ID NO: 2710108 - DNA, 18 bp, Homo sapiens
cagtgactcgggctcctg

SEQ ID NO: 2710109 - DNA, 21 bp, Homo sapiens
cagtgagaagggcctgctctg

SEQ ID NO: 2710110 - DNA, 12 bp, Homo sapiens
cagtgagcctct

SEQ ID NO: 2710111 - DNA, 23 bp, Homo sapiens
cagtgatatggtactaaggagaa

SEQ ID NO: 2710112 - DNA, 20 bp, Homo sapiens
cagtgccgccgcctcgccca

SEQ ID NO: 2710113 - DNA, 23 bp, Homo sapiens
cagtgccgccgcctcgcccaccg

SEQ ID NO: 2710114 - DNA, 20 bp, Homo sapiens
ccagatgctgggcaggaaac

SEQ ID NO: 2710115 - DNA, 16 bp, Homo sapiens
ccagatgtgggctcag

SEQ ID NO: 2710116 - DNA, 18 bp, Homo sapiens
ccagcaaagttttcagat

SEQ ID NO: 2710117 - DNA, 23 bp, Homo sapiens
ccagcacccgggctcagggacca

SEQ ID NO: 2710118 - DNA, 17 bp, Homo sapiens
ccagcacgttttctggc

SEQ ID NO: 2710119 - DNA, 19 bp, Homo sapiens
ccagcacgttttctggctt

SEQ ID NO: 2710120 - DNA, 21 bp, Homo sapiens
ccagcatccttttctgcagag

SEQ ID NO: 2710121 - DNA, 14 bp, Homo sapiens
ccagccactgcagc

SEQ ID NO: 2710122 - DNA, 14 bp, Homo sapiens
ccagccccacagcc

SEQ ID NO: 2710123 - DNA, 19 bp, Homo sapiens
ccagccccacagcccacgt

SEQ ID NO: 2710124 - DNA, 22 bp, Homo sapiens
ccagccccacagcccacgtcct

SEQ ID NO: 2710125 - DNA, 13 bp, Homo sapiens
ccagccctggagg

SEQ ID NO: 2710126 - DNA, 22 bp, Homo sapiens
ccagccgagcgagaaccaggct

SEQ ID NO: 2710127 - DNA, 17 bp, Homo sapiens
ccagcctcacagatgct

SEQ ID NO: 2710128 - DNA, 19 bp, Homo sapiens
ccagcctcacagatgctgg

SEQ ID NO: 2710129 - DNA, 20 bp, Homo sapiens
ccagcctcacagatgctggc

SEQ ID NO: 2710130 - DNA, 22 bp, Homo sapiens
ccagcctcacagatgctggcct

SEQ ID NO: 2710131 - DNA, 13 bp, Homo sapiens
ccagcctggccca

SEQ ID NO: 2710132 - DNA, 17 bp, Homo sapiens
ccagcctggcccagctc

SEQ ID NO: 2710133 - DNA, 13 bp, Homo sapiens
ccagcctggcttc

SEQ ID NO: 2710134 - DNA, 20 bp, Homo sapiens
ccagcctggcttctggagcc

SEQ ID NO: 2710135 - DNA, 21 bp, Homo sapiens
ccagcctggcttctggagccc

SEQ ID NO: 2710136 - DNA, 16 bp, Homo sapiens
ccagcctgggcgacag

SEQ ID NO: 2710137 - DNA, 19 bp, Homo sapiens
ccagcctgggcgacagagc

SEQ ID NO: 2710138 - DNA, 18 bp, Homo sapiens
ccagcctgtcctggtaca

SEQ ID NO: 2710139 - DNA, 16 bp, Homo sapiens
ccagctaattggtcca

SEQ ID NO: 2710140 - DNA, 14 bp, Homo sapiens
ccagctactcagaa

SEQ ID NO: 2710141 - DNA, 23 bp, Homo sapiens
ccagctactcagaagcctgaggc

SEQ ID NO: 2710142 - DNA, 15 bp, Homo sapiens
ccagctagggctgga

SEQ ID NO: 2710143 - DNA, 21 bp, Homo sapiens
ccagctattcaggaggctgag

SEQ ID NO: 2710144 - DNA, 15 bp, Homo sapiens
ccagctcccccggga

SEQ ID NO: 2710145 - DNA, 17 bp, Homo sapiens
ccagctcccccgggagg

SEQ ID NO: 2710146 - DNA, 15 bp, Homo sapiens
ccagctctacgagag

SEQ ID NO: 2710147 - DNA, 12 bp, Homo sapiens
ccagctctggct

SEQ ID NO: 2710148 - DNA, 13 bp, Homo sapiens
ccagctctgtcac

SEQ ID NO: 2710149 - DNA, 21 bp, Homo sapiens
ccagctctgtcaccctggcca

SEQ ID NO: 2710150 - DNA, 21 bp, Homo sapiens
ccagctgacagtcctctccac

SEQ ID NO: 2710151 - DNA, 20 bp, Homo sapiens
ccagctgcacctgccagcct

SEQ ID NO: 2710152 - DNA, 16 bp, Homo sapiens
ccagcttcctctgagc

SEQ ID NO: 2710153 - DNA, 18 bp, Homo sapiens
ccagcttcctctgagccg

SEQ ID NO: 2710154 - DNA, 20 bp, Homo sapiens
ccaggaagggagggagctga

SEQ ID NO: 2710155 - DNA, 23 bp, Homo sapiens
ccaggaagggagggagctgaggc

SEQ ID NO: 2710156 - DNA, 23 bp, Homo sapiens
ccaggacggggccggccaggtgg

SEQ ID NO: 2710157 - DNA, 15 bp, Homo sapiens
ccaggactggggctt

SEQ ID NO: 2710158 - DNA, 17 bp, Homo sapiens
ccaggagcaaatgctgg

SEQ ID NO: 2710159 - DNA, 17 bp, Homo sapiens
ccaggagtttgaggctg

SEQ ID NO: 2710160 - DNA, 21 bp, Homo sapiens
ccaggagtttgaggctgcagc

SEQ ID NO: 2710161 - DNA, 22 bp, Homo sapiens
ccaggagtttgaggctgcagcg

SEQ ID NO: 2710162 - DNA, 16 bp, Homo sapiens
ccaggattcccagaga

SEQ ID NO: 2710163 - DNA, 20 bp, Homo sapiens
ccaggattcccagagagacg

SEQ ID NO: 2710164 - DNA, 24 bp, Homo sapiens
ccaggattggcacaagctccctgg

SEQ ID NO: 2710165 - DNA, 18 bp, Homo sapiens
ccaggccatcttccaggt

SEQ ID NO: 2710166 - DNA, 22 bp, Homo sapiens
ccaggccctaggattcctcccc

SEQ ID NO: 2710167 - DNA, 12 bp, Homo sapiens
ccaggctggcca

SEQ ID NO: 2710168 - DNA, 13 bp, Homo sapiens
ccaggctggccag

SEQ ID NO: 2710169 - DNA, 16 bp, Homo sapiens
ccaggctggccagccc

SEQ ID NO: 2710170 - DNA, 17 bp, Homo sapiens
ccagggaagccctcggc

SEQ ID NO: 2710171 - DNA, 22 bp, Homo sapiens
ccagggaccactgggtgagaga

SEQ ID NO: 2710172 - DNA, 19 bp, Homo sapiens
ccagggccatctcctccca

SEQ ID NO: 2710173 - DNA, 14 bp, Homo sapiens
ccagggcctccagg

SEQ ID NO: 2710174 - DNA, 15 bp, Homo sapiens
ccagggcctccagga

SEQ ID NO: 2710175 - DNA, 18 bp, Homo sapiens
ccagggcctccaggactg

SEQ ID NO: 2710176 - DNA, 14 bp, Homo sapiens
ccagggcctctgtg

SEQ ID NO: 2710177 - DNA, 21 bp, Homo sapiens
ccagggcctctgtgcagacag

SEQ ID NO: 2710178 - DNA, 19 bp, Homo sapiens
ccagggcgggagtgggggc

SEQ ID NO: 2710179 - DNA, 20 bp, Homo sapiens
ccagggcgggagtgggggct

SEQ ID NO: 2710180 - DNA, 17 bp, Homo sapiens
ccagggctccctcctgg

SEQ ID NO: 2710181 - DNA, 23 bp, Homo sapiens
ccagggcttgtggactctctgcc

SEQ ID NO: 2710182 - DNA, 15 bp, Homo sapiens
ccaggggcaggcaca

SEQ ID NO: 2710183 - DNA, 18 bp, Homo sapiens
ccaggggcaggcacagca

SEQ ID NO: 2710184 - DNA, 19 bp, Homo sapiens
ccaggggcaggcacagcac

SEQ ID NO: 2710185 - DNA, 17 bp, Homo sapiens
ccaggggtaccaggcac

SEQ ID NO: 2710186 - DNA, 22 bp, Homo sapiens
ccagggtgagaacgtgcccagc

SEQ ID NO: 2710187 - DNA, 23 bp, Homo sapiens
ccagggtgagaacgtgcccagcc

SEQ ID NO: 2710188 - DNA, 15 bp, Homo sapiens
ccaggtctcctccac

SEQ ID NO: 2710189 - DNA, 22 bp, Homo sapiens
ccaggtgggcgggcagcacagc

SEQ ID NO: 2710190 - DNA, 13 bp, Homo sapiens
ccagtactgggaa

SEQ ID NO: 2710191 - DNA, 20 bp, Homo sapiens
ccagtcaaagcggatgctgg

SEQ ID NO: 2710192 - DNA, 21 bp, Homo sapiens
ccagtcaagttccctcctgca

SEQ ID NO: 2710193 - DNA, 14 bp, Homo sapiens
ccagtcctagagct

SEQ ID NO: 2710194 - DNA, 15 bp, Homo sapiens
ccagtcctagagctc

SEQ ID NO: 2710195 - DNA, 16 bp, Homo sapiens
ccagtcctagagctcc

SEQ ID NO: 2710196 - DNA, 17 bp, Homo sapiens
ccagtcctagagctcct

SEQ ID NO: 2710197 - DNA, 20 bp, Homo sapiens
ccagtcctagagctcctgtc

SEQ ID NO: 2710198 - DNA, 22 bp, Homo sapiens
ccagtcctagagctcctgtccc

SEQ ID NO: 2710199 - DNA, 23 bp, Homo sapiens
ccagtcctagagctcctgtccct

SEQ ID NO: 2710200 - DNA, 24 bp, Homo sapiens
ccagtcctagagctcctgtcccta

SEQ ID NO: 2710201 - DNA, 18 bp, Homo sapiens
ccagtcctgctggcctgc

SEQ ID NO: 2710202 - DNA, 20 bp, Homo sapiens
ccagtcctgctggcctgctc

SEQ ID NO: 2710203 - DNA, 19 bp, Homo sapiens
ccagtcctttgttgctgtt

SEQ ID NO: 2710204 - DNA, 23 bp, Homo sapiens
ccagtcctttgttgctgttgctg

SEQ ID NO: 2710205 - DNA, 14 bp, Homo sapiens
ccagtcgcgctgcc

SEQ ID NO: 2710206 - DNA, 14 bp, Homo sapiens
ccagtctaaaaata

SEQ ID NO: 2710207 - DNA, 16 bp, Homo sapiens
ccagtctgttccccat

SEQ ID NO: 2710208 - DNA, 12 bp, Homo sapiens
ccagtcttgtgt

SEQ ID NO: 2710209 - DNA, 17 bp, Homo sapiens
ccagtgagaagggcctg

SEQ ID NO: 2710210 - DNA, 20 bp, Homo sapiens
ccagtgagcctctgcgcctc

SEQ ID NO: 2710211 - DNA, 23 bp, Homo sapiens
ccagtgagcctctgcgcctctcc

SEQ ID NO: 2710212 - DNA, 13 bp, Homo sapiens
ccagtgcccattc

SEQ ID NO: 2710213 - DNA, 12 bp, Homo sapiens
ccagtgcctcag

SEQ ID NO: 2710214 - DNA, 19 bp, Homo sapiens
ccagtgcctcagtgctgca

SEQ ID NO: 2710215 - DNA, 17 bp, Homo sapiens
ccagtgctggctgctgg

SEQ ID NO: 2710216 - DNA, 21 bp, Homo sapiens
ccagtgctggctgctggccca

SEQ ID NO: 2710217 - DNA, 21 bp, Homo sapiens
ccagtgggaggacagagccgg

SEQ ID NO: 2710218 - DNA, 13 bp, Homo sapiens
ccagtgtcttcct

SEQ ID NO: 2710219 - DNA, 14 bp, Homo sapiens
ccagtgtcttcctg

SEQ ID NO: 2710220 - DNA, 16 bp, Homo sapiens
ccagtgtcttcctgtg

SEQ ID NO: 2710221 - DNA, 13 bp, Homo sapiens
ccagtgtgtgctc

SEQ ID NO: 2710222 - DNA, 15 bp, Homo sapiens
ccagtgtgtgctcag

SEQ ID NO: 2710223 - DNA, 19 bp, Homo sapiens
ccagtgtgtgctcagcagc

SEQ ID NO: 2710224 - DNA, 20 bp, Homo sapiens
ccagtgtgtgctcagcagcc

SEQ ID NO: 2710225 - DNA, 22 bp, Homo sapiens
ccagtgtgtgctcagcagcccc

SEQ ID NO: 2710226 - DNA, 13 bp, Homo sapiens
ccagttctgatga

SEQ ID NO: 2710227 - DNA, 19 bp, Homo sapiens
ccataaatcaattcattgt

SEQ ID NO: 2710228 - DNA, 13 bp, Homo sapiens
ccatactggcctc

SEQ ID NO: 2710229 - DNA, 22 bp, Homo sapiens
ccatactggcctcgcctggcct

SEQ ID NO: 2710230 - DNA, 18 bp, Homo sapiens
ccatattctaaattcact

SEQ ID NO: 2710231 - DNA, 14 bp, Homo sapiens
ccatcccccctcac

SEQ ID NO: 2710232 - DNA, 21 bp, Homo sapiens
ccatcccccctcaccaggggc

SEQ ID NO: 2710233 - DNA, 22 bp, Homo sapiens
ccatcccccctcaccaggggca

SEQ ID NO: 2710234 - DNA, 13 bp, Homo sapiens
ccatcctcctctc

SEQ ID NO: 2710235 - DNA, 12 bp, Homo sapiens
ccatcctggccc

SEQ ID NO: 2710236 - DNA, 16 bp, Homo sapiens
ccatcctggcccatca

SEQ ID NO: 2710237 - DNA, 12 bp, Homo sapiens
cctcctgagcct

SEQ ID NO: 2710238 - DNA, 13 bp, Homo sapiens
cctcctgagcctc

SEQ ID NO: 2710239 - DNA, 15 bp, Homo sapiens
cctcctgagcctcac

SEQ ID NO: 2710240 - DNA, 15 bp, Homo sapiens
cctcctgagtagctg

SEQ ID NO: 2710241 - DNA, 17 bp, Homo sapiens
cctcctgagtagctggg

SEQ ID NO: 2710242 - DNA, 13 bp, Homo sapiens
cctcctgccagct

SEQ ID NO: 2710243 - DNA, 14 bp, Homo sapiens
cctcctgccagctc

SEQ ID NO: 2710244 - DNA, 12 bp, Homo sapiens
cctcctgctgca

SEQ ID NO: 2710245 - DNA, 20 bp, Homo sapiens
cctcctggagcatcccaggc

SEQ ID NO: 2710246 - DNA, 16 bp, Homo sapiens
cctcgaggtttctcaa

SEQ ID NO: 2710247 - DNA, 21 bp, Homo sapiens
cctcgaggtttctcaaagaaa

SEQ ID NO: 2710248 - DNA, 16 bp, Homo sapiens
cctcgcactgcccagg

SEQ ID NO: 2710249 - DNA, 22 bp, Homo sapiens
cctcgcagagaatgtgaacatg

SEQ ID NO: 2710250 - DNA, 21 bp, Homo sapiens
cctcgcccaccgcatgccccc

SEQ ID NO: 2710251 - DNA, 12 bp, Homo sapiens
cctcgcctggcc

SEQ ID NO: 2710252 - DNA, 18 bp, Homo sapiens
cctcggcccatctgtcca

SEQ ID NO: 2710253 - DNA, 19 bp, Homo sapiens
cctcggcccatctgtccat

SEQ ID NO: 2710254 - DNA, 14 bp, Homo sapiens
cctcggcctcccaa

SEQ ID NO: 2710255 - DNA, 14 bp, Homo sapiens
cctcggctcctgct

SEQ ID NO: 2710256 - DNA, 16 bp, Homo sapiens
cctcggctcctgctgc

SEQ ID NO: 2710257 - DNA, 22 bp, Homo sapiens
cctcggctcctgctgcaccaac

SEQ ID NO: 2710258 - DNA, 23 bp, Homo sapiens
cctcgtctttcatggaccaggtc

SEQ ID NO: 2710259 - DNA, 12 bp, Homo sapiens
cctcgtgccagt

SEQ ID NO: 2710260 - DNA, 13 bp, Homo sapiens
cctcgtgccagtc

SEQ ID NO: 2710261 - DNA, 14 bp, Homo sapiens
cctctaactccctc

SEQ ID NO: 2710262 - DNA, 19 bp, Homo sapiens
cctctaactccctcctcac

SEQ ID NO: 2710263 - DNA, 15 bp, Homo sapiens
cctctagaacaccca

SEQ ID NO: 2710264 - DNA, 19 bp, Homo sapiens
cctctagaacacccactgg

SEQ ID NO: 2710265 - DNA, 13 bp, Homo sapiens
cctctagtcagca

SEQ ID NO: 2710266 - DNA, 13 bp, Homo sapiens
cctctagtgccct

SEQ ID NO: 2710267 - DNA, 19 bp, Homo sapiens
cctctccatgcaagtgctg

SEQ ID NO: 2710268 - DNA, 20 bp, Homo sapiens
cctctccatgcaagtgctgt

SEQ ID NO: 2710269 - DNA, 20 bp, Homo sapiens
cctctcgccctggccagggc

SEQ ID NO: 2710270 - DNA, 21 bp, Homo sapiens
cctctcggaaggctggctggg

SEQ ID NO: 2710271 - DNA, 22 bp, Homo sapiens
cctctcttgtgagccatagaga

SEQ ID NO: 2710272 - DNA, 16 bp, Homo sapiens
cctctgaatgtcccag

SEQ ID NO: 2710273 - DNA, 17 bp, Homo sapiens
cctctgaatgtcccaga

SEQ ID NO: 2710274 - DNA, 20 bp, Homo sapiens
cctctgaatgtcccagaggc

SEQ ID NO: 2710275 - DNA, 17 bp, Homo sapiens
cctctgacctgcaggcc

SEQ ID NO: 2710276 - DNA, 19 bp, Homo sapiens
cctctgacctgcaggccaa

SEQ ID NO: 2710277 - DNA, 11 bp, Homo sapiens
cctctgagccg

SEQ ID NO: 2710278 - DNA, 16 bp, Homo sapiens
cctctgcctcatcctc

SEQ ID NO: 2710279 - DNA, 11 bp, Homo sapiens
cctctgtcctg

SEQ ID NO: 2710280 - DNA, 16 bp, Homo sapiens
cctctgtcctgacttc

SEQ ID NO: 2710281 - DNA, 22 bp, Homo sapiens
cctctgtgcagacagtgtcaga

SEQ ID NO: 2710282 - DNA, 18 bp, Homo sapiens
cctctgtgtcactggctg

SEQ ID NO: 2710283 - DNA, 21 bp, Homo sapiens
cctctgtgtcactggctgcct

SEQ ID NO: 2710284 - DNA, 23 bp, Homo sapiens
cctctgtgtcactggctgcctcc

SEQ ID NO: 2710285 - DNA, 12 bp, Homo sapiens
cctcttccccac

SEQ ID NO: 2710286 - DNA, 15 bp, Homo sapiens
cctcttgccccaacc

SEQ ID NO: 2710287 - DNA, 21 bp, Homo sapiens
cctcttgccccaacccccagc

SEQ ID NO: 2710288 - DNA, 14 bp, Homo sapiens
cctcttggcacctg

SEQ ID NO: 2710289 - DNA, 18 bp, Homo sapiens
cctcttggcacctgccta

SEQ ID NO: 2710290 - DNA, 22 bp, Homo sapiens
cctgaaccgtgtgctcctcggc

SEQ ID NO: 2710291 - DNA, 16 bp, Homo sapiens
cctgaaggcatctgag

SEQ ID NO: 2710292 - DNA, 19 bp, Homo sapiens
cctgaatttattattgttc

SEQ ID NO: 2710293 - DNA, 15 bp, Homo sapiens
cctgaccccaggcag

SEQ ID NO: 2710294 - DNA, 21 bp, Homo sapiens
cctgaccccaggccacctgtc

SEQ ID NO: 2710295 - DNA, 19 bp, Homo sapiens
cctgacccggattggccct

SEQ ID NO: 2710296 - DNA, 21 bp, Homo sapiens
cctgacccggattggccctgc

SEQ ID NO: 2710297 - DNA, 21 bp, Homo sapiens
cctgaccctcctccactccac

SEQ ID NO: 2710298 - DNA, 12 bp, Homo sapiens
cctgacctccag

SEQ ID NO: 2710299 - DNA, 18 bp, Homo sapiens
cctgacctccagtcctgc

SEQ ID NO: 2710300 - DNA, 21 bp, Homo sapiens
cctgacctccagtcctgctgg

SEQ ID NO: 2710301 - DNA, 23 bp, Homo sapiens
cctgacgcctactggggcagggc

SEQ ID NO: 2710302 - DNA, 19 bp, Homo sapiens
cctgacttcaggggctgcc

SEQ ID NO: 2710303 - DNA, 21 bp, Homo sapiens
cctgacttcaggggctgcccg

SEQ ID NO: 2710304 - DNA, 15 bp, Homo sapiens
cctgagattctttaa

SEQ ID NO: 2710305 - DNA, 16 bp, Homo sapiens
cctgagattctttaag

SEQ ID NO: 2710306 - DNA, 21 bp, Homo sapiens
cctgagcaacagagtgagacc

SEQ ID NO: 2710307 - DNA, 14 bp, Homo sapiens
cctgagcctcacct

SEQ ID NO: 2710308 - DNA, 17 bp, Homo sapiens
cctgaggatcccctgtc

SEQ ID NO: 2710309 - DNA, 20 bp, Homo sapiens
cctgaggctggcatcctggc

SEQ ID NO: 2710310 - DNA, 14 bp, Homo sapiens
cctgagtagctggg

SEQ ID NO: 2710311 - DNA, 19 bp, Homo sapiens
cctgagtcacccctctgtc

SEQ ID NO: 2710312 - DNA, 20 bp, Homo sapiens
cctgagtcacccctctgtcc

SEQ ID NO: 2710313 - DNA, 22 bp, Homo sapiens
cctgagtcacccctctgtccag

SEQ ID NO: 2710314 - DNA, 19 bp, Homo sapiens
cctgattcggctgtctcag

SEQ ID NO: 2710315 - DNA, 14 bp, Homo sapiens
cctgcactgtcctg

SEQ ID NO: 2710316 - DNA, 15 bp, Homo sapiens
cctgcactgtcctgc

SEQ ID NO: 2710317 - DNA, 17 bp, Homo sapiens
cctgcactgtcctgctc

SEQ ID NO: 2710318 - DNA, 15 bp, Homo sapiens
cctgcagagctatgg

SEQ ID NO: 2710319 - DNA, 22 bp, Homo sapiens
cctgcatatctctagtccctgt

SEQ ID NO: 2710320 - DNA, 10 bp, Homo sapiens
cctgcatttt

SEQ ID NO: 2710321 - DNA, 14 bp, Homo sapiens
cctgccagcctggc

SEQ ID NO: 2710322 - DNA, 12 bp, Homo sapiens
cctgccagctct

SEQ ID NO: 2710323 - DNA, 15 bp, Homo sapiens
cctgccagctctgtc

SEQ ID NO: 2710324 - DNA, 16 bp, Homo sapiens
cctgccccctggtgga

SEQ ID NO: 2710325 - DNA, 22 bp, Homo sapiens
cctgccccgcccagctgcacct

SEQ ID NO: 2710326 - DNA, 15 bp, Homo sapiens
cctgcccctccccct

SEQ ID NO: 2710327 - DNA, 19 bp, Homo sapiens
cctgcccctccctagatcc

SEQ ID NO: 2710328 - DNA, 20 bp, Homo sapiens
cctgcccctccctagatcca

SEQ ID NO: 2710329 - DNA, 24 bp, Homo sapiens
cctgccccttgtcctctcagagcc

SEQ ID NO: 2710330 - DNA, 14 bp, Homo sapiens
cctgcccttgtttt

SEQ ID NO: 2710331 - DNA, 18 bp, Homo sapiens
cctgccgtccctcctgtt

SEQ ID NO: 2710332 - DNA, 11 bp, Homo sapiens
cctgcctgctg

SEQ ID NO: 2710333 - DNA, 12 bp, Homo sapiens
cctgcctgctgt

SEQ ID NO: 2710334 - DNA, 13 bp, Homo sapiens
cctgcctgctgtg

SEQ ID NO: 2710335 - DNA, 18 bp, Homo sapiens
cctgcctgggcctcccaa

SEQ ID NO: 2710336 - DNA, 18 bp, Homo sapiens
cctgcctgttctccagat

SEQ ID NO: 2710337 - DNA, 14 bp, Homo sapiens
cctgccttatgcaa

SEQ ID NO: 2710338 - DNA, 17 bp, Homo sapiens
cctgccttatgcaaggg

SEQ ID NO: 2710339 - DNA, 23 bp, Homo sapiens
cctgccttgaagccactgaagct

SEQ ID NO: 2710340 - DNA, 19 bp, Homo sapiens
cctgcgaaggggccctggt

SEQ ID NO: 2710341 - DNA, 20 bp, Homo sapiens
cctgcgagagaccctacaga

SEQ ID NO: 2710342 - DNA, 17 bp, Homo sapiens
cctgctcattgtggcca

SEQ ID NO: 2710343 - DNA, 13 bp, Homo sapiens
cctgctccacagt

SEQ ID NO: 2710344 - DNA, 19 bp, Homo sapiens
cctgctcttacttccccca

SEQ ID NO: 2710345 - DNA, 12 bp, Homo sapiens
cctgctgcacca

SEQ ID NO: 2710346 - DNA, 17 bp, Homo sapiens
cctgctgcaccaaccca

SEQ ID NO: 2710347 - DNA, 23 bp, Homo sapiens
cctgctgcaccaacccagccgct

SEQ ID NO: 2710348 - DNA, 22 bp, Homo sapiens
cctgctgcgtcagaccagtact

SEQ ID NO: 2710349 - DNA, 23 bp, Homo sapiens
cctgctgcgtcagaccagtactg

SEQ ID NO: 2710350 - DNA, 15 bp, Homo sapiens
cctgctggcctgctc

SEQ ID NO: 2710351 - DNA, 17 bp, Homo sapiens
cctgctggcctgctctt

SEQ ID NO: 2710352 - DNA, 23 bp, Homo sapiens
cctgctgggctcttaactgttgc

SEQ ID NO: 2710353 - DNA, 11 bp, Homo sapiens
cctgctgtgga

SEQ ID NO: 2710354 - DNA, 13 bp, Homo sapiens
cctgctgtggagc

SEQ ID NO: 2710355 - DNA, 15 bp, Homo sapiens
cctgcttcctggacc

SEQ ID NO: 2710356 - DNA, 15 bp, Homo sapiens
cctggaaaggctcag

SEQ ID NO: 2710357 - DNA, 23 bp, Homo sapiens
cctggaaaggctcagtctcagga

SEQ ID NO: 2710358 - DNA, 16 bp, Homo sapiens
cctggaacctttccct

SEQ ID NO: 2710359 - DNA, 19 bp, Homo sapiens
cctggaacctttcccttgt

SEQ ID NO: 2710360 - DNA, 18 bp, Homo sapiens
cctggaatgaagcatgta

SEQ ID NO: 2710361 - DNA, 12 bp, Homo sapiens
ctatcagtgtgc

SEQ ID NO: 2710362 - DNA, 16 bp, Homo sapiens
ctatcagtgtgccccc

SEQ ID NO: 2710363 - DNA, 15 bp, Homo sapiens
ctatctgcaatgttt

SEQ ID NO: 2710364 - DNA, 13 bp, Homo sapiens
ctatgaaaagcaa

SEQ ID NO: 2710365 - DNA, 15 bp, Homo sapiens
ctatgaaaagcaact

SEQ ID NO: 2710366 - DNA, 20 bp, Homo sapiens
ctatggattatccactgcaa

SEQ ID NO: 2710367 - DNA, 14 bp, Homo sapiens
ctatggcccagcca

SEQ ID NO: 2710368 - DNA, 22 bp, Homo sapiens
ctatgtaatgcttatgtgttgc

SEQ ID NO: 2710369 - DNA, 22 bp, Homo sapiens
ctatgtgggaaaaaagaaatcc

SEQ ID NO: 2710370 - DNA, 11 bp, Homo sapiens
ctattaacaaa

SEQ ID NO: 2710371 - DNA, 13 bp, Homo sapiens
ctattaagaaact

SEQ ID NO: 2710372 - DNA, 16 bp, Homo sapiens
ctattaagatttccaa

SEQ ID NO: 2710373 - DNA, 23 bp, Homo sapiens
ctattaagatttccaagtgccaa

SEQ ID NO: 2710374 - DNA, 22 bp, Homo sapiens
ctattgtgttggctttacaaat

SEQ ID NO: 2710375 - DNA, 22 bp, Homo sapiens
ctattgtttattctttttaaag

SEQ ID NO: 2710376 - DNA, 21 bp, Homo sapiens
ctatttaagtactatctttgt

SEQ ID NO: 2710377 - DNA, 14 bp, Homo sapiens
ctatttcctttgcg

SEQ ID NO: 2710378 - DNA, 15 bp, Homo sapiens
ctattttaataaaga

SEQ ID NO: 2710379 - DNA, 15 bp, Homo sapiens
ctcaaatggacaata

SEQ ID NO: 2710380 - DNA, 16 bp, Homo sapiens
ctcaagacttccagag

SEQ ID NO: 2710381 - DNA, 13 bp, Homo sapiens
ctcaagcaggttt

SEQ ID NO: 2710382 - DNA, 13 bp, Homo sapiens
ctcaaggaaaaga

SEQ ID NO: 2710383 - DNA, 17 bp, Homo sapiens
ctcaaggcctcccacag

SEQ ID NO: 2710384 - DNA, 20 bp, Homo sapiens
ctcaaggcctcccacagtga

SEQ ID NO: 2710385 - DNA, 23 bp, Homo sapiens
ctcaatcactgctcccccgtgtg

SEQ ID NO: 2710386 - DNA, 15 bp, Homo sapiens
ctcaattttgtattt

SEQ ID NO: 2710387 - DNA, 14 bp, Homo sapiens
ctcacactccagaa

SEQ ID NO: 2710388 - DNA, 18 bp, Homo sapiens
ctcacactcctcctgcca

SEQ ID NO: 2710389 - DNA, 15 bp, Homo sapiens
ctcacagactcttcc

SEQ ID NO: 2710390 - DNA, 21 bp, Homo sapiens
ctcacagactcttccaccaga

SEQ ID NO: 2710391 - DNA, 14 bp, Homo sapiens
ctcacagatgctgg

SEQ ID NO: 2710392 - DNA, 17 bp, Homo sapiens
ctcacagatgctggcct

SEQ ID NO: 2710393 - DNA, 20 bp, Homo sapiens
ctcacagatgctggcctctt

SEQ ID NO: 2710394 - DNA, 15 bp, Homo sapiens
ctcacagcctctccc

SEQ ID NO: 2710395 - DNA, 20 bp, Homo sapiens
ctcacagcctctcccttaat

SEQ ID NO: 2710396 - DNA, 14 bp, Homo sapiens
ctcacattcccaag

SEQ ID NO: 2710397 - DNA, 16 bp, Homo sapiens
ctcaccttaactcagc

SEQ ID NO: 2710398 - DNA, 18 bp, Homo sapiens
ctcagactcctggcttca

SEQ ID NO: 2710399 - DNA, 22 bp, Homo sapiens
ctcagactctttttgtacctgg

SEQ ID NO: 2710400 - DNA, 17 bp, Homo sapiens
ctcagagcagcactggg

SEQ ID NO: 2710401 - DNA, 13 bp, Homo sapiens
ctcagagcctcag

SEQ ID NO: 2710402 - DNA, 13 bp, Homo sapiens
ctcagagctgcgg

SEQ ID NO: 2710403 - DNA, 16 bp, Homo sapiens
ctcagagctgctgagc

SEQ ID NO: 2710404 - DNA, 16 bp, Homo sapiens
ctcagatcctgggcat

SEQ ID NO: 2710405 - DNA, 14 bp, Homo sapiens
ctcagcagccccct

SEQ ID NO: 2710406 - DNA, 17 bp, Homo sapiens
ctcagccagccctggag

SEQ ID NO: 2710407 - DNA, 18 bp, Homo sapiens
ctcagccagccctggagg

SEQ ID NO: 2710408 - DNA, 19 bp, Homo sapiens
ctcagccagccctggaggc

SEQ ID NO: 2710409 - DNA, 13 bp, Homo sapiens
ctcagcctccagg

SEQ ID NO: 2710410 - DNA, 18 bp, Homo sapiens
ctcagcctcctgagtagc

SEQ ID NO: 2710411 - DNA, 23 bp, Homo sapiens
ctcagcctcctgagtagctggga

SEQ ID NO: 2710412 - DNA, 22 bp, Homo sapiens
ctcagctcaccacaacctccac

SEQ ID NO: 2710413 - DNA, 16 bp, Homo sapiens
ctcagctctcctgctg

SEQ ID NO: 2710414 - DNA, 11 bp, Homo sapiens
ctcagctgtgg

SEQ ID NO: 2710415 - DNA, 19 bp, Homo sapiens
ctcagctgtggtcccaccc

SEQ ID NO: 2710416 - DNA, 22 bp, Homo sapiens
ctcagctgtggtcccacccagg

SEQ ID NO: 2710417 - DNA, 23 bp, Homo sapiens
ctcagctgtggtcccacccagga

SEQ ID NO: 2710418 - DNA, 14 bp, Homo sapiens
ctcagcttcccaag

SEQ ID NO: 2710419 - DNA, 15 bp, Homo sapiens
ctcaggaggctgagg

SEQ ID NO: 2710420 - DNA, 18 bp, Homo sapiens
ctcaggatgtcctttgtg

SEQ ID NO: 2710421 - DNA, 21 bp, Homo sapiens
ctcaggatgtcctttgtgtcc

SEQ ID NO: 2710422 - DNA, 22 bp, Homo sapiens
ctcaggatgtcctttgtgtcca

SEQ ID NO: 2710423 - DNA, 19 bp, Homo sapiens
ctcaggccaacaagccaac

SEQ ID NO: 2710424 - DNA, 15 bp, Homo sapiens
ctcaggccaggtgca

SEQ ID NO: 2710425 - DNA, 15 bp, Homo sapiens
ctcaggggaagctgc

SEQ ID NO: 2710426 - DNA, 20 bp, Homo sapiens
ctcaggtagggagctaagga

SEQ ID NO: 2710427 - DNA, 16 bp, Homo sapiens
ctcaggtagtactggg

SEQ ID NO: 2710428 - DNA, 21 bp, Homo sapiens
ctcaggtgacggactcagact

SEQ ID NO: 2710429 - DNA, 14 bp, Homo sapiens
ctcagtgaaatcat

SEQ ID NO: 2710430 - DNA, 17 bp, Homo sapiens
ctcagtggcaagaatga

SEQ ID NO: 2710431 - DNA, 16 bp, Homo sapiens
ctcagtgtcagcactc

SEQ ID NO: 2710432 - DNA, 12 bp, Homo sapiens
ctcatcctcctc

SEQ ID NO: 2710433 - DNA, 14 bp, Homo sapiens
ctcatcctcctcct

SEQ ID NO: 2710434 - DNA, 15 bp, Homo sapiens
ctcatctgtgcctgt

SEQ ID NO: 2710435 - DNA, 21 bp, Homo sapiens
ctcatctgtgcctgtctgtcc

SEQ ID NO: 2710436 - DNA, 22 bp, Homo sapiens
ctcatctgtgcctgtctgtcca

SEQ ID NO: 2710437 - DNA, 23 bp, Homo sapiens
ctcatctgtgcctgtctgtccaa

SEQ ID NO: 2710438 - DNA, 18 bp, Homo sapiens
ctcatgcaagacttcact

SEQ ID NO: 2710439 - DNA, 23 bp, Homo sapiens
ctcatgcaagacttcactgcagc

SEQ ID NO: 2710440 - DNA, 13 bp, Homo sapiens
ctcattccccggg

SEQ ID NO: 2710441 - DNA, 15 bp, Homo sapiens
ctccaaacactgggc

SEQ ID NO: 2710442 - DNA, 18 bp, Homo sapiens
ctccaacaataaagagct

SEQ ID NO: 2710443 - DNA, 14 bp, Homo sapiens
ctccacagccgcag

SEQ ID NO: 2710444 - DNA, 13 bp, Homo sapiens
ctccacagtgttg

SEQ ID NO: 2710445 - DNA, 20 bp, Homo sapiens
ctccacattaagtggctttt

SEQ ID NO: 2710446 - DNA, 16 bp, Homo sapiens
ctccacccactgtccg

SEQ ID NO: 2710447 - DNA, 20 bp, Homo sapiens
ctccaccctaaagtctcagg

SEQ ID NO: 2710448 - DNA, 20 bp, Homo sapiens
ctccacctagtggctgtcca

SEQ ID NO: 2710449 - DNA, 14 bp, Homo sapiens
ctccacctcctggg

SEQ ID NO: 2710450 - DNA, 15 bp, Homo sapiens
ctccacctcctgggt

SEQ ID NO: 2710451 - DNA, 17 bp, Homo sapiens
ctccagaatgtgctgcc

SEQ ID NO: 2710452 - DNA, 20 bp, Homo sapiens
ctccagaatgtgctgccttt

SEQ ID NO: 2710453 - DNA, 19 bp, Homo sapiens
ctccagaattacccttcct

SEQ ID NO: 2710454 - DNA, 21 bp, Homo sapiens
ctccagaattacccttcctca

SEQ ID NO: 2710455 - DNA, 20 bp, Homo sapiens
ctccagactgcggagcagcc

SEQ ID NO: 2710456 - DNA, 21 bp, Homo sapiens
ctccagcacgttttctggctt

SEQ ID NO: 2710457 - DNA, 19 bp, Homo sapiens
ctccagcctcacagatgct

SEQ ID NO: 2710458 - DNA, 20 bp, Homo sapiens
ctccagcctcacagatgctg

SEQ ID NO: 2710459 - DNA, 21 bp, Homo sapiens
ctccagcctgggcgacagagc

SEQ ID NO: 2710460 - DNA, 13 bp, Homo sapiens
ctccagggacaga

SEQ ID NO: 2710461 - DNA, 12 bp, Homo sapiens
ctccagggttca

SEQ ID NO: 2710462 - DNA, 22 bp, Homo sapiens
ctccagtcctgctggcctgctc

SEQ ID NO: 2710463 - DNA, 13 bp, Homo sapiens
ctccagtgctggc

SEQ ID NO: 2710464 - DNA, 20 bp, Homo sapiens
ctccagtgctggctgctggc

SEQ ID NO: 2710465 - DNA, 23 bp, Homo sapiens
ctccagtgctggctgctggccca

SEQ ID NO: 2710466 - DNA, 17 bp, Homo sapiens
ctccagtgggaggacag

SEQ ID NO: 2710467 - DNA, 18 bp, Homo sapiens
ctccagtgggaggacaga

SEQ ID NO: 2710468 - DNA, 23 bp, Homo sapiens
ctccagtgggaggacagagccgg

SEQ ID NO: 2710469 - DNA, 19 bp, Homo sapiens
ctccatgaagaagctggga

SEQ ID NO: 2710470 - DNA, 15 bp, Homo sapiens
ctccatgcaagtgct

SEQ ID NO: 2710471 - DNA, 16 bp, Homo sapiens
ctccatgcaagtgctg

SEQ ID NO: 2710472 - DNA, 23 bp, Homo sapiens
ctccatgcaagtgctgtttgggc

SEQ ID NO: 2710473 - DNA, 12 bp, Homo sapiens
ctccatgctggt

SEQ ID NO: 2710474 - DNA, 15 bp, Homo sapiens
ctccattccagtctc

SEQ ID NO: 2710475 - DNA, 16 bp, Homo sapiens
ctccattttcttgtca

SEQ ID NO: 2710476 - DNA, 12 bp, Homo sapiens
ctcccacagtga

SEQ ID NO: 2710477 - DNA, 20 bp, Homo sapiens
ctcccacagtgactcgggct

SEQ ID NO: 2710478 - DNA, 19 bp, Homo sapiens
ctcccaccagtggccccca

SEQ ID NO: 2710479 - DNA, 18 bp, Homo sapiens
ctcccaccccatgcatta

SEQ ID NO: 2710480 - DNA, 14 bp, Homo sapiens
ctcccacggggacc

SEQ ID NO: 2710481 - DNA, 14 bp, Homo sapiens
ctcccactcctaat

SEQ ID NO: 2710482 - DNA, 18 bp, Homo sapiens
ctcccacttccctgacac

SEQ ID NO: 2710483 - DNA, 16 bp, Homo sapiens
ctcccagaaggctggg

SEQ ID NO: 2710484 - DNA, 19 bp, Homo sapiens
ctcccagaaggctgggtcc

SEQ ID NO: 2710485 - DNA, 15 bp, Homo sapiens
ctgcctgcttcctgg

SEQ ID NO: 2710486 - DNA, 13 bp, Homo sapiens
ctgcctgtgcatg

SEQ ID NO: 2710487 - DNA, 17 bp, Homo sapiens
ctgcctgttctccagat

SEQ ID NO: 2710488 - DNA, 18 bp, Homo sapiens
ctgcctgttctccagatg

SEQ ID NO: 2710489 - DNA, 20 bp, Homo sapiens
ctgcctgttctccagatgga

SEQ ID NO: 2710490 - DNA, 22 bp, Homo sapiens
ctgccttgggcctcatctgctc

SEQ ID NO: 2710491 - DNA, 22 bp, Homo sapiens
ctgcgagagaccctacagacag

SEQ ID NO: 2710492 - DNA, 16 bp, Homo sapiens
ctgcgccacggcactc

SEQ ID NO: 2710493 - DNA, 18 bp, Homo sapiens
ctgcgccacggcactcca

SEQ ID NO: 2710494 - DNA, 21 bp, Homo sapiens
ctgcgccacggcactccagcc

SEQ ID NO: 2710495 - DNA, 13 bp, Homo sapiens
ctgcggagcagcc

SEQ ID NO: 2710496 - DNA, 14 bp, Homo sapiens
ctgcggagcagcct

SEQ ID NO: 2710497 - DNA, 18 bp, Homo sapiens
ctgcgggatggtcctggg

SEQ ID NO: 2710498 - DNA, 21 bp, Homo sapiens
ctgcgggctgagggcatctct

SEQ ID NO: 2710499 - DNA, 17 bp, Homo sapiens
ctgcggtgtctgcagct

SEQ ID NO: 2710500 - DNA, 21 bp, Homo sapiens
ctgcgtcagaccagtactggg

SEQ ID NO: 2710501 - DNA, 22 bp, Homo sapiens
ctgcgtcctgaggagtgtcctg

SEQ ID NO: 2710502 - DNA, 13 bp, Homo sapiens
ctgcgtctgtgtt

SEQ ID NO: 2710503 - DNA, 19 bp, Homo sapiens
ctgcgtgccagtgtcccca

SEQ ID NO: 2710504 - DNA, 20 bp, Homo sapiens
ctgctaccctccctgctgtc

SEQ ID NO: 2710505 - DNA, 12 bp, Homo sapiens
ctgctatatttg

SEQ ID NO: 2710506 - DNA, 12 bp, Homo sapiens
ctgctccacagt

SEQ ID NO: 2710507 - DNA, 21 bp, Homo sapiens
ctgctccacagtgttggcgag

SEQ ID NO: 2710508 - DNA, 18 bp, Homo sapiens
ctgctcctagcccagcag

SEQ ID NO: 2710509 - DNA, 22 bp, Homo sapiens
ctgctcctagcccagcagagag

SEQ ID NO: 2710510 - DNA, 16 bp, Homo sapiens
ctgctcgaagaacaat

SEQ ID NO: 2710511 - DNA, 17 bp, Homo sapiens
ctgctcgaagaacaatg

SEQ ID NO: 2710512 - DNA, 14 bp, Homo sapiens
ctgctcgggcccag

SEQ ID NO: 2710513 - DNA, 16 bp, Homo sapiens
ctgctcgggcccaggc

SEQ ID NO: 2710514 - DNA, 23 bp, Homo sapiens
ctgctctgcccccaactcccgga

SEQ ID NO: 2710515 - DNA, 16 bp, Homo sapiens
ctgctcttacttcccc

SEQ ID NO: 2710516 - DNA, 20 bp, Homo sapiens
ctgctcttacttcccccacc

SEQ ID NO: 2710517 - DNA, 23 bp, Homo sapiens
ctgctcttacttcccccaccctg

SEQ ID NO: 2710518 - DNA, 18 bp, Homo sapiens
ctgctcttatttttgtac

SEQ ID NO: 2710519 - DNA, 13 bp, Homo sapiens
ctgctgacccacc

SEQ ID NO: 2710520 - DNA, 15 bp, Homo sapiens
ctgctgacccaccaa

SEQ ID NO: 2710521 - DNA, 18 bp, Homo sapiens
ctgctgcagaggggcagg

SEQ ID NO: 2710522 - DNA, 12 bp, Homo sapiens
ctgctgcatggc

SEQ ID NO: 2710523 - DNA, 16 bp, Homo sapiens
ctgctgcgtcagacca

SEQ ID NO: 2710524 - DNA, 20 bp, Homo sapiens
ctgctgcgtcagaccagtac

SEQ ID NO: 2710525 - DNA, 19 bp, Homo sapiens
ctgctggaagaactgcatg

SEQ ID NO: 2710526 - DNA, 20 bp, Homo sapiens
ctgctggaagaactgcatgg

SEQ ID NO: 2710527 - DNA, 21 bp, Homo sapiens
ctgctggctttcttttctcta

SEQ ID NO: 2710528 - DNA, 19 bp, Homo sapiens
ctgctgggactggccaggt

SEQ ID NO: 2710529 - DNA, 12 bp, Homo sapiens
ctgctgggctgg

SEQ ID NO: 2710530 - DNA, 17 bp, Homo sapiens
ctgctggggctggtgag

SEQ ID NO: 2710531 - DNA, 17 bp, Homo sapiens
ctgctgggtggcccatc

SEQ ID NO: 2710532 - DNA, 22 bp, Homo sapiens
ctgctggtaatttgtatctgaa

SEQ ID NO: 2710533 - DNA, 18 bp, Homo sapiens
ctgctgtcccctcttgcc

SEQ ID NO: 2710534 - DNA, 13 bp, Homo sapiens
ctgctgtggaaag

SEQ ID NO: 2710535 - DNA, 15 bp, Homo sapiens
ctgctgtggaaagga

SEQ ID NO: 2710536 - DNA, 14 bp, Homo sapiens
ctgctgtggcatca

SEQ ID NO: 2710537 - DNA, 23 bp, Homo sapiens
ctgctgttaattgattaaaatct

SEQ ID NO: 2710538 - DNA, 14 bp, Homo sapiens
ctgctgttgtggga

SEQ ID NO: 2710539 - DNA, 19 bp, Homo sapiens
ctgcttactaatgtgcccc

SEQ ID NO: 2710540 - DNA, 17 bp, Homo sapiens
ctgcttcatcctgctcc

SEQ ID NO: 2710541 - DNA, 16 bp, Homo sapiens
ctgcttggcttcccct

SEQ ID NO: 2710542 - DNA, 17 bp, Homo sapiens
ctgcttttctcccagaa

SEQ ID NO: 2710543 - DNA, 13 bp, Homo sapiens
ctggaacctttcc

SEQ ID NO: 2710544 - DNA, 14 bp, Homo sapiens
ctggaacctttccc

SEQ ID NO: 2710545 - DNA, 20 bp, Homo sapiens
ctggaaggagccagccagga

SEQ ID NO: 2710546 - DNA, 16 bp, Homo sapiens
ctggaatgaagcatgt

SEQ ID NO: 2710547 - DNA, 17 bp, Homo sapiens
ctggaatgaagcatgta

SEQ ID NO: 2710548 - DNA, 20 bp, Homo sapiens
ctggacagtacctgattgta

SEQ ID NO: 2710549 - DNA, 19 bp, Homo sapiens
ctggacattaacaagatca

SEQ ID NO: 2710550 - DNA, 13 bp, Homo sapiens
ctggacctctctt

SEQ ID NO: 2710551 - DNA, 16 bp, Homo sapiens
ctggacctctcttgtg

SEQ ID NO: 2710552 - DNA, 14 bp, Homo sapiens
ctggacctgaaggc

SEQ ID NO: 2710553 - DNA, 17 bp, Homo sapiens
ctggacgcccagctgag

SEQ ID NO: 2710554 - DNA, 17 bp, Homo sapiens
ctggacggcattcctgc

SEQ ID NO: 2710555 - DNA, 15 bp, Homo sapiens
ctggactagggcctc

SEQ ID NO: 2710556 - DNA, 13 bp, Homo sapiens
ctggacttgagct

SEQ ID NO: 2710557 - DNA, 20 bp, Homo sapiens
ctggacttgagcttggcagc

SEQ ID NO: 2710558 - DNA, 20 bp, Homo sapiens
ctggactttctcttggacat

SEQ ID NO: 2710559 - DNA, 15 bp, Homo sapiens
ctggagcccaggagt

SEQ ID NO: 2710560 - DNA, 15 bp, Homo sapiens
ctggagcccttgggt

SEQ ID NO: 2710561 - DNA, 12 bp, Homo sapiens
ctggaggaacat

SEQ ID NO: 2710562 - DNA, 19 bp, Homo sapiens
ctggatggctcccctgagg

SEQ ID NO: 2710563 - DNA, 17 bp, Homo sapiens
ctggatggggagtctca

SEQ ID NO: 2710564 - DNA, 14 bp, Homo sapiens
ctggcacagtgtct

SEQ ID NO: 2710565 - DNA, 19 bp, Homo sapiens
ctggcacagtgtctgggct

SEQ ID NO: 2710566 - DNA, 20 bp, Homo sapiens
ctggcacagtgtctgggctg

SEQ ID NO: 2710567 - DNA, 13 bp, Homo sapiens
ctggcagcctcca

SEQ ID NO: 2710568 - DNA, 18 bp, Homo sapiens
ctggcaggatgaccctgc

SEQ ID NO: 2710569 - DNA, 20 bp, Homo sapiens
ctggcaggatgaccctgcga

SEQ ID NO: 2710570 - DNA, 22 bp, Homo sapiens
ctggcagtggcctccttttggt

SEQ ID NO: 2710571 - DNA, 14 bp, Homo sapiens
ctggcatcctggct

SEQ ID NO: 2710572 - DNA, 17 bp, Homo sapiens
ctggcatcctggctggc

SEQ ID NO: 2710573 - DNA, 18 bp, Homo sapiens
ctggcatcctggctggct

SEQ ID NO: 2710574 - DNA, 12 bp, Homo sapiens
ctggccaccacc

SEQ ID NO: 2710575 - DNA, 16 bp, Homo sapiens
ctggccaccagcttcc

SEQ ID NO: 2710576 - DNA, 19 bp, Homo sapiens
ctggccactccccagtgct

SEQ ID NO: 2710577 - DNA, 12 bp, Homo sapiens
ctggccagggcc

SEQ ID NO: 2710578 - DNA, 13 bp, Homo sapiens
ctggccagggcct

SEQ ID NO: 2710579 - DNA, 21 bp, Homo sapiens
ctggcccacagctctgctgga

SEQ ID NO: 2710580 - DNA, 16 bp, Homo sapiens
ctggccctcaaggcct

SEQ ID NO: 2710581 - DNA, 21 bp, Homo sapiens
ctggccctcaaggcctcccac

SEQ ID NO: 2710582 - DNA, 24 bp, Homo sapiens
ctggccctcaaggcctcccacagt

SEQ ID NO: 2710583 - DNA, 15 bp, Homo sapiens
ctggccgtggctcca

SEQ ID NO: 2710584 - DNA, 16 bp, Homo sapiens
ctggccgtggctccag

SEQ ID NO: 2710585 - DNA, 17 bp, Homo sapiens
ctggccgtggctccaga

SEQ ID NO: 2710586 - DNA, 12 bp, Homo sapiens
ctggcctcgcct

SEQ ID NO: 2710587 - DNA, 17 bp, Homo sapiens
ctggcctcgcctggcct

SEQ ID NO: 2710588 - DNA, 14 bp, Homo sapiens
ctggcctctagaac

SEQ ID NO: 2710589 - DNA, 23 bp, Homo sapiens
ctggcctctagaacacccactgg

SEQ ID NO: 2710590 - DNA, 16 bp, Homo sapiens
ctggcctcttggcacc

SEQ ID NO: 2710591 - DNA, 19 bp, Homo sapiens
ctggcctcttggcacctgc

SEQ ID NO: 2710592 - DNA, 20 bp, Homo sapiens
ctggcctcttggcacctgcc

SEQ ID NO: 2710593 - DNA, 24 bp, Homo sapiens
ctggcctgaggtctcgctgatgct

SEQ ID NO: 2710594 - DNA, 15 bp, Homo sapiens
ctggcctgctcttac

SEQ ID NO: 2710595 - DNA, 14 bp, Homo sapiens
ctggctcagctgtg

SEQ ID NO: 2710596 - DNA, 20 bp, Homo sapiens
ctggctcagctgtggtccca

SEQ ID NO: 2710597 - DNA, 23 bp, Homo sapiens
ctggctcagctgtggtcccaccc

SEQ ID NO: 2710598 - DNA, 23 bp, Homo sapiens
ctggctctgccagcgtccccggc

SEQ ID NO: 2710599 - DNA, 16 bp, Homo sapiens
ctggctgaacagtgct

SEQ ID NO: 2710600 - DNA, 22 bp, Homo sapiens
ctggctgaacagtgctctgcct

SEQ ID NO: 2710601 - DNA, 23 bp, Homo sapiens
ctggctgaacagtgctctgcctc

SEQ ID NO: 2710602 - DNA, 15 bp, Homo sapiens
ctggctgcctccact

SEQ ID NO: 2710603 - DNA, 15 bp, Homo sapiens
ctggctgctggccca

SEQ ID NO: 2710604 - DNA, 18 bp, Homo sapiens
ctggctgctggcccacag

SEQ ID NO: 2710605 - DNA, 20 bp, Homo sapiens
ctggctgctggcccacagct

SEQ ID NO: 2710606 - DNA, 15 bp, Homo sapiens
ctggctggctgcagt

SEQ ID NO: 2710607 - DNA, 16 bp, Homo sapiens
ctggctggctgtgtcc

SEQ ID NO: 2710608 - DNA, 17 bp, Homo sapiens
ctggctggctgtgtcct

SEQ ID NO: 2710609 - DNA, 22 bp, Homo sapiens
gaaaagacattgaaagctctat

SEQ ID NO: 2710610 - DNA, 12 bp, Homo sapiens
gaaaagccatat

SEQ ID NO: 2710611 - DNA, 17 bp, Homo sapiens
gaaaagccatatctagt

SEQ ID NO: 2710612 - DNA, 13 bp, Homo sapiens
gaaaagcctctgt

SEQ ID NO: 2710613 - DNA, 21 bp, Homo sapiens
gaaaagcctctgtgtcactgg

SEQ ID NO: 2710614 - DNA, 17 bp, Homo sapiens
gaaaatgaatttgactg

SEQ ID NO: 2710615 - DNA, 14 bp, Homo sapiens
gaaaatgcaggaga

SEQ ID NO: 2710616 - DNA, 10 bp, Homo sapiens
gaaaatgtgt

SEQ ID NO: 2710617 - DNA, 23 bp, Homo sapiens
gaaaattagcttttagttttaaa

SEQ ID NO: 2710618 - DNA, 16 bp, Homo sapiens
gaaacaggctctgaga

SEQ ID NO: 2710619 - DNA, 14 bp, Homo sapiens
gaaaccgtccctga

SEQ ID NO: 2710620 - DNA, 15 bp, Homo sapiens
gaaacctgtgaaagc

SEQ ID NO: 2710621 - DNA, 22 bp, Homo sapiens
gaaactaccagtgggcatgtat

SEQ ID NO: 2710622 - DNA, 12 bp, Homo sapiens
gaaagacatcaa

SEQ ID NO: 2710623 - DNA, 17 bp, Homo sapiens
gaaagacatcaatgaaa

SEQ ID NO: 2710624 - DNA, 13 bp, Homo sapiens
gaaagactgaaag

SEQ ID NO: 2710625 - DNA, 13 bp, Homo sapiens
gaaagagagtacc

SEQ ID NO: 2710626 - DNA, 17 bp, Homo sapiens
gaaagccaaattttatt

SEQ ID NO: 2710627 - DNA, 14 bp, Homo sapiens
gaaaggattttacc

SEQ ID NO: 2710628 - DNA, 14 bp, Homo sapiens
gaaaggctcagtct

SEQ ID NO: 2710629 - DNA, 18 bp, Homo sapiens
gaaagtatttttgaaaga

SEQ ID NO: 2710630 - DNA, 18 bp, Homo sapiens
gaaagtgaataaacttca

SEQ ID NO: 2710631 - DNA, 15 bp, Homo sapiens
gaaatcagagctggc

SEQ ID NO: 2710632 - DNA, 20 bp, Homo sapiens
gaaattaccagagttgttct

SEQ ID NO: 2710633 - DNA, 13 bp, Homo sapiens
gaaattagccggg

SEQ ID NO: 2710634 - DNA, 11 bp, Homo sapiens
gaaattatttt

SEQ ID NO: 2710635 - DNA, 21 bp, Homo sapiens
gaaattgtctagcagagcagg

SEQ ID NO: 2710636 - DNA, 22 bp, Homo sapiens
gaaattttactgacagaaatgc

SEQ ID NO: 2710637 - DNA, 17 bp, Homo sapiens
gaacacactcagcagcc

SEQ ID NO: 2710638 - DNA, 20 bp, Homo sapiens
gaacacactcagcagccccc

SEQ ID NO: 2710639 - DNA, 12 bp, Homo sapiens
gaacacccactg

SEQ ID NO: 2710640 - DNA, 13 bp, Homo sapiens
gaacacccactgg

SEQ ID NO: 2710641 - DNA, 14 bp, Homo sapiens
gaacacccactggc

SEQ ID NO: 2710642 - DNA, 18 bp, Homo sapiens
gaacacccactggccagt

SEQ ID NO: 2710643 - DNA, 22 bp, Homo sapiens
gaacacccactggccagtccta

SEQ ID NO: 2710644 - DNA, 15 bp, Homo sapiens
gaacacccggaaaga

SEQ ID NO: 2710645 - DNA, 17 bp, Homo sapiens
gaacacccggaaagact

SEQ ID NO: 2710646 - DNA, 22 bp, Homo sapiens
gaacaggatgtataatatgcaa

SEQ ID NO: 2710647 - DNA, 15 bp, Homo sapiens
gaacagtgctctgcc

SEQ ID NO: 2710648 - DNA, 18 bp, Homo sapiens
gaacagtgctctgcctct

SEQ ID NO: 2710649 - DNA, 15 bp, Homo sapiens
gaacagtttggatgt

SEQ ID NO: 2710650 - DNA, 19 bp, Homo sapiens
gaacatgcagctctgcagc

SEQ ID NO: 2710651 - DNA, 20 bp, Homo sapiens
gaacatggtgtgtgtctctg

SEQ ID NO: 2710652 - DNA, 22 bp, Homo sapiens
gaacatggtgtgtgtctctgac

SEQ ID NO: 2710653 - DNA, 15 bp, Homo sapiens
gaaccaggctgctgc

SEQ ID NO: 2710654 - DNA, 16 bp, Homo sapiens
gaaccaggctgctgca

SEQ ID NO: 2710655 - DNA, 15 bp, Homo sapiens
gaaccgtttacagtg

SEQ ID NO: 2710656 - DNA, 11 bp, Homo sapiens
gaacctcacct

SEQ ID NO: 2710657 - DNA, 14 bp, Homo sapiens
gaacctcaggcttc

SEQ ID NO: 2710658 - DNA, 14 bp, Homo sapiens
gaacgtgaataggc

SEQ ID NO: 2710659 - DNA, 15 bp, Homo sapiens
gaactattggagggt

SEQ ID NO: 2710660 - DNA, 22 bp, Homo sapiens
gaactattggagggtgggagag

SEQ ID NO: 2710661 - DNA, 14 bp, Homo sapiens
gaactccccagggc

SEQ ID NO: 2710662 - DNA, 22 bp, Homo sapiens
gaactccccagggcctccagga

SEQ ID NO: 2710663 - DNA, 11 bp, Homo sapiens
gaactcctgac

SEQ ID NO: 2710664 - DNA, 13 bp, Homo sapiens
gaactcctgacct

SEQ ID NO: 2710665 - DNA, 13 bp, Homo sapiens
gaactgagactgc

SEQ ID NO: 2710666 - DNA, 15 bp, Homo sapiens
gaactgtgctcccac

SEQ ID NO: 2710667 - DNA, 16 bp, Homo sapiens
gaactgtgctcccacg

SEQ ID NO: 2710668 - DNA, 18 bp, Homo sapiens
gaactgtgctcccacggg

SEQ ID NO: 2710669 - DNA, 22 bp, Homo sapiens
gaacttgctgctgagtgcacca

SEQ ID NO: 2710670 - DNA, 18 bp, Homo sapiens
gaagaactgcatggggag

SEQ ID NO: 2710671 - DNA, 23 bp, Homo sapiens
gaagaactttgccttaagtttcc

SEQ ID NO: 2710672 - DNA, 18 bp, Homo sapiens
gaagacttcaatattaaa

SEQ ID NO: 2710673 - DNA, 13 bp, Homo sapiens
gaagagaggcacc

SEQ ID NO: 2710674 - DNA, 20 bp, Homo sapiens
gaagagcacagccctcccgc

SEQ ID NO: 2710675 - DNA, 16 bp, Homo sapiens
gaagagccttcacatg

SEQ ID NO: 2710676 - DNA, 20 bp, Homo sapiens
gaagaggcaggtctgggcca

SEQ ID NO: 2710677 - DNA, 17 bp, Homo sapiens
gaagatctgcttccctg

SEQ ID NO: 2710678 - DNA, 22 bp, Homo sapiens
gaagatctgcttccctggggcc

SEQ ID NO: 2710679 - DNA, 15 bp, Homo sapiens
gaagcaaacacacag

SEQ ID NO: 2710680 - DNA, 22 bp, Homo sapiens
gaagcaaacacacagactctgt

SEQ ID NO: 2710681 - DNA, 18 bp, Homo sapiens
gaagcaagccggcagaaa

SEQ ID NO: 2710682 - DNA, 18 bp, Homo sapiens
gaagcagaaccagctcta

SEQ ID NO: 2710683 - DNA, 13 bp, Homo sapiens
gaagcagcaatta

SEQ ID NO: 2710684 - DNA, 15 bp, Homo sapiens
gaagccactgaagct

SEQ ID NO: 2710685 - DNA, 18 bp, Homo sapiens
gaagccactgaagctggg

SEQ ID NO: 2710686 - DNA, 20 bp, Homo sapiens
gaagccatattcacacctca

SEQ ID NO: 2710687 - DNA, 17 bp, Homo sapiens
gaagccctcggcctcca

SEQ ID NO: 2710688 - DNA, 23 bp, Homo sapiens
gaagccctcggcctccagactgc

SEQ ID NO: 2710689 - DNA, 13 bp, Homo sapiens
gaagcctgaggct

SEQ ID NO: 2710690 - DNA, 21 bp, Homo sapiens
gaaggaagcccgcggggagag

SEQ ID NO: 2710691 - DNA, 16 bp, Homo sapiens
gaagggcctgctctgc

SEQ ID NO: 2710692 - DNA, 20 bp, Homo sapiens
gaagggttttccaccctgga

SEQ ID NO: 2710693 - DNA, 18 bp, Homo sapiens
gaaggtatatcaggaggg

SEQ ID NO: 2710694 - DNA, 21 bp, Homo sapiens
gaaggtttttatgtgcctttt

SEQ ID NO: 2710695 - DNA, 15 bp, Homo sapiens
gaagtaactcccact

SEQ ID NO: 2710696 - DNA, 23 bp, Homo sapiens
gaagtagtggagcccctgctctg

SEQ ID NO: 2710697 - DNA, 16 bp, Homo sapiens
gaagtcattgtcgctc

SEQ ID NO: 2710698 - DNA, 20 bp, Homo sapiens
gaagtcattgtcgctcagca

SEQ ID NO: 2710699 - DNA, 15 bp, Homo sapiens
gaagtcttgcattga

SEQ ID NO: 2710700 - DNA, 22 bp, Homo sapiens
gaagtgacattgtaagaggtgg

SEQ ID NO: 2710701 - DNA, 14 bp, Homo sapiens
gaagtgattgaaag

SEQ ID NO: 2710702 - DNA, 16 bp, Homo sapiens
gaagtgtcgagtccag

SEQ ID NO: 2710703 - DNA, 17 bp, Homo sapiens
gaagtgtcgagtccagt

SEQ ID NO: 2710704 - DNA, 13 bp, Homo sapiens
gaagttacctgga

SEQ ID NO: 2710705 - DNA, 20 bp, Homo sapiens
gaagttacctggatgccatt

SEQ ID NO: 2710706 - DNA, 19 bp, Homo sapiens
gaagtttgggctaacattt

SEQ ID NO: 2710707 - DNA, 16 bp, Homo sapiens
gaagttttaactatgc

SEQ ID NO: 2710708 - DNA, 14 bp, Homo sapiens
gaataaaatactct

SEQ ID NO: 2710709 - DNA, 13 bp, Homo sapiens
gaataaaattgta

SEQ ID NO: 2710710 - DNA, 11 bp, Homo sapiens
gaataaacttc

SEQ ID NO: 2710711 - DNA, 13 bp, Homo sapiens
gaatagtctctgg

SEQ ID NO: 2710712 - DNA, 16 bp, Homo sapiens
gaatagtctctgggtt

SEQ ID NO: 2710713 - DNA, 23 bp, Homo sapiens
gaatattaagaaacaatttaaat

SEQ ID NO: 2710714 - DNA, 22 bp, Homo sapiens
gaatcccacccccacttcatgc

SEQ ID NO: 2710715 - DNA, 19 bp, Homo sapiens
gaatctgcagggagcaact

SEQ ID NO: 2710716 - DNA, 16 bp, Homo sapiens
gaatgaagcatgtagc

SEQ ID NO: 2710717 - DNA, 19 bp, Homo sapiens
gaatgcaatgtttctaaat

SEQ ID NO: 2710718 - DNA, 17 bp, Homo sapiens
gaatggcctgccttgaa

SEQ ID NO: 2710719 - DNA, 15 bp, Homo sapiens
gaatgtcccagaggc

SEQ ID NO: 2710720 - DNA, 22 bp, Homo sapiens
gaattacactcaaggaaaagat

SEQ ID NO: 2710721 - DNA, 14 bp, Homo sapiens
gaattacccttcct

SEQ ID NO: 2710722 - DNA, 19 bp, Homo sapiens
gaattacccttcctcatct

SEQ ID NO: 2710723 - DNA, 12 bp, Homo sapiens
gaattatatttt

SEQ ID NO: 2710724 - DNA, 17 bp, Homo sapiens
gaattgagagatgtttt

SEQ ID NO: 2710725 - DNA, 20 bp, Homo sapiens
gaattgcttgaacccaggag

SEQ ID NO: 2710726 - DNA, 21 bp, Homo sapiens
gaatttaatttataggcagat

SEQ ID NO: 2710727 - DNA, 19 bp, Homo sapiens
gaatttggagactctgtgg

SEQ ID NO: 2710728 - DNA, 13 bp, Homo sapiens
gaattttctttca

SEQ ID NO: 2710729 - DNA, 18 bp, Homo sapiens
gaattttgtaaaaagaaa

SEQ ID NO: 2710730 - DNA, 19 bp, Homo sapiens
gaattttgtaaaaagaaat

SEQ ID NO: 2710731 - DNA, 14 bp, Homo sapiens
gacaaacagtgaat

SEQ ID NO: 2710732 - DNA, 19 bp, Homo sapiens
gacaacatttttgtacatt

SEQ ID NO: 2710733 - DNA, 11 bp, Homo sapiens
gacaacccaga

SEQ ID NO: 2710734 - DNA, 18 bp, Homo sapiens
gagcaggggctgctgggg

SEQ ID NO: 2710735 - DNA, 20 bp, Homo sapiens
gagcaggggctgctgggggc

SEQ ID NO: 2710736 - DNA, 22 bp, Homo sapiens
gagcatggggataaaggagaag

SEQ ID NO: 2710737 - DNA, 17 bp, Homo sapiens
gagccactacctttgtc

SEQ ID NO: 2710738 - DNA, 12 bp, Homo sapiens
gagccagaggca

SEQ ID NO: 2710739 - DNA, 23 bp, Homo sapiens
gagcccaaacaccctcctggcac

SEQ ID NO: 2710740 - DNA, 21 bp, Homo sapiens
gagcccacgcccgactagcag

SEQ ID NO: 2710741 - DNA, 22 bp, Homo sapiens
gagcccagccattaccatggag

SEQ ID NO: 2710742 - DNA, 15 bp, Homo sapiens
gagcccgtgggggca

SEQ ID NO: 2710743 - DNA, 13 bp, Homo sapiens
gagccctggcagg

SEQ ID NO: 2710744 - DNA, 19 bp, Homo sapiens
gagccgagatcacgccact

SEQ ID NO: 2710745 - DNA, 13 bp, Homo sapiens
gagccgcagggcc

SEQ ID NO: 2710746 - DNA, 15 bp, Homo sapiens
gagccgcagggcctg

SEQ ID NO: 2710747 - DNA, 12 bp, Homo sapiens
gagcctcagctt

SEQ ID NO: 2710748 - DNA, 16 bp, Homo sapiens
gagcctcgtccaaggc

SEQ ID NO: 2710749 - DNA, 11 bp, Homo sapiens
gagcctctgcg

SEQ ID NO: 2710750 - DNA, 23 bp, Homo sapiens
gagcctgaaccgtgtgctcctcg

SEQ ID NO: 2710751 - DNA, 15 bp, Homo sapiens
gagcgaggaaaggat

SEQ ID NO: 2710752 - DNA, 19 bp, Homo sapiens
gagctactctcttgccagc

SEQ ID NO: 2710753 - DNA, 15 bp, Homo sapiens
gagctcctgtcccta

SEQ ID NO: 2710754 - DNA, 18 bp, Homo sapiens
gagctctctcttctctgt

SEQ ID NO: 2710755 - DNA, 16 bp, Homo sapiens
gagctgacagagccag

SEQ ID NO: 2710756 - DNA, 20 bp, Homo sapiens
gagctgacagagccagaggc

SEQ ID NO: 2710757 - DNA, 11 bp, Homo sapiens
gagctgcctcc

SEQ ID NO: 2710758 - DNA, 15 bp, Homo sapiens
gagctgcctccccaa

SEQ ID NO: 2710759 - DNA, 18 bp, Homo sapiens
gagctgcgggctgagggc

SEQ ID NO: 2710760 - DNA, 13 bp, Homo sapiens
gagctgctctgct

SEQ ID NO: 2710761 - DNA, 16 bp, Homo sapiens
gagctgctgagcagga

SEQ ID NO: 2710762 - DNA, 18 bp, Homo sapiens
gagctggcagcctccagt

SEQ ID NO: 2710763 - DNA, 21 bp, Homo sapiens
gagctggcctattttggacgt

SEQ ID NO: 2710764 - DNA, 13 bp, Homo sapiens
gagctggtgccag

SEQ ID NO: 2710765 - DNA, 15 bp, Homo sapiens
gagctgtcccctgga

SEQ ID NO: 2710766 - DNA, 19 bp, Homo sapiens
gagcttttcgaactgtgct

SEQ ID NO: 2710767 - DNA, 20 bp, Homo sapiens
gagcttttcgaactgtgctc

SEQ ID NO: 2710768 - DNA, 14 bp, Homo sapiens
gaggaaaggatttt

SEQ ID NO: 2710769 - DNA, 18 bp, Homo sapiens
gaggaggtggcagccctg

SEQ ID NO: 2710770 - DNA, 19 bp, Homo sapiens
gaggagtgtcctgtctgct

SEQ ID NO: 2710771 - DNA, 20 bp, Homo sapiens
gaggagtgtcctgtctgctg

SEQ ID NO: 2710772 - DNA, 19 bp, Homo sapiens
gaggatcccctgtcccctg

SEQ ID NO: 2710773 - DNA, 15 bp, Homo sapiens
gaggcacctgctgga

SEQ ID NO: 2710774 - DNA, 22 bp, Homo sapiens
gaggcactaagtcatggtcctg

SEQ ID NO: 2710775 - DNA, 21 bp, Homo sapiens
gaggcaggatatccccaggga

SEQ ID NO: 2710776 - DNA, 24 bp, Homo sapiens
gaggcaggatatccccagggaaac

SEQ ID NO: 2710777 - DNA, 14 bp, Homo sapiens
gaggcagtgggtcc

SEQ ID NO: 2710778 - DNA, 11 bp, Homo sapiens
gaggcccagcc

SEQ ID NO: 2710779 - DNA, 16 bp, Homo sapiens
gaggccggccctgccc

SEQ ID NO: 2710780 - DNA, 23 bp, Homo sapiens
gaggcctcccttgagtaggccct

SEQ ID NO: 2710781 - DNA, 14 bp, Homo sapiens
gaggcgcgtctgcc

SEQ ID NO: 2710782 - DNA, 20 bp, Homo sapiens
gaggcggccccggccggggt

SEQ ID NO: 2710783 - DNA, 12 bp, Homo sapiens
gaggcgggtgga

SEQ ID NO: 2710784 - DNA, 13 bp, Homo sapiens
gaggctcctgtcc

SEQ ID NO: 2710785 - DNA, 16 bp, Homo sapiens
gaggctgcagcgagct

SEQ ID NO: 2710786 - DNA, 19 bp, Homo sapiens
gaggctggcatcctggctg

SEQ ID NO: 2710787 - DNA, 23 bp, Homo sapiens
gaggctggcatcctggctggctg

SEQ ID NO: 2710788 - DNA, 15 bp, Homo sapiens
gaggcttcaggggac

SEQ ID NO: 2710789 - DNA, 12 bp, Homo sapiens
gagggaaaagct

SEQ ID NO: 2710790 - DNA, 16 bp, Homo sapiens
gagggaaaagctaaga

SEQ ID NO: 2710791 - DNA, 15 bp, Homo sapiens
gagggagctgaggcc

SEQ ID NO: 2710792 - DNA, 20 bp, Homo sapiens
gagggatgctgcctgagtca

SEQ ID NO: 2710793 - DNA, 15 bp, Homo sapiens
gagggcatctctgag

SEQ ID NO: 2710794 - DNA, 17 bp, Homo sapiens
gaggggcccgcttgcct

SEQ ID NO: 2710795 - DNA, 12 bp, Homo sapiens
gaggggctcctg

SEQ ID NO: 2710796 - DNA, 14 bp, Homo sapiens
gaggggctcctgga

SEQ ID NO: 2710797 - DNA, 15 bp, Homo sapiens
gaggggctcctggaa

SEQ ID NO: 2710798 - DNA, 17 bp, Homo sapiens
gaggggctttctggaga

SEQ ID NO: 2710799 - DNA, 20 bp, Homo sapiens
gagggttgtgcccacttcat

SEQ ID NO: 2710800 - DNA, 16 bp, Homo sapiens
gaggtagcgagctgct

SEQ ID NO: 2710801 - DNA, 19 bp, Homo sapiens
gaggtagcgagctgctctg

SEQ ID NO: 2710802 - DNA, 17 bp, Homo sapiens
gaggtctcgctgatgct

SEQ ID NO: 2710803 - DNA, 23 bp, Homo sapiens
gaggtctcgctgatgctgggctg

SEQ ID NO: 2710804 - DNA, 19 bp, Homo sapiens
gaggtggagggtagccctg

SEQ ID NO: 2710805 - DNA, 16 bp, Homo sapiens
gaggtggcagccctgt

SEQ ID NO: 2710806 - DNA, 23 bp, Homo sapiens
gaggtggtggggaccagctaatt

SEQ ID NO: 2710807 - DNA, 19 bp, Homo sapiens
gaggttgcagggagccgag

SEQ ID NO: 2710808 - DNA, 23 bp, Homo sapiens
gagtatctcggacctttcagctg

SEQ ID NO: 2710809 - DNA, 14 bp, Homo sapiens
gagtcaaagctgac

SEQ ID NO: 2710810 - DNA, 20 bp, Homo sapiens
gagtcacccatgaagacagg

SEQ ID NO: 2710811 - DNA, 14 bp, Homo sapiens
gagtctctccagcc

SEQ ID NO: 2710812 - DNA, 17 bp, Homo sapiens
gagtctctggctcagct

SEQ ID NO: 2710813 - DNA, 21 bp, Homo sapiens
gagtctctggctcagctgtgg

SEQ ID NO: 2710814 - DNA, 22 bp, Homo sapiens
gagtctctggctcagctgtggt

SEQ ID NO: 2710815 - DNA, 18 bp, Homo sapiens
gagtctgctatattttca

SEQ ID NO: 2710816 - DNA, 19 bp, Homo sapiens
gagtcttcactgctctgcc

SEQ ID NO: 2710817 - DNA, 21 bp, Homo sapiens
gagtgggggctgtgccgtgaa

SEQ ID NO: 2710818 - DNA, 14 bp, Homo sapiens
gagtgtaacatcca

SEQ ID NO: 2710819 - DNA, 23 bp, Homo sapiens
gagttattttaattatcttttct

SEQ ID NO: 2710820 - DNA, 20 bp, Homo sapiens
gagttcgagaccagcctggc

SEQ ID NO: 2710821 - DNA, 17 bp, Homo sapiens
gagttcttgcaccctca

SEQ ID NO: 2710822 - DNA, 12 bp, Homo sapiens
gagttctttgca

SEQ ID NO: 2710823 - DNA, 19 bp, Homo sapiens
gagttgcaccattctttct

SEQ ID NO: 2710824 - DNA, 20 bp, Homo sapiens
gagttgcaccattctttctt

SEQ ID NO: 2710825 - DNA, 18 bp, Homo sapiens
gataaaagaaccccagac

SEQ ID NO: 2710826 - DNA, 13 bp, Homo sapiens
gataatgtattgc

SEQ ID NO: 2710827 - DNA, 17 bp, Homo sapiens
gatactttaatttttat

SEQ ID NO: 2710828 - DNA, 16 bp, Homo sapiens
gatagacgggttgaaa

SEQ ID NO: 2710829 - DNA, 19 bp, Homo sapiens
gatagacgggttgaaagac

SEQ ID NO: 2710830 - DNA, 20 bp, Homo sapiens
gatagacgggttgaaagaca

SEQ ID NO: 2710831 - DNA, 21 bp, Homo sapiens
gatagacgggttgaaagacat

SEQ ID NO: 2710832 - DNA, 14 bp, Homo sapiens
gatatgcagaagga

SEQ ID NO: 2710833 - DNA, 19 bp, Homo sapiens
gatattggttctatttatt

SEQ ID NO: 2710834 - DNA, 20 bp, Homo sapiens
gatatttaaaagacaaacac

SEQ ID NO: 2710835 - DNA, 14 bp, Homo sapiens
gatcacctgaggtt

SEQ ID NO: 2710836 - DNA, 23 bp, Homo sapiens
gatcacgccactgcactccagcc

SEQ ID NO: 2710837 - DNA, 18 bp, Homo sapiens
gatcactggagcccagga

SEQ ID NO: 2710838 - DNA, 15 bp, Homo sapiens
gatccaggcttctcc

SEQ ID NO: 2710839 - DNA, 12 bp, Homo sapiens
gatccagtctgc

SEQ ID NO: 2710840 - DNA, 16 bp, Homo sapiens
gatccagtctgcagac

SEQ ID NO: 2710841 - DNA, 23 bp, Homo sapiens
gatcccccaagtgtcctggaccc

SEQ ID NO: 2710842 - DNA, 13 bp, Homo sapiens
gatcccctgtccc

SEQ ID NO: 2710843 - DNA, 20 bp, Homo sapiens
gatcccctgtcccctggggc

SEQ ID NO: 2710844 - DNA, 23 bp, Homo sapiens
gatcccctgtcccctggggctgg

SEQ ID NO: 2710845 - DNA, 23 bp, Homo sapiens
gatcgcgccactacactccagcc

SEQ ID NO: 2710846 - DNA, 20 bp, Homo sapiens
gatcggagcctcctctctca

SEQ ID NO: 2710847 - DNA, 22 bp, Homo sapiens
gatctagttctcaatcactgct

SEQ ID NO: 2710848 - DNA, 13 bp, Homo sapiens
gatctcctgagct

SEQ ID NO: 2710849 - DNA, 15 bp, Homo sapiens
gatctcggctcactg

SEQ ID NO: 2710850 - DNA, 11 bp, Homo sapiens
gatctctgctt

SEQ ID NO: 2710851 - DNA, 22 bp, Homo sapiens
gatctgcccgcctcggcctccc

SEQ ID NO: 2710852 - DNA, 19 bp, Homo sapiens
gatctgcttccctggggcc

SEQ ID NO: 2710853 - DNA, 16 bp, Homo sapiens
gatctttaaatacagt

SEQ ID NO: 2710854 - DNA, 20 bp, Homo sapiens
gatctttctttccaaaacat

SEQ ID NO: 2710855 - DNA, 14 bp, Homo sapiens
gatcttttgtaaat

SEQ ID NO: 2710856 - DNA, 18 bp, Homo sapiens
gatgaaaactaaggattt

SEQ ID NO: 2710857 - DNA, 23 bp, Homo sapiens
gatgaccctgcgaaggggccctg

SEQ ID NO: 2710858 - DNA, 16 bp, Homo sapiens
gtctctgcctggagca

SEQ ID NO: 2710859 - DNA, 14 bp, Homo sapiens
gtctctgctgcatt

SEQ ID NO: 2710860 - DNA, 22 bp, Homo sapiens
gtctctgctgcatttgtgtcat

SEQ ID NO: 2710861 - DNA, 16 bp, Homo sapiens
gtctctggattcctgt

SEQ ID NO: 2710862 - DNA, 17 bp, Homo sapiens
gtctctggctcagctgt

SEQ ID NO: 2710863 - DNA, 20 bp, Homo sapiens
gtctctggctcagctgtggt

SEQ ID NO: 2710864 - DNA, 21 bp, Homo sapiens
gtctctggctcagctgtggtc

SEQ ID NO: 2710865 - DNA, 14 bp, Homo sapiens
gtctgactttctct

SEQ ID NO: 2710866 - DNA, 15 bp, Homo sapiens
gtctgaggccccagg

SEQ ID NO: 2710867 - DNA, 15 bp, Homo sapiens
gtctgcagctcctgg

SEQ ID NO: 2710868 - DNA, 15 bp, Homo sapiens
gtctgctatattttc

SEQ ID NO: 2710869 - DNA, 18 bp, Homo sapiens
gtctgctatattttcatg

SEQ ID NO: 2710870 - DNA, 19 bp, Homo sapiens
gtctgctcgggcccaggcc

SEQ ID NO: 2710871 - DNA, 22 bp, Homo sapiens
gtctgctcgggcccaggccatc

SEQ ID NO: 2710872 - DNA, 14 bp, Homo sapiens
gtctgctcttattt

SEQ ID NO: 2710873 - DNA, 13 bp, Homo sapiens
gtctgtccaaccc

SEQ ID NO: 2710874 - DNA, 18 bp, Homo sapiens
gtctgtccaacccctccc

SEQ ID NO: 2710875 - DNA, 20 bp, Homo sapiens
gtctgtccaacccctccccc

SEQ ID NO: 2710876 - DNA, 14 bp, Homo sapiens
gtcttatttcctca

SEQ ID NO: 2710877 - DNA, 19 bp, Homo sapiens
gtcttccaaccccagctgg

SEQ ID NO: 2710878 - DNA, 20 bp, Homo sapiens
gtcttccaaccccagctggc

SEQ ID NO: 2710879 - DNA, 19 bp, Homo sapiens
gtcttgaaacctttctact

SEQ ID NO: 2710880 - DNA, 21 bp, Homo sapiens
gtcttgacctgaactctgcaa

SEQ ID NO: 2710881 - DNA, 13 bp, Homo sapiens
gtctttctttgct

SEQ ID NO: 2710882 - DNA, 22 bp, Homo sapiens
gtctttctttgctgctgtggaa

SEQ ID NO: 2710883 - DNA, 19 bp, Homo sapiens
gtctttggcttcagaattg

SEQ ID NO: 2710884 - DNA, 16 bp, Homo sapiens
gtcttttacatacagt

SEQ ID NO: 2710885 - DNA, 16 bp, Homo sapiens
gtgaaaacactcgtgt

SEQ ID NO: 2710886 - DNA, 21 bp, Homo sapiens
gtgaaagagagtaccatgctg

SEQ ID NO: 2710887 - DNA, 13 bp, Homo sapiens
gtgaaagctgcac

SEQ ID NO: 2710888 - DNA, 21 bp, Homo sapiens
gtgaaagtcagatgcccagag

SEQ ID NO: 2710889 - DNA, 15 bp, Homo sapiens
gtgaacaaagaaaag

SEQ ID NO: 2710890 - DNA, 11 bp, Homo sapiens
gtgaacagctt

SEQ ID NO: 2710891 - DNA, 18 bp, Homo sapiens
gtgaactgcgtgccagtg

SEQ ID NO: 2710892 - DNA, 18 bp, Homo sapiens
gtgaataaacttcagcac

SEQ ID NO: 2710893 - DNA, 17 bp, Homo sapiens
gtgaatttaagcatgag

SEQ ID NO: 2710894 - DNA, 20 bp, Homo sapiens
gtgacaacatttttgtacat

SEQ ID NO: 2710895 - DNA, 13 bp, Homo sapiens
gtgaccagccccg

SEQ ID NO: 2710896 - DNA, 20 bp, Homo sapiens
gtgacggactcagactcctg

SEQ ID NO: 2710897 - DNA, 16 bp, Homo sapiens
gtgacgtgactcagag

SEQ ID NO: 2710898 - DNA, 13 bp, Homo sapiens
gtgactcagagct

SEQ ID NO: 2710899 - DNA, 19 bp, Homo sapiens
gtgactcgggctcctgtgc

SEQ ID NO: 2710900 - DNA, 21 bp, Homo sapiens
gtgacttcctcgcctctccca

SEQ ID NO: 2710901 - DNA, 15 bp, Homo sapiens
gtgacttcctggtga

SEQ ID NO: 2710902 - DNA, 16 bp, Homo sapiens
gtgacttgcctggggc

SEQ ID NO: 2710903 - DNA, 14 bp, Homo sapiens
gtgagaaatttttt

SEQ ID NO: 2710904 - DNA, 16 bp, Homo sapiens
gtgagaagggcctgct

SEQ ID NO: 2710905 - DNA, 19 bp, Homo sapiens
gtgagaagggcctgctctg

SEQ ID NO: 2710906 - DNA, 11 bp, Homo sapiens
gtgagagagga

SEQ ID NO: 2710907 - DNA, 16 bp, Homo sapiens
gtgagagtcaaagctg

SEQ ID NO: 2710908 - DNA, 13 bp, Homo sapiens
gtgagattctaaa

SEQ ID NO: 2710909 - DNA, 21 bp, Homo sapiens
gtgagcaacatttattattta

SEQ ID NO: 2710910 - DNA, 17 bp, Homo sapiens
gtgagcagaggagtcca

SEQ ID NO: 2710911 - DNA, 13 bp, Homo sapiens
gtgaggcagtggg

SEQ ID NO: 2710912 - DNA, 23 bp, Homo sapiens
gtgaggcagtgggtcccacttcc

SEQ ID NO: 2710913 - DNA, 23 bp, Homo sapiens
gtgaggcccagcctgtcctggta

SEQ ID NO: 2710914 - DNA, 19 bp, Homo sapiens
gtgaggccggccctgcccc

SEQ ID NO: 2710915 - DNA, 22 bp, Homo sapiens
gtgaggccggccctgcccctcc

SEQ ID NO: 2710916 - DNA, 23 bp, Homo sapiens
gtgaggtgacttgcctggggcca

SEQ ID NO: 2710917 - DNA, 16 bp, Homo sapiens
gtgagtggcatgtggg

SEQ ID NO: 2710918 - DNA, 22 bp, Homo sapiens
gtgatatggtactaaggagaat

SEQ ID NO: 2710919 - DNA, 21 bp, Homo sapiens
gtgatctgcccgcctcggcct

SEQ ID NO: 2710920 - DNA, 18 bp, Homo sapiens
gtgatggttgattcacac

SEQ ID NO: 2710921 - DNA, 14 bp, Homo sapiens
gtgcaactcttgta

SEQ ID NO: 2710922 - DNA, 16 bp, Homo sapiens
gtgcacagcttcctga

SEQ ID NO: 2710923 - DNA, 18 bp, Homo sapiens
gtgcacctgtactcagga

SEQ ID NO: 2710924 - DNA, 18 bp, Homo sapiens
gtgcagacagtgtcagag

SEQ ID NO: 2710925 - DNA, 17 bp, Homo sapiens
gtgcagaggtgagcaga

SEQ ID NO: 2710926 - DNA, 12 bp, Homo sapiens
gtgccaccctgg

SEQ ID NO: 2710927 - DNA, 14 bp, Homo sapiens
gtgccaccctgggc

SEQ ID NO: 2710928 - DNA, 20 bp, Homo sapiens
gtgccaccctgggctctgtg

SEQ ID NO: 2710929 - DNA, 17 bp, Homo sapiens
gtgccaggctgtaagca

SEQ ID NO: 2710930 - DNA, 21 bp, Homo sapiens
gtgccagtcgcgctgcctgtg

SEQ ID NO: 2710931 - DNA, 22 bp, Homo sapiens
gtgccagtcgcgctgcctgtgt

SEQ ID NO: 2710932 - DNA, 17 bp, Homo sapiens
gtgccccccatcctggc

SEQ ID NO: 2710933 - DNA, 19 bp, Homo sapiens
gtgccccccatcctggccc

SEQ ID NO: 2710934 - DNA, 20 bp, Homo sapiens
gtgccctctggacagcttga

SEQ ID NO: 2710935 - DNA, 18 bp, Homo sapiens
gtgccggtaccagcctga

SEQ ID NO: 2710936 - DNA, 18 bp, Homo sapiens
gtgcctgattcggctgtc

SEQ ID NO: 2710937 - DNA, 21 bp, Homo sapiens
gtgcctgattcggctgtctca

SEQ ID NO: 2710938 - DNA, 22 bp, Homo sapiens
gtgcctgattcggctgtctcag

SEQ ID NO: 2710939 - DNA, 14 bp, Homo sapiens
gtgcctggcaaggc

SEQ ID NO: 2710940 - DNA, 18 bp, Homo sapiens
gtgctcagcagccccacc

SEQ ID NO: 2710941 - DNA, 14 bp, Homo sapiens
gtgctcgcctctgc

SEQ ID NO: 2710942 - DNA, 17 bp, Homo sapiens
gtgctgctaccctccct

SEQ ID NO: 2710943 - DNA, 22 bp, Homo sapiens
gtgctgctaccctccctgctgt

SEQ ID NO: 2710944 - DNA, 23 bp, Homo sapiens
gtgctgctaccctccctgctgtc

SEQ ID NO: 2710945 - DNA, 17 bp, Homo sapiens
gtgctgctgtggcatca

SEQ ID NO: 2710946 - DNA, 17 bp, Homo sapiens
gtgctgtggcctgggca

SEQ ID NO: 2710947 - DNA, 13 bp, Homo sapiens
gtggaaactggat

SEQ ID NO: 2710948 - DNA, 15 bp, Homo sapiens
gtggaaagcctctgc

SEQ ID NO: 2710949 - DNA, 23 bp, Homo sapiens
gtggaaagcctctgctgccatgg

SEQ ID NO: 2710950 - DNA, 23 bp, Homo sapiens
gtggaattggagaaaagcacaat

SEQ ID NO: 2710951 - DNA, 16 bp, Homo sapiens
gtggacagtcctggga

SEQ ID NO: 2710952 - DNA, 18 bp, Homo sapiens
gtggactctctgcctgct

SEQ ID NO: 2710953 - DNA, 18 bp, Homo sapiens
gtggagttctctgttcta

SEQ ID NO: 2710954 - DNA, 15 bp, Homo sapiens
gtggatcacctgagg

SEQ ID NO: 2710955 - DNA, 22 bp, Homo sapiens
gtggatggtgacttttgaagaa

SEQ ID NO: 2710956 - DNA, 14 bp, Homo sapiens
gtggcagccctgta

SEQ ID NO: 2710957 - DNA, 20 bp, Homo sapiens
gtggcattctctctgctcag

SEQ ID NO: 2710958 - DNA, 18 bp, Homo sapiens
gtggcattggcagcaggt

SEQ ID NO: 2710959 - DNA, 21 bp, Homo sapiens
gtggcccatcccccctcacca

SEQ ID NO: 2710960 - DNA, 12 bp, Homo sapiens
gtggccccagcc

SEQ ID NO: 2710961 - DNA, 15 bp, Homo sapiens
gtggccccagcctgg

SEQ ID NO: 2710962 - DNA, 16 bp, Homo sapiens
gtggccccagcctggc

SEQ ID NO: 2710963 - DNA, 12 bp, Homo sapiens
gtggcctgggca

SEQ ID NO: 2710964 - DNA, 22 bp, Homo sapiens
gtggctccagaatgtgctgcct

SEQ ID NO: 2710965 - DNA, 17 bp, Homo sapiens
gtggctgggaagggaag

SEQ ID NO: 2710966 - DNA, 22 bp, Homo sapiens
gtggctgggaagggaaggaagc

SEQ ID NO: 2710967 - DNA, 17 bp, Homo sapiens
gtggctgtccagtgccc

SEQ ID NO: 2710968 - DNA, 12 bp, Homo sapiens
gtgggaacattc

SEQ ID NO: 2710969 - DNA, 13 bp, Homo sapiens
gtgggagagccca

SEQ ID NO: 2710970 - DNA, 14 bp, Homo sapiens
gtgggagagcccag

SEQ ID NO: 2710971 - DNA, 22 bp, Homo sapiens
gtgggcggatcacttgaggtcg

SEQ ID NO: 2710972 - DNA, 20 bp, Homo sapiens
gtgggctcagatcctgggca

SEQ ID NO: 2710973 - DNA, 19 bp, Homo sapiens
gtggggcagcagctgcctc

SEQ ID NO: 2710974 - DNA, 22 bp, Homo sapiens
gtgggggaagagcacagccctc

SEQ ID NO: 2710975 - DNA, 16 bp, Homo sapiens
gtgggttagctacctg

SEQ ID NO: 2710976 - DNA, 17 bp, Homo sapiens
gtgggttgtgatattga

SEQ ID NO: 2710977 - DNA, 14 bp, Homo sapiens
gtggtagaagccag

SEQ ID NO: 2710978 - DNA, 22 bp, Homo sapiens
gtggtctgctcgggcccaggcc

SEQ ID NO: 2710979 - DNA, 17 bp, Homo sapiens
gtgtacccccgcccagg

SEQ ID NO: 2710980 - DNA, 14 bp, Homo sapiens
gtgtagccaaggtc

SEQ ID NO: 2710981 - DNA, 17 bp, Homo sapiens
tagtgccctccacagcc

SEQ ID NO: 2710982 - DNA, 13 bp, Homo sapiens
tagtggctgtcca

SEQ ID NO: 2710983 - DNA, 20 bp, Homo sapiens
tagtgtcttcctagtatatt

SEQ ID NO: 2710984 - DNA, 19 bp, Homo sapiens
tagttgaaaaaagaagttt

SEQ ID NO: 2710985 - DNA, 21 bp, Homo sapiens
tagttgtctttctttgctgct

SEQ ID NO: 2710986 - DNA, 22 bp, Homo sapiens
tataaacctctaatttattttg

SEQ ID NO: 2710987 - DNA, 17 bp, Homo sapiens
tataaattatgaaggac

SEQ ID NO: 2710988 - DNA, 16 bp, Homo sapiens
tataagcaagacagtg

SEQ ID NO: 2710989 - DNA, 18 bp, Homo sapiens
tataattttattgctgga

SEQ ID NO: 2710990 - DNA, 12 bp, Homo sapiens
tatacataaaca

SEQ ID NO: 2710991 - DNA, 14 bp, Homo sapiens
tatacataaacagt

SEQ ID NO: 2710992 - DNA, 21 bp, Homo sapiens
tatagagatatgcagaaggaa

SEQ ID NO: 2710993 - DNA, 21 bp, Homo sapiens
tatagctagctatttctatgt

SEQ ID NO: 2710994 - DNA, 19 bp, Homo sapiens
tatagttgtctttctttgc

SEQ ID NO: 2710995 - DNA, 14 bp, Homo sapiens
tatataaagaaaat

SEQ ID NO: 2710996 - DNA, 12 bp, Homo sapiens
tatatatcataa

SEQ ID NO: 2710997 - DNA, 22 bp, Homo sapiens
tatatattctacacatatatgt

SEQ ID NO: 2710998 - DNA, 13 bp, Homo sapiens
tatatcaggaggg

SEQ ID NO: 2710999 - DNA, 14 bp, Homo sapiens
tatatcataaagta

SEQ ID NO: 2711000 - DNA, 17 bp, Homo sapiens
tatatctttatgcaaaa

SEQ ID NO: 2711001 - DNA, 20 bp, Homo sapiens
tatatctttatgcaaaaaca

SEQ ID NO: 2711002 - DNA, 22 bp, Homo sapiens
tatatctttatgcaaaaacata

SEQ ID NO: 2711003 - DNA, 15 bp, Homo sapiens
tatatgtatatgtat

SEQ ID NO: 2711004 - DNA, 20 bp, Homo sapiens
tatatttatcatatttaata

SEQ ID NO: 2711005 - DNA, 23 bp, Homo sapiens
tatattttcatgacttttccatg

SEQ ID NO: 2711006 - DNA, 17 bp, Homo sapiens
tatcaatccttgttcag

SEQ ID NO: 2711007 - DNA, 16 bp, Homo sapiens
tatcagatttcattaa

SEQ ID NO: 2711008 - DNA, 15 bp, Homo sapiens
tatcagtgtgccccc

SEQ ID NO: 2711009 - DNA, 11 bp, Homo sapiens
tatcataaagt

SEQ ID NO: 2711010 - DNA, 12 bp, Homo sapiens
tatcataaagta

SEQ ID NO: 2711011 - DNA, 13 bp, Homo sapiens
tatcataaagtat

SEQ ID NO: 2711012 - DNA, 11 bp, Homo sapiens
tatccagtcta

SEQ ID NO: 2711013 - DNA, 20 bp, Homo sapiens
tatcgcaccactgtgtattt

SEQ ID NO: 2711014 - DNA, 16 bp, Homo sapiens
tatctaacattttcta

SEQ ID NO: 2711015 - DNA, 21 bp, Homo sapiens
tatctacccagtcatgtactg

SEQ ID NO: 2711016 - DNA, 15 bp, Homo sapiens
tatctatatctctaa

SEQ ID NO: 2711017 - DNA, 19 bp, Homo sapiens
tatctctagtccctgtgtt

SEQ ID NO: 2711018 - DNA, 22 bp, Homo sapiens
tatctctagtccctgtgttctg

SEQ ID NO: 2711019 - DNA, 21 bp, Homo sapiens
tatctgcaatgtttttgtgta

SEQ ID NO: 2711020 - DNA, 23 bp, Homo sapiens
tatctgcaatgtttttgtgtaga

SEQ ID NO: 2711021 - DNA, 12 bp, Homo sapiens
tatctgcatgta

SEQ ID NO: 2711022 - DNA, 21 bp, Homo sapiens
tatctgcatgtaaaatcttca

SEQ ID NO: 2711023 - DNA, 11 bp, Homo sapiens
tatctggtatc

SEQ ID NO: 2711024 - DNA, 23 bp, Homo sapiens
tatctgtggattcagcttctgtt

SEQ ID NO: 2711025 - DNA, 17 bp, Homo sapiens
tatctttgtctaaacaa

SEQ ID NO: 2711026 - DNA, 22 bp, Homo sapiens
tatctttttgcttacagtttta

SEQ ID NO: 2711027 - DNA, 19 bp, Homo sapiens
tatgaccacagagttatat

SEQ ID NO: 2711028 - DNA, 17 bp, Homo sapiens
tatgagaagtactttgt

SEQ ID NO: 2711029 - DNA, 16 bp, Homo sapiens
tatgagactgtgtttc

SEQ ID NO: 2711030 - DNA, 18 bp, Homo sapiens
tatgagactgtgtttcta

SEQ ID NO: 2711031 - DNA, 19 bp, Homo sapiens
tatgatataataaatatat

SEQ ID NO: 2711032 - DNA, 13 bp, Homo sapiens
tatgatgctattt

SEQ ID NO: 2711033 - DNA, 12 bp, Homo sapiens
tatgattgcact

SEQ ID NO: 2711034 - DNA, 23 bp, Homo sapiens
tatgatttttaaagaaaagtttt

SEQ ID NO: 2711035 - DNA, 16 bp, Homo sapiens
tatgcaaggggaaacc

SEQ ID NO: 2711036 - DNA, 13 bp, Homo sapiens
tatgcaagtggga

SEQ ID NO: 2711037 - DNA, 15 bp, Homo sapiens
tatgcaagtgggaga

SEQ ID NO: 2711038 - DNA, 23 bp, Homo sapiens
tatgcaagtgggagatgaaaacc

SEQ ID NO: 2711039 - DNA, 21 bp, Homo sapiens
tatggacatcgatatgaaaaa

SEQ ID NO: 2711040 - DNA, 20 bp, Homo sapiens
tatggatatttttaatttat

SEQ ID NO: 2711041 - DNA, 21 bp, Homo sapiens
tatggcccagccactgcagca

SEQ ID NO: 2711042 - DNA, 23 bp, Homo sapiens
tatgtacagttcataaatttgtt

SEQ ID NO: 2711043 - DNA, 17 bp, Homo sapiens
tatgtctgtctttgcaa

SEQ ID NO: 2711044 - DNA, 20 bp, Homo sapiens
tatgttaatatctgatactg

SEQ ID NO: 2711045 - DNA, 22 bp, Homo sapiens
tatgttaatatctgatactgta

SEQ ID NO: 2711046 - DNA, 19 bp, Homo sapiens
tatgttacttaaacatcat

SEQ ID NO: 2711047 - DNA, 13 bp, Homo sapiens
tatgttagagagg

SEQ ID NO: 2711048 - DNA, 18 bp, Homo sapiens
tattaaaaaaacacaaaa

SEQ ID NO: 2711049 - DNA, 21 bp, Homo sapiens
tattaagaatagtctctgggt

SEQ ID NO: 2711050 - DNA, 15 bp, Homo sapiens
tattaagatttccaa

SEQ ID NO: 2711051 - DNA, 19 bp, Homo sapiens
tattaatataaccataaat

SEQ ID NO: 2711052 - DNA, 19 bp, Homo sapiens
tattagccagtcattgtaa

SEQ ID NO: 2711053 - DNA, 21 bp, Homo sapiens
tattattactttttaaaatgt

SEQ ID NO: 2711054 - DNA, 17 bp, Homo sapiens
tattattttttccacat

SEQ ID NO: 2711055 - DNA, 16 bp, Homo sapiens
tattcatgctttctcc

SEQ ID NO: 2711056 - DNA, 23 bp, Homo sapiens
tattcccatggtagactgtgaca

SEQ ID NO: 2711057 - DNA, 22 bp, Homo sapiens
tattctacacatatatgtatat

SEQ ID NO: 2711058 - DNA, 15 bp, Homo sapiens
tattctcctccctgt

SEQ ID NO: 2711059 - DNA, 16 bp, Homo sapiens
tattctcctccctgtt

SEQ ID NO: 2711060 - DNA, 20 bp, Homo sapiens
tattcttttcaaatatttgt

SEQ ID NO: 2711061 - DNA, 18 bp, Homo sapiens
tattgagcgtgattctgt

SEQ ID NO: 2711062 - DNA, 22 bp, Homo sapiens
tattgctgctggtaatttgtat

SEQ ID NO: 2711063 - DNA, 14 bp, Homo sapiens
tattggaattttct

SEQ ID NO: 2711064 - DNA, 13 bp, Homo sapiens
tattggttctatt

SEQ ID NO: 2711065 - DNA, 18 bp, Homo sapiens
tattgtatatatggatat

SEQ ID NO: 2711066 - DNA, 22 bp, Homo sapiens
tattgtgatttcccgtggcccc

SEQ ID NO: 2711067 - DNA, 16 bp, Homo sapiens
tattgtgttggcttta

SEQ ID NO: 2711068 - DNA, 22 bp, Homo sapiens
tattgtttattctttttaaagt

SEQ ID NO: 2711069 - DNA, 13 bp, Homo sapiens
tatttaaagcaca

SEQ ID NO: 2711070 - DNA, 21 bp, Homo sapiens
tatttaactgccttgtgtaca

SEQ ID NO: 2711071 - DNA, 14 bp, Homo sapiens
tatttaacttgagg

SEQ ID NO: 2711072 - DNA, 20 bp, Homo sapiens
tatttaatgatttttgtgta

SEQ ID NO: 2711073 - DNA, 21 bp, Homo sapiens
tatttacatgaattgcatttt

SEQ ID NO: 2711074 - DNA, 19 bp, Homo sapiens
tatttatattcatcaaata

SEQ ID NO: 2711075 - DNA, 17 bp, Homo sapiens
tatttatcatatttaat

SEQ ID NO: 2711076 - DNA, 21 bp, Homo sapiens
tatttatgtaggatctgtcaa

SEQ ID NO: 2711077 - DNA, 21 bp, Homo sapiens
tatttattgtatatatggata

SEQ ID NO: 2711078 - DNA, 11 bp, Homo sapiens
tatttccatgg

SEQ ID NO: 2711079 - DNA, 22 bp, Homo sapiens
tatttcctttgcgcaaacttta

SEQ ID NO: 2711080 - DNA, 17 bp, Homo sapiens
tatttgactttttcaca

SEQ ID NO: 2711081 - DNA, 15 bp, Homo sapiens
tatttgataacattt

SEQ ID NO: 2711082 - DNA, 19 bp, Homo sapiens
tatttgtacagttcagttc

SEQ ID NO: 2711083 - DNA, 23 bp, Homo sapiens
tatttgtcggggaagatgaaacc

SEQ ID NO: 2711084 - DNA, 15 bp, Homo sapiens
tattttacagtctct

SEQ ID NO: 2711085 - DNA, 20 bp, Homo sapiens
tattttacagtctctgttgt

SEQ ID NO: 2711086 - DNA, 15 bp, Homo sapiens
tattttagagaatgg

SEQ ID NO: 2711087 - DNA, 20 bp, Homo sapiens
tatttttgaaagaattctat

SEQ ID NO: 2711088 - DNA, 12 bp, Homo sapiens
tatttttgtacc

SEQ ID NO: 2711089 - DNA, 15 bp, Homo sapiens
tattttttatttcca

SEQ ID NO: 2711090 - DNA, 18 bp, Homo sapiens
tattttttatttccacat

SEQ ID NO: 2711091 - DNA, 18 bp, Homo sapiens
tcaaaagacacctgcctt

SEQ ID NO: 2711092 - DNA, 19 bp, Homo sapiens
tcaaactggggcctccctg

SEQ ID NO: 2711093 - DNA, 20 bp, Homo sapiens
tcaaagaaaaccctaagtgt

SEQ ID NO: 2711094 - DNA, 19 bp, Homo sapiens
tcaaagaaatttccactca

SEQ ID NO: 2711095 - DNA, 15 bp, Homo sapiens
tcaaatgagaaaatg

SEQ ID NO: 2711096 - DNA, 14 bp, Homo sapiens
tcaacactcttctt

SEQ ID NO: 2711097 - DNA, 15 bp, Homo sapiens
tcaagacttccagag

SEQ ID NO: 2711098 - DNA, 21 bp, Homo sapiens
tcaagagatctttctttccaa

SEQ ID NO: 2711099 - DNA, 16 bp, Homo sapiens
tcaagagtctctccag

SEQ ID NO: 2711100 - DNA, 18 bp, Homo sapiens
tcaagagtctctccagcc

SEQ ID NO: 2711101 - DNA, 20 bp, Homo sapiens
tcaagagtctctccagcctc

SEQ ID NO: 2711102 - DNA, 23 bp, Homo sapiens
tcaagatccaaatgctgtgcaaa

SEQ ID NO: 2711103 - DNA, 22 bp, Homo sapiens
tcaagcaggtttcttgcttctg

SEQ ID NO: 2711104 - DNA, 17 bp, Homo sapiens
tcctgaaagtcatttaa

SEQ ID NO: 2711105 - DNA, 21 bp, Homo sapiens
tcctgacccggattggccctg

SEQ ID NO: 2711106 - DNA, 16 bp, Homo sapiens
tcctgacttcaggggc

SEQ ID NO: 2711107 - DNA, 21 bp, Homo sapiens
tcctgacttcaggggctgccc

SEQ ID NO: 2711108 - DNA, 12 bp, Homo sapiens
tcctgagcctca

SEQ ID NO: 2711109 - DNA, 17 bp, Homo sapiens
tcctgaggagtgtcctg

SEQ ID NO: 2711110 - DNA, 22 bp, Homo sapiens
tcctgaggagtgtcctgtctgc

SEQ ID NO: 2711111 - DNA, 23 bp, Homo sapiens
tcctgaggagtgtcctgtctgct

SEQ ID NO: 2711112 - DNA, 12 bp, Homo sapiens
tcctgccagctc

SEQ ID NO: 2711113 - DNA, 17 bp, Homo sapiens
tcctgccgtccctcctg

SEQ ID NO: 2711114 - DNA, 14 bp, Homo sapiens
tcctgctccacagt

SEQ ID NO: 2711115 - DNA, 16 bp, Homo sapiens
tcctgctccacagtgt

SEQ ID NO: 2711116 - DNA, 12 bp, Homo sapiens
tcctgctgcacc

SEQ ID NO: 2711117 - DNA, 16 bp, Homo sapiens
tcctgctgcagagggg

SEQ ID NO: 2711118 - DNA, 15 bp, Homo sapiens
tcctgctggcctgct

SEQ ID NO: 2711119 - DNA, 18 bp, Homo sapiens
tcctgctggcctgctctt

SEQ ID NO: 2711120 - DNA, 16 bp, Homo sapiens
tcctggaatgaagcat

SEQ ID NO: 2711121 - DNA, 17 bp, Homo sapiens
tcctggaatgaagcatg

SEQ ID NO: 2711122 - DNA, 12 bp, Homo sapiens
tcctggaccctg

SEQ ID NO: 2711123 - DNA, 18 bp, Homo sapiens
tcctggagcatcccaggc

SEQ ID NO: 2711124 - DNA, 17 bp, Homo sapiens
tcctggcccatcagtgt

SEQ ID NO: 2711125 - DNA, 14 bp, Homo sapiens
tcctggctggaagg

SEQ ID NO: 2711126 - DNA, 14 bp, Homo sapiens
tcctggctggctgt

SEQ ID NO: 2711127 - DNA, 16 bp, Homo sapiens
tcctggctggctgtgt

SEQ ID NO: 2711128 - DNA, 18 bp, Homo sapiens
tcctggctggctgtgtcc

SEQ ID NO: 2711129 - DNA, 19 bp, Homo sapiens
tcctggctggctgtgtcct

SEQ ID NO: 2711130 - DNA, 17 bp, Homo sapiens
tcctgggagaacctcag

SEQ ID NO: 2711131 - DNA, 10 bp, Homo sapiens
tcctgggccc

SEQ ID NO: 2711132 - DNA, 15 bp, Homo sapiens
tcctgggcccccaga

SEQ ID NO: 2711133 - DNA, 16 bp, Homo sapiens
tcctgggcccccagag

SEQ ID NO: 2711134 - DNA, 21 bp, Homo sapiens
tcctggtgaggcccagcctgt

SEQ ID NO: 2711135 - DNA, 24 bp, Homo sapiens
tcctggtgaggcccagcctgtcct

SEQ ID NO: 2711136 - DNA, 12 bp, Homo sapiens
tcctgtcagtgc

SEQ ID NO: 2711137 - DNA, 14 bp, Homo sapiens
tcctgtccctaccc

SEQ ID NO: 2711138 - DNA, 21 bp, Homo sapiens
tcctgtccctacccactcttt

SEQ ID NO: 2711139 - DNA, 20 bp, Homo sapiens
tcctgtccggagcgaccctg

SEQ ID NO: 2711140 - DNA, 13 bp, Homo sapiens
tcctgtctgctgg

SEQ ID NO: 2711141 - DNA, 23 bp, Homo sapiens
tcctgtgggggaagagcacagcc

SEQ ID NO: 2711142 - DNA, 21 bp, Homo sapiens
tcctgttgtgtaataacagaa

SEQ ID NO: 2711143 - DNA, 23 bp, Homo sapiens
tccttaaccgtggactcttcctt

SEQ ID NO: 2711144 - DNA, 16 bp, Homo sapiens
tccttactcagagctg

SEQ ID NO: 2711145 - DNA, 17 bp, Homo sapiens
tccttactcagagctgc

SEQ ID NO: 2711146 - DNA, 21 bp, Homo sapiens
tccttactcagagctgcgggc

SEQ ID NO: 2711147 - DNA, 22 bp, Homo sapiens
tccttactcagagctgcgggct

SEQ ID NO: 2711148 - DNA, 19 bp, Homo sapiens
tccttcaagttagctcagg

SEQ ID NO: 2711149 - DNA, 20 bp, Homo sapiens
tccttcaagttagctcagga

SEQ ID NO: 2711150 - DNA, 22 bp, Homo sapiens
tccttcctacacccttggactt

SEQ ID NO: 2711151 - DNA, 23 bp, Homo sapiens
tccttcctacacccttggacttg

SEQ ID NO: 2711152 - DNA, 20 bp, Homo sapiens
tccttcttaactctgcagga

SEQ ID NO: 2711153 - DNA, 14 bp, Homo sapiens
tccttggagagcag

SEQ ID NO: 2711154 - DNA, 16 bp, Homo sapiens
tccttggagagcagct

SEQ ID NO: 2711155 - DNA, 20 bp, Homo sapiens
tccttggcatcacagggcag

SEQ ID NO: 2711156 - DNA, 17 bp, Homo sapiens
tcctttatcccctcctt

SEQ ID NO: 2711157 - DNA, 21 bp, Homo sapiens
tcctttcagggaatttcagga

SEQ ID NO: 2711158 - DNA, 23 bp, Homo sapiens
tcctttcagggaatttcaggaac

SEQ ID NO: 2711159 - DNA, 16 bp, Homo sapiens
tcctttctccagtgta

SEQ ID NO: 2711160 - DNA, 18 bp, Homo sapiens
tcctttgttgctgttgct

SEQ ID NO: 2711161 - DNA, 13 bp, Homo sapiens
tcctttttgtaac

SEQ ID NO: 2711162 - DNA, 16 bp, Homo sapiens
tcgaactcctgacctc

SEQ ID NO: 2711163 - DNA, 13 bp, Homo sapiens
tcgaactgtgctc

SEQ ID NO: 2711164 - DNA, 14 bp, Homo sapiens
tcgaactgtgctcc

SEQ ID NO: 2711165 - DNA, 15 bp, Homo sapiens
tcgaggtgtcaccct

SEQ ID NO: 2711166 - DNA, 13 bp, Homo sapiens
tcgatatgaaaaa

SEQ ID NO: 2711167 - DNA, 20 bp, Homo sapiens
tcgatgaatgtgttgatttg

SEQ ID NO: 2711168 - DNA, 23 bp, Homo sapiens
tcgatgaatgtgttgatttgaga

SEQ ID NO: 2711169 - DNA, 11 bp, Homo sapiens
tcgccccaccc

SEQ ID NO: 2711170 - DNA, 12 bp, Homo sapiens
tcgccccaccca

SEQ ID NO: 2711171 - DNA, 13 bp, Homo sapiens
tcgccccacccag

SEQ ID NO: 2711172 - DNA, 14 bp, Homo sapiens
tcgcctggcctgag

SEQ ID NO: 2711173 - DNA, 15 bp, Homo sapiens
tcgcctggcctgagg

SEQ ID NO: 2711174 - DNA, 13 bp, Homo sapiens
tcgcgctgcctgt

SEQ ID NO: 2711175 - DNA, 16 bp, Homo sapiens
tcgctgatgctgggct

SEQ ID NO: 2711176 - DNA, 17 bp, Homo sapiens
tcgctgatgctgggctg

SEQ ID NO: 2711177 - DNA, 19 bp, Homo sapiens
tcgctgatgctgggctggg

SEQ ID NO: 2711178 - DNA, 21 bp, Homo sapiens
tcggcaccagtgcctcagtgc

SEQ ID NO: 2711179 - DNA, 23 bp, Homo sapiens
tcggcccatctgtccatcctcct

SEQ ID NO: 2711180 - DNA, 12 bp, Homo sapiens
tcggctcctgct

SEQ ID NO: 2711181 - DNA, 15 bp, Homo sapiens
tcggctcctgctgca

SEQ ID NO: 2711182 - DNA, 16 bp, Homo sapiens
tcggctcctgctgcac

SEQ ID NO: 2711183 - DNA, 17 bp, Homo sapiens
tcggctcctgctgcacc

SEQ ID NO: 2711184 - DNA, 15 bp, Homo sapiens
tcgggaccctcccag

SEQ ID NO: 2711185 - DNA, 21 bp, Homo sapiens
tcgggagttcaagaccagcct

SEQ ID NO: 2711186 - DNA, 17 bp, Homo sapiens
tcgggatgaaaagccat

SEQ ID NO: 2711187 - DNA, 22 bp, Homo sapiens
tcgggatgaaaagccatatcta

SEQ ID NO: 2711188 - DNA, 16 bp, Homo sapiens
tcgggctcctgtgccc

SEQ ID NO: 2711189 - DNA, 17 bp, Homo sapiens
tcgggctcctgtgccct

SEQ ID NO: 2711190 - DNA, 18 bp, Homo sapiens
tcggggcatgctggggca

SEQ ID NO: 2711191 - DNA, 21 bp, Homo sapiens
tcggtaagttgaatggcctgc

SEQ ID NO: 2711192 - DNA, 19 bp, Homo sapiens
tcgtccacggtcttctgca

SEQ ID NO: 2711193 - DNA, 16 bp, Homo sapiens
tcgtgatttgcctgcc

SEQ ID NO: 2711194 - DNA, 18 bp, Homo sapiens
tcgtgatttgcctgcctg

SEQ ID NO: 2711195 - DNA, 15 bp, Homo sapiens
tcgtgggtgtgtgta

SEQ ID NO: 2711196 - DNA, 16 bp, Homo sapiens
tcgtggtagaagccag

SEQ ID NO: 2711197 - DNA, 21 bp, Homo sapiens
tcgtgtctagtagaacaatgt

SEQ ID NO: 2711198 - DNA, 19 bp, Homo sapiens
tctaaacagatgtccctga

SEQ ID NO: 2711199 - DNA, 22 bp, Homo sapiens
tctaaacagatgtccctgaagt

SEQ ID NO: 2711200 - DNA, 22 bp, Homo sapiens
tctaaaggtttcactgttcatg

SEQ ID NO: 2711201 - DNA, 16 bp, Homo sapiens
tctaaagtttacagta

SEQ ID NO: 2711202 - DNA, 15 bp, Homo sapiens
tctaaattgatcatt

SEQ ID NO: 2711203 - DNA, 19 bp, Homo sapiens
tctaaattgatcattcata

SEQ ID NO: 2711204 - DNA, 19 bp, Homo sapiens
tctaacataagtaagactt

SEQ ID NO: 2711205 - DNA, 19 bp, Homo sapiens
tctaaccaaagagtctctg

SEQ ID NO: 2711206 - DNA, 19 bp, Homo sapiens
tctaactagaaatctgcca

SEQ ID NO: 2711207 - DNA, 13 bp, Homo sapiens
tctaactccctcc

SEQ ID NO: 2711208 - DNA, 16 bp, Homo sapiens
tctaactccctcctca

SEQ ID NO: 2711209 - DNA, 23 bp, Homo sapiens
tctaactccctcctcacactcca

SEQ ID NO: 2711210 - DNA, 24 bp, Homo sapiens
tctaattggtcattcctaatgcat

SEQ ID NO: 2711211 - DNA, 17 bp, Homo sapiens
tctacacatatatgtat

SEQ ID NO: 2711212 - DNA, 19 bp, Homo sapiens
tctacacatatatgtatat

SEQ ID NO: 2711213 - DNA, 18 bp, Homo sapiens
tctacttgatatttcctt

SEQ ID NO: 2711214 - DNA, 15 bp, Homo sapiens
tctactttttctgta

SEQ ID NO: 2711215 - DNA, 14 bp, Homo sapiens
tctagaacacccac

SEQ ID NO: 2711216 - DNA, 18 bp, Homo sapiens
tctagaacacccactggc

SEQ ID NO: 2711217 - DNA, 19 bp, Homo sapiens
tctagaacacccactggcc

SEQ ID NO: 2711218 - DNA, 13 bp, Homo sapiens
tctagtagaacaa

SEQ ID NO: 2711219 - DNA, 23 bp, Homo sapiens
tctagtatctattgtgttggctt

SEQ ID NO: 2711220 - DNA, 15 bp, Homo sapiens
tctagtgacttcctg

SEQ ID NO: 2711221 - DNA, 22 bp, Homo sapiens
tctagttctcaatcactgctcc

SEQ ID NO: 2711222 - DNA, 22 bp, Homo sapiens
tctatattccgggtgccattcc

SEQ ID NO: 2711223 - DNA, 21 bp, Homo sapiens
tctatctgcaatgtttttgtg

SEQ ID NO: 2711224 - DNA, 13 bp, Homo sapiens
tctatgaaaagca

SEQ ID NO: 2711225 - DNA, 18 bp, Homo sapiens
tctatgaaaagcaactga

SEQ ID NO: 2711226 - DNA, 12 bp, Homo sapiens
tctatgtatgtg

SEQ ID NO: 2711227 - DNA, 17 bp, Homo sapiens
tctattaagatttccaa

SEQ ID NO: 2711228 - DNA, 23 bp, Homo sapiens
tgcacattttgtacaaagatatg

SEQ ID NO: 2711229 - DNA, 11 bp, Homo sapiens
tgcaccaaaga

SEQ ID NO: 2711230 - DNA, 14 bp, Homo sapiens
tgcaccaaagacat

SEQ ID NO: 2711231 - DNA, 20 bp, Homo sapiens
tgcaccaacccagccgctgc

SEQ ID NO: 2711232 - DNA, 23 bp, Homo sapiens
tgcaccattctttcttggtgcat

SEQ ID NO: 2711233 - DNA, 21 bp, Homo sapiens
tgcacccagggtcccagcctg

SEQ ID NO: 2711234 - DNA, 16 bp, Homo sapiens
tgcaccccctcctgct

SEQ ID NO: 2711235 - DNA, 18 bp, Homo sapiens
tgcacctatggcccagcc

SEQ ID NO: 2711236 - DNA, 16 bp, Homo sapiens
tgcacctgccagcctg

SEQ ID NO: 2711237 - DNA, 17 bp, Homo sapiens
tgcacctgtactcagga

SEQ ID NO: 2711238 - DNA, 20 bp, Homo sapiens
tgcacctgtactcaggaggc

SEQ ID NO: 2711239 - DNA, 12 bp, Homo sapiens
tgcacgccgtgg

SEQ ID NO: 2711240 - DNA, 17 bp, Homo sapiens
tgcacgtattttaatag

SEQ ID NO: 2711241 - DNA, 21 bp, Homo sapiens
tgcacgtcaccctcctgagcc

SEQ ID NO: 2711242 - DNA, 22 bp, Homo sapiens
tgcacgtcaccctcctgagcct

SEQ ID NO: 2711243 - DNA, 13 bp, Homo sapiens
tgcactagcattt

SEQ ID NO: 2711244 - DNA, 19 bp, Homo sapiens
tgcactagcattttcttga

SEQ ID NO: 2711245 - DNA, 14 bp, Homo sapiens
tgcactccagcctg

SEQ ID NO: 2711246 - DNA, 17 bp, Homo sapiens
tgcactccagcctgggc

SEQ ID NO: 2711247 - DNA, 19 bp, Homo sapiens
tgcactccagcctgggcga

SEQ ID NO: 2711248 - DNA, 12 bp, Homo sapiens
tgcactcctgga

SEQ ID NO: 2711249 - DNA, 15 bp, Homo sapiens
tgcactctgtgccca

SEQ ID NO: 2711250 - DNA, 13 bp, Homo sapiens
tgcactgaaaacc

SEQ ID NO: 2711251 - DNA, 19 bp, Homo sapiens
tgcactggtcccaagtagt

SEQ ID NO: 2711252 - DNA, 14 bp, Homo sapiens
tgcactgtcctgct

SEQ ID NO: 2711253 - DNA, 23 bp, Homo sapiens
tgcagaaggaagggcatccttct

SEQ ID NO: 2711254 - DNA, 12 bp, Homo sapiens
tgcagacagtgt

SEQ ID NO: 2711255 - DNA, 21 bp, Homo sapiens
tgcagacagtgtcagagtcat

SEQ ID NO: 2711256 - DNA, 14 bp, Homo sapiens
tgcagagctatggt

SEQ ID NO: 2711257 - DNA, 15 bp, Homo sapiens
tgcagaggtgagcag

SEQ ID NO: 2711258 - DNA, 18 bp, Homo sapiens
tgcagatagtgcctctgc

SEQ ID NO: 2711259 - DNA, 21 bp, Homo sapiens
tgcagatctttttgtgaaatt

SEQ ID NO: 2711260 - DNA, 12 bp, Homo sapiens
tgcagcacagga

SEQ ID NO: 2711261 - DNA, 18 bp, Homo sapiens
tgcagcacaggaggctcc

SEQ ID NO: 2711262 - DNA, 17 bp, Homo sapiens
tgcagcctttcacagga

SEQ ID NO: 2711263 - DNA, 15 bp, Homo sapiens
tgcagcttcctgtca

SEQ ID NO: 2711264 - DNA, 19 bp, Homo sapiens
tgcagctttggctgcacgt

SEQ ID NO: 2711265 - DNA, 16 bp, Homo sapiens
tgcagctttgggaaag

SEQ ID NO: 2711266 - DNA, 20 bp, Homo sapiens
tgcaggaaatcagagctggc

SEQ ID NO: 2711267 - DNA, 23 bp, Homo sapiens
tgcaggcagatttactgtcccag

SEQ ID NO: 2711268 - DNA, 16 bp, Homo sapiens
tgcaggcccagcagac

SEQ ID NO: 2711269 - DNA, 14 bp, Homo sapiens
tgcaggggactggg

SEQ ID NO: 2711270 - DNA, 15 bp, Homo sapiens
tgcaggggactgggc

SEQ ID NO: 2711271 - DNA, 20 bp, Homo sapiens
tgcaggtctccatgaagaag

SEQ ID NO: 2711272 - DNA, 15 bp, Homo sapiens
tgcagtcttttgctg

SEQ ID NO: 2711273 - DNA, 19 bp, Homo sapiens
tgcagtgacgtgcacctgt

SEQ ID NO: 2711274 - DNA, 15 bp, Homo sapiens
tgcagtgcagcatgg

SEQ ID NO: 2711275 - DNA, 18 bp, Homo sapiens
tgcataaacaatccaaat

SEQ ID NO: 2711276 - DNA, 22 bp, Homo sapiens
tgcatatctctagtccctgtgt

SEQ ID NO: 2711277 - DNA, 19 bp, Homo sapiens
tgcatggaatttgtaagtt

SEQ ID NO: 2711278 - DNA, 16 bp, Homo sapiens
tgcatggagtgtttga

SEQ ID NO: 2711279 - DNA, 17 bp, Homo sapiens
tgcatgtaaaatcttca

SEQ ID NO: 2711280 - DNA, 18 bp, Homo sapiens
tgcatgtaaaatcttcag

SEQ ID NO: 2711281 - DNA, 20 bp, Homo sapiens
tgcatgtaaaatcttcagct

SEQ ID NO: 2711282 - DNA, 22 bp, Homo sapiens
tgcatgtaaaatcttcagctgg

SEQ ID NO: 2711283 - DNA, 16 bp, Homo sapiens
tgcattagacagatga

SEQ ID NO: 2711284 - DNA, 22 bp, Homo sapiens
tgcattcacagcgcctcctgga

SEQ ID NO: 2711285 - DNA, 22 bp, Homo sapiens
tgcatttttaaaggacaaacag

SEQ ID NO: 2711286 - DNA, 21 bp, Homo sapiens
tgccaattttgtcacagctct

SEQ ID NO: 2711287 - DNA, 20 bp, Homo sapiens
tgccacaccaagctgtgcca

SEQ ID NO: 2711288 - DNA, 21 bp, Homo sapiens
tgccacaccaagctgtgccac

SEQ ID NO: 2711289 - DNA, 22 bp, Homo sapiens
tgccacaccaagctgtgccacc

SEQ ID NO: 2711290 - DNA, 23 bp, Homo sapiens
tgccacaccaagctgtgccaccc

SEQ ID NO: 2711291 - DNA, 20 bp, Homo sapiens
tgccaccctgggctctgtgg

SEQ ID NO: 2711292 - DNA, 13 bp, Homo sapiens
tgccactctgctg

SEQ ID NO: 2711293 - DNA, 17 bp, Homo sapiens
tgccactctgctgcctg

SEQ ID NO: 2711294 - DNA, 22 bp, Homo sapiens
tgccagatgtgggctcagatcc

SEQ ID NO: 2711295 - DNA, 23 bp, Homo sapiens
tgccagatgtgggctcagatcct

SEQ ID NO: 2711296 - DNA, 15 bp, Homo sapiens
tgccagattgcccca

SEQ ID NO: 2711297 - DNA, 15 bp, Homo sapiens
tgccagcctggcttc

SEQ ID NO: 2711298 - DNA, 21 bp, Homo sapiens
tgccagcctggcttctggagc

SEQ ID NO: 2711299 - DNA, 23 bp, Homo sapiens
tgccagcctggcttctggagccc

SEQ ID NO: 2711300 - DNA, 15 bp, Homo sapiens
tgccagcgtccccgg

SEQ ID NO: 2711301 - DNA, 21 bp, Homo sapiens
tgccagggaaaaagaccaaat

SEQ ID NO: 2711302 - DNA, 18 bp, Homo sapiens
tgccagtcgcgctgcctg

SEQ ID NO: 2711303 - DNA, 19 bp, Homo sapiens
tgccatttgcaccctccgc

SEQ ID NO: 2711304 - DNA, 21 bp, Homo sapiens
tgccatttgcaccctccgcct

SEQ ID NO: 2711305 - DNA, 17 bp, Homo sapiens
tgcccacacacactcct

SEQ ID NO: 2711306 - DNA, 18 bp, Homo sapiens
tgcccacacacactcctt

SEQ ID NO: 2711307 - DNA, 19 bp, Homo sapiens
tgcccagagggcccaggca

SEQ ID NO: 2711308 - DNA, 23 bp, Homo sapiens
tgcccatgggcactgctgggtgg

SEQ ID NO: 2711309 - DNA, 15 bp, Homo sapiens
tgccccaaatcacaa

SEQ ID NO: 2711310 - DNA, 15 bp, Homo sapiens
tgccccaacccccag

SEQ ID NO: 2711311 - DNA, 16 bp, Homo sapiens
tgccccaacccccagc

SEQ ID NO: 2711312 - DNA, 17 bp, Homo sapiens
tgccccaacccccagca

SEQ ID NO: 2711313 - DNA, 17 bp, Homo sapiens
tgccccagcctcccagc

SEQ ID NO: 2711314 - DNA, 14 bp, Homo sapiens
tgccccagctctgg

SEQ ID NO: 2711315 - DNA, 16 bp, Homo sapiens
tgccccagctctggct

SEQ ID NO: 2711316 - DNA, 18 bp, Homo sapiens
tgccccagctctggcttc

SEQ ID NO: 2711317 - DNA, 16 bp, Homo sapiens
tgccccccatcctggc

SEQ ID NO: 2711318 - DNA, 17 bp, Homo sapiens
tgccccccatcctggcc

SEQ ID NO: 2711319 - DNA, 18 bp, Homo sapiens
tgccccccatcctggccc

SEQ ID NO: 2711320 - DNA, 21 bp, Homo sapiens
tgccccccatcctggcccatc

SEQ ID NO: 2711321 - DNA, 12 bp, Homo sapiens
tgcccctccccc

SEQ ID NO: 2711322 - DNA, 12 bp, Homo sapiens
tgcccctcccta

SEQ ID NO: 2711323 - DNA, 19 bp, Homo sapiens
tgcccctccctagatccag

SEQ ID NO: 2711324 - DNA, 22 bp, Homo sapiens
tgcccctccctagatccaggct

SEQ ID NO: 2711325 - DNA, 12 bp, Homo sapiens
tgccccttccac

SEQ ID NO: 2711326 - DNA, 19 bp, Homo sapiens
tgcccgcctcggcctccca

SEQ ID NO: 2711327 - DNA, 14 bp, Homo sapiens
tgcccgctcccagt

SEQ ID NO: 2711328 - DNA, 17 bp, Homo sapiens
tgcccgctcccagtgtc

SEQ ID NO: 2711329 - DNA, 15 bp, Homo sapiens
tgcccggattctggg

SEQ ID NO: 2711330 - DNA, 18 bp, Homo sapiens
tgcccggcgccctctgtc

SEQ ID NO: 2711331 - DNA, 17 bp, Homo sapiens
tgccctctggacagctt

SEQ ID NO: 2711332 - DNA, 14 bp, Homo sapiens
tgcccttcctgacc

SEQ ID NO: 2711333 - DNA, 16 bp, Homo sapiens
tgccgccgcctcgccc

SEQ ID NO: 2711334 - DNA, 18 bp, Homo sapiens
tgccgccgtctctgtccc

SEQ ID NO: 2711335 - DNA, 21 bp, Homo sapiens
tgccgggtggggggagggcac

SEQ ID NO: 2711336 - DNA, 23 bp, Homo sapiens
tgccgtagtcctttttgtaacta

SEQ ID NO: 2711337 - DNA, 14 bp, Homo sapiens
tgcctaattcctgg

SEQ ID NO: 2711338 - DNA, 14 bp, Homo sapiens
tgcctagctcttgg

SEQ ID NO: 2711339 - DNA, 19 bp, Homo sapiens
tgcctagctcttgggcctg

SEQ ID NO: 2711340 - DNA, 20 bp, Homo sapiens
tgcctcagccagccctggag

SEQ ID NO: 2711341 - DNA, 15 bp, Homo sapiens
tgcctcagcttccca

SEQ ID NO: 2711342 - DNA, 23 bp, Homo sapiens
tgcctcagcttcccaagtagctg

SEQ ID NO: 2711343 - DNA, 15 bp, Homo sapiens
tgcctcatcctcctc

SEQ ID NO: 2711344 - DNA, 17 bp, Homo sapiens
tgcctcatcctcctcct

SEQ ID NO: 2711345 - DNA, 15 bp, Homo sapiens
tgcctccactcccac

SEQ ID NO: 2711346 - DNA, 20 bp, Homo sapiens
tgcctccactcccacttccc

SEQ ID NO: 2711347 - DNA, 13 bp, Homo sapiens
tgcctccccaatc

SEQ ID NO: 2711348 - DNA, 15 bp, Homo sapiens
tgcctccccaatcca

SEQ ID NO: 2711349 - DNA, 18 bp, Homo sapiens
tgcctcggctcctgctgc

SEQ ID NO: 2711350 - DNA, 20 bp, Homo sapiens
tgcctcggctcctgctgcac

SEQ ID NO: 2711351 - DNA, 22 bp, Homo sapiens
tgtccctctcgccctggccagg

SEQ ID NO: 2711352 - DNA, 13 bp, Homo sapiens
tgtccctggggca

SEQ ID NO: 2711353 - DNA, 14 bp, Homo sapiens
tgtccctggggcac

SEQ ID NO: 2711354 - DNA, 15 bp, Homo sapiens
tgtccctggggcact

SEQ ID NO: 2711355 - DNA, 18 bp, Homo sapiens
tgtccctggggcactccc

SEQ ID NO: 2711356 - DNA, 23 bp, Homo sapiens
tgtccctggggcactcccccagg

SEQ ID NO: 2711357 - DNA, 18 bp, Homo sapiens
tgtccctttttgcagggg

SEQ ID NO: 2711358 - DNA, 15 bp, Homo sapiens
tgtccgcctctgccc

SEQ ID NO: 2711359 - DNA, 18 bp, Homo sapiens
tgtccggagcgaccctgg

SEQ ID NO: 2711360 - DNA, 20 bp, Homo sapiens
tgtccggagcgaccctggct

SEQ ID NO: 2711361 - DNA, 23 bp, Homo sapiens
tgtcctccaacaataaagagctc

SEQ ID NO: 2711362 - DNA, 17 bp, Homo sapiens
tgtcctcgcactgccca

SEQ ID NO: 2711363 - DNA, 14 bp, Homo sapiens
tgtcctcgcagaga

SEQ ID NO: 2711364 - DNA, 16 bp, Homo sapiens
tgtcctctccagcttt

SEQ ID NO: 2711365 - DNA, 14 bp, Homo sapiens
tgtcctgcatgcat

SEQ ID NO: 2711366 - DNA, 12 bp, Homo sapiens
tgtcctgtctgc

SEQ ID NO: 2711367 - DNA, 15 bp, Homo sapiens
tgtccttactcagag

SEQ ID NO: 2711368 - DNA, 16 bp, Homo sapiens
tgtccttactcagagc

SEQ ID NO: 2711369 - DNA, 23 bp, Homo sapiens
tgtccttactcagagctgcgggc

SEQ ID NO: 2711370 - DNA, 14 bp, Homo sapiens
tgtcctttctccag

SEQ ID NO: 2711371 - DNA, 20 bp, Homo sapiens
tgtcgcgccttctccccccc

SEQ ID NO: 2711372 - DNA, 14 bp, Homo sapiens
tgtcggtgtgctgt

SEQ ID NO: 2711373 - DNA, 23 bp, Homo sapiens
tgtcgtagccaaggtgggctgag

SEQ ID NO: 2711374 - DNA, 19 bp, Homo sapiens
tgtctaaagagctttagtc

SEQ ID NO: 2711375 - DNA, 22 bp, Homo sapiens
tgtctaaggtcacacagtatta

SEQ ID NO: 2711376 - DNA, 17 bp, Homo sapiens
tgtctactcctcacagc

SEQ ID NO: 2711377 - DNA, 17 bp, Homo sapiens
tgtctccaggtaacttt

SEQ ID NO: 2711378 - DNA, 15 bp, Homo sapiens
tgtctccctggccct

SEQ ID NO: 2711379 - DNA, 14 bp, Homo sapiens
tgtctctgcctgga

SEQ ID NO: 2711380 - DNA, 19 bp, Homo sapiens
tgtctctgcctggagcagg

SEQ ID NO: 2711381 - DNA, 11 bp, Homo sapiens
tgtctctgctt

SEQ ID NO: 2711382 - DNA, 14 bp, Homo sapiens
tgtctgcagctcct

SEQ ID NO: 2711383 - DNA, 13 bp, Homo sapiens
tgtctgctcccaa

SEQ ID NO: 2711384 - DNA, 13 bp, Homo sapiens
tgtctgctgttgt

SEQ ID NO: 2711385 - DNA, 21 bp, Homo sapiens
tgtctgtccaacccctccccc

SEQ ID NO: 2711386 - DNA, 14 bp, Homo sapiens
tgtctgtctttgca

SEQ ID NO: 2711387 - DNA, 14 bp, Homo sapiens
tgtcttccaacccc

SEQ ID NO: 2711388 - DNA, 18 bp, Homo sapiens
tgtcttccaaccccagct

SEQ ID NO: 2711389 - DNA, 19 bp, Homo sapiens
tgtcttccaaccccagctg

SEQ ID NO: 2711390 - DNA, 23 bp, Homo sapiens
tgtcttccaaccccagctggcct

SEQ ID NO: 2711391 - DNA, 22 bp, Homo sapiens
tgtcttcctagtatattagttt

SEQ ID NO: 2711392 - DNA, 11 bp, Homo sapiens
tgtctttcaaa

SEQ ID NO: 2711393 - DNA, 13 bp, Homo sapiens
tgtctttgcaaag

SEQ ID NO: 2711394 - DNA, 14 bp, Homo sapiens
tgtgaaaaatgagc

SEQ ID NO: 2711395 - DNA, 15 bp, Homo sapiens
tgtgaaagtctcctg

SEQ ID NO: 2711396 - DNA, 23 bp, Homo sapiens
tgtgaaattcaacctgtgtctta

SEQ ID NO: 2711397 - DNA, 18 bp, Homo sapiens
tgtgatggttgattcaca

SEQ ID NO: 2711398 - DNA, 15 bp, Homo sapiens
tgtgatttcccgtgg

SEQ ID NO: 2711399 - DNA, 19 bp, Homo sapiens
tgtgatttcccgtggcccc

SEQ ID NO: 2711400 - DNA, 23 bp, Homo sapiens
tgtgatttcccgtggccccagcc

SEQ ID NO: 2711401 - DNA, 23 bp, Homo sapiens
tgtgcaactcttgtattgctcca

SEQ ID NO: 2711402 - DNA, 21 bp, Homo sapiens
tgtgcacctatggcccagcca

SEQ ID NO: 2711403 - DNA, 21 bp, Homo sapiens
tgtgccaccctgggctctgtg

SEQ ID NO: 2711404 - DNA, 18 bp, Homo sapiens
tgtgcccatgggcactgc

SEQ ID NO: 2711405 - DNA, 15 bp, Homo sapiens
tgtgccccccatcct

SEQ ID NO: 2711406 - DNA, 18 bp, Homo sapiens
tgtgccccccatcctggc

SEQ ID NO: 2711407 - DNA, 19 bp, Homo sapiens
tgtgccccccatcctggcc

SEQ ID NO: 2711408 - DNA, 16 bp, Homo sapiens
tgtgcctgtctgtcca

SEQ ID NO: 2711409 - DNA, 23 bp, Homo sapiens
tgtgcctttgggaggcagcatca

SEQ ID NO: 2711410 - DNA, 16 bp, Homo sapiens
tgtgctcccacgggga

SEQ ID NO: 2711411 - DNA, 13 bp, Homo sapiens
tgtgctctcggct

SEQ ID NO: 2711412 - DNA, 13 bp, Homo sapiens
tgtggaaaggatt

SEQ ID NO: 2711413 - DNA, 18 bp, Homo sapiens
tgtggactctctgcctgc

SEQ ID NO: 2711414 - DNA, 23 bp, Homo sapiens
tgtggatggaggtgatgaaaacc

SEQ ID NO: 2711415 - DNA, 21 bp, Homo sapiens
tgtgggctgcactctgtgccc

SEQ ID NO: 2711416 - DNA, 18 bp, Homo sapiens
tgtgggttgtgatattga

SEQ ID NO: 2711417 - DNA, 13 bp, Homo sapiens
tgtggtgatgaaa

SEQ ID NO: 2711418 - DNA, 23 bp, Homo sapiens
tgtggttcctaagcctgttgctg

SEQ ID NO: 2711419 - DNA, 21 bp, Homo sapiens
tgtgtaccacaccctgcctgc

SEQ ID NO: 2711420 - DNA, 19 bp, Homo sapiens
tgtgtacttcagtcttgga

SEQ ID NO: 2711421 - DNA, 22 bp, Homo sapiens
tgtgtagagtggcgattgaatg

SEQ ID NO: 2711422 - DNA, 12 bp, Homo sapiens
tgtgtatgagaa

SEQ ID NO: 2711423 - DNA, 23 bp, Homo sapiens
tgtgtatgagaagtactttgtgc

SEQ ID NO: 2711424 - DNA, 12 bp, Homo sapiens
tgtgtatgagac

SEQ ID NO: 2711425 - DNA, 17 bp, Homo sapiens
tgtgtcactggctgcct

SEQ ID NO: 2711426 - DNA, 15 bp, Homo sapiens
tgtgtcccagtgaac

SEQ ID NO: 2711427 - DNA, 16 bp, Homo sapiens
tgtgttgcataaacaa

SEQ ID NO: 2711428 - DNA, 18 bp, Homo sapiens
tgttaattgattaaaatc

SEQ ID NO: 2711429 - DNA, 16 bp, Homo sapiens
tgttacctgagatact

SEQ ID NO: 2711430 - DNA, 23 bp, Homo sapiens
tgttagagaggtagcgagctgct

SEQ ID NO: 2711431 - DNA, 19 bp, Homo sapiens
tgttaggagatgtcatcaa

SEQ ID NO: 2711432 - DNA, 21 bp, Homo sapiens
tgttaggcctggcacagtgtc

SEQ ID NO: 2711433 - DNA, 16 bp, Homo sapiens
tgttattaaaaaaaca

SEQ ID NO: 2711434 - DNA, 19 bp, Homo sapiens
tgttattaaaaaaacacaa

SEQ ID NO: 2711435 - DNA, 17 bp, Homo sapiens
tgttatttgtacagttc

SEQ ID NO: 2711436 - DNA, 22 bp, Homo sapiens
tgttcacaccattctcctgcct

SEQ ID NO: 2711437 - DNA, 14 bp, Homo sapiens
tgttcacactccta

SEQ ID NO: 2711438 - DNA, 14 bp, Homo sapiens
tgttccccagctga

SEQ ID NO: 2711439 - DNA, 19 bp, Homo sapiens
tgttcctcgggatgaaaag

SEQ ID NO: 2711440 - DNA, 23 bp, Homo sapiens
tgttcctcgggatgaaaagccat

SEQ ID NO: 2711441 - DNA, 16 bp, Homo sapiens
tgttctaactcttaga

SEQ ID NO: 2711442 - DNA, 17 bp, Homo sapiens
tgttctaactcttagaa

SEQ ID NO: 2711443 - DNA, 13 bp, Homo sapiens
tgttctacttgat

SEQ ID NO: 2711444 - DNA, 18 bp, Homo sapiens
tgttctgtccagtttcca

SEQ ID NO: 2711445 - DNA, 19 bp, Homo sapiens
tgttgaatgcctgtcccag

SEQ ID NO: 2711446 - DNA, 18 bp, Homo sapiens
tgttgagtctctgaacat

SEQ ID NO: 2711447 - DNA, 16 bp, Homo sapiens
tgttgatcccaagaca

SEQ ID NO: 2711448 - DNA, 14 bp, Homo sapiens
tgttgcataaacaa

SEQ ID NO: 2711449 - DNA, 15 bp, Homo sapiens
tgttggcgagaggag

SEQ ID NO: 2711450 - DNA, 14 bp, Homo sapiens
tgttggctttacaa

SEQ ID NO: 2711451 - DNA, 15 bp, Homo sapiens
tgttggctttacaaa

SEQ ID NO: 2711452 - DNA, 16 bp, Homo sapiens
tgttgggtcctctgct

SEQ ID NO: 2711453 - DNA, 15 bp, Homo sapiens
tgttgtcatgtgtat

SEQ ID NO: 2711454 - DNA, 23 bp, Homo sapiens
tgtttagtctcgctaaagttata

SEQ ID NO: 2711455 - DNA, 17 bp, Homo sapiens
tgtttctccccctgggc

SEQ ID NO: 2711456 - DNA, 12 bp, Homo sapiens
tgtttctttctg

SEQ ID NO: 2711457 - DNA, 13 bp, Homo sapiens
tgtttctttctga

SEQ ID NO: 2711458 - DNA, 17 bp, Homo sapiens
tgtttctttctgaagtg

SEQ ID NO: 2711459 - DNA, 14 bp, Homo sapiens
tgtttgcacagagg

SEQ ID NO: 2711460 - DNA, 20 bp, Homo sapiens
tgtttgtataccatgatgca

SEQ ID NO: 2711461 - DNA, 22 bp, Homo sapiens
tgtttgtttctccccctgggct

SEQ ID NO: 2711462 - DNA, 20 bp, Homo sapiens
tgttttaaaagtttgtcctt

SEQ ID NO: 2711463 - DNA, 22 bp, Homo sapiens
tgttttcccgagcaaagtctaa

SEQ ID NO: 2711464 - DNA, 21 bp, Homo sapiens
tgttttgagggctattagaag

SEQ ID NO: 2711465 - DNA, 12 bp, Homo sapiens
ttaaaaaaacac

SEQ ID NO: 2711466 - DNA, 16 bp, Homo sapiens
ttaaaactttctaaat

SEQ ID NO: 2711467 - DNA, 14 bp, Homo sapiens
ttaaaagacaaaca

SEQ ID NO: 2711468 - DNA, 16 bp, Homo sapiens
ttaaaagacaaacacc

SEQ ID NO: 2711469 - DNA, 22 bp, Homo sapiens
ttaaaattaaagtatacatttt

SEQ ID NO: 2711470 - DNA, 22 bp, Homo sapiens
ttaaacagcaaagccatattct

SEQ ID NO: 2711471 - DNA, 18 bp, Homo sapiens
ttaaacctctcttctacc

SEQ ID NO: 2711472 - DNA, 18 bp, Homo sapiens
ttaaagaaaagttttgta

SEQ ID NO: 2711473 - DNA, 13 bp, Homo sapiens
ttaaagaaaatgt

SEQ ID NO: 2711474 - DNA, 17 bp, Homo sapiens
ttaaagaaaatgtgtct

SEQ ID NO: 2711475 - DNA, 18 bp, Homo sapiens
tttatttccacataaagg

SEQ ID NO: 2711476 - DNA, 23 bp, Homo sapiens
tttcaacaagtagctaaagtctg

SEQ ID NO: 2711477 - DNA, 22 bp, Homo sapiens
tttcacagatggaagaagtttt

SEQ ID NO: 2711478 - DNA, 23 bp, Homo sapiens
tttcacagatggaagaagtttta

SEQ ID NO: 2711479 - DNA, 23 bp, Homo sapiens
tttcagaattgaaggagaaaatg

SEQ ID NO: 2711480 - DNA, 23 bp, Homo sapiens
tttcagcatcaaacatgaaaaca

SEQ ID NO: 2711481 - DNA, 14 bp, Homo sapiens
tttcagcttctgct

SEQ ID NO: 2711482 - DNA, 19 bp, Homo sapiens
tttcagcttctgctgggct

SEQ ID NO: 2711483 - DNA, 15 bp, Homo sapiens
tttcatacattatat

SEQ ID NO: 2711484 - DNA, 19 bp, Homo sapiens
tttcatttctaacataagt

SEQ ID NO: 2711485 - DNA, 12 bp, Homo sapiens
tttccaaaacat

SEQ ID NO: 2711486 - DNA, 21 bp, Homo sapiens
tttccaaaacatttctggaca

SEQ ID NO: 2711487 - DNA, 13 bp, Homo sapiens
tttccaaatacat

SEQ ID NO: 2711488 - DNA, 15 bp, Homo sapiens
tttccactgccaaaa

SEQ ID NO: 2711489 - DNA, 21 bp, Homo sapiens
tttccagaattgagagatgtt

SEQ ID NO: 2711490 - DNA, 13 bp, Homo sapiens
tttccatgtatct

SEQ ID NO: 2711491 - DNA, 12 bp, Homo sapiens
tttcccactgca

SEQ ID NO: 2711492 - DNA, 22 bp, Homo sapiens
tttcccactgcaccccctcctg

SEQ ID NO: 2711493 - DNA, 17 bp, Homo sapiens
tttcccagtgagcctct

SEQ ID NO: 2711494 - DNA, 21 bp, Homo sapiens
tttcccgagcaaagtctaaag

SEQ ID NO: 2711495 - DNA, 15 bp, Homo sapiens
tttcccgtggcccca

SEQ ID NO: 2711496 - DNA, 21 bp, Homo sapiens
tttcctgtctgtatataactt

SEQ ID NO: 2711497 - DNA, 22 bp, Homo sapiens
tttcctgtctgtatataactta

SEQ ID NO: 2711498 - DNA, 23 bp, Homo sapiens
tttcctgtctgtatataacttat

SEQ ID NO: 2711499 - DNA, 14 bp, Homo sapiens
tttcgaactgtgct

SEQ ID NO: 2711500 - DNA, 12 bp, Homo sapiens
tttctaaaacat

SEQ ID NO: 2711501 - DNA, 22 bp, Homo sapiens
tttctaaagctctgaacaaaag

SEQ ID NO: 2711502 - DNA, 12 bp, Homo sapiens
tttctactgtat

SEQ ID NO: 2711503 - DNA, 16 bp, Homo sapiens
tttctcaaagaaattt

SEQ ID NO: 2711504 - DNA, 15 bp, Homo sapiens
tttctcctgtgggaa

SEQ ID NO: 2711505 - DNA, 14 bp, Homo sapiens
tttctgaacaaaga

SEQ ID NO: 2711506 - DNA, 21 bp, Homo sapiens
tttctgagtagcatatataat

SEQ ID NO: 2711507 - DNA, 20 bp, Homo sapiens
tttctgcccaactttcattg

SEQ ID NO: 2711508 - DNA, 17 bp, Homo sapiens
tttctggcttctgcttc

SEQ ID NO: 2711509 - DNA, 15 bp, Homo sapiens
tttctgtaaatgaag

SEQ ID NO: 2711510 - DNA, 19 bp, Homo sapiens
tttcttggaattttgtaaa

SEQ ID NO: 2711511 - DNA, 22 bp, Homo sapiens
tttcttggaattttgtaaaaag

SEQ ID NO: 2711512 - DNA, 17 bp, Homo sapiens
tttcttggtatgatcat

SEQ ID NO: 2711513 - DNA, 18 bp, Homo sapiens
tttctttgcaccaaagac

SEQ ID NO: 2711514 - DNA, 20 bp, Homo sapiens
tttctttgcaccaaagacat

SEQ ID NO: 2711515 - DNA, 19 bp, Homo sapiens
tttctttgctgctgtggaa

SEQ ID NO: 2711516 - DNA, 20 bp, Homo sapiens
tttcttttgttttcttcatt

SEQ ID NO: 2711517 - DNA, 13 bp, Homo sapiens
tttgaaagaattc

SEQ ID NO: 2711518 - DNA, 23 bp, Homo sapiens
tttgaaagaattctattttgctg

SEQ ID NO: 2711519 - DNA, 19 bp, Homo sapiens
tttgaaagtgaataaactt

SEQ ID NO: 2711520 - DNA, 21 bp, Homo sapiens
tttgaaagtgaataaacttca

SEQ ID NO: 2711521 - DNA, 21 bp, Homo sapiens
tttgaaagtgggtttcaattt

SEQ ID NO: 2711522 - DNA, 22 bp, Homo sapiens
tttgaatgtgattttaaagagt

SEQ ID NO: 2711523 - DNA, 16 bp, Homo sapiens
tttgacgaagaaacaa

SEQ ID NO: 2711524 - DNA, 15 bp, Homo sapiens
tttgaggagagtgaa

SEQ ID NO: 2711525 - DNA, 19 bp, Homo sapiens
tttgagttattttaattat

SEQ ID NO: 2711526 - DNA, 23 bp, Homo sapiens
tttgataacattttgtttatgtt

SEQ ID NO: 2711527 - DNA, 13 bp, Homo sapiens
tttgatagtgctt

SEQ ID NO: 2711528 - DNA, 16 bp, Homo sapiens
tttgatgtcagccttg

SEQ ID NO: 2711529 - DNA, 15 bp, Homo sapiens
tttgatttctagtat

SEQ ID NO: 2711530 - DNA, 16 bp, Homo sapiens
tttgcacagagggcgc

SEQ ID NO: 2711531 - DNA, 16 bp, Homo sapiens
tttgcaccaaagacat

SEQ ID NO: 2711532 - DNA, 18 bp, Homo sapiens
tttgcagtcttttgctgt

SEQ ID NO: 2711533 - DNA, 14 bp, Homo sapiens
tttgcatcatttaa

SEQ ID NO: 2711534 - DNA, 18 bp, Homo sapiens
tttgcccacacacactcc

SEQ ID NO: 2711535 - DNA, 14 bp, Homo sapiens
tttgcctgcctggg

SEQ ID NO: 2711536 - DNA, 22 bp, Homo sapiens
tttgcctgcctgggcctcccaa

SEQ ID NO: 2711537 - DNA, 14 bp, Homo sapiens
tttgctacaataaa

SEQ ID NO: 2711538 - DNA, 17 bp, Homo sapiens
tttgctacaataaatgc

SEQ ID NO: 2711539 - DNA, 19 bp, Homo sapiens
tttgctcttctgtatgtga

SEQ ID NO: 2711540 - DNA, 23 bp, Homo sapiens
tttgctgtatacaaacaggtgct

SEQ ID NO: 2711541 - DNA, 17 bp, Homo sapiens
tttggaaaaatgtcact

SEQ ID NO: 2711542 - DNA, 20 bp, Homo sapiens
tttggaaaaatgtcactgaa

SEQ ID NO: 2711543 - DNA, 23 bp, Homo sapiens
tttggaagagaggcacctgctgg

SEQ ID NO: 2711544 - DNA, 16 bp, Homo sapiens
tttggcactgatgcaa

SEQ ID NO: 2711545 - DNA, 18 bp, Homo sapiens
tttggcagaactgctggg

SEQ ID NO: 2711546 - DNA, 20 bp, Homo sapiens
tttggcagaactgctggggc

SEQ ID NO: 2711547 - DNA, 17 bp, Homo sapiens
tttggcccctggaacct

SEQ ID NO: 2711548 - DNA, 14 bp, Homo sapiens
tttgggaaagctgc

SEQ ID NO: 2711549 - DNA, 16 bp, Homo sapiens
tttgggctaacattta

SEQ ID NO: 2711550 - DNA, 19 bp, Homo sapiens
tttggtacagttcataatt

SEQ ID NO: 2711551 - DNA, 23 bp, Homo sapiens
tttggtacagttcataattcacc

SEQ ID NO: 2711552 - DNA, 19 bp, Homo sapiens
tttggtgagagtcaaagct

SEQ ID NO: 2711553 - DNA, 12 bp, Homo sapiens
tttgtaactacc

SEQ ID NO: 2711554 - DNA, 13 bp, Homo sapiens
tttgtacattatg

SEQ ID NO: 2711555 - DNA, 15 bp, Homo sapiens
tttgtacattatgtt

SEQ ID NO: 2711556 - DNA, 18 bp, Homo sapiens
tttgtacattatgttatt

SEQ ID NO: 2711557 - DNA, 18 bp, Homo sapiens
tttgtctaaacaaggtaa

SEQ ID NO: 2711558 - DNA, 12 bp, Homo sapiens
tttgttatttgt

SEQ ID NO: 2711559 - DNA, 19 bp, Homo sapiens
tttgttatttgtacagttc

SEQ ID NO: 2711560 - DNA, 15 bp, Homo sapiens
tttgttttagaacca

SEQ ID NO: 2711561 - DNA, 18 bp, Homo sapiens
tttgttttcttcatttct

SEQ ID NO: 2711562 - DNA, 19 bp, Homo sapiens
ttttaaaatgttggtgcaa

SEQ ID NO: 2711563 - DNA, 13 bp, Homo sapiens
ttttaaacagtgt

SEQ ID NO: 2711564 - DNA, 14 bp, Homo sapiens
ttttaaagaaaagt

SEQ ID NO: 2711565 - DNA, 20 bp, Homo sapiens
ttttaaagaaaatgtgtctg

SEQ ID NO: 2711566 - DNA, 19 bp, Homo sapiens
ttttaaaggacaaacagtg

SEQ ID NO: 2711567 - DNA, 22 bp, Homo sapiens
ttttaaaggacaaacagtgaat

SEQ ID NO: 2711568 - DNA, 17 bp, Homo sapiens
ttttaaataaaagcaca

SEQ ID NO: 2711569 - DNA, 12 bp, Homo sapiens
ttttaagcaaat

SEQ ID NO: 2711570 - DNA, 17 bp, Homo sapiens
ttttacagtctctgttg

SEQ ID NO: 2711571 - DNA, 14 bp, Homo sapiens
ttttacatacagtg

SEQ ID NO: 2711572 - DNA, 12 bp, Homo sapiens
ttttacatttca

SEQ ID NO: 2711573 - DNA, 16 bp, Homo sapiens
ttttacatttcataca

SEQ ID NO: 2711574 - DNA, 14 bp, Homo sapiens
ttttaccaaagcat

SEQ ID NO: 2711575 - DNA, 16 bp, Homo sapiens
ttttaccaaagcatca

SEQ ID NO: 2711576 - DNA, 23 bp, Homo sapiens
ttttaccctgttcccaagcaaag

SEQ ID NO: 2711577 - DNA, 15 bp, Homo sapiens
ttttactgacagaaa

SEQ ID NO: 2711578 - DNA, 19 bp, Homo sapiens
ttttaggcagggatttgag

SEQ ID NO: 2711579 - DNA, 16 bp, Homo sapiens
ttttataaaaaatggt

SEQ ID NO: 2711580 - DNA, 19 bp, Homo sapiens
ttttataaacctctaattt

SEQ ID NO: 2711581 - DNA, 22 bp, Homo sapiens
ttttataaatatgtgaaaatga

SEQ ID NO: 2711582 - DNA, 16 bp, Homo sapiens
ttttatacataaacag

SEQ ID NO: 2711583 - DNA, 21 bp, Homo sapiens
ttttatagtctcaaatcaaat

SEQ ID NO: 2711584 - DNA, 18 bp, Homo sapiens
ttttatgtgcctttttgt

SEQ ID NO: 2711585 - DNA, 15 bp, Homo sapiens
ttttattttgtaatt

SEQ ID NO: 2711586 - DNA, 12 bp, Homo sapiens
ttttcagattgt

SEQ ID NO: 2711587 - DNA, 14 bp, Homo sapiens
ttttccaaaatcta

SEQ ID NO: 2711588 - DNA, 15 bp, Homo sapiens
ttttccaccctggaa

SEQ ID NO: 2711589 - DNA, 20 bp, Homo sapiens
ttttcccactgcaccccctc

SEQ ID NO: 2711590 - DNA, 22 bp, Homo sapiens
ttttcccactgcaccccctcct

SEQ ID NO: 2711591 - DNA, 23 bp, Homo sapiens
ttttcccgagcaaagtctaaagt

SEQ ID NO: 2711592 - DNA, 13 bp, Homo sapiens
ttttctcccagaa

SEQ ID NO: 2711593 - DNA, 19 bp, Homo sapiens
ttttctgcccaactttcat

SEQ ID NO: 2711594 - DNA, 16 bp, Homo sapiens
ttttctgcctgagatt

SEQ ID NO: 2711595 - DNA, 21 bp, Homo sapiens
ttttcttttgttttcttcatt

SEQ ID NO: 2711596 - DNA, 19 bp, Homo sapiens
ttttgaaaaaagtatagga

SEQ ID NO: 2711597 - DNA, 20 bp, Homo sapiens
ttttgaaagaattctatttt

SEQ ID NO: 2711598 - DNA, 18 bp, Homo sapiens
agctctgtcaccctggcc

SEQ ID NO: 2711599 - DNA, 19 bp, Homo sapiens
agctctgtcaccctggcca

SEQ ID NO: 2711600 - DNA, 20 bp, Homo sapiens
agctctgtcaccctggccac

SEQ ID NO: 2711601 - DNA, 21 bp, Homo sapiens
agctctgtcaccctggccacc

SEQ ID NO: 2711602 - DNA, 13 bp, Homo sapiens
agctcttgggcct

SEQ ID NO: 2711603 - DNA, 20 bp, Homo sapiens
agctcttgggcctgacctcc

SEQ ID NO: 2711604 - DNA, 22 bp, Homo sapiens
agctcttgggcctgacctccag

SEQ ID NO: 2711605 - DNA, 16 bp, Homo sapiens
agctgacagagccaga

SEQ ID NO: 2711606 - DNA, 18 bp, Homo sapiens
agctgacagagccagagg

SEQ ID NO: 2711607 - DNA, 20 bp, Homo sapiens
agctgacagagccagaggca

SEQ ID NO: 2711608 - DNA, 12 bp, Homo sapiens
agctgaggcctc

SEQ ID NO: 2711609 - DNA, 13 bp, Homo sapiens
agctgaggcctcc

SEQ ID NO: 2711610 - DNA, 15 bp, Homo sapiens
agctgaggcctccct

SEQ ID NO: 2711611 - DNA, 13 bp, Homo sapiens
agctgagtggcag

SEQ ID NO: 2711612 - DNA, 11 bp, Homo sapiens
agctgcagctt

SEQ ID NO: 2711613 - DNA, 17 bp, Homo sapiens
agctgcctccccaatcc

SEQ ID NO: 2711614 - DNA, 17 bp, Homo sapiens
agctgcgggctgagggc

SEQ ID NO: 2711615 - DNA, 12 bp, Homo sapiens
agctgctgagca

SEQ ID NO: 2711616 - DNA, 14 bp, Homo sapiens
agctgggcccacag

SEQ ID NO: 2711617 - DNA, 23 bp, Homo sapiens
agctgggcccacagcccccaccc

SEQ ID NO: 2711618 - DNA, 19 bp, Homo sapiens
agctgtaaaaagagagaaa

SEQ ID NO: 2711619 - DNA, 20 bp, Homo sapiens
agctgtagaactctgcaggc

SEQ ID NO: 2711620 - DNA, 23 bp, Homo sapiens
agctgtagaactctgcaggcaga

SEQ ID NO: 2711621 - DNA, 13 bp, Homo sapiens
agctgtgccaccc

SEQ ID NO: 2711622 - DNA, 22 bp, Homo sapiens
agctgtgccaccctgggctctg

SEQ ID NO: 2711623 - DNA, 20 bp, Homo sapiens
agctgtgccttttttagctt

SEQ ID NO: 2711624 - DNA, 22 bp, Homo sapiens
agctgtgccttttttagcttca

SEQ ID NO: 2711625 - DNA, 22 bp, Homo sapiens
agctgtggtcccacccaggaag

SEQ ID NO: 2711626 - DNA, 11 bp, Homo sapiens
agctgtgtctc

SEQ ID NO: 2711627 - DNA, 14 bp, Homo sapiens
agcttacccttggt

SEQ ID NO: 2711628 - DNA, 16 bp, Homo sapiens
agcttagattttctgt

SEQ ID NO: 2711629 - DNA, 17 bp, Homo sapiens
agcttagattttctgta

SEQ ID NO: 2711630 - DNA, 19 bp, Homo sapiens
agcttagattttctgtaaa

SEQ ID NO: 2711631 - DNA, 22 bp, Homo sapiens
agcttagattttctgtaaatga

SEQ ID NO: 2711632 - DNA, 18 bp, Homo sapiens
agcttatttagcacattt

SEQ ID NO: 2711633 - DNA, 19 bp, Homo sapiens
agcttcagttgttttcccg

SEQ ID NO: 2711634 - DNA, 19 bp, Homo sapiens
agcttcccaagtagctgag

SEQ ID NO: 2711635 - DNA, 13 bp, Homo sapiens
agcttctgctggg

SEQ ID NO: 2711636 - DNA, 18 bp, Homo sapiens
agcttctgctgggctggg

SEQ ID NO: 2711637 - DNA, 13 bp, Homo sapiens
agcttgagcctga

SEQ ID NO: 2711638 - DNA, 15 bp, Homo sapiens
agcttgagcctgaaa

SEQ ID NO: 2711639 - DNA, 12 bp, Homo sapiens
agctttctcctt

SEQ ID NO: 2711640 - DNA, 13 bp, Homo sapiens
agctttctccttt

SEQ ID NO: 2711641 - DNA, 17 bp, Homo sapiens
agcttttagttcagact

SEQ ID NO: 2711642 - DNA, 17 bp, Homo sapiens
aggaaaagcctctgtgt

SEQ ID NO: 2711643 - DNA, 20 bp, Homo sapiens
aggaaagcaccgcagcatgt

SEQ ID NO: 2711644 - DNA, 22 bp, Homo sapiens
aggaaagcaccgcagcatgtgg

SEQ ID NO: 2711645 - DNA, 12 bp, Homo sapiens
aggaaaggattt

SEQ ID NO: 2711646 - DNA, 21 bp, Homo sapiens
aggaaaggattttaccaaagc

SEQ ID NO: 2711647 - DNA, 19 bp, Homo sapiens
aggaaatccagtagggaaa

SEQ ID NO: 2711648 - DNA, 16 bp, Homo sapiens
aggaacacccggaaag

SEQ ID NO: 2711649 - DNA, 20 bp, Homo sapiens
aggaacattgggaaggaagc

SEQ ID NO: 2711650 - DNA, 23 bp, Homo sapiens
aggaacattgggaaggaagcccg

SEQ ID NO: 2711651 - DNA, 18 bp, Homo sapiens
aggaagacacagcccaga

SEQ ID NO: 2711652 - DNA, 15 bp, Homo sapiens
actggtatacacact

SEQ ID NO: 2711653 - DNA, 20 bp, Homo sapiens
actggtttatccacccacaa

SEQ ID NO: 2711654 - DNA, 14 bp, Homo sapiens
actgtataaacaaa

SEQ ID NO: 2711655 - DNA, 15 bp, Homo sapiens
actgtataaacaaat

SEQ ID NO: 2711656 - DNA, 13 bp, Homo sapiens
actgtatgctgga

SEQ ID NO: 2711657 - DNA, 15 bp, Homo sapiens
actgtatgtataaat

SEQ ID NO: 2711658 - DNA, 15 bp, Homo sapiens
actgtccgcctctgc

SEQ ID NO: 2711659 - DNA, 18 bp, Homo sapiens
actgtcctgctccacagt

SEQ ID NO: 2711660 - DNA, 19 bp, Homo sapiens
actgtcctgctccacagtg

SEQ ID NO: 2711661 - DNA, 15 bp, Homo sapiens
actgtctctcctgat

SEQ ID NO: 2711662 - DNA, 23 bp, Homo sapiens
actgtgatgttgggaagctattt

SEQ ID NO: 2711663 - DNA, 20 bp, Homo sapiens
actgttcatgaatacgtaaa

SEQ ID NO: 2711664 - DNA, 17 bp, Homo sapiens
actgtttcatgagccca

SEQ ID NO: 2711665 - DNA, 13 bp, Homo sapiens
acttaaacatcat

SEQ ID NO: 2711666 - DNA, 17 bp, Homo sapiens
acttacaaaagcagctt

SEQ ID NO: 2711667 - DNA, 22 bp, Homo sapiens
acttacggtgcacagtaatatg

SEQ ID NO: 2711668 - DNA, 15 bp, Homo sapiens
acttagaataaaatt

SEQ ID NO: 2711669 - DNA, 17 bp, Homo sapiens
acttagaataaaattgt

SEQ ID NO: 2711670 - DNA, 14 bp, Homo sapiens
acttagtttttata

SEQ ID NO: 2711671 - DNA, 18 bp, Homo sapiens
acttagtttttataaaat

SEQ ID NO: 2711672 - DNA, 23 bp, Homo sapiens
acttatttgccctaagaactttg

SEQ ID NO: 2711673 - DNA, 10 bp, Homo sapiens
acttcagcac

SEQ ID NO: 2711674 - DNA, 16 bp, Homo sapiens
acttcaggggctgccc

SEQ ID NO: 2711675 - DNA, 19 bp, Homo sapiens
acttcaggggctgcccgct

SEQ ID NO: 2711676 - DNA, 14 bp, Homo sapiens
acttcagtcttgga

SEQ ID NO: 2711677 - DNA, 15 bp, Homo sapiens
acttcatagatgaga

SEQ ID NO: 2711678 - DNA, 15 bp, Homo sapiens
acttcatgcccactg

SEQ ID NO: 2711679 - DNA, 18 bp, Homo sapiens
acttcatgcccactgccg

SEQ ID NO: 2711680 - DNA, 16 bp, Homo sapiens
acttccatgatacttt

SEQ ID NO: 2711681 - DNA, 16 bp, Homo sapiens
acttcccctcctaccc

SEQ ID NO: 2711682 - DNA, 22 bp, Homo sapiens
acttccctgacactgcggggct

SEQ ID NO: 2711683 - DNA, 23 bp, Homo sapiens
acttcctggtgaggcccagcctg

SEQ ID NO: 2711684 - DNA, 24 bp, Homo sapiens
acttcttgaaacagcctgggtgac

SEQ ID NO: 2711685 - DNA, 20 bp, Homo sapiens
acttgaattttcccactgca

SEQ ID NO: 2711686 - DNA, 17 bp, Homo sapiens
acttgagggtaataaac

SEQ ID NO: 2711687 - DNA, 18 bp, Homo sapiens
acttgagggtaataaact

SEQ ID NO: 2711688 - DNA, 14 bp, Homo sapiens
acttgggtctctgg

SEQ ID NO: 2711689 - DNA, 17 bp, Homo sapiens
actttataagccaatga

SEQ ID NO: 2711690 - DNA, 16 bp, Homo sapiens
actttcaaaagcaaac

SEQ ID NO: 2711691 - DNA, 17 bp, Homo sapiens
actttctcttggacatt

SEQ ID NO: 2711692 - DNA, 23 bp, Homo sapiens
actttgagaatcccaattattta

SEQ ID NO: 2711693 - DNA, 19 bp, Homo sapiens
actttgagggtgtatattt

SEQ ID NO: 2711694 - DNA, 15 bp, Homo sapiens
actttgccttaagtt

SEQ ID NO: 2711695 - DNA, 20 bp, Homo sapiens
actttgcttgattaaacagc

SEQ ID NO: 2711696 - DNA, 19 bp, Homo sapiens
actttggtacatggccagt

SEQ ID NO: 2711697 - DNA, 12 bp, Homo sapiens
actttgtgcaaa

SEQ ID NO: 2711698 - DNA, 22 bp, Homo sapiens
acttttgaagaacaaaaggctt

SEQ ID NO: 2711699 - DNA, 23 bp, Homo sapiens
acttttgaagaacaaaaggcttt

SEQ ID NO: 2711700 - DNA, 22 bp, Homo sapiens
actttttttttttctgcctgag

SEQ ID NO: 2711701 - DNA, 15 bp, Homo sapiens
agaaaaaaagcaaaa

SEQ ID NO: 2711702 - DNA, 14 bp, Homo sapiens
agaaaaattacaga

SEQ ID NO: 2711703 - DNA, 15 bp, Homo sapiens
agaaaaattacagat

SEQ ID NO: 2711704 - DNA, 23 bp, Homo sapiens
agaaaacaattgttctgggtgat

SEQ ID NO: 2711705 - DNA, 14 bp, Homo sapiens
agaaaacctgtttt

SEQ ID NO: 2711706 - DNA, 18 bp, Homo sapiens
agaaaacctgtttttaac

SEQ ID NO: 2711707 - DNA, 16 bp, Homo sapiens
agaaaactgagaggtg

SEQ ID NO: 2711708 - DNA, 16 bp, Homo sapiens
agaaaagcacaatcaa

SEQ ID NO: 2711709 - DNA, 15 bp, Homo sapiens
agaaaatcagatttt

SEQ ID NO: 2711710 - DNA, 22 bp, Homo sapiens
agaaaatgcagccttaaacagt

SEQ ID NO: 2711711 - DNA, 14 bp, Homo sapiens
agaaaatgtgtctg

SEQ ID NO: 2711712 - DNA, 15 bp, Homo sapiens
agaaaccagaaaagc

SEQ ID NO: 2711713 - DNA, 19 bp, Homo sapiens
agaaactcgatgaatgtgt

SEQ ID NO: 2711714 - DNA, 14 bp, Homo sapiens
agaaagtgaccatg

SEQ ID NO: 2711715 - DNA, 14 bp, Homo sapiens
agaaattattttct

SEQ ID NO: 2711716 - DNA, 23 bp, Homo sapiens
agaaatttattcttatcttagga

SEQ ID NO: 2711717 - DNA, 16 bp, Homo sapiens
agaaatttccactcag

SEQ ID NO: 2711718 - DNA, 18 bp, Homo sapiens
agaaatttttttccagaa

SEQ ID NO: 2711719 - DNA, 18 bp, Homo sapiens
agaacacccactggccag

SEQ ID NO: 2711720 - DNA, 13 bp, Homo sapiens
agaacagggatgc

SEQ ID NO: 2711721 - DNA, 21 bp, Homo sapiens
agaacatggtgtgtgtctctg

SEQ ID NO: 2711722 - DNA, 22 bp, Homo sapiens
agaacatggtgtgtgtctctga

SEQ ID NO: 2711723 - DNA, 18 bp, Homo sapiens
agaaccagccgtatttta

SEQ ID NO: 2711724 - DNA, 17 bp, Homo sapiens
agaaccaggctgctgca

SEQ ID NO: 2711725 - DNA, 21 bp, Homo sapiens
agaacctcaggcttccttggc

SEQ ID NO: 2711726 - DNA, 14 bp, Homo sapiens
agaactgccccatc

SEQ ID NO: 2711727 - DNA, 19 bp, Homo sapiens
agaactgccccatctcctc

SEQ ID NO: 2711728 - DNA, 15 bp, Homo sapiens
agcctcacagatgct

SEQ ID NO: 2711729 - DNA, 16 bp, Homo sapiens
agcctcacagatgctg

SEQ ID NO: 2711730 - DNA, 17 bp, Homo sapiens
agcctcacagatgctgg

SEQ ID NO: 2711731 - DNA, 19 bp, Homo sapiens
agcctcacagatgctggcc

SEQ ID NO: 2711732 - DNA, 20 bp, Homo sapiens
agcctcacagatgctggcct

SEQ ID NO: 2711733 - DNA, 15 bp, Homo sapiens
agcctccagtgctgg

SEQ ID NO: 2711734 - DNA, 19 bp, Homo sapiens
agcctccagtgctggctgc

SEQ ID NO: 2711735 - DNA, 20 bp, Homo sapiens
agcctccagtgggaggacag

SEQ ID NO: 2711736 - DNA, 17 bp, Homo sapiens
agcctcccgagtagctg

SEQ ID NO: 2711737 - DNA, 17 bp, Homo sapiens
agcctccgccattccaa

SEQ ID NO: 2711738 - DNA, 21 bp, Homo sapiens
agcctctgcgcctctccactg

SEQ ID NO: 2711739 - DNA, 22 bp, Homo sapiens
agcctctgcgcctctccactgt

SEQ ID NO: 2711740 - DNA, 13 bp, Homo sapiens
agcctctgctgcc

SEQ ID NO: 2711741 - DNA, 18 bp, Homo sapiens
agcctctgtgtcactggc

SEQ ID NO: 2711742 - DNA, 18 bp, Homo sapiens
agcctgaccccaggcagc

SEQ ID NO: 2711743 - DNA, 17 bp, Homo sapiens
agcctgatgatggaagg

SEQ ID NO: 2711744 - DNA, 21 bp, Homo sapiens
agcctgccccagcctcccagc

SEQ ID NO: 2711745 - DNA, 23 bp, Homo sapiens
agcctgccgccgtctctgtcccg

SEQ ID NO: 2711746 - DNA, 16 bp, Homo sapiens
agcctggcccagctcc

SEQ ID NO: 2711747 - DNA, 14 bp, Homo sapiens
agcctggcttctgg

SEQ ID NO: 2711748 - DNA, 21 bp, Homo sapiens
agcctggcttctggagccctt

SEQ ID NO: 2711749 - DNA, 23 bp, Homo sapiens
agcctggcttctggagcccttgg

SEQ ID NO: 2711750 - DNA, 15 bp, Homo sapiens
agcctgggcgacaga

SEQ ID NO: 2711751 - DNA, 13 bp, Homo sapiens
agcctgtcctggt

SEQ ID NO: 2711752 - DNA, 21 bp, Homo sapiens
agcctgtcctggtacagcagg

SEQ ID NO: 2711753 - DNA, 23 bp, Homo sapiens
agcctgtcctggtacagcagggt

SEQ ID NO: 2711754 - DNA, 17 bp, Homo sapiens
agcctgtcgtgtccagc

SEQ ID NO: 2711755 - DNA, 15 bp, Homo sapiens
agcctgttgctgaag

SEQ ID NO: 2711756 - DNA, 16 bp, Homo sapiens
agccttcacatgaaat

SEQ ID NO: 2711757 - DNA, 18 bp, Homo sapiens
agccttcacatgaaatta

SEQ ID NO: 2711758 - DNA, 19 bp, Homo sapiens
agccttcacatgaaattag

SEQ ID NO: 2711759 - DNA, 18 bp, Homo sapiens
agccttgcatcaagggct

SEQ ID NO: 2711760 - DNA, 21 bp, Homo sapiens
agccttgcccggattctggga

SEQ ID NO: 2711761 - DNA, 18 bp, Homo sapiens
agcgaccctggctctgcc

SEQ ID NO: 2711762 - DNA, 20 bp, Homo sapiens
agcgagaaccaggctgctgc

SEQ ID NO: 2711763 - DNA, 18 bp, Homo sapiens
agcgatgaatttggagac

SEQ ID NO: 2711764 - DNA, 17 bp, Homo sapiens
agcgcacctgccccctg

SEQ ID NO: 2711765 - DNA, 12 bp, Homo sapiens
agcgcctcctgg

SEQ ID NO: 2711766 - DNA, 22 bp, Homo sapiens
agcgcctcctggacctgaaggc

SEQ ID NO: 2711767 - DNA, 12 bp, Homo sapiens
agcgcctgtccc

SEQ ID NO: 2711768 - DNA, 18 bp, Homo sapiens
agcgcctgtcccctcaca

SEQ ID NO: 2711769 - DNA, 20 bp, Homo sapiens
agcgcctgtcccctcacaga

SEQ ID NO: 2711770 - DNA, 17 bp, Homo sapiens
agcgcttagaaacatgt

SEQ ID NO: 2711771 - DNA, 22 bp, Homo sapiens
agcgcttagaaacatgttcctg

SEQ ID NO: 2711772 - DNA, 19 bp, Homo sapiens
agcgtccatttcttattta

SEQ ID NO: 2711773 - DNA, 19 bp, Homo sapiens
agcgtgattcctgctgcct

SEQ ID NO: 2711774 - DNA, 22 bp, Homo sapiens
agctaaggtctataaacatgaa

SEQ ID NO: 2711775 - DNA, 20 bp, Homo sapiens
agctactcagaagcctgagg

SEQ ID NO: 2711776 - DNA, 22 bp, Homo sapiens
agctagaggagattgctctggg

SEQ ID NO: 2711777 - DNA, 19 bp, Homo sapiens
agctagctatttctatgta

SEQ ID NO: 2711778 - DNA, 22 bp, Homo sapiens
agctagctatttctatgtatgt

SEQ ID NO: 2711779 - DNA, 23 bp, Homo sapiens
agctagctatttctatgtatgtg

SEQ ID NO: 2711780 - DNA, 18 bp, Homo sapiens
agctatggaaggtcttgc

SEQ ID NO: 2711781 - DNA, 13 bp, Homo sapiens
agctatggtgagg

SEQ ID NO: 2711782 - DNA, 15 bp, Homo sapiens
agctattagcaactg

SEQ ID NO: 2711783 - DNA, 17 bp, Homo sapiens
agctattcaggaggctg

SEQ ID NO: 2711784 - DNA, 15 bp, Homo sapiens
agctatttctatgta

SEQ ID NO: 2711785 - DNA, 13 bp, Homo sapiens
agctccctggtga

SEQ ID NO: 2711786 - DNA, 13 bp, Homo sapiens
agctcctgtccct

SEQ ID NO: 2711787 - DNA, 18 bp, Homo sapiens
agctcctgtccctaccca

SEQ ID NO: 2711788 - DNA, 22 bp, Homo sapiens
agctcctgtccctacccactct

SEQ ID NO: 2711789 - DNA, 17 bp, Homo sapiens
agctctacacaacatgt

SEQ ID NO: 2711790 - DNA, 16 bp, Homo sapiens
agctctatctgcaatg

SEQ ID NO: 2711791 - DNA, 13 bp, Homo sapiens
agctctgctggaa

SEQ ID NO: 2711792 - DNA, 16 bp, Homo sapiens
agctctgtcaccctgg

SEQ ID NO: 2711793 - DNA, 21 bp, Homo sapiens
attaaattctctctaacataa

SEQ ID NO: 2711794 - DNA, 24 bp, Homo sapiens
attaaattctctctaacataacaa

SEQ ID NO: 2711795 - DNA, 16 bp, Homo sapiens
attaacaaagttactg

SEQ ID NO: 2711796 - DNA, 20 bp, Homo sapiens
attaacaaagttactggctc

SEQ ID NO: 2711797 - DNA, 18 bp, Homo sapiens
attaactccgtttccaaa

SEQ ID NO: 2711798 - DNA, 20 bp, Homo sapiens
attaactttcaaaagcaaac

SEQ ID NO: 2711799 - DNA, 17 bp, Homo sapiens
attaagaaacaatttaa

SEQ ID NO: 2711800 - DNA, 13 bp, Homo sapiens
attaagatttcca

SEQ ID NO: 2711801 - DNA, 16 bp, Homo sapiens
attaagatttccaagt

SEQ ID NO: 2711802 - DNA, 13 bp, Homo sapiens
attaatattcttt

SEQ ID NO: 2711803 - DNA, 15 bp, Homo sapiens
attaatattcttttg

SEQ ID NO: 2711804 - DNA, 16 bp, Homo sapiens
attaatattcttttgt

SEQ ID NO: 2711805 - DNA, 13 bp, Homo sapiens
attaatcttttaa

SEQ ID NO: 2711806 - DNA, 23 bp, Homo sapiens
atatttttaaaggaaaaatcata

SEQ ID NO: 2711807 - DNA, 17 bp, Homo sapiens
atatttttaatttatga

SEQ ID NO: 2711808 - DNA, 12 bp, Homo sapiens
atcaaacatgaa

SEQ ID NO: 2711809 - DNA, 15 bp, Homo sapiens
atcaaacatgaaaac

SEQ ID NO: 2711810 - DNA, 13 bp, Homo sapiens
atcaaatttttct

SEQ ID NO: 2711811 - DNA, 15 bp, Homo sapiens
atcaaatttttctgg

SEQ ID NO: 2711812 - DNA, 15 bp, Homo sapiens
atcaagagtctctcc

SEQ ID NO: 2711813 - DNA, 18 bp, Homo sapiens
atcaagagtctctccagc

SEQ ID NO: 2711814 - DNA, 21 bp, Homo sapiens
atcaagagtctctccagcctc

SEQ ID NO: 2711815 - DNA, 22 bp, Homo sapiens
atcaagagtctctccagcctca

SEQ ID NO: 2711816 - DNA, 18 bp, Homo sapiens
atcaatgaaggatttctt

SEQ ID NO: 2711817 - DNA, 14 bp, Homo sapiens
atcaattcattgtg

SEQ ID NO: 2711818 - DNA, 15 bp, Homo sapiens
atcaattcattgtgt

SEQ ID NO: 2711819 - DNA, 19 bp, Homo sapiens
atcaattcattgtgtatga

SEQ ID NO: 2711820 - DNA, 21 bp, Homo sapiens
atcacaaacatatgtatcttt

SEQ ID NO: 2711821 - DNA, 15 bp, Homo sapiens
atcacagggcagagc

SEQ ID NO: 2711822 - DNA, 20 bp, Homo sapiens
atcacagggcagagccggga

SEQ ID NO: 2711823 - DNA, 12 bp, Homo sapiens
atcacctcaggc

SEQ ID NO: 2711824 - DNA, 14 bp, Homo sapiens
atcacctcaggcca

SEQ ID NO: 2711825 - DNA, 14 bp, Homo sapiens
atcacgccactgca

SEQ ID NO: 2711826 - DNA, 10 bp, Homo sapiens
atcactggag

SEQ ID NO: 2711827 - DNA, 12 bp, Homo sapiens
atcactggagcc

SEQ ID NO: 2711828 - DNA, 13 bp, Homo sapiens
atcactggagccc

SEQ ID NO: 2711829 - DNA, 15 bp, Homo sapiens
atcactggagcccag

SEQ ID NO: 2711830 - DNA, 22 bp, Homo sapiens
atcagaagtaactcccactcct

SEQ ID NO: 2711831 - DNA, 20 bp, Homo sapiens
atcagcctccgccattccaa

SEQ ID NO: 2711832 - DNA, 22 bp, Homo sapiens
atcaggaaaggaagatgtaaga

SEQ ID NO: 2711833 - DNA, 20 bp, Homo sapiens
agttctctgttctagagtga

SEQ ID NO: 2711834 - DNA, 12 bp, Homo sapiens
agttctgctcta

SEQ ID NO: 2711835 - DNA, 15 bp, Homo sapiens
agttctttgcaagct

SEQ ID NO: 2711836 - DNA, 12 bp, Homo sapiens
agttgacttttt

SEQ ID NO: 2711837 - DNA, 13 bp, Homo sapiens
agttgtctttctt

SEQ ID NO: 2711838 - DNA, 20 bp, Homo sapiens
agttgtctttctttgctgct

SEQ ID NO: 2711839 - DNA, 13 bp, Homo sapiens
agttgtgatcatc

SEQ ID NO: 2711840 - DNA, 19 bp, Homo sapiens
agttgtggaaagcctctgc

SEQ ID NO: 2711841 - DNA, 19 bp, Homo sapiens
agtttaaaatgaagcaatt

SEQ ID NO: 2711842 - DNA, 15 bp, Homo sapiens
agtttatgtctaaag

SEQ ID NO: 2711843 - DNA, 16 bp, Homo sapiens
agtttatgtctaaaga

SEQ ID NO: 2711844 - DNA, 22 bp, Homo sapiens
agtttccaaagggcagtaaagt

SEQ ID NO: 2711845 - DNA, 18 bp, Homo sapiens
agtttctaaccaaagagt

SEQ ID NO: 2711846 - DNA, 18 bp, Homo sapiens
agtttctcaagtttaaag

SEQ ID NO: 2711847 - DNA, 16 bp, Homo sapiens
agtttgatttaatatc

SEQ ID NO: 2711848 - DNA, 19 bp, Homo sapiens
agtttgatttaatatctga

SEQ ID NO: 2711849 - DNA, 21 bp, Homo sapiens
agtttgctgtatacaaacagg

SEQ ID NO: 2711850 - DNA, 19 bp, Homo sapiens
agtttgtggtaaaaagatt

SEQ ID NO: 2711851 - DNA, 12 bp, Homo sapiens
agtttgttttag

SEQ ID NO: 2711852 - DNA, 19 bp, Homo sapiens
agttttatacataaacagt

SEQ ID NO: 2711853 - DNA, 18 bp, Homo sapiens
agttttttacttctctta

SEQ ID NO: 2711854 - DNA, 20 bp, Homo sapiens
ataaaaaaatatatacagat

SEQ ID NO: 2711855 - DNA, 14 bp, Homo sapiens
ataaaataatttta

SEQ ID NO: 2711856 - DNA, 21 bp, Homo sapiens
ataaaatgggaattctgactt

SEQ ID NO: 2711857 - DNA, 15 bp, Homo sapiens
ataaacagttttgga

SEQ ID NO: 2711858 - DNA, 12 bp, Homo sapiens
ataaacatgaag

SEQ ID NO: 2711859 - DNA, 22 bp, Homo sapiens
ataaacctctaatttattttgt

SEQ ID NO: 2711860 - DNA, 14 bp, Homo sapiens
ataaacttagaata

SEQ ID NO: 2711861 - DNA, 11 bp, Homo sapiens
ataaacttcag

SEQ ID NO: 2711862 - DNA, 15 bp, Homo sapiens
ataaagatggctatt

SEQ ID NO: 2711863 - DNA, 12 bp, Homo sapiens
ataaagcagagt

SEQ ID NO: 2711864 - DNA, 21 bp, Homo sapiens
ataaatacacagcatgcagac

SEQ ID NO: 2711865 - DNA, 15 bp, Homo sapiens
ataaatatgtgaaaa

SEQ ID NO: 2711866 - DNA, 15 bp, Homo sapiens
ataaatcaattcatt

SEQ ID NO: 2711867 - DNA, 21 bp, Homo sapiens
aggccctgcactgtcctgctc

SEQ ID NO: 2711868 - DNA, 24 bp, Homo sapiens
aggccctgcactgtcctgctccac

SEQ ID NO: 2711869 - DNA, 14 bp, Homo sapiens
aggccggccctgcc

SEQ ID NO: 2711870 - DNA, 12 bp, Homo sapiens
aggcctcccaca

SEQ ID NO: 2711871 - DNA, 16 bp, Homo sapiens
aggcctcccacagtga

SEQ ID NO: 2711872 - DNA, 22 bp, Homo sapiens
aggcctcccttgagtaggccct

SEQ ID NO: 2711873 - DNA, 22 bp, Homo sapiens
aggcctttctagaattttcttt

SEQ ID NO: 2711874 - DNA, 19 bp, Homo sapiens
aggcgtcaacgtgcatttt

SEQ ID NO: 2711875 - DNA, 14 bp, Homo sapiens
aggctagtctcttc

SEQ ID NO: 2711876 - DNA, 17 bp, Homo sapiens
aggctcagtctcaggag

SEQ ID NO: 2711877 - DNA, 17 bp, Homo sapiens
aggctccgtgagccctt

SEQ ID NO: 2711878 - DNA, 13 bp, Homo sapiens
aggctcctccctc

SEQ ID NO: 2711879 - DNA, 14 bp, Homo sapiens
aggctcctccctct

SEQ ID NO: 2711880 - DNA, 17 bp, Homo sapiens
aggctcctccctctgcc

SEQ ID NO: 2711881 - DNA, 17 bp, Homo sapiens
aggctgagactgcggga

SEQ ID NO: 2711882 - DNA, 22 bp, Homo sapiens
aggctgaggggaggatcactgg

SEQ ID NO: 2711883 - DNA, 20 bp, Homo sapiens
aggctggaaaagggctcaga

SEQ ID NO: 2711884 - DNA, 15 bp, Homo sapiens
aggctggcatcctgg

SEQ ID NO: 2711885 - DNA, 22 bp, Homo sapiens
aggctggcatcctggctggctg

SEQ ID NO: 2711886 - DNA, 15 bp, Homo sapiens
aggctggccagcccc

SEQ ID NO: 2711887 - DNA, 16 bp, Homo sapiens
aggctggccagcccca

SEQ ID NO: 2711888 - DNA, 21 bp, Homo sapiens
aggctggccagccccacagcc

SEQ ID NO: 2711889 - DNA, 22 bp, Homo sapiens
aggctggccagccccacagccc

SEQ ID NO: 2711890 - DNA, 13 bp, Homo sapiens
aggctggctgggg

SEQ ID NO: 2711891 - DNA, 16 bp, Homo sapiens
aggctgggtccagggg

SEQ ID NO: 2711892 - DNA, 22 bp, Homo sapiens
aggctggtctcgaactcctgac

SEQ ID NO: 2711893 - DNA, 22 bp, Homo sapiens
aggctgtaagcattctgagctg

SEQ ID NO: 2711894 - DNA, 17 bp, Homo sapiens
aggcttaggtgccaggc

SEQ ID NO: 2711895 - DNA, 12 bp, Homo sapiens
aggcttctccac

SEQ ID NO: 2711896 - DNA, 18 bp, Homo sapiens
aggctttgccatgggcct

SEQ ID NO: 2711897 - DNA, 23 bp, Homo sapiens
aggctttgccatgggcctgctgc

SEQ ID NO: 2711898 - DNA, 16 bp, Homo sapiens
agggaaaagctaagag

SEQ ID NO: 2711899 - DNA, 12 bp, Homo sapiens
agggaagcaggg

SEQ ID NO: 2711900 - DNA, 14 bp, Homo sapiens
agggacagaagcag

SEQ ID NO: 2711901 - DNA, 16 bp, Homo sapiens
agggaccactgggtga

SEQ ID NO: 2711902 - DNA, 18 bp, Homo sapiens
agggaccactgggtgaga

SEQ ID NO: 2711903 - DNA, 19 bp, Homo sapiens
agggactcaggccagtcac

SEQ ID NO: 2711904 - DNA, 15 bp, Homo sapiens
agggactgctgaccc

SEQ ID NO: 2711905 - DNA, 20 bp, Homo sapiens
agggactgctgacccaccaa

SEQ ID NO: 2711906 - DNA, 14 bp, Homo sapiens
agggagagatgagt

SEQ ID NO: 2711907 - DNA, 16 bp, Homo sapiens
agggagcaactctcca

SEQ ID NO: 2711908 - DNA, 18 bp, Homo sapiens
agggagctgaggcctccc

SEQ ID NO: 2711909 - DNA, 20 bp, Homo sapiens
agggagctgaggcctccctt

SEQ ID NO: 2711910 - DNA, 21 bp, Homo sapiens
agggagctgaggcctcccttg

SEQ ID NO: 2711911 - DNA, 15 bp, Homo sapiens
agggagctggcaatg

SEQ ID NO: 2711912 - DNA, 13 bp, Homo sapiens
agggagggagctg

SEQ ID NO: 2711913 - DNA, 21 bp, Homo sapiens
agggataggaagtgccccagg

SEQ ID NO: 2711914 - DNA, 16 bp, Homo sapiens
agtcctgctggcctgc

SEQ ID NO: 2711915 - DNA, 21 bp, Homo sapiens
agtcctgggagaacctcaggc

SEQ ID NO: 2711916 - DNA, 19 bp, Homo sapiens
agtcctttttgtaactacc

SEQ ID NO: 2711917 - DNA, 12 bp, Homo sapiens
agtctaaagttt

SEQ ID NO: 2711918 - DNA, 14 bp, Homo sapiens
agtctaaagtttac

SEQ ID NO: 2711919 - DNA, 14 bp, Homo sapiens
agtctcaaatcaaa

SEQ ID NO: 2711920 - DNA, 13 bp, Homo sapiens
agtctcaattttg

SEQ ID NO: 2711921 - DNA, 14 bp, Homo sapiens
agtctcaattttgt

SEQ ID NO: 2711922 - DNA, 22 bp, Homo sapiens
agtctcaggtgacggactcaga

SEQ ID NO: 2711923 - DNA, 22 bp, Homo sapiens
agtctcatgcaagacttcactg

SEQ ID NO: 2711924 - DNA, 14 bp, Homo sapiens
agtctctccagcct

SEQ ID NO: 2711925 - DNA, 15 bp, Homo sapiens
agtctctccagcctc

SEQ ID NO: 2711926 - DNA, 19 bp, Homo sapiens
agtctctccagcctcacag

SEQ ID NO: 2711927 - DNA, 16 bp, Homo sapiens
agtctctgttgtaaat

SEQ ID NO: 2711928 - DNA, 18 bp, Homo sapiens
agtctcttctcagagcag

SEQ ID NO: 2711929 - DNA, 17 bp, Homo sapiens
agtctgtctcaaaagaa

SEQ ID NO: 2711930 - DNA, 12 bp, Homo sapiens
agtcttgcattg

SEQ ID NO: 2711931 - DNA, 13 bp, Homo sapiens
agtcttttgctgt

SEQ ID NO: 2711932 - DNA, 15 bp, Homo sapiens
agtgaataaacttca

SEQ ID NO: 2711933 - DNA, 17 bp, Homo sapiens
agtgaataaacttcagc

SEQ ID NO: 2711934 - DNA, 22 bp, Homo sapiens
agtgacaggcaccagatgggat

SEQ ID NO: 2711935 - DNA, 18 bp, Homo sapiens
agtgacgtgactcagagc

SEQ ID NO: 2711936 - DNA, 17 bp, Homo sapiens
agtgactcgggctcctg

SEQ ID NO: 2711937 - DNA, 16 bp, Homo sapiens
agtgacttcctggtga

SEQ ID NO: 2711938 - DNA, 17 bp, Homo sapiens
agtgagaagggcctgct

SEQ ID NO: 2711939 - DNA, 16 bp, Homo sapiens
agtgagaccctgtctc

SEQ ID NO: 2711940 - DNA, 12 bp, Homo sapiens
agtgagtggcat

SEQ ID NO: 2711941 - DNA, 16 bp, Homo sapiens
agtgagtggcatgtgg

SEQ ID NO: 2711942 - DNA, 17 bp, Homo sapiens
agtgagtggtgttggca

SEQ ID NO: 2711943 - DNA, 21 bp, Homo sapiens
agtgattgttatgccttgcta

SEQ ID NO: 2711944 - DNA, 18 bp, Homo sapiens
agtgcagcatgggaaagg

SEQ ID NO: 2711945 - DNA, 21 bp, Homo sapiens
agtgccctctggacagcttga

SEQ ID NO: 2711946 - DNA, 16 bp, Homo sapiens
agtgccgccgcctcgc

SEQ ID NO: 2711947 - DNA, 19 bp, Homo sapiens
agtgccgccgcctcgccca

SEQ ID NO: 2711948 - DNA, 20 bp, Homo sapiens
agtgccgccgcctcgcccac

SEQ ID NO: 2711949 - DNA, 23 bp, Homo sapiens
agtgccgccgcctcgcccaccgc

SEQ ID NO: 2711950 - DNA, 14 bp, Homo sapiens
agtgctcctgtgca

SEQ ID NO: 2711951 - DNA, 12 bp, Homo sapiens
agtgctgcagct

SEQ ID NO: 2711952 - DNA, 13 bp, Homo sapiens
agtgctgcagctt

SEQ ID NO: 2711953 - DNA, 16 bp, Homo sapiens
agtgctgcagctttgg

SEQ ID NO: 2711954 - DNA, 20 bp, Homo sapiens
agtgctgcagctttgggaaa

SEQ ID NO: 2711955 - DNA, 13 bp, Homo sapiens
agtgctggctgct

SEQ ID NO: 2711956 - DNA, 14 bp, Homo sapiens
agtgctgtggcctg

SEQ ID NO: 2711957 - DNA, 15 bp, Homo sapiens
agtgcttcagcctga

SEQ ID NO: 2711958 - DNA, 13 bp, Homo sapiens
agtgcttcttgta

SEQ ID NO: 2711959 - DNA, 14 bp, Homo sapiens
agtgcttcttgtaa

SEQ ID NO: 2711960 - DNA, 22 bp, Homo sapiens
agtgcttcttgtaatatttctt

SEQ ID NO: 2711961 - DNA, 16 bp, Homo sapiens
agtggaaccagcccag

SEQ ID NO: 2711962 - DNA, 13 bp, Homo sapiens
agtggcactaaaa

SEQ ID NO: 2711963 - DNA, 14 bp, Homo sapiens
agtggcagccgcct

SEQ ID NO: 2711964 - DNA, 23 bp, Homo sapiens
agtggcatgtgggttgtgatatt

SEQ ID NO: 2711965 - DNA, 12 bp, Homo sapiens
agtggctgtcca

SEQ ID NO: 2711966 - DNA, 16 bp, Homo sapiens
agtgggagatgaaaac

SEQ ID NO: 2711967 - DNA, 17 bp, Homo sapiens
agtgggagatgaaaacc

SEQ ID NO: 2711968 - DNA, 14 bp, Homo sapiens
agtgggtcccactt

SEQ ID NO: 2711969 - DNA, 22 bp, Homo sapiens
agtgggtcccacttcccctcct

SEQ ID NO: 2711970 - DNA, 19 bp, Homo sapiens
agtgtacccccgcccaggc

SEQ ID NO: 2711971 - DNA, 20 bp, Homo sapiens
agtgtacccccgcccaggct

SEQ ID NO: 2711972 - DNA, 18 bp, Homo sapiens
agtgtagccttgcccgga

SEQ ID NO: 2711973 - DNA, 16 bp, Homo sapiens
agtgtattttctgtgt

SEQ ID NO: 2711974 - DNA, 13 bp, Homo sapiens
agtgtcctggacc

SEQ ID NO: 2711975 - DNA, 19 bp, Homo sapiens
agtgtcctggaccctggcc

SEQ ID NO: 2711976 - DNA, 16 bp, Homo sapiens
agtgtcctgtctgctg

SEQ ID NO: 2711977 - DNA, 15 bp, Homo sapiens
agtgtcgagtccagt

SEQ ID NO: 2711978 - DNA, 18 bp, Homo sapiens
agtgtcgtgtctgctgtt

SEQ ID NO: 2711979 - DNA, 19 bp, Homo sapiens
agtgtcgtgtctgctgttg

SEQ ID NO: 2711980 - DNA, 12 bp, Homo sapiens
agtgtctctgcc

SEQ ID NO: 2711981 - DNA, 14 bp, Homo sapiens
agtgtctctgcctg

SEQ ID NO: 2711982 - DNA, 15 bp, Homo sapiens
agtgtctctgcctgg

SEQ ID NO: 2711983 - DNA, 14 bp, Homo sapiens
agtgtctgggctga

SEQ ID NO: 2711984 - DNA, 13 bp, Homo sapiens
agtgtgcccccca

SEQ ID NO: 2711985 - DNA, 20 bp, Homo sapiens
agtgtgccccccatcctggc

SEQ ID NO: 2711986 - DNA, 17 bp, Homo sapiens
agtgtggatgttcagaa

SEQ ID NO: 2711987 - DNA, 21 bp, Homo sapiens
agtgtgtgctcagcagcccca

SEQ ID NO: 2711988 - DNA, 14 bp, Homo sapiens
agtgtttcctgagt

SEQ ID NO: 2711989 - DNA, 15 bp, Homo sapiens
agttaagatgtttct

SEQ ID NO: 2711990 - DNA, 16 bp, Homo sapiens
agttaaggtatctggt

SEQ ID NO: 2711991 - DNA, 19 bp, Homo sapiens
agttactggctctttgtgt

SEQ ID NO: 2711992 - DNA, 14 bp, Homo sapiens
agttatatttgtct

SEQ ID NO: 2711993 - DNA, 22 bp, Homo sapiens
agttatttatgcctctgtattt

SEQ ID NO: 2711994 - DNA, 14 bp, Homo sapiens
agttcaagaccagc

SEQ ID NO: 2711995 - DNA, 20 bp, Homo sapiens
agttcagttcctctttgcat

SEQ ID NO: 2711996 - DNA, 17 bp, Homo sapiens
agttccaggactcaggg

SEQ ID NO: 2711997 - DNA, 19 bp, Homo sapiens
agttccagttttgttttga

SEQ ID NO: 2711998 - DNA, 21 bp, Homo sapiens
agttcctctttgcatggaatt

SEQ ID NO: 2711999 - DNA, 21 bp, Homo sapiens
agttcgagaccagcctggcca

SEQ ID NO: 2712000 - DNA, 18 bp, Homo sapiens
agttctagttgattgcga

SEQ ID NO: 2712001 - DNA, 17 bp, Homo sapiens
ccaccctaaagtctcag

SEQ ID NO: 2712002 - DNA, 22 bp, Homo sapiens
ccaccctgggcaatgcagtgca

SEQ ID NO: 2712003 - DNA, 12 bp, Homo sapiens
ccaccctgggct

SEQ ID NO: 2712004 - DNA, 17 bp, Homo sapiens
ccaccctgggctctgtg

SEQ ID NO: 2712005 - DNA, 21 bp, Homo sapiens
ccaccctgggtttggcccctg

SEQ ID NO: 2712006 - DNA, 22 bp, Homo sapiens
ccaccctgggtttggcccctgg

SEQ ID NO: 2712007 - DNA, 23 bp, Homo sapiens
ccaccctgggtttggcccctgga

SEQ ID NO: 2712008 - DNA, 12 bp, Homo sapiens
ccaccgcagctg

SEQ ID NO: 2712009 - DNA, 14 bp, Homo sapiens
ccaccgcagctgct

SEQ ID NO: 2712010 - DNA, 17 bp, Homo sapiens
ccaccgcagctgctgcc

SEQ ID NO: 2712011 - DNA, 13 bp, Homo sapiens
ccaccgcatgccc

SEQ ID NO: 2712012 - DNA, 18 bp, Homo sapiens
ccaccgcatgccccctcg

SEQ ID NO: 2712013 - DNA, 18 bp, Homo sapiens
ccaccgccatggcttcca

SEQ ID NO: 2712014 - DNA, 14 bp, Homo sapiens
ccaccgcgcccagc

SEQ ID NO: 2712015 - DNA, 16 bp, Homo sapiens
ccacctagtggctgtc

SEQ ID NO: 2712016 - DNA, 18 bp, Homo sapiens
ccacctagtggctgtcca

SEQ ID NO: 2712017 - DNA, 20 bp, Homo sapiens
ccacctagtggctgtccagt

SEQ ID NO: 2712018 - DNA, 15 bp, Homo sapiens
ccacctccacccact

SEQ ID NO: 2712019 - DNA, 14 bp, Homo sapiens
ccacctcggatccc

SEQ ID NO: 2712020 - DNA, 20 bp, Homo sapiens
ccacctcggatcccactgat

SEQ ID NO: 2712021 - DNA, 20 bp, Homo sapiens
ccacctttgggatcagcctc

SEQ ID NO: 2712022 - DNA, 21 bp, Homo sapiens
ccacgaacacgcatgcctcag

SEQ ID NO: 2712023 - DNA, 20 bp, Homo sapiens
ccacggcactccagcctggg

SEQ ID NO: 2712024 - DNA, 13 bp, Homo sapiens
ccacggtcttctg

SEQ ID NO: 2712025 - DNA, 15 bp, Homo sapiens
ccacggtcttctgca

SEQ ID NO: 2712026 - DNA, 23 bp, Homo sapiens
ccacgtaccaagccaccgcagct

SEQ ID NO: 2712027 - DNA, 17 bp, Homo sapiens
ccacgtctctctgcctg

SEQ ID NO: 2712028 - DNA, 19 bp, Homo sapiens
ccacgtctctctgcctgct

SEQ ID NO: 2712029 - DNA, 17 bp, Homo sapiens
ccacgtctgtgctctgt

SEQ ID NO: 2712030 - DNA, 21 bp, Homo sapiens
ccactaagctttctcctttga

SEQ ID NO: 2712031 - DNA, 18 bp, Homo sapiens
ccactacactccagcctg

SEQ ID NO: 2712032 - DNA, 21 bp, Homo sapiens
ccactacactccagcctgagc

SEQ ID NO: 2712033 - DNA, 14 bp, Homo sapiens
ccactacctttgtc

SEQ ID NO: 2712034 - DNA, 20 bp, Homo sapiens
ccactaggactctgaggctc

SEQ ID NO: 2712035 - DNA, 20 bp, Homo sapiens
ccactagggtcctggccctc

SEQ ID NO: 2712036 - DNA, 13 bp, Homo sapiens
ccactcaggccaa

SEQ ID NO: 2712037 - DNA, 11 bp, Homo sapiens
ccactcaggtc

SEQ ID NO: 2712038 - DNA, 11 bp, Homo sapiens
ccactcccact

SEQ ID NO: 2712039 - DNA, 12 bp, Homo sapiens
ccactcccactt

SEQ ID NO: 2712040 - DNA, 21 bp, Homo sapiens
ccactcccacttccctgacac

SEQ ID NO: 2712041 - DNA, 22 bp, Homo sapiens
ccactcccacttccctgacact

SEQ ID NO: 2712042 - DNA, 23 bp, Homo sapiens
ccactcccacttccctgacactg

SEQ ID NO: 2712043 - DNA, 15 bp, Homo sapiens
ccactccccagtgct

SEQ ID NO: 2712044 - DNA, 21 bp, Homo sapiens
ccactccccagtgctcctgtg

SEQ ID NO: 2712045 - DNA, 11 bp, Homo sapiens
ccactgcaccc

SEQ ID NO: 2712046 - DNA, 21 bp, Homo sapiens
ccactgcaccccctcctgctg

SEQ ID NO: 2712047 - DNA, 20 bp, Homo sapiens
ccactgcactccagcctggg

SEQ ID NO: 2712048 - DNA, 15 bp, Homo sapiens
ccactgccgcctcct

SEQ ID NO: 2712049 - DNA, 16 bp, Homo sapiens
ccactgccgcctcctt

SEQ ID NO: 2712050 - DNA, 13 bp, Homo sapiens
ccactggccagtc

SEQ ID NO: 2712051 - DNA, 15 bp, Homo sapiens
ccactggccagtcct

SEQ ID NO: 2712052 - DNA, 22 bp, Homo sapiens
ccactggccagtcctagagctc

SEQ ID NO: 2712053 - DNA, 24 bp, Homo sapiens
ccactggccagtcctagagctcct

SEQ ID NO: 2712054 - DNA, 14 bp, Homo sapiens
ccactgtccgcctc

SEQ ID NO: 2712055 - DNA, 21 bp, Homo sapiens
cattcaaaatgtccagcttct

SEQ ID NO: 2712056 - DNA, 17 bp, Homo sapiens
cattcacagcgcctcct

SEQ ID NO: 2712057 - DNA, 18 bp, Homo sapiens
cattcacagcgcctcctg

SEQ ID NO: 2712058 - DNA, 12 bp, Homo sapiens
cattcacatttc

SEQ ID NO: 2712059 - DNA, 16 bp, Homo sapiens
cattcatctggaggct

SEQ ID NO: 2712060 - DNA, 22 bp, Homo sapiens
cattcatgttttaaaagtttgt

SEQ ID NO: 2712061 - DNA, 23 bp, Homo sapiens
cattctcctgcctcagcctcctg

SEQ ID NO: 2712062 - DNA, 12 bp, Homo sapiens
cattctgtctct

SEQ ID NO: 2712063 - DNA, 16 bp, Homo sapiens
cattctgtctctgctt

SEQ ID NO: 2712064 - DNA, 19 bp, Homo sapiens
cattctgtctctgcttggc

SEQ ID NO: 2712065 - DNA, 14 bp, Homo sapiens
cattggcagcaggt

SEQ ID NO: 2712066 - DNA, 16 bp, Homo sapiens
cattggcagcaggtgc

SEQ ID NO: 2712067 - DNA, 23 bp, Homo sapiens
cattggcagcaggtgctgctacc

SEQ ID NO: 2712068 - DNA, 20 bp, Homo sapiens
cattgtaacctcgtgtctag

SEQ ID NO: 2712069 - DNA, 22 bp, Homo sapiens
cattgtaacctcgtgtctagta

SEQ ID NO: 2712070 - DNA, 17 bp, Homo sapiens
cattgtcttccaacccc

SEQ ID NO: 2712071 - DNA, 23 bp, Homo sapiens
cattgtcttccaaccccagctgg

SEQ ID NO: 2712072 - DNA, 21 bp, Homo sapiens
cattgtggccagtttagagtt

SEQ ID NO: 2712073 - DNA, 23 bp, Homo sapiens
cattgtgtatgagactgtgtttc

SEQ ID NO: 2712074 - DNA, 17 bp, Homo sapiens
catttaaacatgcagaa

SEQ ID NO: 2712075 - DNA, 23 bp, Homo sapiens
catttcatacaacagaaaccaga

SEQ ID NO: 2712076 - DNA, 15 bp, Homo sapiens
catttctaacataag

SEQ ID NO: 2712077 - DNA, 21 bp, Homo sapiens
catttctaacataagtaagac

SEQ ID NO: 2712078 - DNA, 16 bp, Homo sapiens
catttctactgtataa

SEQ ID NO: 2712079 - DNA, 23 bp, Homo sapiens
catttgaaagtgggtttcaattt

SEQ ID NO: 2712080 - DNA, 22 bp, Homo sapiens
catttgagttattttaattatc

SEQ ID NO: 2712081 - DNA, 21 bp, Homo sapiens
catttggcagaactgctgggg

SEQ ID NO: 2712082 - DNA, 13 bp, Homo sapiens
cattttagaaaat

SEQ ID NO: 2712083 - DNA, 20 bp, Homo sapiens
cattttagaaaatcagattt

SEQ ID NO: 2712084 - DNA, 18 bp, Homo sapiens
cattttatataaagaaaa

SEQ ID NO: 2712085 - DNA, 22 bp, Homo sapiens
cattttcttgtcaatggaagaa

SEQ ID NO: 2712086 - DNA, 21 bp, Homo sapiens
cattttgaaaacccctggctg

SEQ ID NO: 2712087 - DNA, 12 bp, Homo sapiens
cattttgaatgt

SEQ ID NO: 2712088 - DNA, 19 bp, Homo sapiens
cattttgcattagacagat

SEQ ID NO: 2712089 - DNA, 14 bp, Homo sapiens
catttttaaaacaa

SEQ ID NO: 2712090 - DNA, 23 bp, Homo sapiens
catttttgtacattatgttattg

SEQ ID NO: 2712091 - DNA, 19 bp, Homo sapiens
ccaaacaccctcctggcac

SEQ ID NO: 2712092 - DNA, 22 bp, Homo sapiens
ccaaacactgggctctgaggag

SEQ ID NO: 2712093 - DNA, 14 bp, Homo sapiens
ccaaagagtctctg

SEQ ID NO: 2712094 - DNA, 18 bp, Homo sapiens
ccaaagagtctctggctc

SEQ ID NO: 2712095 - DNA, 19 bp, Homo sapiens
ccaaagagtctctggctca

SEQ ID NO: 2712096 - DNA, 22 bp, Homo sapiens
ccaaagagtctctggctcagct

SEQ ID NO: 2712097 - DNA, 14 bp, Homo sapiens
ccaaatcaggctgg

SEQ ID NO: 2712098 - DNA, 17 bp, Homo sapiens
ccaaatccacaagccat

SEQ ID NO: 2712099 - DNA, 12 bp, Homo sapiens
ccaaattcaaag

SEQ ID NO: 2712100 - DNA, 20 bp, Homo sapiens
ccaaattgtctgtctgctct

SEQ ID NO: 2712101 - DNA, 17 bp, Homo sapiens
catcaaacatgaaaaca

SEQ ID NO: 2712102 - DNA, 22 bp, Homo sapiens
catcaaacatgaaaacattgat

SEQ ID NO: 2712103 - DNA, 17 bp, Homo sapiens
catcaatacaaccagcc

SEQ ID NO: 2712104 - DNA, 13 bp, Homo sapiens
catcacagggcag

SEQ ID NO: 2712105 - DNA, 15 bp, Homo sapiens
catcacagggcagag

SEQ ID NO: 2712106 - DNA, 23 bp, Homo sapiens
catcaccgtcattgatggagcct

SEQ ID NO: 2712107 - DNA, 13 bp, Homo sapiens
catcacctcaggc

SEQ ID NO: 2712108 - DNA, 13 bp, Homo sapiens
catcagaactgaa

SEQ ID NO: 2712109 - DNA, 18 bp, Homo sapiens
catcagaagtaactccca

SEQ ID NO: 2712110 - DNA, 20 bp, Homo sapiens
catcagaagtaactcccact

SEQ ID NO: 2712111 - DNA, 21 bp, Homo sapiens
catcagaagtaactcccactc

SEQ ID NO: 2712112 - DNA, 18 bp, Homo sapiens
catcattggataaatttg

SEQ ID NO: 2712113 - DNA, 20 bp, Homo sapiens
catcattggataaatttgaa

SEQ ID NO: 2712114 - DNA, 15 bp, Homo sapiens
catccaaccccccac

SEQ ID NO: 2712115 - DNA, 12 bp, Homo sapiens
catcccccctca

SEQ ID NO: 2712116 - DNA, 19 bp, Homo sapiens
catcccttgcttaagaatc

SEQ ID NO: 2712117 - DNA, 13 bp, Homo sapiens
catcctccccacc

SEQ ID NO: 2712118 - DNA, 18 bp, Homo sapiens
catcctccccaccagagc

SEQ ID NO: 2712119 - DNA, 19 bp, Homo sapiens
catcctccccaccagagct

SEQ ID NO: 2712120 - DNA, 21 bp, Homo sapiens
catcctccccaccagagctgc

SEQ ID NO: 2712121 - DNA, 23 bp, Homo sapiens
catcctccccaccagagctgcct

SEQ ID NO: 2712122 - DNA, 12 bp, Homo sapiens
catcctcctctc

SEQ ID NO: 2712123 - DNA, 18 bp, Homo sapiens
catcctcctctccatgca

SEQ ID NO: 2712124 - DNA, 11 bp, Homo sapiens
catcctggccc

SEQ ID NO: 2712125 - DNA, 14 bp, Homo sapiens
catcctggctggct

SEQ ID NO: 2712126 - DNA, 19 bp, Homo sapiens
catcctggctggctgtgtc

SEQ ID NO: 2712127 - DNA, 20 bp, Homo sapiens
catcctggctggctgtgtcc

SEQ ID NO: 2712128 - DNA, 19 bp, Homo sapiens
catctaaattgatcattca

SEQ ID NO: 2712129 - DNA, 23 bp, Homo sapiens
catctaagctgcagcttcctgtc

SEQ ID NO: 2712130 - DNA, 21 bp, Homo sapiens
catctccagtatcctgctggt

SEQ ID NO: 2712131 - DNA, 16 bp, Homo sapiens
catctccctgaccttc

SEQ ID NO: 2712132 - DNA, 20 bp, Homo sapiens
catctcctcccatggccttc

SEQ ID NO: 2712133 - DNA, 23 bp, Homo sapiens
catctcctcccatggccttccct

SEQ ID NO: 2712134 - DNA, 22 bp, Homo sapiens
catctctctactcctacctcag

SEQ ID NO: 2712135 - DNA, 15 bp, Homo sapiens
catctctgagtgtct

SEQ ID NO: 2712136 - DNA, 20 bp, Homo sapiens
catctctgagtgtctctgcc

SEQ ID NO: 2712137 - DNA, 22 bp, Homo sapiens
catctgcccaggacggggccgg

SEQ ID NO: 2712138 - DNA, 19 bp, Homo sapiens
catctgctcctagcccagc

SEQ ID NO: 2712139 - DNA, 22 bp, Homo sapiens
catctgctcctagcccagcaga

SEQ ID NO: 2712140 - DNA, 11 bp, Homo sapiens
catctggaggc

SEQ ID NO: 2712141 - DNA, 22 bp, Homo sapiens
caggggtaccaggcacatggct

SEQ ID NO: 2712142 - DNA, 23 bp, Homo sapiens
caggggtaccaggcacatggctg

SEQ ID NO: 2712143 - DNA, 21 bp, Homo sapiens
cagggtcccagcctggccacc

SEQ ID NO: 2712144 - DNA, 16 bp, Homo sapiens
caggtagggagctaag

SEQ ID NO: 2712145 - DNA, 19 bp, Homo sapiens
caggtagggagctaaggaa

SEQ ID NO: 2712146 - DNA, 21 bp, Homo sapiens
caggtagggagctaaggaaga

SEQ ID NO: 2712147 - DNA, 13 bp, Homo sapiens
caggtagtactgg

SEQ ID NO: 2712148 - DNA, 16 bp, Homo sapiens
caggtagtactgggaa

SEQ ID NO: 2712149 - DNA, 20 bp, Homo sapiens
caggtctccatgaagaagct

SEQ ID NO: 2712150 - DNA, 19 bp, Homo sapiens
caggtctcctccaccgcca

SEQ ID NO: 2712151 - DNA, 14 bp, Homo sapiens
caggtcttgcccaa

SEQ ID NO: 2712152 - DNA, 21 bp, Homo sapiens
caggtgacggactcagactcc

SEQ ID NO: 2712153 - DNA, 12 bp, Homo sapiens
caggtgcagtgg

SEQ ID NO: 2712154 - DNA, 15 bp, Homo sapiens
caggtgcagtggctc

SEQ ID NO: 2712155 - DNA, 13 bp, Homo sapiens
caggtgctgctac

SEQ ID NO: 2712156 - DNA, 16 bp, Homo sapiens
caggtgctgctaccct

SEQ ID NO: 2712157 - DNA, 21 bp, Homo sapiens
caggtgctgctaccctccctg

SEQ ID NO: 2712158 - DNA, 21 bp, Homo sapiens
caggttgggccatactggcct

SEQ ID NO: 2712159 - DNA, 17 bp, Homo sapiens
cagtaaataaattgttt

SEQ ID NO: 2712160 - DNA, 18 bp, Homo sapiens
cagtaatatgaaagccac

SEQ ID NO: 2712161 - DNA, 19 bp, Homo sapiens
cagtaatatgaaagccaca

SEQ ID NO: 2712162 - DNA, 21 bp, Homo sapiens
cagtacagagaaattctgtgg

SEQ ID NO: 2712163 - DNA, 18 bp, Homo sapiens
cagtatgtctactcctca

SEQ ID NO: 2712164 - DNA, 19 bp, Homo sapiens
cagtcaagttccctcctgc

SEQ ID NO: 2712165 - DNA, 21 bp, Homo sapiens
cagtcaagttccctcctgcag

SEQ ID NO: 2712166 - DNA, 13 bp, Homo sapiens
cagtcaccctgtg

SEQ ID NO: 2712167 - DNA, 22 bp, Homo sapiens
cagtccaaattgtctgtctgct

SEQ ID NO: 2712168 - DNA, 22 bp, Homo sapiens
cagtcctcacagcctctccctt

SEQ ID NO: 2712169 - DNA, 19 bp, Homo sapiens
cagtcctgctggcctgctc

SEQ ID NO: 2712170 - DNA, 21 bp, Homo sapiens
cagtcctgggagaacctcagg

SEQ ID NO: 2712171 - DNA, 13 bp, Homo sapiens
cagtcctttgttg

SEQ ID NO: 2712172 - DNA, 19 bp, Homo sapiens
cagtcctttgttgctgttg

SEQ ID NO: 2712173 - DNA, 15 bp, Homo sapiens
cagtcgcgctgcctg

SEQ ID NO: 2712174 - DNA, 18 bp, Homo sapiens
cagagggcccaggcaggc

SEQ ID NO: 2712175 - DNA, 14 bp, Homo sapiens
cagagggcgctcct

SEQ ID NO: 2712176 - DNA, 18 bp, Homo sapiens
cagaggggcaggccctgc

SEQ ID NO: 2712177 - DNA, 19 bp, Homo sapiens
cagaggggcaggccctgca

SEQ ID NO: 2712178 - DNA, 18 bp, Homo sapiens
cagaggggctttctggag

SEQ ID NO: 2712179 - DNA, 19 bp, Homo sapiens
cagaggggctttctggaga

SEQ ID NO: 2712180 - DNA, 23 bp, Homo sapiens
cagaggggtgggttcctcttccc

SEQ ID NO: 2712181 - DNA, 14 bp, Homo sapiens
cagaggtgagcaga

SEQ ID NO: 2712182 - DNA, 15 bp, Homo sapiens
cagagttctgctcta

SEQ ID NO: 2712183 - DNA, 16 bp, Homo sapiens
cagagttctttgcaag

SEQ ID NO: 2712184 - DNA, 14 bp, Homo sapiens
cagatagtgcctct

SEQ ID NO: 2712185 - DNA, 15 bp, Homo sapiens
cagatagtgcctctg

SEQ ID NO: 2712186 - DNA, 23 bp, Homo sapiens
cagatcatataagcaagacagtg

SEQ ID NO: 2712187 - DNA, 14 bp, Homo sapiens
cagatcatggcagg

SEQ ID NO: 2712188 - DNA, 23 bp, Homo sapiens
cagatcctccatttttgttggga

SEQ ID NO: 2712189 - DNA, 12 bp, Homo sapiens
cagatcctgggc

SEQ ID NO: 2712190 - DNA, 13 bp, Homo sapiens
cagatcctgggca

SEQ ID NO: 2712191 - DNA, 14 bp, Homo sapiens
cagatcctgggcat

SEQ ID NO: 2712192 - DNA, 22 bp, Homo sapiens
cagatcctgggcatgatgggcc

SEQ ID NO: 2712193 - DNA, 12 bp, Homo sapiens
cagatctttaaa

SEQ ID NO: 2712194 - DNA, 23 bp, Homo sapiens
cagatctttaaatacagtcaact

SEQ ID NO: 2712195 - DNA, 15 bp, Homo sapiens
cagatgcccagaggg

SEQ ID NO: 2712196 - DNA, 20 bp, Homo sapiens
cagatgcccagagggcccag

SEQ ID NO: 2712197 - DNA, 12 bp, Homo sapiens
cagatgctggcc

SEQ ID NO: 2712198 - DNA, 13 bp, Homo sapiens
cagatgctggcct

SEQ ID NO: 2712199 - DNA, 14 bp, Homo sapiens
cagatgctggcctc

SEQ ID NO: 2712200 - DNA, 17 bp, Homo sapiens
cagatgctggcctcttg

SEQ ID NO: 2712201 - DNA, 23 bp, Homo sapiens
cagatgctggcctcttggcacct

SEQ ID NO: 2712202 - DNA, 19 bp, Homo sapiens
cagatgctgggcaggaaac

SEQ ID NO: 2712203 - DNA, 18 bp, Homo sapiens
cagatggaagaagtttta

SEQ ID NO: 2712204 - DNA, 19 bp, Homo sapiens
cagatggatccacgtgctc

SEQ ID NO: 2712205 - DNA, 16 bp, Homo sapiens
cagatgggcctgtgtg

SEQ ID NO: 2712206 - DNA, 16 bp, Homo sapiens
cagatgtgggctcaga

SEQ ID NO: 2712207 - DNA, 18 bp, Homo sapiens
cagatgtgggctcagatc

SEQ ID NO: 2712208 - DNA, 13 bp, Homo sapiens
cagattacaataa

SEQ ID NO: 2712209 - DNA, 19 bp, Homo sapiens
cagattacaataaatcctt

SEQ ID NO: 2712210 - DNA, 21 bp, Homo sapiens
cagattacaataaatccttta

SEQ ID NO: 2712211 - DNA, 15 bp, Homo sapiens
cagattttctcctgt

SEQ ID NO: 2712212 - DNA, 20 bp, Homo sapiens
cagcaaggaggctggctggg

SEQ ID NO: 2712213 - DNA, 21 bp, Homo sapiens
cagcaaggaggctggctgggg

SEQ ID NO: 2712214 - DNA, 22 bp, Homo sapiens
cagcaaggaggctggctggggc

SEQ ID NO: 2712215 - DNA, 17 bp, Homo sapiens
cagcaaggcacctgcag

SEQ ID NO: 2712216 - DNA, 13 bp, Homo sapiens
cagcacagcaagg

SEQ ID NO: 2712217 - DNA, 14 bp, Homo sapiens
cagcacagctcctc

SEQ ID NO: 2712218 - DNA, 23 bp, Homo sapiens
cagcacagctcctcccctgccgc

SEQ ID NO: 2712219 - DNA, 22 bp, Homo sapiens
cagcacgttttctggcttctgc

SEQ ID NO: 2712220 - DNA, 18 bp, Homo sapiens
cagcactttgggaggctg

SEQ ID NO: 2712221 - DNA, 23 bp, Homo sapiens
cagcactttgggaggctgaggcg

SEQ ID NO: 2712222 - DNA, 17 bp, Homo sapiens
cagcagccagctcctgg

SEQ ID NO: 2712223 - DNA, 15 bp, Homo sapiens
cagcagctgcctctg

SEQ ID NO: 2712224 - DNA, 20 bp, Homo sapiens
cagcaggcagcgcctgtccc

SEQ ID NO: 2712225 - DNA, 20 bp, Homo sapiens
cagcatcaaacatgaaaaca

SEQ ID NO: 2712226 - DNA, 22 bp, Homo sapiens
cagcatcaaacatgaaaacatt

SEQ ID NO: 2712227 - DNA, 18 bp, Homo sapiens
cagcatctcagagtccag

SEQ ID NO: 2712228 - DNA, 16 bp, Homo sapiens
cagcatgtggggaagc

SEQ ID NO: 2712229 - DNA, 23 bp, Homo sapiens
cagcattacgatcccccaagtgt

SEQ ID NO: 2712230 - DNA, 22 bp, Homo sapiens
cagccacatcatctttatctcc

SEQ ID NO: 2712231 - DNA, 13 bp, Homo sapiens
cagccactgcagc

SEQ ID NO: 2712232 - DNA, 14 bp, Homo sapiens
cagccagccctgga

SEQ ID NO: 2712233 - DNA, 14 bp, Homo sapiens
cagccagctcctgg

SEQ ID NO: 2712234 - DNA, 20 bp, Homo sapiens
cagccagggaggacaagcag

SEQ ID NO: 2712235 - DNA, 16 bp, Homo sapiens
cagcccacgtcctgtc

SEQ ID NO: 2712236 - DNA, 18 bp, Homo sapiens
cagcccacgtcctgtcag

SEQ ID NO: 2712237 - DNA, 19 bp, Homo sapiens
cagcccacgtcctgtcagt

SEQ ID NO: 2712238 - DNA, 14 bp, Homo sapiens
cagccccacagccc

SEQ ID NO: 2712239 - DNA, 18 bp, Homo sapiens
cagccccacagcccacgt

SEQ ID NO: 2712240 - DNA, 20 bp, Homo sapiens
cagccccacagcccacgtcc

SEQ ID NO: 2712241 - DNA, 22 bp, Homo sapiens
cagcccccaccccagcacagct

SEQ ID NO: 2712242 - DNA, 16 bp, Homo sapiens
cagccccgcgcctcct

SEQ ID NO: 2712243 - DNA, 20 bp, Homo sapiens
cagccctcccgccccttccc

SEQ ID NO: 2712244 - DNA, 15 bp, Homo sapiens
cagccctggaggctg

SEQ ID NO: 2712245 - DNA, 21 bp, Homo sapiens
cagccgagcgagaaccaggct

SEQ ID NO: 2712246 - DNA, 15 bp, Homo sapiens
cagccgctgcccggc

SEQ ID NO: 2712247 - DNA, 14 bp, Homo sapiens
cagccgtattttac

SEQ ID NO: 2712248 - DNA, 19 bp, Homo sapiens
cagcctcacagatgctggc

SEQ ID NO: 2712249 - DNA, 22 bp, Homo sapiens
cagcctcacagatgctggcctc

SEQ ID NO: 2712250 - DNA, 17 bp, Homo sapiens
cagcctccagtgctggc

SEQ ID NO: 2712251 - DNA, 19 bp, Homo sapiens
cagcctccagtgctggctg

SEQ ID NO: 2712252 - DNA, 22 bp, Homo sapiens
cagcctccagtgctggctgctg

SEQ ID NO: 2712253 - DNA, 19 bp, Homo sapiens
cagcctcccaagtagctgg

SEQ ID NO: 2712254 - DNA, 13 bp, Homo sapiens
cagcctccctctg

SEQ ID NO: 2712255 - DNA, 15 bp, Homo sapiens
cagcctccctctgac

SEQ ID NO: 2712256 - DNA, 23 bp, Homo sapiens
cagcctccctctgacctgcaggc

SEQ ID NO: 2712257 - DNA, 17 bp, Homo sapiens
cagcctccgccattcca

SEQ ID NO: 2712258 - DNA, 16 bp, Homo sapiens
cagcctcctgagtagc

SEQ ID NO: 2712259 - DNA, 24 bp, Homo sapiens
cagcctgactaggtacaggcaagc

SEQ ID NO: 2712260 - DNA, 12 bp, Homo sapiens
cagcctgaggct

SEQ ID NO: 2712261 - DNA, 15 bp, Homo sapiens
cagcctgaggctgag

SEQ ID NO: 2712262 - DNA, 20 bp, Homo sapiens
cagcctgccccagcctccca

SEQ ID NO: 2712263 - DNA, 22 bp, Homo sapiens
cagcctgccccagcctgcccca

SEQ ID NO: 2712264 - DNA, 16 bp, Homo sapiens
cagcctggccaccagc

SEQ ID NO: 2712265 - DNA, 13 bp, Homo sapiens
cagcctggcccag

SEQ ID NO: 2712266 - DNA, 17 bp, Homo sapiens
cagcctggcttctggag

SEQ ID NO: 2712267 - DNA, 21 bp, Homo sapiens
cagccttccccctcccagggc

SEQ ID NO: 2712268 - DNA, 13 bp, Homo sapiens
cagcgcctcctgg

SEQ ID NO: 2712269 - DNA, 13 bp, Homo sapiens
cagcgcctgtccc

SEQ ID NO: 2712270 - DNA, 20 bp, Homo sapiens
cagcgcctgtcccctcacag

SEQ ID NO: 2712271 - DNA, 23 bp, Homo sapiens
cagcgcctgtcccctcacagact

SEQ ID NO: 2712272 - DNA, 16 bp, Homo sapiens
cagcgctggctccagg

SEQ ID NO: 2712273 - DNA, 22 bp, Homo sapiens
cagcgcttagaaacatgttcct

SEQ ID NO: 2712274 - DNA, 18 bp, Homo sapiens
cagcggcagatgggcctg

SEQ ID NO: 2712275 - DNA, 20 bp, Homo sapiens
cagctactcagaagcctgag

SEQ ID NO: 2712276 - DNA, 14 bp, Homo sapiens
cagctagggctgga

SEQ ID NO: 2712277 - DNA, 15 bp, Homo sapiens
cagctagggctggac

SEQ ID NO: 2712278 - DNA, 19 bp, Homo sapiens
cagctattagcaactgtgc

SEQ ID NO: 2712279 - DNA, 12 bp, Homo sapiens
cagctcccccgg

SEQ ID NO: 2712280 - DNA, 19 bp, Homo sapiens
cagctcctcccctgccgcc

SEQ ID NO: 2712281 - DNA, 11 bp, Homo sapiens
cagctcctgga

SEQ ID NO: 2712282 - DNA, 22 bp, Homo sapiens
cagctctatgtgggaaaaaaga

SEQ ID NO: 2712283 - DNA, 12 bp, Homo sapiens
cagctctgctgg

SEQ ID NO: 2712284 - DNA, 13 bp, Homo sapiens
cagctctgctgga

SEQ ID NO: 2712285 - DNA, 16 bp, Homo sapiens
cagctctgctggaaga

SEQ ID NO: 2712286 - DNA, 12 bp, Homo sapiens
cagctctggctt

SEQ ID NO: 2712287 - DNA, 21 bp, Homo sapiens
cagctctgtcaccctggccac

SEQ ID NO: 2712288 - DNA, 11 bp, Homo sapiens
cagctcttgtt

SEQ ID NO: 2712289 - DNA, 15 bp, Homo sapiens
cagctgacagtcctc

SEQ ID NO: 2712290 - DNA, 21 bp, Homo sapiens
cagctgacagtcctctccacc

SEQ ID NO: 2712291 - DNA, 15 bp, Homo sapiens
cagctgagctggcct

SEQ ID NO: 2712292 - DNA, 13 bp, Homo sapiens
cagctgaggctgg

SEQ ID NO: 2712293 - DNA, 20 bp, Homo sapiens
cagctgaggctgggggcggg

SEQ ID NO: 2712294 - DNA, 20 bp, Homo sapiens
cagctgcacctgccagcctg

SEQ ID NO: 2712295 - DNA, 14 bp, Homo sapiens
cagctgctgccact

SEQ ID NO: 2712296 - DNA, 20 bp, Homo sapiens
cagctgctgccactctgctg

SEQ ID NO: 2712297 - DNA, 19 bp, Homo sapiens
cagctggcctctagaacac

SEQ ID NO: 2712298 - DNA, 18 bp, Homo sapiens
cagctggctctccacctt

SEQ ID NO: 2712299 - DNA, 16 bp, Homo sapiens
cagctgggcccacagc

SEQ ID NO: 2712300 - DNA, 18 bp, Homo sapiens
cagctgggcccacagccc

SEQ ID NO: 2712301 - DNA, 13 bp, Homo sapiens
cacgtcctttcct

SEQ ID NO: 2712302 - DNA, 20 bp, Homo sapiens
cacgtctctctgcctgctgg

SEQ ID NO: 2712303 - DNA, 14 bp, Homo sapiens
cacgtgaccagccc

SEQ ID NO: 2712304 - DNA, 17 bp, Homo sapiens
cacgtgaccagccccgt

SEQ ID NO: 2712305 - DNA, 14 bp, Homo sapiens
cacgtgcacagctt

SEQ ID NO: 2712306 - DNA, 17 bp, Homo sapiens
cacgtgctcgcctctgc

SEQ ID NO: 2712307 - DNA, 13 bp, Homo sapiens
cactaaataaact

SEQ ID NO: 2712308 - DNA, 17 bp, Homo sapiens
cactaaattagtttaaa

SEQ ID NO: 2712309 - DNA, 18 bp, Homo sapiens
cactaagctttctccttt

SEQ ID NO: 2712310 - DNA, 19 bp, Homo sapiens
cactaagctttctcctttg

SEQ ID NO: 2712311 - DNA, 20 bp, Homo sapiens
cactaagctttctcctttga

SEQ ID NO: 2712312 - DNA, 18 bp, Homo sapiens
cactaagtcatggtcctg

SEQ ID NO: 2712313 - DNA, 21 bp, Homo sapiens
cactaagtcatggtcctggct

SEQ ID NO: 2712314 - DNA, 17 bp, Homo sapiens
cactacactccagcctg

SEQ ID NO: 2712315 - DNA, 18 bp, Homo sapiens
cactacactccagcctga

SEQ ID NO: 2712316 - DNA, 20 bp, Homo sapiens
cactacctttgtccaggcct

SEQ ID NO: 2712317 - DNA, 15 bp, Homo sapiens
cactcaaggaaaaga

SEQ ID NO: 2712318 - DNA, 20 bp, Homo sapiens
cactcagcagccccctgccc

SEQ ID NO: 2712319 - DNA, 14 bp, Homo sapiens
cactccagcctggg

SEQ ID NO: 2712320 - DNA, 15 bp, Homo sapiens
cactccagcctgggc

SEQ ID NO: 2712321 - DNA, 14 bp, Homo sapiens
cactcccccaggat

SEQ ID NO: 2712322 - DNA, 19 bp, Homo sapiens
cactccggtgtgcctgcag

SEQ ID NO: 2712323 - DNA, 22 bp, Homo sapiens
cactccggtgtgcctgcagccc

SEQ ID NO: 2712324 - DNA, 23 bp, Homo sapiens
cactcctaatcaagagtctctcc

SEQ ID NO: 2712325 - DNA, 13 bp, Homo sapiens
cactcctcctgcc

SEQ ID NO: 2712326 - DNA, 20 bp, Homo sapiens
cactcctcctgccagctctg

SEQ ID NO: 2712327 - DNA, 19 bp, Homo sapiens
cactctagtgacttcctgg

SEQ ID NO: 2712328 - DNA, 23 bp, Homo sapiens
cactctagtgacttcctggtgag

SEQ ID NO: 2712329 - DNA, 15 bp, Homo sapiens
cactctgctgcctgt

SEQ ID NO: 2712330 - DNA, 16 bp, Homo sapiens
cactctgtgcccatgg

SEQ ID NO: 2712331 - DNA, 21 bp, Homo sapiens
cactctgtgcccatgggcact

SEQ ID NO: 2712332 - DNA, 12 bp, Homo sapiens
cactctttgcta

SEQ ID NO: 2712333 - DNA, 22 bp, Homo sapiens
cactctttgctacaataaatgc

SEQ ID NO: 2712334 - DNA, 13 bp, Homo sapiens
cactgaagtgatt

SEQ ID NO: 2712335 - DNA, 17 bp, Homo sapiens
cactgaagtgattgaaa

SEQ ID NO: 2712336 - DNA, 20 bp, Homo sapiens
cactgcaagctctgcctccc

SEQ ID NO: 2712337 - DNA, 15 bp, Homo sapiens
cactgcaccccctcc

SEQ ID NO: 2712338 - DNA, 19 bp, Homo sapiens
cactgcaccccctcctgct

SEQ ID NO: 2712339 - DNA, 17 bp, Homo sapiens
cactgcactccagcctg

SEQ ID NO: 2712340 - DNA, 20 bp, Homo sapiens
cactgcactccagcctgggc

SEQ ID NO: 2712341 - DNA, 21 bp, Homo sapiens
cactgcccagggaagccctcg

SEQ ID NO: 2712342 - DNA, 15 bp, Homo sapiens
cactgccgatgccca

SEQ ID NO: 2712343 - DNA, 14 bp, Homo sapiens
cactgctgggtggc

SEQ ID NO: 2712344 - DNA, 23 bp, Homo sapiens
cactgctgggtggcccatccccc

SEQ ID NO: 2712345 - DNA, 18 bp, Homo sapiens
cactggccagtcctagag

SEQ ID NO: 2712346 - DNA, 13 bp, Homo sapiens
cactggctgcctc

SEQ ID NO: 2712347 - DNA, 16 bp, Homo sapiens
cactggctgcctccac

SEQ ID NO: 2712348 - DNA, 22 bp, Homo sapiens
cactggctgcctccactcccac

SEQ ID NO: 2712349 - DNA, 18 bp, Homo sapiens
cactgtccgcctctgccc

SEQ ID NO: 2712350 - DNA, 16 bp, Homo sapiens
cactgtcctgctccac

SEQ ID NO: 2712351 - DNA, 21 bp, Homo sapiens
cactgtcctgctccacagtgt

SEQ ID NO: 2712352 - DNA, 13 bp, Homo sapiens
cactgtctcaact

SEQ ID NO: 2712353 - DNA, 16 bp, Homo sapiens
cactgtgatgttggga

SEQ ID NO: 2712354 - DNA, 23 bp, Homo sapiens
cacttatttgggggaggcttcag

SEQ ID NO: 2712355 - DNA, 17 bp, Homo sapiens
cacttcatgcccactgc

SEQ ID NO: 2712356 - DNA, 23 bp, Homo sapiens
cacttcccaggtaagcaggagga

SEQ ID NO: 2712357 - DNA, 23 bp, Homo sapiens
cacttccctgcttttctcccaga

SEQ ID NO: 2712358 - DNA, 18 bp, Homo sapiens
cacttcttgaaacagcct

SEQ ID NO: 2712359 - DNA, 15 bp, Homo sapiens
cacttgggtctctgg

SEQ ID NO: 2712360 - DNA, 19 bp, Homo sapiens
cactttgaaggtaataaat

SEQ ID NO: 2712361 - DNA, 15 bp, Homo sapiens
cacttttctccaggg

SEQ ID NO: 2712362 - DNA, 18 bp, Homo sapiens
cagaaaccagaaaagcaa

SEQ ID NO: 2712363 - DNA, 19 bp, Homo sapiens
cagaaagaaaatgaatttg

SEQ ID NO: 2712364 - DNA, 15 bp, Homo sapiens
cagaaatacaacaga

SEQ ID NO: 2712365 - DNA, 16 bp, Homo sapiens
cagaaattagccgggc

SEQ ID NO: 2712366 - DNA, 16 bp, Homo sapiens
cagaaattattttcta

SEQ ID NO: 2712367 - DNA, 13 bp, Homo sapiens
cagaactgctggg

SEQ ID NO: 2712368 - DNA, 17 bp, Homo sapiens
cagaactgctggggctg

SEQ ID NO: 2712369 - DNA, 19 bp, Homo sapiens
cagaactgctggggctggt

SEQ ID NO: 2712370 - DNA, 20 bp, Homo sapiens
cagaactgctggggctggtg

SEQ ID NO: 2712371 - DNA, 18 bp, Homo sapiens
cagaagcaggagtaagtt

SEQ ID NO: 2712372 - DNA, 15 bp, Homo sapiens
cagaagcctgaggct

SEQ ID NO: 2712373 - DNA, 19 bp, Homo sapiens
cagaagcctgaggctggga

SEQ ID NO: 2712374 - DNA, 19 bp, Homo sapiens
cagaaggctgggtccaggg

SEQ ID NO: 2712375 - DNA, 15 bp, Homo sapiens
cagaagtaactccca

SEQ ID NO: 2712376 - DNA, 17 bp, Homo sapiens
cagaagtaactcccact

SEQ ID NO: 2712377 - DNA, 18 bp, Homo sapiens
cagaagttatatttttaa

SEQ ID NO: 2712378 - DNA, 21 bp, Homo sapiens
cagaatcctgggcccccagag

SEQ ID NO: 2712379 - DNA, 19 bp, Homo sapiens
cagaattacccttcctcat

SEQ ID NO: 2712380 - DNA, 21 bp, Homo sapiens
cagaattgcttgaacccagga

SEQ ID NO: 2712381 - DNA, 18 bp, Homo sapiens
cagaattttggaaaaatg

SEQ ID NO: 2712382 - DNA, 21 bp, Homo sapiens
cagaattttggaaaaatgtca

SEQ ID NO: 2712383 - DNA, 22 bp, Homo sapiens
cagaattttggaaaaatgtcac

SEQ ID NO: 2712384 - DNA, 23 bp, Homo sapiens
cagaattttggaaaaatgtcact

SEQ ID NO: 2712385 - DNA, 19 bp, Homo sapiens
cagacaagatggctggaag

SEQ ID NO: 2712386 - DNA, 13 bp, Homo sapiens
cagacagctggac

SEQ ID NO: 2712387 - DNA, 16 bp, Homo sapiens
cagacagctggaccca

SEQ ID NO: 2712388 - DNA, 15 bp, Homo sapiens
cagacagtgtcagag

SEQ ID NO: 2712389 - DNA, 19 bp, Homo sapiens
cagacagtgtcagagtcat

SEQ ID NO: 2712390 - DNA, 17 bp, Homo sapiens
cagaccattgtcttcca

SEQ ID NO: 2712391 - DNA, 18 bp, Homo sapiens
cagaccattgtcttccaa

SEQ ID NO: 2712392 - DNA, 22 bp, Homo sapiens
cagaccattgtcttccaacccc

SEQ ID NO: 2712393 - DNA, 19 bp, Homo sapiens
cagacctctgaatgtccca

SEQ ID NO: 2712394 - DNA, 23 bp, Homo sapiens
cagacctctgaatgtcccagagg

SEQ ID NO: 2712395 - DNA, 19 bp, Homo sapiens
cagactatttaacttgagg

SEQ ID NO: 2712396 - DNA, 12 bp, Homo sapiens
cagactctgtga

SEQ ID NO: 2712397 - DNA, 13 bp, Homo sapiens
cagactcttccac

SEQ ID NO: 2712398 - DNA, 19 bp, Homo sapiens
cagactcttccaccagagc

SEQ ID NO: 2712399 - DNA, 22 bp, Homo sapiens
cagactcttccaccagagcagg

SEQ ID NO: 2712400 - DNA, 17 bp, Homo sapiens
cagactgcggagcagcc

SEQ ID NO: 2712401 - DNA, 20 bp, Homo sapiens
cagactgcggagcagcctcc

SEQ ID NO: 2712402 - DNA, 21 bp, Homo sapiens
cagacttagtttttataaaat

SEQ ID NO: 2712403 - DNA, 17 bp, Homo sapiens
cagagacctttgcccac

SEQ ID NO: 2712404 - DNA, 23 bp, Homo sapiens
cagagagagttgacccctcctga

SEQ ID NO: 2712405 - DNA, 15 bp, Homo sapiens
cagagcagcactggg

SEQ ID NO: 2712406 - DNA, 18 bp, Homo sapiens
cagagcaggggctgctgg

SEQ ID NO: 2712407 - DNA, 18 bp, Homo sapiens
cagagccggtttccgtgg

SEQ ID NO: 2712408 - DNA, 20 bp, Homo sapiens
cagagcgagagtctgtctca

SEQ ID NO: 2712409 - DNA, 22 bp, Homo sapiens
cagagctgagtggcagccgcct

SEQ ID NO: 2712410 - DNA, 11 bp, Homo sapiens
cagagctgcct

SEQ ID NO: 2712411 - DNA, 12 bp, Homo sapiens
cagagctgcctc

SEQ ID NO: 2712412 - DNA, 13 bp, Homo sapiens
cagagctgcctcc

SEQ ID NO: 2712413 - DNA, 16 bp, Homo sapiens
cagagctgcctcccca

SEQ ID NO: 2712414 - DNA, 22 bp, Homo sapiens
cagagctgcctccccaatccat

SEQ ID NO: 2712415 - DNA, 10 bp, Homo sapiens
cagagctgcg

SEQ ID NO: 2712416 - DNA, 18 bp, Homo sapiens
cagagctgctgagcagga

SEQ ID NO: 2712417 - DNA, 17 bp, Homo sapiens
cagagctggcagcctcc

SEQ ID NO: 2712418 - DNA, 19 bp, Homo sapiens
cagagctggcagcctccag

SEQ ID NO: 2712419 - DNA, 21 bp, Homo sapiens
cagagctggcagcctccagtg

SEQ ID NO: 2712420 - DNA, 22 bp, Homo sapiens
cagagctgtggactttgttcac

SEQ ID NO: 2712421 - DNA, 14 bp, Homo sapiens
cagaggaggagaaa

SEQ ID NO: 2712422 - DNA, 16 bp, Homo sapiens
cagaggagtccagggc

SEQ ID NO: 2712423 - DNA, 20 bp, Homo sapiens
cagagggaaggggcctacac

SEQ ID NO: 2712424 - DNA, 21 bp, Homo sapiens
cagagggaggagtttttctta

SEQ ID NO: 2712425 - DNA, 18 bp, Homo sapiens
cagagggatctaggtctt

SEQ ID NO: 2712426 - DNA, 16 bp, Homo sapiens
cagagggcccaggcag

SEQ ID NO: 2712427 - DNA, 18 bp, Homo sapiens
aaaataagttttatacat

SEQ ID NO: 2712428 - DNA, 16 bp, Homo sapiens
aaaatagcacatgatt

SEQ ID NO: 2712429 - DNA, 16 bp, Homo sapiens
aaaatagggtccttga

SEQ ID NO: 2712430 - DNA, 14 bp, Homo sapiens
aaaatatatacaga

SEQ ID NO: 2712431 - DNA, 13 bp, Homo sapiens
aaaatatcccttt

SEQ ID NO: 2712432 - DNA, 20 bp, Homo sapiens
aaaatatttttttaagaaaa

SEQ ID NO: 2712433 - DNA, 13 bp, Homo sapiens
aaaatcagatttt

SEQ ID NO: 2712434 - DNA, 12 bp, Homo sapiens
aaaatcttcagc

SEQ ID NO: 2712435 - DNA, 19 bp, Homo sapiens
aaaatcttcagctggtgga

SEQ ID NO: 2712436 - DNA, 13 bp, Homo sapiens
aaaatcttggttt

SEQ ID NO: 2712437 - DNA, 17 bp, Homo sapiens
aaaatgaagcaatttat

SEQ ID NO: 2712438 - DNA, 16 bp, Homo sapiens
aaaatgatgataatca

SEQ ID NO: 2712439 - DNA, 20 bp, Homo sapiens
aaaatgtcactgaagtgatt

SEQ ID NO: 2712440 - DNA, 12 bp, Homo sapiens
aaaatgtgtctg

SEQ ID NO: 2712441 - DNA, 20 bp, Homo sapiens
aaaatgtgtctgcaacatgg

SEQ ID NO: 2712442 - DNA, 22 bp, Homo sapiens
aaaatgtgtctgcaacatggat

SEQ ID NO: 2712443 - DNA, 16 bp, Homo sapiens
aaaatgttggtgcaat

SEQ ID NO: 2712444 - DNA, 23 bp, Homo sapiens
aaaattatgataaaatgctttaa

SEQ ID NO: 2712445 - DNA, 16 bp, Homo sapiens
aaaattgtatagagat

SEQ ID NO: 2712446 - DNA, 15 bp, Homo sapiens
aaaatttactaatct

SEQ ID NO: 2712447 - DNA, 22 bp, Homo sapiens
aaacaaatggcttacttacaaa

SEQ ID NO: 2712448 - DNA, 21 bp, Homo sapiens
aaacaaattagcaatcatttt

SEQ ID NO: 2712449 - DNA, 18 bp, Homo sapiens
aaacacaaaaaaataata

SEQ ID NO: 2712450 - DNA, 15 bp, Homo sapiens
aaacagcaaagccat

SEQ ID NO: 2712451 - DNA, 16 bp, Homo sapiens
aaacagcaaagccata

SEQ ID NO: 2712452 - DNA, 13 bp, Homo sapiens
aaacagtgtttat

SEQ ID NO: 2712453 - DNA, 15 bp, Homo sapiens
aaacagtgtttatga

SEQ ID NO: 2712454 - DNA, 23 bp, Homo sapiens
aaacataaaaaaattagtcaggt

SEQ ID NO: 2712455 - DNA, 15 bp, Homo sapiens
aaacatatgtatctt

SEQ ID NO: 2712456 - DNA, 14 bp, Homo sapiens
aaacatatgtctgt

SEQ ID NO: 2712457 - DNA, 17 bp, Homo sapiens
aaacatatgtctgtctt

SEQ ID NO: 2712458 - DNA, 21 bp, Homo sapiens
aaacatcattggataaatttg

SEQ ID NO: 2712459 - DNA, 16 bp, Homo sapiens
aaacatgaaaacattg

SEQ ID NO: 2712460 - DNA, 12 bp, Homo sapiens
aaacatgcagaa

SEQ ID NO: 2712461 - DNA, 19 bp, Homo sapiens
aaacatgctgaaatctatt

SEQ ID NO: 2712462 - DNA, 15 bp, Homo sapiens
aaacattgatgaatg

SEQ ID NO: 2712463 - DNA, 16 bp, Homo sapiens
aaaccagaaaagcaat

SEQ ID NO: 2712464 - DNA, 19 bp, Homo sapiens
aaaccagtgtagccttgcc

SEQ ID NO: 2712465 - DNA, 23 bp, Homo sapiens
aaaccatccatctgtggaaatga

SEQ ID NO: 2712466 - DNA, 17 bp, Homo sapiens
aaaccctaagtgtggat

SEQ ID NO: 2712467 - DNA, 13 bp, Homo sapiens
aaaccgtccctga

SEQ ID NO: 2712468 - DNA, 19 bp, Homo sapiens
aaacctctaatttattttg

SEQ ID NO: 2712469 - DNA, 24 bp, Homo sapiens
aaacctctaatttattttgtcgaa

SEQ ID NO: 2712470 - DNA, 17 bp, Homo sapiens
aaacctgtccataaagt

SEQ ID NO: 2712471 - DNA, 18 bp, Homo sapiens
aaacctgtccataaagta

SEQ ID NO: 2712472 - DNA, 17 bp, Homo sapiens
aaacctgtttttaacat

SEQ ID NO: 2712473 - DNA, 17 bp, Homo sapiens
aaacctttctacttttt

SEQ ID NO: 2712474 - DNA, 18 bp, Homo sapiens
aaacgtatagtcaatatg

SEQ ID NO: 2712475 - DNA, 16 bp, Homo sapiens
aaactaacaatatgat

SEQ ID NO: 2712476 - DNA, 21 bp, Homo sapiens
aaactaaggaaccctggaaac

SEQ ID NO: 2712477 - DNA, 20 bp, Homo sapiens
aaactaccagtgggcatgta

SEQ ID NO: 2712478 - DNA, 18 bp, Homo sapiens
aaactatatttatttatg

SEQ ID NO: 2712479 - DNA, 23 bp, Homo sapiens
aaactatatttatttatgtagga

SEQ ID NO: 2712480 - DNA, 15 bp, Homo sapiens
aaactcctactgctt

SEQ ID NO: 2712481 - DNA, 14 bp, Homo sapiens
aaactcctgaaaaa

SEQ ID NO: 2712482 - DNA, 16 bp, Homo sapiens
aaactggggcctccct

SEQ ID NO: 2712483 - DNA, 14 bp, Homo sapiens
aaacttatttgagt

SEQ ID NO: 2712484 - DNA, 19 bp, Homo sapiens
aaacttcagagaaattatg

SEQ ID NO: 2712485 - DNA, 14 bp, Homo sapiens
aaactttctctgca

SEQ ID NO: 2712486 - DNA, 19 bp, Homo sapiens
aaactttgatctctgctta

SEQ ID NO: 2712487 - DNA, 13 bp, Homo sapiens
aaagaaaatcaat

SEQ ID NO: 2712488 - DNA, 11 bp, Homo sapiens
aaagaacccca

SEQ ID NO: 2712489 - DNA, 18 bp, Homo sapiens
aaagaattctattttgct

SEQ ID NO: 2712490 - DNA, 21 bp, Homo sapiens
aaagaattctattttgctgga

SEQ ID NO: 2712491 - DNA, 17 bp, Homo sapiens
aaagacaaacaccttat

SEQ ID NO: 2712492 - DNA, 21 bp, Homo sapiens
aaagacatcagtctccaacat

SEQ ID NO: 2712493 - DNA, 17 bp, Homo sapiens
aaagacattgaaagctc

SEQ ID NO: 2712494 - DNA, 17 bp, Homo sapiens
aaagaccaaattttgag

SEQ ID NO: 2712495 - DNA, 20 bp, Homo sapiens
aaagactgaaagaatacatt

SEQ ID NO: 2712496 - DNA, 14 bp, Homo sapiens
aaagagttttctat

SEQ ID NO: 2712497 - DNA, 17 bp, Homo sapiens
aaagattatatatcata

SEQ ID NO: 2712498 - DNA, 22 bp, Homo sapiens
aaagattatatatcataaagta

SEQ ID NO: 2712499 - DNA, 22 bp, Homo sapiens
aaagattgtattgatacagaga

SEQ ID NO: 2712500 - DNA, 19 bp, Homo sapiens
aaagcacatgccagggaaa

SEQ ID NO: 2712501 - DNA, 19 bp, Homo sapiens
aaagcaccgcagcatgtgg

SEQ ID NO: 2712502 - DNA, 22 bp, Homo sapiens
aaagcaccgcagcatgtgggga

SEQ ID NO: 2712503 - DNA, 21 bp, Homo sapiens
aaagcaggcttgtgctttata

SEQ ID NO: 2712504 - DNA, 18 bp, Homo sapiens
aaagcatcacctcaggcc

SEQ ID NO: 2712505 - DNA, 15 bp, Homo sapiens
aaagccacattttgc

SEQ ID NO: 2712506 - DNA, 15 bp, Homo sapiens
aaagccatattctaa

SEQ ID NO: 2712507 - DNA, 13 bp, Homo sapiens
aaagcctctgtgt

SEQ ID NO: 2712508 - DNA, 17 bp, Homo sapiens
aaagctgtgcctttttt

SEQ ID NO: 2712509 - DNA, 13 bp, Homo sapiens
aaagctgtgtctc

SEQ ID NO: 2712510 - DNA, 17 bp, Homo sapiens
aaagctgtgtctctgta

SEQ ID NO: 2712511 - DNA, 19 bp, Homo sapiens
aaaggaacacccggaaaga

SEQ ID NO: 2712512 - DNA, 13 bp, Homo sapiens
aaaggacaaacag

SEQ ID NO: 2712513 - DNA, 16 bp, Homo sapiens
aaaggacaaacagtga

SEQ ID NO: 2712514 - DNA, 17 bp, Homo sapiens
aaaggacaaacagtgaa

SEQ ID NO: 2712515 - DNA, 18 bp, Homo sapiens
aaaggactgtaagcagat

SEQ ID NO: 2712516 - DNA, 21 bp, Homo sapiens
aaaggctcagtctcaggagca

SEQ ID NO: 2712517 - DNA, 14 bp, Homo sapiens
aaagggaacatgca

SEQ ID NO: 2712518 - DNA, 15 bp, Homo sapiens
aaagggcagtaaagt

SEQ ID NO: 2712519 - DNA, 23 bp, Homo sapiens
aaagggcccacagtgacttttgc

SEQ ID NO: 2712520 - DNA, 14 bp, Homo sapiens
aaaggtaggtgcat

SEQ ID NO: 2712521 - DNA, 16 bp, Homo sapiens
aaaggtaggttttaaa

SEQ ID NO: 2712522 - DNA, 17 bp, Homo sapiens
aaaggtcgcacctcctt

SEQ ID NO: 2712523 - DNA, 19 bp, Homo sapiens
aaaggtttcactgttcatg

SEQ ID NO: 2712524 - DNA, 19 bp, Homo sapiens
aaagtaaattttacggaaa

SEQ ID NO: 2712525 - DNA, 16 bp, Homo sapiens
aaagtaattttgtgaa

SEQ ID NO: 2712526 - DNA, 15 bp, Homo sapiens
aaagtatatattcta

SEQ ID NO: 2712527 - DNA, 20 bp, Homo sapiens
aaagtcacatataaaagtta

SEQ ID NO: 2712528 - DNA, 12 bp, Homo sapiens
aaagtctaaagt

SEQ ID NO: 2712529 - DNA, 19 bp, Homo sapiens
aaagtctaaagtttacagt

SEQ ID NO: 2712530 - DNA, 14 bp, Homo sapiens
aaagtctcctgtat

SEQ ID NO: 2712531 - DNA, 16 bp, Homo sapiens
aaagtgaataaacttc

SEQ ID NO: 2712532 - DNA, 19 bp, Homo sapiens
aaagtgaataaacttcagc

SEQ ID NO: 2712533 - DNA, 20 bp, Homo sapiens
aaagtgaataaacttcagca

SEQ ID NO: 2712534 - DNA, 21 bp, Homo sapiens
aaagtgaataaacttcagcac

SEQ ID NO: 2712535 - DNA, 16 bp, Homo sapiens
aaagtgtagcaccctg

SEQ ID NO: 2712536 - DNA, 22 bp, Homo sapiens
aaagttactggctctttgtgtg

SEQ ID NO: 2712537 - DNA, 22 bp, Homo sapiens
aaagtttacagtaaataaattg

SEQ ID NO: 2712538 - DNA, 21 bp, Homo sapiens
aaataaaactaaggaaccctg

SEQ ID NO: 2712539 - DNA, 14 bp, Homo sapiens
aaataaaagcacaa

SEQ ID NO: 2712540 - DNA, 16 bp, Homo sapiens
aaataaaagcacaagt

SEQ ID NO: 2712541 - DNA, 16 bp, Homo sapiens
aaataaactactttga

SEQ ID NO: 2712542 - DNA, 16 bp, Homo sapiens
aaataaccacactgaa

SEQ ID NO: 2712543 - DNA, 16 bp, Homo sapiens
aaataagttttataca

SEQ ID NO: 2712544 - DNA, 21 bp, Homo sapiens
aaatacaagttaaggtatctg

SEQ ID NO: 2712545 - DNA, 15 bp, Homo sapiens
aaatactccattatt

SEQ ID NO: 2712546 - DNA, 15 bp, Homo sapiens
aaatagaaagtgacc

SEQ ID NO: 2712547 - DNA, 22 bp, Homo sapiens
aaatagggtccttgaaacagaa

SEQ ID NO: 2712548 - DNA, 18 bp, Homo sapiens
aaatagtgtgtccatgca

SEQ ID NO: 2712549 - DNA, 16 bp, Homo sapiens
aaatataaattttgtc

SEQ ID NO: 2712550 - DNA, 16 bp, Homo sapiens
aaatatagttgtcttt

SEQ ID NO: 2712551 - DNA, 17 bp, Homo sapiens
aactgaagacctccaca

SEQ ID NO: 2712552 - DNA, 14 bp, Homo sapiens
aactgaattttgtc

SEQ ID NO: 2712553 - DNA, 23 bp, Homo sapiens
aactgatcttttcctgccagaag

SEQ ID NO: 2712554 - DNA, 14 bp, Homo sapiens
aactgcgtgccagt

SEQ ID NO: 2712555 - DNA, 12 bp, Homo sapiens
aactgctggggc

SEQ ID NO: 2712556 - DNA, 13 bp, Homo sapiens
aactgctggggct

SEQ ID NO: 2712557 - DNA, 11 bp, Homo sapiens
aactgctttat

SEQ ID NO: 2712558 - DNA, 14 bp, Homo sapiens
aactggatgaacag

SEQ ID NO: 2712559 - DNA, 21 bp, Homo sapiens
aactggccactccccagtgct

SEQ ID NO: 2712560 - DNA, 21 bp, Homo sapiens
ttctcctgcctcagcctcctg

SEQ ID NO: 2712561 - DNA, 13 bp, Homo sapiens
ttctcctttttct

SEQ ID NO: 2712562 - DNA, 17 bp, Homo sapiens
ttctctatgaaaagcaa

SEQ ID NO: 2712563 - DNA, 20 bp, Homo sapiens
ttctctcccacgtgcacagc

SEQ ID NO: 2712564 - DNA, 12 bp, Homo sapiens
ttctctctgctc

SEQ ID NO: 2712565 - DNA, 15 bp, Homo sapiens
ttctctctgctcagt

SEQ ID NO: 2712566 - DNA, 19 bp, Homo sapiens
ttctcttggacattgtaaa

SEQ ID NO: 2712567 - DNA, 22 bp, Homo sapiens
ttctgaatgtgaaaatatttaa

SEQ ID NO: 2712568 - DNA, 21 bp, Homo sapiens
ttctgacttacttaaccaggt

SEQ ID NO: 2712569 - DNA, 13 bp, Homo sapiens
ttctgagctgggc

SEQ ID NO: 2712570 - DNA, 12 bp, Homo sapiens
ttctgattccac

SEQ ID NO: 2712571 - DNA, 14 bp, Homo sapiens
ttctgcactcctgg

SEQ ID NO: 2712572 - DNA, 16 bp, Homo sapiens
ttctgcagctttggct

SEQ ID NO: 2712573 - DNA, 14 bp, Homo sapiens
ttctgcattcacag

SEQ ID NO: 2712574 - DNA, 13 bp, Homo sapiens
ttctgctgggctg

SEQ ID NO: 2712575 - DNA, 15 bp, Homo sapiens
ttctgctgggctggg

SEQ ID NO: 2712576 - DNA, 21 bp, Homo sapiens
ttctggctttgttcttgtcat

SEQ ID NO: 2712577 - DNA, 22 bp, Homo sapiens
ttctgggaagaaaatgagatgg

SEQ ID NO: 2712578 - DNA, 16 bp, Homo sapiens
ttctgggaggaagcag

SEQ ID NO: 2712579 - DNA, 20 bp, Homo sapiens
ttctgtatgtgacaacattt

SEQ ID NO: 2712580 - DNA, 14 bp, Homo sapiens
ttctgtctttagat

SEQ ID NO: 2712581 - DNA, 13 bp, Homo sapiens
ttctgtgcagcca

SEQ ID NO: 2712582 - DNA, 17 bp, Homo sapiens
ttcttaactctgcagga

SEQ ID NO: 2712583 - DNA, 12 bp, Homo sapiens
ttcttatgagct

SEQ ID NO: 2712584 - DNA, 22 bp, Homo sapiens
ttcttattcatgctttctcctt

SEQ ID NO: 2712585 - DNA, 18 bp, Homo sapiens
ttcttgtcaatggaagaa

SEQ ID NO: 2712586 - DNA, 17 bp, Homo sapiens
ttcttgtgtcctgatga

SEQ ID NO: 2712587 - DNA, 15 bp, Homo sapiens
ttctttaaggagata

SEQ ID NO: 2712588 - DNA, 16 bp, Homo sapiens
ttctttcatacattat

SEQ ID NO: 2712589 - DNA, 19 bp, Homo sapiens
ttctttccaaaacatttct

SEQ ID NO: 2712590 - DNA, 13 bp, Homo sapiens
ttctttcttggtg

SEQ ID NO: 2712591 - DNA, 14 bp, Homo sapiens
ttcttttgttatta

SEQ ID NO: 2712592 - DNA, 16 bp, Homo sapiens
ttcttttgttattaaa

SEQ ID NO: 2712593 - DNA, 19 bp, Homo sapiens
ttcttttgttttcttcatt

SEQ ID NO: 2712594 - DNA, 16 bp, Homo sapiens
ttgaaaaaagaagttt

SEQ ID NO: 2712595 - DNA, 14 bp, Homo sapiens
ttgaaaacccctgg

SEQ ID NO: 2712596 - DNA, 15 bp, Homo sapiens
ttgaaaacccctggc

SEQ ID NO: 2712597 - DNA, 13 bp, Homo sapiens
ttgaaagacatca

SEQ ID NO: 2712598 - DNA, 18 bp, Homo sapiens
ttgaaagacatcaatgaa

SEQ ID NO: 2712599 - DNA, 21 bp, Homo sapiens
ttgaagccactgaagctggga

SEQ ID NO: 2712600 - DNA, 16 bp, Homo sapiens
ttgaattttcccactg

SEQ ID NO: 2712601 - DNA, 14 bp, Homo sapiens
ttgacaacacatgt

SEQ ID NO: 2712602 - DNA, 15 bp, Homo sapiens
ttgaccatgtgatta

SEQ ID NO: 2712603 - DNA, 18 bp, Homo sapiens
ttgacctgaactctgcaa

SEQ ID NO: 2712604 - DNA, 16 bp, Homo sapiens
ttgactactagagctc

SEQ ID NO: 2712605 - DNA, 17 bp, Homo sapiens
ttgagaaaatgcaggag

SEQ ID NO: 2712606 - DNA, 19 bp, Homo sapiens
ttgaggagcagcttcagtt

SEQ ID NO: 2712607 - DNA, 15 bp, Homo sapiens
ttgaggattttgagt

SEQ ID NO: 2712608 - DNA, 15 bp, Homo sapiens
ttgaggggctcctgg

SEQ ID NO: 2712609 - DNA, 18 bp, Homo sapiens
ttgagggtgtaaccagta

SEQ ID NO: 2712610 - DNA, 12 bp, Homo sapiens
ttgagtctctga

SEQ ID NO: 2712611 - DNA, 12 bp, Homo sapiens
ttgagtgattat

SEQ ID NO: 2712612 - DNA, 17 bp, Homo sapiens
ttgatagtgcttcttgt

SEQ ID NO: 2712613 - DNA, 19 bp, Homo sapiens
ttgatagtgcttcttgtaa

SEQ ID NO: 2712614 - DNA, 13 bp, Homo sapiens
ttgatctctgctt

SEQ ID NO: 2712615 - DNA, 14 bp, Homo sapiens
ttgatggagatatt

SEQ ID NO: 2712616 - DNA, 18 bp, Homo sapiens
ttgatggagcctgaaccg

SEQ ID NO: 2712617 - DNA, 22 bp, Homo sapiens
ttgattaaacagcaaagccata

SEQ ID NO: 2712618 - DNA, 14 bp, Homo sapiens
ttgattaagtaaat

SEQ ID NO: 2712619 - DNA, 12 bp, Homo sapiens
ttgattattctg

SEQ ID NO: 2712620 - DNA, 12 bp, Homo sapiens
ttgcaccaaaga

SEQ ID NO: 2712621 - DNA, 19 bp, Homo sapiens
ttgcactaaataaactact

SEQ ID NO: 2712622 - DNA, 16 bp, Homo sapiens
ttgcaggggactgggc

SEQ ID NO: 2712623 - DNA, 13 bp, Homo sapiens
ttgcagtcttttg

SEQ ID NO: 2712624 - DNA, 14 bp, Homo sapiens
ttgcagtcttttgc

SEQ ID NO: 2712625 - DNA, 14 bp, Homo sapiens
ttgcagtgaactga

SEQ ID NO: 2712626 - DNA, 19 bp, Homo sapiens
ttgcataaacaatccaaat

SEQ ID NO: 2712627 - DNA, 13 bp, Homo sapiens
ttgcatcatttaa

SEQ ID NO: 2712628 - DNA, 13 bp, Homo sapiens
ttgcatgaattca

SEQ ID NO: 2712629 - DNA, 14 bp, Homo sapiens
ttgccatgggcctg

SEQ ID NO: 2712630 - DNA, 15 bp, Homo sapiens
ttgccatgggcctgc

SEQ ID NO: 2712631 - DNA, 16 bp, Homo sapiens
ttgccccaacccccag

SEQ ID NO: 2712632 - DNA, 17 bp, Homo sapiens
ttgccccggcttgcctg

SEQ ID NO: 2712633 - DNA, 17 bp, Homo sapiens
ttgcctcggctcctgct

SEQ ID NO: 2712634 - DNA, 17 bp, Homo sapiens
ttgcctgcctgggcctc

SEQ ID NO: 2712635 - DNA, 19 bp, Homo sapiens
ttgcctgcctgggcctccc

SEQ ID NO: 2712636 - DNA, 23 bp, Homo sapiens
ttgcctgcctgggcctcccaaag

SEQ ID NO: 2712637 - DNA, 20 bp, Homo sapiens
ttgcctggggccacatagct

SEQ ID NO: 2712638 - DNA, 15 bp, Homo sapiens
ttgcgagaattttca

SEQ ID NO: 2712639 - DNA, 15 bp, Homo sapiens
ttgctacaataaatg

SEQ ID NO: 2712640 - DNA, 17 bp, Homo sapiens
ttgctacaataaatgct

SEQ ID NO: 2712641 - DNA, 14 bp, Homo sapiens
tgtctactcctcac

SEQ ID NO: 2712642 - DNA, 21 bp, Homo sapiens
tgtctagtagaacaatgtaca

SEQ ID NO: 2712643 - DNA, 13 bp, Homo sapiens
tgtctctgcctgg

SEQ ID NO: 2712644 - DNA, 12 bp, Homo sapiens
tgtctctgcttg

SEQ ID NO: 2712645 - DNA, 15 bp, Homo sapiens
tgtctctgcttggct

SEQ ID NO: 2712646 - DNA, 19 bp, Homo sapiens
tgtctctgtatatagctct

SEQ ID NO: 2712647 - DNA, 16 bp, Homo sapiens
tgtctgcaacatggat

SEQ ID NO: 2712648 - DNA, 13 bp, Homo sapiens
tgtctgcagctcc

SEQ ID NO: 2712649 - DNA, 11 bp, Homo sapiens
tgtctgggctg

SEQ ID NO: 2712650 - DNA, 12 bp, Homo sapiens
tgtctgggctga

SEQ ID NO: 2712651 - DNA, 17 bp, Homo sapiens
tgtctgtatataactta

SEQ ID NO: 2712652 - DNA, 14 bp, Homo sapiens
tgtctgtccaaccc

SEQ ID NO: 2712653 - DNA, 16 bp, Homo sapiens
tgtcttccaaccccag

SEQ ID NO: 2712654 - DNA, 21 bp, Homo sapiens
tgtcttccaaccccagctggc

SEQ ID NO: 2712655 - DNA, 14 bp, Homo sapiens
tgtcttcctgtggg

SEQ ID NO: 2712656 - DNA, 20 bp, Homo sapiens
tgtcttgaaacctttctact

SEQ ID NO: 2712657 - DNA, 16 bp, Homo sapiens
tgtctttcaaaagaca

SEQ ID NO: 2712658 - DNA, 14 bp, Homo sapiens
tgtctttgcaaagg

SEQ ID NO: 2712659 - DNA, 17 bp, Homo sapiens
tgtctttgcaaaggact

SEQ ID NO: 2712660 - DNA, 20 bp, Homo sapiens
tgtctttggcttcagaattg

SEQ ID NO: 2712661 - DNA, 12 bp, Homo sapiens
tgtgaaagctgc

SEQ ID NO: 2712662 - DNA, 22 bp, Homo sapiens
tgtgaaatcaccacattctgtc

SEQ ID NO: 2712663 - DNA, 12 bp, Homo sapiens
tgtgacaacatt

SEQ ID NO: 2712664 - DNA, 21 bp, Homo sapiens
tgtgagattactttgtcccgc

SEQ ID NO: 2712665 - DNA, 17 bp, Homo sapiens
tgtgatgctttgaagta

SEQ ID NO: 2712666 - DNA, 20 bp, Homo sapiens
tgtgatgttgggaagctatt

SEQ ID NO: 2712667 - DNA, 24 bp, Homo sapiens
tgtgatttcccgtggccccagcct

SEQ ID NO: 2712668 - DNA, 15 bp, Homo sapiens
tgtgatttctttctt

SEQ ID NO: 2712669 - DNA, 15 bp, Homo sapiens
tgtgcaactcttgta

SEQ ID NO: 2712670 - DNA, 18 bp, Homo sapiens
tgtgcaatagtcagagtg

SEQ ID NO: 2712671 - DNA, 18 bp, Homo sapiens
tgtgcacccaacgtgatg

SEQ ID NO: 2712672 - DNA, 12 bp, Homo sapiens
tgtgccaccctg

SEQ ID NO: 2712673 - DNA, 14 bp, Homo sapiens
tgtgccaccctggg

SEQ ID NO: 2712674 - DNA, 16 bp, Homo sapiens
tgtgccaccctgggct

SEQ ID NO: 2712675 - DNA, 22 bp, Homo sapiens
tgtgccaccctgggctctgtgg

SEQ ID NO: 2712676 - DNA, 18 bp, Homo sapiens
tgtgcccacttcatagat

SEQ ID NO: 2712677 - DNA, 21 bp, Homo sapiens
tgtgcccatgggcactgctgg

SEQ ID NO: 2712678 - DNA, 20 bp, Homo sapiens
tgtgccccccatcctggccc

SEQ ID NO: 2712679 - DNA, 22 bp, Homo sapiens
tgtgccccccatcctggcccat

SEQ ID NO: 2712680 - DNA, 17 bp, Homo sapiens
tgtgccgtgaactgcgt

SEQ ID NO: 2712681 - DNA, 13 bp, Homo sapiens
tgtgcctgcagcc

SEQ ID NO: 2712682 - DNA, 17 bp, Homo sapiens
tgtgcctgtctgtccaa

SEQ ID NO: 2712683 - DNA, 17 bp, Homo sapiens
tgtgcctttgggaggca

SEQ ID NO: 2712684 - DNA, 20 bp, Homo sapiens
tgtgccttttttagcttcat

SEQ ID NO: 2712685 - DNA, 14 bp, Homo sapiens
tgtgctcccacggg

SEQ ID NO: 2712686 - DNA, 15 bp, Homo sapiens
tgtgctgctgtggca

SEQ ID NO: 2712687 - DNA, 22 bp, Homo sapiens
tgtgctgtacattactgtatgt

SEQ ID NO: 2712688 - DNA, 19 bp, Homo sapiens
tgtggaaagcctctgctgc

SEQ ID NO: 2712689 - DNA, 20 bp, Homo sapiens
tgtggaaagcctctgctgcc

SEQ ID NO: 2712690 - DNA, 19 bp, Homo sapiens
tgtggactctctgcctgct

SEQ ID NO: 2712691 - DNA, 18 bp, Homo sapiens
tgtggcattctctctgct

SEQ ID NO: 2712692 - DNA, 19 bp, Homo sapiens
tgtggcattctctctgctc

SEQ ID NO: 2712693 - DNA, 21 bp, Homo sapiens
tgtggcattctctctgctcag

SEQ ID NO: 2712694 - DNA, 14 bp, Homo sapiens
tgtgggctgcactc

SEQ ID NO: 2712695 - DNA, 20 bp, Homo sapiens
tgtgggctgcactctgtgcc

SEQ ID NO: 2712696 - DNA, 23 bp, Homo sapiens
tgtgggggaagagcacagccctc

SEQ ID NO: 2712697 - DNA, 15 bp, Homo sapiens
tgtgggttgtgatat

SEQ ID NO: 2712698 - DNA, 14 bp, Homo sapiens
tgtggtcccaccca

SEQ ID NO: 2712699 - DNA, 21 bp, Homo sapiens
tgtggttcctaagcctgttgc

SEQ ID NO: 2712700 - DNA, 16 bp, Homo sapiens
ttataaatatgtgaaa

SEQ ID NO: 2712701 - DNA, 17 bp, Homo sapiens
ttatacataaacagttt

SEQ ID NO: 2712702 - DNA, 19 bp, Homo sapiens
ttataggcagatctttaaa

SEQ ID NO: 2712703 - DNA, 14 bp, Homo sapiens
ttatataaagaaaa

SEQ ID NO: 2712704 - DNA, 22 bp, Homo sapiens
ttatataaagaaaatcaatgaa

SEQ ID NO: 2712705 - DNA, 13 bp, Homo sapiens
ttatatatcataa

SEQ ID NO: 2712706 - DNA, 14 bp, Homo sapiens
ttatatatcataaa

SEQ ID NO: 2712707 - DNA, 13 bp, Homo sapiens
ttatatctttatg

SEQ ID NO: 2712708 - DNA, 12 bp, Homo sapiens
ttatattcatca

SEQ ID NO: 2712709 - DNA, 21 bp, Homo sapiens
ttatattcctctaaaactctc

SEQ ID NO: 2712710 - DNA, 12 bp, Homo sapiens
ttatgatctact

SEQ ID NO: 2712711 - DNA, 16 bp, Homo sapiens
ttatgatttttaaaga

SEQ ID NO: 2712712 - DNA, 14 bp, Homo sapiens
ttatgcaaaaacat

SEQ ID NO: 2712713 - DNA, 11 bp, Homo sapiens
ttatggacatc

SEQ ID NO: 2712714 - DNA, 13 bp, Homo sapiens
ttattaatataat

SEQ ID NO: 2712715 - DNA, 20 bp, Homo sapiens
ttattcaggaaaagcctctg

SEQ ID NO: 2712716 - DNA, 14 bp, Homo sapiens
ttattcatttgagt

SEQ ID NO: 2712717 - DNA, 16 bp, Homo sapiens
ttattcttttccagaa

SEQ ID NO: 2712718 - DNA, 19 bp, Homo sapiens
ttattggaattttctttca

SEQ ID NO: 2712719 - DNA, 23 bp, Homo sapiens
ttattgtattcctcatgtcatca

SEQ ID NO: 2712720 - DNA, 13 bp, Homo sapiens
ttatttaagaaat

SEQ ID NO: 2712721 - DNA, 14 bp, Homo sapiens
ttatttatgcctct

SEQ ID NO: 2712722 - DNA, 20 bp, Homo sapiens
ttatttatgcctctgtattt

SEQ ID NO: 2712723 - DNA, 17 bp, Homo sapiens
ttatttccacataaagg

SEQ ID NO: 2712724 - DNA, 13 bp, Homo sapiens
ttatttgtacagt

SEQ ID NO: 2712725 - DNA, 15 bp, Homo sapiens
ttatttgttttcccg

SEQ ID NO: 2712726 - DNA, 13 bp, Homo sapiens
ttattttacagtc

SEQ ID NO: 2712727 - DNA, 16 bp, Homo sapiens
ttattttccaaaatct

SEQ ID NO: 2712728 - DNA, 18 bp, Homo sapiens
ttattttgtaattattgt

SEQ ID NO: 2712729 - DNA, 21 bp, Homo sapiens
ttatttttgttagcaaagatt

SEQ ID NO: 2712730 - DNA, 21 bp, Homo sapiens
ttcaaagaaaaccctaagtgt

SEQ ID NO: 2712731 - DNA, 16 bp, Homo sapiens
ttcaacctgtgtctta

SEQ ID NO: 2712732 - DNA, 16 bp, Homo sapiens
ttcaagaccagcctgg

SEQ ID NO: 2712733 - DNA, 16 bp, Homo sapiens
ttcaattcctgggccc

SEQ ID NO: 2712734 - DNA, 22 bp, Homo sapiens
ttcaatttactttttaaacagt

SEQ ID NO: 2712735 - DNA, 20 bp, Homo sapiens
ttcacacctcacgctctgga

SEQ ID NO: 2712736 - DNA, 20 bp, Homo sapiens
ttcacatttcaagatccaaa

SEQ ID NO: 2712737 - DNA, 18 bp, Homo sapiens
ttcaccagggttctgacc

SEQ ID NO: 2712738 - DNA, 16 bp, Homo sapiens
ttcaccatgcaggcaa

SEQ ID NO: 2712739 - DNA, 20 bp, Homo sapiens
ttcaccatgcaggcaacatt

SEQ ID NO: 2712740 - DNA, 16 bp, Homo sapiens
ttcacttaaaatcaaa

SEQ ID NO: 2712741 - DNA, 18 bp, Homo sapiens
ttcagcatcaaacatgaa

SEQ ID NO: 2712742 - DNA, 20 bp, Homo sapiens
ttcagcatcaaacatgaaaa

SEQ ID NO: 2712743 - DNA, 18 bp, Homo sapiens
ttcagctattagcaactg

SEQ ID NO: 2712744 - DNA, 20 bp, Homo sapiens
ttcagcttctgctgggctgg

SEQ ID NO: 2712745 - DNA, 19 bp, Homo sapiens
ttcaggaaaagcctctgtg

SEQ ID NO: 2712746 - DNA, 20 bp, Homo sapiens
ttcaggaaaagcctctgtgt

SEQ ID NO: 2712747 - DNA, 12 bp, Homo sapiens
ttcaggagctga

SEQ ID NO: 2712748 - DNA, 13 bp, Homo sapiens
ttcaggaggctga

SEQ ID NO: 2712749 - DNA, 22 bp, Homo sapiens
ttcaggggctgcccgctcccag

SEQ ID NO: 2712750 - DNA, 13 bp, Homo sapiens
ttcagtgctgtgg

SEQ ID NO: 2712751 - DNA, 19 bp, Homo sapiens
ttcagtgctgtggcctggg

SEQ ID NO: 2712752 - DNA, 23 bp, Homo sapiens
ttcataaatttgttgtcatgtgt

SEQ ID NO: 2712753 - DNA, 13 bp, Homo sapiens
ttcataattcacc

SEQ ID NO: 2712754 - DNA, 19 bp, Homo sapiens
ttcatagatgagaaaactg

SEQ ID NO: 2712755 - DNA, 18 bp, Homo sapiens
ttcatataatttaaagaa

SEQ ID NO: 2712756 - DNA, 21 bp, Homo sapiens
ttcatataatttaaagaaaca

SEQ ID NO: 2712757 - DNA, 17 bp, Homo sapiens
ttcatatctaatttacc

SEQ ID NO: 2712758 - DNA, 14 bp, Homo sapiens
ttcatcaaataaac

SEQ ID NO: 2712759 - DNA, 13 bp, Homo sapiens
ttcatctggaggc

SEQ ID NO: 2712760 - DNA, 23 bp, Homo sapiens
ttcatgacttttccatgtatcta

SEQ ID NO: 2712761 - DNA, 23 bp, Homo sapiens
ttcatgtggcattctctctgctc

SEQ ID NO: 2712762 - DNA, 15 bp, Homo sapiens
ttcattaatctgttt

SEQ ID NO: 2712763 - DNA, 14 bp, Homo sapiens
ttcattcaaaatgt

SEQ ID NO: 2712764 - DNA, 22 bp, Homo sapiens
ttccaaaacatttctggacagt

SEQ ID NO: 2712765 - DNA, 20 bp, Homo sapiens
ttccaaaatctaaaagctgt

SEQ ID NO: 2712766 - DNA, 16 bp, Homo sapiens
ttccaacacacaatta

SEQ ID NO: 2712767 - DNA, 12 bp, Homo sapiens
ttccaaccccag

SEQ ID NO: 2712768 - DNA, 15 bp, Homo sapiens
ttccaaccccagctg

SEQ ID NO: 2712769 - DNA, 21 bp, Homo sapiens
ttccaagggtatgggaagcca

SEQ ID NO: 2712770 - DNA, 20 bp, Homo sapiens
ttccaaggtggtctgctcgg

SEQ ID NO: 2712771 - DNA, 17 bp, Homo sapiens
ttccaataaagcagagt

SEQ ID NO: 2712772 - DNA, 23 bp, Homo sapiens
ttccaccagagcaggggctgctg

SEQ ID NO: 2712773 - DNA, 22 bp, Homo sapiens
ttccactggacttgagcttggc

SEQ ID NO: 2712774 - DNA, 18 bp, Homo sapiens
ttccagaaaaccccagca

SEQ ID NO: 2712775 - DNA, 17 bp, Homo sapiens
tgctcctagcccagcag

SEQ ID NO: 2712776 - DNA, 23 bp, Homo sapiens
tgctcgggcccaggccatcttcc

SEQ ID NO: 2712777 - DNA, 20 bp, Homo sapiens
tgctctgcttttcctgtctg

SEQ ID NO: 2712778 - DNA, 15 bp, Homo sapiens
tgctctgtccttgtg

SEQ ID NO: 2712779 - DNA, 14 bp, Homo sapiens
tgctcttacttccc

SEQ ID NO: 2712780 - DNA, 21 bp, Homo sapiens
tgctcttacttcccccaccct

SEQ ID NO: 2712781 - DNA, 21 bp, Homo sapiens
tgctcttatttttgtaccata

SEQ ID NO: 2712782 - DNA, 13 bp, Homo sapiens
tgctgaatgtcat

SEQ ID NO: 2712783 - DNA, 22 bp, Homo sapiens
tgctgcagaggggcaggccctg

SEQ ID NO: 2712784 - DNA, 19 bp, Homo sapiens
tgctgcatttgtgtcatct

SEQ ID NO: 2712785 - DNA, 17 bp, Homo sapiens
tgctgctaccctccctg

SEQ ID NO: 2712786 - DNA, 14 bp, Homo sapiens
tgctgctgtggaaa

SEQ ID NO: 2712787 - DNA, 14 bp, Homo sapiens
tgctgctttccaac

SEQ ID NO: 2712788 - DNA, 17 bp, Homo sapiens
tgctggaaaccacactt

SEQ ID NO: 2712789 - DNA, 18 bp, Homo sapiens
tgctggaaaccacacttc

SEQ ID NO: 2712790 - DNA, 19 bp, Homo sapiens
tgctggacggcattcctgc

SEQ ID NO: 2712791 - DNA, 14 bp, Homo sapiens
tgctggcagggcct

SEQ ID NO: 2712792 - DNA, 15 bp, Homo sapiens
tgctggcagggcctg

SEQ ID NO: 2712793 - DNA, 18 bp, Homo sapiens
tgctggcccacagctctg

SEQ ID NO: 2712794 - DNA, 22 bp, Homo sapiens
tgctggcccacagctctgctgg

SEQ ID NO: 2712795 - DNA, 23 bp, Homo sapiens
tgctggcccacagctctgctgga

SEQ ID NO: 2712796 - DNA, 19 bp, Homo sapiens
tgctggcctcttggcacct

SEQ ID NO: 2712797 - DNA, 20 bp, Homo sapiens
tgctggcctcttggcacctg

SEQ ID NO: 2712798 - DNA, 22 bp, Homo sapiens
tgctggcctcttggcacctgcc

SEQ ID NO: 2712799 - DNA, 15 bp, Homo sapiens
tgctggcctgctctt

SEQ ID NO: 2712800 - DNA, 11 bp, Homo sapiens
tgctgggctgg

SEQ ID NO: 2712801 - DNA, 14 bp, Homo sapiens
tgctgggctggggc

SEQ ID NO: 2712802 - DNA, 17 bp, Homo sapiens
tgctgggctggggcctg

SEQ ID NO: 2712803 - DNA, 14 bp, Homo sapiens
tgctgggctgggtg

SEQ ID NO: 2712804 - DNA, 16 bp, Homo sapiens
tgctgggctgggtgcg

SEQ ID NO: 2712805 - DNA, 14 bp, Homo sapiens
tgctgggggctccc

SEQ ID NO: 2712806 - DNA, 22 bp, Homo sapiens
tgctgggggctccccttgccct

SEQ ID NO: 2712807 - DNA, 16 bp, Homo sapiens
tgctgggtggcccatc

SEQ ID NO: 2712808 - DNA, 22 bp, Homo sapiens
tgctggtaatttgtatctgaag

SEQ ID NO: 2712809 - DNA, 18 bp, Homo sapiens
tgctgtatacaaacaggt

SEQ ID NO: 2712810 - DNA, 13 bp, Homo sapiens
tgctgtcccctct

SEQ ID NO: 2712811 - DNA, 16 bp, Homo sapiens
tgctgtcctaggccac

SEQ ID NO: 2712812 - DNA, 12 bp, Homo sapiens
tgctgtggcctg

SEQ ID NO: 2712813 - DNA, 14 bp, Homo sapiens
tgctgttgctgttg

SEQ ID NO: 2712814 - DNA, 16 bp, Homo sapiens
tgctgttgctgttgct

SEQ ID NO: 2712815 - DNA, 21 bp, Homo sapiens
tgctgttggcatcttgctgct

SEQ ID NO: 2712816 - DNA, 23 bp, Homo sapiens
tgctgttgttgttacttccctcc

SEQ ID NO: 2712817 - DNA, 14 bp, Homo sapiens
tgctgtttgggcag

SEQ ID NO: 2712818 - DNA, 14 bp, Homo sapiens
tgcttcagcctgag

SEQ ID NO: 2712819 - DNA, 17 bp, Homo sapiens
tgcttcagcctgaggct

SEQ ID NO: 2712820 - DNA, 14 bp, Homo sapiens
tgcttccctggggc

SEQ ID NO: 2712821 - DNA, 18 bp, Homo sapiens
tgcttcctctgaatatta

SEQ ID NO: 2712822 - DNA, 14 bp, Homo sapiens
tgcttcctggaccg

SEQ ID NO: 2712823 - DNA, 23 bp, Homo sapiens
tgcttctggctttgttcttgtca

SEQ ID NO: 2712824 - DNA, 12 bp, Homo sapiens
tgcttcttgtaa

SEQ ID NO: 2712825 - DNA, 16 bp, Homo sapiens
tgcttcttgtaatatt

SEQ ID NO: 2712826 - DNA, 17 bp, Homo sapiens
tgcttgaacccaggagg

SEQ ID NO: 2712827 - DNA, 14 bp, Homo sapiens
tgcttgattaaaca

SEQ ID NO: 2712828 - DNA, 15 bp, Homo sapiens
tgcttgattaaacag

SEQ ID NO: 2712829 - DNA, 19 bp, Homo sapiens
tgcttggcttcccctccac

SEQ ID NO: 2712830 - DNA, 20 bp, Homo sapiens
tgctttaaatagatttcagc

SEQ ID NO: 2712831 - DNA, 22 bp, Homo sapiens
tgctttataccccatttgattt

SEQ ID NO: 2712832 - DNA, 15 bp, Homo sapiens
tggaaaaatatttca

SEQ ID NO: 2712833 - DNA, 13 bp, Homo sapiens
tggaaaaatgtca

SEQ ID NO: 2712834 - DNA, 15 bp, Homo sapiens
tggaaaaatgtcact

SEQ ID NO: 2712835 - DNA, 15 bp, Homo sapiens
tggaaaccacacttc

SEQ ID NO: 2712836 - DNA, 19 bp, Homo sapiens
tggaaaccacacttcttga

SEQ ID NO: 2712837 - DNA, 19 bp, Homo sapiens
tggaaactaccagtgggca

SEQ ID NO: 2712838 - DNA, 20 bp, Homo sapiens
tggaaaggaagaatgcagag

SEQ ID NO: 2712839 - DNA, 21 bp, Homo sapiens
tggaaaggctcagtctcagga

SEQ ID NO: 2712840 - DNA, 20 bp, Homo sapiens
tggaagaagttttaactatg

SEQ ID NO: 2712841 - DNA, 13 bp, Homo sapiens
tggaagagaggca

SEQ ID NO: 2712842 - DNA, 17 bp, Homo sapiens
tggaagagaggcacctg

SEQ ID NO: 2712843 - DNA, 18 bp, Homo sapiens
tggaagagaggcacctgc

SEQ ID NO: 2712844 - DNA, 19 bp, Homo sapiens
tggaagagaggcacctgct

SEQ ID NO: 2712845 - DNA, 20 bp, Homo sapiens
tggaagagaggcacctgctg

SEQ ID NO: 2712846 - DNA, 20 bp, Homo sapiens
tggaatacgatcctgcaggg

SEQ ID NO: 2712847 - DNA, 18 bp, Homo sapiens
tggaatctactagaacct

SEQ ID NO: 2712848 - DNA, 14 bp, Homo sapiens
tgggactacaggca

SEQ ID NO: 2712849 - DNA, 23 bp, Homo sapiens
tgggactggccaggtttctgccc

SEQ ID NO: 2712850 - DNA, 22 bp, Homo sapiens
tgggagatgaaaacctgcattt

SEQ ID NO: 2712851 - DNA, 16 bp, Homo sapiens
tgggaggacagagccg

SEQ ID NO: 2712852 - DNA, 13 bp, Homo sapiens
tgggaggcagcat

SEQ ID NO: 2712853 - DNA, 14 bp, Homo sapiens
tgggatcagcctcc

SEQ ID NO: 2712854 - DNA, 14 bp, Homo sapiens
tgggcactgctggg

SEQ ID NO: 2712855 - DNA, 16 bp, Homo sapiens
tgggcactgctgggtg

SEQ ID NO: 2712856 - DNA, 21 bp, Homo sapiens
tgggcactgctgggtggccca

SEQ ID NO: 2712857 - DNA, 23 bp, Homo sapiens
tgggcactgctgggtggcccatc

SEQ ID NO: 2712858 - DNA, 23 bp, Homo sapiens
tgggcatttggtgagagtcaaag

SEQ ID NO: 2712859 - DNA, 20 bp, Homo sapiens
tgggccagatgctgggcagg

SEQ ID NO: 2712860 - DNA, 20 bp, Homo sapiens
tgggccatactggcctcgcc

SEQ ID NO: 2712861 - DNA, 13 bp, Homo sapiens
tgggcccacagcc

SEQ ID NO: 2712862 - DNA, 18 bp, Homo sapiens
tgggcccacagcccccac

SEQ ID NO: 2712863 - DNA, 20 bp, Homo sapiens
tgggcccacagcccccaccc

SEQ ID NO: 2712864 - DNA, 23 bp, Homo sapiens
tgggcccccagagacctttgccc

SEQ ID NO: 2712865 - DNA, 22 bp, Homo sapiens
tgggcccctcaggggaagctgc

SEQ ID NO: 2712866 - DNA, 20 bp, Homo sapiens
tgggcctcctctccctgcac

SEQ ID NO: 2712867 - DNA, 15 bp, Homo sapiens
tgggcctgacctcca

SEQ ID NO: 2712868 - DNA, 16 bp, Homo sapiens
tgggcctgacctccag

SEQ ID NO: 2712869 - DNA, 13 bp, Homo sapiens
tgggcgacagagc

SEQ ID NO: 2712870 - DNA, 13 bp, Homo sapiens
tgggcgggcagca

SEQ ID NO: 2712871 - DNA, 12 bp, Homo sapiens
tgggctaacatt

SEQ ID NO: 2712872 - DNA, 14 bp, Homo sapiens
tgggctctgaggag

SEQ ID NO: 2712873 - DNA, 12 bp, Homo sapiens
tgggctgagccc

SEQ ID NO: 2712874 - DNA, 17 bp, Homo sapiens
tgggctgcactctgtgc

SEQ ID NO: 2712875 - DNA, 19 bp, Homo sapiens
tgggctgcactctgtgccc

SEQ ID NO: 2712876 - DNA, 20 bp, Homo sapiens
tgggctgcactctgtgccca

SEQ ID NO: 2712877 - DNA, 22 bp, Homo sapiens
tgggctgcactctgtgcccatg

SEQ ID NO: 2712878 - DNA, 20 bp, Homo sapiens
tgggctgggtgcgaccccat

SEQ ID NO: 2712879 - DNA, 20 bp, Homo sapiens
tgggctttctcagtgtcagc

SEQ ID NO: 2712880 - DNA, 21 bp, Homo sapiens
tggggaagcaagacgtcctgg

SEQ ID NO: 2712881 - DNA, 16 bp, Homo sapiens
tggggaccccctcagg

SEQ ID NO: 2712882 - DNA, 21 bp, Homo sapiens
tggggagtacattcatctgga

SEQ ID NO: 2712883 - DNA, 19 bp, Homo sapiens
tggggcctgatggggaggg

SEQ ID NO: 2712884 - DNA, 15 bp, Homo sapiens
tggggctctgtgcag

SEQ ID NO: 2712885 - DNA, 17 bp, Homo sapiens
tggggctggtgaggccg

SEQ ID NO: 2712886 - DNA, 19 bp, Homo sapiens
tgggggaagagcacagccc

SEQ ID NO: 2712887 - DNA, 22 bp, Homo sapiens
tgggggaagagcacagccctcc

SEQ ID NO: 2712888 - DNA, 23 bp, Homo sapiens
tgggggaagagcacagccctccc

SEQ ID NO: 2712889 - DNA, 11 bp, Homo sapiens
tgggggaggct

SEQ ID NO: 2712890 - DNA, 19 bp, Homo sapiens
tgggggagggactgctgac

SEQ ID NO: 2712891 - DNA, 12 bp, Homo sapiens
tgggggcagggg

SEQ ID NO: 2712892 - DNA, 18 bp, Homo sapiens
tgggggcgggggagccaa

SEQ ID NO: 2712893 - DNA, 19 bp, Homo sapiens
tgggggcgggggagccaac

SEQ ID NO: 2712894 - DNA, 14 bp, Homo sapiens
tgggggctcccctt

SEQ ID NO: 2712895 - DNA, 16 bp, Homo sapiens
tgggggcttccctggg

SEQ ID NO: 2712896 - DNA, 13 bp, Homo sapiens
tggggggagggca

SEQ ID NO: 2712897 - DNA, 15 bp, Homo sapiens
tggggggagggcacc

SEQ ID NO: 2712898 - DNA, 16 bp, Homo sapiens
tggggggagggcaccc

SEQ ID NO: 2712899 - DNA, 19 bp, Homo sapiens
tgggggggagaaggcctcc

SEQ ID NO: 2712900 - DNA, 22 bp, Homo sapiens
tgggtccaggggagggaaaagc

SEQ ID NO: 2712901 - DNA, 19 bp, Homo sapiens
tgggtcccacttcccctcc

SEQ ID NO: 2712902 - DNA, 12 bp, Homo sapiens
tgggtgagagag

SEQ ID NO: 2712903 - DNA, 13 bp, Homo sapiens
tgggtgcgacccc

SEQ ID NO: 2712904 - DNA, 21 bp, Homo sapiens
tgggtgcgaccccatctgccc

SEQ ID NO: 2712905 - DNA, 22 bp, Homo sapiens
tgggtgcgaccccatctgccca

SEQ ID NO: 2712906 - DNA, 23 bp, Homo sapiens
tgggtgcgaccccatctgcccag

SEQ ID NO: 2712907 - DNA, 23 bp, Homo sapiens
tgcaggttgggccatactggcct

SEQ ID NO: 2712908 - DNA, 13 bp, Homo sapiens
tgcagtcttttgc

SEQ ID NO: 2712909 - DNA, 14 bp, Homo sapiens
tgcagtgcggctca

SEQ ID NO: 2712910 - DNA, 17 bp, Homo sapiens
tgcagtggctcacgcct

SEQ ID NO: 2712911 - DNA, 22 bp, Homo sapiens
tgcataatgaaccgtttacagt

SEQ ID NO: 2712912 - DNA, 23 bp, Homo sapiens
tgcataatgaaccgtttacagtg

SEQ ID NO: 2712913 - DNA, 20 bp, Homo sapiens
tgcatatctctagtccctgt

SEQ ID NO: 2712914 - DNA, 20 bp, Homo sapiens
tgcatcactggtatacacac

SEQ ID NO: 2712915 - DNA, 18 bp, Homo sapiens
tgcatcagctttttgtat

SEQ ID NO: 2712916 - DNA, 17 bp, Homo sapiens
tgcatctgcacccaggg

SEQ ID NO: 2712917 - DNA, 21 bp, Homo sapiens
tgcatgcaggtctccatgaag

SEQ ID NO: 2712918 - DNA, 14 bp, Homo sapiens
tgcatggagtgttt

SEQ ID NO: 2712919 - DNA, 13 bp, Homo sapiens
tgcatggcactga

SEQ ID NO: 2712920 - DNA, 23 bp, Homo sapiens
tgcatgtaaaatcttcagctggt

SEQ ID NO: 2712921 - DNA, 16 bp, Homo sapiens
tgcattcccggtgcag

SEQ ID NO: 2712922 - DNA, 23 bp, Homo sapiens
tgcattcgcggttaagatactca

SEQ ID NO: 2712923 - DNA, 16 bp, Homo sapiens
tgcattctagtgcaga

SEQ ID NO: 2712924 - DNA, 22 bp, Homo sapiens
tgcattgaatttagtcattatt

SEQ ID NO: 2712925 - DNA, 17 bp, Homo sapiens
tgcatttttaaaggaca

SEQ ID NO: 2712926 - DNA, 13 bp, Homo sapiens
tgccaagaaatcg

SEQ ID NO: 2712927 - DNA, 19 bp, Homo sapiens
tgccaagaaatcgccttat

SEQ ID NO: 2712928 - DNA, 17 bp, Homo sapiens
tgccaccctgggctctg

SEQ ID NO: 2712929 - DNA, 14 bp, Homo sapiens
tgccactctgctgc

SEQ ID NO: 2712930 - DNA, 18 bp, Homo sapiens
tgccactctgctgcctgt

SEQ ID NO: 2712931 - DNA, 20 bp, Homo sapiens
tgccactctgctgcctgtac

SEQ ID NO: 2712932 - DNA, 16 bp, Homo sapiens
tgccacttcccaggta

SEQ ID NO: 2712933 - DNA, 16 bp, Homo sapiens
tgccagcctggcttct

SEQ ID NO: 2712934 - DNA, 14 bp, Homo sapiens
tgccagctctgtca

SEQ ID NO: 2712935 - DNA, 19 bp, Homo sapiens
tgccagctctgtcaccctg

SEQ ID NO: 2712936 - DNA, 20 bp, Homo sapiens
tgccagctctgtcaccctgg

SEQ ID NO: 2712937 - DNA, 21 bp, Homo sapiens
tgccagctctgtcaccctggc

SEQ ID NO: 2712938 - DNA, 12 bp, Homo sapiens
tgccagtcgcgc

SEQ ID NO: 2712939 - DNA, 21 bp, Homo sapiens
tgccagtcgcgctgcctgtgt

SEQ ID NO: 2712940 - DNA, 22 bp, Homo sapiens
tgccagtcgcgctgcctgtgtg

SEQ ID NO: 2712941 - DNA, 15 bp, Homo sapiens
tgccatgggcctgct

SEQ ID NO: 2712942 - DNA, 16 bp, Homo sapiens
tgccatgggcctgctg

SEQ ID NO: 2712943 - DNA, 17 bp, Homo sapiens
tgccatgggcctgctgc

SEQ ID NO: 2712944 - DNA, 11 bp, Homo sapiens
tgccattccca

SEQ ID NO: 2712945 - DNA, 22 bp, Homo sapiens
tgccatttgcaccctccgcctt

SEQ ID NO: 2712946 - DNA, 15 bp, Homo sapiens
tgcccaatccaggcc

SEQ ID NO: 2712947 - DNA, 19 bp, Homo sapiens
tgcccactgccgatgccca

SEQ ID NO: 2712948 - DNA, 23 bp, Homo sapiens
tgcccagagggcccaggcaggcc

SEQ ID NO: 2712949 - DNA, 13 bp, Homo sapiens
tgcccagctctcg

SEQ ID NO: 2712950 - DNA, 12 bp, Homo sapiens
tgcccaggctgg

SEQ ID NO: 2712951 - DNA, 20 bp, Homo sapiens
tgcccagggtcagtgtatct

SEQ ID NO: 2712952 - DNA, 18 bp, Homo sapiens
tgcccatgggcactgctg

SEQ ID NO: 2712953 - DNA, 20 bp, Homo sapiens
tgcccatgggcactgctggg

SEQ ID NO: 2712954 - DNA, 15 bp, Homo sapiens
tgcccattcctcacc

SEQ ID NO: 2712955 - DNA, 17 bp, Homo sapiens
tgccccatctcctccca

SEQ ID NO: 2712956 - DNA, 22 bp, Homo sapiens
tgccccatctcctcccatggcc

SEQ ID NO: 2712957 - DNA, 19 bp, Homo sapiens
tgcccccaactcccggagg

SEQ ID NO: 2712958 - DNA, 12 bp, Homo sapiens
tgccccccatcc

SEQ ID NO: 2712959 - DNA, 14 bp, Homo sapiens
tgccccccatcctg

SEQ ID NO: 2712960 - DNA, 13 bp, Homo sapiens
tgccccctcgtgc

SEQ ID NO: 2712961 - DNA, 17 bp, Homo sapiens
tgccccctcgtgccagt

SEQ ID NO: 2712962 - DNA, 12 bp, Homo sapiens
tgccccctggtg

SEQ ID NO: 2712963 - DNA, 13 bp, Homo sapiens
tgccccctggtgg

SEQ ID NO: 2712964 - DNA, 18 bp, Homo sapiens
tgccccggcttgcctgta

SEQ ID NO: 2712965 - DNA, 17 bp, Homo sapiens
tgcccctccctagatcc

SEQ ID NO: 2712966 - DNA, 16 bp, Homo sapiens
tgcccgcagagcccac

SEQ ID NO: 2712967 - DNA, 17 bp, Homo sapiens
tgcccggattctgggag

SEQ ID NO: 2712968 - DNA, 22 bp, Homo sapiens
tgcccggcgccctctgtcctga

SEQ ID NO: 2712969 - DNA, 18 bp, Homo sapiens
tgccctccacagccgcag

SEQ ID NO: 2712970 - DNA, 21 bp, Homo sapiens
tgccctccacagccgcagcct

SEQ ID NO: 2712971 - DNA, 15 bp, Homo sapiens
tgcccttcctgaccc

SEQ ID NO: 2712972 - DNA, 16 bp, Homo sapiens
tgccgagagaggcgcg

SEQ ID NO: 2712973 - DNA, 17 bp, Homo sapiens
tgccgccgcctcgccca

SEQ ID NO: 2712974 - DNA, 20 bp, Homo sapiens
tgccgccgcctcgcccaccg

SEQ ID NO: 2712975 - DNA, 12 bp, Homo sapiens
tgccgcctcctt

SEQ ID NO: 2712976 - DNA, 23 bp, Homo sapiens
tgccgggtggggggagggcaccc

SEQ ID NO: 2712977 - DNA, 19 bp, Homo sapiens
tgccggtaccagcctgact

SEQ ID NO: 2712978 - DNA, 23 bp, Homo sapiens
tgcctaattcctggcatgacact

SEQ ID NO: 2712979 - DNA, 16 bp, Homo sapiens
tgcctagctcttgggc

SEQ ID NO: 2712980 - DNA, 18 bp, Homo sapiens
tgcctagctcttgggcct

SEQ ID NO: 2712981 - DNA, 19 bp, Homo sapiens
tgcctcagccagccctgga

SEQ ID NO: 2712982 - DNA, 21 bp, Homo sapiens
tgcctcagccagccctggagg

SEQ ID NO: 2712983 - DNA, 22 bp, Homo sapiens
tgcctcagccagccctggaggc

SEQ ID NO: 2712984 - DNA, 16 bp, Homo sapiens
tcacagattgcttcat

SEQ ID NO: 2712985 - DNA, 13 bp, Homo sapiens
tcacagcctctcc

SEQ ID NO: 2712986 - DNA, 16 bp, Homo sapiens
tcacagcctctccctt

SEQ ID NO: 2712987 - DNA, 16 bp, Homo sapiens
tcacagctcttgtttg

SEQ ID NO: 2712988 - DNA, 15 bp, Homo sapiens
tcacagggagctggc

SEQ ID NO: 2712989 - DNA, 13 bp, Homo sapiens
tcacataaaatgc

SEQ ID NO: 2712990 - DNA, 21 bp, Homo sapiens
tcacatataaaagttaaacta

SEQ ID NO: 2712991 - DNA, 14 bp, Homo sapiens
tcacatattattgg

SEQ ID NO: 2712992 - DNA, 14 bp, Homo sapiens
tcacatcttatgct

SEQ ID NO: 2712993 - DNA, 17 bp, Homo sapiens
tcacattttgcctttct

SEQ ID NO: 2712994 - DNA, 19 bp, Homo sapiens
tcaccacattctgtctctg

SEQ ID NO: 2712995 - DNA, 15 bp, Homo sapiens
tcaccaggggcaggc

SEQ ID NO: 2712996 - DNA, 18 bp, Homo sapiens
tcaccaggggcaggcaca

SEQ ID NO: 2712997 - DNA, 19 bp, Homo sapiens
tcaccaggggcaggcacag

SEQ ID NO: 2712998 - DNA, 22 bp, Homo sapiens
tcaccaggggcaggcacagcac

SEQ ID NO: 2712999 - DNA, 13 bp, Homo sapiens
tcaccatgcaagg

SEQ ID NO: 2713000 - DNA, 16 bp, Homo sapiens
tcaccatgcaggcaac

SEQ ID NO: 2713001 - DNA, 14 bp, Homo sapiens
tcaccctcctgagc

SEQ ID NO: 2713002 - DNA, 15 bp, Homo sapiens
tcaccctcctgagcc

SEQ ID NO: 2713003 - DNA, 17 bp, Homo sapiens
tcaccctcctgagcctc

SEQ ID NO: 2713004 - DNA, 17 bp, Homo sapiens
tcaccctggccaccacc

SEQ ID NO: 2713005 - DNA, 18 bp, Homo sapiens
tcaccctggccaccaccc

SEQ ID NO: 2713006 - DNA, 22 bp, Homo sapiens
tcaccgtcattgatggagcctg

SEQ ID NO: 2713007 - DNA, 18 bp, Homo sapiens
tcacctcaggccaggtgc

SEQ ID NO: 2713008 - DNA, 20 bp, Homo sapiens
tcacctcgttactctcacct

SEQ ID NO: 2713009 - DNA, 17 bp, Homo sapiens
tcaccttaactcagcca

SEQ ID NO: 2713010 - DNA, 20 bp, Homo sapiens
tcaccttgccgagagaggcg

SEQ ID NO: 2713011 - DNA, 22 bp, Homo sapiens
tcacctttcctgccgtccctcc

SEQ ID NO: 2713012 - DNA, 19 bp, Homo sapiens
tcacgcctatgatcccagc

SEQ ID NO: 2713013 - DNA, 20 bp, Homo sapiens
tcacgtgaccagccccgtgt

SEQ ID NO: 2713014 - DNA, 22 bp, Homo sapiens
tcactccggtgtgcctgcagcc

SEQ ID NO: 2713015 - DNA, 19 bp, Homo sapiens
tcactgaagtgattgaaag

SEQ ID NO: 2713016 - DNA, 21 bp, Homo sapiens
tcactgcaagctctgcctccc

SEQ ID NO: 2713017 - DNA, 12 bp, Homo sapiens
tcactgcagcct

SEQ ID NO: 2713018 - DNA, 14 bp, Homo sapiens
tcactggctgcctc

SEQ ID NO: 2713019 - DNA, 15 bp, Homo sapiens
tcactggctgcctcc

SEQ ID NO: 2713020 - DNA, 17 bp, Homo sapiens
tcactggctgcctccac

SEQ ID NO: 2713021 - DNA, 16 bp, Homo sapiens
tcacttaaaaaaatgc

SEQ ID NO: 2713022 - DNA, 13 bp, Homo sapiens
tcagaagcctgag

SEQ ID NO: 2713023 - DNA, 22 bp, Homo sapiens
tcagaattgtttttagaaattt

SEQ ID NO: 2713024 - DNA, 16 bp, Homo sapiens
tcagaattttggaaaa

SEQ ID NO: 2713025 - DNA, 18 bp, Homo sapiens
tcagaccagtactgggaa

SEQ ID NO: 2713026 - DNA, 13 bp, Homo sapiens
tcagactggctgg

SEQ ID NO: 2713027 - DNA, 14 bp, Homo sapiens
tcagactggctggc

SEQ ID NO: 2713028 - DNA, 20 bp, Homo sapiens
tcagacttagtttttataaa

SEQ ID NO: 2713029 - DNA, 17 bp, Homo sapiens
tcagagagcatcttttc

SEQ ID NO: 2713030 - DNA, 15 bp, Homo sapiens
tcagagcctcagctt

SEQ ID NO: 2713031 - DNA, 15 bp, Homo sapiens
tcagagctgcgggct

SEQ ID NO: 2713032 - DNA, 16 bp, Homo sapiens
tcagagctgcgggctg

SEQ ID NO: 2713033 - DNA, 13 bp, Homo sapiens
tcagagctgctga

SEQ ID NO: 2713034 - DNA, 16 bp, Homo sapiens
tcagagctgctgagca

SEQ ID NO: 2713035 - DNA, 23 bp, Homo sapiens
tcagagcttttcgaactgtgctc

SEQ ID NO: 2713036 - DNA, 21 bp, Homo sapiens
tcagagggaggagtttttctt

SEQ ID NO: 2713037 - DNA, 13 bp, Homo sapiens
tcagatcctgggc

SEQ ID NO: 2713038 - DNA, 12 bp, Homo sapiens
tcagattgtaaa

SEQ ID NO: 2713039 - DNA, 22 bp, Homo sapiens
tcagcaaaaatctcccagtgac

SEQ ID NO: 2713040 - DNA, 14 bp, Homo sapiens
tcagcagccccacc

SEQ ID NO: 2713041 - DNA, 19 bp, Homo sapiens
tcagcatcaaacatgaaaa

SEQ ID NO: 2713042 - DNA, 20 bp, Homo sapiens
tcagcatcaaacatgaaaac

SEQ ID NO: 2713043 - DNA, 21 bp, Homo sapiens
tcagcatcaaacatgaaaaca

SEQ ID NO: 2713044 - DNA, 21 bp, Homo sapiens
tcagcctcatgccccaggcct

SEQ ID NO: 2713045 - DNA, 11 bp, Homo sapiens
tcagcctccag

SEQ ID NO: 2713046 - DNA, 21 bp, Homo sapiens
tcagcctcccgagtagctgag

SEQ ID NO: 2713047 - DNA, 12 bp, Homo sapiens
tcagcctcctga

SEQ ID NO: 2713048 - DNA, 20 bp, Homo sapiens
tcagcctgaggctgagactg

SEQ ID NO: 2713049 - DNA, 21 bp, Homo sapiens
tcagccttccccctcccaggg

SEQ ID NO: 2713050 - DNA, 22 bp, Homo sapiens
tcagccttccccctcccagggc

SEQ ID NO: 2713051 - DNA, 12 bp, Homo sapiens
tcagctgcctca

SEQ ID NO: 2713052 - DNA, 22 bp, Homo sapiens
tcagctggtggatggtgacttt

SEQ ID NO: 2713053 - DNA, 23 bp, Homo sapiens
tcagctggtggatggtgactttt

SEQ ID NO: 2713054 - DNA, 12 bp, Homo sapiens
tcagctgtgaac

SEQ ID NO: 2713055 - DNA, 22 bp, Homo sapiens
tcagcttctgctgggctggggc

SEQ ID NO: 2713056 - DNA, 12 bp, Homo sapiens
tcagcttctgtt

SEQ ID NO: 2713057 - DNA, 16 bp, Homo sapiens
tcagcttttgcttcat

SEQ ID NO: 2713058 - DNA, 16 bp, Homo sapiens
tcaggaatttaattta

SEQ ID NO: 2713059 - DNA, 13 bp, Homo sapiens
tcaggagctcagt

SEQ ID NO: 2713060 - DNA, 15 bp, Homo sapiens
tcaggaggctgaggg

SEQ ID NO: 2713061 - DNA, 16 bp, Homo sapiens
tcaggccaggtgcagt

SEQ ID NO: 2713062 - DNA, 15 bp, Homo sapiens
tcaggcttccttggc

SEQ ID NO: 2713063 - DNA, 14 bp, Homo sapiens
tcagggaccacagc

SEQ ID NO: 2713064 - DNA, 15 bp, Homo sapiens
tcagggaccacagca

SEQ ID NO: 2713065 - DNA, 16 bp, Homo sapiens
tcagggaccacagcaa

SEQ ID NO: 2713066 - DNA, 15 bp, Homo sapiens
tcaggggaagctgct

SEQ ID NO: 2713067 - DNA, 13 bp, Homo sapiens
tcaggggctgccc

SEQ ID NO: 2713068 - DNA, 21 bp, Homo sapiens
tcaggggctgcccgctcccag

SEQ ID NO: 2713069 - DNA, 22 bp, Homo sapiens
tcaggggctgcccgctcccagt

SEQ ID NO: 2713070 - DNA, 22 bp, Homo sapiens
tcaggtgacggactcagactcc

SEQ ID NO: 2713071 - DNA, 19 bp, Homo sapiens
tcaggtgtggcggtgcgtg

SEQ ID NO: 2713072 - DNA, 16 bp, Homo sapiens
tcagtaagtataacaa

SEQ ID NO: 2713073 - DNA, 14 bp, Homo sapiens
tcagtctgaatggc

SEQ ID NO: 2713074 - DNA, 21 bp, Homo sapiens
tcagtctgaatggcatggaga

SEQ ID NO: 2713075 - DNA, 12 bp, Homo sapiens
tcagtcttggag

SEQ ID NO: 2713076 - DNA, 14 bp, Homo sapiens
tcagtgccgccgcc

SEQ ID NO: 2713077 - DNA, 12 bp, Homo sapiens
tcagtgctgtgg

SEQ ID NO: 2713078 - DNA, 20 bp, Homo sapiens
tcagtgtacccccgcccagg

SEQ ID NO: 2713079 - DNA, 22 bp, Homo sapiens
tcagtgtgccccccatcctggc

SEQ ID NO: 2713080 - DNA, 16 bp, Homo sapiens
tcagttcctctttgca

SEQ ID NO: 2713081 - DNA, 12 bp, Homo sapiens
tcagttgttttc

SEQ ID NO: 2713082 - DNA, 20 bp, Homo sapiens
tcatagatgagaaaactgag

SEQ ID NO: 2713083 - DNA, 15 bp, Homo sapiens
tcatagtcaatcaaa

SEQ ID NO: 2713084 - DNA, 16 bp, Homo sapiens
tcatataatttaaaga

SEQ ID NO: 2713085 - DNA, 17 bp, Homo sapiens
tcatataatttaaagaa

SEQ ID NO: 2713086 - DNA, 22 bp, Homo sapiens
tcatataatttaaagaaacact

SEQ ID NO: 2713087 - DNA, 12 bp, Homo sapiens
tcatatgaaaaa

SEQ ID NO: 2713088 - DNA, 21 bp, Homo sapiens
tcatattgctaccaaaaacta

SEQ ID NO: 2713089 - DNA, 17 bp, Homo sapiens
tcatcaaataaaccttg

SEQ ID NO: 2713090 - DNA, 14 bp, Homo sapiens
tcatcagaactgaa

SEQ ID NO: 2713091 - DNA, 23 bp, Homo sapiens
tcatcagtcttaatattcagaga

SEQ ID NO: 2713092 - DNA, 13 bp, Homo sapiens
tcatcctcctcct

SEQ ID NO: 2713093 - DNA, 22 bp, Homo sapiens
tcatctgctcctagcccagcag

SEQ ID NO: 2713094 - DNA, 20 bp, Homo sapiens
tcatctgtgcctgtctgtcc

SEQ ID NO: 2713095 - DNA, 17 bp, Homo sapiens
tcatctttatctcctgg

SEQ ID NO: 2713096 - DNA, 18 bp, Homo sapiens
tcatctttatctcctggg

SEQ ID NO: 2713097 - DNA, 17 bp, Homo sapiens
tcatgcaagacttcact

SEQ ID NO: 2713098 - DNA, 22 bp, Homo sapiens
tcttgtttggagggatcatttt

SEQ ID NO: 2713099 - DNA, 13 bp, Homo sapiens
tctttaaatacag

SEQ ID NO: 2713100 - DNA, 14 bp, Homo sapiens
tctttaaatacagt

SEQ ID NO: 2713101 - DNA, 14 bp, Homo sapiens
tctttatctcctgg

SEQ ID NO: 2713102 - DNA, 16 bp, Homo sapiens
tctttatgatttttaa

SEQ ID NO: 2713103 - DNA, 15 bp, Homo sapiens
tctttcttggtgcat

SEQ ID NO: 2713104 - DNA, 22 bp, Homo sapiens
tctttctttccaaaacatttct

SEQ ID NO: 2713105 - DNA, 12 bp, Homo sapiens
tctttctttgct

SEQ ID NO: 2713106 - DNA, 20 bp, Homo sapiens
tctttctttgctgctgtgga

SEQ ID NO: 2713107 - DNA, 19 bp, Homo sapiens
tctttgcaccaaagacatc

SEQ ID NO: 2713108 - DNA, 16 bp, Homo sapiens
tctttgctacaataaa

SEQ ID NO: 2713109 - DNA, 21 bp, Homo sapiens
tctttgctacaataaatgctg

SEQ ID NO: 2713110 - DNA, 14 bp, Homo sapiens
tctttggggaaact

SEQ ID NO: 2713111 - DNA, 15 bp, Homo sapiens
tcttttacatacagt

SEQ ID NO: 2713112 - DNA, 14 bp, Homo sapiens
tcttttccagaaag

SEQ ID NO: 2713113 - DNA, 23 bp, Homo sapiens
tcttttctctatgaaaagcaact

SEQ ID NO: 2713114 - DNA, 21 bp, Homo sapiens
tgaaaaaagaagtttgggcta

SEQ ID NO: 2713115 - DNA, 22 bp, Homo sapiens
tgaaaaaagtataggataaatt

SEQ ID NO: 2713116 - DNA, 19 bp, Homo sapiens
tgaaaaacacggcagctgt

SEQ ID NO: 2713117 - DNA, 22 bp, Homo sapiens
tgaaaaacacggcagctgtagc

SEQ ID NO: 2713118 - DNA, 13 bp, Homo sapiens
tgaaaaataaata

SEQ ID NO: 2713119 - DNA, 20 bp, Homo sapiens
tgaaaaatagtgtgtccatg

SEQ ID NO: 2713120 - DNA, 16 bp, Homo sapiens
tgaaaaatatgtgctt

SEQ ID NO: 2713121 - DNA, 16 bp, Homo sapiens
tgaaaacattgatgaa

SEQ ID NO: 2713122 - DNA, 14 bp, Homo sapiens
tgaaaacccctggc

SEQ ID NO: 2713123 - DNA, 17 bp, Homo sapiens
tgaaaacccctggctga

SEQ ID NO: 2713124 - DNA, 13 bp, Homo sapiens
tgaaaacctgcat

SEQ ID NO: 2713125 - DNA, 12 bp, Homo sapiens
tgaaaagccata

SEQ ID NO: 2713126 - DNA, 18 bp, Homo sapiens
tgaaaagccatatctagt

SEQ ID NO: 2713127 - DNA, 15 bp, Homo sapiens
tgaaaccgtccctga

SEQ ID NO: 2713128 - DNA, 11 bp, Homo sapiens
tgaaagacatc

SEQ ID NO: 2713129 - DNA, 17 bp, Homo sapiens
tgaaagacatcaatgaa

SEQ ID NO: 2713130 - DNA, 15 bp, Homo sapiens
tgaaagatgcaagca

SEQ ID NO: 2713131 - DNA, 18 bp, Homo sapiens
tgaaagtcagatgcccag

SEQ ID NO: 2713132 - DNA, 18 bp, Homo sapiens
tgaaagtgaataaacttc

SEQ ID NO: 2713133 - DNA, 12 bp, Homo sapiens
tgaacaaaagct

SEQ ID NO: 2713134 - DNA, 13 bp, Homo sapiens
tgaacaattctct

SEQ ID NO: 2713135 - DNA, 16 bp, Homo sapiens
tgaacacactcagcag

SEQ ID NO: 2713136 - DNA, 16 bp, Homo sapiens
tgaacagcttcactta

SEQ ID NO: 2713137 - DNA, 15 bp, Homo sapiens
tgaacagtgctctgc

SEQ ID NO: 2713138 - DNA, 14 bp, Homo sapiens
tgaacatggactct

SEQ ID NO: 2713139 - DNA, 17 bp, Homo sapiens
tgaacattgcaatagaa

SEQ ID NO: 2713140 - DNA, 18 bp, Homo sapiens
tgaacattgcaatagaaa

SEQ ID NO: 2713141 - DNA, 15 bp, Homo sapiens
tgaaccgacttttct

SEQ ID NO: 2713142 - DNA, 15 bp, Homo sapiens
tgaaccgtttacagt

SEQ ID NO: 2713143 - DNA, 19 bp, Homo sapiens
tgaacgtgaataggctgct

SEQ ID NO: 2713144 - DNA, 24 bp, Homo sapiens
tgaagacctccacattaagtggct

SEQ ID NO: 2713145 - DNA, 14 bp, Homo sapiens
tgaagcaatttata

SEQ ID NO: 2713146 - DNA, 18 bp, Homo sapiens
tgaagcaatttatatctt

SEQ ID NO: 2713147 - DNA, 20 bp, Homo sapiens
tgaagcaatttatatcttta

SEQ ID NO: 2713148 - DNA, 23 bp, Homo sapiens
tgaaggacctgaaataaggtata

SEQ ID NO: 2713149 - DNA, 20 bp, Homo sapiens
tgaaggagattttccttcct

SEQ ID NO: 2713150 - DNA, 22 bp, Homo sapiens
tgaaggatttcttattttcttg

SEQ ID NO: 2713151 - DNA, 21 bp, Homo sapiens
tgaaggtaataaatacacagc

SEQ ID NO: 2713152 - DNA, 17 bp, Homo sapiens
tgaagtatttctcactc

SEQ ID NO: 2713153 - DNA, 17 bp, Homo sapiens
tgaagtgtcgagtccag

SEQ ID NO: 2713154 - DNA, 14 bp, Homo sapiens
tgaataaacttcag

SEQ ID NO: 2713155 - DNA, 17 bp, Homo sapiens
tgaataaacttcagcac

SEQ ID NO: 2713156 - DNA, 20 bp, Homo sapiens
tgaataaagggaacatgcag

SEQ ID NO: 2713157 - DNA, 14 bp, Homo sapiens
tgaatacttgaagt

SEQ ID NO: 2713158 - DNA, 17 bp, Homo sapiens
tgaatgaggaacaatca

SEQ ID NO: 2713159 - DNA, 22 bp, Homo sapiens
tgaatgagtttccagctaagcc

SEQ ID NO: 2713160 - DNA, 16 bp, Homo sapiens
tgaatgtcataaagaa

SEQ ID NO: 2713161 - DNA, 14 bp, Homo sapiens
tgaatgtcccagag

SEQ ID NO: 2713162 - DNA, 16 bp, Homo sapiens
tgaatgtcccagaggc

SEQ ID NO: 2713163 - DNA, 14 bp, Homo sapiens
tgaattcacaaaca

SEQ ID NO: 2713164 - DNA, 21 bp, Homo sapiens
tgaattcacaaacaaatggct

SEQ ID NO: 2713165 - DNA, 23 bp, Homo sapiens
tgaattcacaaacaaatggctgt

SEQ ID NO: 2713166 - DNA, 15 bp, Homo sapiens
tgaattgagctagaa

SEQ ID NO: 2713167 - DNA, 13 bp, Homo sapiens
tgaatttaagcat

SEQ ID NO: 2713168 - DNA, 19 bp, Homo sapiens
tgaatttaagcatgagtgg

SEQ ID NO: 2713169 - DNA, 13 bp, Homo sapiens
tgaatttagtcat

SEQ ID NO: 2713170 - DNA, 15 bp, Homo sapiens
tgaatttattattgt

SEQ ID NO: 2713171 - DNA, 18 bp, Homo sapiens
tgaatttattattgttct

SEQ ID NO: 2713172 - DNA, 14 bp, Homo sapiens
tgaatttggagact

SEQ ID NO: 2713173 - DNA, 17 bp, Homo sapiens
tgaatttggagactctg

SEQ ID NO: 2713174 - DNA, 14 bp, Homo sapiens
tgaattttcccact

SEQ ID NO: 2713175 - DNA, 20 bp, Homo sapiens
tgaattttcccactgcaccc

SEQ ID NO: 2713176 - DNA, 19 bp, Homo sapiens
tgacaacatttttgtacat

SEQ ID NO: 2713177 - DNA, 20 bp, Homo sapiens
tgacaacatttttgtacatt

SEQ ID NO: 2713178 - DNA, 22 bp, Homo sapiens
tgacaacatttttgtacattat

SEQ ID NO: 2713179 - DNA, 23 bp, Homo sapiens
tgacaacatttttgtacattatg

SEQ ID NO: 2713180 - DNA, 19 bp, Homo sapiens
tgacactctagtgacttcc

SEQ ID NO: 2713181 - DNA, 22 bp, Homo sapiens
tgacactctagtgacttcctgg

SEQ ID NO: 2713182 - DNA, 15 bp, Homo sapiens
tgacagagccagagg

SEQ ID NO: 2713183 - DNA, 16 bp, Homo sapiens
tgacagagccagaggc

SEQ ID NO: 2713184 - DNA, 21 bp, Homo sapiens
tgacagatcctccatttttgt

SEQ ID NO: 2713185 - DNA, 15 bp, Homo sapiens
tgacagtcctctcca

SEQ ID NO: 2713186 - DNA, 20 bp, Homo sapiens
tcattgatggagcctgaacc

SEQ ID NO: 2713187 - DNA, 18 bp, Homo sapiens
tcattggataaatttgaa

SEQ ID NO: 2713188 - DNA, 18 bp, Homo sapiens
tcattggcccaacaagaa

SEQ ID NO: 2713189 - DNA, 18 bp, Homo sapiens
tcattttatataaagaaa

SEQ ID NO: 2713190 - DNA, 16 bp, Homo sapiens
tccaaatgcattcatg

SEQ ID NO: 2713191 - DNA, 19 bp, Homo sapiens
tccaaatgcattcatgttt

SEQ ID NO: 2713192 - DNA, 22 bp, Homo sapiens
tccaaatgctgtgcaaacagtg

SEQ ID NO: 2713193 - DNA, 16 bp, Homo sapiens
tccaaattgtctgtct

SEQ ID NO: 2713194 - DNA, 18 bp, Homo sapiens
tccaaattgtctgtctgc

SEQ ID NO: 2713195 - DNA, 21 bp, Homo sapiens
tccaaattgtctgtctgctct

SEQ ID NO: 2713196 - DNA, 22 bp, Homo sapiens
tccaaattgtctgtctgctctt

SEQ ID NO: 2713197 - DNA, 16 bp, Homo sapiens
tccaacccctccccca

SEQ ID NO: 2713198 - DNA, 15 bp, Homo sapiens
tccaaggcagttctg

SEQ ID NO: 2713199 - DNA, 17 bp, Homo sapiens
tccaaggcagttctgtg

SEQ ID NO: 2713200 - DNA, 20 bp, Homo sapiens
tccaaggcagttctgtgtcc

SEQ ID NO: 2713201 - DNA, 22 bp, Homo sapiens
tccaaggcagttctgtgtcctc

SEQ ID NO: 2713202 - DNA, 20 bp, Homo sapiens
tccaagggtatgggaagcca

SEQ ID NO: 2713203 - DNA, 22 bp, Homo sapiens
tccaagggtatgggaagccata

SEQ ID NO: 2713204 - DNA, 22 bp, Homo sapiens
tccaagtcaacactcttcttga

SEQ ID NO: 2713205 - DNA, 15 bp, Homo sapiens
tccaagtgccaatat

SEQ ID NO: 2713206 - DNA, 12 bp, Homo sapiens
tccacataaagg

SEQ ID NO: 2713207 - DNA, 19 bp, Homo sapiens
tccaccagagcaggggctg

SEQ ID NO: 2713208 - DNA, 12 bp, Homo sapiens
tccacccactgt

SEQ ID NO: 2713209 - DNA, 20 bp, Homo sapiens
tccacctagtggctgtccag

SEQ ID NO: 2713210 - DNA, 23 bp, Homo sapiens
tccacctggccccttctccagca

SEQ ID NO: 2713211 - DNA, 23 bp, Homo sapiens
tccactccatatttatttaaaca

SEQ ID NO: 2713212 - DNA, 10 bp, Homo sapiens
tccactggac

SEQ ID NO: 2713213 - DNA, 13 bp, Homo sapiens
tccactgtttcat

SEQ ID NO: 2713214 - DNA, 19 bp, Homo sapiens
tccactgtttcatgagccc

SEQ ID NO: 2713215 - DNA, 20 bp, Homo sapiens
tccactgtttcatgagccca

SEQ ID NO: 2713216 - DNA, 17 bp, Homo sapiens
tccagaatgtgctgcct

SEQ ID NO: 2713217 - DNA, 18 bp, Homo sapiens
tccagaatgtgctgcctt

SEQ ID NO: 2713218 - DNA, 19 bp, Homo sapiens
tccagaattacccttcctc

SEQ ID NO: 2713219 - DNA, 21 bp, Homo sapiens
tccagaattacccttcctcat

SEQ ID NO: 2713220 - DNA, 18 bp, Homo sapiens
tccagaccattgtcttcc

SEQ ID NO: 2713221 - DNA, 19 bp, Homo sapiens
tccagaccattgtcttcca

SEQ ID NO: 2713222 - DNA, 20 bp, Homo sapiens
tccagaccattgtcttccaa

SEQ ID NO: 2713223 - DNA, 15 bp, Homo sapiens
tccagactgcggagc

SEQ ID NO: 2713224 - DNA, 20 bp, Homo sapiens
tccagcacgttttctggctt

SEQ ID NO: 2713225 - DNA, 18 bp, Homo sapiens
tccagccagctcctgcac

SEQ ID NO: 2713226 - DNA, 19 bp, Homo sapiens
tccagccagctcctgcaca

SEQ ID NO: 2713227 - DNA, 14 bp, Homo sapiens
tccagcctcacaga

SEQ ID NO: 2713228 - DNA, 23 bp, Homo sapiens
tccagcctcacagatgctggcct

SEQ ID NO: 2713229 - DNA, 13 bp, Homo sapiens
tccagcctgagca

SEQ ID NO: 2713230 - DNA, 20 bp, Homo sapiens
tccagcctgggcgacagagc

SEQ ID NO: 2713231 - DNA, 22 bp, Homo sapiens
tccagcctgggcgacagagcaa

SEQ ID NO: 2713232 - DNA, 22 bp, Homo sapiens
tccagctgttacctgagatact

SEQ ID NO: 2713233 - DNA, 19 bp, Homo sapiens
tccagcttcctctgagccg

SEQ ID NO: 2713234 - DNA, 16 bp, Homo sapiens
tccaggaataggcatt

SEQ ID NO: 2713235 - DNA, 14 bp, Homo sapiens
tccaggcttctccc

SEQ ID NO: 2713236 - DNA, 15 bp, Homo sapiens
tccagtatcctgctg

SEQ ID NO: 2713237 - DNA, 14 bp, Homo sapiens
tccagtcctgctgg

SEQ ID NO: 2713238 - DNA, 14 bp, Homo sapiens
tccagtctgcagac

SEQ ID NO: 2713239 - DNA, 15 bp, Homo sapiens
tccagtgctggctgc

SEQ ID NO: 2713240 - DNA, 16 bp, Homo sapiens
tccagtgctggctgct

SEQ ID NO: 2713241 - DNA, 22 bp, Homo sapiens
tccagtgctggctgctggccca

SEQ ID NO: 2713242 - DNA, 17 bp, Homo sapiens
tccagtgggaggacaga

SEQ ID NO: 2713243 - DNA, 22 bp, Homo sapiens
tccagtgggaggacagagccgg

SEQ ID NO: 2713244 - DNA, 19 bp, Homo sapiens
tccagtgtattttctgtgt

SEQ ID NO: 2713245 - DNA, 13 bp, Homo sapiens
tccagtttccaaa

SEQ ID NO: 2713246 - DNA, 18 bp, Homo sapiens
tccataatataaacactt

SEQ ID NO: 2713247 - DNA, 17 bp, Homo sapiens
tccatcctcctctccat

SEQ ID NO: 2713248 - DNA, 21 bp, Homo sapiens
tccatcctcctctccatgcaa

SEQ ID NO: 2713249 - DNA, 16 bp, Homo sapiens
tccatgatactttaat

SEQ ID NO: 2713250 - DNA, 14 bp, Homo sapiens
tccatgcaagtgct

SEQ ID NO: 2713251 - DNA, 16 bp, Homo sapiens
tccatgcaagtgctgt

SEQ ID NO: 2713252 - DNA, 18 bp, Homo sapiens
tccatgggattttatctg

SEQ ID NO: 2713253 - DNA, 15 bp, Homo sapiens
tccatttctactgta

SEQ ID NO: 2713254 - DNA, 15 bp, Homo sapiens
tccattttacttcca

SEQ ID NO: 2713255 - DNA, 13 bp, Homo sapiens
tccatttttgttg

SEQ ID NO: 2713256 - DNA, 20 bp, Homo sapiens
tcccaagtagtagtgtcttc

SEQ ID NO: 2713257 - DNA, 13 bp, Homo sapiens
tcccaagtgtctc

SEQ ID NO: 2713258 - DNA, 13 bp, Homo sapiens
tcccaattttctg

SEQ ID NO: 2713259 - DNA, 21 bp, Homo sapiens
tcccaccaggcagctccagct

SEQ ID NO: 2713260 - DNA, 22 bp, Homo sapiens
tcccacccccacttcatgccca

SEQ ID NO: 2713261 - DNA, 20 bp, Homo sapiens
tcccacggggaccactgggc

SEQ ID NO: 2713262 - DNA, 23 bp, Homo sapiens
tcccacggggaccactgggcccc

SEQ ID NO: 2713263 - DNA, 23 bp, Homo sapiens
tcccactcctaatcaagagtctc

SEQ ID NO: 2713264 - DNA, 13 bp, Homo sapiens
tcccactgcaccc

SEQ ID NO: 2713265 - DNA, 17 bp, Homo sapiens
tcccacttccctgacac

SEQ ID NO: 2713266 - DNA, 13 bp, Homo sapiens
tcccagacagctg

SEQ ID NO: 2713267 - DNA, 16 bp, Homo sapiens
tcccagacagctggac

SEQ ID NO: 2713268 - DNA, 19 bp, Homo sapiens
tcccagcctggccaccagc

SEQ ID NO: 2713269 - DNA, 16 bp, Homo sapiens
tcccagctactcagaa

SEQ ID NO: 2713270 - DNA, 19 bp, Homo sapiens
tcccagctactcagaagcc

SEQ ID NO: 2713271 - DNA, 21 bp, Homo sapiens
tcccagctactcagaagcctg

SEQ ID NO: 2713272 - DNA, 18 bp, Homo sapiens
tcccagctattcaggagg

SEQ ID NO: 2713273 - DNA, 18 bp, Homo sapiens
tcccagctgacagtcctc

SEQ ID NO: 2713274 - DNA, 16 bp, Homo sapiens
tcccagggccagggcc

SEQ ID NO: 2713275 - DNA, 17 bp, Homo sapiens
tcccagggccagggccc

SEQ ID NO: 2713276 - DNA, 18 bp, Homo sapiens
tcccaggtaagcaggagg

SEQ ID NO: 2713277 - DNA, 18 bp, Homo sapiens
tcccagtgagcctctgcg

SEQ ID NO: 2713278 - DNA, 20 bp, Homo sapiens
tcccagtgagcctctgcgcc

SEQ ID NO: 2713279 - DNA, 22 bp, Homo sapiens
tcccagtgagcctctgcgcctc

SEQ ID NO: 2713280 - DNA, 19 bp, Homo sapiens
tcccatctaagctgcagct

SEQ ID NO: 2713281 - DNA, 14 bp, Homo sapiens
tcccatggccttcc

SEQ ID NO: 2713282 - DNA, 17 bp, Homo sapiens
tcccatggtagactgtg

SEQ ID NO: 2713283 - DNA, 23 bp, Homo sapiens
tcccattttagaaaatcagattt

SEQ ID NO: 2713284 - DNA, 20 bp, Homo sapiens
tccccacagtcctcacagcc

SEQ ID NO: 2713285 - DNA, 21 bp, Homo sapiens
tccccacagtcctcacagcct

SEQ ID NO: 2713286 - DNA, 15 bp, Homo sapiens
tccccaccagagctg

SEQ ID NO: 2713287 - DNA, 18 bp, Homo sapiens
tccccaccttcaattcct

SEQ ID NO: 2713288 - DNA, 12 bp, Homo sapiens
tcccccaccctg

SEQ ID NO: 2713289 - DNA, 13 bp, Homo sapiens
tcccccaccctgg

SEQ ID NO: 2713290 - DNA, 14 bp, Homo sapiens
tcccccaccctggg

SEQ ID NO: 2713291 - DNA, 18 bp, Homo sapiens
tcccccacgtctctctgc

SEQ ID NO: 2713292 - DNA, 21 bp, Homo sapiens
tcccccacgtctctctgcctg

SEQ ID NO: 2713293 - DNA, 22 bp, Homo sapiens
tcccccacgtctctctgcctgc

SEQ ID NO: 2713294 - DNA, 23 bp, Homo sapiens
tcccccacgtctctctgcctgct

SEQ ID NO: 2713295 - DNA, 18 bp, Homo sapiens
tcccccagcgcttagaaa

SEQ ID NO: 2713296 - DNA, 14 bp, Homo sapiens
tcccccctcaccag

SEQ ID NO: 2713297 - DNA, 18 bp, Homo sapiens
tccccctaccgcatggca

SEQ ID NO: 2713298 - DNA, 10 bp, Homo sapiens
tccccctggg

SEQ ID NO: 2713299 - DNA, 14 bp, Homo sapiens
tccccctgggctct

SEQ ID NO: 2713300 - DNA, 13 bp, Homo sapiens
tccccgaaaaccc

SEQ ID NO: 2713301 - DNA, 20 bp, Homo sapiens
tccccgagggatgatgccac

SEQ ID NO: 2713302 - DNA, 14 bp, Homo sapiens
tcccctcacagact

SEQ ID NO: 2713303 - DNA, 20 bp, Homo sapiens
tcccctcacagactcttcca

SEQ ID NO: 2713304 - DNA, 23 bp, Homo sapiens
tcccctccaccctaaagtctcag

SEQ ID NO: 2713305 - DNA, 13 bp, Homo sapiens
tcccctcctaccc

SEQ ID NO: 2713306 - DNA, 22 bp, Homo sapiens
tcccctgaggatcccctgtccc

SEQ ID NO: 2713307 - DNA, 18 bp, Homo sapiens
tcccctgaggctggcatc

SEQ ID NO: 2713308 - DNA, 20 bp, Homo sapiens
tcccctgaggctggcatcct

SEQ ID NO: 2713309 - DNA, 17 bp, Homo sapiens
tcccctgccgcctcccg

SEQ ID NO: 2713310 - DNA, 18 bp, Homo sapiens
tcccctgccgcctcccgg

SEQ ID NO: 2713311 - DNA, 16 bp, Homo sapiens
tccccttgcccttcct

SEQ ID NO: 2713312 - DNA, 14 bp, Homo sapiens
tatatatcataaag

SEQ ID NO: 2713313 - DNA, 17 bp, Homo sapiens
tatatatcataaagtat

SEQ ID NO: 2713314 - DNA, 21 bp, Homo sapiens
tatatattctacacatatatg

SEQ ID NO: 2713315 - DNA, 16 bp, Homo sapiens
tatatctttatgcaaa

SEQ ID NO: 2713316 - DNA, 14 bp, Homo sapiens
tatatctttttcca

SEQ ID NO: 2713317 - DNA, 18 bp, Homo sapiens
tatatgccttaagccaat

SEQ ID NO: 2713318 - DNA, 19 bp, Homo sapiens
tatatgtatatctatatct

SEQ ID NO: 2713319 - DNA, 17 bp, Homo sapiens
tatatgtatatgtatat

SEQ ID NO: 2713320 - DNA, 22 bp, Homo sapiens
tatatttttaaaggaaaaatca

SEQ ID NO: 2713321 - DNA, 11 bp, Homo sapiens
tatcaggaggg

SEQ ID NO: 2713322 - DNA, 15 bp, Homo sapiens
tatcaggaggggaag

SEQ ID NO: 2713323 - DNA, 21 bp, Homo sapiens
tatccacagaaacattttcat

SEQ ID NO: 2713324 - DNA, 15 bp, Homo sapiens
tatccattgtggaaa

SEQ ID NO: 2713325 - DNA, 17 bp, Homo sapiens
tatccttggagagcagc

SEQ ID NO: 2713326 - DNA, 20 bp, Homo sapiens
tatccttggagagcagctgg

SEQ ID NO: 2713327 - DNA, 16 bp, Homo sapiens
tatcgttcgcttgttt

SEQ ID NO: 2713328 - DNA, 12 bp, Homo sapiens
tatctaatttac

SEQ ID NO: 2713329 - DNA, 14 bp, Homo sapiens
tatctaatttacca

SEQ ID NO: 2713330 - DNA, 14 bp, Homo sapiens
tatctagtcaataa

SEQ ID NO: 2713331 - DNA, 17 bp, Homo sapiens
tatctcgctagccatat

SEQ ID NO: 2713332 - DNA, 21 bp, Homo sapiens
tatctctaaactgctgttaat

SEQ ID NO: 2713333 - DNA, 16 bp, Homo sapiens
tatctctagtccctgt

SEQ ID NO: 2713334 - DNA, 21 bp, Homo sapiens
tatctgaaggagattttcctt

SEQ ID NO: 2713335 - DNA, 16 bp, Homo sapiens
tatctgagaagtgtat

SEQ ID NO: 2713336 - DNA, 22 bp, Homo sapiens
tatctgagaagtgtatatagtt

SEQ ID NO: 2713337 - DNA, 13 bp, Homo sapiens
tatctgaggtcac

SEQ ID NO: 2713338 - DNA, 22 bp, Homo sapiens
tatctgcatgtaaaatcttcag

SEQ ID NO: 2713339 - DNA, 15 bp, Homo sapiens
tatctggtatctgca

SEQ ID NO: 2713340 - DNA, 19 bp, Homo sapiens
tatctggtatctgcatgta

SEQ ID NO: 2713341 - DNA, 19 bp, Homo sapiens
tatctttatgcaaaaacat

SEQ ID NO: 2713342 - DNA, 14 bp, Homo sapiens
tatctttgtctaaa

SEQ ID NO: 2713343 - DNA, 23 bp, Homo sapiens
tatcttttctattgtttattctt

SEQ ID NO: 2713344 - DNA, 17 bp, Homo sapiens
tatgaaaagcaactgag

SEQ ID NO: 2713345 - DNA, 21 bp, Homo sapiens
tatgacagtgaattttgcaca

SEQ ID NO: 2713346 - DNA, 21 bp, Homo sapiens
tatgatctactcatttgctga

SEQ ID NO: 2713347 - DNA, 12 bp, Homo sapiens
tatgatgctatt

SEQ ID NO: 2713348 - DNA, 19 bp, Homo sapiens
tatgattgcactaaataaa

SEQ ID NO: 2713349 - DNA, 15 bp, Homo sapiens
tatgattgtttgcac

SEQ ID NO: 2713350 - DNA, 23 bp, Homo sapiens
tatgcacgttaacagcgtgtcaa

SEQ ID NO: 2713351 - DNA, 18 bp, Homo sapiens
tatgccgtgtagtttctg

SEQ ID NO: 2713352 - DNA, 21 bp, Homo sapiens
tatgccgtgtagtttctggta

SEQ ID NO: 2713353 - DNA, 18 bp, Homo sapiens
tatggcccagccactgca

SEQ ID NO: 2713354 - DNA, 23 bp, Homo sapiens
tatggggggaggggggagggctg

SEQ ID NO: 2713355 - DNA, 19 bp, Homo sapiens
tatgtacagttcataaatt

SEQ ID NO: 2713356 - DNA, 18 bp, Homo sapiens
tatgtctgtctttgcaaa

SEQ ID NO: 2713357 - DNA, 14 bp, Homo sapiens
tatgtgacaacatt

SEQ ID NO: 2713358 - DNA, 16 bp, Homo sapiens
tatgtgacaacatttt

SEQ ID NO: 2713359 - DNA, 17 bp, Homo sapiens
tatgtggatacagtcat

SEQ ID NO: 2713360 - DNA, 16 bp, Homo sapiens
tatgttacttaaacat

SEQ ID NO: 2713361 - DNA, 20 bp, Homo sapiens
tattaagaaacaatttaaat

SEQ ID NO: 2713362 - DNA, 18 bp, Homo sapiens
tattaagaatagtctctg

SEQ ID NO: 2713363 - DNA, 19 bp, Homo sapiens
tattaagaatagtctctgg

SEQ ID NO: 2713364 - DNA, 21 bp, Homo sapiens
tattaatggaaacatgctgta

SEQ ID NO: 2713365 - DNA, 17 bp, Homo sapiens
tattaggggtaatatat

SEQ ID NO: 2713366 - DNA, 22 bp, Homo sapiens
tattagtttgatttaatatctg

SEQ ID NO: 2713367 - DNA, 17 bp, Homo sapiens
tattcaggaaaagcctc

SEQ ID NO: 2713368 - DNA, 21 bp, Homo sapiens
tattcagtgctgtggcctggg

SEQ ID NO: 2713369 - DNA, 23 bp, Homo sapiens
tattcatcaaataaaccttgttt

SEQ ID NO: 2713370 - DNA, 19 bp, Homo sapiens
tattcatgctttctccttt

SEQ ID NO: 2713371 - DNA, 22 bp, Homo sapiens
tattcccttctgatcttggaaa

SEQ ID NO: 2713372 - DNA, 21 bp, Homo sapiens
tattctaataaatcaatgtga

SEQ ID NO: 2713373 - DNA, 16 bp, Homo sapiens
tattctacacatatat

SEQ ID NO: 2713374 - DNA, 18 bp, Homo sapiens
tattctacacatatatgt

SEQ ID NO: 2713375 - DNA, 20 bp, Homo sapiens
tattctacacatatatgtat

SEQ ID NO: 2713376 - DNA, 14 bp, Homo sapiens
tattctctgatgtt

SEQ ID NO: 2713377 - DNA, 18 bp, Homo sapiens
tattctgataatgtattg

SEQ ID NO: 2713378 - DNA, 15 bp, Homo sapiens
tattgaccatgtgat

SEQ ID NO: 2713379 - DNA, 18 bp, Homo sapiens
tattgctccattttcttg

SEQ ID NO: 2713380 - DNA, 11 bp, Homo sapiens
tattgctctta

SEQ ID NO: 2713381 - DNA, 15 bp, Homo sapiens
tattgctcttaaaaa

SEQ ID NO: 2713382 - DNA, 22 bp, Homo sapiens
tattgctcttaaaaatcttggt

SEQ ID NO: 2713383 - DNA, 19 bp, Homo sapiens
tatttaagaaagggaaagc

SEQ ID NO: 2713384 - DNA, 17 bp, Homo sapiens
tatttaagtactatctt

SEQ ID NO: 2713385 - DNA, 19 bp, Homo sapiens
tatttaagtactatctttg

SEQ ID NO: 2713386 - DNA, 13 bp, Homo sapiens
tatttatttatgt

SEQ ID NO: 2713387 - DNA, 18 bp, Homo sapiens
tatttccacataaaggta

SEQ ID NO: 2713388 - DNA, 19 bp, Homo sapiens
tatttccacataaaggtat

SEQ ID NO: 2713389 - DNA, 12 bp, Homo sapiens
tatttcctttgc

SEQ ID NO: 2713390 - DNA, 13 bp, Homo sapiens
tatttgataacat

SEQ ID NO: 2713391 - DNA, 19 bp, Homo sapiens
tatttgataacattttgtt

SEQ ID NO: 2713392 - DNA, 22 bp, Homo sapiens
tattttacatgaagctgtataa

SEQ ID NO: 2713393 - DNA, 19 bp, Homo sapiens
tattttcacagatggaaga

SEQ ID NO: 2713394 - DNA, 21 bp, Homo sapiens
tattttcatgacttttccatg

SEQ ID NO: 2713395 - DNA, 19 bp, Homo sapiens
tattttcatttctaacata

SEQ ID NO: 2713396 - DNA, 22 bp, Homo sapiens
tattttctgagtagcatatata

SEQ ID NO: 2713397 - DNA, 19 bp, Homo sapiens
tattttggacgtgtgagga

SEQ ID NO: 2713398 - DNA, 14 bp, Homo sapiens
tattttgtaattat

SEQ ID NO: 2713399 - DNA, 13 bp, Homo sapiens
tatttttgaaaga

SEQ ID NO: 2713400 - DNA, 19 bp, Homo sapiens
tatttttgaaagaattcta

SEQ ID NO: 2713401 - DNA, 20 bp, Homo sapiens
tatttttttaagctgtaaaa

SEQ ID NO: 2713402 - DNA, 16 bp, Homo sapiens
tcaaaaagtataaatt

SEQ ID NO: 2713403 - DNA, 20 bp, Homo sapiens
tcaaaagtggtctcaaaata

SEQ ID NO: 2713404 - DNA, 23 bp, Homo sapiens
tcaaacagggacactacaaacat

SEQ ID NO: 2713405 - DNA, 16 bp, Homo sapiens
tcaaacatgaaaacat

SEQ ID NO: 2713406 - DNA, 12 bp, Homo sapiens
tcaaagaaattt

SEQ ID NO: 2713407 - DNA, 20 bp, Homo sapiens
tcaaagaaatttccactcag

SEQ ID NO: 2713408 - DNA, 17 bp, Homo sapiens
tcaacacttttctccag

SEQ ID NO: 2713409 - DNA, 17 bp, Homo sapiens
tcaacagtgaacagctt

SEQ ID NO: 2713410 - DNA, 14 bp, Homo sapiens
tcaactttcatttg

SEQ ID NO: 2713411 - DNA, 15 bp, Homo sapiens
tcaagaccagcctgg

SEQ ID NO: 2713412 - DNA, 17 bp, Homo sapiens
tcaagagtctctccagc

SEQ ID NO: 2713413 - DNA, 17 bp, Homo sapiens
tcaagatttcaggatta

SEQ ID NO: 2713414 - DNA, 18 bp, Homo sapiens
tcaagcaggtttcttgct

SEQ ID NO: 2713415 - DNA, 14 bp, Homo sapiens
tcaaggcctcccac

SEQ ID NO: 2713416 - DNA, 17 bp, Homo sapiens
tcaaggcctcccacagt

SEQ ID NO: 2713417 - DNA, 21 bp, Homo sapiens
tcaaggggactggtgatggga

SEQ ID NO: 2713418 - DNA, 11 bp, Homo sapiens
tcaagtctgtg

SEQ ID NO: 2713419 - DNA, 12 bp, Homo sapiens
tcaagtctgtga

SEQ ID NO: 2713420 - DNA, 18 bp, Homo sapiens
tcaagtgagtggcatgtg

SEQ ID NO: 2713421 - DNA, 15 bp, Homo sapiens
tcaagttagctcagg

SEQ ID NO: 2713422 - DNA, 24 bp, Homo sapiens
tcaagttccctcctgcagcctgac

SEQ ID NO: 2713423 - DNA, 15 bp, Homo sapiens
tcaatgtcaagtacc

SEQ ID NO: 2713424 - DNA, 19 bp, Homo sapiens
tcaatttactttttaaaca

SEQ ID NO: 2713425 - DNA, 13 bp, Homo sapiens
tcaattttgtatt

SEQ ID NO: 2713426 - DNA, 14 bp, Homo sapiens
tcacaaaagctgtg

SEQ ID NO: 2713427 - DNA, 21 bp, Homo sapiens
tcacaaaagctgtgtctctgt

SEQ ID NO: 2713428 - DNA, 17 bp, Homo sapiens
tcacaccattctcctgc

SEQ ID NO: 2713429 - DNA, 16 bp, Homo sapiens
taaattcactgttgaa

SEQ ID NO: 2713430 - DNA, 19 bp, Homo sapiens
taaattcgctgtgagtgag

SEQ ID NO: 2713431 - DNA, 22 bp, Homo sapiens
tacccccgcccaggctggccag

SEQ ID NO: 2713432 - DNA, 17 bp, Homo sapiens
gttaccaaaaatatccc

SEQ ID NO: 2713433 - DNA, 16 bp, Homo sapiens
gttaccaaatctcagt

SEQ ID NO: 2713434 - DNA, 15 bp, Homo sapiens
gttacttaaacatca

SEQ ID NO: 2713435 - DNA, 22 bp, Homo sapiens
gttaggattaggtttagaatca

SEQ ID NO: 2713436 - DNA, 16 bp, Homo sapiens
gttaggcctggcacag

SEQ ID NO: 2713437 - DNA, 11 bp, Homo sapiens
gttatatttgt

SEQ ID NO: 2713438 - DNA, 16 bp, Homo sapiens
gttattggaattttct

SEQ ID NO: 2713439 - DNA, 14 bp, Homo sapiens
gtccagtgcccatt

SEQ ID NO: 2713440 - DNA, 13 bp, Homo sapiens
gtccatcctcctc

SEQ ID NO: 2713441 - DNA, 17 bp, Homo sapiens
gtccatcctcctctcca

SEQ ID NO: 2713442 - DNA, 18 bp, Homo sapiens
gtccatcctcctctccat

SEQ ID NO: 2713443 - DNA, 15 bp, Homo sapiens
gtcccacccaggaag

SEQ ID NO: 2713444 - DNA, 16 bp, Homo sapiens
gtcccacttcccctcc

SEQ ID NO: 2713445 - DNA, 17 bp, Homo sapiens
gtcccacttcccctcct

SEQ ID NO: 2713446 - DNA, 14 bp, Homo sapiens
gtcccagacagctg

SEQ ID NO: 2713447 - DNA, 20 bp, Homo sapiens
gtcccagcctggccaccagc

SEQ ID NO: 2713448 - DNA, 22 bp, Homo sapiens
gtcccagctactcagaagcctg

SEQ ID NO: 2713449 - DNA, 13 bp, Homo sapiens
gtcccctcacaga

SEQ ID NO: 2713450 - DNA, 20 bp, Homo sapiens
gtcccctcacagactcttcc

SEQ ID NO: 2713451 - DNA, 23 bp, Homo sapiens
gtcccctcacagactcttccacc

SEQ ID NO: 2713452 - DNA, 23 bp, Homo sapiens
gtcccctcacgtgaccagccccg

SEQ ID NO: 2713453 - DNA, 15 bp, Homo sapiens
gtcccctcttgcccc

SEQ ID NO: 2713454 - DNA, 16 bp, Homo sapiens
gtcccctcttgcccca

SEQ ID NO: 2713455 - DNA, 23 bp, Homo sapiens
gtcccctcttgccccaaccccca

SEQ ID NO: 2713456 - DNA, 14 bp, Homo sapiens
gtgacatcagaagt

SEQ ID NO: 2713457 - DNA, 18 bp, Homo sapiens
gtgacatcgacaaccacg

SEQ ID NO: 2713458 - DNA, 23 bp, Homo sapiens
gtgacccccactgccgcctcctt

SEQ ID NO: 2713459 - DNA, 20 bp, Homo sapiens
gtgacggtcctttaggcagc

SEQ ID NO: 2713460 - DNA, 24 bp, Homo sapiens
gtgacggtcctttaggcagcctgc

SEQ ID NO: 2713461 - DNA, 18 bp, Homo sapiens
gtgacgtgactcagagct

SEQ ID NO: 2713462 - DNA, 18 bp, Homo sapiens
gtgactcgggctcctgtg

SEQ ID NO: 2713463 - DNA, 20 bp, Homo sapiens
gtgactcgggctcctgtgcc

SEQ ID NO: 2713464 - DNA, 20 bp, Homo sapiens
gtgagaagggcctgctctgc

SEQ ID NO: 2713465 - DNA, 16 bp, Homo sapiens
gtgagaccctgtctct

SEQ ID NO: 2713466 - DNA, 23 bp, Homo sapiens
gtgagccatagagatatttaaaa

SEQ ID NO: 2713467 - DNA, 12 bp, Homo sapiens
gtgagcctctgc

SEQ ID NO: 2713468 - DNA, 17 bp, Homo sapiens
gtgagcctctgcgcctc

SEQ ID NO: 2713469 - DNA, 17 bp, Homo sapiens
gtgagctggaggaacat

SEQ ID NO: 2713470 - DNA, 23 bp, Homo sapiens
gtgaggccggccctgcccctccc

SEQ ID NO: 2713471 - DNA, 14 bp, Homo sapiens
gtgagtggcatgtg

SEQ ID NO: 2713472 - DNA, 16 bp, Homo sapiens
gtgatcacgatccagt

SEQ ID NO: 2713473 - DNA, 18 bp, Homo sapiens
gtgatgttgggaagctat

SEQ ID NO: 2713474 - DNA, 17 bp, Homo sapiens
gtgattggcaggaggca

SEQ ID NO: 2713475 - DNA, 18 bp, Homo sapiens
gtgatttcccgtggcccc

SEQ ID NO: 2713476 - DNA, 21 bp, Homo sapiens
gtgatttcccgtggccccagc

SEQ ID NO: 2713477 - DNA, 22 bp, Homo sapiens
gtgatttcccgtggccccagcc

SEQ ID NO: 2713478 - DNA, 16 bp, Homo sapiens
gtgatttgcctgcctg

SEQ ID NO: 2713479 - DNA, 20 bp, Homo sapiens
gtgcaaacagtgtaagctta

SEQ ID NO: 2713480 - DNA, 17 bp, Homo sapiens
gtgcacagacctcagag

SEQ ID NO: 2713481 - DNA, 23 bp, Homo sapiens
gtgcacagtaatatgaaagccac

SEQ ID NO: 2713482 - DNA, 23 bp, Homo sapiens
gtgcacctatggcccagccactg

SEQ ID NO: 2713483 - DNA, 21 bp, Homo sapiens
gtgcacctgtactcaggaggc

SEQ ID NO: 2713484 - DNA, 17 bp, Homo sapiens
gtgcagacagtgtcaga

SEQ ID NO: 2713485 - DNA, 20 bp, Homo sapiens
gtgcagaggtgagcagagga

SEQ ID NO: 2713486 - DNA, 21 bp, Homo sapiens
gtgcagaggtgagcagaggag

SEQ ID NO: 2713487 - DNA, 15 bp, Homo sapiens
gtgcagttttccagg

SEQ ID NO: 2713488 - DNA, 11 bp, Homo sapiens
gtgccaccctg

SEQ ID NO: 2713489 - DNA, 15 bp, Homo sapiens
gtgccaccctgggct

SEQ ID NO: 2713490 - DNA, 16 bp, Homo sapiens
gtgccaccctgggctc

SEQ ID NO: 2713491 - DNA, 18 bp, Homo sapiens
gtgccagtcttgtgtctg

SEQ ID NO: 2713492 - DNA, 16 bp, Homo sapiens
gtgcccatgggcactg

SEQ ID NO: 2713493 - DNA, 13 bp, Homo sapiens
gtgccccatgtcc

SEQ ID NO: 2713494 - DNA, 18 bp, Homo sapiens
gtgccgccgcctcgccca

SEQ ID NO: 2713495 - DNA, 20 bp, Homo sapiens
gtgccgccgcctcgcccacc

SEQ ID NO: 2713496 - DNA, 22 bp, Homo sapiens
gtgccgtgaactgcgtgccagt

SEQ ID NO: 2713497 - DNA, 14 bp, Homo sapiens
gtgcctcagtgctg

SEQ ID NO: 2713498 - DNA, 14 bp, Homo sapiens
gtgcctgtctgtcc

SEQ ID NO: 2713499 - DNA, 20 bp, Homo sapiens
gtgcgaccccatctgcccag

SEQ ID NO: 2713500 - DNA, 20 bp, Homo sapiens
gtgctcacgactcttcctgc

SEQ ID NO: 2713501 - DNA, 15 bp, Homo sapiens
gtgctctgtccttgt

SEQ ID NO: 2713502 - DNA, 18 bp, Homo sapiens
gtgctgcaattgagggct

SEQ ID NO: 2713503 - DNA, 19 bp, Homo sapiens
gtgctgctaccctccctgc

SEQ ID NO: 2713504 - DNA, 21 bp, Homo sapiens
gtgctgctaccctccctgctg

SEQ ID NO: 2713505 - DNA, 22 bp, Homo sapiens
gtgctggctgctggcccacagc

SEQ ID NO: 2713506 - DNA, 19 bp, Homo sapiens
gtgctgtggcctgggcaag

SEQ ID NO: 2713507 - DNA, 13 bp, Homo sapiens
gtgcttcagcctg

SEQ ID NO: 2713508 - DNA, 15 bp, Homo sapiens
gtgcttcagcctgag

SEQ ID NO: 2713509 - DNA, 18 bp, Homo sapiens
gtgcttcagcctgaggct

SEQ ID NO: 2713510 - DNA, 21 bp, Homo sapiens
gtgcttcttgtaatatttctt

SEQ ID NO: 2713511 - DNA, 13 bp, Homo sapiens
gtggacagtcctg

SEQ ID NO: 2713512 - DNA, 23 bp, Homo sapiens
gtggaggttgcagtgaactgaga

SEQ ID NO: 2713513 - DNA, 14 bp, Homo sapiens
gtggatacagtcat

SEQ ID NO: 2713514 - DNA, 17 bp, Homo sapiens
gtggatggtgacttttg

SEQ ID NO: 2713515 - DNA, 18 bp, Homo sapiens
gtggatggtgacttttga

SEQ ID NO: 2713516 - DNA, 21 bp, Homo sapiens
gtggattcagcttctgttgga

SEQ ID NO: 2713517 - DNA, 18 bp, Homo sapiens
gtggcaaccctcagctgc

SEQ ID NO: 2713518 - DNA, 12 bp, Homo sapiens
gtggcagccctg

SEQ ID NO: 2713519 - DNA, 13 bp, Homo sapiens
gtggcagccctgt

SEQ ID NO: 2713520 - DNA, 21 bp, Homo sapiens
gtggcatatccattgtggaaa

SEQ ID NO: 2713521 - DNA, 23 bp, Homo sapiens
gtggcatgtgggttgtgatattg

SEQ ID NO: 2713522 - DNA, 21 bp, Homo sapiens
gtggcattctctctgctcagt

SEQ ID NO: 2713523 - DNA, 20 bp, Homo sapiens
gtggcccatcccccctcacc

SEQ ID NO: 2713524 - DNA, 22 bp, Homo sapiens
gtggccccagcctggcccagct

SEQ ID NO: 2713525 - DNA, 23 bp, Homo sapiens
gtggctctgggaatgggagaggg

SEQ ID NO: 2713526 - DNA, 15 bp, Homo sapiens
gtggctgtccagtgc

SEQ ID NO: 2713527 - DNA, 19 bp, Homo sapiens
gtggctgtccagtgcccat

SEQ ID NO: 2713528 - DNA, 15 bp, Homo sapiens
gtgggagatgaaaac

SEQ ID NO: 2713529 - DNA, 12 bp, Homo sapiens
gtgggaggacag

SEQ ID NO: 2713530 - DNA, 16 bp, Homo sapiens
gtgggctcagatcctg

SEQ ID NO: 2713531 - DNA, 15 bp, Homo sapiens
gtgggctgagccctg

SEQ ID NO: 2713532 - DNA, 16 bp, Homo sapiens
gtgggctgagccctgg

SEQ ID NO: 2713533 - DNA, 21 bp, Homo sapiens
gtggggaagcaagacgtcctg

SEQ ID NO: 2713534 - DNA, 13 bp, Homo sapiens
gtggggccttggt

SEQ ID NO: 2713535 - DNA, 15 bp, Homo sapiens
gtggggggagggcac

SEQ ID NO: 2713536 - DNA, 23 bp, Homo sapiens
gtgggggggagaaggcctcccct

SEQ ID NO: 2713537 - DNA, 20 bp, Homo sapiens
gtgggtcccacttcccctcc

SEQ ID NO: 2713538 - DNA, 21 bp, Homo sapiens
gtgggtcccacttcccctcct

SEQ ID NO: 2713539 - DNA, 17 bp, Homo sapiens
gtggtcacttatcctga

SEQ ID NO: 2713540 - DNA, 18 bp, Homo sapiens
gtggtctgctcgggccca

SEQ ID NO: 2713541 - DNA, 21 bp, Homo sapiens
gtgtaccacaccctgcctgct

SEQ ID NO: 2713542 - DNA, 16 bp, Homo sapiens
gtgtagccttgcccgg

SEQ ID NO: 2713543 - DNA, 16 bp, Homo sapiens
gtgtcaactttcattt

SEQ ID NO: 2713544 - DNA, 17 bp, Homo sapiens
gtgtcaccctgcagagc

SEQ ID NO: 2713545 - DNA, 13 bp, Homo sapiens
gtgtcagagtcat

SEQ ID NO: 2713546 - DNA, 20 bp, Homo sapiens
gtgtccagaccattgtcttc

SEQ ID NO: 2713547 - DNA, 21 bp, Homo sapiens
gtgtccctttttgcaggggac

SEQ ID NO: 2713548 - DNA, 17 bp, Homo sapiens
gtgtcctggaccctggc

SEQ ID NO: 2713549 - DNA, 19 bp, Homo sapiens
gtgtcctggaccctggcct

SEQ ID NO: 2713550 - DNA, 14 bp, Homo sapiens
gtgtcgtgtctgct

SEQ ID NO: 2713551 - DNA, 14 bp, Homo sapiens
gtgtctctgcctgg

SEQ ID NO: 2713552 - DNA, 18 bp, Homo sapiens
gtgtctctgcctggagca

SEQ ID NO: 2713553 - DNA, 19 bp, Homo sapiens
gtgtctcttgactggctca

SEQ ID NO: 2713554 - DNA, 14 bp, Homo sapiens
gtgtctgcagctcc

SEQ ID NO: 2713555 - DNA, 12 bp, Homo sapiens
gtgtctgggctg

SEQ ID NO: 2713556 - DNA, 17 bp, Homo sapiens
gtgtgatcccaagtgcc

SEQ ID NO: 2713557 - DNA, 15 bp, Homo sapiens
gtgtgcccaccagcg

SEQ ID NO: 2713558 - DNA, 16 bp, Homo sapiens
gtgtgccccccatcct

SEQ ID NO: 2713559 - DNA, 23 bp, Homo sapiens
gtgtgccccccatcctggcccat

SEQ ID NO: 2713560 - DNA, 13 bp, Homo sapiens
gtgtgcctgcagc

SEQ ID NO: 2713561 - DNA, 13 bp, Homo sapiens
gtgtggatgttca

SEQ ID NO: 2713562 - DNA, 13 bp, Homo sapiens
gtgtggctgtctg

SEQ ID NO: 2713563 - DNA, 17 bp, Homo sapiens
gtgtgtaccacaccctg

SEQ ID NO: 2713564 - DNA, 12 bp, Homo sapiens
gtgtgtctctga

SEQ ID NO: 2713565 - DNA, 15 bp, Homo sapiens
gtgttaggcctggca

SEQ ID NO: 2713566 - DNA, 21 bp, Homo sapiens
gtgttaggcctggcacagtgt

SEQ ID NO: 2713567 - DNA, 16 bp, Homo sapiens
gtgttccccagctgat

SEQ ID NO: 2713568 - DNA, 15 bp, Homo sapiens
gtgttgatcccaaga

SEQ ID NO: 2713569 - DNA, 16 bp, Homo sapiens
gtgttggctttacaaa

SEQ ID NO: 2713570 - DNA, 16 bp, Homo sapiens
gttaacacgtgacact

SEQ ID NO: 2713571 - DNA, 22 bp, Homo sapiens
ggtgcgaccccatctgcccagg

SEQ ID NO: 2713572 - DNA, 15 bp, Homo sapiens
ggtggacagtcctgg

SEQ ID NO: 2713573 - DNA, 16 bp, Homo sapiens
ggtggacagtcctggg

SEQ ID NO: 2713574 - DNA, 14 bp, Homo sapiens
ggtggatggtgact

SEQ ID NO: 2713575 - DNA, 19 bp, Homo sapiens
ggtggcgggcacctatagt

SEQ ID NO: 2713576 - DNA, 16 bp, Homo sapiens
ggtgggagagcccagc

SEQ ID NO: 2713577 - DNA, 23 bp, Homo sapiens
ggtgggcggatcacttgaggtcg

SEQ ID NO: 2713578 - DNA, 15 bp, Homo sapiens
ggtggtaccaggtct

SEQ ID NO: 2713579 - DNA, 16 bp, Homo sapiens
ggtggtaccaggtctc

SEQ ID NO: 2713580 - DNA, 22 bp, Homo sapiens
ggtggtaccaggtctcctccac

SEQ ID NO: 2713581 - DNA, 15 bp, Homo sapiens
ggtgtcgcgccttct

SEQ ID NO: 2713582 - DNA, 21 bp, Homo sapiens
ggtgtcgcgccttctcccccc

SEQ ID NO: 2713583 - DNA, 14 bp, Homo sapiens
ggtgtgtgtagcca

SEQ ID NO: 2713584 - DNA, 16 bp, Homo sapiens
ggtgtgtgtctctgac

SEQ ID NO: 2713585 - DNA, 22 bp, Homo sapiens
ggttaccaaaaatatccctttt

SEQ ID NO: 2713586 - DNA, 20 bp, Homo sapiens
ggttaggagttcgagaccag

SEQ ID NO: 2713587 - DNA, 14 bp, Homo sapiens
ggttatgatggaaa

SEQ ID NO: 2713588 - DNA, 13 bp, Homo sapiens
ggttcaccttgcc

SEQ ID NO: 2713589 - DNA, 16 bp, Homo sapiens
ggttcctaagcctgtt

SEQ ID NO: 2713590 - DNA, 17 bp, Homo sapiens
ggttctgcactcctgga

SEQ ID NO: 2713591 - DNA, 15 bp, Homo sapiens
ggttgaaagacatca

SEQ ID NO: 2713592 - DNA, 16 bp, Homo sapiens
ggttgaaagacatcaa

SEQ ID NO: 2713593 - DNA, 21 bp, Homo sapiens
cttctcccggacctggactag

SEQ ID NO: 2713594 - DNA, 20 bp, Homo sapiens
cttctccttagaagtggaag

SEQ ID NO: 2713595 - DNA, 14 bp, Homo sapiens
cttctcgacttcag

SEQ ID NO: 2713596 - DNA, 21 bp, Homo sapiens
cttctctcccacgtgcacagc

SEQ ID NO: 2713597 - DNA, 16 bp, Homo sapiens
cttctgccacttccca

SEQ ID NO: 2713598 - DNA, 17 bp, Homo sapiens
cttctgccacttcccag

SEQ ID NO: 2713599 - DNA, 12 bp, Homo sapiens
cttctgcctcag

SEQ ID NO: 2713600 - DNA, 11 bp, Homo sapiens
cttctgctggg

SEQ ID NO: 2713601 - DNA, 15 bp, Homo sapiens
cttctgctgggctgg

SEQ ID NO: 2713602 - DNA, 16 bp, Homo sapiens
cttctgcttcatcctg

SEQ ID NO: 2713603 - DNA, 14 bp, Homo sapiens
cttctggagccctt

SEQ ID NO: 2713604 - DNA, 15 bp, Homo sapiens
cttctggctttgttc

SEQ ID NO: 2713605 - DNA, 12 bp, Homo sapiens
cttcttgtaata

SEQ ID NO: 2713606 - DNA, 20 bp, Homo sapiens
cttcttgtaatatttcttca

SEQ ID NO: 2713607 - DNA, 13 bp, Homo sapiens
cttgaagccactg

SEQ ID NO: 2713608 - DNA, 16 bp, Homo sapiens
cttgaagccactgaag

SEQ ID NO: 2713609 - DNA, 17 bp, Homo sapiens
cttgacctgaactctgc

SEQ ID NO: 2713610 - DNA, 12 bp, Homo sapiens
cttgagcttggc

SEQ ID NO: 2713611 - DNA, 17 bp, Homo sapiens
cttgaggattttgagta

SEQ ID NO: 2713612 - DNA, 14 bp, Homo sapiens
cttgatatttcctt

SEQ ID NO: 2713613 - DNA, 13 bp, Homo sapiens
cttgatctcctga

SEQ ID NO: 2713614 - DNA, 15 bp, Homo sapiens
cttgatctcctgagc

SEQ ID NO: 2713615 - DNA, 24 bp, Homo sapiens
cttgatggctcagagagcatcttt

SEQ ID NO: 2713616 - DNA, 18 bp, Homo sapiens
cttgcccggattctggga

SEQ ID NO: 2713617 - DNA, 13 bp, Homo sapiens
cttgcccttcctg

SEQ ID NO: 2713618 - DNA, 15 bp, Homo sapiens
cttgcctcggctcct

SEQ ID NO: 2713619 - DNA, 16 bp, Homo sapiens
cttgcctcggctcctg

SEQ ID NO: 2713620 - DNA, 17 bp, Homo sapiens
cttgcctcggctcctgc

SEQ ID NO: 2713621 - DNA, 19 bp, Homo sapiens
cttgcctcggctcctgctg

SEQ ID NO: 2713622 - DNA, 20 bp, Homo sapiens
cttgcctcggctcctgctgc

SEQ ID NO: 2713623 - DNA, 21 bp, Homo sapiens
cttgcctcggctcctgctgca

SEQ ID NO: 2713624 - DNA, 12 bp, Homo sapiens
cttgcctggggc

SEQ ID NO: 2713625 - DNA, 13 bp, Homo sapiens
cttgcctggggcc

SEQ ID NO: 2713626 - DNA, 18 bp, Homo sapiens
cttgctgtaactcagaca

SEQ ID NO: 2713627 - DNA, 20 bp, Homo sapiens
cttgctgtcctaggccacac

SEQ ID NO: 2713628 - DNA, 14 bp, Homo sapiens
cttggaaagaggtt

SEQ ID NO: 2713629 - DNA, 17 bp, Homo sapiens
cttggaaccacagtcat

SEQ ID NO: 2713630 - DNA, 17 bp, Homo sapiens
cttggagaactccgctg

SEQ ID NO: 2713631 - DNA, 14 bp, Homo sapiens
cttggagagcagct

SEQ ID NO: 2713632 - DNA, 16 bp, Homo sapiens
cttggagagcagctgg

SEQ ID NO: 2713633 - DNA, 15 bp, Homo sapiens
cttggccagagctga

SEQ ID NO: 2713634 - DNA, 22 bp, Homo sapiens
cttgggcctcatctgctcctag

SEQ ID NO: 2713635 - DNA, 23 bp, Homo sapiens
cttgggcctgacctccagtcctg

SEQ ID NO: 2713636 - DNA, 20 bp, Homo sapiens
cttggggttttcagtatgaa

SEQ ID NO: 2713637 - DNA, 12 bp, Homo sapiens
cttgggtctctg

SEQ ID NO: 2713638 - DNA, 14 bp, Homo sapiens
cttgggtctctgga

SEQ ID NO: 2713639 - DNA, 17 bp, Homo sapiens
cttggttcccttgtgtg

SEQ ID NO: 2713640 - DNA, 18 bp, Homo sapiens
cttggtttgcacataaaa

SEQ ID NO: 2713641 - DNA, 23 bp, Homo sapiens
cttgtcatcagtaagtataacaa

SEQ ID NO: 2713642 - DNA, 16 bp, Homo sapiens
cttgtccccagctcca

SEQ ID NO: 2713643 - DNA, 12 bp, Homo sapiens
cttgtccctggg

SEQ ID NO: 2713644 - DNA, 23 bp, Homo sapiens
cttgtccctggggcactccccca

SEQ ID NO: 2713645 - DNA, 20 bp, Homo sapiens
cttgtcctctcagagcctca

SEQ ID NO: 2713646 - DNA, 23 bp, Homo sapiens
cttgtccttttgtaccatggtgt

SEQ ID NO: 2713647 - DNA, 12 bp, Homo sapiens
cttgtgtcctga

SEQ ID NO: 2713648 - DNA, 18 bp, Homo sapiens
cttgtgtgtaccacaccc

SEQ ID NO: 2713649 - DNA, 23 bp, Homo sapiens
cttgtgtgtaccacaccctgcct

SEQ ID NO: 2713650 - DNA, 14 bp, Homo sapiens
cttgttcaacagtt

SEQ ID NO: 2713651 - DNA, 14 bp, Homo sapiens
cttgtttctttctg

SEQ ID NO: 2713652 - DNA, 19 bp, Homo sapiens
cttgttttaaaagggttca

SEQ ID NO: 2713653 - DNA, 21 bp, Homo sapiens
ctttaaaaaaaatagaagcta

SEQ ID NO: 2713654 - DNA, 15 bp, Homo sapiens
ctttaaaataaaata

SEQ ID NO: 2713655 - DNA, 23 bp, Homo sapiens
ctttaaaggtcgcacctccttgg

SEQ ID NO: 2713656 - DNA, 19 bp, Homo sapiens
ctttaacaggttttcttct

SEQ ID NO: 2713657 - DNA, 18 bp, Homo sapiens
ctttaatttttataaata

SEQ ID NO: 2713658 - DNA, 13 bp, Homo sapiens
ctttacaaataat

SEQ ID NO: 2713659 - DNA, 19 bp, Homo sapiens
ctttaggcagcctgccgcc

SEQ ID NO: 2713660 - DNA, 20 bp, Homo sapiens
ctttaggcagcctgccgccg

SEQ ID NO: 2713661 - DNA, 22 bp, Homo sapiens
ctttataagccaatgaagcaaa

SEQ ID NO: 2713662 - DNA, 22 bp, Homo sapiens
ctttatcaggggacaaaccagg

SEQ ID NO: 2713663 - DNA, 14 bp, Homo sapiens
ctttatcccctcct

SEQ ID NO: 2713664 - DNA, 13 bp, Homo sapiens
ctttatctcctgg

SEQ ID NO: 2713665 - DNA, 13 bp, Homo sapiens
ctttatgcaaaaa

SEQ ID NO: 2713666 - DNA, 17 bp, Homo sapiens
ctttatgcaaaaacata

SEQ ID NO: 2713667 - DNA, 20 bp, Homo sapiens
ctttcagggaatttcaggaa

SEQ ID NO: 2713668 - DNA, 13 bp, Homo sapiens
ctttcatacatta

SEQ ID NO: 2713669 - DNA, 14 bp, Homo sapiens
ctttcatacattat

SEQ ID NO: 2713670 - DNA, 13 bp, Homo sapiens
ctttcatttgaaa

SEQ ID NO: 2713671 - DNA, 17 bp, Homo sapiens
ctttccaaaacatttct

SEQ ID NO: 2713672 - DNA, 15 bp, Homo sapiens
ctttccaacacacaa

SEQ ID NO: 2713673 - DNA, 21 bp, Homo sapiens
ctttcccatttcgtgtaatat

SEQ ID NO: 2713674 - DNA, 18 bp, Homo sapiens
ctttcctaaagtctctgc

SEQ ID NO: 2713675 - DNA, 20 bp, Homo sapiens
ctttcctaaagtctctgctg

SEQ ID NO: 2713676 - DNA, 21 bp, Homo sapiens
ctttcctaaagtctctgctgc

SEQ ID NO: 2713677 - DNA, 23 bp, Homo sapiens
ctttcctgaagtgtcgagtccag

SEQ ID NO: 2713678 - DNA, 15 bp, Homo sapiens
ctttctgtgtgcaca

SEQ ID NO: 2713679 - DNA, 16 bp, Homo sapiens
ctttctgtgtgcacag

SEQ ID NO: 2713680 - DNA, 16 bp, Homo sapiens
ctttcttctttccaga

SEQ ID NO: 2713681 - DNA, 17 bp, Homo sapiens
ctttcttggtgcattcg

SEQ ID NO: 2713682 - DNA, 21 bp, Homo sapiens
ctttctttccaaaacatttct

SEQ ID NO: 2713683 - DNA, 17 bp, Homo sapiens
ctttcttttctctatga

SEQ ID NO: 2713684 - DNA, 23 bp, Homo sapiens
ctttgaaggtaataaatacacag

SEQ ID NO: 2713685 - DNA, 19 bp, Homo sapiens
gggcatgtattagccagtc

SEQ ID NO: 2713686 - DNA, 15 bp, Homo sapiens
gggcatttggtgaga

SEQ ID NO: 2713687 - DNA, 19 bp, Homo sapiens
gggcatttggtgagagtca

SEQ ID NO: 2713688 - DNA, 16 bp, Homo sapiens
gggccagatgctgggc

SEQ ID NO: 2713689 - DNA, 17 bp, Homo sapiens
gggccagcaggcagcgc

SEQ ID NO: 2713690 - DNA, 18 bp, Homo sapiens
gggccagcaggcagcgcc

SEQ ID NO: 2713691 - DNA, 17 bp, Homo sapiens
gggccatactggcctcg

SEQ ID NO: 2713692 - DNA, 16 bp, Homo sapiens
gggcccaacaggccct

SEQ ID NO: 2713693 - DNA, 15 bp, Homo sapiens
gggcccacagccccc

SEQ ID NO: 2713694 - DNA, 17 bp, Homo sapiens
gggcccacagcccccac

SEQ ID NO: 2713695 - DNA, 18 bp, Homo sapiens
gggcccacagcccccacc

SEQ ID NO: 2713696 - DNA, 16 bp, Homo sapiens
gggcccctcaggggaa

SEQ ID NO: 2713697 - DNA, 21 bp, Homo sapiens
gggcccgcttgcctcggctcc

SEQ ID NO: 2713698 - DNA, 22 bp, Homo sapiens
gggcccgttgtctccctggccc

SEQ ID NO: 2713699 - DNA, 15 bp, Homo sapiens
gggccgagccacctc

SEQ ID NO: 2713700 - DNA, 14 bp, Homo sapiens
gggccggccaggtg

SEQ ID NO: 2713701 - DNA, 15 bp, Homo sapiens
gggccggccaggtgg

SEQ ID NO: 2713702 - DNA, 18 bp, Homo sapiens
gggcctatcagtgtgccc

SEQ ID NO: 2713703 - DNA, 23 bp, Homo sapiens
gggcctatcagtgtgccccccat

SEQ ID NO: 2713704 - DNA, 21 bp, Homo sapiens
gggcctcctctccctgcacct

SEQ ID NO: 2713705 - DNA, 16 bp, Homo sapiens
gggcctgatggggagg

SEQ ID NO: 2713706 - DNA, 12 bp, Homo sapiens
gggcctgctgcg

SEQ ID NO: 2713707 - DNA, 17 bp, Homo sapiens
gggcctgctgcgtcaga

SEQ ID NO: 2713708 - DNA, 20 bp, Homo sapiens
gggcctgctgcgtcagacca

SEQ ID NO: 2713709 - DNA, 15 bp, Homo sapiens
gggcgggagtggggg

SEQ ID NO: 2713710 - DNA, 20 bp, Homo sapiens
gggcgggcagcacagcaagg

SEQ ID NO: 2713711 - DNA, 18 bp, Homo sapiens
gggctcagagctgctgag

SEQ ID NO: 2713712 - DNA, 20 bp, Homo sapiens
gctctatggattatccactg

SEQ ID NO: 2713713 - DNA, 13 bp, Homo sapiens
gctctccaccttg

SEQ ID NO: 2713714 - DNA, 20 bp, Homo sapiens
gctctgccccagctctggct

SEQ ID NO: 2713715 - DNA, 19 bp, Homo sapiens
gctctgcctctaactccct

SEQ ID NO: 2713716 - DNA, 23 bp, Homo sapiens
gctctgcctctaactccctcctc

SEQ ID NO: 2713717 - DNA, 15 bp, Homo sapiens
gctctgctggaagaa

SEQ ID NO: 2713718 - DNA, 19 bp, Homo sapiens
gctctgctggaagaactgc

SEQ ID NO: 2713719 - DNA, 17 bp, Homo sapiens
gctctgcttttcctgtc

SEQ ID NO: 2713720 - DNA, 17 bp, Homo sapiens
gctctggcctccaagtc

SEQ ID NO: 2713721 - DNA, 18 bp, Homo sapiens
gctctgtcaccctggcca

SEQ ID NO: 2713722 - DNA, 14 bp, Homo sapiens
gctctgtgggctgc

SEQ ID NO: 2713723 - DNA, 23 bp, Homo sapiens
gctctgtgggctgcactctgtgc

SEQ ID NO: 2713724 - DNA, 16 bp, Homo sapiens
gctcttaactgttgct

SEQ ID NO: 2713725 - DNA, 21 bp, Homo sapiens
gctcttatttttgtaccatat

SEQ ID NO: 2713726 - DNA, 19 bp, Homo sapiens
gctcttctgtatgtgacaa

SEQ ID NO: 2713727 - DNA, 13 bp, Homo sapiens
gctcttgggcctg

SEQ ID NO: 2713728 - DNA, 14 bp, Homo sapiens
gctcttgggcctga

SEQ ID NO: 2713729 - DNA, 20 bp, Homo sapiens
gctcttgggcctgacctcca

SEQ ID NO: 2713730 - DNA, 23 bp, Homo sapiens
gctcttgggcctgacctccagtc

SEQ ID NO: 2713731 - DNA, 18 bp, Homo sapiens
gctctttctgggccaagt

SEQ ID NO: 2713732 - DNA, 18 bp, Homo sapiens
gctgaacagtgctctgcc

SEQ ID NO: 2713733 - DNA, 15 bp, Homo sapiens
gctgaataaagggaa

SEQ ID NO: 2713734 - DNA, 14 bp, Homo sapiens
gctgacagagccag

SEQ ID NO: 2713735 - DNA, 12 bp, Homo sapiens
gctgacagtcct

SEQ ID NO: 2713736 - DNA, 14 bp, Homo sapiens
gctgacagtcctct

SEQ ID NO: 2713737 - DNA, 16 bp, Homo sapiens
gctgacagtcctctcc

SEQ ID NO: 2713738 - DNA, 13 bp, Homo sapiens
gctgagagctctc

SEQ ID NO: 2713739 - DNA, 16 bp, Homo sapiens
gctgaggcctcccttg

SEQ ID NO: 2713740 - DNA, 13 bp, Homo sapiens
gctgagggcatct

SEQ ID NO: 2713741 - DNA, 22 bp, Homo sapiens
gctgatgcattcccggtgcaga

SEQ ID NO: 2713742 - DNA, 23 bp, Homo sapiens
gctgatgcattcccggtgcagaa

SEQ ID NO: 2713743 - DNA, 14 bp, Homo sapiens
gctgatgctgggct

SEQ ID NO: 2713744 - DNA, 15 bp, Homo sapiens
gctgatgctgggctg

SEQ ID NO: 2713745 - DNA, 20 bp, Homo sapiens
gctgcaccaacccagccgct

SEQ ID NO: 2713746 - DNA, 23 bp, Homo sapiens
gctgcaccaacccagccgctgcc

SEQ ID NO: 2713747 - DNA, 17 bp, Homo sapiens
gctgcacctgccagcct

SEQ ID NO: 2713748 - DNA, 22 bp, Homo sapiens
gctgcacctgccagcctggctt

SEQ ID NO: 2713749 - DNA, 15 bp, Homo sapiens
gctgcacgtcaccct

SEQ ID NO: 2713750 - DNA, 20 bp, Homo sapiens
gctgcacgtcaccctcctga

SEQ ID NO: 2713751 - DNA, 22 bp, Homo sapiens
gctgcacgtcaccctcctgagc

SEQ ID NO: 2713752 - DNA, 18 bp, Homo sapiens
gctgcactctgtgcccat

SEQ ID NO: 2713753 - DNA, 15 bp, Homo sapiens
gctgcagaggggcag

SEQ ID NO: 2713754 - DNA, 22 bp, Homo sapiens
gctgcagaggggcaggccctgc

SEQ ID NO: 2713755 - DNA, 13 bp, Homo sapiens
gctgcagctttgg

SEQ ID NO: 2713756 - DNA, 14 bp, Homo sapiens
gctgccactctgct

SEQ ID NO: 2713757 - DNA, 15 bp, Homo sapiens
gctgccactctgctg

SEQ ID NO: 2713758 - DNA, 17 bp, Homo sapiens
ggcaacaggagagacag

SEQ ID NO: 2713759 - DNA, 20 bp, Homo sapiens
ggcaagcttgtgtgggccca

SEQ ID NO: 2713760 - DNA, 24 bp, Homo sapiens
ggcacaacgctctaccctgcagct

SEQ ID NO: 2713761 - DNA, 15 bp, Homo sapiens
ggcacagtgtctggg

SEQ ID NO: 2713762 - DNA, 23 bp, Homo sapiens
ggcacatctaaattgatcattca

SEQ ID NO: 2713763 - DNA, 14 bp, Homo sapiens
ggcacatggctggg

SEQ ID NO: 2713764 - DNA, 15 bp, Homo sapiens
ggcacatggctgggg

SEQ ID NO: 2713765 - DNA, 16 bp, Homo sapiens
ggcacatggctggggg

SEQ ID NO: 2713766 - DNA, 22 bp, Homo sapiens
ggcacatggctgggggagggac

SEQ ID NO: 2713767 - DNA, 23 bp, Homo sapiens
ggcaccactagggtcctggccct

SEQ ID NO: 2713768 - DNA, 16 bp, Homo sapiens
ggcacctgcaggttgg

SEQ ID NO: 2713769 - DNA, 14 bp, Homo sapiens
ggcacctgcctagc

SEQ ID NO: 2713770 - DNA, 21 bp, Homo sapiens
ggcacctgcctagctcttggg

SEQ ID NO: 2713771 - DNA, 12 bp, Homo sapiens
ggcacctgctgg

SEQ ID NO: 2713772 - DNA, 23 bp, Homo sapiens
ggcactaagtcatggtcctggct

SEQ ID NO: 2713773 - DNA, 16 bp, Homo sapiens
ggcactcccccaggat

SEQ ID NO: 2713774 - DNA, 16 bp, Homo sapiens
ggcactgctgggtggc

SEQ ID NO: 2713775 - DNA, 19 bp, Homo sapiens
ggcactgctgggtggccca

SEQ ID NO: 2713776 - DNA, 15 bp, Homo sapiens
ggcagaactgctggg

SEQ ID NO: 2713777 - DNA, 17 bp, Homo sapiens
ggcagaactgctggggc

SEQ ID NO: 2713778 - DNA, 19 bp, Homo sapiens
ggcagaactgctggggctg

SEQ ID NO: 2713779 - DNA, 20 bp, Homo sapiens
ggcagaactgctggggctgg

SEQ ID NO: 2713780 - DNA, 14 bp, Homo sapiens
ggcagatctttaaa

SEQ ID NO: 2713781 - DNA, 24 bp, Homo sapiens
ggcagatttactgtcccaggagca

SEQ ID NO: 2713782 - DNA, 15 bp, Homo sapiens
ggcagcaggtgctgc

SEQ ID NO: 2713783 - DNA, 14 bp, Homo sapiens
ggcagcctgccgcc

SEQ ID NO: 2713784 - DNA, 18 bp, Homo sapiens
ggcagcgcctgtcccctc

SEQ ID NO: 2713785 - DNA, 20 bp, Homo sapiens
ggcagcgcctgtcccctcac

SEQ ID NO: 2713786 - DNA, 23 bp, Homo sapiens
ggcagctccagctgttacctgag

SEQ ID NO: 2713787 - DNA, 12 bp, Homo sapiens
ggcagctgggcc

SEQ ID NO: 2713788 - DNA, 18 bp, Homo sapiens
ggcagctgggcccacagc

SEQ ID NO: 2713789 - DNA, 19 bp, Homo sapiens
ggcagctgggcccacagcc

SEQ ID NO: 2713790 - DNA, 18 bp, Homo sapiens
ggcaggagtcaccatgca

SEQ ID NO: 2713791 - DNA, 19 bp, Homo sapiens
ggcaggagtcaccatgcaa

SEQ ID NO: 2713792 - DNA, 16 bp, Homo sapiens
ggcaggatatccccag

SEQ ID NO: 2713793 - DNA, 16 bp, Homo sapiens
ggcaggcacagcacag

SEQ ID NO: 2713794 - DNA, 19 bp, Homo sapiens
ggcaggccctgcactgtcc

SEQ ID NO: 2713795 - DNA, 21 bp, Homo sapiens
ggcaggccctgcactgtcctg

SEQ ID NO: 2713796 - DNA, 23 bp, Homo sapiens
ggcagtgggtcccacttcccctc

SEQ ID NO: 2713797 - DNA, 16 bp, Homo sapiens
ggcagttctgtgtcct

SEQ ID NO: 2713798 - DNA, 14 bp, Homo sapiens
ggcatcacagggca

SEQ ID NO: 2713799 - DNA, 13 bp, Homo sapiens
ggcatcctggctg

SEQ ID NO: 2713800 - DNA, 15 bp, Homo sapiens
ggcatcctggctggc

SEQ ID NO: 2713801 - DNA, 19 bp, Homo sapiens
ggcatctccctgaccttct

SEQ ID NO: 2713802 - DNA, 19 bp, Homo sapiens
ggcatgatgggccgagcca

SEQ ID NO: 2713803 - DNA, 12 bp, Homo sapiens
ggcatgctgggg

SEQ ID NO: 2713804 - DNA, 20 bp, Homo sapiens
ggcatgtattagccagtcat

SEQ ID NO: 2713805 - DNA, 18 bp, Homo sapiens
ggcatgtgggttgtgata

SEQ ID NO: 2713806 - DNA, 15 bp, Homo sapiens
ggcattaatattctt

SEQ ID NO: 2713807 - DNA, 13 bp, Homo sapiens
ggcattcctgctt

SEQ ID NO: 2713808 - DNA, 17 bp, Homo sapiens
ggcattttgaatgtgat

SEQ ID NO: 2713809 - DNA, 11 bp, Homo sapiens
ggccacactgg

SEQ ID NO: 2713810 - DNA, 14 bp, Homo sapiens
ggccacactgggct

SEQ ID NO: 2713811 - DNA, 14 bp, Homo sapiens
ggccacagaaaggc

SEQ ID NO: 2713812 - DNA, 19 bp, Homo sapiens
ggccacgtctgtgctctgt

SEQ ID NO: 2713813 - DNA, 22 bp, Homo sapiens
ggccactccccagtgctcctgt

SEQ ID NO: 2713814 - DNA, 18 bp, Homo sapiens
ggccagagctgagtggca

SEQ ID NO: 2713815 - DNA, 19 bp, Homo sapiens
ggccagcaggcagcgcctg

SEQ ID NO: 2713816 - DNA, 15 bp, Homo sapiens
ggccagccccacagc

SEQ ID NO: 2713817 - DNA, 19 bp, Homo sapiens
ggccagccccacagcccac

SEQ ID NO: 2713818 - DNA, 10 bp, Homo sapiens
ggccagggcc

SEQ ID NO: 2713819 - DNA, 13 bp, Homo sapiens
ggccagggccctg

SEQ ID NO: 2713820 - DNA, 16 bp, Homo sapiens
ggccagggccctgcag

SEQ ID NO: 2713821 - DNA, 18 bp, Homo sapiens
ggccagggccctgcagag

SEQ ID NO: 2713822 - DNA, 16 bp, Homo sapiens
ggccagtcctagagct

SEQ ID NO: 2713823 - DNA, 17 bp, Homo sapiens
ggccagtcctagagctc

SEQ ID NO: 2713824 - DNA, 19 bp, Homo sapiens
ggccagtgtgatcccaagt

SEQ ID NO: 2713825 - DNA, 16 bp, Homo sapiens
ggccatactggcctcg

SEQ ID NO: 2713826 - DNA, 22 bp, Homo sapiens
ggccatactggcctcgcctggc

SEQ ID NO: 2713827 - DNA, 23 bp, Homo sapiens
ggccatactggcctcgcctggcc

SEQ ID NO: 2713828 - DNA, 22 bp, Homo sapiens
ggccatcttccaggtggggtga

SEQ ID NO: 2713829 - DNA, 15 bp, Homo sapiens
ggccatgggtcctcg

SEQ ID NO: 2713830 - DNA, 22 bp, Homo sapiens
ggccatgggtcctcggcccatc

SEQ ID NO: 2713831 - DNA, 12 bp, Homo sapiens
ggcccacagccc

SEQ ID NO: 2713832 - DNA, 13 bp, Homo sapiens
ggcccacagcccc

SEQ ID NO: 2713833 - DNA, 15 bp, Homo sapiens
ggcccacagccccca

SEQ ID NO: 2713834 - DNA, 12 bp, Homo sapiens
ggcccacagctc

SEQ ID NO: 2713835 - DNA, 15 bp, Homo sapiens
ggcccacagctctgc

SEQ ID NO: 2713836 - DNA, 18 bp, Homo sapiens
ggcccacagctctgctgg

SEQ ID NO: 2713837 - DNA, 19 bp, Homo sapiens
ggcccacagctctgctgga

SEQ ID NO: 2713838 - DNA, 22 bp, Homo sapiens
ggcccacagctctgctggaaga

SEQ ID NO: 2713839 - DNA, 22 bp, Homo sapiens
ggcccagcctgtcctggtacag

SEQ ID NO: 2713840 - DNA, 12 bp, Homo sapiens
ggcccagctccc

SEQ ID NO: 2713841 - DNA, 18 bp, Homo sapiens
ggccccagcctggcccag

SEQ ID NO: 2713842 - DNA, 21 bp, Homo sapiens
ggcccgttgtctccctggccc

SEQ ID NO: 2713843 - DNA, 24 bp, Homo sapiens
ggcccgttgtctccctggccctca

SEQ ID NO: 2713844 - DNA, 16 bp, Homo sapiens
ggccctcaaggcctcc

SEQ ID NO: 2713845 - DNA, 19 bp, Homo sapiens
ggccctcttcttattcatg

SEQ ID NO: 2713846 - DNA, 19 bp, Homo sapiens
ggccctgcactgtcctgct

SEQ ID NO: 2713847 - DNA, 13 bp, Homo sapiens
ggccctgcccctc

SEQ ID NO: 2713848 - DNA, 16 bp, Homo sapiens
gccccgggctgaccca

SEQ ID NO: 2713849 - DNA, 18 bp, Homo sapiens
gccccgggctgacccagt

SEQ ID NO: 2713850 - DNA, 14 bp, Homo sapiens
gcccctcaggggaa

SEQ ID NO: 2713851 - DNA, 17 bp, Homo sapiens
gcccctccccagccctt

SEQ ID NO: 2713852 - DNA, 16 bp, Homo sapiens
gcccctccccctaccg

SEQ ID NO: 2713853 - DNA, 17 bp, Homo sapiens
gcccctccctagatcca

SEQ ID NO: 2713854 - DNA, 23 bp, Homo sapiens
gcccctccctagatccaggcttc

SEQ ID NO: 2713855 - DNA, 15 bp, Homo sapiens
gccccttctccagca

SEQ ID NO: 2713856 - DNA, 17 bp, Homo sapiens
gccccttctccagcaag

SEQ ID NO: 2713857 - DNA, 20 bp, Homo sapiens
gccccttgtcctctcagagc

SEQ ID NO: 2713858 - DNA, 14 bp, Homo sapiens
gcccgaccccatct

SEQ ID NO: 2713859 - DNA, 19 bp, Homo sapiens
gcccgaccccatctcattc

SEQ ID NO: 2713860 - DNA, 12 bp, Homo sapiens
gcccgcagagcc

SEQ ID NO: 2713861 - DNA, 15 bp, Homo sapiens
gcccgcggggagaga

SEQ ID NO: 2713862 - DNA, 22 bp, Homo sapiens
gcccgcggggagagaggaggag

SEQ ID NO: 2713863 - DNA, 14 bp, Homo sapiens
gcccgcttgcctcg

SEQ ID NO: 2713864 - DNA, 23 bp, Homo sapiens
gcccgcttgcctcggctcctgct

SEQ ID NO: 2713865 - DNA, 15 bp, Homo sapiens
gcccggattctggga

SEQ ID NO: 2713866 - DNA, 20 bp, Homo sapiens
gcccggcgccctctgtcctg

SEQ ID NO: 2713867 - DNA, 21 bp, Homo sapiens
gcccgtgggggcaggggacct

SEQ ID NO: 2713868 - DNA, 14 bp, Homo sapiens
gccctaagaacttt

SEQ ID NO: 2713869 - DNA, 15 bp, Homo sapiens
gccctacctgcctgt

SEQ ID NO: 2713870 - DNA, 22 bp, Homo sapiens
gccctacctgcctgttctccag

SEQ ID NO: 2713871 - DNA, 17 bp, Homo sapiens
gccctcaaggcctccca

SEQ ID NO: 2713872 - DNA, 22 bp, Homo sapiens
gccctcaaggcctcccacagtg

SEQ ID NO: 2713873 - DNA, 14 bp, Homo sapiens
gccctctggacagc

SEQ ID NO: 2713874 - DNA, 12 bp, Homo sapiens
gccctctgtcct

SEQ ID NO: 2713875 - DNA, 15 bp, Homo sapiens
gccctctgtcctgac

SEQ ID NO: 2713876 - DNA, 14 bp, Homo sapiens
gccctgcactgtcc

SEQ ID NO: 2713877 - DNA, 17 bp, Homo sapiens
gccctgcactgtcctgc

SEQ ID NO: 2713878 - DNA, 18 bp, Homo sapiens
gccctgcactgtcctgct

SEQ ID NO: 2713879 - DNA, 20 bp, Homo sapiens
gccctgcactgtcctgctcc

SEQ ID NO: 2713880 - DNA, 13 bp, Homo sapiens
gccctgcagaggg

SEQ ID NO: 2713881 - DNA, 12 bp, Homo sapiens
gccctgcccctc

SEQ ID NO: 2713882 - DNA, 17 bp, Homo sapiens
gccctgcccctccctag

SEQ ID NO: 2713883 - DNA, 23 bp, Homo sapiens
gccctgcccctccctagatccag

SEQ ID NO: 2713884 - DNA, 22 bp, Homo sapiens
gccctgcgctaacactgtcctg

SEQ ID NO: 2713885 - DNA, 22 bp, Homo sapiens
gccctggaggctggatggctcc

SEQ ID NO: 2713886 - DNA, 13 bp, Homo sapiens
gccctggccaggg

SEQ ID NO: 2713887 - DNA, 18 bp, Homo sapiens
gccctggtccttccaggc

SEQ ID NO: 2713888 - DNA, 14 bp, Homo sapiens
gcccttcctgaccc

SEQ ID NO: 2713889 - DNA, 13 bp, Homo sapiens
gccgagagaggcg

SEQ ID NO: 2713890 - DNA, 22 bp, Homo sapiens
gccgagatcacgccactgcact

SEQ ID NO: 2713891 - DNA, 14 bp, Homo sapiens
gccgccgcctcgcc

SEQ ID NO: 2713892 - DNA, 16 bp, Homo sapiens
gccgcctcgcccaccg

SEQ ID NO: 2713893 - DNA, 17 bp, Homo sapiens
gccgcctcgcccaccgc

SEQ ID NO: 2713894 - DNA, 21 bp, Homo sapiens
gccgcggtaggtaagggccgc

SEQ ID NO: 2713895 - DNA, 23 bp, Homo sapiens
gccggaccgcgtagagagccggg

SEQ ID NO: 2713896 - DNA, 14 bp, Homo sapiens
gccgggaaagctgt

SEQ ID NO: 2713897 - DNA, 15 bp, Homo sapiens
gccggtaccagcctg

SEQ ID NO: 2713898 - DNA, 23 bp, Homo sapiens
gccgtattttacatgaagctgta

SEQ ID NO: 2713899 - DNA, 14 bp, Homo sapiens
gcctagctcttggg

SEQ ID NO: 2713900 - DNA, 17 bp, Homo sapiens
gcctagctcttgggcct

SEQ ID NO: 2713901 - DNA, 21 bp, Homo sapiens
gcctcacagatgctggcctct

SEQ ID NO: 2713902 - DNA, 22 bp, Homo sapiens
gcctcacagatgctggcctctt

SEQ ID NO: 2713903 - DNA, 19 bp, Homo sapiens
gcctcacctttcctgccgt

SEQ ID NO: 2713904 - DNA, 14 bp, Homo sapiens
gcctcagccagccc

SEQ ID NO: 2713905 - DNA, 16 bp, Homo sapiens
gcctcagccagccctg

SEQ ID NO: 2713906 - DNA, 14 bp, Homo sapiens
gcctcagcctccag

SEQ ID NO: 2713907 - DNA, 17 bp, Homo sapiens
gcctcagcctccaggca

SEQ ID NO: 2713908 - DNA, 17 bp, Homo sapiens
gcctcagcctcctgagt

SEQ ID NO: 2713909 - DNA, 12 bp, Homo sapiens
gcctcagcttct

SEQ ID NO: 2713910 - DNA, 16 bp, Homo sapiens
gcctcatcctcctcct

SEQ ID NO: 2713911 - DNA, 17 bp, Homo sapiens
gcctccaaatgccaact

SEQ ID NO: 2713912 - DNA, 22 bp, Homo sapiens
gcctccactcccacttccctga

SEQ ID NO: 2713913 - DNA, 22 bp, Homo sapiens
gcctccagactgcggagcagcc

SEQ ID NO: 2713914 - DNA, 15 bp, Homo sapiens
gcctccagtgctggc

SEQ ID NO: 2713915 - DNA, 16 bp, Homo sapiens
gcctccagtgctggct

SEQ ID NO: 2713916 - DNA, 20 bp, Homo sapiens
gcctccagtgctggctgctg

SEQ ID NO: 2713917 - DNA, 21 bp, Homo sapiens
gcctccagtgctggctgctgg

SEQ ID NO: 2713918 - DNA, 21 bp, Homo sapiens
gcctccagtgggaggacagag

SEQ ID NO: 2713919 - DNA, 17 bp, Homo sapiens
gattaacataaagaaaa

SEQ ID NO: 2713920 - DNA, 18 bp, Homo sapiens
gattatatatcataaagt

SEQ ID NO: 2713921 - DNA, 19 bp, Homo sapiens
gattatatatcataaagta

SEQ ID NO: 2713922 - DNA, 21 bp, Homo sapiens
gattatatatcataaagtatg

SEQ ID NO: 2713923 - DNA, 19 bp, Homo sapiens
gattatttaaacctgccct

SEQ ID NO: 2713924 - DNA, 17 bp, Homo sapiens
gattcctcccccagagc

SEQ ID NO: 2713925 - DNA, 16 bp, Homo sapiens
gattcctgctgcctgt

SEQ ID NO: 2713926 - DNA, 13 bp, Homo sapiens
gattcggctgtct

SEQ ID NO: 2713927 - DNA, 18 bp, Homo sapiens
gattctgttctacttgat

SEQ ID NO: 2713928 - DNA, 17 bp, Homo sapiens
gattctttaaggagata

SEQ ID NO: 2713929 - DNA, 16 bp, Homo sapiens
gattgaatttttaagc

SEQ ID NO: 2713930 - DNA, 20 bp, Homo sapiens
gattgaatttttaagcaaat

SEQ ID NO: 2713931 - DNA, 22 bp, Homo sapiens
gattgatcggagcctcctctct

SEQ ID NO: 2713932 - DNA, 18 bp, Homo sapiens
gattgctgataataaatt

SEQ ID NO: 2713933 - DNA, 13 bp, Homo sapiens
gattggcaggagg

SEQ ID NO: 2713934 - DNA, 14 bp, Homo sapiens
gattggcaggaggc

SEQ ID NO: 2713935 - DNA, 17 bp, Homo sapiens
gattggcaggaggcagg

SEQ ID NO: 2713936 - DNA, 20 bp, Homo sapiens
gattggcaggaggcaggata

SEQ ID NO: 2713937 - DNA, 15 bp, Homo sapiens
gattggccctgcccc

SEQ ID NO: 2713938 - DNA, 18 bp, Homo sapiens
gattggccctgcccctcc

SEQ ID NO: 2713939 - DNA, 20 bp, Homo sapiens
gattgggcagaatcctgggc

SEQ ID NO: 2713940 - DNA, 19 bp, Homo sapiens
gattgtgcaatagtcagag

SEQ ID NO: 2713941 - DNA, 13 bp, Homo sapiens
gattgttcatcat

SEQ ID NO: 2713942 - DNA, 22 bp, Homo sapiens
gattgttctgtccagtttccaa

SEQ ID NO: 2713943 - DNA, 15 bp, Homo sapiens
gattgtttgcacaga

SEQ ID NO: 2713944 - DNA, 19 bp, Homo sapiens
gattgtttgcacagagggc

SEQ ID NO: 2713945 - DNA, 17 bp, Homo sapiens
gatttactgtcccagga

SEQ ID NO: 2713946 - DNA, 16 bp, Homo sapiens
gatttagggaagcagg

SEQ ID NO: 2713947 - DNA, 21 bp, Homo sapiens
gatttcacaggtcttgcccaa

SEQ ID NO: 2713948 - DNA, 13 bp, Homo sapiens
gatttcatgcatt

SEQ ID NO: 2713949 - DNA, 22 bp, Homo sapiens
gatttcccgtggccccagcctg

SEQ ID NO: 2713950 - DNA, 14 bp, Homo sapiens
gatttgagaaattt

SEQ ID NO: 2713951 - DNA, 23 bp, Homo sapiens
gatttgaggagcagcttcagttg

SEQ ID NO: 2713952 - DNA, 22 bp, Homo sapiens
gattttaaagagtgaaaaatga

SEQ ID NO: 2713953 - DNA, 12 bp, Homo sapiens
gattttaccaaa

SEQ ID NO: 2713954 - DNA, 14 bp, Homo sapiens
gattttaccaaagc

SEQ ID NO: 2713955 - DNA, 14 bp, Homo sapiens
gattttcttttgtt

SEQ ID NO: 2713956 - DNA, 20 bp, Homo sapiens
gattttgatattttcacaga

SEQ ID NO: 2713957 - DNA, 14 bp, Homo sapiens
gatttttaaaaggt

SEQ ID NO: 2713958 - DNA, 21 bp, Homo sapiens
gatttttgctcttctgtatgt

SEQ ID NO: 2713959 - DNA, 20 bp, Homo sapiens
gcaaaaacatatgtctgtct

SEQ ID NO: 2713960 - DNA, 17 bp, Homo sapiens
gcaaagatctcagcagc

SEQ ID NO: 2713961 - DNA, 21 bp, Homo sapiens
gcaaagtctaaagtttacagt

SEQ ID NO: 2713962 - DNA, 18 bp, Homo sapiens
gcaacaaagacttgcttt

SEQ ID NO: 2713963 - DNA, 19 bp, Homo sapiens
gcaaccctcagctgcctca

SEQ ID NO: 2713964 - DNA, 17 bp, Homo sapiens
gcaactctccactccat

SEQ ID NO: 2713965 - DNA, 17 bp, Homo sapiens
gcaactgaatacttgaa

SEQ ID NO: 2713966 - DNA, 15 bp, Homo sapiens
gcaagactctgtctc

SEQ ID NO: 2713967 - DNA, 21 bp, Homo sapiens
gcaagactctgtctcaataaa

SEQ ID NO: 2713968 - DNA, 23 bp, Homo sapiens
gcaagactctgtctcaataaata

SEQ ID NO: 2713969 - DNA, 21 bp, Homo sapiens
gcaagacttcactgcagcctt

SEQ ID NO: 2713970 - DNA, 19 bp, Homo sapiens
gcaagcagtgccctctgga

SEQ ID NO: 2713971 - DNA, 16 bp, Homo sapiens
gcaagctctgcctccc

SEQ ID NO: 2713972 - DNA, 18 bp, Homo sapiens
gcaagcttgtgtgggccc

SEQ ID NO: 2713973 - DNA, 21 bp, Homo sapiens
gcaaggacaacctgcccctcc

SEQ ID NO: 2713974 - DNA, 17 bp, Homo sapiens
gaattcacaaacaaatg

SEQ ID NO: 2713975 - DNA, 14 bp, Homo sapiens
gaattctattttgc

SEQ ID NO: 2713976 - DNA, 15 bp, Homo sapiens
gaattggagaaaagc

SEQ ID NO: 2713977 - DNA, 17 bp, Homo sapiens
gaatttattattgttct

SEQ ID NO: 2713978 - DNA, 18 bp, Homo sapiens
gaattttggaaaaatgtc

SEQ ID NO: 2713979 - DNA, 21 bp, Homo sapiens
gaattttggaaaaatgtcact

SEQ ID NO: 2713980 - DNA, 21 bp, Homo sapiens
gaattttgtaaaaagaaattg

SEQ ID NO: 2713981 - DNA, 21 bp, Homo sapiens
gacaaaccaggggtaccaggc

SEQ ID NO: 2713982 - DNA, 22 bp, Homo sapiens
gacaaaccaggggtaccaggca

SEQ ID NO: 2713983 - DNA, 12 bp, Homo sapiens
gacaacattttt

SEQ ID NO: 2713984 - DNA, 22 bp, Homo sapiens
gacaacatttttgtacattatg

SEQ ID NO: 2713985 - DNA, 21 bp, Homo sapiens
gacactctagtgacttcctgg

SEQ ID NO: 2713986 - DNA, 22 bp, Homo sapiens
gacactctagtgacttcctggt

SEQ ID NO: 2713987 - DNA, 18 bp, Homo sapiens
gacagaaatgcaatctcc

SEQ ID NO: 2713988 - DNA, 14 bp, Homo sapiens
gacagaagcaggag

SEQ ID NO: 2713989 - DNA, 15 bp, Homo sapiens
gacagagccagaggc

SEQ ID NO: 2713990 - DNA, 16 bp, Homo sapiens
gacagagccagaggca

SEQ ID NO: 2713991 - DNA, 19 bp, Homo sapiens
gacagagttggtgttcata

SEQ ID NO: 2713992 - DNA, 14 bp, Homo sapiens
gacagcggggaagg

SEQ ID NO: 2713993 - DNA, 14 bp, Homo sapiens
gacaggacagtgct

SEQ ID NO: 2713994 - DNA, 22 bp, Homo sapiens
gacaggacagtgcttcagcctg

SEQ ID NO: 2713995 - DNA, 15 bp, Homo sapiens
gacagtcctctccac

SEQ ID NO: 2713996 - DNA, 24 bp, Homo sapiens
gacagtcctctccacctagtggct

SEQ ID NO: 2713997 - DNA, 14 bp, Homo sapiens
gacagtcctgggag

SEQ ID NO: 2713998 - DNA, 18 bp, Homo sapiens
gacagtcctgggagaacc

SEQ ID NO: 2713999 - DNA, 23 bp, Homo sapiens
gacagtcctgggagaacctcagg

SEQ ID NO: 2714000 - DNA, 16 bp, Homo sapiens
gacagtgcttcagcct

SEQ ID NO: 2714001 - DNA, 17 bp, Homo sapiens
gacagtgcttcagcctg

SEQ ID NO: 2714002 - DNA, 19 bp, Homo sapiens
gacagtgcttcagcctgag

SEQ ID NO: 2714003 - DNA, 20 bp, Homo sapiens
gacagtgcttcagcctgagg

SEQ ID NO: 2714004 - DNA, 13 bp, Homo sapiens
gacatcaatgaaa

SEQ ID NO: 2714005 - DNA, 22 bp, Homo sapiens
gacatcagaagtaactcccact

SEQ ID NO: 2714006 - DNA, 21 bp, Homo sapiens
gacatgatggagcgcacctgc

SEQ ID NO: 2714007 - DNA, 21 bp, Homo sapiens
gacatgtctttggcttcagaa

SEQ ID NO: 2714008 - DNA, 11 bp, Homo sapiens
gaccacagcaa

SEQ ID NO: 2714009 - DNA, 14 bp, Homo sapiens
gaccactgggcccc

SEQ ID NO: 2714010 - DNA, 17 bp, Homo sapiens
gaccactgggcccctca

SEQ ID NO: 2714011 - DNA, 17 bp, Homo sapiens
gaccactgggtgagaga

SEQ ID NO: 2714012 - DNA, 15 bp, Homo sapiens
gaccagtactgggaa

SEQ ID NO: 2714013 - DNA, 15 bp, Homo sapiens
gaccattgtcttcca

SEQ ID NO: 2714014 - DNA, 19 bp, Homo sapiens
gacccaccaaggtctcaca

SEQ ID NO: 2714015 - DNA, 20 bp, Homo sapiens
gacccagtgtgtgctcagca

SEQ ID NO: 2714016 - DNA, 17 bp, Homo sapiens
gacccggattggccctg

SEQ ID NO: 2714017 - DNA, 16 bp, Homo sapiens
gaccctcccagtgaga

SEQ ID NO: 2714018 - DNA, 21 bp, Homo sapiens
gaccctcctccactccacctc

SEQ ID NO: 2714019 - DNA, 19 bp, Homo sapiens
gaccctcctcctcccccag

SEQ ID NO: 2714020 - DNA, 19 bp, Homo sapiens
gaccctctatttacctgcg

SEQ ID NO: 2714021 - DNA, 20 bp, Homo sapiens
gaccctgcgaaggggccctg

SEQ ID NO: 2714022 - DNA, 21 bp, Homo sapiens
gaccctgcgaaggggccctgg

SEQ ID NO: 2714023 - DNA, 16 bp, Homo sapiens
gaccctggctctgcca

SEQ ID NO: 2714024 - DNA, 19 bp, Homo sapiens
gaccgccgcttccagcttc

SEQ ID NO: 2714025 - DNA, 16 bp, Homo sapiens
gaccgcgtagagagcc

SEQ ID NO: 2714026 - DNA, 20 bp, Homo sapiens
gaccgcgtagagagccgggc

SEQ ID NO: 2714027 - DNA, 16 bp, Homo sapiens
gacctccagtcctgct

SEQ ID NO: 2714028 - DNA, 17 bp, Homo sapiens
gacctccagtcctgctg

SEQ ID NO: 2714029 - DNA, 18 bp, Homo sapiens
gacctccagtcctgctgg

SEQ ID NO: 2714030 - DNA, 17 bp, Homo sapiens
gacctcctaacaagtag

SEQ ID NO: 2714031 - DNA, 22 bp, Homo sapiens
gacctctgaatgtcccagaggc

SEQ ID NO: 2714032 - DNA, 16 bp, Homo sapiens
gacctgaaggcatctg

SEQ ID NO: 2714033 - DNA, 22 bp, Homo sapiens
gacctgatcattacatggctgt

SEQ ID NO: 2714034 - DNA, 13 bp, Homo sapiens
gacctgcaggcca

SEQ ID NO: 2714035 - DNA, 17 bp, Homo sapiens
gacctggagctgccagc

SEQ ID NO: 2714036 - DNA, 20 bp, Homo sapiens
gacctggagctgccagcacc

SEQ ID NO: 2714037 - DNA, 17 bp, Homo sapiens
gacctggggtgggcaca

SEQ ID NO: 2714038 - DNA, 16 bp, Homo sapiens
gaccttacaaccacat

SEQ ID NO: 2714039 - DNA, 13 bp, Homo sapiens
gaccttgtgatct

SEQ ID NO: 2714040 - DNA, 16 bp, Homo sapiens
gacctttgcccacaca

SEQ ID NO: 2714041 - DNA, 24 bp, Homo sapiens
gacgctactaacctgacatcacca

SEQ ID NO: 2714042 - DNA, 22 bp, Homo sapiens
gacgctgtgattggcaggaggc

SEQ ID NO: 2714043 - DNA, 23 bp, Homo sapiens
gacggactcagactcctggcttc

SEQ ID NO: 2714044 - DNA, 19 bp, Homo sapiens
gacggtcctttaggcagcc

SEQ ID NO: 2714045 - DNA, 13 bp, Homo sapiens
gacgtgactcaga

SEQ ID NO: 2714046 - DNA, 14 bp, Homo sapiens
gacgtgactcagag

SEQ ID NO: 2714047 - DNA, 15 bp, Homo sapiens
gacgtgactcagagc

SEQ ID NO: 2714048 - DNA, 21 bp, Homo sapiens
gacgttcggggcatgctgggg

SEQ ID NO: 2714049 - DNA, 12 bp, Homo sapiens
gactagcaggca

SEQ ID NO: 2714050 - DNA, 13 bp, Homo sapiens
gactatttaagta

SEQ ID NO: 2714051 - DNA, 11 bp, Homo sapiens
gactcagagct

SEQ ID NO: 2714052 - DNA, 12 bp, Homo sapiens
gactccttagac

SEQ ID NO: 2714053 - DNA, 16 bp, Homo sapiens
gactcgggctcctgtg

SEQ ID NO: 2714054 - DNA, 18 bp, Homo sapiens
gactcgggctcctgtgcc

SEQ ID NO: 2714055 - DNA, 17 bp, Homo sapiens
gactctactcccagcgc

SEQ ID NO: 2714056 - DNA, 15 bp, Homo sapiens
gactctctgcctgct

SEQ ID NO: 2714057 - DNA, 21 bp, Homo sapiens
gactctctgcctgcttcctgg

SEQ ID NO: 2714058 - DNA, 13 bp, Homo sapiens
gactctctgtgac

SEQ ID NO: 2714059 - DNA, 14 bp, Homo sapiens
gactctctgtgacc

SEQ ID NO: 2714060 - DNA, 19 bp, Homo sapiens
gactctctgtgacctgccc

SEQ ID NO: 2714061 - DNA, 19 bp, Homo sapiens
gactctgaggctctttctg

SEQ ID NO: 2714062 - DNA, 21 bp, Homo sapiens
gactctgcagatagtgcctct

SEQ ID NO: 2714063 - DNA, 18 bp, Homo sapiens
gactctgtggggccttgg

SEQ ID NO: 2714064 - DNA, 14 bp, Homo sapiens
gactcttccaccag

SEQ ID NO: 2714065 - DNA, 18 bp, Homo sapiens
gactcttccaccagagca

SEQ ID NO: 2714066 - DNA, 19 bp, Homo sapiens
gactcttccaccagagcag

SEQ ID NO: 2714067 - DNA, 23 bp, Homo sapiens
gactcttccaccagagcaggggc

SEQ ID NO: 2714068 - DNA, 16 bp, Homo sapiens
gactcttcctgcaaag

SEQ ID NO: 2714069 - DNA, 21 bp, Homo sapiens
gactgcgggatggtcctgggg

SEQ ID NO: 2714070 - DNA, 16 bp, Homo sapiens
gactgctgacccacca

SEQ ID NO: 2714071 - DNA, 14 bp, Homo sapiens
gactgctgggactg

SEQ ID NO: 2714072 - DNA, 19 bp, Homo sapiens
gactgctgggactggccag

SEQ ID NO: 2714073 - DNA, 17 bp, Homo sapiens
gactggccgtggctcca

SEQ ID NO: 2714074 - DNA, 18 bp, Homo sapiens
gactggccgtggctccag

SEQ ID NO: 2714075 - DNA, 19 bp, Homo sapiens
gactggccgtggctccaga

SEQ ID NO: 2714076 - DNA, 17 bp, Homo sapiens
gactggctggctgcagt

SEQ ID NO: 2714077 - DNA, 18 bp, Homo sapiens
gactgggccatgggtcct

SEQ ID NO: 2714078 - DNA, 19 bp, Homo sapiens
gactgggccatgggtcctc

SEQ ID NO: 2714079 - DNA, 16 bp, Homo sapiens
gactggtaagtaactg

SEQ ID NO: 2714080 - DNA, 17 bp, Homo sapiens
gactgtcctcgcagaga

SEQ ID NO: 2714081 - DNA, 18 bp, Homo sapiens
gacttcactgcagccttt

SEQ ID NO: 2714082 - DNA, 22 bp, Homo sapiens
gacttcctggtgaggcccagcc

SEQ ID NO: 2714083 - DNA, 19 bp, Homo sapiens
gacttgaggattttgagta

SEQ ID NO: 2714084 - DNA, 23 bp, Homo sapiens
gacttgaggattttgagtatctc

SEQ ID NO: 2714085 - DNA, 18 bp, Homo sapiens
gacttgcctggggccaca

SEQ ID NO: 2714086 - DNA, 19 bp, Homo sapiens
gactttatgaataatttca

SEQ ID NO: 2714087 - DNA, 12 bp, Homo sapiens
gactttgttcac

SEQ ID NO: 2714088 - DNA, 16 bp, Homo sapiens
gacttttgaagaacaa

SEQ ID NO: 2714089 - DNA, 23 bp, Homo sapiens
gacttttgaagaacaaaaggctt

SEQ ID NO: 2714090 - DNA, 18 bp, Homo sapiens
gagaaaacttatttgagt

SEQ ID NO: 2714091 - DNA, 17 bp, Homo sapiens
gagaaaagcacaatcaa

SEQ ID NO: 2714092 - DNA, 15 bp, Homo sapiens
gagaaaatgcaggag

SEQ ID NO: 2714093 - DNA, 14 bp, Homo sapiens
gagaaattctgtgg

SEQ ID NO: 2714094 - DNA, 21 bp, Homo sapiens
gagaaattttactgacagaaa

SEQ ID NO: 2714095 - DNA, 23 bp, Homo sapiens
gagaaatttttttccagaattga

SEQ ID NO: 2714096 - DNA, 14 bp, Homo sapiens
gagaacctcaggct

SEQ ID NO: 2714097 - DNA, 20 bp, Homo sapiens
gagaaggcctcccctgagga

SEQ ID NO: 2714098 - DNA, 17 bp, Homo sapiens
gagaagggcctgctctg

SEQ ID NO: 2714099 - DNA, 18 bp, Homo sapiens
gagaagggcctgctctgc

SEQ ID NO: 2714100 - DNA, 21 bp, Homo sapiens
ctcctgctgcaccaacccagc

SEQ ID NO: 2714101 - DNA, 16 bp, Homo sapiens
ctcctgctgcagaggg

SEQ ID NO: 2714102 - DNA, 17 bp, Homo sapiens
ctcctggaaaggctcag

SEQ ID NO: 2714103 - DNA, 20 bp, Homo sapiens
ctcctggaaaggctcagtct

SEQ ID NO: 2714104 - DNA, 19 bp, Homo sapiens
ctcctggagcatcccaggc

SEQ ID NO: 2714105 - DNA, 11 bp, Homo sapiens
ctcctggcaca

SEQ ID NO: 2714106 - DNA, 15 bp, Homo sapiens
ctcctggcttcatgt

SEQ ID NO: 2714107 - DNA, 13 bp, Homo sapiens
ctcctgtccctac

SEQ ID NO: 2714108 - DNA, 16 bp, Homo sapiens
ctcctgtccctaccca

SEQ ID NO: 2714109 - DNA, 20 bp, Homo sapiens
ctcctgtccctacccactct

SEQ ID NO: 2714110 - DNA, 10 bp, Homo sapiens
ctccttcccc

SEQ ID NO: 2714111 - DNA, 18 bp, Homo sapiens
ctccttccccttgtccct

SEQ ID NO: 2714112 - DNA, 22 bp, Homo sapiens
ctccttcttaactctgcaggaa

SEQ ID NO: 2714113 - DNA, 16 bp, Homo sapiens
ctcctttttctacctt

SEQ ID NO: 2714114 - DNA, 13 bp, Homo sapiens
ctcgaactcctga

SEQ ID NO: 2714115 - DNA, 15 bp, Homo sapiens
ctcgaagaacaatgt

SEQ ID NO: 2714116 - DNA, 17 bp, Homo sapiens
ctcgagcatgccctgag

SEQ ID NO: 2714117 - DNA, 16 bp, Homo sapiens
ctcgaggtggagggta

SEQ ID NO: 2714118 - DNA, 17 bp, Homo sapiens
ctcgaggtttctcaaag

SEQ ID NO: 2714119 - DNA, 23 bp, Homo sapiens
ctcgcactgcccagggaagccct

SEQ ID NO: 2714120 - DNA, 14 bp, Homo sapiens
ctcgccccacccag

SEQ ID NO: 2714121 - DNA, 18 bp, Homo sapiens
ctcgccctggccagggcc

SEQ ID NO: 2714122 - DNA, 13 bp, Homo sapiens
ctcgcctctccca

SEQ ID NO: 2714123 - DNA, 17 bp, Homo sapiens
ctcgcctggcctgaggt

SEQ ID NO: 2714124 - DNA, 18 bp, Homo sapiens
ctcgctgatgctgggctg

SEQ ID NO: 2714125 - DNA, 21 bp, Homo sapiens
ctcgctgatgctgggctgggt

SEQ ID NO: 2714126 - DNA, 16 bp, Homo sapiens
ctcggaaggctggctg

SEQ ID NO: 2714127 - DNA, 17 bp, Homo sapiens
ctcggatcccactgatt

SEQ ID NO: 2714128 - DNA, 19 bp, Homo sapiens
ctcggcaccagtgcctcag

SEQ ID NO: 2714129 - DNA, 17 bp, Homo sapiens
ctcggcccatctgtcca

SEQ ID NO: 2714130 - DNA, 13 bp, Homo sapiens
ctcggcctccaga

SEQ ID NO: 2714131 - DNA, 18 bp, Homo sapiens
ctcggcctccagactgcg

SEQ ID NO: 2714132 - DNA, 12 bp, Homo sapiens
ctcggctcactg

SEQ ID NO: 2714133 - DNA, 13 bp, Homo sapiens
ctcggctcctgct

SEQ ID NO: 2714134 - DNA, 15 bp, Homo sapiens
ctcgggctcctgtgc

SEQ ID NO: 2714135 - DNA, 19 bp, Homo sapiens
ctcggtggtaccaggtctc

SEQ ID NO: 2714136 - DNA, 14 bp, Homo sapiens
ctcgtagccatctc

SEQ ID NO: 2714137 - DNA, 16 bp, Homo sapiens
ctcgtgatttgcctgc

SEQ ID NO: 2714138 - DNA, 21 bp, Homo sapiens
ctcgtgccagtcgcgctgcct

SEQ ID NO: 2714139 - DNA, 20 bp, Homo sapiens
ctcgtggtagaagccagtac

SEQ ID NO: 2714140 - DNA, 13 bp, Homo sapiens
ctctaactccctc

SEQ ID NO: 2714141 - DNA, 14 bp, Homo sapiens
ctctaactccctcc

SEQ ID NO: 2714142 - DNA, 15 bp, Homo sapiens
ctctaccctgcagct

SEQ ID NO: 2714143 - DNA, 15 bp, Homo sapiens
ctctagaacacccac

SEQ ID NO: 2714144 - DNA, 22 bp, Homo sapiens
ctctagaacacccactggccag

SEQ ID NO: 2714145 - DNA, 23 bp, Homo sapiens
ctctagaagcagaaccagctcta

SEQ ID NO: 2714146 - DNA, 22 bp, Homo sapiens
ctctatgtgggaaaaaagaaat

SEQ ID NO: 2714147 - DNA, 20 bp, Homo sapiens
ctctattaagatttccaagt

SEQ ID NO: 2714148 - DNA, 11 bp, Homo sapiens
ctctcacagat

SEQ ID NO: 2714149 - DNA, 23 bp, Homo sapiens
ctctccacctagtggctgtccag

SEQ ID NO: 2714150 - DNA, 16 bp, Homo sapiens
ctctccagcctcacag

SEQ ID NO: 2714151 - DNA, 15 bp, Homo sapiens
ctctccatgcaagtg

SEQ ID NO: 2714152 - DNA, 19 bp, Homo sapiens
ctctcggaaggctggctgg

SEQ ID NO: 2714153 - DNA, 12 bp, Homo sapiens
ctctctaacata

SEQ ID NO: 2714154 - DNA, 13 bp, Homo sapiens
ctctctgcctgct

SEQ ID NO: 2714155 - DNA, 13 bp, Homo sapiens
ctctctgctcagt

SEQ ID NO: 2714156 - DNA, 15 bp, Homo sapiens
ctctctgctcagtga

SEQ ID NO: 2714157 - DNA, 17 bp, Homo sapiens
ctctctgctcagtgatc

SEQ ID NO: 2714158 - DNA, 14 bp, Homo sapiens
ctctcttgccagca

SEQ ID NO: 2714159 - DNA, 19 bp, Homo sapiens
ctctgaatattaagaaaca

SEQ ID NO: 2714160 - DNA, 16 bp, Homo sapiens
ctctgaatgtcccaga

SEQ ID NO: 2714161 - DNA, 19 bp, Homo sapiens
ctctgaatgtcccagaggc

SEQ ID NO: 2714162 - DNA, 15 bp, Homo sapiens
ctctgacctgcaggc

SEQ ID NO: 2714163 - DNA, 16 bp, Homo sapiens
ctctgagatttcacag

SEQ ID NO: 2714164 - DNA, 12 bp, Homo sapiens
ctctgagccgca

SEQ ID NO: 2714165 - DNA, 15 bp, Homo sapiens
ctctgagtgtctctg

SEQ ID NO: 2714166 - DNA, 17 bp, Homo sapiens
ctctgagtgtctctgcc

SEQ ID NO: 2714167 - DNA, 13 bp, Homo sapiens
ctctgcaaagact

SEQ ID NO: 2714168 - DNA, 22 bp, Homo sapiens
ctctgcagatagtgcctctgca

SEQ ID NO: 2714169 - DNA, 12 bp, Homo sapiens
ctctgcaggaaa

SEQ ID NO: 2714170 - DNA, 14 bp, Homo sapiens
ctctgccagcgtcc

SEQ ID NO: 2714171 - DNA, 14 bp, Homo sapiens
ctctgcccagcctg

SEQ ID NO: 2714172 - DNA, 13 bp, Homo sapiens
ctctgccccagct

SEQ ID NO: 2714173 - DNA, 18 bp, Homo sapiens
ctctgccccagctctggc

SEQ ID NO: 2714174 - DNA, 19 bp, Homo sapiens
ctctgccccagctctggct

SEQ ID NO: 2714175 - DNA, 21 bp, Homo sapiens
ctctgccccagctctggcttc

SEQ ID NO: 2714176 - DNA, 10 bp, Homo sapiens
ctctgcctca

SEQ ID NO: 2714177 - DNA, 16 bp, Homo sapiens
ctctgcctcatcctcc

SEQ ID NO: 2714178 - DNA, 20 bp, Homo sapiens
ctctgcctcatcctcctcct

SEQ ID NO: 2714179 - DNA, 16 bp, Homo sapiens
ctctgcctctaactcc

SEQ ID NO: 2714180 - DNA, 19 bp, Homo sapiens
ctctgcctctaactccctc

SEQ ID NO: 2714181 - DNA, 21 bp, Homo sapiens
ctctgcctctaactccctcct

SEQ ID NO: 2714182 - DNA, 14 bp, Homo sapiens
ctctgcctgctggg

SEQ ID NO: 2714183 - DNA, 19 bp, Homo sapiens
ctctgcctgctgggctctt

SEQ ID NO: 2714184 - DNA, 13 bp, Homo sapiens
ctctgcctgcttc

SEQ ID NO: 2714185 - DNA, 19 bp, Homo sapiens
ctctgcctgcttcctggac

SEQ ID NO: 2714186 - DNA, 14 bp, Homo sapiens
ctctgcctggagca

SEQ ID NO: 2714187 - DNA, 17 bp, Homo sapiens
ctctgcctggagcaggg

SEQ ID NO: 2714188 - DNA, 19 bp, Homo sapiens
ctctgcgcctctccactgt

SEQ ID NO: 2714189 - DNA, 21 bp, Homo sapiens
ctctgctcagtgatctcactt

SEQ ID NO: 2714190 - DNA, 13 bp, Homo sapiens
ctctgctgccatg

SEQ ID NO: 2714191 - DNA, 16 bp, Homo sapiens
ctctgcttcctgagct

SEQ ID NO: 2714192 - DNA, 13 bp, Homo sapiens
ctctgcttggctt

SEQ ID NO: 2714193 - DNA, 13 bp, Homo sapiens
ctctggacagctt

SEQ ID NO: 2714194 - DNA, 14 bp, Homo sapiens
ctctggacagcttg

SEQ ID NO: 2714195 - DNA, 18 bp, Homo sapiens
ctctggacctctcttgtg

SEQ ID NO: 2714196 - DNA, 16 bp, Homo sapiens
ctctggattcctgtca

SEQ ID NO: 2714197 - DNA, 13 bp, Homo sapiens
ctctggctcagct

SEQ ID NO: 2714198 - DNA, 22 bp, Homo sapiens
ctctggctcagctgtggtccca

SEQ ID NO: 2714199 - DNA, 16 bp, Homo sapiens
ctctgtcaccctggcc

SEQ ID NO: 2714200 - DNA, 18 bp, Homo sapiens
ctctgtcaccctggccac

SEQ ID NO: 2714201 - DNA, 17 bp, Homo sapiens
ctctgtgcagacagtgt

SEQ ID NO: 2714202 - DNA, 16 bp, Homo sapiens
ctctgtgcccatgggc

SEQ ID NO: 2714203 - DNA, 22 bp, Homo sapiens
ctctgtgcccatgggcactgct

SEQ ID NO: 2714204 - DNA, 17 bp, Homo sapiens
ctctgtgggctgcactc

SEQ ID NO: 2714205 - DNA, 23 bp, Homo sapiens
ctctgtgggctgcactctgtgcc

SEQ ID NO: 2714206 - DNA, 13 bp, Homo sapiens
ctctgtgtcactg

SEQ ID NO: 2714207 - DNA, 18 bp, Homo sapiens
ctctgtgtcactggctgc

SEQ ID NO: 2714208 - DNA, 23 bp, Homo sapiens
ctctgtgtcactggctgcctcca

SEQ ID NO: 2714209 - DNA, 13 bp, Homo sapiens
ctctgttgtaaat

SEQ ID NO: 2714210 - DNA, 19 bp, Homo sapiens
ctctgttgtaaataaccac

SEQ ID NO: 2714211 - DNA, 14 bp, Homo sapiens
ctcttaaaaatctt

SEQ ID NO: 2714212 - DNA, 18 bp, Homo sapiens
ctcttagaagtgacattg

SEQ ID NO: 2714213 - DNA, 16 bp, Homo sapiens
ctcttccaccagagca

SEQ ID NO: 2714214 - DNA, 19 bp, Homo sapiens
ctcttcctttatcccctcc

SEQ ID NO: 2714215 - DNA, 14 bp, Homo sapiens
ctcttcggttgtct

SEQ ID NO: 2714216 - DNA, 15 bp, Homo sapiens
ctcttctcagagcag

SEQ ID NO: 2714217 - DNA, 22 bp, Homo sapiens
ctcttcttattcatgctttctc

SEQ ID NO: 2714218 - DNA, 18 bp, Homo sapiens
ctcttgccccaaatcaca

SEQ ID NO: 2714219 - DNA, 20 bp, Homo sapiens
ctcttgccccaacccccagc

SEQ ID NO: 2714220 - DNA, 15 bp, Homo sapiens
ggatcccctgtcccc

SEQ ID NO: 2714221 - DNA, 16 bp, Homo sapiens
ggatcccctgtcccct

SEQ ID NO: 2714222 - DNA, 15 bp, Homo sapiens
ggatcttttgtaaat

SEQ ID NO: 2714223 - DNA, 21 bp, Homo sapiens
ggatggtcttgatctcctgag

SEQ ID NO: 2714224 - DNA, 20 bp, Homo sapiens
ggatggtgacttttgaagaa

SEQ ID NO: 2714225 - DNA, 21 bp, Homo sapiens
ggatggtgacttttgaagaac

SEQ ID NO: 2714226 - DNA, 18 bp, Homo sapiens
ggatgtgtgtctcacccc

SEQ ID NO: 2714227 - DNA, 15 bp, Homo sapiens
ggattcccagagaga

SEQ ID NO: 2714228 - DNA, 13 bp, Homo sapiens
ggattctgggagg

SEQ ID NO: 2714229 - DNA, 19 bp, Homo sapiens
ggattctgggaggaagcag

SEQ ID NO: 2714230 - DNA, 20 bp, Homo sapiens
ggattgatcggagcctcctc

SEQ ID NO: 2714231 - DNA, 23 bp, Homo sapiens
ggattggcacaagctccctggtg

SEQ ID NO: 2714232 - DNA, 16 bp, Homo sapiens
ggattggccctgcccc

SEQ ID NO: 2714233 - DNA, 17 bp, Homo sapiens
ggatttcttattttctt

SEQ ID NO: 2714234 - DNA, 20 bp, Homo sapiens
ggcaaagaactgccccatct

SEQ ID NO: 2714235 - DNA, 23 bp, Homo sapiens
ggcaaagaactgccccatctcct

SEQ ID NO: 2714236 - DNA, 14 bp, Homo sapiens
ggcaaccctcagct

SEQ ID NO: 2714237 - DNA, 23 bp, Homo sapiens
ggcaagtccctgactctctgtga

SEQ ID NO: 2714238 - DNA, 15 bp, Homo sapiens
ggcacaaatgcacct

SEQ ID NO: 2714239 - DNA, 21 bp, Homo sapiens
ggcacaacgctctaccctgca

SEQ ID NO: 2714240 - DNA, 23 bp, Homo sapiens
ggcacaacgctctaccctgcagc

SEQ ID NO: 2714241 - DNA, 23 bp, Homo sapiens
ggcacaagctcaggtcctgctgc

SEQ ID NO: 2714242 - DNA, 19 bp, Homo sapiens
ggcacaagctccctggtga

SEQ ID NO: 2714243 - DNA, 20 bp, Homo sapiens
ggcacaagctccctggtgag

SEQ ID NO: 2714244 - DNA, 19 bp, Homo sapiens
ggcacagtgtctgggctga

SEQ ID NO: 2714245 - DNA, 22 bp, Homo sapiens
ggcacccccaaattcaaagaaa

SEQ ID NO: 2714246 - DNA, 23 bp, Homo sapiens
ggcaccctccaaacactgggctc

SEQ ID NO: 2714247 - DNA, 22 bp, Homo sapiens
ggcacctatagtcccagctact

SEQ ID NO: 2714248 - DNA, 13 bp, Homo sapiens
ggcacctgctgga

SEQ ID NO: 2714249 - DNA, 16 bp, Homo sapiens
ggcacgatctcagctc

SEQ ID NO: 2714250 - DNA, 15 bp, Homo sapiens
ggcacgtaatttttt

SEQ ID NO: 2714251 - DNA, 21 bp, Homo sapiens
ggcacgtcccatgtgcatgga

SEQ ID NO: 2714252 - DNA, 18 bp, Homo sapiens
ggcactaaaatgtttaat

SEQ ID NO: 2714253 - DNA, 20 bp, Homo sapiens
ggcactaaaatgtttaattc

SEQ ID NO: 2714254 - DNA, 19 bp, Homo sapiens
ggcactaagtcatggtcct

SEQ ID NO: 2714255 - DNA, 15 bp, Homo sapiens
ggcactgctgggtgg

SEQ ID NO: 2714256 - DNA, 14 bp, Homo sapiens
ggcagaactgctgg

SEQ ID NO: 2714257 - DNA, 14 bp, Homo sapiens
ggcagaatcctggg

SEQ ID NO: 2714258 - DNA, 18 bp, Homo sapiens
ggcagaatcctgggcccc

SEQ ID NO: 2714259 - DNA, 14 bp, Homo sapiens
ggcagatgggcctg

SEQ ID NO: 2714260 - DNA, 23 bp, Homo sapiens
ggcagatttactgtcccaggagc

SEQ ID NO: 2714261 - DNA, 11 bp, Homo sapiens
ggcagcctgcc

SEQ ID NO: 2714262 - DNA, 15 bp, Homo sapiens
ggcagcgcctgtccc

SEQ ID NO: 2714263 - DNA, 16 bp, Homo sapiens
ggcagcgcctgtcccc

SEQ ID NO: 2714264 - DNA, 21 bp, Homo sapiens
ggcagcgcctgtcccctcaca

SEQ ID NO: 2714265 - DNA, 23 bp, Homo sapiens
ggcagctgggcccacagccccca

SEQ ID NO: 2714266 - DNA, 13 bp, Homo sapiens
ggcagctgtagct

SEQ ID NO: 2714267 - DNA, 23 bp, Homo sapiens
ggcaggagtcaccatgcaagggt

SEQ ID NO: 2714268 - DNA, 15 bp, Homo sapiens
ggcaggatgaccctg

SEQ ID NO: 2714269 - DNA, 24 bp, Homo sapiens
ggcagtgaacacactcagcagccc

SEQ ID NO: 2714270 - DNA, 15 bp, Homo sapiens
ggcagtgtttgtata

SEQ ID NO: 2714271 - DNA, 14 bp, Homo sapiens
ggcagttctgtgtc

SEQ ID NO: 2714272 - DNA, 16 bp, Homo sapiens
ggcatcacagggcaga

SEQ ID NO: 2714273 - DNA, 17 bp, Homo sapiens
ggcatcacagggcagag

SEQ ID NO: 2714274 - DNA, 22 bp, Homo sapiens
ggcatcacagggcagagccggg

SEQ ID NO: 2714275 - DNA, 23 bp, Homo sapiens
ggcatctccctgaccttctccag

SEQ ID NO: 2714276 - DNA, 13 bp, Homo sapiens
ggcatctctgagt

SEQ ID NO: 2714277 - DNA, 23 bp, Homo sapiens
ggcatgacactctagtgacttcc

SEQ ID NO: 2714278 - DNA, 22 bp, Homo sapiens
ggcatgatgggccgagccacct

SEQ ID NO: 2714279 - DNA, 14 bp, Homo sapiens
ggcatgctggggca

SEQ ID NO: 2714280 - DNA, 16 bp, Homo sapiens
ggcatgctggggcaag

SEQ ID NO: 2714281 - DNA, 19 bp, Homo sapiens
ggcatgtgggttgtgatat

SEQ ID NO: 2714282 - DNA, 17 bp, Homo sapiens
ggcattctctctgctca

SEQ ID NO: 2714283 - DNA, 19 bp, Homo sapiens
ggcattctctctgctcagt

SEQ ID NO: 2714284 - DNA, 19 bp, Homo sapiens
ggcattggcagcaggtgct

SEQ ID NO: 2714285 - DNA, 15 bp, Homo sapiens
ggcctcccacagtga

SEQ ID NO: 2714286 - DNA, 23 bp, Homo sapiens
ggcctcccttgagtaggccctgc

SEQ ID NO: 2714287 - DNA, 15 bp, Homo sapiens
ggcctcgcctggcct

SEQ ID NO: 2714288 - DNA, 16 bp, Homo sapiens
ggcctcgcctggcctg

SEQ ID NO: 2714289 - DNA, 17 bp, Homo sapiens
ggcctcggaggctcctc

SEQ ID NO: 2714290 - DNA, 20 bp, Homo sapiens
ggcctcggaggctcctccct

SEQ ID NO: 2714291 - DNA, 13 bp, Homo sapiens
ggcctctagaaca

SEQ ID NO: 2714292 - DNA, 13 bp, Homo sapiens
ggcctcttggcac

SEQ ID NO: 2714293 - DNA, 16 bp, Homo sapiens
ggcctcttggcacctg

SEQ ID NO: 2714294 - DNA, 18 bp, Homo sapiens
ggcctcttggcacctgcc

SEQ ID NO: 2714295 - DNA, 19 bp, Homo sapiens
ggcctcttggcacctgcct

SEQ ID NO: 2714296 - DNA, 18 bp, Homo sapiens
ggcctgaggtctcgctga

SEQ ID NO: 2714297 - DNA, 22 bp, Homo sapiens
ggcctgaggtctcgctgatgct

SEQ ID NO: 2714298 - DNA, 12 bp, Homo sapiens
ggcctggcacag

SEQ ID NO: 2714299 - DNA, 22 bp, Homo sapiens
ggcctggcacagtgtctgggct

SEQ ID NO: 2714300 - DNA, 14 bp, Homo sapiens
ggccttaataaata

SEQ ID NO: 2714301 - DNA, 20 bp, Homo sapiens
ggccttggtcccagacagct

SEQ ID NO: 2714302 - DNA, 19 bp, Homo sapiens
ggccttgtccccagctcca

SEQ ID NO: 2714303 - DNA, 13 bp, Homo sapiens
ggcgacagagcaa

SEQ ID NO: 2714304 - DNA, 14 bp, Homo sapiens
ggcgacagagcaag

SEQ ID NO: 2714305 - DNA, 14 bp, Homo sapiens
ggcgccctctgtcc

SEQ ID NO: 2714306 - DNA, 17 bp, Homo sapiens
ggcgccctctgtcctga

SEQ ID NO: 2714307 - DNA, 15 bp, Homo sapiens
ggcgggagtgggggc

SEQ ID NO: 2714308 - DNA, 21 bp, Homo sapiens
ggcgggggagccaacagcagc

SEQ ID NO: 2714309 - DNA, 20 bp, Homo sapiens
ggcgtgtgttccccagctga

SEQ ID NO: 2714310 - DNA, 11 bp, Homo sapiens
ggcgtttcttt

SEQ ID NO: 2714311 - DNA, 17 bp, Homo sapiens
ggctacaaaccaggagc

SEQ ID NO: 2714312 - DNA, 20 bp, Homo sapiens
ggctagtctcttctcagagc

SEQ ID NO: 2714313 - DNA, 17 bp, Homo sapiens
ggctcagagctgctgag

SEQ ID NO: 2714314 - DNA, 18 bp, Homo sapiens
ggctcagagctgctgagc

SEQ ID NO: 2714315 - DNA, 19 bp, Homo sapiens
ggctcagagctgctgagca

SEQ ID NO: 2714316 - DNA, 17 bp, Homo sapiens
ggctcagatcctgggca

SEQ ID NO: 2714317 - DNA, 20 bp, Homo sapiens
ggctcagctgtggtcccacc

SEQ ID NO: 2714318 - DNA, 16 bp, Homo sapiens
ggctcagggaccacag

SEQ ID NO: 2714319 - DNA, 18 bp, Homo sapiens
ggctcagggaccacagca

SEQ ID NO: 2714320 - DNA, 17 bp, Homo sapiens
ggctccagaatgtgctg

SEQ ID NO: 2714321 - DNA, 18 bp, Homo sapiens
ggctccagaatgtgctgc

SEQ ID NO: 2714322 - DNA, 21 bp, Homo sapiens
ggctcccctgaggctggcatc

SEQ ID NO: 2714323 - DNA, 18 bp, Homo sapiens
ggctccctcctggagcat

SEQ ID NO: 2714324 - DNA, 14 bp, Homo sapiens
ggctccgtgagccc

SEQ ID NO: 2714325 - DNA, 15 bp, Homo sapiens
ggctcctccctctgc

SEQ ID NO: 2714326 - DNA, 17 bp, Homo sapiens
ggctcctccctctgcct

SEQ ID NO: 2714327 - DNA, 22 bp, Homo sapiens
ggctcctccctctgcctcatcc

SEQ ID NO: 2714328 - DNA, 23 bp, Homo sapiens
ggctcctccctctgcctcatcct

SEQ ID NO: 2714329 - DNA, 12 bp, Homo sapiens
ggctcctgctgc

SEQ ID NO: 2714330 - DNA, 13 bp, Homo sapiens
ggctcctgctgca

SEQ ID NO: 2714331 - DNA, 13 bp, Homo sapiens
ggctcctggaaag

SEQ ID NO: 2714332 - DNA, 13 bp, Homo sapiens
ggctcctgtgccc

SEQ ID NO: 2714333 - DNA, 17 bp, Homo sapiens
ggctcctgtgcccttat

SEQ ID NO: 2714334 - DNA, 20 bp, Homo sapiens
ggctcgccccacccagggct

SEQ ID NO: 2714335 - DNA, 21 bp, Homo sapiens
ggctctccaccttgttacaca

SEQ ID NO: 2714336 - DNA, 14 bp, Homo sapiens
ggctgaacagtgct

SEQ ID NO: 2714337 - DNA, 15 bp, Homo sapiens
ggctgaacagtgctc

SEQ ID NO: 2714338 - DNA, 19 bp, Homo sapiens
ggctgaacagtgctctgcc

SEQ ID NO: 2714339 - DNA, 14 bp, Homo sapiens
ggctgacccagtgt

SEQ ID NO: 2714340 - DNA, 23 bp, Homo sapiens
ggctgacccagtgtgtgctcagc

SEQ ID NO: 2714341 - DNA, 12 bp, Homo sapiens
ggctgagagctc

SEQ ID NO: 2714342 - DNA, 18 bp, Homo sapiens
ggctgagggcatctctga

SEQ ID NO: 2714343 - DNA, 21 bp, Homo sapiens
ggctgagggcatctctgagtg

SEQ ID NO: 2714344 - DNA, 16 bp, Homo sapiens
ggctgcacgtcaccct

SEQ ID NO: 2714345 - DNA, 17 bp, Homo sapiens
ggctgcacgtcaccctc

SEQ ID NO: 2714346 - DNA, 16 bp, Homo sapiens
ggctgcactctgtgcc

SEQ ID NO: 2714347 - DNA, 18 bp, Homo sapiens
ggctgcactctgtgccca

SEQ ID NO: 2714348 - DNA, 13 bp, Homo sapiens
ggctgccctgcca

SEQ ID NO: 2714349 - DNA, 12 bp, Homo sapiens
ggctgcctccac

SEQ ID NO: 2714350 - DNA, 16 bp, Homo sapiens
ggctgcctccactccc

SEQ ID NO: 2714351 - DNA, 12 bp, Homo sapiens
ggctgctggccc

SEQ ID NO: 2714352 - DNA, 17 bp, Homo sapiens
ggctgctggcccacagc

SEQ ID NO: 2714353 - DNA, 18 bp, Homo sapiens
ggctgctggcccacagct

SEQ ID NO: 2714354 - DNA, 13 bp, Homo sapiens
ggctgctgggggc

SEQ ID NO: 2714355 - DNA, 20 bp, Homo sapiens
ggctgctgggggctcccctt

SEQ ID NO: 2714356 - DNA, 19 bp, Homo sapiens
ggctgctttttgctttctt

SEQ ID NO: 2714357 - DNA, 12 bp, Homo sapiens
ggctggccagcc

SEQ ID NO: 2714358 - DNA, 14 bp, Homo sapiens
ggggcttccctggg

SEQ ID NO: 2714359 - DNA, 15 bp, Homo sapiens
ggggctttctggaga

SEQ ID NO: 2714360 - DNA, 18 bp, Homo sapiens
gggggagaaggcctcccc

SEQ ID NO: 2714361 - DNA, 22 bp, Homo sapiens
gggggagaaggcctcccctgag

SEQ ID NO: 2714362 - DNA, 16 bp, Homo sapiens
gggggagccaacagca

SEQ ID NO: 2714363 - DNA, 22 bp, Homo sapiens
gggggctccccttgcccttcct

SEQ ID NO: 2714364 - DNA, 14 bp, Homo sapiens
ggggtaccaggcac

SEQ ID NO: 2714365 - DNA, 18 bp, Homo sapiens
ggggtattttaggcaggg

SEQ ID NO: 2714366 - DNA, 23 bp, Homo sapiens
gggtaactcttggccagagctga

SEQ ID NO: 2714367 - DNA, 21 bp, Homo sapiens
gggtaataaacttagaataaa

SEQ ID NO: 2714368 - DNA, 13 bp, Homo sapiens
gggtaccaggcac

SEQ ID NO: 2714369 - DNA, 14 bp, Homo sapiens
gggtcctcggccca

SEQ ID NO: 2714370 - DNA, 18 bp, Homo sapiens
gggtgagaacgtgcccag

SEQ ID NO: 2714371 - DNA, 22 bp, Homo sapiens
gggtgcgaccccatctgcccag

SEQ ID NO: 2714372 - DNA, 18 bp, Homo sapiens
gggtggcccatcccccct

SEQ ID NO: 2714373 - DNA, 19 bp, Homo sapiens
gggtgggagagcccagcca

SEQ ID NO: 2714374 - DNA, 12 bp, Homo sapiens
gggtgggcacag

SEQ ID NO: 2714375 - DNA, 16 bp, Homo sapiens
gggttgaaagacatca

SEQ ID NO: 2714376 - DNA, 16 bp, Homo sapiens
gggtttggcccctgga

SEQ ID NO: 2714377 - DNA, 11 bp, Homo sapiens
ggtacagcagg

SEQ ID NO: 2714378 - DNA, 21 bp, Homo sapiens
ggtacagcagggtcttgctgt

SEQ ID NO: 2714379 - DNA, 19 bp, Homo sapiens
ggtacagttcataattcac

SEQ ID NO: 2714380 - DNA, 21 bp, Homo sapiens
ggtaccaggcacatggctggg

SEQ ID NO: 2714381 - DNA, 15 bp, Homo sapiens
ggtactaaggagaat

SEQ ID NO: 2714382 - DNA, 14 bp, Homo sapiens
ggtagcgagctgct

SEQ ID NO: 2714383 - DNA, 19 bp, Homo sapiens
ggtataaggatcttttgta

SEQ ID NO: 2714384 - DNA, 15 bp, Homo sapiens
ggtatatcaggaggg

SEQ ID NO: 2714385 - DNA, 17 bp, Homo sapiens
ggtatatcaggagggga

SEQ ID NO: 2714386 - DNA, 11 bp, Homo sapiens
ggtatgtacag

SEQ ID NO: 2714387 - DNA, 15 bp, Homo sapiens
ggtcacttatcctga

SEQ ID NO: 2714388 - DNA, 20 bp, Homo sapiens
ggtcattcctaatgcattag

SEQ ID NO: 2714389 - DNA, 13 bp, Homo sapiens
ggtccaacccagc

SEQ ID NO: 2714390 - DNA, 22 bp, Homo sapiens
ggtcccaagtagtagtgtcttc

SEQ ID NO: 2714391 - DNA, 17 bp, Homo sapiens
ggtcctctgcttcctga

SEQ ID NO: 2714392 - DNA, 12 bp, Homo sapiens
ggtcctggggct

SEQ ID NO: 2714393 - DNA, 19 bp, Homo sapiens
ggtcctttaggcagcctgc

SEQ ID NO: 2714394 - DNA, 19 bp, Homo sapiens
ggtctcacactcctcctgc

SEQ ID NO: 2714395 - DNA, 21 bp, Homo sapiens
ggtctcacactcctcctgcca

SEQ ID NO: 2714396 - DNA, 22 bp, Homo sapiens
ggtctcacactcctcctgccag

SEQ ID NO: 2714397 - DNA, 24 bp, Homo sapiens
ggtctcacactcctcctgccagct

SEQ ID NO: 2714398 - DNA, 14 bp, Homo sapiens
ggtctcctccaccg

SEQ ID NO: 2714399 - DNA, 22 bp, Homo sapiens
ggtctcctccaccgccatggct

SEQ ID NO: 2714400 - DNA, 17 bp, Homo sapiens
ggtctcgaactcctgac

SEQ ID NO: 2714401 - DNA, 20 bp, Homo sapiens
ggtctcgaactcctgacctc

SEQ ID NO: 2714402 - DNA, 20 bp, Homo sapiens
tacatacaacctatgtaatt

SEQ ID NO: 2714403 - DNA, 22 bp, Homo sapiens
tacatacaacctatgtaatttt

SEQ ID NO: 2714404 - DNA, 21 bp, Homo sapiens
tacattaaaatagcacatgat

SEQ ID NO: 2714405 - DNA, 18 bp, Homo sapiens
tacattagtatcccacta

SEQ ID NO: 2714406 - DNA, 14 bp, Homo sapiens
tacattatgttatt

SEQ ID NO: 2714407 - DNA, 15 bp, Homo sapiens
tacattatgttattg

SEQ ID NO: 2714408 - DNA, 21 bp, Homo sapiens
tacattatgttattggaattt

SEQ ID NO: 2714409 - DNA, 19 bp, Homo sapiens
tacattttatatctggatt

SEQ ID NO: 2714410 - DNA, 21 bp, Homo sapiens
tacattttgtatatttgtatt

SEQ ID NO: 2714411 - DNA, 18 bp, Homo sapiens
taccaaatccacaagcca

SEQ ID NO: 2714412 - DNA, 13 bp, Homo sapiens
taccacaccctgc

SEQ ID NO: 2714413 - DNA, 18 bp, Homo sapiens
taccacaccctgcctgct

SEQ ID NO: 2714414 - DNA, 22 bp, Homo sapiens
taccacaccctgcctgctgtgg

SEQ ID NO: 2714415 - DNA, 17 bp, Homo sapiens
taccacttccctgcttt

SEQ ID NO: 2714416 - DNA, 20 bp, Homo sapiens
taccaggcacatggctgggg

SEQ ID NO: 2714417 - DNA, 14 bp, Homo sapiens
taccagtgggcatg

SEQ ID NO: 2714418 - DNA, 16 bp, Homo sapiens
taccatattgctctta

SEQ ID NO: 2714419 - DNA, 19 bp, Homo sapiens
taccatattgctcttaaaa

SEQ ID NO: 2714420 - DNA, 15 bp, Homo sapiens
taccatgatgcatgg

SEQ ID NO: 2714421 - DNA, 15 bp, Homo sapiens
taccattattttaca

SEQ ID NO: 2714422 - DNA, 19 bp, Homo sapiens
taccattattttacagtct

SEQ ID NO: 2714423 - DNA, 14 bp, Homo sapiens
tacccactctttgc

SEQ ID NO: 2714424 - DNA, 16 bp, Homo sapiens
tacccccgcccaggct

SEQ ID NO: 2714425 - DNA, 13 bp, Homo sapiens
tacccctcccagc

SEQ ID NO: 2714426 - DNA, 11 bp, Homo sapiens
taccctccctg

SEQ ID NO: 2714427 - DNA, 17 bp, Homo sapiens
taccctccctgctgtcc

SEQ ID NO: 2714428 - DNA, 22 bp, Homo sapiens
taccctccctgctgtcccctct

SEQ ID NO: 2714429 - DNA, 18 bp, Homo sapiens
taccctcctctatttctt

SEQ ID NO: 2714430 - DNA, 15 bp, Homo sapiens
tacccttggtttgca

SEQ ID NO: 2714431 - DNA, 14 bp, Homo sapiens
taccgcatggcagc

SEQ ID NO: 2714432 - DNA, 16 bp, Homo sapiens
taccgcatggcagctg

SEQ ID NO: 2714433 - DNA, 17 bp, Homo sapiens
taccgcatggcagctgg

SEQ ID NO: 2714434 - DNA, 21 bp, Homo sapiens
taccgcatggcagctgggccc

SEQ ID NO: 2714435 - DNA, 22 bp, Homo sapiens
taccgcatggcagctgggccca

SEQ ID NO: 2714436 - DNA, 11 bp, Homo sapiens
tacctcagcct

SEQ ID NO: 2714437 - DNA, 16 bp, Homo sapiens
tacctcagcctagacc

SEQ ID NO: 2714438 - DNA, 23 bp, Homo sapiens
tacctgagatactgaagtgcagc

SEQ ID NO: 2714439 - DNA, 20 bp, Homo sapiens
tacctgcctgttctccagat

SEQ ID NO: 2714440 - DNA, 21 bp, Homo sapiens
taccttattgagcgtgattct

SEQ ID NO: 2714441 - DNA, 22 bp, Homo sapiens
taccttattgagcgtgattctg

SEQ ID NO: 2714442 - DNA, 18 bp, Homo sapiens
tacctttttttctctcct

SEQ ID NO: 2714443 - DNA, 15 bp, Homo sapiens
tacggtgagactctg

SEQ ID NO: 2714444 - DNA, 19 bp, Homo sapiens
tacgttctgctatatttgt

SEQ ID NO: 2714445 - DNA, 20 bp, Homo sapiens
tactacttttgcatgaaaat

SEQ ID NO: 2714446 - DNA, 21 bp, Homo sapiens
tactatctttgtctaaacaag

SEQ ID NO: 2714447 - DNA, 12 bp, Homo sapiens
tactattaaaca

SEQ ID NO: 2714448 - DNA, 13 bp, Homo sapiens
tactcagagctgc

SEQ ID NO: 2714449 - DNA, 20 bp, Homo sapiens
tactcagtgaaatcatatta

SEQ ID NO: 2714450 - DNA, 22 bp, Homo sapiens
tactcagtgaaatcatattaat

SEQ ID NO: 2714451 - DNA, 20 bp, Homo sapiens
tactcattcatttattcatt

SEQ ID NO: 2714452 - DNA, 17 bp, Homo sapiens
tactccattattttatt

SEQ ID NO: 2714453 - DNA, 12 bp, Homo sapiens
tactcccagcgc

SEQ ID NO: 2714454 - DNA, 14 bp, Homo sapiens
tactcctacctcag

SEQ ID NO: 2714455 - DNA, 15 bp, Homo sapiens
tactcctacctcagc

SEQ ID NO: 2714456 - DNA, 16 bp, Homo sapiens
tactcctacctcagcc

SEQ ID NO: 2714457 - DNA, 13 bp, Homo sapiens
tactgaagtgcag

SEQ ID NO: 2714458 - DNA, 22 bp, Homo sapiens
tactgggaatggaaggctttgc

SEQ ID NO: 2714459 - DNA, 15 bp, Homo sapiens
tacttaaacatcatt

SEQ ID NO: 2714460 - DNA, 19 bp, Homo sapiens
tacttacaaaagcagcttt

SEQ ID NO: 2714461 - DNA, 13 bp, Homo sapiens
tacttccctccaa

SEQ ID NO: 2714462 - DNA, 11 bp, Homo sapiens
tactttgtgct

SEQ ID NO: 2714463 - DNA, 21 bp, Homo sapiens
tactttttaaacagtgtttat

SEQ ID NO: 2714464 - DNA, 13 bp, Homo sapiens
tagaaaatcagat

SEQ ID NO: 2714465 - DNA, 23 bp, Homo sapiens
tagaaaatcagattttctcctgt

SEQ ID NO: 2714466 - DNA, 14 bp, Homo sapiens
tagaacacccactg

SEQ ID NO: 2714467 - DNA, 15 bp, Homo sapiens
tagaacacccactgg

SEQ ID NO: 2714468 - DNA, 16 bp, Homo sapiens
tagaacacccactggc

SEQ ID NO: 2714469 - DNA, 13 bp, Homo sapiens
tagaactgaattt

SEQ ID NO: 2714470 - DNA, 12 bp, Homo sapiens
tagaagtgacat

SEQ ID NO: 2714471 - DNA, 19 bp, Homo sapiens
tagaataaaattgtaaaat

SEQ ID NO: 2714472 - DNA, 20 bp, Homo sapiens
tagaatgcatgtaaggtctt

SEQ ID NO: 2714473 - DNA, 21 bp, Homo sapiens
tagacattattttgtatggaa

SEQ ID NO: 2714474 - DNA, 16 bp, Homo sapiens
tagagaagtaagcaga

SEQ ID NO: 2714475 - DNA, 20 bp, Homo sapiens
tagagacggggtttccccat

SEQ ID NO: 2714476 - DNA, 12 bp, Homo sapiens
tagagctcctgt

SEQ ID NO: 2714477 - DNA, 17 bp, Homo sapiens
tagagctcctgtcccta

SEQ ID NO: 2714478 - DNA, 20 bp, Homo sapiens
tagagctcctgtccctaccc

SEQ ID NO: 2714479 - DNA, 11 bp, Homo sapiens
tagagtgacag

SEQ ID NO: 2714480 - DNA, 14 bp, Homo sapiens
tagagtgcagtggc

SEQ ID NO: 2714481 - DNA, 16 bp, Homo sapiens
tagagttctattagaa

SEQ ID NO: 2714482 - DNA, 14 bp, Homo sapiens
tagatattattcat

SEQ ID NO: 2714483 - DNA, 20 bp, Homo sapiens
tagatccaggcttctcccgg

SEQ ID NO: 2714484 - DNA, 18 bp, Homo sapiens
tagattctcacctgcctt

SEQ ID NO: 2714485 - DNA, 15 bp, Homo sapiens
tagatttttaaaagg

SEQ ID NO: 2714486 - DNA, 12 bp, Homo sapiens
tagcaactgtgc

SEQ ID NO: 2714487 - DNA, 14 bp, Homo sapiens
tagcaaggccaggg

SEQ ID NO: 2714488 - DNA, 23 bp, Homo sapiens
tagcaaggccagggcacagctgg

SEQ ID NO: 2714489 - DNA, 16 bp, Homo sapiens
tagcaatcattttata

SEQ ID NO: 2714490 - DNA, 17 bp, Homo sapiens
tagccccgggctgaccc

SEQ ID NO: 2714491 - DNA, 20 bp, Homo sapiens
tagctaaggtctataaacat

SEQ ID NO: 2714492 - DNA, 13 bp, Homo sapiens
tagctacctgcta

SEQ ID NO: 2714493 - DNA, 15 bp, Homo sapiens
tagctagctatttct

SEQ ID NO: 2714494 - DNA, 16 bp, Homo sapiens
tagctatttctatgta

SEQ ID NO: 2714495 - DNA, 23 bp, Homo sapiens
tagctcccgagctactctcttgc

SEQ ID NO: 2714496 - DNA, 18 bp, Homo sapiens
tagctctacacaacatgt

SEQ ID NO: 2714497 - DNA, 18 bp, Homo sapiens
tagctcttgggcctgacc

SEQ ID NO: 2714498 - DNA, 19 bp, Homo sapiens
tagctgagattacaggcgc

SEQ ID NO: 2714499 - DNA, 23 bp, Homo sapiens
taggaaagcaccgcagcatgtgg

SEQ ID NO: 2714500 - DNA, 15 bp, Homo sapiens
taggactctgaggct

SEQ ID NO: 2714501 - DNA, 21 bp, Homo sapiens
taggagttcgagaccagcctg

SEQ ID NO: 2714502 - DNA, 12 bp, Homo sapiens
taggataaatta

SEQ ID NO: 2714503 - DNA, 19 bp, Homo sapiens
taggataaattacattaaa

SEQ ID NO: 2714504 - DNA, 17 bp, Homo sapiens
taggcagatctttaaat

SEQ ID NO: 2714505 - DNA, 18 bp, Homo sapiens
tagggcaaagaatcaaca

SEQ ID NO: 2714506 - DNA, 16 bp, Homo sapiens
tagggcctcggaggct

SEQ ID NO: 2714507 - DNA, 21 bp, Homo sapiens
tagggcctcggaggctcctcc

SEQ ID NO: 2714508 - DNA, 22 bp, Homo sapiens
tagggcctcggaggctcctccc

SEQ ID NO: 2714509 - DNA, 16 bp, Homo sapiens
tagggtccttgaaaca

SEQ ID NO: 2714510 - DNA, 12 bp, Homo sapiens
taggtaagggcc

SEQ ID NO: 2714511 - DNA, 15 bp, Homo sapiens
taggtgccaggctgt

SEQ ID NO: 2714512 - DNA, 20 bp, Homo sapiens
taggtggctctgggaatggg

SEQ ID NO: 2714513 - DNA, 14 bp, Homo sapiens
tagtagaacaatgt

SEQ ID NO: 2714514 - DNA, 11 bp, Homo sapiens
tagtagcattt

SEQ ID NO: 2714515 - DNA, 20 bp, Homo sapiens
tagtatattagtttgattta

SEQ ID NO: 2714516 - DNA, 15 bp, Homo sapiens
ggctggccagcccca

SEQ ID NO: 2714517 - DNA, 14 bp, Homo sapiens
ggctggctgtgtcc

SEQ ID NO: 2714518 - DNA, 21 bp, Homo sapiens
ggctgggggcgggggagccaa

SEQ ID NO: 2714519 - DNA, 19 bp, Homo sapiens
ggctgggttgtcactgaga

SEQ ID NO: 2714520 - DNA, 13 bp, Homo sapiens
ggcttcaccaggg

SEQ ID NO: 2714521 - DNA, 19 bp, Homo sapiens
ggcttccaaggtggtctgc

SEQ ID NO: 2714522 - DNA, 21 bp, Homo sapiens
ggcttccctgggcctcagcct

SEQ ID NO: 2714523 - DNA, 19 bp, Homo sapiens
ggcttctgcagctttggct

SEQ ID NO: 2714524 - DNA, 12 bp, Homo sapiens
ggcttctgcttc

SEQ ID NO: 2714525 - DNA, 13 bp, Homo sapiens
ggcttctggagcc

SEQ ID NO: 2714526 - DNA, 18 bp, Homo sapiens
ggcttgtggactctctgc

SEQ ID NO: 2714527 - DNA, 20 bp, Homo sapiens
ggcttgtggactctctgcct

SEQ ID NO: 2714528 - DNA, 18 bp, Homo sapiens
ggctttacaaataatttt

SEQ ID NO: 2714529 - DNA, 14 bp, Homo sapiens
ggctttctggagag

SEQ ID NO: 2714530 - DNA, 16 bp, Homo sapiens
ggctttcttttctcta

SEQ ID NO: 2714531 - DNA, 17 bp, Homo sapiens
ggctttggcaacagaaa

SEQ ID NO: 2714532 - DNA, 24 bp, Homo sapiens
ggctttgttcttgtcatcagtaag

SEQ ID NO: 2714533 - DNA, 18 bp, Homo sapiens
gggaaacctgtgaaagct

SEQ ID NO: 2714534 - DNA, 15 bp, Homo sapiens
gggaagcagggacac

SEQ ID NO: 2714535 - DNA, 15 bp, Homo sapiens
gggaagcatcctccc

SEQ ID NO: 2714536 - DNA, 24 bp, Homo sapiens
gggaagccctcggcctccagactg

SEQ ID NO: 2714537 - DNA, 23 bp, Homo sapiens
gggaagcggaggttgcagggagc

SEQ ID NO: 2714538 - DNA, 20 bp, Homo sapiens
gggaaggtatatcaggaggg

SEQ ID NO: 2714539 - DNA, 23 bp, Homo sapiens
gggacaattcttctcgacttcag

SEQ ID NO: 2714540 - DNA, 19 bp, Homo sapiens
gggaccacagcaaggcacc

SEQ ID NO: 2714541 - DNA, 17 bp, Homo sapiens
gggaccactgggtgaga

SEQ ID NO: 2714542 - DNA, 21 bp, Homo sapiens
gggaccccagctagggctgga

SEQ ID NO: 2714543 - DNA, 16 bp, Homo sapiens
gggacctggagctgcc

SEQ ID NO: 2714544 - DNA, 17 bp, Homo sapiens
gggacctggagctgcca

SEQ ID NO: 2714545 - DNA, 14 bp, Homo sapiens
gggactcaggccag

SEQ ID NO: 2714546 - DNA, 12 bp, Homo sapiens
gggactgggcca

SEQ ID NO: 2714547 - DNA, 14 bp, Homo sapiens
gggagaacctcagg

SEQ ID NO: 2714548 - DNA, 19 bp, Homo sapiens
gggagaaggcctcccctga

SEQ ID NO: 2714549 - DNA, 21 bp, Homo sapiens
gggagataaaagaaccccaga

SEQ ID NO: 2714550 - DNA, 15 bp, Homo sapiens
gggagcaactctcca

SEQ ID NO: 2714551 - DNA, 19 bp, Homo sapiens
gggaggatcactggagccc

SEQ ID NO: 2714552 - DNA, 22 bp, Homo sapiens
gggaggatcactggagcccagg

SEQ ID NO: 2714553 - DNA, 18 bp, Homo sapiens
gggagggaaaagctaaga

SEQ ID NO: 2714554 - DNA, 14 bp, Homo sapiens
gggagggctgcctg

SEQ ID NO: 2714555 - DNA, 13 bp, Homo sapiens
gggaggggcccgc

SEQ ID NO: 2714556 - DNA, 23 bp, Homo sapiens
gggatcagcctccgccattccaa

SEQ ID NO: 2714557 - DNA, 16 bp, Homo sapiens
gggatgaaaagccata

SEQ ID NO: 2714558 - DNA, 21 bp, Homo sapiens
gggatgctatctcgctagcca

SEQ ID NO: 2714559 - DNA, 20 bp, Homo sapiens
gggcaaagatctcagcagcc

SEQ ID NO: 2714560 - DNA, 24 bp, Homo sapiens
gggcaagtccctgactctctgtga

SEQ ID NO: 2714561 - DNA, 16 bp, Homo sapiens
gggcaatgcagtgcag

SEQ ID NO: 2714562 - DNA, 12 bp, Homo sapiens
gggcacagggag

SEQ ID NO: 2714563 - DNA, 15 bp, Homo sapiens
gggcaccctccaaac

SEQ ID NO: 2714564 - DNA, 19 bp, Homo sapiens
gggcacctatagtcccagc

SEQ ID NO: 2714565 - DNA, 17 bp, Homo sapiens
tagtcagagtgtccctt

SEQ ID NO: 2714566 - DNA, 14 bp, Homo sapiens
tagtctcttctcag

SEQ ID NO: 2714567 - DNA, 16 bp, Homo sapiens
tagtctcttctcagag

SEQ ID NO: 2714568 - DNA, 14 bp, Homo sapiens
tagtgacttcctgg

SEQ ID NO: 2714569 - DNA, 13 bp, Homo sapiens
tagtgcctctgca

SEQ ID NO: 2714570 - DNA, 13 bp, Homo sapiens
tagtgtgtccatg

SEQ ID NO: 2714571 - DNA, 14 bp, Homo sapiens
tagttgtctttctt

SEQ ID NO: 2714572 - DNA, 13 bp, Homo sapiens
tcagcctgaggct

SEQ ID NO: 2714573 - DNA, 17 bp, Homo sapiens
tcagctctcctgctgca

SEQ ID NO: 2714574 - DNA, 11 bp, Homo sapiens
tcagctggtgg

SEQ ID NO: 2714575 - DNA, 14 bp, Homo sapiens
tttctgtaaatgaa

SEQ ID NO: 2714576 - DNA, 14 bp, Homo sapiens
tttctttcatacat

SEQ ID NO: 2714577 - DNA, 17 bp, Homo sapiens
tttctttcatacattat

SEQ ID NO: 2714578 - DNA, 14 bp, Homo sapiens
tttctttgctgctg

SEQ ID NO: 2714579 - DNA, 18 bp, Homo sapiens
tttgaaagaattctattt

SEQ ID NO: 2714580 - DNA, 22 bp, Homo sapiens
tttgaaagtgggtttcaattta

SEQ ID NO: 2714581 - DNA, 19 bp, Homo sapiens
tttgaatagaggccaaatt

SEQ ID NO: 2714582 - DNA, 19 bp, Homo sapiens
tttgaatgtgatcatcttt

SEQ ID NO: 2714583 - DNA, 20 bp, Homo sapiens
tttgacaacacatgtgggag

SEQ ID NO: 2714584 - DNA, 22 bp, Homo sapiens
tttgacagagttggtgttcata

SEQ ID NO: 2714585 - DNA, 14 bp, Homo sapiens
tttgacgaagaaac

SEQ ID NO: 2714586 - DNA, 19 bp, Homo sapiens
tttgagctagttacataaa

SEQ ID NO: 2714587 - DNA, 20 bp, Homo sapiens
tttgaggagcagcttcagtt

SEQ ID NO: 2714588 - DNA, 16 bp, Homo sapiens
tttgatagtgcttctt

SEQ ID NO: 2714589 - DNA, 13 bp, Homo sapiens
tttgatcagtgtt

SEQ ID NO: 2714590 - DNA, 13 bp, Homo sapiens
tttgcaatttcag

SEQ ID NO: 2714591 - DNA, 14 bp, Homo sapiens
tttgcacagagggc

SEQ ID NO: 2714592 - DNA, 12 bp, Homo sapiens
tttgcacataaa

SEQ ID NO: 2714593 - DNA, 13 bp, Homo sapiens
tttgcaccaaaga

SEQ ID NO: 2714594 - DNA, 16 bp, Homo sapiens
tttgcattagacagat

SEQ ID NO: 2714595 - DNA, 19 bp, Homo sapiens
tttgccatgggcctgctgc

SEQ ID NO: 2714596 - DNA, 22 bp, Homo sapiens
tttgcccacacacactccttcc

SEQ ID NO: 2714597 - DNA, 12 bp, Homo sapiens
tttgctacaata

SEQ ID NO: 2714598 - DNA, 18 bp, Homo sapiens
tttgctacaataaatgct

SEQ ID NO: 2714599 - DNA, 21 bp, Homo sapiens
tttgctgaatgtcattatttg

SEQ ID NO: 2714600 - DNA, 21 bp, Homo sapiens
tttgctgtatacaaacaggtg

SEQ ID NO: 2714601 - DNA, 16 bp, Homo sapiens
tttgcttgattaaaca

SEQ ID NO: 2714602 - DNA, 14 bp, Homo sapiens
tttgctttcttctt

SEQ ID NO: 2714603 - DNA, 16 bp, Homo sapiens
tttggcaacagaaaac

SEQ ID NO: 2714604 - DNA, 21 bp, Homo sapiens
tttggcagaactgctggggct

SEQ ID NO: 2714605 - DNA, 11 bp, Homo sapiens
tttgggaaagc

SEQ ID NO: 2714606 - DNA, 17 bp, Homo sapiens
tttgggggcttccctgg

SEQ ID NO: 2714607 - DNA, 22 bp, Homo sapiens
tttggtgaacattgcaatagaa

SEQ ID NO: 2714608 - DNA, 21 bp, Homo sapiens
tttgtaagtttatgtctaaag

SEQ ID NO: 2714609 - DNA, 21 bp, Homo sapiens
tttgtaatgtttgtcagtaaa

SEQ ID NO: 2714610 - DNA, 14 bp, Homo sapiens
tttgtaccatattg

SEQ ID NO: 2714611 - DNA, 17 bp, Homo sapiens
tttgtaccatattgctc

SEQ ID NO: 2714612 - DNA, 13 bp, Homo sapiens
tttgtatctgaag

SEQ ID NO: 2714613 - DNA, 13 bp, Homo sapiens
tttgtattaacaa

SEQ ID NO: 2714614 - DNA, 16 bp, Homo sapiens
tttgtcagtaaatact

SEQ ID NO: 2714615 - DNA, 14 bp, Homo sapiens
tttgtccaggcctg

SEQ ID NO: 2714616 - DNA, 13 bp, Homo sapiens
tttgtctaaacaa

SEQ ID NO: 2714617 - DNA, 20 bp, Homo sapiens
tttgtgcatcagaaaatgca

SEQ ID NO: 2714618 - DNA, 19 bp, Homo sapiens
tttgtggtaaaaagattat

SEQ ID NO: 2714619 - DNA, 20 bp, Homo sapiens
tttgttagcaaagattaaat

SEQ ID NO: 2714620 - DNA, 18 bp, Homo sapiens
tttgttatttgtacagtt

SEQ ID NO: 2714621 - DNA, 14 bp, Homo sapiens
tttgttcacactcc

SEQ ID NO: 2714622 - DNA, 16 bp, Homo sapiens
tttgttgagtctctga

SEQ ID NO: 2714623 - DNA, 15 bp, Homo sapiens
tttgttgtcatgtgt

SEQ ID NO: 2714624 - DNA, 13 bp, Homo sapiens
tttgtttatgtta

SEQ ID NO: 2714625 - DNA, 21 bp, Homo sapiens
tttgtttatgttacttaaaca

SEQ ID NO: 2714626 - DNA, 20 bp, Homo sapiens
ttttaaaggaaaaatcataa

SEQ ID NO: 2714627 - DNA, 17 bp, Homo sapiens
ttttaaaggacaaacag

SEQ ID NO: 2714628 - DNA, 15 bp, Homo sapiens
ttttaaataaaagca

SEQ ID NO: 2714629 - DNA, 16 bp, Homo sapiens
ttttaaataaaagcac

SEQ ID NO: 2714630 - DNA, 21 bp, Homo sapiens
ttttaaataaaatagagtctg

SEQ ID NO: 2714631 - DNA, 13 bp, Homo sapiens
ttttaacatgtga

SEQ ID NO: 2714632 - DNA, 20 bp, Homo sapiens
ttttaagaaaaaaagcaaaa

SEQ ID NO: 2714633 - DNA, 22 bp, Homo sapiens
ttttaagctgtaaaaagagaga

SEQ ID NO: 2714634 - DNA, 11 bp, Homo sapiens
ttttaccaaag

SEQ ID NO: 2714635 - DNA, 15 bp, Homo sapiens
ttttaccaaagcatc

SEQ ID NO: 2714636 - DNA, 18 bp, Homo sapiens
ttttactgacagaaatgc

SEQ ID NO: 2714637 - DNA, 14 bp, Homo sapiens
ttttataaatatgt

SEQ ID NO: 2714638 - DNA, 14 bp, Homo sapiens
ttttatataaagaa

SEQ ID NO: 2714639 - DNA, 16 bp, Homo sapiens
ttttatataaagaaaa

SEQ ID NO: 2714640 - DNA, 22 bp, Homo sapiens
ttttatctacccagtcatgtac

SEQ ID NO: 2714641 - DNA, 13 bp, Homo sapiens
ttttatctgtgga

SEQ ID NO: 2714642 - DNA, 15 bp, Homo sapiens
ttttatgatgctatt

SEQ ID NO: 2714643 - DNA, 13 bp, Homo sapiens
ttttattgctgga

SEQ ID NO: 2714644 - DNA, 20 bp, Homo sapiens
ttttatttccacataaaggt

SEQ ID NO: 2714645 - DNA, 19 bp, Homo sapiens
ttttcagattgtaaaggta

SEQ ID NO: 2714646 - DNA, 20 bp, Homo sapiens
ttttcagctattagcaactg

SEQ ID NO: 2714647 - DNA, 17 bp, Homo sapiens
ttttccagaaagaaaat

SEQ ID NO: 2714648 - DNA, 13 bp, Homo sapiens
ttttcccactgca

SEQ ID NO: 2714649 - DNA, 21 bp, Homo sapiens
ttttctccagggttcaccatg

SEQ ID NO: 2714650 - DNA, 21 bp, Homo sapiens
ttttctctatgaaaagcaact

SEQ ID NO: 2714651 - DNA, 22 bp, Homo sapiens
ttttctcttgccccaaatcaca

SEQ ID NO: 2714652 - DNA, 14 bp, Homo sapiens
ttttctgcctgaga

SEQ ID NO: 2714653 - DNA, 16 bp, Homo sapiens
ttttcttcatttctct

SEQ ID NO: 2714654 - DNA, 14 bp, Homo sapiens
ttttgaagaacaaa

SEQ ID NO: 2714655 - DNA, 16 bp, Homo sapiens
ttttgaagaacaaaag

SEQ ID NO: 2714656 - DNA, 15 bp, Homo sapiens
ttttgatcagtgtta

SEQ ID NO: 2714657 - DNA, 15 bp, Homo sapiens
ttttgcaggggactg

SEQ ID NO: 2714658 - DNA, 22 bp, Homo sapiens
ttttgcaggggactgggccatg

SEQ ID NO: 2714659 - DNA, 16 bp, Homo sapiens
ttttgctcttctgtat

SEQ ID NO: 2714660 - DNA, 15 bp, Homo sapiens
ttttgctgtgctgta

SEQ ID NO: 2714661 - DNA, 18 bp, Homo sapiens
ttttgctgtgctgtacat

SEQ ID NO: 2714662 - DNA, 13 bp, Homo sapiens
ttttggaaaaatg

SEQ ID NO: 2714663 - DNA, 15 bp, Homo sapiens
ttttgtaattattgt

SEQ ID NO: 2714664 - DNA, 13 bp, Homo sapiens
ttttgtacattat

SEQ ID NO: 2714665 - DNA, 23 bp, Homo sapiens
ttttgtaccatattgctcttaaa

SEQ ID NO: 2714666 - DNA, 21 bp, Homo sapiens
ttttgtatgaaatattaaaca

SEQ ID NO: 2714667 - DNA, 20 bp, Homo sapiens
ttttgtgtatccagtatgca

SEQ ID NO: 2714668 - DNA, 20 bp, Homo sapiens
ttttgttattaaaaaaacac

SEQ ID NO: 2714669 - DNA, 12 bp, Homo sapiens
tttttaaagaaa

SEQ ID NO: 2714670 - DNA, 20 bp, Homo sapiens
tttttaaagaaaagttttgt

SEQ ID NO: 2714671 - DNA, 22 bp, Homo sapiens
tttttaaagaaaatgtgtctgc

SEQ ID NO: 2714672 - DNA, 19 bp, Homo sapiens
tttttaaataaaagcacaa

SEQ ID NO: 2714673 - DNA, 21 bp, Homo sapiens
tttttaagaaaaaaagcaaaa

SEQ ID NO: 2714674 - DNA, 19 bp, Homo sapiens
tgaggcagtgggtcccact

SEQ ID NO: 2714675 - DNA, 17 bp, Homo sapiens
tgaggcccagcctgtcc

SEQ ID NO: 2714676 - DNA, 14 bp, Homo sapiens
tgaggccggccctg

SEQ ID NO: 2714677 - DNA, 18 bp, Homo sapiens
tgaggccggccctgcccc

SEQ ID NO: 2714678 - DNA, 19 bp, Homo sapiens
tgaggccggccctgcccct

SEQ ID NO: 2714679 - DNA, 12 bp, Homo sapiens
tgaggcctccct

SEQ ID NO: 2714680 - DNA, 23 bp, Homo sapiens
tgaggcgggtggatcacctgagg

SEQ ID NO: 2714681 - DNA, 16 bp, Homo sapiens
tgaggctctttctggg

SEQ ID NO: 2714682 - DNA, 18 bp, Homo sapiens
tgaggctctttctgggcc

SEQ ID NO: 2714683 - DNA, 12 bp, Homo sapiens
tgaggctgggaa

SEQ ID NO: 2714684 - DNA, 16 bp, Homo sapiens
tgagggcatctctgag

SEQ ID NO: 2714685 - DNA, 17 bp, Homo sapiens
tgagggcatctctgagt

SEQ ID NO: 2714686 - DNA, 22 bp, Homo sapiens
tgaggggaggatcactggagcc

SEQ ID NO: 2714687 - DNA, 21 bp, Homo sapiens
tgagggtaataaacttagaat

SEQ ID NO: 2714688 - DNA, 22 bp, Homo sapiens
tgagggtaataaacttagaata

SEQ ID NO: 2714689 - DNA, 12 bp, Homo sapiens
tgaggttaggag

SEQ ID NO: 2714690 - DNA, 21 bp, Homo sapiens
tgagtcacccctctgtccagc

SEQ ID NO: 2714691 - DNA, 13 bp, Homo sapiens
tctcaattttgta

SEQ ID NO: 2714692 - DNA, 16 bp, Homo sapiens
tctcaattttgtattt

SEQ ID NO: 2714693 - DNA, 20 bp, Homo sapiens
tctcacactcctcctgccag

SEQ ID NO: 2714694 - DNA, 12 bp, Homo sapiens
tctcagagcagc

SEQ ID NO: 2714695 - DNA, 14 bp, Homo sapiens
tctcagcagccagc

SEQ ID NO: 2714696 - DNA, 15 bp, Homo sapiens
tctcagcagccagct

SEQ ID NO: 2714697 - DNA, 15 bp, Homo sapiens
tctcaggagcatggg

SEQ ID NO: 2714698 - DNA, 23 bp, Homo sapiens
tctcatgcaagacttcactgcag

SEQ ID NO: 2714699 - DNA, 14 bp, Homo sapiens
tctccacctagtgg

SEQ ID NO: 2714700 - DNA, 21 bp, Homo sapiens
tctccacctagtggctgtcca

SEQ ID NO: 2714701 - DNA, 12 bp, Homo sapiens
tctccactccat

SEQ ID NO: 2714702 - DNA, 14 bp, Homo sapiens
tctccactgtttca

SEQ ID NO: 2714703 - DNA, 21 bp, Homo sapiens
tctccagcctcacagatgctg

SEQ ID NO: 2714704 - DNA, 19 bp, Homo sapiens
tctccagggacagaagcag

SEQ ID NO: 2714705 - DNA, 13 bp, Homo sapiens
tctccatgcaagt

SEQ ID NO: 2714706 - DNA, 16 bp, Homo sapiens
tctccatgcaagtgct

SEQ ID NO: 2714707 - DNA, 19 bp, Homo sapiens
tctcccacgtgcacagctt

SEQ ID NO: 2714708 - DNA, 19 bp, Homo sapiens
tctcccagaaggctgggtc

SEQ ID NO: 2714709 - DNA, 21 bp, Homo sapiens
tctcccccccggggctgggtt

SEQ ID NO: 2714710 - DNA, 12 bp, Homo sapiens
tctccccctggg

SEQ ID NO: 2714711 - DNA, 13 bp, Homo sapiens
tctccccctgggc

SEQ ID NO: 2714712 - DNA, 14 bp, Homo sapiens
tctccccctgggct

SEQ ID NO: 2714713 - DNA, 19 bp, Homo sapiens
tctccctgaccttctccag

SEQ ID NO: 2714714 - DNA, 19 bp, Homo sapiens
tctcctcccaccagtggcc

SEQ ID NO: 2714715 - DNA, 18 bp, Homo sapiens
tctcctcccatggccttc

SEQ ID NO: 2714716 - DNA, 23 bp, Homo sapiens
tctcctccctgttatctgctaga

SEQ ID NO: 2714717 - DNA, 20 bp, Homo sapiens
tctcctgcctcagcctcctg

SEQ ID NO: 2714718 - DNA, 21 bp, Homo sapiens
tctccttagaagtggaagtag

SEQ ID NO: 2714719 - DNA, 14 bp, Homo sapiens
tctcgacttcagga

SEQ ID NO: 2714720 - DNA, 19 bp, Homo sapiens
tctcgaggggcgtgtgttc

SEQ ID NO: 2714721 - DNA, 21 bp, Homo sapiens
tctcgccctggccagggcctc

SEQ ID NO: 2714722 - DNA, 18 bp, Homo sapiens
tctcgctgatgctgggct

SEQ ID NO: 2714723 - DNA, 22 bp, Homo sapiens
tctcgctgatgctgggctgggt

SEQ ID NO: 2714724 - DNA, 15 bp, Homo sapiens
tctcggcttcaccag

SEQ ID NO: 2714725 - DNA, 20 bp, Homo sapiens
tctcgtggtagaagccagta

SEQ ID NO: 2714726 - DNA, 11 bp, Homo sapiens
tctctccagcc

SEQ ID NO: 2714727 - DNA, 16 bp, Homo sapiens
tctctccagcctcaca

SEQ ID NO: 2714728 - DNA, 18 bp, Homo sapiens
tctctccagcctcacaga

SEQ ID NO: 2714729 - DNA, 24 bp, Homo sapiens
tctctccagcctcacagatgctgg

SEQ ID NO: 2714730 - DNA, 16 bp, Homo sapiens
tctctctaacataaca

SEQ ID NO: 2714731 - DNA, 20 bp, Homo sapiens
tctctctactcctacctcag

SEQ ID NO: 2714732 - DNA, 14 bp, Homo sapiens
tctctctgcctgct

SEQ ID NO: 2714733 - DNA, 17 bp, Homo sapiens
tctctctgcctgctggg

SEQ ID NO: 2714734 - DNA, 11 bp, Homo sapiens
tctctctgctc

SEQ ID NO: 2714735 - DNA, 13 bp, Homo sapiens
tctctctgctcag

SEQ ID NO: 2714736 - DNA, 13 bp, Homo sapiens
tctctctgttaaa

SEQ ID NO: 2714737 - DNA, 15 bp, Homo sapiens
tctctctgttaaaga

SEQ ID NO: 2714738 - DNA, 17 bp, Homo sapiens
tctctctgttaaagatc

SEQ ID NO: 2714739 - DNA, 11 bp, Homo sapiens
tctctctttcc

SEQ ID NO: 2714740 - DNA, 16 bp, Homo sapiens
tctctgagtgtctctg

SEQ ID NO: 2714741 - DNA, 19 bp, Homo sapiens
tctctgagtgtctctgcct

SEQ ID NO: 2714742 - DNA, 21 bp, Homo sapiens
tctctgagtgtctctgcctgg

SEQ ID NO: 2714743 - DNA, 22 bp, Homo sapiens
tctctgagtgtctctgcctgga

SEQ ID NO: 2714744 - DNA, 14 bp, Homo sapiens
tctctgcctgctgg

SEQ ID NO: 2714745 - DNA, 15 bp, Homo sapiens
tctctgcctgctggg

SEQ ID NO: 2714746 - DNA, 13 bp, Homo sapiens
tctctgcctgctt

SEQ ID NO: 2714747 - DNA, 15 bp, Homo sapiens
tctctgcctggagca

SEQ ID NO: 2714748 - DNA, 19 bp, Homo sapiens
tctctgcctggagcagggg

SEQ ID NO: 2714749 - DNA, 22 bp, Homo sapiens
tctctgcttactaatgtgcccc

SEQ ID NO: 2714750 - DNA, 18 bp, Homo sapiens
tctctgcttggcttcccc

SEQ ID NO: 2714751 - DNA, 11 bp, Homo sapiens
tctctgttcta

SEQ ID NO: 2714752 - DNA, 19 bp, Homo sapiens
tctcttgccccaaatcaca

SEQ ID NO: 2714753 - DNA, 16 bp, Homo sapiens
tctcttggacattgta

SEQ ID NO: 2714754 - DNA, 19 bp, Homo sapiens
tctgaaggagattttcctt

SEQ ID NO: 2714755 - DNA, 18 bp, Homo sapiens
tctgaatgtcccagaggc

SEQ ID NO: 2714756 - DNA, 12 bp, Homo sapiens
tctgagctgggc

SEQ ID NO: 2714757 - DNA, 22 bp, Homo sapiens
tctgaggagtggagttctctgt

SEQ ID NO: 2714758 - DNA, 18 bp, Homo sapiens
tctgaggccccaggccct

SEQ ID NO: 2714759 - DNA, 15 bp, Homo sapiens
tctgagtgtctctgc

SEQ ID NO: 2714760 - DNA, 19 bp, Homo sapiens
tctgagtgtctctgcctgg

SEQ ID NO: 2714761 - DNA, 21 bp, Homo sapiens
tctgagtgtctctgcctggag

SEQ ID NO: 2714762 - DNA, 22 bp, Homo sapiens
tctgagtgtctctgcctggagc

SEQ ID NO: 2714763 - DNA, 11 bp, Homo sapiens
tctgattccac

SEQ ID NO: 2714764 - DNA, 13 bp, Homo sapiens
tctgcaacatgga

SEQ ID NO: 2714765 - DNA, 22 bp, Homo sapiens
tctgcaacatggattccaaagc

SEQ ID NO: 2714766 - DNA, 21 bp, Homo sapiens
tctgcacccagggtcccagcc

SEQ ID NO: 2714767 - DNA, 20 bp, Homo sapiens
tctgcagatagtgcctctgc

SEQ ID NO: 2714768 - DNA, 13 bp, Homo sapiens
tctgcagggagca

SEQ ID NO: 2714769 - DNA, 16 bp, Homo sapiens
tctgcagggagcaact

SEQ ID NO: 2714770 - DNA, 22 bp, Homo sapiens
tctgcattcacagcgcctcctg

SEQ ID NO: 2714771 - DNA, 16 bp, Homo sapiens
tctgcccagcctgccc

SEQ ID NO: 2714772 - DNA, 19 bp, Homo sapiens
tctgcccagcctgccccag

SEQ ID NO: 2714773 - DNA, 12 bp, Homo sapiens
tctgcccaggac

SEQ ID NO: 2714774 - DNA, 14 bp, Homo sapiens
tctgccccagctct

SEQ ID NO: 2714775 - DNA, 12 bp, Homo sapiens
tctgcctcatcc

SEQ ID NO: 2714776 - DNA, 22 bp, Homo sapiens
tctgcctcatcctcctcctcat

SEQ ID NO: 2714777 - DNA, 19 bp, Homo sapiens
tctgcctctaactccctcc

SEQ ID NO: 2714778 - DNA, 22 bp, Homo sapiens
tctgcctctaactccctcctca

SEQ ID NO: 2714779 - DNA, 23 bp, Homo sapiens
tctgcctctaactccctcctcac

SEQ ID NO: 2714780 - DNA, 15 bp, Homo sapiens
tctgcctgagattct

SEQ ID NO: 2714781 - DNA, 11 bp, Homo sapiens
tctgcctgctg

SEQ ID NO: 2714782 - DNA, 17 bp, Homo sapiens
tctgcctgcttcctgga

SEQ ID NO: 2714783 - DNA, 15 bp, Homo sapiens
tctgcctggagcagg

SEQ ID NO: 2714784 - DNA, 15 bp, Homo sapiens
tctgcgtctgtgttg

SEQ ID NO: 2714785 - DNA, 16 bp, Homo sapiens
tctgctcgggcccagg

SEQ ID NO: 2714786 - DNA, 17 bp, Homo sapiens
tctgctgggctggggcc

SEQ ID NO: 2714787 - DNA, 15 bp, Homo sapiens
tctgcttttcctgtc

SEQ ID NO: 2714788 - DNA, 17 bp, Homo sapiens
tctgcttttcctgtctg

SEQ ID NO: 2714789 - DNA, 13 bp, Homo sapiens
tctggacagcttg

SEQ ID NO: 2714790 - DNA, 18 bp, Homo sapiens
tctggcaaacatgtgcaa

SEQ ID NO: 2714791 - DNA, 12 bp, Homo sapiens
tctggcacccag

SEQ ID NO: 2714792 - DNA, 15 bp, Homo sapiens
tctggccacactggg

SEQ ID NO: 2714793 - DNA, 16 bp, Homo sapiens
tctggctcagctgtgg

SEQ ID NO: 2714794 - DNA, 17 bp, Homo sapiens
tctggctcagctgtggt

SEQ ID NO: 2714795 - DNA, 19 bp, Homo sapiens
tctggctcagctgtggtcc

SEQ ID NO: 2714796 - DNA, 21 bp, Homo sapiens
tctggctcagctgtggtccca

SEQ ID NO: 2714797 - DNA, 15 bp, Homo sapiens
tctggctttgttctt

SEQ ID NO: 2714798 - DNA, 19 bp, Homo sapiens
tctggctttgttcttgtca

SEQ ID NO: 2714799 - DNA, 12 bp, Homo sapiens
tctgggccaagt

SEQ ID NO: 2714800 - DNA, 19 bp, Homo sapiens
tctgggccaagttcctcta

SEQ ID NO: 2714801 - DNA, 15 bp, Homo sapiens
tctggggcagggtta

SEQ ID NO: 2714802 - DNA, 19 bp, Homo sapiens
tctgggtgatttctagaat

SEQ ID NO: 2714803 - DNA, 23 bp, Homo sapiens
tctgggtttacaacaaacactgt

SEQ ID NO: 2714804 - DNA, 17 bp, Homo sapiens
tctgtatataacttatt

SEQ ID NO: 2714805 - DNA, 19 bp, Homo sapiens
tctgtatgtgacaacattt

SEQ ID NO: 2714806 - DNA, 16 bp, Homo sapiens
tctgtcacccaggctg

SEQ ID NO: 2714807 - DNA, 17 bp, Homo sapiens
tctgtcacccaggctgg

SEQ ID NO: 2714808 - DNA, 14 bp, Homo sapiens
tctgtcaccctggc

SEQ ID NO: 2714809 - DNA, 15 bp, Homo sapiens
tctgtcaccctggcc

SEQ ID NO: 2714810 - DNA, 17 bp, Homo sapiens
tctgtcaccctggccac

SEQ ID NO: 2714811 - DNA, 21 bp, Homo sapiens
tctgtcaccctggccaccacc

SEQ ID NO: 2714812 - DNA, 12 bp, Homo sapiens
tctgtccaaccc

SEQ ID NO: 2714813 - DNA, 13 bp, Homo sapiens
tctgtccaacccc

SEQ ID NO: 2714814 - DNA, 17 bp, Homo sapiens
tctgtccaacccctccc

SEQ ID NO: 2714815 - DNA, 20 bp, Homo sapiens
tctgtccatcctcctctcca

SEQ ID NO: 2714816 - DNA, 15 bp, Homo sapiens
tctttgcatggaatt

SEQ ID NO: 2714817 - DNA, 14 bp, Homo sapiens
tctttgctacaata

SEQ ID NO: 2714818 - DNA, 19 bp, Homo sapiens
tctttgctacaataaatgc

SEQ ID NO: 2714819 - DNA, 23 bp, Homo sapiens
tctttgctgctgtggaaaggatt

SEQ ID NO: 2714820 - DNA, 13 bp, Homo sapiens
tctttggcttcag

SEQ ID NO: 2714821 - DNA, 16 bp, Homo sapiens
tctttggtgaacattg

SEQ ID NO: 2714822 - DNA, 13 bp, Homo sapiens
tcttttaaaaatg

SEQ ID NO: 2714823 - DNA, 18 bp, Homo sapiens
tcttttacatacagtgat

SEQ ID NO: 2714824 - DNA, 14 bp, Homo sapiens
tcttttgtaaatga

SEQ ID NO: 2714825 - DNA, 17 bp, Homo sapiens
tcttttgtaaatgagac

SEQ ID NO: 2714826 - DNA, 23 bp, Homo sapiens
tctttttttttttttttaaagaa

SEQ ID NO: 2714827 - DNA, 18 bp, Homo sapiens
tgaaaaacacggcagctg

SEQ ID NO: 2714828 - DNA, 12 bp, Homo sapiens
tgaaaaatgagc

SEQ ID NO: 2714829 - DNA, 17 bp, Homo sapiens
tgaaaacattgatgaat

SEQ ID NO: 2714830 - DNA, 15 bp, Homo sapiens
tgaaaacccctggct

SEQ ID NO: 2714831 - DNA, 17 bp, Homo sapiens
tgaaaactaaggatttt

SEQ ID NO: 2714832 - DNA, 11 bp, Homo sapiens
tgaaaagccat

SEQ ID NO: 2714833 - DNA, 16 bp, Homo sapiens
tgaaaatttgcctttg

SEQ ID NO: 2714834 - DNA, 21 bp, Homo sapiens
tgaaagaattctattttgctg

SEQ ID NO: 2714835 - DNA, 13 bp, Homo sapiens
tgaaagacatcaa

SEQ ID NO: 2714836 - DNA, 14 bp, Homo sapiens
tgaaagacatcaat

SEQ ID NO: 2714837 - DNA, 15 bp, Homo sapiens
tgaaagacatcaatg

SEQ ID NO: 2714838 - DNA, 21 bp, Homo sapiens
tgaaagagagtaccatgctgg

SEQ ID NO: 2714839 - DNA, 15 bp, Homo sapiens
tgaaagtcagatgcc

SEQ ID NO: 2714840 - DNA, 16 bp, Homo sapiens
gtcgctggacaaccca

SEQ ID NO: 2714841 - DNA, 17 bp, Homo sapiens
gtcggcacgtcccatgt

SEQ ID NO: 2714842 - DNA, 20 bp, Homo sapiens
gtcgtagccaaggtgggctg

SEQ ID NO: 2714843 - DNA, 17 bp, Homo sapiens
gtcgtgtctgctgttgt

SEQ ID NO: 2714844 - DNA, 11 bp, Homo sapiens
gtctaaagttt

SEQ ID NO: 2714845 - DNA, 17 bp, Homo sapiens
gtctaaagtttacagta

SEQ ID NO: 2714846 - DNA, 19 bp, Homo sapiens
gtctagcagagcaggggca

SEQ ID NO: 2714847 - DNA, 17 bp, Homo sapiens
gtctcaattttgtattt

SEQ ID NO: 2714848 - DNA, 12 bp, Homo sapiens
gtctcacactcc

SEQ ID NO: 2714849 - DNA, 17 bp, Homo sapiens
gtctcccctgatccaga

SEQ ID NO: 2714850 - DNA, 13 bp, Homo sapiens
gtctccctggccc

SEQ ID NO: 2714851 - DNA, 18 bp, Homo sapiens
gtctccctggccctcaag

SEQ ID NO: 2714852 - DNA, 19 bp, Homo sapiens
gtctcgaactcctgacctc

SEQ ID NO: 2714853 - DNA, 13 bp, Homo sapiens
gtctcgctctgct

SEQ ID NO: 2714854 - DNA, 19 bp, Homo sapiens
gtctcgctgatgctgggct

SEQ ID NO: 2714855 - DNA, 19 bp, Homo sapiens
gtctctccagcctcacaga

SEQ ID NO: 2714856 - DNA, 13 bp, Homo sapiens
gtctctctgcctg

SEQ ID NO: 2714857 - DNA, 20 bp, Homo sapiens
gtctctctgcctgctgggct

SEQ ID NO: 2714858 - DNA, 20 bp, Homo sapiens
gtctctgcctggagcagggg

SEQ ID NO: 2714859 - DNA, 23 bp, Homo sapiens
gtctctgggtttacaacaaacac

SEQ ID NO: 2714860 - DNA, 23 bp, Homo sapiens
gtctctgtcccggttcaccttgc

SEQ ID NO: 2714861 - DNA, 15 bp, Homo sapiens
gtctctgttgtaaat

SEQ ID NO: 2714862 - DNA, 19 bp, Homo sapiens
gtctgaggccccaggccct

SEQ ID NO: 2714863 - DNA, 16 bp, Homo sapiens
gtctgcagctcctgga

SEQ ID NO: 2714864 - DNA, 18 bp, Homo sapiens
gtctgcatcagctttttg

SEQ ID NO: 2714865 - DNA, 20 bp, Homo sapiens
gtctgcatcagctttttgta

SEQ ID NO: 2714866 - DNA, 21 bp, Homo sapiens
gtctgcatcagctttttgtat

SEQ ID NO: 2714867 - DNA, 17 bp, Homo sapiens
gtctgctatattttcat

SEQ ID NO: 2714868 - DNA, 17 bp, Homo sapiens
gtctgctcgggcccagg

SEQ ID NO: 2714869 - DNA, 21 bp, Homo sapiens
gtctgctcgggcccaggccat

SEQ ID NO: 2714870 - DNA, 17 bp, Homo sapiens
gtctgctcttatttttg

SEQ ID NO: 2714871 - DNA, 19 bp, Homo sapiens
gtctggcaaacatgtgcaa

SEQ ID NO: 2714872 - DNA, 21 bp, Homo sapiens
taaaccttgtttctttctgaa

SEQ ID NO: 2714873 - DNA, 19 bp, Homo sapiens
taaacttagaataaaattg

SEQ ID NO: 2714874 - DNA, 17 bp, Homo sapiens
taaagaaaatcaatgaa

SEQ ID NO: 2714875 - DNA, 14 bp, Homo sapiens
taaagaaacactaa

SEQ ID NO: 2714876 - DNA, 23 bp, Homo sapiens
taaagaaacactaaattagttta

SEQ ID NO: 2714877 - DNA, 13 bp, Homo sapiens
taaagagaaaaat

SEQ ID NO: 2714878 - DNA, 17 bp, Homo sapiens
taaaggacaaacagtga

SEQ ID NO: 2714879 - DNA, 21 bp, Homo sapiens
taaaggacaaacagtgaattt

SEQ ID NO: 2714880 - DNA, 21 bp, Homo sapiens
taaaggtttcactgttcatga

SEQ ID NO: 2714881 - DNA, 12 bp, Homo sapiens
taaataaattgt

SEQ ID NO: 2714882 - DNA, 20 bp, Homo sapiens
taaataaattgtttgaccat

SEQ ID NO: 2714883 - DNA, 16 bp, Homo sapiens
taaatatagttgtctt

SEQ ID NO: 2714884 - DNA, 14 bp, Homo sapiens
taaatatatattta

SEQ ID NO: 2714885 - DNA, 18 bp, Homo sapiens
taaatatatatttatcat

SEQ ID NO: 2714886 - DNA, 13 bp, Homo sapiens
taaatatgtgaaa

SEQ ID NO: 2714887 - DNA, 22 bp, Homo sapiens
taaatattggtttgttattctt

SEQ ID NO: 2714888 - DNA, 22 bp, Homo sapiens
taaatcccaagtgtctcttgac

SEQ ID NO: 2714889 - DNA, 20 bp, Homo sapiens
taaatgaagggtcatttctc

SEQ ID NO: 2714890 - DNA, 21 bp, Homo sapiens
taaatgaagggtcatttctct

SEQ ID NO: 2714891 - DNA, 19 bp, Homo sapiens
gcctatcagtgtgcccccc

SEQ ID NO: 2714892 - DNA, 14 bp, Homo sapiens
gcctcacagatgct

SEQ ID NO: 2714893 - DNA, 16 bp, Homo sapiens
gcctcacagatgctgg

SEQ ID NO: 2714894 - DNA, 18 bp, Homo sapiens
gcctcacagatgctggcc

SEQ ID NO: 2714895 - DNA, 20 bp, Homo sapiens
gcctcacagatgctggcctc

SEQ ID NO: 2714896 - DNA, 17 bp, Homo sapiens
gcctcagccagccctgg

SEQ ID NO: 2714897 - DNA, 18 bp, Homo sapiens
gcctcagccagccctgga

SEQ ID NO: 2714898 - DNA, 14 bp, Homo sapiens
gcctcagcctcctg

SEQ ID NO: 2714899 - DNA, 15 bp, Homo sapiens
gcctcagcctcctga

SEQ ID NO: 2714900 - DNA, 13 bp, Homo sapiens
gcctcatcctcct

SEQ ID NO: 2714901 - DNA, 19 bp, Homo sapiens
gcctcatcctcctcctcat

SEQ ID NO: 2714902 - DNA, 13 bp, Homo sapiens
gcctcatctgctc

SEQ ID NO: 2714903 - DNA, 23 bp, Homo sapiens
gcctcatctgctcctagcccagc

SEQ ID NO: 2714904 - DNA, 12 bp, Homo sapiens
gcctcatgcccc

SEQ ID NO: 2714905 - DNA, 15 bp, Homo sapiens
gcctccactcccact

SEQ ID NO: 2714906 - DNA, 16 bp, Homo sapiens
gcctccactcccactt

SEQ ID NO: 2714907 - DNA, 18 bp, Homo sapiens
gcctccactcccacttcc

SEQ ID NO: 2714908 - DNA, 21 bp, Homo sapiens
gcctccactcccacttccctg

SEQ ID NO: 2714909 - DNA, 14 bp, Homo sapiens
gcctccagtgctgg

SEQ ID NO: 2714910 - DNA, 17 bp, Homo sapiens
gcctccagtgctggctg

SEQ ID NO: 2714911 - DNA, 23 bp, Homo sapiens
gcctcccacagtgactcgggctc

SEQ ID NO: 2714912 - DNA, 22 bp, Homo sapiens
gcctcccgggaagcatcctccc

SEQ ID NO: 2714913 - DNA, 23 bp, Homo sapiens
gcctcccgggaagcatcctcccc

SEQ ID NO: 2714914 - DNA, 14 bp, Homo sapiens
gcctccctctgacc

SEQ ID NO: 2714915 - DNA, 20 bp, Homo sapiens
gcctccctctgacctgcagg

SEQ ID NO: 2714916 - DNA, 16 bp, Homo sapiens
gcctccctggtccctt

SEQ ID NO: 2714917 - DNA, 22 bp, Homo sapiens
gcctcctgaaagtcatttaaaa

SEQ ID NO: 2714918 - DNA, 20 bp, Homo sapiens
gcctcctgagtagctgggac

SEQ ID NO: 2714919 - DNA, 21 bp, Homo sapiens
gcctcctgagtagctgggact

SEQ ID NO: 2714920 - DNA, 23 bp, Homo sapiens
gcctcctgagtagctgggactac

SEQ ID NO: 2714921 - DNA, 21 bp, Homo sapiens
gcctccttcttaactctgcag

SEQ ID NO: 2714922 - DNA, 14 bp, Homo sapiens
gcctccttttggtt

SEQ ID NO: 2714923 - DNA, 14 bp, Homo sapiens
gcctcgcctggcct

SEQ ID NO: 2714924 - DNA, 16 bp, Homo sapiens
gcctcggaggctcctc

SEQ ID NO: 2714925 - DNA, 19 bp, Homo sapiens
gcctcggaggctcctccct

SEQ ID NO: 2714926 - DNA, 21 bp, Homo sapiens
gcctcggaggctcctccctct

SEQ ID NO: 2714927 - DNA, 22 bp, Homo sapiens
gcctcggaggctcctccctctg

SEQ ID NO: 2714928 - DNA, 23 bp, Homo sapiens
gcctcggcctcccaaagtgctgg

SEQ ID NO: 2714929 - DNA, 15 bp, Homo sapiens
gcctcggctcctgct

SEQ ID NO: 2714930 - DNA, 14 bp, Homo sapiens
gcctcgtccaaggc

SEQ ID NO: 2714931 - DNA, 14 bp, Homo sapiens
gcctctaactccct

SEQ ID NO: 2714932 - DNA, 17 bp, Homo sapiens
gcctctaactccctcct

SEQ ID NO: 2714933 - DNA, 18 bp, Homo sapiens
gcctctaactccctcctc

SEQ ID NO: 2714934 - DNA, 19 bp, Homo sapiens
gcctctaactccctcctca

SEQ ID NO: 2714935 - DNA, 18 bp, Homo sapiens
gcctctagaacacccact

SEQ ID NO: 2714936 - DNA, 20 bp, Homo sapiens
gcctctagaacacccactgg

SEQ ID NO: 2714937 - DNA, 22 bp, Homo sapiens
gcctctagaacacccactggcc

SEQ ID NO: 2714938 - DNA, 23 bp, Homo sapiens
gcctctagaacacccactggcca

SEQ ID NO: 2714939 - DNA, 17 bp, Homo sapiens
gcctctgcccagcctgc

SEQ ID NO: 2714940 - DNA, 11 bp, Homo sapiens
gcctctgctgc

SEQ ID NO: 2714941 - DNA, 16 bp, Homo sapiens
gcctctgtgtcactgg

SEQ ID NO: 2714942 - DNA, 12 bp, Homo sapiens
gcctcttggcac

SEQ ID NO: 2714943 - DNA, 16 bp, Homo sapiens
gcctcttggcacctgc

SEQ ID NO: 2714944 - DNA, 23 bp, Homo sapiens
gcctcttggcacctgcctagctc

SEQ ID NO: 2714945 - DNA, 19 bp, Homo sapiens
gcctgacctccagtcctgc

SEQ ID NO: 2714946 - DNA, 23 bp, Homo sapiens
gcctgacctccagtcctgctggc

SEQ ID NO: 2714947 - DNA, 19 bp, Homo sapiens
gcctgagattctttaagga

SEQ ID NO: 2714948 - DNA, 22 bp, Homo sapiens
gcctgagattctttaaggagat

SEQ ID NO: 2714949 - DNA, 17 bp, Homo sapiens
gcctgatggggagggtc

SEQ ID NO: 2714950 - DNA, 17 bp, Homo sapiens
gcctgattcggctgtct

SEQ ID NO: 2714951 - DNA, 20 bp, Homo sapiens
gcctgattcggctgtctcag

SEQ ID NO: 2714952 - DNA, 16 bp, Homo sapiens
gcctgcctgggcctcc

SEQ ID NO: 2714953 - DNA, 17 bp, Homo sapiens
gcctgcctgggcctccc

SEQ ID NO: 2714954 - DNA, 16 bp, Homo sapiens
gcctgccttgaagcca

SEQ ID NO: 2714955 - DNA, 14 bp, Homo sapiens
gcctgctctgcttt

SEQ ID NO: 2714956 - DNA, 11 bp, Homo sapiens
gcctgctgggc

SEQ ID NO: 2714957 - DNA, 13 bp, Homo sapiens
gcctgctgggctc

SEQ ID NO: 2714958 - DNA, 14 bp, Homo sapiens
gcctgctgggctct

SEQ ID NO: 2714959 - DNA, 16 bp, Homo sapiens
gcctgcttcctggacc

SEQ ID NO: 2714960 - DNA, 15 bp, Homo sapiens
gcctggagcaggggt

SEQ ID NO: 2714961 - DNA, 17 bp, Homo sapiens
gcctggagcaggggtgg

SEQ ID NO: 2714962 - DNA, 15 bp, Homo sapiens
gcctggcaaggcctc

SEQ ID NO: 2714963 - DNA, 22 bp, Homo sapiens
gcctggcttctggagcccttgg

SEQ ID NO: 2714964 - DNA, 12 bp, Homo sapiens
gcctgggcctcc

SEQ ID NO: 2714965 - DNA, 18 bp, Homo sapiens
gcctgggcgacagagcaa

SEQ ID NO: 2714966 - DNA, 12 bp, Homo sapiens
gcctgtcctggt

SEQ ID NO: 2714967 - DNA, 20 bp, Homo sapiens
gcctgtctgtccaacccctc

SEQ ID NO: 2714968 - DNA, 14 bp, Homo sapiens
gcctgttctccaga

SEQ ID NO: 2714969 - DNA, 13 bp, Homo sapiens
gccttaataaata

SEQ ID NO: 2714970 - DNA, 16 bp, Homo sapiens
gccttatgagaacatg

SEQ ID NO: 2714971 - DNA, 21 bp, Homo sapiens
gccttatgagaacatggtgtg

SEQ ID NO: 2714972 - DNA, 23 bp, Homo sapiens
gccttccccctcccagggccagg

SEQ ID NO: 2714973 - DNA, 16 bp, Homo sapiens
gccttccctccccaca

SEQ ID NO: 2714974 - DNA, 17 bp, Homo sapiens
gccttctcccccccggg

SEQ ID NO: 2714975 - DNA, 23 bp, Homo sapiens
gccttctcccccccggggctggg

SEQ ID NO: 2714976 - DNA, 21 bp, Homo sapiens
gccttggtcccagacagctgg

SEQ ID NO: 2714977 - DNA, 23 bp, Homo sapiens
gccttggtcccagacagctggac

SEQ ID NO: 2714978 - DNA, 12 bp, Homo sapiens
gccttgtgtaca

SEQ ID NO: 2714979 - DNA, 23 bp, Homo sapiens
gcctttaccctcctctatttctt

SEQ ID NO: 2714980 - DNA, 20 bp, Homo sapiens
gcctttcacaggactctgca

SEQ ID NO: 2714981 - DNA, 22 bp, Homo sapiens
gcctttctcgtggtagaagcca

SEQ ID NO: 2714982 - DNA, 12 bp, Homo sapiens
gcgacagagcaa

SEQ ID NO: 2714983 - DNA, 16 bp, Homo sapiens
gcgaccagggccatct

SEQ ID NO: 2714984 - DNA, 14 bp, Homo sapiens
gcgaccccatctgc

SEQ ID NO: 2714985 - DNA, 16 bp, Homo sapiens
gcgaccccatctgccc

SEQ ID NO: 2714986 - DNA, 17 bp, Homo sapiens
gcgaccccatctgccca

SEQ ID NO: 2714987 - DNA, 19 bp, Homo sapiens
gcgaccccatctgcccagg

SEQ ID NO: 2714988 - DNA, 16 bp, Homo sapiens
gcgagattgggcctcc

SEQ ID NO: 2714989 - DNA, 19 bp, Homo sapiens
gcgatgaatttggagactc

SEQ ID NO: 2714990 - DNA, 13 bp, Homo sapiens
gcgcaccctcccc

SEQ ID NO: 2714991 - DNA, 15 bp, Homo sapiens
gcgcaccctcccctc

SEQ ID NO: 2714992 - DNA, 18 bp, Homo sapiens
gcgcacctgccccctggt

SEQ ID NO: 2714993 - DNA, 16 bp, Homo sapiens
gcgccacggcactcca

SEQ ID NO: 2714994 - DNA, 19 bp, Homo sapiens
gcgcccagccaagaataaa

SEQ ID NO: 2714995 - DNA, 16 bp, Homo sapiens
gcgccctctgtcctga

SEQ ID NO: 2714996 - DNA, 22 bp, Homo sapiens
gcgcctccttccttgctgtcct

SEQ ID NO: 2714997 - DNA, 13 bp, Homo sapiens
gcgccttctcccc

SEQ ID NO: 2714998 - DNA, 13 bp, Homo sapiens
gcggagcagcctc

SEQ ID NO: 2714999 - DNA, 21 bp, Homo sapiens
gcgggatcccagcatctcaga

SEQ ID NO: 2715000 - DNA, 17 bp, Homo sapiens
gcgggatggtcctgggg

SEQ ID NO: 2715001 - DNA, 20 bp, Homo sapiens
gcgggcacctatagtcccag

SEQ ID NO: 2715002 - DNA, 16 bp, Homo sapiens
gcgggcagcacagcaa

SEQ ID NO: 2715003 - DNA, 16 bp, Homo sapiens
gcgggctgagggcatc

SEQ ID NO: 2715004 - DNA, 15 bp, Homo sapiens
gcggtgtctgcagct

SEQ ID NO: 2715005 - DNA, 15 bp, Homo sapiens
gcgtctgccccaccc

SEQ ID NO: 2715006 - DNA, 17 bp, Homo sapiens
gcgtctgccccaccctc

SEQ ID NO: 2715007 - DNA, 18 bp, Homo sapiens
gcgtgattcctgctgcct

SEQ ID NO: 2715008 - DNA, 13 bp, Homo sapiens
gcgtgattctgtt

SEQ ID NO: 2715009 - DNA, 16 bp, Homo sapiens
gcgtggggcagcagct

SEQ ID NO: 2715010 - DNA, 18 bp, Homo sapiens
gctaacgtttatttaaaa

SEQ ID NO: 2715011 - DNA, 17 bp, Homo sapiens
gctacaaaccaggagca

SEQ ID NO: 2715012 - DNA, 12 bp, Homo sapiens
gctacaataaat

SEQ ID NO: 2715013 - DNA, 14 bp, Homo sapiens
gctacaataaatgc

SEQ ID NO: 2715014 - DNA, 16 bp, Homo sapiens
gctaccctccctgctg

SEQ ID NO: 2715015 - DNA, 18 bp, Homo sapiens
ggaccccagctagggctg

SEQ ID NO: 2715016 - DNA, 20 bp, Homo sapiens
ggaccccagctagggctgga

SEQ ID NO: 2715017 - DNA, 17 bp, Homo sapiens
ggaccgcgtagagagcc

SEQ ID NO: 2715018 - DNA, 18 bp, Homo sapiens
ggaccggggccttggtcc

SEQ ID NO: 2715019 - DNA, 16 bp, Homo sapiens
ggacctggactagggc

SEQ ID NO: 2715020 - DNA, 17 bp, Homo sapiens
ggacctttcagctgtga

SEQ ID NO: 2715021 - DNA, 16 bp, Homo sapiens
ggacggggccggccag

SEQ ID NO: 2715022 - DNA, 14 bp, Homo sapiens
ggacgttggttctg

SEQ ID NO: 2715023 - DNA, 14 bp, Homo sapiens
ggactcagactcct

SEQ ID NO: 2715024 - DNA, 19 bp, Homo sapiens
ggactcagactcctggctt

SEQ ID NO: 2715025 - DNA, 21 bp, Homo sapiens
ggactcagactcctggcttca

SEQ ID NO: 2715026 - DNA, 24 bp, Homo sapiens
ggactcagactcctggcttcatgt

SEQ ID NO: 2715027 - DNA, 23 bp, Homo sapiens
ggactctctgcctgcttcctgga

SEQ ID NO: 2715028 - DNA, 13 bp, Homo sapiens
ggactctgaggct

SEQ ID NO: 2715029 - DNA, 22 bp, Homo sapiens
ggactctgcagatagtgcctct

SEQ ID NO: 2715030 - DNA, 14 bp, Homo sapiens
ggactgctgaccca

SEQ ID NO: 2715031 - DNA, 15 bp, Homo sapiens
ggactggccgtggct

SEQ ID NO: 2715032 - DNA, 18 bp, Homo sapiens
ggactggccgtggctcca

SEQ ID NO: 2715033 - DNA, 21 bp, Homo sapiens
ggactggccgtggctccagaa

SEQ ID NO: 2715034 - DNA, 20 bp, Homo sapiens
ggactggggcttgccaggct

SEQ ID NO: 2715035 - DNA, 15 bp, Homo sapiens
ggactggtgatggga

SEQ ID NO: 2715036 - DNA, 17 bp, Homo sapiens
ggactggtgatgggaca

SEQ ID NO: 2715037 - DNA, 16 bp, Homo sapiens
ggactgttctcacctt

SEQ ID NO: 2715038 - DNA, 17 bp, Homo sapiens
ggagaaggcctcccctg

SEQ ID NO: 2715039 - DNA, 18 bp, Homo sapiens
ggagaaggcctcccctga

SEQ ID NO: 2715040 - DNA, 20 bp, Homo sapiens
ggagaaggtcccgaggatgc

SEQ ID NO: 2715041 - DNA, 19 bp, Homo sapiens
ggagagaagtggccagggc

SEQ ID NO: 2715042 - DNA, 13 bp, Homo sapiens
ggagagcagctgg

SEQ ID NO: 2715043 - DNA, 14 bp, Homo sapiens
ggagattgctctgg

SEQ ID NO: 2715044 - DNA, 16 bp, Homo sapiens
ggagattttccttcct

SEQ ID NO: 2715045 - DNA, 16 bp, Homo sapiens
ggagcagcctccagtg

SEQ ID NO: 2715046 - DNA, 14 bp, Homo sapiens
ggagccagccagga

SEQ ID NO: 2715047 - DNA, 13 bp, Homo sapiens
ggagcccttgggt

SEQ ID NO: 2715048 - DNA, 22 bp, Homo sapiens
ggagcctgaaccgtgtgctcct

SEQ ID NO: 2715049 - DNA, 15 bp, Homo sapiens
ggagcgcacctgccc

SEQ ID NO: 2715050 - DNA, 23 bp, Homo sapiens
ggagcgcacctgccccctggtgg

SEQ ID NO: 2715051 - DNA, 14 bp, Homo sapiens
ggagctgacagagc

SEQ ID NO: 2715052 - DNA, 12 bp, Homo sapiens
ggagctgaggcc

SEQ ID NO: 2715053 - DNA, 22 bp, Homo sapiens
ggagctggcaatgccctacctg

SEQ ID NO: 2715054 - DNA, 19 bp, Homo sapiens
ggaggaagcaggttgaggg

SEQ ID NO: 2715055 - DNA, 14 bp, Homo sapiens
ggaggacagagccg

SEQ ID NO: 2715056 - DNA, 22 bp, Homo sapiens
ggaggacggttgtaagcagttg

SEQ ID NO: 2715057 - DNA, 16 bp, Homo sapiens
ggaggatcactggagc

SEQ ID NO: 2715058 - DNA, 19 bp, Homo sapiens
ggaggatcactggagccca

SEQ ID NO: 2715059 - DNA, 22 bp, Homo sapiens
ggaggatcactggagcccagga

SEQ ID NO: 2715060 - DNA, 12 bp, Homo sapiens
ggaggcaagaac

SEQ ID NO: 2715061 - DNA, 15 bp, Homo sapiens
ggaggctccgtgagc

SEQ ID NO: 2715062 - DNA, 15 bp, Homo sapiens
ggaggctcctccctc

SEQ ID NO: 2715063 - DNA, 16 bp, Homo sapiens
ggaggctcctccctct

SEQ ID NO: 2715064 - DNA, 20 bp, Homo sapiens
ggaggctcctccctctgcct

SEQ ID NO: 2715065 - DNA, 12 bp, Homo sapiens
ggaggctgaggc

SEQ ID NO: 2715066 - DNA, 17 bp, Homo sapiens
ggaggctgaggcaccag

SEQ ID NO: 2715067 - DNA, 15 bp, Homo sapiens
ggaggctggctgggg

SEQ ID NO: 2715068 - DNA, 16 bp, Homo sapiens
ggaggctggctggggc

SEQ ID NO: 2715069 - DNA, 11 bp, Homo sapiens
ggaggcttcag

SEQ ID NO: 2715070 - DNA, 12 bp, Homo sapiens
ggagggagctga

SEQ ID NO: 2715071 - DNA, 17 bp, Homo sapiens
ggagggagctgaggcct

SEQ ID NO: 2715072 - DNA, 18 bp, Homo sapiens
ggagggagctgaggcctc

SEQ ID NO: 2715073 - DNA, 20 bp, Homo sapiens
ggaggtgccggtaccagcct

SEQ ID NO: 2715074 - DNA, 14 bp, Homo sapiens
ggaggttgcagtga

SEQ ID NO: 2715075 - DNA, 16 bp, Homo sapiens
ggaggttgttgcagtg

SEQ ID NO: 2715076 - DNA, 16 bp, Homo sapiens
ggagtctcgctctgct

SEQ ID NO: 2715077 - DNA, 20 bp, Homo sapiens
ggagtcttcactgctctgcc

SEQ ID NO: 2715078 - DNA, 14 bp, Homo sapiens
ggagtgtcctgtct

SEQ ID NO: 2715079 - DNA, 21 bp, Homo sapiens
ggagtgtttgacgaagaaaca

SEQ ID NO: 2715080 - DNA, 14 bp, Homo sapiens
ggataaattacatt

SEQ ID NO: 2715081 - DNA, 21 bp, Homo sapiens
ggatccacgtgctcgcctctg

SEQ ID NO: 2715082 - DNA, 22 bp, Homo sapiens
ggatccacgtgctcgcctctgc

SEQ ID NO: 2715083 - DNA, 14 bp, Homo sapiens
ggatgaaaagccat

SEQ ID NO: 2715084 - DNA, 21 bp, Homo sapiens
ggatgaaaagccatatctagt

SEQ ID NO: 2715085 - DNA, 14 bp, Homo sapiens
ggatggtcctgggg

SEQ ID NO: 2715086 - DNA, 22 bp, Homo sapiens
ggatggtcttgatctcctgagc

SEQ ID NO: 2715087 - DNA, 15 bp, Homo sapiens
ggatgttcagaattt

SEQ ID NO: 2715088 - DNA, 20 bp, Homo sapiens
ggatgttcagaattttggaa

SEQ ID NO: 2715089 - DNA, 22 bp, Homo sapiens
ggattaatggtcctgtgatgct

SEQ ID NO: 2715090 - DNA, 13 bp, Homo sapiens
ggattcccagaga

SEQ ID NO: 2715091 - DNA, 17 bp, Homo sapiens
ggattggccctgcccct

SEQ ID NO: 2715092 - DNA, 22 bp, Homo sapiens
ggattgtgcaatagtcagagtg

SEQ ID NO: 2715093 - DNA, 21 bp, Homo sapiens
ggatttgaggagcagcttcag

SEQ ID NO: 2715094 - DNA, 14 bp, Homo sapiens
ggcaaacatgtgca

SEQ ID NO: 2715095 - DNA, 16 bp, Homo sapiens
ggcaaagaactgcccc

SEQ ID NO: 2715096 - DNA, 16 bp, Homo sapiens
ggcaaagatctcagca

SEQ ID NO: 2715097 - DNA, 13 bp, Homo sapiens
ggcaaccctcagc

SEQ ID NO: 2715098 - DNA, 16 bp, Homo sapiens
ggcaagcgtgctgcct

SEQ ID NO: 2715099 - DNA, 16 bp, Homo sapiens
ggcaaggttcagtctg

SEQ ID NO: 2715100 - DNA, 21 bp, Homo sapiens
ggcaagtatttttatttaaat

SEQ ID NO: 2715101 - DNA, 22 bp, Homo sapiens
ggcaagtccctgactctctgtg

SEQ ID NO: 2715102 - DNA, 22 bp, Homo sapiens
ggcaatgcagtgcagcatggga

SEQ ID NO: 2715103 - DNA, 16 bp, Homo sapiens
ggcacaagctccctgg

SEQ ID NO: 2715104 - DNA, 18 bp, Homo sapiens
ggcacagtgtctgggctg

SEQ ID NO: 2715105 - DNA, 12 bp, Homo sapiens
ggcacctaaact

SEQ ID NO: 2715106 - DNA, 19 bp, Homo sapiens
ggcacctatagtcccagct

SEQ ID NO: 2715107 - DNA, 20 bp, Homo sapiens
ggcacctgcaggttgggcca

SEQ ID NO: 2715108 - DNA, 18 bp, Homo sapiens
ggcacgccaacagccccc

SEQ ID NO: 2715109 - DNA, 19 bp, Homo sapiens
ggcacgccaacagcccccc

SEQ ID NO: 2715110 - DNA, 15 bp, Homo sapiens
ggcacgtcccatgtg

SEQ ID NO: 2715111 - DNA, 22 bp, Homo sapiens
ggcactaaaatgtttaattcat

SEQ ID NO: 2715112 - DNA, 20 bp, Homo sapiens
ggcactgctgggtggcccat

SEQ ID NO: 2715113 - DNA, 21 bp, Homo sapiens
ggcactgctgggtggcccatc

SEQ ID NO: 2715114 - DNA, 15 bp, Homo sapiens
ggcacttaatttttg

SEQ ID NO: 2715115 - DNA, 18 bp, Homo sapiens
ggcagaactgctggggct

SEQ ID NO: 2715116 - DNA, 17 bp, Homo sapiens
ggcagaatcctgggccc

SEQ ID NO: 2715117 - DNA, 21 bp, Homo sapiens
ggcagaatcctgggcccccag

SEQ ID NO: 2715118 - DNA, 19 bp, Homo sapiens
ggcagatttactgtcccag

SEQ ID NO: 2715119 - DNA, 16 bp, Homo sapiens
ggcagcaggtgctgct

SEQ ID NO: 2715120 - DNA, 19 bp, Homo sapiens
ggcagcaggtgctgctacc

SEQ ID NO: 2715121 - DNA, 21 bp, Homo sapiens
ggcagcaggtgctgctaccct

SEQ ID NO: 2715122 - DNA, 13 bp, Homo sapiens
ggcagcctccagt

SEQ ID NO: 2715123 - DNA, 14 bp, Homo sapiens
ggcagcctccagtg

SEQ ID NO: 2715124 - DNA, 12 bp, Homo sapiens
ggcagcctgccg

SEQ ID NO: 2715125 - DNA, 22 bp, Homo sapiens
ggcagcctgccgccgtctctgt

SEQ ID NO: 2715126 - DNA, 19 bp, Homo sapiens
ggcagcgcctgtcccctca

SEQ ID NO: 2715127 - DNA, 14 bp, Homo sapiens
ggcagctccagctg

SEQ ID NO: 2715128 - DNA, 13 bp, Homo sapiens
ggcagctcgagca

SEQ ID NO: 2715129 - DNA, 21 bp, Homo sapiens
ggcagctgaactattggaggg

SEQ ID NO: 2715130 - DNA, 13 bp, Homo sapiens
ggcagctgggccc

SEQ ID NO: 2715131 - DNA, 14 bp, Homo sapiens
ggcagctgggccca

SEQ ID NO: 2715132 - DNA, 20 bp, Homo sapiens
ggcagctgggcccacagccc

SEQ ID NO: 2715133 - DNA, 22 bp, Homo sapiens
ggcagctgggcccacagccccc

SEQ ID NO: 2715134 - DNA, 14 bp, Homo sapiens
ggcaggccctgcac

SEQ ID NO: 2715135 - DNA, 15 bp, Homo sapiens
ggcaggccctgcact

SEQ ID NO: 2715136 - DNA, 16 bp, Homo sapiens
ggcaggccctgcactg

SEQ ID NO: 2715137 - DNA, 23 bp, Homo sapiens
ggcaggggacctggagctgccag

SEQ ID NO: 2715138 - DNA, 15 bp, Homo sapiens
ggcaggtctgggcca

SEQ ID NO: 2715139 - DNA, 15 bp, Homo sapiens
ggctgagggcatctc

SEQ ID NO: 2715140 - DNA, 15 bp, Homo sapiens
ggctgcactctgtgc

SEQ ID NO: 2715141 - DNA, 21 bp, Homo sapiens
ggctgcactctgtgcccatgg

SEQ ID NO: 2715142 - DNA, 13 bp, Homo sapiens
ggctgcccgctcc

SEQ ID NO: 2715143 - DNA, 17 bp, Homo sapiens
ggctgcccgctcccagt

SEQ ID NO: 2715144 - DNA, 21 bp, Homo sapiens
ggctgcccgctcccagtgtct

SEQ ID NO: 2715145 - DNA, 17 bp, Homo sapiens
ggctgcctccactccca

SEQ ID NO: 2715146 - DNA, 19 bp, Homo sapiens
ggctgcctccactcccact

SEQ ID NO: 2715147 - DNA, 20 bp, Homo sapiens
ggctgcctccactcccactt

SEQ ID NO: 2715148 - DNA, 22 bp, Homo sapiens
ggctgctggcccacagctctgc

SEQ ID NO: 2715149 - DNA, 23 bp, Homo sapiens
ggctgctgggggctccccttgcc

SEQ ID NO: 2715150 - DNA, 16 bp, Homo sapiens
ggctggaaggagccag

SEQ ID NO: 2715151 - DNA, 18 bp, Homo sapiens
ggctggcatcctggctgg

SEQ ID NO: 2715152 - DNA, 13 bp, Homo sapiens
ggctggccagccc

SEQ ID NO: 2715153 - DNA, 19 bp, Homo sapiens
ggctggccagccccacagc

SEQ ID NO: 2715154 - DNA, 23 bp, Homo sapiens
ggctggctgtgtcctctccagct

SEQ ID NO: 2715155 - DNA, 20 bp, Homo sapiens
ggctggggcctatcagtgtg

SEQ ID NO: 2715156 - DNA, 22 bp, Homo sapiens
ggctggggcctatcagtgtgcc

SEQ ID NO: 2715157 - DNA, 22 bp, Homo sapiens
ggctgggggcgggggagccaac

SEQ ID NO: 2715158 - DNA, 14 bp, Homo sapiens
ggctggtagcagaa

SEQ ID NO: 2715159 - DNA, 19 bp, Homo sapiens
ggctggtggattgggcaga

SEQ ID NO: 2715160 - DNA, 13 bp, Homo sapiens
ggctgtaaaacta

SEQ ID NO: 2715161 - DNA, 19 bp, Homo sapiens
ggctgtccagtgcccattc

SEQ ID NO: 2715162 - DNA, 19 bp, Homo sapiens
ggctgtcggtgtgctgtca

SEQ ID NO: 2715163 - DNA, 12 bp, Homo sapiens
ggctgtgtcctc

SEQ ID NO: 2715164 - DNA, 19 bp, Homo sapiens
ggctgtgtcctctccagct

SEQ ID NO: 2715165 - DNA, 16 bp, Homo sapiens
ggcttaggtgccaggc

SEQ ID NO: 2715166 - DNA, 17 bp, Homo sapiens
ggcttaggtgccaggct

SEQ ID NO: 2715167 - DNA, 14 bp, Homo sapiens
ggcttcccctccac

SEQ ID NO: 2715168 - DNA, 11 bp, Homo sapiens
ggcttccctgg

SEQ ID NO: 2715169 - DNA, 12 bp, Homo sapiens
ggcttccctggg

SEQ ID NO: 2715170 - DNA, 15 bp, Homo sapiens
ggcttccctgggcct

SEQ ID NO: 2715171 - DNA, 13 bp, Homo sapiens
ggcttctcccgga

SEQ ID NO: 2715172 - DNA, 16 bp, Homo sapiens
ggcttctggagccctt

SEQ ID NO: 2715173 - DNA, 18 bp, Homo sapiens
ggcttctggagcccttgg

SEQ ID NO: 2715174 - DNA, 20 bp, Homo sapiens
ggcttctggagcccttgggt

SEQ ID NO: 2715175 - DNA, 13 bp, Homo sapiens
ggctttctggaga

SEQ ID NO: 2715176 - DNA, 13 bp, Homo sapiens
gggaaaattagct

SEQ ID NO: 2715177 - DNA, 14 bp, Homo sapiens
gggaagagcacagc

SEQ ID NO: 2715178 - DNA, 22 bp, Homo sapiens
gggaagagcacagccctcccgc

SEQ ID NO: 2715179 - DNA, 13 bp, Homo sapiens
gggaagcatcctc

SEQ ID NO: 2715180 - DNA, 12 bp, Homo sapiens
gggaagctgcta

SEQ ID NO: 2715181 - DNA, 13 bp, Homo sapiens
gggaatgggagag

SEQ ID NO: 2715182 - DNA, 23 bp, Homo sapiens
gggaccacagcaaggcacctgca

SEQ ID NO: 2715183 - DNA, 15 bp, Homo sapiens
gggaccactgggccc

SEQ ID NO: 2715184 - DNA, 19 bp, Homo sapiens
gggaccactgggcccctca

SEQ ID NO: 2715185 - DNA, 15 bp, Homo sapiens
gggaccccctcagga

SEQ ID NO: 2715186 - DNA, 17 bp, Homo sapiens
gggactgggccatgggt

SEQ ID NO: 2715187 - DNA, 17 bp, Homo sapiens
gggagaaggcctcccct

SEQ ID NO: 2715188 - DNA, 12 bp, Homo sapiens
gggagagcccag

SEQ ID NO: 2715189 - DNA, 14 bp, Homo sapiens
gggagccaacagca

SEQ ID NO: 2715190 - DNA, 16 bp, Homo sapiens
gggagccaacagcagc

SEQ ID NO: 2715191 - DNA, 16 bp, Homo sapiens
gggagctgaggcctcc

SEQ ID NO: 2715192 - DNA, 16 bp, Homo sapiens
gggaggacagagccgg

SEQ ID NO: 2715193 - DNA, 17 bp, Homo sapiens
gggaggatcactggagc

SEQ ID NO: 2715194 - DNA, 17 bp, Homo sapiens
gggagggagctgaggcc

SEQ ID NO: 2715195 - DNA, 18 bp, Homo sapiens
gggagggagctgaggcct

SEQ ID NO: 2715196 - DNA, 15 bp, Homo sapiens
gggatgactgtgatt

SEQ ID NO: 2715197 - DNA, 15 bp, Homo sapiens
gggatggtcctgggg

SEQ ID NO: 2715198 - DNA, 16 bp, Homo sapiens
gggatggtcctggggc

SEQ ID NO: 2715199 - DNA, 20 bp, Homo sapiens
gggcacccccaaattcaaag

SEQ ID NO: 2715200 - DNA, 13 bp, Homo sapiens
gggcactccccca

SEQ ID NO: 2715201 - DNA, 13 bp, Homo sapiens
gggcactgctggg

SEQ ID NO: 2715202 - DNA, 14 bp, Homo sapiens
gggcactgctgggt

SEQ ID NO: 2715203 - DNA, 14 bp, Homo sapiens
gggcagaatcctgg

SEQ ID NO: 2715204 - DNA, 18 bp, Homo sapiens
gggcagaatcctgggccc

SEQ ID NO: 2715205 - DNA, 20 bp, Homo sapiens
gggcagaatcctgggccccc

SEQ ID NO: 2715206 - DNA, 12 bp, Homo sapiens
gggcagcacagc

SEQ ID NO: 2715207 - DNA, 14 bp, Homo sapiens
gggcaggccctgca

SEQ ID NO: 2715208 - DNA, 19 bp, Homo sapiens
gggcaggccctgcactgtc

SEQ ID NO: 2715209 - DNA, 22 bp, Homo sapiens
gggcaggccctgcactgtcctg

SEQ ID NO: 2715210 - DNA, 23 bp, Homo sapiens
gggcaggccctgcactgtcctgc

SEQ ID NO: 2715211 - DNA, 13 bp, Homo sapiens
gggccagggccct

SEQ ID NO: 2715212 - DNA, 18 bp, Homo sapiens
gggccagggccctgcaga

SEQ ID NO: 2715213 - DNA, 15 bp, Homo sapiens
gggccatactggcct

SEQ ID NO: 2715214 - DNA, 16 bp, Homo sapiens
gggccatactggcctc

SEQ ID NO: 2715215 - DNA, 14 bp, Homo sapiens
gggccatgggtcct

SEQ ID NO: 2715216 - DNA, 22 bp, Homo sapiens
gggccatgggtcctcggcccat

SEQ ID NO: 2715217 - DNA, 12 bp, Homo sapiens
gggcccacagcc

SEQ ID NO: 2715218 - DNA, 13 bp, Homo sapiens
gggcccaggcagg

SEQ ID NO: 2715219 - DNA, 13 bp, Homo sapiens
gggcccccagaga

SEQ ID NO: 2715220 - DNA, 15 bp, Homo sapiens
gggcccccagagacc

SEQ ID NO: 2715221 - DNA, 23 bp, Homo sapiens
gggcccccagagacctttgccca

SEQ ID NO: 2715222 - DNA, 22 bp, Homo sapiens
gggcccctcaggggaagctgct

SEQ ID NO: 2715223 - DNA, 15 bp, Homo sapiens
gggccctgcagaggg

SEQ ID NO: 2715224 - DNA, 20 bp, Homo sapiens
gggcctatcagtgtgccccc

SEQ ID NO: 2715225 - DNA, 12 bp, Homo sapiens
gggcctcagcct

SEQ ID NO: 2715226 - DNA, 12 bp, Homo sapiens
gggcctccagga

SEQ ID NO: 2715227 - DNA, 21 bp, Homo sapiens
gggcctcggaggctcctccct

SEQ ID NO: 2715228 - DNA, 22 bp, Homo sapiens
gggcctcggaggctcctccctc

SEQ ID NO: 2715229 - DNA, 20 bp, Homo sapiens
gggccttggtcccagacagc

SEQ ID NO: 2715230 - DNA, 12 bp, Homo sapiens
gggcgctcctgt

SEQ ID NO: 2715231 - DNA, 19 bp, Homo sapiens
gggctacaaaccaggagca

SEQ ID NO: 2715232 - DNA, 14 bp, Homo sapiens
gggctcagatcctg

SEQ ID NO: 2715233 - DNA, 20 bp, Homo sapiens
gggctcagatcctgggcatg

SEQ ID NO: 2715234 - DNA, 17 bp, Homo sapiens
gggctcagggaccacag

SEQ ID NO: 2715235 - DNA, 14 bp, Homo sapiens
gggctccccttgcc

SEQ ID NO: 2715236 - DNA, 15 bp, Homo sapiens
gggctccccttgccc

SEQ ID NO: 2715237 - DNA, 16 bp, Homo sapiens
gggctccccttgccct

SEQ ID NO: 2715238 - DNA, 18 bp, Homo sapiens
gggctccccttgcccttc

SEQ ID NO: 2715239 - DNA, 12 bp, Homo sapiens
gggctccctcct

SEQ ID NO: 2715240 - DNA, 11 bp, Homo sapiens
gggctctgccc

SEQ ID NO: 2715241 - DNA, 14 bp, Homo sapiens
gggctctgtgggct

SEQ ID NO: 2715242 - DNA, 14 bp, Homo sapiens
gggctgactgggac

SEQ ID NO: 2715243 - DNA, 16 bp, Homo sapiens
gggctgagccctggca

SEQ ID NO: 2715244 - DNA, 20 bp, Homo sapiens
gggctgagggcatctctgag

SEQ ID NO: 2715245 - DNA, 18 bp, Homo sapiens
gggctgcccgctcccagt

SEQ ID NO: 2715246 - DNA, 22 bp, Homo sapiens
gggctgcccgctcccagtgtct

SEQ ID NO: 2715247 - DNA, 13 bp, Homo sapiens
gggctgccctgcc

SEQ ID NO: 2715248 - DNA, 20 bp, Homo sapiens
gggctggactctggcaccca

SEQ ID NO: 2715249 - DNA, 19 bp, Homo sapiens
gggctgggttggcgcaccc

SEQ ID NO: 2715250 - DNA, 23 bp, Homo sapiens
gggctgggttggcgcaccctccc

SEQ ID NO: 2715251 - DNA, 16 bp, Homo sapiens
gggcttccctgggcct

SEQ ID NO: 2715252 - DNA, 17 bp, Homo sapiens
gggcttccctgggcctc

SEQ ID NO: 2715253 - DNA, 15 bp, Homo sapiens
gggcttgtggactct

SEQ ID NO: 2715254 - DNA, 20 bp, Homo sapiens
gggcttgtggactctctgcc

SEQ ID NO: 2715255 - DNA, 14 bp, Homo sapiens
ggggaagagcacag

SEQ ID NO: 2715256 - DNA, 15 bp, Homo sapiens
ggggaccactgggcc

SEQ ID NO: 2715257 - DNA, 19 bp, Homo sapiens
ggggaccactgggcccctc

SEQ ID NO: 2715258 - DNA, 16 bp, Homo sapiens
ggggagaaggcctccc

SEQ ID NO: 2715259 - DNA, 18 bp, Homo sapiens
ggggagggactgctgacc

SEQ ID NO: 2715260 - DNA, 12 bp, Homo sapiens
ggggagggcacc

SEQ ID NO: 2715261 - DNA, 15 bp, Homo sapiens
ggggcaggcacagca

SEQ ID NO: 2715262 - DNA, 17 bp, Homo sapiens
ggggcaggcacagcaca

SEQ ID NO: 2715263 - DNA, 21 bp, Homo sapiens
ggggcccgcttgcctcggctc

SEQ ID NO: 2715264 - DNA, 17 bp, Homo sapiens
aacgggctgccctgcca

SEQ ID NO: 2715265 - DNA, 14 bp, Homo sapiens
aacgttgctcccca

SEQ ID NO: 2715266 - DNA, 16 bp, Homo sapiens
aactaccagtgggcat

SEQ ID NO: 2715267 - DNA, 18 bp, Homo sapiens
aactaccagtgggcatgt

SEQ ID NO: 2715268 - DNA, 10 bp, Homo sapiens
aactccctcc

SEQ ID NO: 2715269 - DNA, 13 bp, Homo sapiens
aactccctcctca

SEQ ID NO: 2715270 - DNA, 19 bp, Homo sapiens
aactctaccctggtaggaa

SEQ ID NO: 2715271 - DNA, 12 bp, Homo sapiens
aactctccactc

SEQ ID NO: 2715272 - DNA, 14 bp, Homo sapiens
aactctgattttga

SEQ ID NO: 2715273 - DNA, 18 bp, Homo sapiens
aactctgattttgatatt

SEQ ID NO: 2715274 - DNA, 13 bp, Homo sapiens
aactctgcaggaa

SEQ ID NO: 2715275 - DNA, 16 bp, Homo sapiens
aactctgcaggaaatc

SEQ ID NO: 2715276 - DNA, 14 bp, Homo sapiens
aactctgccagcca

SEQ ID NO: 2715277 - DNA, 20 bp, Homo sapiens
aactctgtgttgtgaatgtc

SEQ ID NO: 2715278 - DNA, 19 bp, Homo sapiens
aactcttggccagagctga

SEQ ID NO: 2715279 - DNA, 13 bp, Homo sapiens
aactcttgtattg

SEQ ID NO: 2715280 - DNA, 14 bp, Homo sapiens
aactcttgtattgc

SEQ ID NO: 2715281 - DNA, 20 bp, Homo sapiens
aactgaagacctccacatta

SEQ ID NO: 2715282 - DNA, 14 bp, Homo sapiens
aactgctggggctg

SEQ ID NO: 2715283 - DNA, 20 bp, Homo sapiens
aactgctgttaattgattaa

SEQ ID NO: 2715284 - DNA, 15 bp, Homo sapiens
aacttagaataaaat

SEQ ID NO: 2715285 - DNA, 19 bp, Homo sapiens
aacttatttgagtgattat

SEQ ID NO: 2715286 - DNA, 12 bp, Homo sapiens
aacttcagcacc

SEQ ID NO: 2715287 - DNA, 19 bp, Homo sapiens
aacttgagggtaataaact

SEQ ID NO: 2715288 - DNA, 23 bp, Homo sapiens
aacttgattcttgtgattgactt

SEQ ID NO: 2715289 - DNA, 23 bp, Homo sapiens
aactttaacaggttttcttctaa

SEQ ID NO: 2715290 - DNA, 14 bp, Homo sapiens
aagaaaaaaagcaa

SEQ ID NO: 2715291 - DNA, 14 bp, Homo sapiens
aagaaaacttccaa

SEQ ID NO: 2715292 - DNA, 23 bp, Homo sapiens
aagaaaagacattgaaagctcta

SEQ ID NO: 2715293 - DNA, 15 bp, Homo sapiens
aagaaaatgtgtctg

SEQ ID NO: 2715294 - DNA, 12 bp, Homo sapiens
aagaaacaaaaa

SEQ ID NO: 2715295 - DNA, 14 bp, Homo sapiens
aagaaacaatttaa

SEQ ID NO: 2715296 - DNA, 16 bp, Homo sapiens
aagaaacactaaatta

SEQ ID NO: 2715297 - DNA, 15 bp, Homo sapiens
aagaaatcaattttt

SEQ ID NO: 2715298 - DNA, 17 bp, Homo sapiens
aagaaccccagacctct

SEQ ID NO: 2715299 - DNA, 15 bp, Homo sapiens
aagaaccgcattttg

SEQ ID NO: 2715300 - DNA, 14 bp, Homo sapiens
aagaagttttaact

SEQ ID NO: 2715301 - DNA, 14 bp, Homo sapiens
aagaataaaatact

SEQ ID NO: 2715302 - DNA, 14 bp, Homo sapiens
aagaatgaaatact

SEQ ID NO: 2715303 - DNA, 14 bp, Homo sapiens
aagaattctatttt

SEQ ID NO: 2715304 - DNA, 20 bp, Homo sapiens
aagacacctgccttatgcaa

SEQ ID NO: 2715305 - DNA, 16 bp, Homo sapiens
aagacatcaatgaaac

SEQ ID NO: 2715306 - DNA, 12 bp, Homo sapiens
aagactgaaaga

SEQ ID NO: 2715307 - DNA, 14 bp, Homo sapiens
aagactgaaagaat

SEQ ID NO: 2715308 - DNA, 20 bp, Homo sapiens
aagacttcaatattaaatga

SEQ ID NO: 2715309 - DNA, 20 bp, Homo sapiens
aagacttcactgcagccttt

SEQ ID NO: 2715310 - DNA, 21 bp, Homo sapiens
aagacttcactgcagcctttc

SEQ ID NO: 2715311 - DNA, 16 bp, Homo sapiens
aagacttccagagcct

SEQ ID NO: 2715312 - DNA, 12 bp, Homo sapiens
aagagaggcacc

SEQ ID NO: 2715313 - DNA, 16 bp, Homo sapiens
aagagaggcacctgct

SEQ ID NO: 2715314 - DNA, 17 bp, Homo sapiens
aagagagtaccatgctg

SEQ ID NO: 2715315 - DNA, 18 bp, Homo sapiens
aagagccttcacatgaaa

SEQ ID NO: 2715316 - DNA, 13 bp, Homo sapiens
aagaggttctgca

SEQ ID NO: 2715317 - DNA, 21 bp, Homo sapiens
aagagtagaaaaggattgctt

SEQ ID NO: 2715318 - DNA, 16 bp, Homo sapiens
aagagtctctggctca

SEQ ID NO: 2715319 - DNA, 18 bp, Homo sapiens
aagagtctctggctcagc

SEQ ID NO: 2715320 - DNA, 21 bp, Homo sapiens
aagagtctctggctcagctgt

SEQ ID NO: 2715321 - DNA, 13 bp, Homo sapiens
aagagtgtaacat

SEQ ID NO: 2715322 - DNA, 21 bp, Homo sapiens
aagatcattatcttcatgttt

SEQ ID NO: 2715323 - DNA, 20 bp, Homo sapiens
aagatccaaatgctgtgcaa

SEQ ID NO: 2715324 - DNA, 18 bp, Homo sapiens
aagatctgcttccctggg

SEQ ID NO: 2715325 - DNA, 16 bp, Homo sapiens
aagatgatgttaaatg

SEQ ID NO: 2715326 - DNA, 14 bp, Homo sapiens
aagattatatatca

SEQ ID NO: 2715327 - DNA, 16 bp, Homo sapiens
aagattatatatcata

SEQ ID NO: 2715328 - DNA, 20 bp, Homo sapiens
aagattatatatcataaagt

SEQ ID NO: 2715329 - DNA, 17 bp, Homo sapiens
aagatttccaagtgcca

SEQ ID NO: 2715330 - DNA, 13 bp, Homo sapiens
aagcaaaattatt

SEQ ID NO: 2715331 - DNA, 21 bp, Homo sapiens
aagcaagacagtggcactaaa

SEQ ID NO: 2715332 - DNA, 19 bp, Homo sapiens
aagcaagacgtcctggaat

SEQ ID NO: 2715333 - DNA, 23 bp, Homo sapiens
aagcaatgcttctgcctcagctt

SEQ ID NO: 2715334 - DNA, 22 bp, Homo sapiens
aagcaatttatatctttatgca

SEQ ID NO: 2715335 - DNA, 18 bp, Homo sapiens
aagcaccgcagcatgtgg

SEQ ID NO: 2715336 - DNA, 23 bp, Homo sapiens
aagcagacgtgagtgtgactttt

SEQ ID NO: 2715337 - DNA, 15 bp, Homo sapiens
aagcagagttctttg

SEQ ID NO: 2715338 - DNA, 16 bp, Homo sapiens
aagcagagttctttgc

SEQ ID NO: 2715339 - DNA, 16 bp, Homo sapiens
aagcagattacaataa

SEQ ID NO: 2715340 - DNA, 17 bp, Homo sapiens
aagcagggacacccccc

SEQ ID NO: 2715341 - DNA, 22 bp, Homo sapiens
aagcaggttgaggggctcctgg

SEQ ID NO: 2715342 - DNA, 17 bp, Homo sapiens
aagcaggtttcttgctt

SEQ ID NO: 2715343 - DNA, 23 bp, Homo sapiens
aagcagtgccctctggacagctt

SEQ ID NO: 2715344 - DNA, 16 bp, Homo sapiens
aagcatcacctcaggc

SEQ ID NO: 2715345 - DNA, 12 bp, Homo sapiens
aagcatcctccc

SEQ ID NO: 2715346 - DNA, 13 bp, Homo sapiens
aagcatcctcccc

SEQ ID NO: 2715347 - DNA, 21 bp, Homo sapiens
aagcatcctccccaccagagc

SEQ ID NO: 2715348 - DNA, 18 bp, Homo sapiens
aagcattctgagctgggc

SEQ ID NO: 2715349 - DNA, 17 bp, Homo sapiens
aagcattttcagcatca

SEQ ID NO: 2715350 - DNA, 21 bp, Homo sapiens
aagcattttcagcatcaaaca

SEQ ID NO: 2715351 - DNA, 15 bp, Homo sapiens
aagccaaactctgcc

SEQ ID NO: 2715352 - DNA, 17 bp, Homo sapiens
aagccaagccctccgcc

SEQ ID NO: 2715353 - DNA, 14 bp, Homo sapiens
aagccaccgcagct

SEQ ID NO: 2715354 - DNA, 21 bp, Homo sapiens
aagccaccgcagctgctgcca

SEQ ID NO: 2715355 - DNA, 14 bp, Homo sapiens
aagccactgaagct

SEQ ID NO: 2715356 - DNA, 13 bp, Homo sapiens
aagccatattcta

SEQ ID NO: 2715357 - DNA, 22 bp, Homo sapiens
aagcctctgtgtcactggctgc

SEQ ID NO: 2715358 - DNA, 24 bp, Homo sapiens
aagcctctgtgtcactggctgcct

SEQ ID NO: 2715359 - DNA, 21 bp, Homo sapiens
aagcggaggttgcagggagcc

SEQ ID NO: 2715360 - DNA, 22 bp, Homo sapiens
aagctcagtggcaagaatgaaa

SEQ ID NO: 2715361 - DNA, 14 bp, Homo sapiens
aagctccctggtga

SEQ ID NO: 2715362 - DNA, 15 bp, Homo sapiens
aagctctgcctcccg

SEQ ID NO: 2715363 - DNA, 11 bp, Homo sapiens
aagctgcagct

SEQ ID NO: 2715364 - DNA, 13 bp, Homo sapiens
aagctgcagcttc

SEQ ID NO: 2715365 - DNA, 16 bp, Homo sapiens
aagctgggactcattc

SEQ ID NO: 2715366 - DNA, 17 bp, Homo sapiens
aagctgtaaaaagagag

SEQ ID NO: 2715367 - DNA, 21 bp, Homo sapiens
aagctgtagaactctgcaggc

SEQ ID NO: 2715368 - DNA, 14 bp, Homo sapiens
aagctgtgccaccc

SEQ ID NO: 2715369 - DNA, 16 bp, Homo sapiens
aagctgtgccaccctg

SEQ ID NO: 2715370 - DNA, 20 bp, Homo sapiens
aagctgtgccaccctgggct

SEQ ID NO: 2715371 - DNA, 21 bp, Homo sapiens
aagctgtgccaccctgggctc

SEQ ID NO: 2715372 - DNA, 16 bp, Homo sapiens
aagctgtgtctctgta

SEQ ID NO: 2715373 - DNA, 15 bp, Homo sapiens
aagcttgtgtgggcc

SEQ ID NO: 2715374 - DNA, 14 bp, Homo sapiens
aagctttctccttt

SEQ ID NO: 2715375 - DNA, 22 bp, Homo sapiens
aaggaagcaagccggcagaaat

SEQ ID NO: 2715376 - DNA, 14 bp, Homo sapiens
aaggatatgattaa

SEQ ID NO: 2715377 - DNA, 23 bp, Homo sapiens
aaggatatgattaatattattaa

SEQ ID NO: 2715378 - DNA, 22 bp, Homo sapiens
aaggatatttactacttttgca

SEQ ID NO: 2715379 - DNA, 14 bp, Homo sapiens
aaggatcttttgta

SEQ ID NO: 2715380 - DNA, 15 bp, Homo sapiens
aaggatcttttgtaa

SEQ ID NO: 2715381 - DNA, 17 bp, Homo sapiens
aaggatcttttgtaaat

SEQ ID NO: 2715382 - DNA, 17 bp, Homo sapiens
aaggattctaaacagat

SEQ ID NO: 2715383 - DNA, 15 bp, Homo sapiens
aaggatttcttattt

SEQ ID NO: 2715384 - DNA, 16 bp, Homo sapiens
aaggatttcttatttt

SEQ ID NO: 2715385 - DNA, 20 bp, Homo sapiens
aaggattttaccaaagcatc

SEQ ID NO: 2715386 - DNA, 22 bp, Homo sapiens
aaggcagttctgtgtcctcgca

SEQ ID NO: 2715387 - DNA, 10 bp, Homo sapiens
aaggcctccc

SEQ ID NO: 2715388 - DNA, 13 bp, Homo sapiens
aaggcctcccaca

SEQ ID NO: 2715389 - DNA, 14 bp, Homo sapiens
acaccctgcctgct

SEQ ID NO: 2715390 - DNA, 17 bp, Homo sapiens
acaccctgcctgctgtg

SEQ ID NO: 2715391 - DNA, 18 bp, Homo sapiens
acacccttggacttgagg

SEQ ID NO: 2715392 - DNA, 21 bp, Homo sapiens
acacgcatgcctcagccagcc

SEQ ID NO: 2715393 - DNA, 13 bp, Homo sapiens
acacggcagctgt

SEQ ID NO: 2715394 - DNA, 17 bp, Homo sapiens
acactcaccgagaggaa

SEQ ID NO: 2715395 - DNA, 12 bp, Homo sapiens
acactccagcct

SEQ ID NO: 2715396 - DNA, 13 bp, Homo sapiens
acactcctcctgc

SEQ ID NO: 2715397 - DNA, 14 bp, Homo sapiens
acactcctcctgcc

SEQ ID NO: 2715398 - DNA, 15 bp, Homo sapiens
acactcctcctgcca

SEQ ID NO: 2715399 - DNA, 19 bp, Homo sapiens
acactcctcctgccagctc

SEQ ID NO: 2715400 - DNA, 21 bp, Homo sapiens
acactcctcctgccagctctg

SEQ ID NO: 2715401 - DNA, 13 bp, Homo sapiens
acactccttcccc

SEQ ID NO: 2715402 - DNA, 18 bp, Homo sapiens
acactccttccccttgtc

SEQ ID NO: 2715403 - DNA, 21 bp, Homo sapiens
acactccttccccttgtccct

SEQ ID NO: 2715404 - DNA, 19 bp, Homo sapiens
acactcgtgtgcccaccag

SEQ ID NO: 2715405 - DNA, 20 bp, Homo sapiens
acactctagtgacttcctgg

SEQ ID NO: 2715406 - DNA, 22 bp, Homo sapiens
acactctagtgacttcctggtg

SEQ ID NO: 2715407 - DNA, 23 bp, Homo sapiens
acactctagtgacttcctggtga

SEQ ID NO: 2715408 - DNA, 20 bp, Homo sapiens
acactcttcttgagcagacc

SEQ ID NO: 2715409 - DNA, 18 bp, Homo sapiens
acactgcggggcttggct

SEQ ID NO: 2715410 - DNA, 19 bp, Homo sapiens
acactgcggggcttggctg

SEQ ID NO: 2715411 - DNA, 20 bp, Homo sapiens
acactgcggtgtctgcagct

SEQ ID NO: 2715412 - DNA, 18 bp, Homo sapiens
acactggcatctccctga

SEQ ID NO: 2715413 - DNA, 22 bp, Homo sapiens
acactggcatctccctgacctt

SEQ ID NO: 2715414 - DNA, 17 bp, Homo sapiens
acactgggctctgagga

SEQ ID NO: 2715415 - DNA, 23 bp, Homo sapiens
acactgtgggtctgactttctct

SEQ ID NO: 2715416 - DNA, 16 bp, Homo sapiens
acacttcttgaaacag

SEQ ID NO: 2715417 - DNA, 20 bp, Homo sapiens
acacttcttgaaacagcctg

SEQ ID NO: 2715418 - DNA, 22 bp, Homo sapiens
acacttgttcaacagtttctca

SEQ ID NO: 2715419 - DNA, 17 bp, Homo sapiens
acagaaattagccgggc

SEQ ID NO: 2715420 - DNA, 20 bp, Homo sapiens
acagacagtatgtctactcc

SEQ ID NO: 2715421 - DNA, 23 bp, Homo sapiens
acagactgcaagaggctcctgtc

SEQ ID NO: 2715422 - DNA, 21 bp, Homo sapiens
acagagaaattctgtggtggg

SEQ ID NO: 2715423 - DNA, 15 bp, Homo sapiens
acagagcaagactct

SEQ ID NO: 2715424 - DNA, 14 bp, Homo sapiens
acagagccagaggc

SEQ ID NO: 2715425 - DNA, 19 bp, Homo sapiens
acagagccggtttccgtgg

SEQ ID NO: 2715426 - DNA, 21 bp, Homo sapiens
acagagcgagagtctgtctca

SEQ ID NO: 2715427 - DNA, 18 bp, Homo sapiens
acagagttggtgttcata

SEQ ID NO: 2715428 - DNA, 20 bp, Homo sapiens
acagagttggtgttcataat

SEQ ID NO: 2715429 - DNA, 20 bp, Homo sapiens
acagatacccatccaactcc

SEQ ID NO: 2715430 - DNA, 13 bp, Homo sapiens
acagatgctggcc

SEQ ID NO: 2715431 - DNA, 14 bp, Homo sapiens
acagatgctggcct

SEQ ID NO: 2715432 - DNA, 19 bp, Homo sapiens
acagatggaagaagtttta

SEQ ID NO: 2715433 - DNA, 18 bp, Homo sapiens
acagcaaggaggctggct

SEQ ID NO: 2715434 - DNA, 20 bp, Homo sapiens
acagcaaggaggctggctgg

SEQ ID NO: 2715435 - DNA, 21 bp, Homo sapiens
acagcaaggaggctggctggg

SEQ ID NO: 2715436 - DNA, 14 bp, Homo sapiens
acagcatctctatg

SEQ ID NO: 2715437 - DNA, 23 bp, Homo sapiens
acagccagcctgtcgtgtccagc

SEQ ID NO: 2715438 - DNA, 16 bp, Homo sapiens
acagcccacgtcctgt

SEQ ID NO: 2715439 - DNA, 17 bp, Homo sapiens
acagcccccaccccagc

SEQ ID NO: 2715440 - DNA, 19 bp, Homo sapiens
acagcccccaccccagcac

SEQ ID NO: 2715441 - DNA, 18 bp, Homo sapiens
acagccctcccgcccctt

SEQ ID NO: 2715442 - DNA, 22 bp, Homo sapiens
acagccctcccgccccttcccc

SEQ ID NO: 2715443 - DNA, 20 bp, Homo sapiens
acagccgcagcctccctctg

SEQ ID NO: 2715444 - DNA, 12 bp, Homo sapiens
acagcgcctcct

SEQ ID NO: 2715445 - DNA, 14 bp, Homo sapiens
acagcgcctcctgg

SEQ ID NO: 2715446 - DNA, 12 bp, Homo sapiens
acagctcctccc

SEQ ID NO: 2715447 - DNA, 15 bp, Homo sapiens
acagctcctcccctg

SEQ ID NO: 2715448 - DNA, 16 bp, Homo sapiens
acagctcctcccctgc

SEQ ID NO: 2715449 - DNA, 17 bp, Homo sapiens
acagctcctcccctgcc

SEQ ID NO: 2715450 - DNA, 20 bp, Homo sapiens
acagctcctcccctgccgcc

SEQ ID NO: 2715451 - DNA, 22 bp, Homo sapiens
acagctcctcccctgccgcctc

SEQ ID NO: 2715452 - DNA, 12 bp, Homo sapiens
acagcttcctga

SEQ ID NO: 2715453 - DNA, 22 bp, Homo sapiens
acagcttgactctactcccagc

SEQ ID NO: 2715454 - DNA, 22 bp, Homo sapiens
acaggacagtgcttcagcctga

SEQ ID NO: 2715455 - DNA, 22 bp, Homo sapiens
acaggcccttggtagagctggt

SEQ ID NO: 2715456 - DNA, 13 bp, Homo sapiens
acaggctctgaga

SEQ ID NO: 2715457 - DNA, 14 bp, Homo sapiens
acagggagctggca

SEQ ID NO: 2715458 - DNA, 12 bp, Homo sapiens
acagtaaataaa

SEQ ID NO: 2715459 - DNA, 15 bp, Homo sapiens
acagtaaataaattg

SEQ ID NO: 2715460 - DNA, 17 bp, Homo sapiens
acagtaaataaattgtt

SEQ ID NO: 2715461 - DNA, 17 bp, Homo sapiens
acagtaatatgaaagcc

SEQ ID NO: 2715462 - DNA, 19 bp, Homo sapiens
acagtaatatgaaagccac

SEQ ID NO: 2715463 - DNA, 17 bp, Homo sapiens
acagtacctgattgtat

SEQ ID NO: 2715464 - DNA, 16 bp, Homo sapiens
acagtcctcacagcct

SEQ ID NO: 2715465 - DNA, 22 bp, Homo sapiens
acagtcctgggagaacctcagg

SEQ ID NO: 2715466 - DNA, 23 bp, Homo sapiens
acagtcctgggagaacctcaggc

SEQ ID NO: 2715467 - DNA, 17 bp, Homo sapiens
acagtctcaattttgta

SEQ ID NO: 2715468 - DNA, 15 bp, Homo sapiens
acagtctctgttgta

SEQ ID NO: 2715469 - DNA, 18 bp, Homo sapiens
acagtctctgttgtaaat

SEQ ID NO: 2715470 - DNA, 19 bp, Homo sapiens
acagtgactcgggctcctg

SEQ ID NO: 2715471 - DNA, 13 bp, Homo sapiens
acagtgctctgcc

SEQ ID NO: 2715472 - DNA, 18 bp, Homo sapiens
acagtgcttcagcctgag

SEQ ID NO: 2715473 - DNA, 15 bp, Homo sapiens
acagtggcactaaaa

SEQ ID NO: 2715474 - DNA, 23 bp, Homo sapiens
acagtgtaagcttagattttctg

SEQ ID NO: 2715475 - DNA, 17 bp, Homo sapiens
acagtgtatttaagaaa

SEQ ID NO: 2715476 - DNA, 19 bp, Homo sapiens
acagtgtctgggctgactg

SEQ ID NO: 2715477 - DNA, 14 bp, Homo sapiens
acagtgtttatgac

SEQ ID NO: 2715478 - DNA, 15 bp, Homo sapiens
acagttcataattca

SEQ ID NO: 2715479 - DNA, 17 bp, Homo sapiens
acagttcataattcacc

SEQ ID NO: 2715480 - DNA, 12 bp, Homo sapiens
acataaaggtat

SEQ ID NO: 2715481 - DNA, 20 bp, Homo sapiens
acataacaacctttcccatt

SEQ ID NO: 2715482 - DNA, 13 bp, Homo sapiens
acataatttgcaa

SEQ ID NO: 2715483 - DNA, 21 bp, Homo sapiens
acatacaacctatgtaatttt

SEQ ID NO: 2715484 - DNA, 16 bp, Homo sapiens
acatacagtgatatgg

SEQ ID NO: 2715485 - DNA, 21 bp, Homo sapiens
acatagttgaaaaaagaagtt

SEQ ID NO: 2715486 - DNA, 13 bp, Homo sapiens
acatatatgtata

SEQ ID NO: 2715487 - DNA, 23 bp, Homo sapiens
acatatatgtatatgtatatcta

SEQ ID NO: 2715488 - DNA, 20 bp, Homo sapiens
acatatgtctgtctttgcaa

SEQ ID NO: 2715489 - DNA, 23 bp, Homo sapiens
acatattattggtcaagaaaagc

SEQ ID NO: 2715490 - DNA, 22 bp, Homo sapiens
acatattcccatggtagactgt

SEQ ID NO: 2715491 - DNA, 16 bp, Homo sapiens
acatcaccaagtgtgg

SEQ ID NO: 2715492 - DNA, 20 bp, Homo sapiens
acatcatctttatctcctgg

SEQ ID NO: 2715493 - DNA, 21 bp, Homo sapiens
acatcgacaaccacgtaccaa

SEQ ID NO: 2715494 - DNA, 21 bp, Homo sapiens
acatctaaattgatcattcat

SEQ ID NO: 2715495 - DNA, 20 bp, Homo sapiens
acatgaaaaacacggcagct

SEQ ID NO: 2715496 - DNA, 22 bp, Homo sapiens
acatgaaaaacacggcagctgt

SEQ ID NO: 2715497 - DNA, 14 bp, Homo sapiens
acatgatgtgagat

SEQ ID NO: 2715498 - DNA, 18 bp, Homo sapiens
acatggattccaaagcat

SEQ ID NO: 2715499 - DNA, 20 bp, Homo sapiens
acatggattccaaagcattt

SEQ ID NO: 2715500 - DNA, 16 bp, Homo sapiens
acatggtgtgtgtctc

SEQ ID NO: 2715501 - DNA, 19 bp, Homo sapiens
acatggtgtgtgtctctga

SEQ ID NO: 2715502 - DNA, 19 bp, Homo sapiens
acatgtgcaactcttgtat

SEQ ID NO: 2715503 - DNA, 20 bp, Homo sapiens
acatgttgggcatgattcta

SEQ ID NO: 2715504 - DNA, 17 bp, Homo sapiens
acatgtttctgttttgt

SEQ ID NO: 2715505 - DNA, 15 bp, Homo sapiens
acattaacaagatca

SEQ ID NO: 2715506 - DNA, 20 bp, Homo sapiens
acattaccttgtctttcaaa

SEQ ID NO: 2715507 - DNA, 21 bp, Homo sapiens
acattaccttgtctttcaaaa

SEQ ID NO: 2715508 - DNA, 22 bp, Homo sapiens
acattactgtatgtataaatta

SEQ ID NO: 2715509 - DNA, 17 bp, Homo sapiens
acattagtatcccacta

SEQ ID NO: 2715510 - DNA, 16 bp, Homo sapiens
acattatgttattgga

SEQ ID NO: 2715511 - DNA, 17 bp, Homo sapiens
acattatgttattggaa

SEQ ID NO: 2715512 - DNA, 14 bp, Homo sapiens
agaacacgctttca

SEQ ID NO: 2715513 - DNA, 20 bp, Homo sapiens
agaacatggtgtgtgtctct

SEQ ID NO: 2715514 - DNA, 22 bp, Homo sapiens
agaaccagccgtattttacatg

SEQ ID NO: 2715515 - DNA, 12 bp, Homo sapiens
agaacctcaggc

SEQ ID NO: 2715516 - DNA, 20 bp, Homo sapiens
agaactaggagtcttcactg

SEQ ID NO: 2715517 - DNA, 21 bp, Homo sapiens
agaactgccccatctcctccc

SEQ ID NO: 2715518 - DNA, 13 bp, Homo sapiens
agaactgctgggg

SEQ ID NO: 2715519 - DNA, 16 bp, Homo sapiens
agaactgctggggctg

SEQ ID NO: 2715520 - DNA, 18 bp, Homo sapiens
agaactgctggggctggt

SEQ ID NO: 2715521 - DNA, 21 bp, Homo sapiens
agaagacttcaatattaaatg

SEQ ID NO: 2715522 - DNA, 12 bp, Homo sapiens
agaagcctgagg

SEQ ID NO: 2715523 - DNA, 13 bp, Homo sapiens
agaaggaagggca

SEQ ID NO: 2715524 - DNA, 14 bp, Homo sapiens
agaagggcctgctc

SEQ ID NO: 2715525 - DNA, 17 bp, Homo sapiens
agaagggcctgctctgc

SEQ ID NO: 2715526 - DNA, 20 bp, Homo sapiens
agaagggttttccaccctgg

SEQ ID NO: 2715527 - DNA, 14 bp, Homo sapiens
agaagtactttgtg

SEQ ID NO: 2715528 - DNA, 13 bp, Homo sapiens
agaagttttaact

SEQ ID NO: 2715529 - DNA, 15 bp, Homo sapiens
agaataaaatactct

SEQ ID NO: 2715530 - DNA, 14 bp, Homo sapiens
agaataaaattgta

SEQ ID NO: 2715531 - DNA, 21 bp, Homo sapiens
agaatacattttatatctgga

SEQ ID NO: 2715532 - DNA, 14 bp, Homo sapiens
agaatagtctctgg

SEQ ID NO: 2715533 - DNA, 14 bp, Homo sapiens
agaatcaagtctgt

SEQ ID NO: 2715534 - DNA, 16 bp, Homo sapiens
agaatcaagtctgtga

SEQ ID NO: 2715535 - DNA, 18 bp, Homo sapiens
agaatcagattcaggagc

SEQ ID NO: 2715536 - DNA, 15 bp, Homo sapiens
agaatgaaatactct

SEQ ID NO: 2715537 - DNA, 22 bp, Homo sapiens
agaatgcacattggaagctccc

SEQ ID NO: 2715538 - DNA, 23 bp, Homo sapiens
agaatgcacattggaagctccca

SEQ ID NO: 2715539 - DNA, 23 bp, Homo sapiens
agaatggtttttgttgagtctct

SEQ ID NO: 2715540 - DNA, 13 bp, Homo sapiens
agaatgtgctgcc

SEQ ID NO: 2715541 - DNA, 10 bp, Homo sapiens
agaattgaga

SEQ ID NO: 2715542 - DNA, 23 bp, Homo sapiens
agaattgccttaaggccacactg

SEQ ID NO: 2715543 - DNA, 21 bp, Homo sapiens
agaattgtttttagaaattta

SEQ ID NO: 2715544 - DNA, 22 bp, Homo sapiens
agaattttggaaaaatgtcact

SEQ ID NO: 2715545 - DNA, 23 bp, Homo sapiens
agaattttggaaaaatgtcactg

SEQ ID NO: 2715546 - DNA, 17 bp, Homo sapiens
agacacagcccagacaa

SEQ ID NO: 2715547 - DNA, 13 bp, Homo sapiens
agacagctggacc

SEQ ID NO: 2715548 - DNA, 15 bp, Homo sapiens
agacagctggaccca

SEQ ID NO: 2715549 - DNA, 17 bp, Homo sapiens
agacagtgtcagagtca

SEQ ID NO: 2715550 - DNA, 14 bp, Homo sapiens
agacatcagtctcc

SEQ ID NO: 2715551 - DNA, 17 bp, Homo sapiens
agaccagagcagtctga

SEQ ID NO: 2715552 - DNA, 14 bp, Homo sapiens
agaccagcctggcc

SEQ ID NO: 2715553 - DNA, 20 bp, Homo sapiens
agaccatgtggtttgctgtt

SEQ ID NO: 2715554 - DNA, 16 bp, Homo sapiens
agaccattgtcttcca

SEQ ID NO: 2715555 - DNA, 23 bp, Homo sapiens
agaccattgtcttccaaccccag

SEQ ID NO: 2715556 - DNA, 16 bp, Homo sapiens
agacctttgcccacac

SEQ ID NO: 2715557 - DNA, 17 bp, Homo sapiens
agacctttgcccacaca

SEQ ID NO: 2715558 - DNA, 22 bp, Homo sapiens
agacgctgtgattggcaggagg

SEQ ID NO: 2715559 - DNA, 20 bp, Homo sapiens
agacgggttgaaagacatca

SEQ ID NO: 2715560 - DNA, 17 bp, Homo sapiens
agacgtcctggaatgaa

SEQ ID NO: 2715561 - DNA, 18 bp, Homo sapiens
agactatttaacttgagg

SEQ ID NO: 2715562 - DNA, 13 bp, Homo sapiens
agactatttaagt

SEQ ID NO: 2715563 - DNA, 14 bp, Homo sapiens
agactatttaagta

SEQ ID NO: 2715564 - DNA, 12 bp, Homo sapiens
agactcctggct

SEQ ID NO: 2715565 - DNA, 20 bp, Homo sapiens
agactcttccaccagagcag

SEQ ID NO: 2715566 - DNA, 22 bp, Homo sapiens
agactcttccaccagagcaggg

SEQ ID NO: 2715567 - DNA, 21 bp, Homo sapiens
agactctttttgtacctggtg

SEQ ID NO: 2715568 - DNA, 23 bp, Homo sapiens
agactctttttgtacctggtgac

SEQ ID NO: 2715569 - DNA, 19 bp, Homo sapiens
agactgcaagaggctcctg

SEQ ID NO: 2715570 - DNA, 13 bp, Homo sapiens
agactgcggagca

SEQ ID NO: 2715571 - DNA, 17 bp, Homo sapiens
agactgcggagcagcct

SEQ ID NO: 2715572 - DNA, 18 bp, Homo sapiens
agactgcggagcagcctc

SEQ ID NO: 2715573 - DNA, 22 bp, Homo sapiens
agactgcgggatggtcctgggg

SEQ ID NO: 2715574 - DNA, 15 bp, Homo sapiens
agactgctgggactg

SEQ ID NO: 2715575 - DNA, 20 bp, Homo sapiens
agactgctgggactggccag

SEQ ID NO: 2715576 - DNA, 20 bp, Homo sapiens
agactggctggctgcagtga

SEQ ID NO: 2715577 - DNA, 14 bp, Homo sapiens
agactgggaacttg

SEQ ID NO: 2715578 - DNA, 17 bp, Homo sapiens
agactgttaaatgaaac

SEQ ID NO: 2715579 - DNA, 17 bp, Homo sapiens
agacttcaatattaaat

SEQ ID NO: 2715580 - DNA, 16 bp, Homo sapiens
agacttcactgcagcc

SEQ ID NO: 2715581 - DNA, 17 bp, Homo sapiens
agacttcactgcagcct

SEQ ID NO: 2715582 - DNA, 17 bp, Homo sapiens
agacttgattggtttaa

SEQ ID NO: 2715583 - DNA, 13 bp, Homo sapiens
agagacctttgcc

SEQ ID NO: 2715584 - DNA, 14 bp, Homo sapiens
agagacctttgccc

SEQ ID NO: 2715585 - DNA, 23 bp, Homo sapiens
agagagcagcttctgccacttcc

SEQ ID NO: 2715586 - DNA, 12 bp, Homo sapiens
agagaggcacct

SEQ ID NO: 2715587 - DNA, 18 bp, Homo sapiens
agagaggcacctgctgga

SEQ ID NO: 2715588 - DNA, 23 bp, Homo sapiens
agagaggcgcgtctgccccaccc

SEQ ID NO: 2715589 - DNA, 17 bp, Homo sapiens
agagaggtagcgagctg

SEQ ID NO: 2715590 - DNA, 19 bp, Homo sapiens
agagaggtagcgagctgct

SEQ ID NO: 2715591 - DNA, 17 bp, Homo sapiens
agagatgttttgttgat

SEQ ID NO: 2715592 - DNA, 11 bp, Homo sapiens
agagcacagcc

SEQ ID NO: 2715593 - DNA, 11 bp, Homo sapiens
agagcagctgg

SEQ ID NO: 2715594 - DNA, 18 bp, Homo sapiens
agagcagctggctctcca

SEQ ID NO: 2715595 - DNA, 20 bp, Homo sapiens
agagcaggggctgctggggg

SEQ ID NO: 2715596 - DNA, 16 bp, Homo sapiens
agagccgggaagcgat

SEQ ID NO: 2715597 - DNA, 15 bp, Homo sapiens
agagccgggccccgg

SEQ ID NO: 2715598 - DNA, 17 bp, Homo sapiens
agagcgagagtctgtct

SEQ ID NO: 2715599 - DNA, 16 bp, Homo sapiens
agagcgaggaaaggat

SEQ ID NO: 2715600 - DNA, 14 bp, Homo sapiens
agagctcctgtccc

SEQ ID NO: 2715601 - DNA, 18 bp, Homo sapiens
agagctcctgtccctacc

SEQ ID NO: 2715602 - DNA, 12 bp, Homo sapiens
agagctgagtgg

SEQ ID NO: 2715603 - DNA, 22 bp, Homo sapiens
agagctgagtggcagccgcctc

SEQ ID NO: 2715604 - DNA, 11 bp, Homo sapiens
agagctgcctc

SEQ ID NO: 2715605 - DNA, 15 bp, Homo sapiens
agagctgcctcccca

SEQ ID NO: 2715606 - DNA, 22 bp, Homo sapiens
agagctgcgggctgagggcatc

SEQ ID NO: 2715607 - DNA, 15 bp, Homo sapiens
agagctgctgagcag

SEQ ID NO: 2715608 - DNA, 20 bp, Homo sapiens
agagcttttcgaactgtgct

SEQ ID NO: 2715609 - DNA, 23 bp, Homo sapiens
agagcttttcgaactgtgctccc

SEQ ID NO: 2715610 - DNA, 23 bp, Homo sapiens
agaggaggagagaagtggccagg

SEQ ID NO: 2715611 - DNA, 17 bp, Homo sapiens
agaggagggatgctgcc

SEQ ID NO: 2715612 - DNA, 15 bp, Homo sapiens
agaggcacctgctgg

SEQ ID NO: 2715613 - DNA, 18 bp, Homo sapiens
agaggcaggtctgggcca

SEQ ID NO: 2715614 - DNA, 16 bp, Homo sapiens
agaggcgcgtctgccc

SEQ ID NO: 2715615 - DNA, 17 bp, Homo sapiens
agaggcgcgtctgcccc

SEQ ID NO: 2715616 - DNA, 21 bp, Homo sapiens
agagggcccaggcaggccacc

SEQ ID NO: 2715617 - DNA, 22 bp, Homo sapiens
agaggggaaaccagtgtagcct

SEQ ID NO: 2715618 - DNA, 15 bp, Homo sapiens
agaggggcaggccct

SEQ ID NO: 2715619 - DNA, 22 bp, Homo sapiens
agaggggttttagatttttaaa

SEQ ID NO: 2715620 - DNA, 15 bp, Homo sapiens
agaggtagcgagctg

SEQ ID NO: 2715621 - DNA, 20 bp, Homo sapiens
agaggtagcgagctgctctg

SEQ ID NO: 2715622 - DNA, 19 bp, Homo sapiens
agaggtgaggtgacttgcc

SEQ ID NO: 2715623 - DNA, 16 bp, Homo sapiens
agaggttctgcactcc

SEQ ID NO: 2715624 - DNA, 13 bp, Homo sapiens
agagtccagtcaa

SEQ ID NO: 2715625 - DNA, 13 bp, Homo sapiens
agagtctctccag

SEQ ID NO: 2715626 - DNA, 19 bp, Homo sapiens
agagtctctccagcctcac

SEQ ID NO: 2715627 - DNA, 14 bp, Homo sapiens
agagtctctggctc

SEQ ID NO: 2715628 - DNA, 15 bp, Homo sapiens
agagtctctggctca

SEQ ID NO: 2715629 - DNA, 17 bp, Homo sapiens
agagtctctggctcagc

SEQ ID NO: 2715630 - DNA, 18 bp, Homo sapiens
agagtctctggctcagct

SEQ ID NO: 2715631 - DNA, 22 bp, Homo sapiens
agagtctctggctcagctgtgg

SEQ ID NO: 2715632 - DNA, 17 bp, Homo sapiens
agagtgacaggcaccag

SEQ ID NO: 2715633 - DNA, 21 bp, Homo sapiens
agagtgacaggcaccagatgg

SEQ ID NO: 2715634 - DNA, 12 bp, Homo sapiens
agagtgtaacat

SEQ ID NO: 2715635 - DNA, 23 bp, Homo sapiens
agagtgtccctttttgcagggga

SEQ ID NO: 2715636 - DNA, 16 bp, Homo sapiens
aggacggggccggcca

SEQ ID NO: 2715637 - DNA, 22 bp, Homo sapiens
aggacggggccggccaggtggg

SEQ ID NO: 2715638 - DNA, 21 bp, Homo sapiens
aggacggttgtaagcagttgt

SEQ ID NO: 2715639 - DNA, 14 bp, Homo sapiens
aggactctgaggct

SEQ ID NO: 2715640 - DNA, 19 bp, Homo sapiens
aggactggggcttgccagg

SEQ ID NO: 2715641 - DNA, 13 bp, Homo sapiens
aggagaagttggt

SEQ ID NO: 2715642 - DNA, 20 bp, Homo sapiens
aggagaatctcttgaacccg

SEQ ID NO: 2715643 - DNA, 15 bp, Homo sapiens
aggagaattaaactc

SEQ ID NO: 2715644 - DNA, 22 bp, Homo sapiens
aggagagacaggattgggccaa

SEQ ID NO: 2715645 - DNA, 21 bp, Homo sapiens
aggagatgtcatcaagctcca

SEQ ID NO: 2715646 - DNA, 15 bp, Homo sapiens
aggagattttccttc

SEQ ID NO: 2715647 - DNA, 18 bp, Homo sapiens
aggagattttccttccta

SEQ ID NO: 2715648 - DNA, 13 bp, Homo sapiens
aggagcaaatgct

SEQ ID NO: 2715649 - DNA, 22 bp, Homo sapiens
aggagctgacagagccagaggc

SEQ ID NO: 2715650 - DNA, 13 bp, Homo sapiens
aggagcttctctg

SEQ ID NO: 2715651 - DNA, 20 bp, Homo sapiens
aggaggggcccgttgtctcc

SEQ ID NO: 2715652 - DNA, 14 bp, Homo sapiens
aggaggtggcagcc

SEQ ID NO: 2715653 - DNA, 21 bp, Homo sapiens
aggaggtggcagccctgtagg

SEQ ID NO: 2715654 - DNA, 17 bp, Homo sapiens
aggagtccagggcggga

SEQ ID NO: 2715655 - DNA, 21 bp, Homo sapiens
aggagtcttcactgctctgcc

SEQ ID NO: 2715656 - DNA, 12 bp, Homo sapiens
aggagtgtcctg

SEQ ID NO: 2715657 - DNA, 21 bp, Homo sapiens
aggagttcgagaccagcctgg

SEQ ID NO: 2715658 - DNA, 24 bp, Homo sapiens
aggagtttgaggctgcagcgagct

SEQ ID NO: 2715659 - DNA, 16 bp, Homo sapiens
aggatatccccaggga

SEQ ID NO: 2715660 - DNA, 17 bp, Homo sapiens
aggatatccccagggaa

SEQ ID NO: 2715661 - DNA, 18 bp, Homo sapiens
aggatcactggagcccag

SEQ ID NO: 2715662 - DNA, 22 bp, Homo sapiens
aggatcactggagcccaggagt

SEQ ID NO: 2715663 - DNA, 13 bp, Homo sapiens
aggatcttttgta

SEQ ID NO: 2715664 - DNA, 16 bp, Homo sapiens
aggatcttttgtaaat

SEQ ID NO: 2715665 - DNA, 17 bp, Homo sapiens
aggatgaatgggaaagt

SEQ ID NO: 2715666 - DNA, 17 bp, Homo sapiens
aggatggagccagctct

SEQ ID NO: 2715667 - DNA, 22 bp, Homo sapiens
aggatggtcttgatctcctgag

SEQ ID NO: 2715668 - DNA, 15 bp, Homo sapiens
aggattcccagagag

SEQ ID NO: 2715669 - DNA, 23 bp, Homo sapiens
aggattggcacaagctccctggt

SEQ ID NO: 2715670 - DNA, 13 bp, Homo sapiens
aggattgggccaa

SEQ ID NO: 2715671 - DNA, 19 bp, Homo sapiens
aggcaagcttgtgtgggcc

SEQ ID NO: 2715672 - DNA, 12 bp, Homo sapiens
aggcacagcaca

SEQ ID NO: 2715673 - DNA, 15 bp, Homo sapiens
aggcacatggctggg

SEQ ID NO: 2715674 - DNA, 17 bp, Homo sapiens
aggcacatggctggggg

SEQ ID NO: 2715675 - DNA, 14 bp, Homo sapiens
aggcacctgcaggt

SEQ ID NO: 2715676 - DNA, 18 bp, Homo sapiens
aggcacctgcaggttggg

SEQ ID NO: 2715677 - DNA, 21 bp, Homo sapiens
aggcacctgcaggttgggcca

SEQ ID NO: 2715678 - DNA, 24 bp, Homo sapiens
aggcagatttactgtcccaggagc

SEQ ID NO: 2715679 - DNA, 12 bp, Homo sapiens
aggcagcctgcc

SEQ ID NO: 2715680 - DNA, 18 bp, Homo sapiens
aggcaggatatccccagg

SEQ ID NO: 2715681 - DNA, 14 bp, Homo sapiens
aggcagggatttga

SEQ ID NO: 2715682 - DNA, 15 bp, Homo sapiens
aggcagggatttgag

SEQ ID NO: 2715683 - DNA, 18 bp, Homo sapiens
aggcagtgggtcccactt

SEQ ID NO: 2715684 - DNA, 15 bp, Homo sapiens
aggcagttctgtgtc

SEQ ID NO: 2715685 - DNA, 18 bp, Homo sapiens
aggcagttctgtgtcctc

SEQ ID NO: 2715686 - DNA, 21 bp, Homo sapiens
aggcatttgcctaattcctgg

SEQ ID NO: 2715687 - DNA, 23 bp, Homo sapiens
aggcatttgcctaattcctggca

SEQ ID NO: 2715688 - DNA, 22 bp, Homo sapiens
aggccacaccatctcctttcag

SEQ ID NO: 2715689 - DNA, 12 bp, Homo sapiens
aggccacactgg

SEQ ID NO: 2715690 - DNA, 14 bp, Homo sapiens
aggccagggcacag

SEQ ID NO: 2715691 - DNA, 17 bp, Homo sapiens
aggccagggcacagctg

SEQ ID NO: 2715692 - DNA, 19 bp, Homo sapiens
aggccagggcacagctgga

SEQ ID NO: 2715693 - DNA, 17 bp, Homo sapiens
aggcccagcctgtcctg

SEQ ID NO: 2715694 - DNA, 19 bp, Homo sapiens
aggcccagcctgtcctggt

SEQ ID NO: 2715695 - DNA, 23 bp, Homo sapiens
aggccctgcactgtcctgctcca

SEQ ID NO: 2715696 - DNA, 15 bp, Homo sapiens
aggccggccctgccc

SEQ ID NO: 2715697 - DNA, 22 bp, Homo sapiens
aggccggccctgcccctcccta

SEQ ID NO: 2715698 - DNA, 11 bp, Homo sapiens
aggcctcccct

SEQ ID NO: 2715699 - DNA, 13 bp, Homo sapiens
aggcctggcacag

SEQ ID NO: 2715700 - DNA, 21 bp, Homo sapiens
aggcctttagatattattcat

SEQ ID NO: 2715701 - DNA, 19 bp, Homo sapiens
aggcgcgtctgccccaccc

SEQ ID NO: 2715702 - DNA, 20 bp, Homo sapiens
aggcgcgtctgccccaccct

SEQ ID NO: 2715703 - DNA, 22 bp, Homo sapiens
aggcgcgtctgccccaccctca

SEQ ID NO: 2715704 - DNA, 20 bp, Homo sapiens
aggctagagtgcagtggcat

SEQ ID NO: 2715705 - DNA, 18 bp, Homo sapiens
aggctcagtctcaggagc

SEQ ID NO: 2715706 - DNA, 23 bp, Homo sapiens
aggctcagtctcaggagcatggg

SEQ ID NO: 2715707 - DNA, 16 bp, Homo sapiens
aggctcctccctctgc

SEQ ID NO: 2715708 - DNA, 18 bp, Homo sapiens
aggctcctccctctgcct

SEQ ID NO: 2715709 - DNA, 20 bp, Homo sapiens
aggctcctccctctgcctca

SEQ ID NO: 2715710 - DNA, 18 bp, Homo sapiens
aggctctttctgggccaa

SEQ ID NO: 2715711 - DNA, 11 bp, Homo sapiens
aggctgaggcg

SEQ ID NO: 2715712 - DNA, 18 bp, Homo sapiens
aggctgcaaccctggtgt

SEQ ID NO: 2715713 - DNA, 23 bp, Homo sapiens
aggctgccgggtggggggagggc

SEQ ID NO: 2715714 - DNA, 18 bp, Homo sapiens
aggctgcgtcctgaggag

SEQ ID NO: 2715715 - DNA, 16 bp, Homo sapiens
aggctggatggctccc

SEQ ID NO: 2715716 - DNA, 17 bp, Homo sapiens
aggctggcatcctggct

SEQ ID NO: 2715717 - DNA, 21 bp, Homo sapiens
aggctggcatcctggctggct

SEQ ID NO: 2715718 - DNA, 13 bp, Homo sapiens
aggctggccagcc

SEQ ID NO: 2715719 - DNA, 17 bp, Homo sapiens
aggctggccagccccac

SEQ ID NO: 2715720 - DNA, 18 bp, Homo sapiens
aggctggccagccccaca

SEQ ID NO: 2715721 - DNA, 23 bp, Homo sapiens
aggctgggggcgggggagccaac

SEQ ID NO: 2715722 - DNA, 13 bp, Homo sapiens
aggctgggtccag

SEQ ID NO: 2715723 - DNA, 15 bp, Homo sapiens
aggcttaggtgccag

SEQ ID NO: 2715724 - DNA, 18 bp, Homo sapiens
aggcttaggtgccaggct

SEQ ID NO: 2715725 - DNA, 14 bp, Homo sapiens
aggcttctgcagct

SEQ ID NO: 2715726 - DNA, 23 bp, Homo sapiens
aggcttgtcaaatagcaaggcca

SEQ ID NO: 2715727 - DNA, 22 bp, Homo sapiens
aggctttgccatgggcctgctg

SEQ ID NO: 2715728 - DNA, 15 bp, Homo sapiens
agggaaaagctaaga

SEQ ID NO: 2715729 - DNA, 16 bp, Homo sapiens
agggaacatgcagctc

SEQ ID NO: 2715730 - DNA, 14 bp, Homo sapiens
agggaagcagggac

SEQ ID NO: 2715731 - DNA, 16 bp, Homo sapiens
agggaagccctcggcc

SEQ ID NO: 2715732 - DNA, 20 bp, Homo sapiens
agggaaggtatatcaggagg

SEQ ID NO: 2715733 - DNA, 21 bp, Homo sapiens
agggaaggtatatcaggaggg

SEQ ID NO: 2715734 - DNA, 16 bp, Homo sapiens
agggacagaagcagga

SEQ ID NO: 2715735 - DNA, 18 bp, Homo sapiens
agggacagaagcaggagt

SEQ ID NO: 2715736 - DNA, 21 bp, Homo sapiens
agggaccactgggtgagagag

SEQ ID NO: 2715737 - DNA, 12 bp, Homo sapiens
agggactgctga

SEQ ID NO: 2715738 - DNA, 18 bp, Homo sapiens
agggactgctgacccacc

SEQ ID NO: 2715739 - DNA, 22 bp, Homo sapiens
agggactgctgacccaccaagg

SEQ ID NO: 2715740 - DNA, 22 bp, Homo sapiens
agggagataaaagaaccccaga

SEQ ID NO: 2715741 - DNA, 13 bp, Homo sapiens
agggagctaagga

SEQ ID NO: 2715742 - DNA, 15 bp, Homo sapiens
agggagggagctgag

SEQ ID NO: 2715743 - DNA, 13 bp, Homo sapiens
agggcacagctgg

SEQ ID NO: 2715744 - DNA, 22 bp, Homo sapiens
agggcacccccaaattcaaaga

SEQ ID NO: 2715745 - DNA, 17 bp, Homo sapiens
agggccagcaggcagcg

SEQ ID NO: 2715746 - DNA, 19 bp, Homo sapiens
agggccagcaggcagcgcc

SEQ ID NO: 2715747 - DNA, 22 bp, Homo sapiens
agggccagcaggcagcgcctgt

SEQ ID NO: 2715748 - DNA, 13 bp, Homo sapiens
agggccctgcaga

SEQ ID NO: 2715749 - DNA, 15 bp, Homo sapiens
agggcctgctctgct

SEQ ID NO: 2715750 - DNA, 16 bp, Homo sapiens
agggcctgctctgctt

SEQ ID NO: 2715751 - DNA, 20 bp, Homo sapiens
agggcctgctctgcttttcc

SEQ ID NO: 2715752 - DNA, 21 bp, Homo sapiens
agggcgtcgctggacaaccca

SEQ ID NO: 2715753 - DNA, 18 bp, Homo sapiens
agggctcagagctgctga

SEQ ID NO: 2715754 - DNA, 17 bp, Homo sapiens
agggctccctcctggag

SEQ ID NO: 2715755 - DNA, 11 bp, Homo sapiens
agggctgcctg

SEQ ID NO: 2715756 - DNA, 21 bp, Homo sapiens
agggcttgtggactctctgcc

SEQ ID NO: 2715757 - DNA, 23 bp, Homo sapiens
aggggaaaccagtgtagccttgc

SEQ ID NO: 2715758 - DNA, 20 bp, Homo sapiens
aggggaaacctgtgaaagct

SEQ ID NO: 2715759 - DNA, 19 bp, Homo sapiens
atccctttttttacatttc

SEQ ID NO: 2715760 - DNA, 20 bp, Homo sapiens
atccctttttttacatttca

SEQ ID NO: 2715761 - DNA, 20 bp, Homo sapiens
atcctcaggtagtactggga

SEQ ID NO: 2715762 - DNA, 14 bp, Homo sapiens
atcctccccaccag

SEQ ID NO: 2715763 - DNA, 12 bp, Homo sapiens
atcctggcccat

SEQ ID NO: 2715764 - DNA, 12 bp, Homo sapiens
atcctggctggc

SEQ ID NO: 2715765 - DNA, 19 bp, Homo sapiens
atcctggctggctgtgtcc

SEQ ID NO: 2715766 - DNA, 23 bp, Homo sapiens
atcctggctggctgtgtcctctc

SEQ ID NO: 2715767 - DNA, 14 bp, Homo sapiens
atcctggtttgtaa

SEQ ID NO: 2715768 - DNA, 16 bp, Homo sapiens
atccttggagagcagc

SEQ ID NO: 2715769 - DNA, 13 bp, Homo sapiens
atcgttcgcttgt

SEQ ID NO: 2715770 - DNA, 20 bp, Homo sapiens
atcgttcgcttgttttaaaa

SEQ ID NO: 2715771 - DNA, 14 bp, Homo sapiens
atctactagaacct

SEQ ID NO: 2715772 - DNA, 23 bp, Homo sapiens
atctcagcagccagctcctggta

SEQ ID NO: 2715773 - DNA, 16 bp, Homo sapiens
atctctaaactgctgt

SEQ ID NO: 2715774 - DNA, 15 bp, Homo sapiens
atctctagtccctgt

SEQ ID NO: 2715775 - DNA, 20 bp, Homo sapiens
atctctgagtgtctctgcct

SEQ ID NO: 2715776 - DNA, 21 bp, Homo sapiens
atctctgagtgtctctgcctg

SEQ ID NO: 2715777 - DNA, 18 bp, Homo sapiens
atctgagaagtgtatata

SEQ ID NO: 2715778 - DNA, 17 bp, Homo sapiens
atctgcttccctggggc

SEQ ID NO: 2715779 - DNA, 16 bp, Homo sapiens
atctggaggctgcgtc

SEQ ID NO: 2715780 - DNA, 15 bp, Homo sapiens
atctggccacactgg

SEQ ID NO: 2715781 - DNA, 15 bp, Homo sapiens
atctggtatctgcat

SEQ ID NO: 2715782 - DNA, 21 bp, Homo sapiens
atctgtcaaagaaaacttcca

SEQ ID NO: 2715783 - DNA, 20 bp, Homo sapiens
atctgtccatcctcctctcc

SEQ ID NO: 2715784 - DNA, 18 bp, Homo sapiens
atctgtgcctgtctgtcc

SEQ ID NO: 2715785 - DNA, 23 bp, Homo sapiens
atcttagttgatgctacaaaaca

SEQ ID NO: 2715786 - DNA, 17 bp, Homo sapiens
atcttcacgcctgggtg

SEQ ID NO: 2715787 - DNA, 13 bp, Homo sapiens
atcttcagctggt

SEQ ID NO: 2715788 - DNA, 20 bp, Homo sapiens
atcttcagctggtggatggt

SEQ ID NO: 2715789 - DNA, 16 bp, Homo sapiens
atctttatctcctggg

SEQ ID NO: 2715790 - DNA, 15 bp, Homo sapiens
atctttggggaaact

SEQ ID NO: 2715791 - DNA, 23 bp, Homo sapiens
atcttttcctcccattttagaaa

SEQ ID NO: 2715792 - DNA, 13 bp, Homo sapiens
atcttttgtaaat

SEQ ID NO: 2715793 - DNA, 19 bp, Homo sapiens
atgaaaaacacggcagctg

SEQ ID NO: 2715794 - DNA, 11 bp, Homo sapiens
atgaaaacatt

SEQ ID NO: 2715795 - DNA, 13 bp, Homo sapiens
atgaaaacattga

SEQ ID NO: 2715796 - DNA, 14 bp, Homo sapiens
atgaaaacattgat

SEQ ID NO: 2715797 - DNA, 15 bp, Homo sapiens
atgaaaacattgatg

SEQ ID NO: 2715798 - DNA, 20 bp, Homo sapiens
atgaaaacattgatgaatga

SEQ ID NO: 2715799 - DNA, 19 bp, Homo sapiens
atgaaaaccaccctatcat

SEQ ID NO: 2715800 - DNA, 14 bp, Homo sapiens
atgaaaacctgcat

SEQ ID NO: 2715801 - DNA, 12 bp, Homo sapiens
atgaaaagccat

SEQ ID NO: 2715802 - DNA, 16 bp, Homo sapiens
atgaaaccgtccctga

SEQ ID NO: 2715803 - DNA, 23 bp, Homo sapiens
atgaacaggatgtataatatgca

SEQ ID NO: 2715804 - DNA, 22 bp, Homo sapiens
atgaagactgttaaatgaaacc

SEQ ID NO: 2715805 - DNA, 20 bp, Homo sapiens
atgaataagtgtaagtaaat

SEQ ID NO: 2715806 - DNA, 14 bp, Homo sapiens
atgaatgggaaagt

SEQ ID NO: 2715807 - DNA, 18 bp, Homo sapiens
atgaatgtgttgatttga

SEQ ID NO: 2715808 - DNA, 15 bp, Homo sapiens
atgaattcacaaaca

SEQ ID NO: 2715809 - DNA, 19 bp, Homo sapiens
atgaattcacaaacaaatg

SEQ ID NO: 2715810 - DNA, 23 bp, Homo sapiens
atgacgagacctcagatgtgttg

SEQ ID NO: 2715811 - DNA, 20 bp, Homo sapiens
atgacttttccatgtatcta

SEQ ID NO: 2715812 - DNA, 23 bp, Homo sapiens
atgagaaactttgatctctgctt

SEQ ID NO: 2715813 - DNA, 15 bp, Homo sapiens
atgagaagtactttg

SEQ ID NO: 2715814 - DNA, 16 bp, Homo sapiens
atgagaagtactttgt

SEQ ID NO: 2715815 - DNA, 21 bp, Homo sapiens
atgagatgggttgagtttgct

SEQ ID NO: 2715816 - DNA, 17 bp, Homo sapiens
atgagcaactcctgttc

SEQ ID NO: 2715817 - DNA, 19 bp, Homo sapiens
atgagctcctgctcattgt

SEQ ID NO: 2715818 - DNA, 20 bp, Homo sapiens
atgagctcctgctcattgtg

SEQ ID NO: 2715819 - DNA, 17 bp, Homo sapiens
atgaggccatgcaaggg

SEQ ID NO: 2715820 - DNA, 16 bp, Homo sapiens
atgaggtccctctagc

SEQ ID NO: 2715821 - DNA, 22 bp, Homo sapiens
atgagtgggttagctacctgct

SEQ ID NO: 2715822 - DNA, 20 bp, Homo sapiens
atgagtttccagctaagcct

SEQ ID NO: 2715823 - DNA, 13 bp, Homo sapiens
atgatactttaat

SEQ ID NO: 2715824 - DNA, 15 bp, Homo sapiens
atgatgcatggagtg

SEQ ID NO: 2715825 - DNA, 20 bp, Homo sapiens
atgatgcatggagtgtttga

SEQ ID NO: 2715826 - DNA, 12 bp, Homo sapiens
atgatgccacac

SEQ ID NO: 2715827 - DNA, 11 bp, Homo sapiens
atgatgttaaa

SEQ ID NO: 2715828 - DNA, 19 bp, Homo sapiens
atgattgcactaaataaac

SEQ ID NO: 2715829 - DNA, 23 bp, Homo sapiens
atgattgcactaaataaactact

SEQ ID NO: 2715830 - DNA, 24 bp, Homo sapiens
atgattgcactaaataaactactt

SEQ ID NO: 2715831 - DNA, 19 bp, Homo sapiens
atgattgtttgcacagagg

SEQ ID NO: 2715832 - DNA, 14 bp, Homo sapiens
atgatttttgtgta

SEQ ID NO: 2715833 - DNA, 18 bp, Homo sapiens
atgatttttgtgtatcca

SEQ ID NO: 2715834 - DNA, 21 bp, Homo sapiens
atgatttttgtgtatccagta

SEQ ID NO: 2715835 - DNA, 12 bp, Homo sapiens
atgcaaaaacat

SEQ ID NO: 2715836 - DNA, 14 bp, Homo sapiens
atgcaaaaacatat

SEQ ID NO: 2715837 - DNA, 22 bp, Homo sapiens
atgcaaaaacatatgtctgtct

SEQ ID NO: 2715838 - DNA, 15 bp, Homo sapiens
atgcaagggtgacat

SEQ ID NO: 2715839 - DNA, 16 bp, Homo sapiens
atgcaagggtgacatc

SEQ ID NO: 2715840 - DNA, 13 bp, Homo sapiens
atgcaagtgctgt

SEQ ID NO: 2715841 - DNA, 14 bp, Homo sapiens
atgcaagtgctgtt

SEQ ID NO: 2715842 - DNA, 21 bp, Homo sapiens
atgcaagtgctgtttgggcag

SEQ ID NO: 2715843 - DNA, 16 bp, Homo sapiens
atgcaatgtatggctt

SEQ ID NO: 2715844 - DNA, 22 bp, Homo sapiens
atgcataatgaaccgtttacag

SEQ ID NO: 2715845 - DNA, 13 bp, Homo sapiens
atgcattcatgtt

SEQ ID NO: 2715846 - DNA, 14 bp, Homo sapiens
atgccaacttgtcc

SEQ ID NO: 2715847 - DNA, 17 bp, Homo sapiens
atgccacaccaagctgt

SEQ ID NO: 2715848 - DNA, 18 bp, Homo sapiens
atgccgcggtaggtaagg

SEQ ID NO: 2715849 - DNA, 18 bp, Homo sapiens
atgcctcagccagccctg

SEQ ID NO: 2715850 - DNA, 21 bp, Homo sapiens
atgctatctcgctagccatat

SEQ ID NO: 2715851 - DNA, 14 bp, Homo sapiens
atgctgaatgaatc

SEQ ID NO: 2715852 - DNA, 12 bp, Homo sapiens
atgctgcctgag

SEQ ID NO: 2715853 - DNA, 19 bp, Homo sapiens
atgctgctaattcaaagct

SEQ ID NO: 2715854 - DNA, 22 bp, Homo sapiens
atgctggacggcattcctgctt

SEQ ID NO: 2715855 - DNA, 17 bp, Homo sapiens
atgctggatgagcaact

SEQ ID NO: 2715856 - DNA, 21 bp, Homo sapiens
atgctggcctcttggcacctg

SEQ ID NO: 2715857 - DNA, 22 bp, Homo sapiens
atgctggcctcttggcacctgc

SEQ ID NO: 2715858 - DNA, 16 bp, Homo sapiens
atgctgggctgggtgc

SEQ ID NO: 2715859 - DNA, 21 bp, Homo sapiens
atgctggtgtggccaaggctg

SEQ ID NO: 2715860 - DNA, 22 bp, Homo sapiens
atgctggtgtggccaaggctga

SEQ ID NO: 2715861 - DNA, 18 bp, Homo sapiens
atgctgtcaggagatgga

SEQ ID NO: 2715862 - DNA, 22 bp, Homo sapiens
atgcttccatatttttaaattt

SEQ ID NO: 2715863 - DNA, 13 bp, Homo sapiens
atgcttctgcctc

SEQ ID NO: 2715864 - DNA, 15 bp, Homo sapiens
atgctttccaaaacc

SEQ ID NO: 2715865 - DNA, 13 bp, Homo sapiens
atgctttctcctt

SEQ ID NO: 2715866 - DNA, 19 bp, Homo sapiens
atggaactccccagggcct

SEQ ID NO: 2715867 - DNA, 13 bp, Homo sapiens
atggaagagtcat

SEQ ID NO: 2715868 - DNA, 17 bp, Homo sapiens
atggacaggagaaacat

SEQ ID NO: 2715869 - DNA, 22 bp, Homo sapiens
atggatttggttatgatggaaa

SEQ ID NO: 2715870 - DNA, 13 bp, Homo sapiens
atggcactgaccg

SEQ ID NO: 2715871 - DNA, 14 bp, Homo sapiens
atggcagatacatt

SEQ ID NO: 2715872 - DNA, 14 bp, Homo sapiens
atggcagctgggcc

SEQ ID NO: 2715873 - DNA, 16 bp, Homo sapiens
atggcagctgggccca

SEQ ID NO: 2715874 - DNA, 18 bp, Homo sapiens
atggcagctgggcccaca

SEQ ID NO: 2715875 - DNA, 21 bp, Homo sapiens
atggcagctgggcccacagcc

SEQ ID NO: 2715876 - DNA, 15 bp, Homo sapiens
atggcccagccactg

SEQ ID NO: 2715877 - DNA, 20 bp, Homo sapiens
atggcccagccactgcagca

SEQ ID NO: 2715878 - DNA, 20 bp, Homo sapiens
atggcctgccttgaagccac

SEQ ID NO: 2715879 - DNA, 15 bp, Homo sapiens
atggctattataatg

SEQ ID NO: 2715880 - DNA, 15 bp, Homo sapiens
atggctcccctgagg

SEQ ID NO: 2715881 - DNA, 19 bp, Homo sapiens
atggctcccctgaggctgg

SEQ ID NO: 2715882 - DNA, 20 bp, Homo sapiens
atggctcccctgaggctggc

SEQ ID NO: 2715883 - DNA, 23 bp, Homo sapiens
caagagtctctccagcctcacag

SEQ ID NO: 2715884 - DNA, 15 bp, Homo sapiens
caagatgtcagactg

SEQ ID NO: 2715885 - DNA, 17 bp, Homo sapiens
caagatgtcagactggc

SEQ ID NO: 2715886 - DNA, 18 bp, Homo sapiens
caagatttcacatcagct

SEQ ID NO: 2715887 - DNA, 13 bp, Homo sapiens
caagcattctcct

SEQ ID NO: 2715888 - DNA, 15 bp, Homo sapiens
caagcattctcctgt

SEQ ID NO: 2715889 - DNA, 14 bp, Homo sapiens
caagccctccgcct

SEQ ID NO: 2715890 - DNA, 23 bp, Homo sapiens
caagcctatggagtgaaattatt

SEQ ID NO: 2715891 - DNA, 22 bp, Homo sapiens
caagcgtgattcctgctgcctg

SEQ ID NO: 2715892 - DNA, 14 bp, Homo sapiens
caagctctgcctcc

SEQ ID NO: 2715893 - DNA, 18 bp, Homo sapiens
caagctgtgccaccctgg

SEQ ID NO: 2715894 - DNA, 20 bp, Homo sapiens
caagctgtgccaccctgggc

SEQ ID NO: 2715895 - DNA, 20 bp, Homo sapiens
caaggacaacctgcccctcc

SEQ ID NO: 2715896 - DNA, 16 bp, Homo sapiens
caaggaggctggctgg

SEQ ID NO: 2715897 - DNA, 19 bp, Homo sapiens
caaggaggctggctggggc

SEQ ID NO: 2715898 - DNA, 17 bp, Homo sapiens
caaggcagttctgtgtc

SEQ ID NO: 2715899 - DNA, 21 bp, Homo sapiens
caaggcagttctgtgtcctcg

SEQ ID NO: 2715900 - DNA, 18 bp, Homo sapiens
caaggcctcccacagtga

SEQ ID NO: 2715901 - DNA, 15 bp, Homo sapiens
caaggctgagagctc

SEQ ID NO: 2715902 - DNA, 18 bp, Homo sapiens
caagggtatgggaagcca

SEQ ID NO: 2715903 - DNA, 23 bp, Homo sapiens
caaggtaatttttttttgtaaag

SEQ ID NO: 2715904 - DNA, 15 bp, Homo sapiens
caaggtgcacagacc

SEQ ID NO: 2715905 - DNA, 21 bp, Homo sapiens
caaggtgcacagacctcagag

SEQ ID NO: 2715906 - DNA, 12 bp, Homo sapiens
caaggtgggctg

SEQ ID NO: 2715907 - DNA, 17 bp, Homo sapiens
caaggtgggctgagccc

SEQ ID NO: 2715908 - DNA, 18 bp, Homo sapiens
caaggtgggctgagccct

SEQ ID NO: 2715909 - DNA, 19 bp, Homo sapiens
caaggtgggctgagccctg

SEQ ID NO: 2715910 - DNA, 23 bp, Homo sapiens
caagtatttttatttaaattatt

SEQ ID NO: 2715911 - DNA, 19 bp, Homo sapiens
caagtccaacctgcctgtg

SEQ ID NO: 2715912 - DNA, 18 bp, Homo sapiens
caagtccctgactctctg

SEQ ID NO: 2715913 - DNA, 20 bp, Homo sapiens
caagtgaatgagtttccagc

SEQ ID NO: 2715914 - DNA, 12 bp, Homo sapiens
caagtgagtggc

SEQ ID NO: 2715915 - DNA, 22 bp, Homo sapiens
caagttcaagctctaaattgat

SEQ ID NO: 2715916 - DNA, 21 bp, Homo sapiens
caagttcctctagtgccctcc

SEQ ID NO: 2715917 - DNA, 15 bp, Homo sapiens
caagtttaaagtcat

SEQ ID NO: 2715918 - DNA, 12 bp, Homo sapiens
caataaagagct

SEQ ID NO: 2715919 - DNA, 13 bp, Homo sapiens
caataaatgctga

SEQ ID NO: 2715920 - DNA, 14 bp, Homo sapiens
caataactctgatt

SEQ ID NO: 2715921 - DNA, 16 bp, Homo sapiens
caataactctgatttt

SEQ ID NO: 2715922 - DNA, 19 bp, Homo sapiens
caatatgattgcactaaat

SEQ ID NO: 2715923 - DNA, 23 bp, Homo sapiens
caatattaaatgactttttgaat

SEQ ID NO: 2715924 - DNA, 13 bp, Homo sapiens
caatcaaacaggg

SEQ ID NO: 2715925 - DNA, 12 bp, Homo sapiens
caatcattttat

SEQ ID NO: 2715926 - DNA, 13 bp, Homo sapiens
caatcattttata

SEQ ID NO: 2715927 - DNA, 22 bp, Homo sapiens
caatcattttatataaagaaaa

SEQ ID NO: 2715928 - DNA, 15 bp, Homo sapiens
caatccaaatgcatt

SEQ ID NO: 2715929 - DNA, 16 bp, Homo sapiens
caatccaaatgcattc

SEQ ID NO: 2715930 - DNA, 17 bp, Homo sapiens
caatccaaatgcattca

SEQ ID NO: 2715931 - DNA, 16 bp, Homo sapiens
caatgccctacctgcc

SEQ ID NO: 2715932 - DNA, 18 bp, Homo sapiens
caatgccctacctgcctg

SEQ ID NO: 2715933 - DNA, 12 bp, Homo sapiens
caatgcgtggca

SEQ ID NO: 2715934 - DNA, 13 bp, Homo sapiens
caatgcttctgcc

SEQ ID NO: 2715935 - DNA, 21 bp, Homo sapiens
caatgtacaaggtatgtacag

SEQ ID NO: 2715936 - DNA, 15 bp, Homo sapiens
caatgtcagaaactc

SEQ ID NO: 2715937 - DNA, 13 bp, Homo sapiens
caattaactctgg

SEQ ID NO: 2715938 - DNA, 11 bp, Homo sapiens
caattcattgt

SEQ ID NO: 2715939 - DNA, 12 bp, Homo sapiens
caattcctgggc

SEQ ID NO: 2715940 - DNA, 16 bp, Homo sapiens
caattcctgggcccca

SEQ ID NO: 2715941 - DNA, 21 bp, Homo sapiens
caattcttctcgacttcagga

SEQ ID NO: 2715942 - DNA, 13 bp, Homo sapiens
caattgtcttttt

SEQ ID NO: 2715943 - DNA, 21 bp, Homo sapiens
caatttactttttaaacagtg

SEQ ID NO: 2715944 - DNA, 15 bp, Homo sapiens
caatttatatcttta

SEQ ID NO: 2715945 - DNA, 19 bp, Homo sapiens
caatttatatctttatgca

SEQ ID NO: 2715946 - DNA, 21 bp, Homo sapiens
caatttatatctttatgcaaa

SEQ ID NO: 2715947 - DNA, 22 bp, Homo sapiens
caatttatatctttatgcaaaa

SEQ ID NO: 2715948 - DNA, 14 bp, Homo sapiens
caattttgtcacag

SEQ ID NO: 2715949 - DNA, 14 bp, Homo sapiens
caattttttaaacc

SEQ ID NO: 2715950 - DNA, 15 bp, Homo sapiens
caattttttaaacca

SEQ ID NO: 2715951 - DNA, 18 bp, Homo sapiens
cacaaaaaaataataaaa

SEQ ID NO: 2715952 - DNA, 16 bp, Homo sapiens
cacaaaagctgtgtct

SEQ ID NO: 2715953 - DNA, 19 bp, Homo sapiens
cacaacgctctaccctgca

SEQ ID NO: 2715954 - DNA, 16 bp, Homo sapiens
cacaagctcaggtcct

SEQ ID NO: 2715955 - DNA, 14 bp, Homo sapiens
cacaagctccctgg

SEQ ID NO: 2715956 - DNA, 13 bp, Homo sapiens
cacacacactcct

SEQ ID NO: 2715957 - DNA, 23 bp, Homo sapiens
cacaccaagctgtgccaccctgg

SEQ ID NO: 2715958 - DNA, 12 bp, Homo sapiens
cacaccctgcct

SEQ ID NO: 2715959 - DNA, 14 bp, Homo sapiens
cacaccctgcctgc

SEQ ID NO: 2715960 - DNA, 15 bp, Homo sapiens
cacaccctgcctgct

SEQ ID NO: 2715961 - DNA, 20 bp, Homo sapiens
cacaccctgcctgctgtgga

SEQ ID NO: 2715962 - DNA, 12 bp, Homo sapiens
cacactcagcag

SEQ ID NO: 2715963 - DNA, 15 bp, Homo sapiens
cacactcagcagccc

SEQ ID NO: 2715964 - DNA, 13 bp, Homo sapiens
cacactcctcctg

SEQ ID NO: 2715965 - DNA, 15 bp, Homo sapiens
cacactcctcctgcc

SEQ ID NO: 2715966 - DNA, 17 bp, Homo sapiens
cacagacctcagagatg

SEQ ID NO: 2715967 - DNA, 12 bp, Homo sapiens
cacagactctgt

SEQ ID NO: 2715968 - DNA, 20 bp, Homo sapiens
cacagactcttccaccagag

SEQ ID NO: 2715969 - DNA, 21 bp, Homo sapiens
cacagactcttccaccagagc

SEQ ID NO: 2715970 - DNA, 22 bp, Homo sapiens
cacagactcttccaccagagca

SEQ ID NO: 2715971 - DNA, 14 bp, Homo sapiens
cacagagagagtca

SEQ ID NO: 2715972 - DNA, 16 bp, Homo sapiens
cacagagggcgctcct

SEQ ID NO: 2715973 - DNA, 18 bp, Homo sapiens
cacagagggcgctcctgt

SEQ ID NO: 2715974 - DNA, 13 bp, Homo sapiens
cacagatgctggc

SEQ ID NO: 2715975 - DNA, 14 bp, Homo sapiens
cacagatgctggcc

SEQ ID NO: 2715976 - DNA, 16 bp, Homo sapiens
cacagatgctggcctc

SEQ ID NO: 2715977 - DNA, 18 bp, Homo sapiens
cacagatgctggcctctt

SEQ ID NO: 2715978 - DNA, 16 bp, Homo sapiens
cacagcaaggaggctg

SEQ ID NO: 2715979 - DNA, 21 bp, Homo sapiens
cacagcaaggaggctggctgg

SEQ ID NO: 2715980 - DNA, 19 bp, Homo sapiens
cacagcaaggcacctgcag

SEQ ID NO: 2715981 - DNA, 14 bp, Homo sapiens
cacagcatgcagac

SEQ ID NO: 2715982 - DNA, 15 bp, Homo sapiens
cacagcccccacccc

SEQ ID NO: 2715983 - DNA, 17 bp, Homo sapiens
cacagcccccaccccag

SEQ ID NO: 2715984 - DNA, 14 bp, Homo sapiens
cacagccctcccgc

SEQ ID NO: 2715985 - DNA, 17 bp, Homo sapiens
cacagccctcccgcccc

SEQ ID NO: 2715986 - DNA, 16 bp, Homo sapiens
cacagcgcctcctgga

SEQ ID NO: 2715987 - DNA, 11 bp, Homo sapiens
cacagctcctc

SEQ ID NO: 2715988 - DNA, 15 bp, Homo sapiens
cacagctcctcccct

SEQ ID NO: 2715989 - DNA, 18 bp, Homo sapiens
cacagctcctcccctgcc

SEQ ID NO: 2715990 - DNA, 19 bp, Homo sapiens
cacagctcctcccctgccg

SEQ ID NO: 2715991 - DNA, 22 bp, Homo sapiens
cacagctcctcccctgccgcct

SEQ ID NO: 2715992 - DNA, 18 bp, Homo sapiens
cacagctgagctggccta

SEQ ID NO: 2715993 - DNA, 15 bp, Homo sapiens
cacaggactctgcag

SEQ ID NO: 2715994 - DNA, 17 bp, Homo sapiens
cacaggactctgcagat

SEQ ID NO: 2715995 - DNA, 22 bp, Homo sapiens
cacaggaggctccgtgagccct

SEQ ID NO: 2715996 - DNA, 13 bp, Homo sapiens
cacagggagctgg

SEQ ID NO: 2715997 - DNA, 14 bp, Homo sapiens
cacagggcagagcc

SEQ ID NO: 2715998 - DNA, 17 bp, Homo sapiens
cacagggcagagccggg

SEQ ID NO: 2715999 - DNA, 13 bp, Homo sapiens
cacaggtggtaca

SEQ ID NO: 2716000 - DNA, 15 bp, Homo sapiens
cacagtagagcactt

SEQ ID NO: 2716001 - DNA, 16 bp, Homo sapiens
cacagtcctcacagcc

SEQ ID NO: 2716002 - DNA, 18 bp, Homo sapiens
cacagtgactcgggctcc

SEQ ID NO: 2716003 - DNA, 23 bp, Homo sapiens
cacagtgactcgggctcctgtgc

SEQ ID NO: 2716004 - DNA, 13 bp, Homo sapiens
cacagtggaacca

SEQ ID NO: 2716005 - DNA, 14 bp, Homo sapiens
cacagtgtctgggc

SEQ ID NO: 2716006 - DNA, 23 bp, Homo sapiens
cacagtgtttcctgagtagcagt

SEQ ID NO: 2716007 - DNA, 14 bp, Homo sapiens
cacagttcatttaa

SEQ ID NO: 2716008 - DNA, 20 bp, Homo sapiens
caggatgtcctttgtgtcca

SEQ ID NO: 2716009 - DNA, 18 bp, Homo sapiens
caggcacatggctggggg

SEQ ID NO: 2716010 - DNA, 18 bp, Homo sapiens
caggcagcgcctgtcccc

SEQ ID NO: 2716011 - DNA, 21 bp, Homo sapiens
caggcagcgcctgtcccctca

SEQ ID NO: 2716012 - DNA, 18 bp, Homo sapiens
caggccaagagcagaggc

SEQ ID NO: 2716013 - DNA, 16 bp, Homo sapiens
caggccacaaatgtgt

SEQ ID NO: 2716014 - DNA, 15 bp, Homo sapiens
caggccaggtgcagt

SEQ ID NO: 2716015 - DNA, 19 bp, Homo sapiens
caggccatcttccaggtgg

SEQ ID NO: 2716016 - DNA, 14 bp, Homo sapiens
caggccctgcactg

SEQ ID NO: 2716017 - DNA, 17 bp, Homo sapiens
caggccctgcactgtcc

SEQ ID NO: 2716018 - DNA, 19 bp, Homo sapiens
caggccctgcactgtcctg

SEQ ID NO: 2716019 - DNA, 17 bp, Homo sapiens
caggcctggcaagtggg

SEQ ID NO: 2716020 - DNA, 20 bp, Homo sapiens
caggcctggcaagtgggtga

SEQ ID NO: 2716021 - DNA, 11 bp, Homo sapiens
caggctggcca

SEQ ID NO: 2716022 - DNA, 16 bp, Homo sapiens
caggctggccagcccc

SEQ ID NO: 2716023 - DNA, 20 bp, Homo sapiens
caggctgggttgtcactgag

SEQ ID NO: 2716024 - DNA, 22 bp, Homo sapiens
caggctgggttgtcactgagac

SEQ ID NO: 2716025 - DNA, 20 bp, Homo sapiens
caggctggtctcgaactcct

SEQ ID NO: 2716026 - DNA, 21 bp, Homo sapiens
cagggaagccctcggcctcca

SEQ ID NO: 2716027 - DNA, 23 bp, Homo sapiens
cagggaatttcaggaactagaga

SEQ ID NO: 2716028 - DNA, 20 bp, Homo sapiens
cagggacactacaaacatgg

SEQ ID NO: 2716029 - DNA, 11 bp, Homo sapiens
cagggacagaa

SEQ ID NO: 2716030 - DNA, 20 bp, Homo sapiens
cagggaccactgggtgagag

SEQ ID NO: 2716031 - DNA, 18 bp, Homo sapiens
cagggactcaggccagtc

SEQ ID NO: 2716032 - DNA, 14 bp, Homo sapiens
cagggatttgagga

SEQ ID NO: 2716033 - DNA, 16 bp, Homo sapiens
cagggcacagctggag

SEQ ID NO: 2716034 - DNA, 16 bp, Homo sapiens
cagggccagggccctg

SEQ ID NO: 2716035 - DNA, 18 bp, Homo sapiens
cagggccatctcctccca

SEQ ID NO: 2716036 - DNA, 18 bp, Homo sapiens
cagggccctgcagagggg

SEQ ID NO: 2716037 - DNA, 17 bp, Homo sapiens
cagggcctccaggactg

SEQ ID NO: 2716038 - DNA, 16 bp, Homo sapiens
cagggcctctgtgcag

SEQ ID NO: 2716039 - DNA, 18 bp, Homo sapiens
cagggctccctcctggag

SEQ ID NO: 2716040 - DNA, 21 bp, Homo sapiens
cagggcttgtggactctctgc

SEQ ID NO: 2716041 - DNA, 22 bp, Homo sapiens
cagggcttgtggactctctgcc

SEQ ID NO: 2716042 - DNA, 23 bp, Homo sapiens
cagggcttgtggactctctgcct

SEQ ID NO: 2716043 - DNA, 14 bp, Homo sapiens
caggggactgggcc

SEQ ID NO: 2716044 - DNA, 17 bp, Homo sapiens
caggggactgggccatg

SEQ ID NO: 2716045 - DNA, 18 bp, Homo sapiens
caggggagggaaaagcta

SEQ ID NO: 2716046 - DNA, 18 bp, Homo sapiens
caggggcaccctccaaac

SEQ ID NO: 2716047 - DNA, 21 bp, Homo sapiens
caggggcaccctccaaacact

SEQ ID NO: 2716048 - DNA, 14 bp, Homo sapiens
caggggcaggcaca

SEQ ID NO: 2716049 - DNA, 16 bp, Homo sapiens
caggggcaggcacagc

SEQ ID NO: 2716050 - DNA, 22 bp, Homo sapiens
caggggcaggcacagcacaggg

SEQ ID NO: 2716051 - DNA, 20 bp, Homo sapiens
caggggctgcccgctcccag

SEQ ID NO: 2716052 - DNA, 13 bp, Homo sapiens
caggggctgctgg

SEQ ID NO: 2716053 - DNA, 14 bp, Homo sapiens
caggggctgctggg

SEQ ID NO: 2716054 - DNA, 15 bp, Homo sapiens
caggggctgctgggg

SEQ ID NO: 2716055 - DNA, 17 bp, Homo sapiens
caggggctgctgggggc

SEQ ID NO: 2716056 - DNA, 19 bp, Homo sapiens
cagggtagactaaaaaggc

SEQ ID NO: 2716057 - DNA, 12 bp, Homo sapiens
cagggtcccagc

SEQ ID NO: 2716058 - DNA, 19 bp, Homo sapiens
cagggtgagaacgtgccca

SEQ ID NO: 2716059 - DNA, 21 bp, Homo sapiens
cagggtgagaacgtgcccagc

SEQ ID NO: 2716060 - DNA, 18 bp, Homo sapiens
cagggttctgaccgggtc

SEQ ID NO: 2716061 - DNA, 19 bp, Homo sapiens
caggtcttgttcaagcagc

SEQ ID NO: 2716062 - DNA, 23 bp, Homo sapiens
caggtgacggactcagactcctg

SEQ ID NO: 2716063 - DNA, 22 bp, Homo sapiens
caggtgggcgggcagcacagca

SEQ ID NO: 2716064 - DNA, 22 bp, Homo sapiens
caggtggggtgaggcagtgggt

SEQ ID NO: 2716065 - DNA, 23 bp, Homo sapiens
caggtgtgagccaccgcgcccag

SEQ ID NO: 2716066 - DNA, 20 bp, Homo sapiens
caggtgtgttcagtagttcc

SEQ ID NO: 2716067 - DNA, 22 bp, Homo sapiens
caggttgaggggctcctggaaa

SEQ ID NO: 2716068 - DNA, 19 bp, Homo sapiens
caggttggaaaagaaatca

SEQ ID NO: 2716069 - DNA, 13 bp, Homo sapiens
caggttgggccat

SEQ ID NO: 2716070 - DNA, 19 bp, Homo sapiens
cagtaaactttctctgcaa

SEQ ID NO: 2716071 - DNA, 19 bp, Homo sapiens
cagtaaataaattgtttga

SEQ ID NO: 2716072 - DNA, 24 bp, Homo sapiens
cagtaaataaattgtttgaccatg

SEQ ID NO: 2716073 - DNA, 18 bp, Homo sapiens
cagtaagtataacaaact

SEQ ID NO: 2716074 - DNA, 23 bp, Homo sapiens
cagtacagagaaattctgtggtg

SEQ ID NO: 2716075 - DNA, 17 bp, Homo sapiens
cagtagtcacctctggg

SEQ ID NO: 2716076 - DNA, 16 bp, Homo sapiens
cagtatcctgctggtt

SEQ ID NO: 2716077 - DNA, 22 bp, Homo sapiens
cagtcattgtaacctcgtgtct

SEQ ID NO: 2716078 - DNA, 13 bp, Homo sapiens
cagtcctagagct

SEQ ID NO: 2716079 - DNA, 14 bp, Homo sapiens
cagtcctagagctc

SEQ ID NO: 2716080 - DNA, 15 bp, Homo sapiens
cagtcctagagctcc

SEQ ID NO: 2716081 - DNA, 22 bp, Homo sapiens
cagtcctagagctcctgtccct

SEQ ID NO: 2716082 - DNA, 17 bp, Homo sapiens
cagtcctcacagcctct

SEQ ID NO: 2716083 - DNA, 20 bp, Homo sapiens
cagtcctcacagcctctccc

SEQ ID NO: 2716084 - DNA, 20 bp, Homo sapiens
cagtcctctccacctagtgg

SEQ ID NO: 2716085 - DNA, 15 bp, Homo sapiens
cagtcctgctggcct

SEQ ID NO: 2716086 - DNA, 16 bp, Homo sapiens
cagtcctgctggcctg

SEQ ID NO: 2716087 - DNA, 12 bp, Homo sapiens
cagtcctgggag

SEQ ID NO: 2716088 - DNA, 13 bp, Homo sapiens
cagtcctgggaga

SEQ ID NO: 2716089 - DNA, 22 bp, Homo sapiens
cagtcctgggagaacctcaggc

SEQ ID NO: 2716090 - DNA, 23 bp, Homo sapiens
cagtcctgggagaacctcaggct

SEQ ID NO: 2716091 - DNA, 16 bp, Homo sapiens
cagtcgcgctgcctgt

SEQ ID NO: 2716092 - DNA, 13 bp, Homo sapiens
cagtctcaatttt

SEQ ID NO: 2716093 - DNA, 15 bp, Homo sapiens
cagtctcaattttgt

SEQ ID NO: 2716094 - DNA, 13 bp, Homo sapiens
cagtctcaggagc

SEQ ID NO: 2716095 - DNA, 14 bp, Homo sapiens
cagtctcaggagca

SEQ ID NO: 2716096 - DNA, 18 bp, Homo sapiens
cagtctcaggagcatggg

SEQ ID NO: 2716097 - DNA, 19 bp, Homo sapiens
cagtcttaatattcagaga

SEQ ID NO: 2716098 - DNA, 15 bp, Homo sapiens
cagtcttttgctgtg

SEQ ID NO: 2716099 - DNA, 19 bp, Homo sapiens
cagtgaacacactcagcag

SEQ ID NO: 2716100 - DNA, 18 bp, Homo sapiens
cagtgaactgagactgcg

SEQ ID NO: 2716101 - DNA, 18 bp, Homo sapiens
cagtgaatttaagcatga

SEQ ID NO: 2716102 - DNA, 13 bp, Homo sapiens
cagtgacaacatc

SEQ ID NO: 2716103 - DNA, 21 bp, Homo sapiens
cagtgacgtgactcagagctt

SEQ ID NO: 2716104 - DNA, 22 bp, Homo sapiens
cagtgacgtgcacctgtactca

SEQ ID NO: 2716105 - DNA, 21 bp, Homo sapiens
cagtgactcgggctcctgtgc

SEQ ID NO: 2716106 - DNA, 19 bp, Homo sapiens
cagtgagaagggcctgctc

SEQ ID NO: 2716107 - DNA, 20 bp, Homo sapiens
cagtgagaagggcctgctct

SEQ ID NO: 2716108 - DNA, 22 bp, Homo sapiens
cagtgagaagggcctgctctgc

SEQ ID NO: 2716109 - DNA, 14 bp, Homo sapiens
cagtgagcctctgc

SEQ ID NO: 2716110 - DNA, 19 bp, Homo sapiens
cagtgagcctctgcgcctc

SEQ ID NO: 2716111 - DNA, 18 bp, Homo sapiens
cagtgcccattcctcacc

SEQ ID NO: 2716112 - DNA, 19 bp, Homo sapiens
cagtgcccattcctcacct

SEQ ID NO: 2716113 - DNA, 18 bp, Homo sapiens
cagtgccgccgcctcgcc

SEQ ID NO: 2716114 - DNA, 12 bp, Homo sapiens
cagtgcctcagt

SEQ ID NO: 2716115 - DNA, 12 bp, Homo sapiens
cagtgctgtggc

SEQ ID NO: 2716116 - DNA, 16 bp, Homo sapiens
cagtgcttcagcctga

SEQ ID NO: 2716117 - DNA, 20 bp, Homo sapiens
cagtgcttcagcctgaggct

SEQ ID NO: 2716118 - DNA, 22 bp, Homo sapiens
cagtggcccccactcacaggga

SEQ ID NO: 2716119 - DNA, 19 bp, Homo sapiens
cagtggcgtgatctcggct

SEQ ID NO: 2716120 - DNA, 20 bp, Homo sapiens
cagtgggaggacagagccgg

SEQ ID NO: 2716121 - DNA, 17 bp, Homo sapiens
cagtgggagggaattcc

SEQ ID NO: 2716122 - DNA, 14 bp, Homo sapiens
cagtgggtcccact

SEQ ID NO: 2716123 - DNA, 20 bp, Homo sapiens
cagtgggtcccacttcccct

SEQ ID NO: 2716124 - DNA, 22 bp, Homo sapiens
cagtgggtcccacttcccctcc

SEQ ID NO: 2716125 - DNA, 17 bp, Homo sapiens
cagtgtacccccgccca

SEQ ID NO: 2716126 - DNA, 20 bp, Homo sapiens
cagtgtacccccgcccaggc

SEQ ID NO: 2716127 - DNA, 14 bp, Homo sapiens
cagtgtatctaatt

SEQ ID NO: 2716128 - DNA, 15 bp, Homo sapiens
cagtgtcagagtcat

SEQ ID NO: 2716129 - DNA, 17 bp, Homo sapiens
cagtgtcttcctgtggg

SEQ ID NO: 2716130 - DNA, 19 bp, Homo sapiens
cagtgtgagtataaaataa

SEQ ID NO: 2716131 - DNA, 22 bp, Homo sapiens
catgtgtatgagaagtactttg

SEQ ID NO: 2716132 - DNA, 21 bp, Homo sapiens
catgttttaaaagtttgtcct

SEQ ID NO: 2716133 - DNA, 15 bp, Homo sapiens
cattaatctgtttgt

SEQ ID NO: 2716134 - DNA, 15 bp, Homo sapiens
cattacatggctgtg

SEQ ID NO: 2716135 - DNA, 16 bp, Homo sapiens
cattaccttgtctttc

SEQ ID NO: 2716136 - DNA, 18 bp, Homo sapiens
cattaccttgtctttcaa

SEQ ID NO: 2716137 - DNA, 17 bp, Homo sapiens
cattaggaaaacatctt

SEQ ID NO: 2716138 - DNA, 23 bp, Homo sapiens
cattagggcaaagatctcagcag

SEQ ID NO: 2716139 - DNA, 19 bp, Homo sapiens
cattatgttattggaattt

SEQ ID NO: 2716140 - DNA, 21 bp, Homo sapiens
cattatgttattggaattttc

SEQ ID NO: 2716141 - DNA, 23 bp, Homo sapiens
cattatgttattggaattttctt

SEQ ID NO: 2716142 - DNA, 13 bp, Homo sapiens
cattatttgataa

SEQ ID NO: 2716143 - DNA, 14 bp, Homo sapiens
cattattttgtatg

SEQ ID NO: 2716144 - DNA, 17 bp, Homo sapiens
cattcaagcatgtttaa

SEQ ID NO: 2716145 - DNA, 15 bp, Homo sapiens
cattcagcagtcagt

SEQ ID NO: 2716146 - DNA, 18 bp, Homo sapiens
cattcaggtgttctcttc

SEQ ID NO: 2716147 - DNA, 14 bp, Homo sapiens
cattcataatttta

SEQ ID NO: 2716148 - DNA, 14 bp, Homo sapiens
cattcatctggagg

SEQ ID NO: 2716149 - DNA, 18 bp, Homo sapiens
cattccaagtcaacactc

SEQ ID NO: 2716150 - DNA, 20 bp, Homo sapiens
cattccaagtcaacactctt

SEQ ID NO: 2716151 - DNA, 21 bp, Homo sapiens
cattccctcgggaccctccca

SEQ ID NO: 2716152 - DNA, 20 bp, Homo sapiens
cattcgaggtgtcaccctgc

SEQ ID NO: 2716153 - DNA, 14 bp, Homo sapiens
cattctagtgcaga

SEQ ID NO: 2716154 - DNA, 13 bp, Homo sapiens
cattctcctgcct

SEQ ID NO: 2716155 - DNA, 22 bp, Homo sapiens
cattctcctgcctcagcctcct

SEQ ID NO: 2716156 - DNA, 14 bp, Homo sapiens
cattctctctgctc

SEQ ID NO: 2716157 - DNA, 18 bp, Homo sapiens
cattctctctgctcagtg

SEQ ID NO: 2716158 - DNA, 19 bp, Homo sapiens
cattctctctgctcagtga

SEQ ID NO: 2716159 - DNA, 21 bp, Homo sapiens
cattctgtctctgcttggctt

SEQ ID NO: 2716160 - DNA, 20 bp, Homo sapiens
cattctttcttggtgcattc

SEQ ID NO: 2716161 - DNA, 13 bp, Homo sapiens
cattgatgaatga

SEQ ID NO: 2716162 - DNA, 17 bp, Homo sapiens
cattggcagcaggtgct

SEQ ID NO: 2716163 - DNA, 17 bp, Homo sapiens
cattggttaaaatatta

SEQ ID NO: 2716164 - DNA, 19 bp, Homo sapiens
cattgtcttccaaccccag

SEQ ID NO: 2716165 - DNA, 12 bp, Homo sapiens
cattgtgtatga

SEQ ID NO: 2716166 - DNA, 13 bp, Homo sapiens
catttaggagaag

SEQ ID NO: 2716167 - DNA, 13 bp, Homo sapiens
catttcaggaggt

SEQ ID NO: 2716168 - DNA, 15 bp, Homo sapiens
catttcatacaacag

SEQ ID NO: 2716169 - DNA, 16 bp, Homo sapiens
catttcatacaacaga

SEQ ID NO: 2716170 - DNA, 13 bp, Homo sapiens
catttctactgta

SEQ ID NO: 2716171 - DNA, 21 bp, Homo sapiens
catttctactgtataaacaaa

SEQ ID NO: 2716172 - DNA, 17 bp, Homo sapiens
catttcttggtatgatc

SEQ ID NO: 2716173 - DNA, 14 bp, Homo sapiens
catttgatttcgat

SEQ ID NO: 2716174 - DNA, 12 bp, Homo sapiens
catttggcagaa

SEQ ID NO: 2716175 - DNA, 20 bp, Homo sapiens
catttggcagaactgctggg

SEQ ID NO: 2716176 - DNA, 15 bp, Homo sapiens
cattttataaagtta

SEQ ID NO: 2716177 - DNA, 20 bp, Homo sapiens
cattttcagcatcaaacatg

SEQ ID NO: 2716178 - DNA, 12 bp, Homo sapiens
cattttcttgtc

SEQ ID NO: 2716179 - DNA, 18 bp, Homo sapiens
cattttcttgtcaatgga

SEQ ID NO: 2716180 - DNA, 18 bp, Homo sapiens
cattttgaaaacccctgg

SEQ ID NO: 2716181 - DNA, 18 bp, Homo sapiens
cattttgaatgtgatcat

SEQ ID NO: 2716182 - DNA, 23 bp, Homo sapiens
cattttgtacaaagatatgctaa

SEQ ID NO: 2716183 - DNA, 12 bp, Homo sapiens
catttttaaagg

SEQ ID NO: 2716184 - DNA, 21 bp, Homo sapiens
catttttaaaggacaaacagt

SEQ ID NO: 2716185 - DNA, 22 bp, Homo sapiens
catttttaaaggacaaacagtg

SEQ ID NO: 2716186 - DNA, 23 bp, Homo sapiens
catttttaaaggacaaacagtga

SEQ ID NO: 2716187 - DNA, 16 bp, Homo sapiens
catttttgtacattat

SEQ ID NO: 2716188 - DNA, 18 bp, Homo sapiens
catttttgtacattatgt

SEQ ID NO: 2716189 - DNA, 18 bp, Homo sapiens
ccaaaatctaaaagctgt

SEQ ID NO: 2716190 - DNA, 13 bp, Homo sapiens
ccaaactctgcca

SEQ ID NO: 2716191 - DNA, 16 bp, Homo sapiens
ccaaagagtctctggc

SEQ ID NO: 2716192 - DNA, 17 bp, Homo sapiens
ccaaagagtctctggct

SEQ ID NO: 2716193 - DNA, 20 bp, Homo sapiens
ccaaatagggcaaagaatca

SEQ ID NO: 2716194 - DNA, 14 bp, Homo sapiens
ccaaatattctcct

SEQ ID NO: 2716195 - DNA, 21 bp, Homo sapiens
ccaaattaatcttttaaaaat

SEQ ID NO: 2716196 - DNA, 13 bp, Homo sapiens
ccaaattcaaaga

SEQ ID NO: 2716197 - DNA, 11 bp, Homo sapiens
ccaacagcagc

SEQ ID NO: 2716198 - DNA, 16 bp, Homo sapiens
ccaacagcccccccct

SEQ ID NO: 2716199 - DNA, 13 bp, Homo sapiens
ccaacccagccgc

SEQ ID NO: 2716200 - DNA, 16 bp, Homo sapiens
ccaacccagccgctgc

SEQ ID NO: 2716201 - DNA, 13 bp, Homo sapiens
ccaacccagcctg

SEQ ID NO: 2716202 - DNA, 13 bp, Homo sapiens
ccaacctgtcctt

SEQ ID NO: 2716203 - DNA, 23 bp, Homo sapiens
ccaacctgtccttactcagagct

SEQ ID NO: 2716204 - DNA, 15 bp, Homo sapiens
ccaagaggctggaaa

SEQ ID NO: 2716205 - DNA, 18 bp, Homo sapiens
ccaagaggctggaaaagg

SEQ ID NO: 2716206 - DNA, 16 bp, Homo sapiens
ccaagccaccgcagct

SEQ ID NO: 2716207 - DNA, 15 bp, Homo sapiens
ccaagccctccgcct

SEQ ID NO: 2716208 - DNA, 15 bp, Homo sapiens
ccaagctgtgccacc

SEQ ID NO: 2716209 - DNA, 14 bp, Homo sapiens
ccaaggcagttctg

SEQ ID NO: 2716210 - DNA, 22 bp, Homo sapiens
ccaagggtaactcttggccaga

SEQ ID NO: 2716211 - DNA, 18 bp, Homo sapiens
ccaaggtctcacactcct

SEQ ID NO: 2716212 - DNA, 22 bp, Homo sapiens
ccaaggtctcacactcctcctg

SEQ ID NO: 2716213 - DNA, 18 bp, Homo sapiens
ccaaggtgggctgagccc

SEQ ID NO: 2716214 - DNA, 23 bp, Homo sapiens
ccaaggtggtctgctcgggccca

SEQ ID NO: 2716215 - DNA, 22 bp, Homo sapiens
ccaaggtttcccagtgagcctc

SEQ ID NO: 2716216 - DNA, 20 bp, Homo sapiens
ccaagtagctgagattacag

SEQ ID NO: 2716217 - DNA, 22 bp, Homo sapiens
ccaagtgtctcttgactggctc

SEQ ID NO: 2716218 - DNA, 20 bp, Homo sapiens
ccaatccatttggcagaact

SEQ ID NO: 2716219 - DNA, 20 bp, Homo sapiens
ccaatgaagcaaacacacag

SEQ ID NO: 2716220 - DNA, 22 bp, Homo sapiens
ccacaaatgtgtcccagtgaac

SEQ ID NO: 2716221 - DNA, 19 bp, Homo sapiens
ccacacacactccttcccc

SEQ ID NO: 2716222 - DNA, 12 bp, Homo sapiens
ccacaccaagct

SEQ ID NO: 2716223 - DNA, 14 bp, Homo sapiens
ccacaccaagctgt

SEQ ID NO: 2716224 - DNA, 23 bp, Homo sapiens
ccacaccaagctgtgccaccctg

SEQ ID NO: 2716225 - DNA, 13 bp, Homo sapiens
ccacaccctgcct

SEQ ID NO: 2716226 - DNA, 23 bp, Homo sapiens
ccacaccctgcctgctgtggagc

SEQ ID NO: 2716227 - DNA, 23 bp, Homo sapiens
ccacacttcttgaaacagcctgg

SEQ ID NO: 2716228 - DNA, 17 bp, Homo sapiens
ccacagcaaggcacctg

SEQ ID NO: 2716229 - DNA, 17 bp, Homo sapiens
ccacagcccacgtcctg

SEQ ID NO: 2716230 - DNA, 18 bp, Homo sapiens
ccacagcccacgtcctgt

SEQ ID NO: 2716231 - DNA, 19 bp, Homo sapiens
ccacagcccacgtcctgtc

SEQ ID NO: 2716232 - DNA, 12 bp, Homo sapiens
ccacagccgcag

SEQ ID NO: 2716233 - DNA, 18 bp, Homo sapiens
ccacagccgcagcctccc

SEQ ID NO: 2716234 - DNA, 14 bp, Homo sapiens
ccacagctctgctg

SEQ ID NO: 2716235 - DNA, 19 bp, Homo sapiens
ccacagggaagcatgtact

SEQ ID NO: 2716236 - DNA, 15 bp, Homo sapiens
ccacagtcctcacag

SEQ ID NO: 2716237 - DNA, 23 bp, Homo sapiens
ccacagtgactcgggctcctgtg

SEQ ID NO: 2716238 - DNA, 16 bp, Homo sapiens
ccacattctgtctctg

SEQ ID NO: 2716239 - DNA, 18 bp, Homo sapiens
ccaccaaggtctcacact

SEQ ID NO: 2716240 - DNA, 21 bp, Homo sapiens
ccaccaaggtctcacactcct

SEQ ID NO: 2716241 - DNA, 22 bp, Homo sapiens
ccaccaaggtctcacactcctc

SEQ ID NO: 2716242 - DNA, 14 bp, Homo sapiens
ccaccacccaacct

SEQ ID NO: 2716243 - DNA, 20 bp, Homo sapiens
ccaccagagcaggggctgct

SEQ ID NO: 2716244 - DNA, 13 bp, Homo sapiens
ccaccagagctgc

SEQ ID NO: 2716245 - DNA, 14 bp, Homo sapiens
ccaccagagctgcc

SEQ ID NO: 2716246 - DNA, 16 bp, Homo sapiens
ccaccagagctgcctc

SEQ ID NO: 2716247 - DNA, 17 bp, Homo sapiens
ccaccagagctgcctcc

SEQ ID NO: 2716248 - DNA, 15 bp, Homo sapiens
ccacccagggctccc

SEQ ID NO: 2716249 - DNA, 12 bp, Homo sapiens
ccaccccagcac

SEQ ID NO: 2716250 - DNA, 15 bp, Homo sapiens
ccaccccagcacagc

SEQ ID NO: 2716251 - DNA, 15 bp, Homo sapiens
ccaccctgggctctg

SEQ ID NO: 2716252 - DNA, 23 bp, Homo sapiens
ccaccctgggctctgtgggctgc

SEQ ID NO: 2716253 - DNA, 18 bp, Homo sapiens
ccaccgcagctgctgcca

SEQ ID NO: 2716254 - DNA, 22 bp, Homo sapiens
ccaccgcagctgctgccactct

SEQ ID NO: 2716255 - DNA, 13 bp, Homo sapiens
cccctgggctctg

SEQ ID NO: 2716256 - DNA, 15 bp, Homo sapiens
cccctgggctctgcc

SEQ ID NO: 2716257 - DNA, 23 bp, Homo sapiens
cccctgggctctgccccagctct

SEQ ID NO: 2716258 - DNA, 15 bp, Homo sapiens
cccctggggctggtg

SEQ ID NO: 2716259 - DNA, 13 bp, Homo sapiens
cccctgtcccctg

SEQ ID NO: 2716260 - DNA, 16 bp, Homo sapiens
ccccttgcccttcctg

SEQ ID NO: 2716261 - DNA, 18 bp, Homo sapiens
ccccttgtccctggggca

SEQ ID NO: 2716262 - DNA, 22 bp, Homo sapiens
ccccttgtccctggggcactcc

SEQ ID NO: 2716263 - DNA, 20 bp, Homo sapiens
cccgcccaggctggccagcc

SEQ ID NO: 2716264 - DNA, 22 bp, Homo sapiens
cccgcccaggctggccagcccc

SEQ ID NO: 2716265 - DNA, 13 bp, Homo sapiens
cccgctcccagtg

SEQ ID NO: 2716266 - DNA, 23 bp, Homo sapiens
cccgctcccagtgtcttcctgtg

SEQ ID NO: 2716267 - DNA, 15 bp, Homo sapiens
cccgcttgcctcggc

SEQ ID NO: 2716268 - DNA, 17 bp, Homo sapiens
cccgcttgcctcggctc

SEQ ID NO: 2716269 - DNA, 19 bp, Homo sapiens
cccgcttgcctcggctcct

SEQ ID NO: 2716270 - DNA, 20 bp, Homo sapiens
cccgcttgcctcggctcctg

SEQ ID NO: 2716271 - DNA, 23 bp, Homo sapiens
cccgcttgcctcggctcctgctg

SEQ ID NO: 2716272 - DNA, 16 bp, Homo sapiens
cccggaaagactgaaa

SEQ ID NO: 2716273 - DNA, 15 bp, Homo sapiens
cccggaggtgtcacc

SEQ ID NO: 2716274 - DNA, 18 bp, Homo sapiens
cccggatgtgtgtctcac

SEQ ID NO: 2716275 - DNA, 15 bp, Homo sapiens
cccggattggccctg

SEQ ID NO: 2716276 - DNA, 17 bp, Homo sapiens
cccggattggccctgcc

SEQ ID NO: 2716277 - DNA, 20 bp, Homo sapiens
cccggattggccctgcccct

SEQ ID NO: 2716278 - DNA, 20 bp, Homo sapiens
cccggcgccctctgtcctga

SEQ ID NO: 2716279 - DNA, 18 bp, Homo sapiens
cccggctaatttttggat

SEQ ID NO: 2716280 - DNA, 19 bp, Homo sapiens
cccgggaagcatcctcccc

SEQ ID NO: 2716281 - DNA, 23 bp, Homo sapiens
cccgggaagcatcctccccacca

SEQ ID NO: 2716282 - DNA, 13 bp, Homo sapiens
cccgggaggggcc

SEQ ID NO: 2716283 - DNA, 17 bp, Homo sapiens
cccgggaggggcccgct

SEQ ID NO: 2716284 - DNA, 20 bp, Homo sapiens
cccgggctcagggaccacag

SEQ ID NO: 2716285 - DNA, 21 bp, Homo sapiens
cccgggctcagggaccacagc

SEQ ID NO: 2716286 - DNA, 12 bp, Homo sapiens
cccgtggcccca

SEQ ID NO: 2716287 - DNA, 18 bp, Homo sapiens
cccgtggccccagcctgg

SEQ ID NO: 2716288 - DNA, 21 bp, Homo sapiens
cccgtggccccagcctggccc

SEQ ID NO: 2716289 - DNA, 23 bp, Homo sapiens
cccgtggccccagcctggcccag

SEQ ID NO: 2716290 - DNA, 22 bp, Homo sapiens
cccgttgtctccctggccctca

SEQ ID NO: 2716291 - DNA, 17 bp, Homo sapiens
ccctaaagtctcaggtg

SEQ ID NO: 2716292 - DNA, 16 bp, Homo sapiens
ccctacccactctttg

SEQ ID NO: 2716293 - DNA, 15 bp, Homo sapiens
ccctagatccaggct

SEQ ID NO: 2716294 - DNA, 13 bp, Homo sapiens
ccctcacagactc

SEQ ID NO: 2716295 - DNA, 18 bp, Homo sapiens
ccctcacagactcttcca

SEQ ID NO: 2716296 - DNA, 23 bp, Homo sapiens
ccctcacagactcttccaccaga

SEQ ID NO: 2716297 - DNA, 22 bp, Homo sapiens
ccctcacgtgaccagccccgtg

SEQ ID NO: 2716298 - DNA, 22 bp, Homo sapiens
ccctcaggggaagctgctaggg

SEQ ID NO: 2716299 - DNA, 18 bp, Homo sapiens
ccctccaaacactgggct

SEQ ID NO: 2716300 - DNA, 19 bp, Homo sapiens
ccctccaaacactgggctc

SEQ ID NO: 2716301 - DNA, 16 bp, Homo sapiens
ccctccacagccgcag

SEQ ID NO: 2716302 - DNA, 22 bp, Homo sapiens
ccctccaccctaaagtctcagg

SEQ ID NO: 2716303 - DNA, 12 bp, Homo sapiens
ccctcccagctg

SEQ ID NO: 2716304 - DNA, 13 bp, Homo sapiens
ccctccccagccc

SEQ ID NO: 2716305 - DNA, 15 bp, Homo sapiens
ccctccccagccctt

SEQ ID NO: 2716306 - DNA, 15 bp, Homo sapiens
ccctcccccacgtct

SEQ ID NO: 2716307 - DNA, 21 bp, Homo sapiens
ccctcccccacgtctctctgc

SEQ ID NO: 2716308 - DNA, 12 bp, Homo sapiens
ccctcccctccc

SEQ ID NO: 2716309 - DNA, 22 bp, Homo sapiens
ccctcccgtctactcattcccc

SEQ ID NO: 2716310 - DNA, 13 bp, Homo sapiens
ccctccctgctgt

SEQ ID NO: 2716311 - DNA, 17 bp, Homo sapiens
ccctccctgctgtcccc

SEQ ID NO: 2716312 - DNA, 20 bp, Homo sapiens
ccctcctacccctcccagct

SEQ ID NO: 2716313 - DNA, 21 bp, Homo sapiens
ccctcctacccctcccagctg

SEQ ID NO: 2716314 - DNA, 14 bp, Homo sapiens
ccctcctcacactc

SEQ ID NO: 2716315 - DNA, 15 bp, Homo sapiens
ccctcctcacactcc

SEQ ID NO: 2716316 - DNA, 16 bp, Homo sapiens
ccctcctgagcctcac

SEQ ID NO: 2716317 - DNA, 13 bp, Homo sapiens
ccctcctggagca

SEQ ID NO: 2716318 - DNA, 22 bp, Homo sapiens
ccctcgtgccagtcgcgctgcc

SEQ ID NO: 2716319 - DNA, 23 bp, Homo sapiens
ccctcgtgccagtcgcgctgcct

SEQ ID NO: 2716320 - DNA, 17 bp, Homo sapiens
ccctctatttacctgcg

SEQ ID NO: 2716321 - DNA, 18 bp, Homo sapiens
ccctctcgccctggccag

SEQ ID NO: 2716322 - DNA, 19 bp, Homo sapiens
ccctcttgccccaaccccc

SEQ ID NO: 2716323 - DNA, 22 bp, Homo sapiens
ccctcttgccccaacccccagc

SEQ ID NO: 2716324 - DNA, 16 bp, Homo sapiens
ccctgaagtcttgcat

SEQ ID NO: 2716325 - DNA, 19 bp, Homo sapiens
ccctgaggatcccctgtcc

SEQ ID NO: 2716326 - DNA, 12 bp, Homo sapiens
ccctgaggctgg

SEQ ID NO: 2716327 - DNA, 15 bp, Homo sapiens
ccctgaggctggcat

SEQ ID NO: 2716328 - DNA, 16 bp, Homo sapiens
ccctgaggctggcatc

SEQ ID NO: 2716329 - DNA, 21 bp, Homo sapiens
ccctgaggctggcatcctggc

SEQ ID NO: 2716330 - DNA, 21 bp, Homo sapiens
ccctgcccctccccctaccgc

SEQ ID NO: 2716331 - DNA, 22 bp, Homo sapiens
ccctgcccctccccctaccgca

SEQ ID NO: 2716332 - DNA, 11 bp, Homo sapiens
ccctgcctgct

SEQ ID NO: 2716333 - DNA, 13 bp, Homo sapiens
ccctgctgtcccc

SEQ ID NO: 2716334 - DNA, 17 bp, Homo sapiens
ccctgcttttctcccag

SEQ ID NO: 2716335 - DNA, 17 bp, Homo sapiens
ccctggaacctttccct

SEQ ID NO: 2716336 - DNA, 22 bp, Homo sapiens
ccctggcaggatgaccctgcga

SEQ ID NO: 2716337 - DNA, 13 bp, Homo sapiens
ccctggccagggc

SEQ ID NO: 2716338 - DNA, 13 bp, Homo sapiens
ccctggccctcaa

SEQ ID NO: 2716339 - DNA, 20 bp, Homo sapiens
ccctggccctcaaggcctcc

SEQ ID NO: 2716340 - DNA, 22 bp, Homo sapiens
ccctggcctttgaggcaaaggc

SEQ ID NO: 2716341 - DNA, 21 bp, Homo sapiens
ccctgggcctcagcctccagg

SEQ ID NO: 2716342 - DNA, 20 bp, Homo sapiens
ccctggggcactcccccagg

SEQ ID NO: 2716343 - DNA, 15 bp, Homo sapiens
ccctggggctggtgg

SEQ ID NO: 2716344 - DNA, 16 bp, Homo sapiens
ccctggggctggtgga

SEQ ID NO: 2716345 - DNA, 16 bp, Homo sapiens
ccctgggtttggcccc

SEQ ID NO: 2716346 - DNA, 17 bp, Homo sapiens
ccctgggtttggcccct

SEQ ID NO: 2716347 - DNA, 23 bp, Homo sapiens
ccctgggtttggcccctggaacc

SEQ ID NO: 2716348 - DNA, 13 bp, Homo sapiens
ccctggtccttcc

SEQ ID NO: 2716349 - DNA, 15 bp, Homo sapiens
ccctggtgagggagc

SEQ ID NO: 2716350 - DNA, 19 bp, Homo sapiens
ccctggtgagggagcctcg

SEQ ID NO: 2716351 - DNA, 19 bp, Homo sapiens
ccctggtgcagaggtgagc

SEQ ID NO: 2716352 - DNA, 17 bp, Homo sapiens
ccctggtggacagtcct

SEQ ID NO: 2716353 - DNA, 18 bp, Homo sapiens
ccctggtggacagtcctg

SEQ ID NO: 2716354 - DNA, 14 bp, Homo sapiens
ccctgtcccctggg

SEQ ID NO: 2716355 - DNA, 16 bp, Homo sapiens
ccctgtcccctggggc

SEQ ID NO: 2716356 - DNA, 16 bp, Homo sapiens
ccctgttatctgctag

SEQ ID NO: 2716357 - DNA, 14 bp, Homo sapiens
cccttcctcatctg

SEQ ID NO: 2716358 - DNA, 19 bp, Homo sapiens
cccttcctcatctgtgcct

SEQ ID NO: 2716359 - DNA, 21 bp, Homo sapiens
cccttcctcatctgtgcctgt

SEQ ID NO: 2716360 - DNA, 16 bp, Homo sapiens
cccttgaatctgcagg

SEQ ID NO: 2716361 - DNA, 18 bp, Homo sapiens
cccttgagtaggccctgc

SEQ ID NO: 2716362 - DNA, 21 bp, Homo sapiens
cccttgagtaggccctgcttt

SEQ ID NO: 2716363 - DNA, 22 bp, Homo sapiens
cccttggtttgcacataaaacg

SEQ ID NO: 2716364 - DNA, 23 bp, Homo sapiens
cccttgtccctggggcactcccc

SEQ ID NO: 2716365 - DNA, 20 bp, Homo sapiens
cccttgtgtgtaccacaccc

SEQ ID NO: 2716366 - DNA, 19 bp, Homo sapiens
ccctttaaaggtcgcacct

SEQ ID NO: 2716367 - DNA, 18 bp, Homo sapiens
cccttttcagcttctgct

SEQ ID NO: 2716368 - DNA, 20 bp, Homo sapiens
ccctttttgcaggggactgg

SEQ ID NO: 2716369 - DNA, 18 bp, Homo sapiens
ccctttttttacatttca

SEQ ID NO: 2716370 - DNA, 22 bp, Homo sapiens
ccgacttgggaggacaggtcct

SEQ ID NO: 2716371 - DNA, 21 bp, Homo sapiens
ccgagatcacgccactgcact

SEQ ID NO: 2716372 - DNA, 21 bp, Homo sapiens
ccgagcgagaaccaggctgct

SEQ ID NO: 2716373 - DNA, 16 bp, Homo sapiens
ccgaggatgctgtcag

SEQ ID NO: 2716374 - DNA, 18 bp, Homo sapiens
ccgagggatgatgccaca

SEQ ID NO: 2716375 - DNA, 19 bp, Homo sapiens
ccgagggatgatgccacac

SEQ ID NO: 2716376 - DNA, 20 bp, Homo sapiens
ccgagggatgatgccacacc

SEQ ID NO: 2716377 - DNA, 15 bp, Homo sapiens
ccgcagagcccacgc

SEQ ID NO: 2716378 - DNA, 18 bp, Homo sapiens
cctgctgcaccaacccag

SEQ ID NO: 2716379 - DNA, 21 bp, Homo sapiens
cctgctgcaccaacccagccg

SEQ ID NO: 2716380 - DNA, 14 bp, Homo sapiens
cctgctgcagaggg

SEQ ID NO: 2716381 - DNA, 16 bp, Homo sapiens
cctgctgcagaggggc

SEQ ID NO: 2716382 - DNA, 22 bp, Homo sapiens
cctgctgcctccctttcataca

SEQ ID NO: 2716383 - DNA, 12 bp, Homo sapiens
cctgctggcctg

SEQ ID NO: 2716384 - DNA, 12 bp, Homo sapiens
cctgctgggctc

SEQ ID NO: 2716385 - DNA, 14 bp, Homo sapiens
cctgctgggctctt

SEQ ID NO: 2716386 - DNA, 12 bp, Homo sapiens
cctgctgtcccc

SEQ ID NO: 2716387 - DNA, 17 bp, Homo sapiens
cctgcttttctcccaga

SEQ ID NO: 2716388 - DNA, 17 bp, Homo sapiens
cctggaaaggctcagtc

SEQ ID NO: 2716389 - DNA, 21 bp, Homo sapiens
cctggaatacgatcctgcagg

SEQ ID NO: 2716390 - DNA, 16 bp, Homo sapiens
cctggaatgaagcatg

SEQ ID NO: 2716391 - DNA, 13 bp, Homo sapiens
cctggaccctggc

SEQ ID NO: 2716392 - DNA, 14 bp, Homo sapiens
cctggaccctggcc

SEQ ID NO: 2716393 - DNA, 14 bp, Homo sapiens
cctggactagggcc

SEQ ID NO: 2716394 - DNA, 15 bp, Homo sapiens
cctggaggctggatg

SEQ ID NO: 2716395 - DNA, 13 bp, Homo sapiens
cctggcacagtgt

SEQ ID NO: 2716396 - DNA, 15 bp, Homo sapiens
cctggcacagtgtct

SEQ ID NO: 2716397 - DNA, 22 bp, Homo sapiens
cctggcaggatgaccctgcgaa

SEQ ID NO: 2716398 - DNA, 18 bp, Homo sapiens
cctggcccatcagtgtac

SEQ ID NO: 2716399 - DNA, 13 bp, Homo sapiens
cctggccctcaag

SEQ ID NO: 2716400 - DNA, 22 bp, Homo sapiens
cctggccctcaaggcctcccac

SEQ ID NO: 2716401 - DNA, 23 bp, Homo sapiens
cctggccctcaaggcctcccaca

SEQ ID NO: 2716402 - DNA, 14 bp, Homo sapiens
cctggcctcataca

SEQ ID NO: 2716403 - DNA, 22 bp, Homo sapiens
cctggccttgtccccagctcca

SEQ ID NO: 2716404 - DNA, 14 bp, Homo sapiens
cctggctctgccag

SEQ ID NO: 2716405 - DNA, 20 bp, Homo sapiens
cctggctctgccagcgtccc

SEQ ID NO: 2716406 - DNA, 17 bp, Homo sapiens
cctggctgaacagtgct

SEQ ID NO: 2716407 - DNA, 19 bp, Homo sapiens
cctggctgaacagtgctct

SEQ ID NO: 2716408 - DNA, 21 bp, Homo sapiens
cctggctgaacagtgctctgc

SEQ ID NO: 2716409 - DNA, 23 bp, Homo sapiens
cctggctgaacagtgctctgcct

SEQ ID NO: 2716410 - DNA, 17 bp, Homo sapiens
cctggctggctgtgtcc

SEQ ID NO: 2716411 - DNA, 16 bp, Homo sapiens
cctggcttctggagcc

SEQ ID NO: 2716412 - DNA, 19 bp, Homo sapiens
cctgggagaacctcaggct

SEQ ID NO: 2716413 - DNA, 23 bp, Homo sapiens
cctgggcatgatgggccgagcca

SEQ ID NO: 2716414 - DNA, 19 bp, Homo sapiens
cctgggcatttggtgagag

SEQ ID NO: 2716415 - DNA, 16 bp, Homo sapiens
cctgggcctcagcctc

SEQ ID NO: 2716416 - DNA, 18 bp, Homo sapiens
cctgggcctcagcctcca

SEQ ID NO: 2716417 - DNA, 20 bp, Homo sapiens
cctgggcctcagcctccagg

SEQ ID NO: 2716418 - DNA, 14 bp, Homo sapiens
cctgggcctcccaa

SEQ ID NO: 2716419 - DNA, 16 bp, Homo sapiens
cctgggcgacagagca

SEQ ID NO: 2716420 - DNA, 22 bp, Homo sapiens
cctgggctctgccccagctctg

SEQ ID NO: 2716421 - DNA, 24 bp, Homo sapiens
cctgggctctgccccagctctggc

SEQ ID NO: 2716422 - DNA, 13 bp, Homo sapiens
cctgggctctgtg

SEQ ID NO: 2716423 - DNA, 17 bp, Homo sapiens
cctggggcactccccca

SEQ ID NO: 2716424 - DNA, 20 bp, Homo sapiens
cctggggcactcccccagga

SEQ ID NO: 2716425 - DNA, 17 bp, Homo sapiens
cctgggtttggcccctg

SEQ ID NO: 2716426 - DNA, 15 bp, Homo sapiens
cctggtccttccagg

SEQ ID NO: 2716427 - DNA, 18 bp, Homo sapiens
cctggtccttccaggccc

SEQ ID NO: 2716428 - DNA, 19 bp, Homo sapiens
cctggtgaggcccagcctg

SEQ ID NO: 2716429 - DNA, 15 bp, Homo sapiens
cctggtgagggagcc

SEQ ID NO: 2716430 - DNA, 21 bp, Homo sapiens
cctggtgcagaggtgagcaga

SEQ ID NO: 2716431 - DNA, 16 bp, Homo sapiens
cctgtaaaccaaagtt

SEQ ID NO: 2716432 - DNA, 15 bp, Homo sapiens
cctgtaatcccagca

SEQ ID NO: 2716433 - DNA, 14 bp, Homo sapiens
cctgtactcaggag

SEQ ID NO: 2716434 - DNA, 23 bp, Homo sapiens
cctgtactcaggaggctgagggg

SEQ ID NO: 2716435 - DNA, 14 bp, Homo sapiens
cctgtcagtgccgc

SEQ ID NO: 2716436 - DNA, 19 bp, Homo sapiens
cctgtcagtgccgccgcct

SEQ ID NO: 2716437 - DNA, 16 bp, Homo sapiens
cctgtcccctcacaga

SEQ ID NO: 2716438 - DNA, 19 bp, Homo sapiens
cctgtcccctggggctggt

SEQ ID NO: 2716439 - DNA, 23 bp, Homo sapiens
cctgtccctctcgccctggccag

SEQ ID NO: 2716440 - DNA, 20 bp, Homo sapiens
cctgtcctggtacagcaggg

SEQ ID NO: 2716441 - DNA, 20 bp, Homo sapiens
cctgtccttactcagagctg

SEQ ID NO: 2716442 - DNA, 16 bp, Homo sapiens
cctgtcgtgtccagcc

SEQ ID NO: 2716443 - DNA, 12 bp, Homo sapiens
cctgtctgctgg

SEQ ID NO: 2716444 - DNA, 17 bp, Homo sapiens
cctgtctgtccaacccc

SEQ ID NO: 2716445 - DNA, 22 bp, Homo sapiens
cctgtgggggaagagcacagcc

SEQ ID NO: 2716446 - DNA, 22 bp, Homo sapiens
cctgttctaactcttagaagtg

SEQ ID NO: 2716447 - DNA, 14 bp, Homo sapiens
cctgttctccagat

SEQ ID NO: 2716448 - DNA, 12 bp, Homo sapiens
ccttaataaata

SEQ ID NO: 2716449 - DNA, 14 bp, Homo sapiens
ccttactcagagct

SEQ ID NO: 2716450 - DNA, 15 bp, Homo sapiens
ccttactcagagctg

SEQ ID NO: 2716451 - DNA, 14 bp, Homo sapiens
ccttagaagtggaa

SEQ ID NO: 2716452 - DNA, 19 bp, Homo sapiens
ccttattgagcgtgattct

SEQ ID NO: 2716453 - DNA, 21 bp, Homo sapiens
ccttattgagcgtgattctgt

SEQ ID NO: 2716454 - DNA, 23 bp, Homo sapiens
ccttcactccggtgtgcctgcag

SEQ ID NO: 2716455 - DNA, 19 bp, Homo sapiens
ccttccacgtgtatgcaag

SEQ ID NO: 2716456 - DNA, 17 bp, Homo sapiens
ccttccccctcccaggg

SEQ ID NO: 2716457 - DNA, 16 bp, Homo sapiens
ccttcctcatctgtgc

SEQ ID NO: 2716458 - DNA, 20 bp, Homo sapiens
ccttcctcatctgtgcctgt

SEQ ID NO: 2716459 - DNA, 22 bp, Homo sapiens
ccttcctcatctgtgcctgtct

SEQ ID NO: 2716460 - DNA, 17 bp, Homo sapiens
ccttctccagcaagcag

SEQ ID NO: 2716461 - DNA, 22 bp, Homo sapiens
ccttctccagggacagaagcag

SEQ ID NO: 2716462 - DNA, 19 bp, Homo sapiens
ccttcttaactctgcagga

SEQ ID NO: 2716463 - DNA, 19 bp, Homo sapiens
ccttgaatctgcagggagc

SEQ ID NO: 2716464 - DNA, 17 bp, Homo sapiens
ccttgagtaggccctgc

SEQ ID NO: 2716465 - DNA, 18 bp, Homo sapiens
ccttgagtaggccctgct

SEQ ID NO: 2716466 - DNA, 19 bp, Homo sapiens
ccttgatggagatatttac

SEQ ID NO: 2716467 - DNA, 13 bp, Homo sapiens
ccttgcccttcct

SEQ ID NO: 2716468 - DNA, 19 bp, Homo sapiens
ccttgcccttcctgacccg

SEQ ID NO: 2716469 - DNA, 21 bp, Homo sapiens
ccttggagagcagctggctct

SEQ ID NO: 2716470 - DNA, 18 bp, Homo sapiens
ccttggagtgctgcagct

SEQ ID NO: 2716471 - DNA, 20 bp, Homo sapiens
ccttggagtgctgcagcttt

SEQ ID NO: 2716472 - DNA, 21 bp, Homo sapiens
ccttggtcccagacagctgga

SEQ ID NO: 2716473 - DNA, 17 bp, Homo sapiens
ccttgtccccagctcca

SEQ ID NO: 2716474 - DNA, 16 bp, Homo sapiens
ccttgtccctggggca

SEQ ID NO: 2716475 - DNA, 14 bp, Homo sapiens
ccttgtttctttct

SEQ ID NO: 2716476 - DNA, 20 bp, Homo sapiens
ccttgtttctttctgaagtg

SEQ ID NO: 2716477 - DNA, 17 bp, Homo sapiens
cctttaggcagcctgcc

SEQ ID NO: 2716478 - DNA, 19 bp, Homo sapiens
cctttaggcagcctgccgc

SEQ ID NO: 2716479 - DNA, 13 bp, Homo sapiens
cctttcccttgtg

SEQ ID NO: 2716480 - DNA, 22 bp, Homo sapiens
cctttctcgtggtagaagccag

SEQ ID NO: 2716481 - DNA, 18 bp, Homo sapiens
cctttgcccacacacact

SEQ ID NO: 2716482 - DNA, 17 bp, Homo sapiens
cctttgttgctgttgct

SEQ ID NO: 2716483 - DNA, 14 bp, Homo sapiens
cctttttctacctt

SEQ ID NO: 2716484 - DNA, 16 bp, Homo sapiens
cctttttttctctcct

SEQ ID NO: 2716485 - DNA, 16 bp, Homo sapiens
cgaaaacccccagcat

SEQ ID NO: 2716486 - DNA, 20 bp, Homo sapiens
cgaaacctgtccataaagta

SEQ ID NO: 2716487 - DNA, 23 bp, Homo sapiens
cgaacacgcatgcctcagccagc

SEQ ID NO: 2716488 - DNA, 18 bp, Homo sapiens
cgaccccatctgcccagg

SEQ ID NO: 2716489 - DNA, 19 bp, Homo sapiens
cgaccccatctgcccagga

SEQ ID NO: 2716490 - DNA, 13 bp, Homo sapiens
cgactcttcctgc

SEQ ID NO: 2716491 - DNA, 19 bp, Homo sapiens
cgacttgaattttcccact

SEQ ID NO: 2716492 - DNA, 21 bp, Homo sapiens
cgacttgaattttcccactgc

SEQ ID NO: 2716493 - DNA, 16 bp, Homo sapiens
cgagaccagcctggcc

SEQ ID NO: 2716494 - DNA, 15 bp, Homo sapiens
cgagagtctgtctca

SEQ ID NO: 2716495 - DNA, 17 bp, Homo sapiens
cgagcgagaaccaggct

SEQ ID NO: 2716496 - DNA, 22 bp, Homo sapiens
cgagcgagaaccaggctgctgc

SEQ ID NO: 2716497 - DNA, 16 bp, Homo sapiens
cgagctactctcttgc

SEQ ID NO: 2716498 - DNA, 15 bp, Homo sapiens
cgaggaaaggatttt

SEQ ID NO: 2716499 - DNA, 18 bp, Homo sapiens
cgaggtgtcaccctgcag

SEQ ID NO: 2716500 - DNA, 15 bp, Homo sapiens
cgagtccagtccttt

SEQ ID NO: 2716501 - DNA, 18 bp, Homo sapiens
ctccctcctcacactcca

SEQ ID NO: 2716502 - DNA, 22 bp, Homo sapiens
ctccctcctggagcatcccagg

SEQ ID NO: 2716503 - DNA, 14 bp, Homo sapiens
ctccctctgacctg

SEQ ID NO: 2716504 - DNA, 12 bp, Homo sapiens
ctccctctgcct

SEQ ID NO: 2716505 - DNA, 13 bp, Homo sapiens
ctccctctgcctc

SEQ ID NO: 2716506 - DNA, 17 bp, Homo sapiens
ctccctctgcctcatcc

SEQ ID NO: 2716507 - DNA, 14 bp, Homo sapiens
ctccctgctgtccc

SEQ ID NO: 2716508 - DNA, 13 bp, Homo sapiens
ctccctggccctc

SEQ ID NO: 2716509 - DNA, 18 bp, Homo sapiens
ctcccttgagtaggccct

SEQ ID NO: 2716510 - DNA, 19 bp, Homo sapiens
ctcccttgagtaggccctg

SEQ ID NO: 2716511 - DNA, 19 bp, Homo sapiens
ctccgccttcactccggtg

SEQ ID NO: 2716512 - DNA, 13 bp, Homo sapiens
ctccgtgagccct

SEQ ID NO: 2716513 - DNA, 20 bp, Homo sapiens
ctcctaatcaagagtctctc

SEQ ID NO: 2716514 - DNA, 19 bp, Homo sapiens
ctcctacaaccaggtcttg

SEQ ID NO: 2716515 - DNA, 16 bp, Homo sapiens
ctcctacccctcccag

SEQ ID NO: 2716516 - DNA, 17 bp, Homo sapiens
ctcctacccctcccagc

SEQ ID NO: 2716517 - DNA, 18 bp, Homo sapiens
ctcctacccctcccagct

SEQ ID NO: 2716518 - DNA, 14 bp, Homo sapiens
ctcctagcccagca

SEQ ID NO: 2716519 - DNA, 15 bp, Homo sapiens
ctcctatccttggag

SEQ ID NO: 2716520 - DNA, 13 bp, Homo sapiens
ctcctcacactcc

SEQ ID NO: 2716521 - DNA, 15 bp, Homo sapiens
ctcctcacactccag

SEQ ID NO: 2716522 - DNA, 16 bp, Homo sapiens
ctcctcattcagacca

SEQ ID NO: 2716523 - DNA, 18 bp, Homo sapiens
ctcctccaccgccatggc

SEQ ID NO: 2716524 - DNA, 15 bp, Homo sapiens
ctcctccactccacc

SEQ ID NO: 2716525 - DNA, 16 bp, Homo sapiens
ctcctccactccacct

SEQ ID NO: 2716526 - DNA, 20 bp, Homo sapiens
ctcctccagttctgatgagg

SEQ ID NO: 2716527 - DNA, 18 bp, Homo sapiens
ctcctcccctgccgcctc

SEQ ID NO: 2716528 - DNA, 14 bp, Homo sapiens
ctcctccctctgcc

SEQ ID NO: 2716529 - DNA, 15 bp, Homo sapiens
ctcctccctctgcct

SEQ ID NO: 2716530 - DNA, 17 bp, Homo sapiens
ctcctccctctgcctca

SEQ ID NO: 2716531 - DNA, 13 bp, Homo sapiens
ctcctcctgccag

SEQ ID NO: 2716532 - DNA, 18 bp, Homo sapiens
ctcctcctgccagctctg

SEQ ID NO: 2716533 - DNA, 15 bp, Homo sapiens
ctcctctccatgcaa

SEQ ID NO: 2716534 - DNA, 22 bp, Homo sapiens
ctcctctccatgcaagtgctgt

SEQ ID NO: 2716535 - DNA, 16 bp, Homo sapiens
ctcctgagctcgtgat

SEQ ID NO: 2716536 - DNA, 18 bp, Homo sapiens
ctcctgagtagctgggac

SEQ ID NO: 2716537 - DNA, 15 bp, Homo sapiens
ctcctgcctcagcct

SEQ ID NO: 2716538 - DNA, 16 bp, Homo sapiens
ctcctgcctcagcctc

SEQ ID NO: 2716539 - DNA, 19 bp, Homo sapiens
ctcctgcctcagcctcctg

SEQ ID NO: 2716540 - DNA, 19 bp, Homo sapiens
ctcctgctgcaccaaccca

SEQ ID NO: 2716541 - DNA, 16 bp, Homo sapiens
ctcctggagcatccca

SEQ ID NO: 2716542 - DNA, 17 bp, Homo sapiens
ctcctgtccctacccac

SEQ ID NO: 2716543 - DNA, 18 bp, Homo sapiens
ctcctgtccctacccact

SEQ ID NO: 2716544 - DNA, 19 bp, Homo sapiens
ctcctgtccctacccactc

SEQ ID NO: 2716545 - DNA, 22 bp, Homo sapiens
ctcctgtccctacccactcttt

SEQ ID NO: 2716546 - DNA, 24 bp, Homo sapiens
ctcctgtccctacccactctttgc

SEQ ID NO: 2716547 - DNA, 11 bp, Homo sapiens
ctcctgtgccc

SEQ ID NO: 2716548 - DNA, 13 bp, Homo sapiens
ctccttagaagtg

SEQ ID NO: 2716549 - DNA, 21 bp, Homo sapiens
ctccttccccttgtccctggg

SEQ ID NO: 2716550 - DNA, 22 bp, Homo sapiens
ctccttccttgctgtcctaggc

SEQ ID NO: 2716551 - DNA, 23 bp, Homo sapiens
ctcgaagaacaatgtcagaaact

SEQ ID NO: 2716552 - DNA, 22 bp, Homo sapiens
ctcgacttcaggagctgacaga

SEQ ID NO: 2716553 - DNA, 22 bp, Homo sapiens
ctcgcccaccgcatgccccctc

SEQ ID NO: 2716554 - DNA, 14 bp, Homo sapiens
ctcgcctctcccac

SEQ ID NO: 2716555 - DNA, 16 bp, Homo sapiens
ctcgcctctgcccagc

SEQ ID NO: 2716556 - DNA, 20 bp, Homo sapiens
ctcgcctggcctgaggtctc

SEQ ID NO: 2716557 - DNA, 11 bp, Homo sapiens
ctcgctctgct

SEQ ID NO: 2716558 - DNA, 13 bp, Homo sapiens
ctcgctctgctgc

SEQ ID NO: 2716559 - DNA, 18 bp, Homo sapiens
ctcgctctgctgcccagg

SEQ ID NO: 2716560 - DNA, 19 bp, Homo sapiens
ctcgctgatgctgggctgg

SEQ ID NO: 2716561 - DNA, 22 bp, Homo sapiens
ctcgctgatgctgggctgggtg

SEQ ID NO: 2716562 - DNA, 23 bp, Homo sapiens
ctcgctgatgctgggctgggtgc

SEQ ID NO: 2716563 - DNA, 13 bp, Homo sapiens
ctcggaggctcct

SEQ ID NO: 2716564 - DNA, 15 bp, Homo sapiens
ctcggaggctcctcc

SEQ ID NO: 2716565 - DNA, 16 bp, Homo sapiens
ctcggaggctcctccc

SEQ ID NO: 2716566 - DNA, 19 bp, Homo sapiens
ctcggaggctcctccctct

SEQ ID NO: 2716567 - DNA, 21 bp, Homo sapiens
ctcggaggctcctccctctgc

SEQ ID NO: 2716568 - DNA, 13 bp, Homo sapiens
ctcggcccatctg

SEQ ID NO: 2716569 - DNA, 18 bp, Homo sapiens
ctcggcccatctgtccat

SEQ ID NO: 2716570 - DNA, 24 bp, Homo sapiens
ctcggcccatctgtccatcctcct

SEQ ID NO: 2716571 - DNA, 15 bp, Homo sapiens
ctcggctcactgcaa

SEQ ID NO: 2716572 - DNA, 14 bp, Homo sapiens
ctcggctcctgctg

SEQ ID NO: 2716573 - DNA, 15 bp, Homo sapiens
ctcggctcctgctgc

SEQ ID NO: 2716574 - DNA, 19 bp, Homo sapiens
ctcggctcctgctgcacca

SEQ ID NO: 2716575 - DNA, 11 bp, Homo sapiens
ctcgggaccct

SEQ ID NO: 2716576 - DNA, 21 bp, Homo sapiens
ctcgtccacggtcttctgcat

SEQ ID NO: 2716577 - DNA, 19 bp, Homo sapiens
ctcgtgatttgcctgcctg

SEQ ID NO: 2716578 - DNA, 12 bp, Homo sapiens
ctcgtttgatag

SEQ ID NO: 2716579 - DNA, 15 bp, Homo sapiens
ctctaaaactctcaa

SEQ ID NO: 2716580 - DNA, 18 bp, Homo sapiens
ctctaaactgctgttaat

SEQ ID NO: 2716581 - DNA, 16 bp, Homo sapiens
ctctaactccctcctc

SEQ ID NO: 2716582 - DNA, 23 bp, Homo sapiens
ctctaactccctcctcacactcc

SEQ ID NO: 2716583 - DNA, 16 bp, Homo sapiens
ctctacacaacatgta

SEQ ID NO: 2716584 - DNA, 13 bp, Homo sapiens
ctctaccctgcag

SEQ ID NO: 2716585 - DNA, 23 bp, Homo sapiens
ctctaccctggtaggaaagcacc

SEQ ID NO: 2716586 - DNA, 18 bp, Homo sapiens
ctctacgagagtgagact

SEQ ID NO: 2716587 - DNA, 19 bp, Homo sapiens
ctctactaaaaatacagaa

SEQ ID NO: 2716588 - DNA, 19 bp, Homo sapiens
ctctactcctacctcagcc

SEQ ID NO: 2716589 - DNA, 19 bp, Homo sapiens
ctctagaacacccactggc

SEQ ID NO: 2716590 - DNA, 21 bp, Homo sapiens
ctctagtccctgtgttctgca

SEQ ID NO: 2716591 - DNA, 18 bp, Homo sapiens
ctctagtgccctccacag

SEQ ID NO: 2716592 - DNA, 15 bp, Homo sapiens
ctctatgaaaagcaa

SEQ ID NO: 2716593 - DNA, 18 bp, Homo sapiens
ctctattaagatttccaa

SEQ ID NO: 2716594 - DNA, 11 bp, Homo sapiens
ctctatttctt

SEQ ID NO: 2716595 - DNA, 13 bp, Homo sapiens
ctctcacctcgtg

SEQ ID NO: 2716596 - DNA, 13 bp, Homo sapiens
ctctcagagcctc

SEQ ID NO: 2716597 - DNA, 16 bp, Homo sapiens
ctctcagagcctcagc

SEQ ID NO: 2716598 - DNA, 22 bp, Homo sapiens
ctctcagagcctcagcttctgg

SEQ ID NO: 2716599 - DNA, 12 bp, Homo sapiens
ctctccagcctc

SEQ ID NO: 2716600 - DNA, 17 bp, Homo sapiens
ctctccagcctcacaga

SEQ ID NO: 2716601 - DNA, 22 bp, Homo sapiens
ctctccagcctcacagatgctg

SEQ ID NO: 2716602 - DNA, 22 bp, Homo sapiens
ctctccagctttccctccccag

SEQ ID NO: 2716603 - DNA, 19 bp, Homo sapiens
ctctccatgcaagtgctgt

SEQ ID NO: 2716604 - DNA, 22 bp, Homo sapiens
ctctccatgcaagtgctgtttg

SEQ ID NO: 2716605 - DNA, 20 bp, Homo sapiens
ctctcccacgtgcacagctt

SEQ ID NO: 2716606 - DNA, 13 bp, Homo sapiens
ctctcctgctgca

SEQ ID NO: 2716607 - DNA, 16 bp, Homo sapiens
ctctcggaaggctggc

SEQ ID NO: 2716608 - DNA, 22 bp, Homo sapiens
ctctcggaaggctggctgggca

SEQ ID NO: 2716609 - DNA, 19 bp, Homo sapiens
ctctctactcctacctcag

SEQ ID NO: 2716610 - DNA, 20 bp, Homo sapiens
ctctctactcctacctcagc

SEQ ID NO: 2716611 - DNA, 12 bp, Homo sapiens
ctctctctctgt

SEQ ID NO: 2716612 - DNA, 17 bp, Homo sapiens
ctctctgcctgctgggc

SEQ ID NO: 2716613 - DNA, 18 bp, Homo sapiens
ctctctgcctgcttcctg

SEQ ID NO: 2716614 - DNA, 14 bp, Homo sapiens
ctctctgctcagtg

SEQ ID NO: 2716615 - DNA, 13 bp, Homo sapiens
ctctcttctctgt

SEQ ID NO: 2716616 - DNA, 15 bp, Homo sapiens
ctctgaatgtcccag

SEQ ID NO: 2716617 - DNA, 14 bp, Homo sapiens
ctctgacctgcagg

SEQ ID NO: 2716618 - DNA, 16 bp, Homo sapiens
ctctgacctgcaggcc

SEQ ID NO: 2716619 - DNA, 19 bp, Homo sapiens
ctctgaggctctttctggg

SEQ ID NO: 2716620 - DNA, 14 bp, Homo sapiens
ctctgagtgtctct

SEQ ID NO: 2716621 - DNA, 18 bp, Homo sapiens
ctctgagtgtctctgcct

SEQ ID NO: 2716622 - DNA, 19 bp, Homo sapiens
ctctgagtgtctctgcctg

SEQ ID NO: 2716623 - DNA, 21 bp, Homo sapiens
ctctgagtgtctctgcctgga

SEQ ID NO: 2716624 - DNA, 24 bp, Homo sapiens
ctctgagtgtctctgcctggagca

SEQ ID NO: 2716625 - DNA, 14 bp, Homo sapiens
ctgggaatgggaga

SEQ ID NO: 2716626 - DNA, 16 bp, Homo sapiens
ctgggaatgggagagg

SEQ ID NO: 2716627 - DNA, 16 bp, Homo sapiens
ctgggaccccagctag

SEQ ID NO: 2716628 - DNA, 15 bp, Homo sapiens
ctgggactacaggca

SEQ ID NO: 2716629 - DNA, 13 bp, Homo sapiens
ctgggaggaagca

SEQ ID NO: 2716630 - DNA, 14 bp, Homo sapiens
ctgggattcctccc

SEQ ID NO: 2716631 - DNA, 21 bp, Homo sapiens
ctgggccaagttcctctagtg

SEQ ID NO: 2716632 - DNA, 23 bp, Homo sapiens
ctgggccatgggtcctcggccca

SEQ ID NO: 2716633 - DNA, 15 bp, Homo sapiens
ctgggcccacagccc

SEQ ID NO: 2716634 - DNA, 17 bp, Homo sapiens
ctgggcccccagagacc

SEQ ID NO: 2716635 - DNA, 22 bp, Homo sapiens
ctgggcccctcaggggaagctg

SEQ ID NO: 2716636 - DNA, 20 bp, Homo sapiens
ctgggcctcagcctccaggc

SEQ ID NO: 2716637 - DNA, 13 bp, Homo sapiens
ctgggcgacagag

SEQ ID NO: 2716638 - DNA, 16 bp, Homo sapiens
ctgggcgacagagcaa

SEQ ID NO: 2716639 - DNA, 22 bp, Homo sapiens
ctgggctacaaaccaggagcaa

SEQ ID NO: 2716640 - DNA, 18 bp, Homo sapiens
ctgggctctgccccagct

SEQ ID NO: 2716641 - DNA, 14 bp, Homo sapiens
ctgggctctgtggg

SEQ ID NO: 2716642 - DNA, 15 bp, Homo sapiens
ctgggctctgtgggc

SEQ ID NO: 2716643 - DNA, 18 bp, Homo sapiens
ctgggctctgtgggctgc

SEQ ID NO: 2716644 - DNA, 12 bp, Homo sapiens
ctgggctgactg

SEQ ID NO: 2716645 - DNA, 15 bp, Homo sapiens
ctgggctgactggga

SEQ ID NO: 2716646 - DNA, 15 bp, Homo sapiens
ctgggctggggcctg

SEQ ID NO: 2716647 - DNA, 12 bp, Homo sapiens
ctgggctgggtg

SEQ ID NO: 2716648 - DNA, 17 bp, Homo sapiens
ctggggcactcccccag

SEQ ID NO: 2716649 - DNA, 18 bp, Homo sapiens
ctggggcactcccccagg

SEQ ID NO: 2716650 - DNA, 20 bp, Homo sapiens
ctggggcactcccccaggat

SEQ ID NO: 2716651 - DNA, 18 bp, Homo sapiens
ctggggccacatagctca

SEQ ID NO: 2716652 - DNA, 17 bp, Homo sapiens
ctggggctctgtgcagg

SEQ ID NO: 2716653 - DNA, 17 bp, Homo sapiens
ctggggctggtgaggcc

SEQ ID NO: 2716654 - DNA, 15 bp, Homo sapiens
ctgggggagggactg

SEQ ID NO: 2716655 - DNA, 17 bp, Homo sapiens
ctgggggagggactgct

SEQ ID NO: 2716656 - DNA, 19 bp, Homo sapiens
ctgggggagggactgctga

SEQ ID NO: 2716657 - DNA, 20 bp, Homo sapiens
ctgggggagggactgctgac

SEQ ID NO: 2716658 - DNA, 22 bp, Homo sapiens
ctgggggagggactgctgaccc

SEQ ID NO: 2716659 - DNA, 13 bp, Homo sapiens
ctgggggctcccc

SEQ ID NO: 2716660 - DNA, 14 bp, Homo sapiens
ctgggggctcccct

SEQ ID NO: 2716661 - DNA, 20 bp, Homo sapiens
ctgggtgacccccactgccg

SEQ ID NO: 2716662 - DNA, 14 bp, Homo sapiens
ctgggtttggcccc

SEQ ID NO: 2716663 - DNA, 15 bp, Homo sapiens
ctgggtttggcccct

SEQ ID NO: 2716664 - DNA, 22 bp, Homo sapiens
ctgggtttggcccctggaacct

SEQ ID NO: 2716665 - DNA, 19 bp, Homo sapiens
ctggtccttccaggccccc

SEQ ID NO: 2716666 - DNA, 17 bp, Homo sapiens
ctggtctcgaactcctg

SEQ ID NO: 2716667 - DNA, 23 bp, Homo sapiens
ctggtgaccccttttcagcttct

SEQ ID NO: 2716668 - DNA, 14 bp, Homo sapiens
ctggtgaggcccag

SEQ ID NO: 2716669 - DNA, 19 bp, Homo sapiens
ctggtgaggcccagcctgt

SEQ ID NO: 2716670 - DNA, 17 bp, Homo sapiens
ctggtgaggccggccct

SEQ ID NO: 2716671 - DNA, 17 bp, Homo sapiens
ctggtgagggagcctcg

SEQ ID NO: 2716672 - DNA, 23 bp, Homo sapiens
ctggtgcagaggtgagcagagga

SEQ ID NO: 2716673 - DNA, 15 bp, Homo sapiens
ctggtggacagtcct

SEQ ID NO: 2716674 - DNA, 16 bp, Homo sapiens
ctggtggacagtcctg

SEQ ID NO: 2716675 - DNA, 18 bp, Homo sapiens
ctggtggacagtcctggg

SEQ ID NO: 2716676 - DNA, 19 bp, Homo sapiens
ctggtggacagtcctggga

SEQ ID NO: 2716677 - DNA, 19 bp, Homo sapiens
ctgtaaatataaattttgt

SEQ ID NO: 2716678 - DNA, 20 bp, Homo sapiens
ctgtaaatataaattttgtc

SEQ ID NO: 2716679 - DNA, 22 bp, Homo sapiens
ctgtaaatgaagggtcatttct

SEQ ID NO: 2716680 - DNA, 15 bp, Homo sapiens
ctgtaactcagacat

SEQ ID NO: 2716681 - DNA, 19 bp, Homo sapiens
ctgtaactcagacattcca

SEQ ID NO: 2716682 - DNA, 22 bp, Homo sapiens
ctgtaagcagattacaataaat

SEQ ID NO: 2716683 - DNA, 19 bp, Homo sapiens
ctgtacagaagaaactgaa

SEQ ID NO: 2716684 - DNA, 22 bp, Homo sapiens
ctgtacagaagaaactgaatct

SEQ ID NO: 2716685 - DNA, 20 bp, Homo sapiens
ctgtactcaggaggctgagg

SEQ ID NO: 2716686 - DNA, 21 bp, Homo sapiens
ctgtagaactctgcaggcaga

SEQ ID NO: 2716687 - DNA, 19 bp, Homo sapiens
ctgtagctcccgagctact

SEQ ID NO: 2716688 - DNA, 14 bp, Homo sapiens
ctgtatcatttctt

SEQ ID NO: 2716689 - DNA, 20 bp, Homo sapiens
ctgtcaaagaaaacttccaa

SEQ ID NO: 2716690 - DNA, 16 bp, Homo sapiens
ctgtcaccctggccac

SEQ ID NO: 2716691 - DNA, 23 bp, Homo sapiens
ctgtcaggagatggaagagtcat

SEQ ID NO: 2716692 - DNA, 15 bp, Homo sapiens
ctgtccaacccctcc

SEQ ID NO: 2716693 - DNA, 13 bp, Homo sapiens
ctgtccagtgccc

SEQ ID NO: 2716694 - DNA, 14 bp, Homo sapiens
ctgtccagtttcca

SEQ ID NO: 2716695 - DNA, 16 bp, Homo sapiens
ctgtccagtttccaaa

SEQ ID NO: 2716696 - DNA, 12 bp, Homo sapiens
ctgtccatcctc

SEQ ID NO: 2716697 - DNA, 14 bp, Homo sapiens
ctgtccatcctcct

SEQ ID NO: 2716698 - DNA, 20 bp, Homo sapiens
ctgtccatcctcctctccat

SEQ ID NO: 2716699 - DNA, 13 bp, Homo sapiens
ctgtcccaggagc

SEQ ID NO: 2716700 - DNA, 15 bp, Homo sapiens
ctgtcccctcttgcc

SEQ ID NO: 2716701 - DNA, 21 bp, Homo sapiens
ctgtcccctggagaaggtccc

SEQ ID NO: 2716702 - DNA, 14 bp, Homo sapiens
ctgtcccctggggc

SEQ ID NO: 2716703 - DNA, 21 bp, Homo sapiens
ctgtcccctggggctggtgga

SEQ ID NO: 2716704 - DNA, 16 bp, Homo sapiens
ctgtccctacccactc

SEQ ID NO: 2716705 - DNA, 23 bp, Homo sapiens
ctgtccctacccactctttgcta

SEQ ID NO: 2716706 - DNA, 19 bp, Homo sapiens
ctgtccgcctctgcccgca

SEQ ID NO: 2716707 - DNA, 20 bp, Homo sapiens
ctgtccgcctctgcccgcag

SEQ ID NO: 2716708 - DNA, 15 bp, Homo sapiens
ctgtcctaggccaca

SEQ ID NO: 2716709 - DNA, 14 bp, Homo sapiens
ctgtcctcgcagag

SEQ ID NO: 2716710 - DNA, 20 bp, Homo sapiens
ctgtcctgacttcaggggct

SEQ ID NO: 2716711 - DNA, 13 bp, Homo sapiens
ctgtcctgctcca

SEQ ID NO: 2716712 - DNA, 18 bp, Homo sapiens
ctgtcctgctccacagtg

SEQ ID NO: 2716713 - DNA, 24 bp, Homo sapiens
ctgtccttactcagagctgcgggc

SEQ ID NO: 2716714 - DNA, 18 bp, Homo sapiens
ctgtccttgtgtaatgga

SEQ ID NO: 2716715 - DNA, 20 bp, Homo sapiens
ctgtccttgtgtaatggaat

SEQ ID NO: 2716716 - DNA, 16 bp, Homo sapiens
ctgtcgtgtccagcct

SEQ ID NO: 2716717 - DNA, 16 bp, Homo sapiens
ctgtctctgcttggct

SEQ ID NO: 2716718 - DNA, 14 bp, Homo sapiens
ctgtctgctcttat

SEQ ID NO: 2716719 - DNA, 13 bp, Homo sapiens
ctgtctgctgggc

SEQ ID NO: 2716720 - DNA, 14 bp, Homo sapiens
ctgtctgctgggct

SEQ ID NO: 2716721 - DNA, 15 bp, Homo sapiens
ctgtctgctgggcta

SEQ ID NO: 2716722 - DNA, 20 bp, Homo sapiens
ctgtctgtatataacttatt

SEQ ID NO: 2716723 - DNA, 11 bp, Homo sapiens
ctgtgaaagct

SEQ ID NO: 2716724 - DNA, 16 bp, Homo sapiens
ctgtgacacagctgag

SEQ ID NO: 2716725 - DNA, 18 bp, Homo sapiens
ctgtgacacagctgagct

SEQ ID NO: 2716726 - DNA, 16 bp, Homo sapiens
ctgtgacatcagaagt

SEQ ID NO: 2716727 - DNA, 16 bp, Homo sapiens
ctgtgacctgccccgc

SEQ ID NO: 2716728 - DNA, 13 bp, Homo sapiens
ctgtgagtgagtg

SEQ ID NO: 2716729 - DNA, 14 bp, Homo sapiens
ctgtgcatgacctg

SEQ ID NO: 2716730 - DNA, 13 bp, Homo sapiens
ctgtgcccatggg

SEQ ID NO: 2716731 - DNA, 15 bp, Homo sapiens
ctgtgcccatgggca

SEQ ID NO: 2716732 - DNA, 14 bp, Homo sapiens
ctgtgcctgtctgt

SEQ ID NO: 2716733 - DNA, 18 bp, Homo sapiens
ctgtgctatgctggacat

SEQ ID NO: 2716734 - DNA, 19 bp, Homo sapiens
ctgtgctatgctggacatt

SEQ ID NO: 2716735 - DNA, 11 bp, Homo sapiens
ctgtgctccca

SEQ ID NO: 2716736 - DNA, 19 bp, Homo sapiens
ctgtgctctgtccttgtgt

SEQ ID NO: 2716737 - DNA, 13 bp, Homo sapiens
ctgtggcctgggc

SEQ ID NO: 2716738 - DNA, 18 bp, Homo sapiens
ctgtgggctgcactctgt

SEQ ID NO: 2716739 - DNA, 13 bp, Homo sapiens
ctgtggggcctga

SEQ ID NO: 2716740 - DNA, 19 bp, Homo sapiens
ctgtgggggaagagcacag

SEQ ID NO: 2716741 - DNA, 22 bp, Homo sapiens
ctgtggtcacttatcctgacac

SEQ ID NO: 2716742 - DNA, 16 bp, Homo sapiens
ctgtgtcactggctgc

SEQ ID NO: 2716743 - DNA, 20 bp, Homo sapiens
ctgtgtcactggctgcctcc

SEQ ID NO: 2716744 - DNA, 21 bp, Homo sapiens
ctgtgtcctcgcactgcccag

SEQ ID NO: 2716745 - DNA, 23 bp, Homo sapiens
ctgtgtcctcgcactgcccaggg

SEQ ID NO: 2716746 - DNA, 17 bp, Homo sapiens
ctgtgtcctctccagct

SEQ ID NO: 2716747 - DNA, 16 bp, Homo sapiens
ctgtgtcgtagccaag

SEQ ID NO: 2716748 - DNA, 12 bp, Homo sapiens
ctgtgtctctgt

SEQ ID NO: 2716749 - DNA, 13 bp, Homo sapiens
gagacgctgtgat

SEQ ID NO: 2716750 - DNA, 12 bp, Homo sapiens
gagactctgagg

SEQ ID NO: 2716751 - DNA, 23 bp, Homo sapiens
gagactctgtggggccttggttc

SEQ ID NO: 2716752 - DNA, 22 bp, Homo sapiens
gagactgcgggatggtcctggg

SEQ ID NO: 2716753 - DNA, 23 bp, Homo sapiens
gagactgcgggatggtcctgggg

SEQ ID NO: 2716754 - DNA, 20 bp, Homo sapiens
gagagaaaacttatttgagt

SEQ ID NO: 2716755 - DNA, 14 bp, Homo sapiens
gagagacgctgtga

SEQ ID NO: 2716756 - DNA, 19 bp, Homo sapiens
gagagagcagcttctgcca

SEQ ID NO: 2716757 - DNA, 10 bp, Homo sapiens
gagagcccag

SEQ ID NO: 2716758 - DNA, 21 bp, Homo sapiens
gagagctctctcttctctgtt

SEQ ID NO: 2716759 - DNA, 15 bp, Homo sapiens
gagaggaaaaaggct

SEQ ID NO: 2716760 - DNA, 17 bp, Homo sapiens
gagaggcacctgctgga

SEQ ID NO: 2716761 - DNA, 19 bp, Homo sapiens
gagaggcgcgtctgcccca

SEQ ID NO: 2716762 - DNA, 16 bp, Homo sapiens
gagagtaccatgctgg

SEQ ID NO: 2716763 - DNA, 16 bp, Homo sapiens
gagagtcaaagctgac

SEQ ID NO: 2716764 - DNA, 14 bp, Homo sapiens
gagagtctgtctca

SEQ ID NO: 2716765 - DNA, 19 bp, Homo sapiens
gagatatttaaaagacaaa

SEQ ID NO: 2716766 - DNA, 22 bp, Homo sapiens
gagatatttacatgaattgcat

SEQ ID NO: 2716767 - DNA, 17 bp, Homo sapiens
gagatctttctttccaa

SEQ ID NO: 2716768 - DNA, 18 bp, Homo sapiens
gagatctttctttccaaa

SEQ ID NO: 2716769 - DNA, 22 bp, Homo sapiens
gagatctttctttccaaaacat

SEQ ID NO: 2716770 - DNA, 21 bp, Homo sapiens
gagatggagtctcgctctgct

SEQ ID NO: 2716771 - DNA, 21 bp, Homo sapiens
gagattctttaaggagataga

SEQ ID NO: 2716772 - DNA, 18 bp, Homo sapiens
gagcaaccgtgcagccac

SEQ ID NO: 2716773 - DNA, 13 bp, Homo sapiens
gagcaactctcca

SEQ ID NO: 2716774 - DNA, 16 bp, Homo sapiens
gagcaactctccactc

SEQ ID NO: 2716775 - DNA, 13 bp, Homo sapiens
gagcacagccctc

SEQ ID NO: 2716776 - DNA, 14 bp, Homo sapiens
gagcacagccctcc

SEQ ID NO: 2716777 - DNA, 13 bp, Homo sapiens
gagcagaggcagc

SEQ ID NO: 2716778 - DNA, 21 bp, Homo sapiens
gagcagatggatccacgtgct

SEQ ID NO: 2716779 - DNA, 12 bp, Homo sapiens
gagcagcctcca

SEQ ID NO: 2716780 - DNA, 18 bp, Homo sapiens
gagcagcctccagtgctg

SEQ ID NO: 2716781 - DNA, 23 bp, Homo sapiens
gagcagcctccagtgctggctgc

SEQ ID NO: 2716782 - DNA, 19 bp, Homo sapiens
gagcagctggctctccacc

SEQ ID NO: 2716783 - DNA, 13 bp, Homo sapiens
gagcaggggcagg

SEQ ID NO: 2716784 - DNA, 13 bp, Homo sapiens
gagcaggggctgc

SEQ ID NO: 2716785 - DNA, 14 bp, Homo sapiens
gagcaggggctgct

SEQ ID NO: 2716786 - DNA, 17 bp, Homo sapiens
gagcaggggctgctggg

SEQ ID NO: 2716787 - DNA, 21 bp, Homo sapiens
gagcatggggataaaggagaa

SEQ ID NO: 2716788 - DNA, 23 bp, Homo sapiens
gagccaccgcgcccagccaagaa

SEQ ID NO: 2716789 - DNA, 23 bp, Homo sapiens
gagccactacctttgtccaggcc

SEQ ID NO: 2716790 - DNA, 17 bp, Homo sapiens
gagcccaaacaccctcc

SEQ ID NO: 2716791 - DNA, 23 bp, Homo sapiens
gagccctggcaggatgaccctgc

SEQ ID NO: 2716792 - DNA, 14 bp, Homo sapiens
gagcctctgcgcct

SEQ ID NO: 2716793 - DNA, 19 bp, Homo sapiens
gagcctctgcgcctctcca

SEQ ID NO: 2716794 - DNA, 14 bp, Homo sapiens
gagcgaccctggct

SEQ ID NO: 2716795 - DNA, 16 bp, Homo sapiens
gagcgaccctggctct

SEQ ID NO: 2716796 - DNA, 21 bp, Homo sapiens
gagcgaccctggctctgccag

SEQ ID NO: 2716797 - DNA, 17 bp, Homo sapiens
gagctactctcttgcca

SEQ ID NO: 2716798 - DNA, 23 bp, Homo sapiens
gagctcctgctcattgtggccag

SEQ ID NO: 2716799 - DNA, 18 bp, Homo sapiens
gagctcctgtccctaccc

SEQ ID NO: 2716800 - DNA, 19 bp, Homo sapiens
gagctcctgtccctaccca

SEQ ID NO: 2716801 - DNA, 20 bp, Homo sapiens
gagctcctgtccctacccac

SEQ ID NO: 2716802 - DNA, 12 bp, Homo sapiens
gagctgaggcct

SEQ ID NO: 2716803 - DNA, 12 bp, Homo sapiens
gagctgcctccc

SEQ ID NO: 2716804 - DNA, 16 bp, Homo sapiens
gagctgcgggctgagg

SEQ ID NO: 2716805 - DNA, 19 bp, Homo sapiens
gagctgcgggctgagggca

SEQ ID NO: 2716806 - DNA, 14 bp, Homo sapiens
gagctgctgagcag

SEQ ID NO: 2716807 - DNA, 19 bp, Homo sapiens
gagctggtgccagatgtgg

SEQ ID NO: 2716808 - DNA, 20 bp, Homo sapiens
gagctgtggactttgttcac

SEQ ID NO: 2716809 - DNA, 21 bp, Homo sapiens
gagcttttcgaactgtgctcc

SEQ ID NO: 2716810 - DNA, 22 bp, Homo sapiens
gaggaaaggattttaccaaagc

SEQ ID NO: 2716811 - DNA, 19 bp, Homo sapiens
gaggaacattgggaaggaa

SEQ ID NO: 2716812 - DNA, 13 bp, Homo sapiens
gaggacagagccg

SEQ ID NO: 2716813 - DNA, 14 bp, Homo sapiens
gaggacagagccgg

SEQ ID NO: 2716814 - DNA, 21 bp, Homo sapiens
gaggagagaagtggccagggc

SEQ ID NO: 2716815 - DNA, 21 bp, Homo sapiens
gaggagagagcagcttctgcc

SEQ ID NO: 2716816 - DNA, 18 bp, Homo sapiens
gaggagtccagggcggga

SEQ ID NO: 2716817 - DNA, 15 bp, Homo sapiens
gaggatcccctgtcc

SEQ ID NO: 2716818 - DNA, 13 bp, Homo sapiens
gaggattttgagt

SEQ ID NO: 2716819 - DNA, 14 bp, Homo sapiens
gaggcacctgctgg

SEQ ID NO: 2716820 - DNA, 21 bp, Homo sapiens
gaggcagcgtgaaagcagatg

SEQ ID NO: 2716821 - DNA, 23 bp, Homo sapiens
gaggcagcgtgaaagcagatgag

SEQ ID NO: 2716822 - DNA, 19 bp, Homo sapiens
gaggcagtgggtcccactt

SEQ ID NO: 2716823 - DNA, 22 bp, Homo sapiens
gaggcagtgggtcccacttccc

SEQ ID NO: 2716824 - DNA, 21 bp, Homo sapiens
gaggccaaggtttcccagtga

SEQ ID NO: 2716825 - DNA, 14 bp, Homo sapiens
gaggccccaggccc

SEQ ID NO: 2716826 - DNA, 16 bp, Homo sapiens
gaggccccaggcccta

SEQ ID NO: 2716827 - DNA, 14 bp, Homo sapiens
gaggccggccctgc

SEQ ID NO: 2716828 - DNA, 15 bp, Homo sapiens
gaggccggccctgcc

SEQ ID NO: 2716829 - DNA, 17 bp, Homo sapiens
gaggccggccctgcccc

SEQ ID NO: 2716830 - DNA, 18 bp, Homo sapiens
gaggccggccctgcccct

SEQ ID NO: 2716831 - DNA, 12 bp, Homo sapiens
gaggcctccctt

SEQ ID NO: 2716832 - DNA, 19 bp, Homo sapiens
gaggcgggtggatcacctg

SEQ ID NO: 2716833 - DNA, 20 bp, Homo sapiens
gaggctccgtgagcccttgg

SEQ ID NO: 2716834 - DNA, 19 bp, Homo sapiens
gaggctcctccctctgcct

SEQ ID NO: 2716835 - DNA, 12 bp, Homo sapiens
gaggctgaggcg

SEQ ID NO: 2716836 - DNA, 17 bp, Homo sapiens
gaggctgcgtcctgagg

SEQ ID NO: 2716837 - DNA, 14 bp, Homo sapiens
gaggctggatggct

SEQ ID NO: 2716838 - DNA, 17 bp, Homo sapiens
gaggctggcatcctggc

SEQ ID NO: 2716839 - DNA, 15 bp, Homo sapiens
gaggcttggaaagca

SEQ ID NO: 2716840 - DNA, 13 bp, Homo sapiens
gagggaaaagcta

SEQ ID NO: 2716841 - DNA, 14 bp, Homo sapiens
gagggagctgaggc

SEQ ID NO: 2716842 - DNA, 20 bp, Homo sapiens
gagggagctgaggcctccct

SEQ ID NO: 2716843 - DNA, 22 bp, Homo sapiens
gagggcacccccaaattcaaag

SEQ ID NO: 2716844 - DNA, 23 bp, Homo sapiens
gagggcacccccaaattcaaaga

SEQ ID NO: 2716845 - DNA, 17 bp, Homo sapiens
gagggcagtggggagca

SEQ ID NO: 2716846 - DNA, 13 bp, Homo sapiens
gagggcccaggca

SEQ ID NO: 2716847 - DNA, 16 bp, Homo sapiens
gagggcccaggcaggc

SEQ ID NO: 2716848 - DNA, 13 bp, Homo sapiens
gaggggcaggccc

SEQ ID NO: 2716849 - DNA, 14 bp, Homo sapiens
gaggggcaggccct

SEQ ID NO: 2716850 - DNA, 23 bp, Homo sapiens
gaggggcaggccctgcactgtcc

SEQ ID NO: 2716851 - DNA, 13 bp, Homo sapiens
gaggggctcctgg

SEQ ID NO: 2716852 - DNA, 13 bp, Homo sapiens
gaggggtctttta

SEQ ID NO: 2716853 - DNA, 15 bp, Homo sapiens
gagggtagccctggg

SEQ ID NO: 2716854 - DNA, 18 bp, Homo sapiens
gagggtgggagagcccag

SEQ ID NO: 2716855 - DNA, 14 bp, Homo sapiens
gaggtagcgagctg

SEQ ID NO: 2716856 - DNA, 21 bp, Homo sapiens
gaggtagcgagctgctctgct

SEQ ID NO: 2716857 - DNA, 22 bp, Homo sapiens
gaggtcgggagttcaagaccag

SEQ ID NO: 2716858 - DNA, 22 bp, Homo sapiens
gaggtcgtataatttagtccct

SEQ ID NO: 2716859 - DNA, 20 bp, Homo sapiens
gaggtctcccctgatccaga

SEQ ID NO: 2716860 - DNA, 21 bp, Homo sapiens
gaggtctcccctgatccagac

SEQ ID NO: 2716861 - DNA, 19 bp, Homo sapiens
gaggtgacttgcctggggc

SEQ ID NO: 2716862 - DNA, 20 bp, Homo sapiens
gaggtgacttgcctggggcc

SEQ ID NO: 2716863 - DNA, 20 bp, Homo sapiens
gaggtggaggttgcagtgaa

SEQ ID NO: 2716864 - DNA, 18 bp, Homo sapiens
gaggtgtcaccctgcaga

SEQ ID NO: 2716865 - DNA, 19 bp, Homo sapiens
gaggtgtcaccctgcagag

SEQ ID NO: 2716866 - DNA, 21 bp, Homo sapiens
gaggtgtcaccctgcagagct

SEQ ID NO: 2716867 - DNA, 22 bp, Homo sapiens
gaggtgtcaccctgcagagcta

SEQ ID NO: 2716868 - DNA, 22 bp, Homo sapiens
gaggttaggagttcgagaccag

SEQ ID NO: 2716869 - DNA, 20 bp, Homo sapiens
gaggttgcagtgaactgaga

SEQ ID NO: 2716870 - DNA, 17 bp, Homo sapiens
gagtacattcatctgga

SEQ ID NO: 2716871 - DNA, 20 bp, Homo sapiens
gagtataaaataaagcaaat

SEQ ID NO: 2716872 - DNA, 19 bp, Homo sapiens
gccaggtgggcgggcagca

SEQ ID NO: 2716873 - DNA, 23 bp, Homo sapiens
gccagtcctagagctcctgtccc

SEQ ID NO: 2716874 - DNA, 14 bp, Homo sapiens
gccagtcgcgctgc

SEQ ID NO: 2716875 - DNA, 16 bp, Homo sapiens
gccagtcgcgctgcct

SEQ ID NO: 2716876 - DNA, 18 bp, Homo sapiens
gccagtcgcgctgcctgt

SEQ ID NO: 2716877 - DNA, 20 bp, Homo sapiens
gccagtcgcgctgcctgtgt

SEQ ID NO: 2716878 - DNA, 17 bp, Homo sapiens
gccagtgtgatcccaag

SEQ ID NO: 2716879 - DNA, 20 bp, Homo sapiens
gccagtgtgatcccaagtgc

SEQ ID NO: 2716880 - DNA, 14 bp, Homo sapiens
gccatactggcctc

SEQ ID NO: 2716881 - DNA, 15 bp, Homo sapiens
gccatactggcctcg

SEQ ID NO: 2716882 - DNA, 19 bp, Homo sapiens
gccatatattttctgagta

SEQ ID NO: 2716883 - DNA, 17 bp, Homo sapiens
gccatggaataaaccat

SEQ ID NO: 2716884 - DNA, 22 bp, Homo sapiens
gccatggcgtgtccctctcgga

SEQ ID NO: 2716885 - DNA, 19 bp, Homo sapiens
gccatggcttccaaggtgg

SEQ ID NO: 2716886 - DNA, 23 bp, Homo sapiens
gccatgggtcctcggcccatctg

SEQ ID NO: 2716887 - DNA, 15 bp, Homo sapiens
gccatgtgttccaag

SEQ ID NO: 2716888 - DNA, 16 bp, Homo sapiens
gccattaccatggaga

SEQ ID NO: 2716889 - DNA, 18 bp, Homo sapiens
gccattaccatggagaca

SEQ ID NO: 2716890 - DNA, 12 bp, Homo sapiens
gccattcccact

SEQ ID NO: 2716891 - DNA, 21 bp, Homo sapiens
gccattgtatttcttcatccc

SEQ ID NO: 2716892 - DNA, 16 bp, Homo sapiens
gcccacagcccccacc

SEQ ID NO: 2716893 - DNA, 17 bp, Homo sapiens
gcccacagcccccaccc

SEQ ID NO: 2716894 - DNA, 18 bp, Homo sapiens
gcccacagcccccacccc

SEQ ID NO: 2716895 - DNA, 13 bp, Homo sapiens
gcccacagctctg

SEQ ID NO: 2716896 - DNA, 18 bp, Homo sapiens
gcccacagctctgctgga

SEQ ID NO: 2716897 - DNA, 16 bp, Homo sapiens
gcccacattggaccca

SEQ ID NO: 2716898 - DNA, 21 bp, Homo sapiens
gcccacgcccgactagcaggc

SEQ ID NO: 2716899 - DNA, 14 bp, Homo sapiens
gcccacgtcctgtc

SEQ ID NO: 2716900 - DNA, 23 bp, Homo sapiens
gcccacgtcctgtcagtgccgcc

SEQ ID NO: 2716901 - DNA, 13 bp, Homo sapiens
gcccagagggccc

SEQ ID NO: 2716902 - DNA, 16 bp, Homo sapiens
gcccagagggcccagg

SEQ ID NO: 2716903 - DNA, 20 bp, Homo sapiens
gcccagagggcccaggcagg

SEQ ID NO: 2716904 - DNA, 13 bp, Homo sapiens
gcccagcagagag

SEQ ID NO: 2716905 - DNA, 14 bp, Homo sapiens
gcccagccactgca

SEQ ID NO: 2716906 - DNA, 16 bp, Homo sapiens
gcccagccactgcagc

SEQ ID NO: 2716907 - DNA, 17 bp, Homo sapiens
gcccagccactgcagca

SEQ ID NO: 2716908 - DNA, 11 bp, Homo sapiens
gcccagcctgt

SEQ ID NO: 2716909 - DNA, 12 bp, Homo sapiens
gcccagctcccc

SEQ ID NO: 2716910 - DNA, 18 bp, Homo sapiens
gcccagctgcacctgcca

SEQ ID NO: 2716911 - DNA, 20 bp, Homo sapiens
gcccaggacggggccggcca

SEQ ID NO: 2716912 - DNA, 18 bp, Homo sapiens
gcccaggccatcttccag

SEQ ID NO: 2716913 - DNA, 14 bp, Homo sapiens
gcccaggctggcca

SEQ ID NO: 2716914 - DNA, 16 bp, Homo sapiens
gcccaggctggccagc

SEQ ID NO: 2716915 - DNA, 17 bp, Homo sapiens
gcccaggctggccagcc

SEQ ID NO: 2716916 - DNA, 20 bp, Homo sapiens
gcccaggctggccagcccca

SEQ ID NO: 2716917 - DNA, 22 bp, Homo sapiens
gcccaggctggccagccccaca

SEQ ID NO: 2716918 - DNA, 14 bp, Homo sapiens
gcccatcccccctc

SEQ ID NO: 2716919 - DNA, 14 bp, Homo sapiens
gcccatctgtccat

SEQ ID NO: 2716920 - DNA, 21 bp, Homo sapiens
gcccatctgtccatcctcctc

SEQ ID NO: 2716921 - DNA, 23 bp, Homo sapiens
gcccatctgtccatcctcctctc

SEQ ID NO: 2716922 - DNA, 18 bp, Homo sapiens
gcccatgggcactgctgg

SEQ ID NO: 2716923 - DNA, 21 bp, Homo sapiens
gcccatgggcactgctgggtg

SEQ ID NO: 2716924 - DNA, 23 bp, Homo sapiens
gcccattgtggaggcggtggggg

SEQ ID NO: 2716925 - DNA, 17 bp, Homo sapiens
gccccaacccccagcac

SEQ ID NO: 2716926 - DNA, 11 bp, Homo sapiens
gccccacagcc

SEQ ID NO: 2716927 - DNA, 13 bp, Homo sapiens
gccccacagccca

SEQ ID NO: 2716928 - DNA, 14 bp, Homo sapiens
gccccacagcccac

SEQ ID NO: 2716929 - DNA, 23 bp, Homo sapiens
gccccacccagggctccctcctg

SEQ ID NO: 2716930 - DNA, 16 bp, Homo sapiens
gccccaccccaccctg

SEQ ID NO: 2716931 - DNA, 19 bp, Homo sapiens
gccccagcctggcccagct

SEQ ID NO: 2716932 - DNA, 13 bp, Homo sapiens
gccccagctctgg

SEQ ID NO: 2716933 - DNA, 16 bp, Homo sapiens
gccccatctcctccca

SEQ ID NO: 2716934 - DNA, 21 bp, Homo sapiens
gcccccaccactaggactctg

SEQ ID NO: 2716935 - DNA, 14 bp, Homo sapiens
gccccccacctttg

SEQ ID NO: 2716936 - DNA, 18 bp, Homo sapiens
gccccccatcctggccca

SEQ ID NO: 2716937 - DNA, 20 bp, Homo sapiens
gccccccatcctggcccatc

SEQ ID NO: 2716938 - DNA, 17 bp, Homo sapiens
gccccctcgtgccagtc

SEQ ID NO: 2716939 - DNA, 17 bp, Homo sapiens
gccccgcgcctccttcc

SEQ ID NO: 2716940 - DNA, 16 bp, Homo sapiens
gccccggcttgcctgt

SEQ ID NO: 2716941 - DNA, 14 bp, Homo sapiens
gccccgtgtagccc

SEQ ID NO: 2716942 - DNA, 21 bp, Homo sapiens
gcccctcaggggaagctgcta

SEQ ID NO: 2716943 - DNA, 18 bp, Homo sapiens
gcccctccccctaccgca

SEQ ID NO: 2716944 - DNA, 22 bp, Homo sapiens
gcccctccccctaccgcatggc

SEQ ID NO: 2716945 - DNA, 13 bp, Homo sapiens
gcccctggaacct

SEQ ID NO: 2716946 - DNA, 20 bp, Homo sapiens
gcccctggaacctttccctt

SEQ ID NO: 2716947 - DNA, 22 bp, Homo sapiens
gccccttgtcctctcagagcct

SEQ ID NO: 2716948 - DNA, 14 bp, Homo sapiens
gcccgactagcagg

SEQ ID NO: 2716949 - DNA, 15 bp, Homo sapiens
gcccgactagcaggc

SEQ ID NO: 2716950 - DNA, 12 bp, Homo sapiens
gcccgcttgcct

SEQ ID NO: 2716951 - DNA, 19 bp, Homo sapiens
gcccgcttgcctcggctcc

SEQ ID NO: 2716952 - DNA, 22 bp, Homo sapiens
gcccgcttgcctcggctcctgc

SEQ ID NO: 2716953 - DNA, 16 bp, Homo sapiens
gcccgttgtctccctg

SEQ ID NO: 2716954 - DNA, 18 bp, Homo sapiens
gcccgttgtctccctggc

SEQ ID NO: 2716955 - DNA, 23 bp, Homo sapiens
gcccgttgtctccctggccctca

SEQ ID NO: 2716956 - DNA, 18 bp, Homo sapiens
gccctaggattcctcccc

SEQ ID NO: 2716957 - DNA, 15 bp, Homo sapiens
gccctcaaggcctcc

SEQ ID NO: 2716958 - DNA, 16 bp, Homo sapiens
gccctcaaggcctccc

SEQ ID NO: 2716959 - DNA, 21 bp, Homo sapiens
gccctcaaggcctcccacagt

SEQ ID NO: 2716960 - DNA, 23 bp, Homo sapiens
gccctcaaggcctcccacagtga

SEQ ID NO: 2716961 - DNA, 14 bp, Homo sapiens
gccctccacagccg

SEQ ID NO: 2716962 - DNA, 13 bp, Homo sapiens
gccctcccgcccc

SEQ ID NO: 2716963 - DNA, 15 bp, Homo sapiens
gccctcccgcccctt

SEQ ID NO: 2716964 - DNA, 14 bp, Homo sapiens
gccctccgcctaga

SEQ ID NO: 2716965 - DNA, 14 bp, Homo sapiens
gccctcggcctcca

SEQ ID NO: 2716966 - DNA, 16 bp, Homo sapiens
gccctcggcctccaga

SEQ ID NO: 2716967 - DNA, 15 bp, Homo sapiens
gccctctgctgcttt

SEQ ID NO: 2716968 - DNA, 15 bp, Homo sapiens
gccctgcactgtcct

SEQ ID NO: 2716969 - DNA, 15 bp, Homo sapiens
gccctgcccctcccc

SEQ ID NO: 2716970 - DNA, 18 bp, Homo sapiens
gccctgcccctcccccta

SEQ ID NO: 2716971 - DNA, 16 bp, Homo sapiens
gccctgcccctcccta

SEQ ID NO: 2716972 - DNA, 22 bp, Homo sapiens
gccctgcccctccctagatcca

SEQ ID NO: 2716973 - DNA, 17 bp, Homo sapiens
gccctggaggctggatg

SEQ ID NO: 2716974 - DNA, 17 bp, Homo sapiens
gccctggccagggcctc

SEQ ID NO: 2716975 - DNA, 19 bp, Homo sapiens
gccctggggcccctcgaca

SEQ ID NO: 2716976 - DNA, 15 bp, Homo sapiens
gccctggtccttcca

SEQ ID NO: 2716977 - DNA, 17 bp, Homo sapiens
gcccttggtagagctgg

SEQ ID NO: 2716978 - DNA, 16 bp, Homo sapiens
gccctttgcaggccca

SEQ ID NO: 2716979 - DNA, 23 bp, Homo sapiens
gccctttgcaggcccagcagact

SEQ ID NO: 2716980 - DNA, 17 bp, Homo sapiens
gccgcagcctccctctg

SEQ ID NO: 2716981 - DNA, 24 bp, Homo sapiens
gccgccgcctcgcccaccgcatgc

SEQ ID NO: 2716982 - DNA, 13 bp, Homo sapiens
gccgcctcgccca

SEQ ID NO: 2716983 - DNA, 16 bp, Homo sapiens
gccgcttccagcttcc

SEQ ID NO: 2716984 - DNA, 13 bp, Homo sapiens
gccggccaggtgg

SEQ ID NO: 2716985 - DNA, 12 bp, Homo sapiens
gccggccctgcc

SEQ ID NO: 2716986 - DNA, 18 bp, Homo sapiens
gccggccctgcccctccc

SEQ ID NO: 2716987 - DNA, 12 bp, Homo sapiens
gccggggtggat

SEQ ID NO: 2716988 - DNA, 19 bp, Homo sapiens
gccgggtggggggagggca

SEQ ID NO: 2716989 - DNA, 14 bp, Homo sapiens
gccgtccctcctgt

SEQ ID NO: 2716990 - DNA, 15 bp, Homo sapiens
gccgtgtagtttctg

SEQ ID NO: 2716991 - DNA, 17 bp, Homo sapiens
gcctaattcctggcatg

SEQ ID NO: 2716992 - DNA, 17 bp, Homo sapiens
gcctagaggtcccctca

SEQ ID NO: 2716993 - DNA, 14 bp, Homo sapiens
gcctatcagtgtgc

SEQ ID NO: 2716994 - DNA, 23 bp, Homo sapiens
gcctatcagtgtgccccccatcc

SEQ ID NO: 2716995 - DNA, 18 bp, Homo sapiens
gcctatgatcccagcact

SEQ ID NO: 2716996 - DNA, 21 bp, Homo sapiens
ggaccgcgtagagagccgggc

SEQ ID NO: 2716997 - DNA, 15 bp, Homo sapiens
ggacctttcagctgt

SEQ ID NO: 2716998 - DNA, 20 bp, Homo sapiens
ggacgcccagctgaggctgg

SEQ ID NO: 2716999 - DNA, 18 bp, Homo sapiens
ggacggcattcctgctta

SEQ ID NO: 2717000 - DNA, 17 bp, Homo sapiens
ggactagggcctcggag

SEQ ID NO: 2717001 - DNA, 23 bp, Homo sapiens
ggactagggcctcggaggctcct

SEQ ID NO: 2717002 - DNA, 15 bp, Homo sapiens
ggactcagactcctg

SEQ ID NO: 2717003 - DNA, 16 bp, Homo sapiens
ggactcaggccagtca

SEQ ID NO: 2717004 - DNA, 21 bp, Homo sapiens
ggactctgaggctctttctgg

SEQ ID NO: 2717005 - DNA, 14 bp, Homo sapiens
ggagactatttaag

SEQ ID NO: 2717006 - DNA, 13 bp, Homo sapiens
ggagactctgtgg

SEQ ID NO: 2717007 - DNA, 16 bp, Homo sapiens
ggagactctgtggggc

SEQ ID NO: 2717008 - DNA, 14 bp, Homo sapiens
ggagagaggaggag

SEQ ID NO: 2717009 - DNA, 11 bp, Homo sapiens
ggagagcagct

SEQ ID NO: 2717010 - DNA, 12 bp, Homo sapiens
ggagagcccagc

SEQ ID NO: 2717011 - DNA, 13 bp, Homo sapiens
ggagatgaaaacc

SEQ ID NO: 2717012 - DNA, 12 bp, Homo sapiens
ggagcagcctcc

SEQ ID NO: 2717013 - DNA, 15 bp, Homo sapiens
ggagccaacagcagc

SEQ ID NO: 2717014 - DNA, 12 bp, Homo sapiens
ggagccagctct

SEQ ID NO: 2717015 - DNA, 14 bp, Homo sapiens
ggagccgggaaagc

SEQ ID NO: 2717016 - DNA, 23 bp, Homo sapiens
ggagcctcgtccaaggcagttct

SEQ ID NO: 2717017 - DNA, 13 bp, Homo sapiens
ggagcctgaaccg

SEQ ID NO: 2717018 - DNA, 13 bp, Homo sapiens
ggagcgaccctgg

SEQ ID NO: 2717019 - DNA, 17 bp, Homo sapiens
ggagcgaccctggctct

SEQ ID NO: 2717020 - DNA, 18 bp, Homo sapiens
ggagcgaccctggctctg

SEQ ID NO: 2717021 - DNA, 22 bp, Homo sapiens
ggagcgaccctggctctgccag

SEQ ID NO: 2717022 - DNA, 21 bp, Homo sapiens
ggagcgcacctgccccctggt

SEQ ID NO: 2717023 - DNA, 21 bp, Homo sapiens
ggagctgacagagccagaggc

SEQ ID NO: 2717024 - DNA, 22 bp, Homo sapiens
ggagctgacagagccagaggca

SEQ ID NO: 2717025 - DNA, 15 bp, Homo sapiens
ggagctgaggcctcc

SEQ ID NO: 2717026 - DNA, 16 bp, Homo sapiens
ggagctgaggcctccc

SEQ ID NO: 2717027 - DNA, 21 bp, Homo sapiens
ggagcttctctgatgtgatat

SEQ ID NO: 2717028 - DNA, 15 bp, Homo sapiens
ggaggaggtgccaac

SEQ ID NO: 2717029 - DNA, 17 bp, Homo sapiens
ggaggatcactggagcc

SEQ ID NO: 2717030 - DNA, 21 bp, Homo sapiens
ggaggatcactggagcccagg

SEQ ID NO: 2717031 - DNA, 22 bp, Homo sapiens
ggaggcactaagtcatggtcct

SEQ ID NO: 2717032 - DNA, 23 bp, Homo sapiens
ggaggcaggatatccccagggaa

SEQ ID NO: 2717033 - DNA, 14 bp, Homo sapiens
ggaggctcctccct

SEQ ID NO: 2717034 - DNA, 13 bp, Homo sapiens
ggagggagctgag

SEQ ID NO: 2717035 - DNA, 16 bp, Homo sapiens
ggagggagctgaggcc

SEQ ID NO: 2717036 - DNA, 18 bp, Homo sapiens
ggaggggcccgcttgcct

SEQ ID NO: 2717037 - DNA, 22 bp, Homo sapiens
ggaggggcccgcttgcctcggc

SEQ ID NO: 2717038 - DNA, 23 bp, Homo sapiens
ggaggggcccgcttgcctcggct

SEQ ID NO: 2717039 - DNA, 14 bp, Homo sapiens
ggagggtagccctg

SEQ ID NO: 2717040 - DNA, 13 bp, Homo sapiens
ggagggtgaccca

SEQ ID NO: 2717041 - DNA, 20 bp, Homo sapiens
ggaggtggaggttgcagtga

SEQ ID NO: 2717042 - DNA, 15 bp, Homo sapiens
ggaggtggcagccct

SEQ ID NO: 2717043 - DNA, 17 bp, Homo sapiens
ggaggtggcagccctgt

SEQ ID NO: 2717044 - DNA, 14 bp, Homo sapiens
ggaggttgcaggga

SEQ ID NO: 2717045 - DNA, 17 bp, Homo sapiens
ggaggttgcagggagcc

SEQ ID NO: 2717046 - DNA, 15 bp, Homo sapiens
ggagtcaccatgcaa

SEQ ID NO: 2717047 - DNA, 21 bp, Homo sapiens
ggagtcccttagaagatctgc

SEQ ID NO: 2717048 - DNA, 15 bp, Homo sapiens
ggagtctcgctctgc

SEQ ID NO: 2717049 - DNA, 22 bp, Homo sapiens
ggagtgagaatgccgggcccct

SEQ ID NO: 2717050 - DNA, 17 bp, Homo sapiens
ggagtgctgcagctttg

SEQ ID NO: 2717051 - DNA, 13 bp, Homo sapiens
ggagtgggggctg

SEQ ID NO: 2717052 - DNA, 19 bp, Homo sapiens
ggagtgtcctgtctgctgg

SEQ ID NO: 2717053 - DNA, 20 bp, Homo sapiens
ggagttcagtggtgtgatct

SEQ ID NO: 2717054 - DNA, 18 bp, Homo sapiens
ggagttcgagaccagcct

SEQ ID NO: 2717055 - DNA, 20 bp, Homo sapiens
ggagttcgagaccagcctgg

SEQ ID NO: 2717056 - DNA, 20 bp, Homo sapiens
ggagtttgaggctgcagcga

SEQ ID NO: 2717057 - DNA, 17 bp, Homo sapiens
ggagtttttcttacata

SEQ ID NO: 2717058 - DNA, 13 bp, Homo sapiens
ggatcactggagc

SEQ ID NO: 2717059 - DNA, 18 bp, Homo sapiens
ggatcactggagcccagg

SEQ ID NO: 2717060 - DNA, 22 bp, Homo sapiens
ggatcccactgattggccagcc

SEQ ID NO: 2717061 - DNA, 17 bp, Homo sapiens
ggatcccctgtcccctg

SEQ ID NO: 2717062 - DNA, 23 bp, Homo sapiens
ggatcccctgtcccctggggctg

SEQ ID NO: 2717063 - DNA, 16 bp, Homo sapiens
ggatgaaaagccatat

SEQ ID NO: 2717064 - DNA, 16 bp, Homo sapiens
ggatgaatgggaaagt

SEQ ID NO: 2717065 - DNA, 18 bp, Homo sapiens
ggatgctggccacagaaa

SEQ ID NO: 2717066 - DNA, 15 bp, Homo sapiens
ggatggggagtctca

SEQ ID NO: 2717067 - DNA, 20 bp, Homo sapiens
ggatggtcctggggctctgt

SEQ ID NO: 2717068 - DNA, 14 bp, Homo sapiens
ggattcccagagag

SEQ ID NO: 2717069 - DNA, 23 bp, Homo sapiens
ggattctaaacagatgtccctga

SEQ ID NO: 2717070 - DNA, 13 bp, Homo sapiens
ggattttaccaaa

SEQ ID NO: 2717071 - DNA, 15 bp, Homo sapiens
ggattttaccaaagc

SEQ ID NO: 2717072 - DNA, 16 bp, Homo sapiens
ggattttaccaaagca

SEQ ID NO: 2717073 - DNA, 17 bp, Homo sapiens
ggattttaccaaagcat

SEQ ID NO: 2717074 - DNA, 21 bp, Homo sapiens
ggatttttacaaataaagatg

SEQ ID NO: 2717075 - DNA, 21 bp, Homo sapiens
ggcaacagaaaacaattgttc

SEQ ID NO: 2717076 - DNA, 19 bp, Homo sapiens
ggcaagaatgaaatactct

SEQ ID NO: 2717077 - DNA, 17 bp, Homo sapiens
ggcaagcgtgctgcctc

SEQ ID NO: 2717078 - DNA, 17 bp, Homo sapiens
ggcaatgcagtgcagca

SEQ ID NO: 2717079 - DNA, 17 bp, Homo sapiens
ggcaatgccctacctgc

SEQ ID NO: 2717080 - DNA, 18 bp, Homo sapiens
ggcacagggaggctgcag

SEQ ID NO: 2717081 - DNA, 24 bp, Homo sapiens
ggcaccactagggtcctggccctc

SEQ ID NO: 2717082 - DNA, 15 bp, Homo sapiens
ggcaccagtgcctca

SEQ ID NO: 2717083 - DNA, 16 bp, Homo sapiens
ggcaccagtgcctcag

SEQ ID NO: 2717084 - DNA, 17 bp, Homo sapiens
ggcaccagtgcctcagt

SEQ ID NO: 2717085 - DNA, 16 bp, Homo sapiens
ggcacccccaaattca

SEQ ID NO: 2717086 - DNA, 18 bp, Homo sapiens
ggcacctatagtcccagc

SEQ ID NO: 2717087 - DNA, 12 bp, Homo sapiens
ggcactgctggg

SEQ ID NO: 2717088 - DNA, 14 bp, Homo sapiens
ggcactgctgggtg

SEQ ID NO: 2717089 - DNA, 22 bp, Homo sapiens
ggcactgctgggtggcccatcc

SEQ ID NO: 2717090 - DNA, 16 bp, Homo sapiens
ggcagaactgctgggg

SEQ ID NO: 2717091 - DNA, 23 bp, Homo sapiens
ggcagaactgctggggctggtga

SEQ ID NO: 2717092 - DNA, 16 bp, Homo sapiens
ggcagaatcctgggcc

SEQ ID NO: 2717093 - DNA, 19 bp, Homo sapiens
ggcagaatcctgggccccc

SEQ ID NO: 2717094 - DNA, 16 bp, Homo sapiens
ggcagagccgggaagc

SEQ ID NO: 2717095 - DNA, 19 bp, Homo sapiens
ggcagatgggcctgtgtgc

SEQ ID NO: 2717096 - DNA, 13 bp, Homo sapiens
ggcagccctgtag

SEQ ID NO: 2717097 - DNA, 15 bp, Homo sapiens
ggcagccctgtaggg

SEQ ID NO: 2717098 - DNA, 13 bp, Homo sapiens
ggcagctccagct

SEQ ID NO: 2717099 - DNA, 22 bp, Homo sapiens
ggcagctcgagcatgccctgag

SEQ ID NO: 2717100 - DNA, 15 bp, Homo sapiens
ggcagctgggcccac

SEQ ID NO: 2717101 - DNA, 17 bp, Homo sapiens
ggcagctgggcccacag

SEQ ID NO: 2717102 - DNA, 14 bp, Homo sapiens
ggcaggagtcacca

SEQ ID NO: 2717103 - DNA, 21 bp, Homo sapiens
ggcaggagtcaccatgcaagg

SEQ ID NO: 2717104 - DNA, 13 bp, Homo sapiens
ggcaggcacagca

SEQ ID NO: 2717105 - DNA, 18 bp, Homo sapiens
ggcaggcacagcacaggg

SEQ ID NO: 2717106 - DNA, 13 bp, Homo sapiens
ggcaggccctgca

SEQ ID NO: 2717107 - DNA, 22 bp, Homo sapiens
ggcaggccctgcactgtcctgc

SEQ ID NO: 2717108 - DNA, 15 bp, Homo sapiens
ggcagggatttgagg

SEQ ID NO: 2717109 - DNA, 16 bp, Homo sapiens
ggcagggcctggcctt

SEQ ID NO: 2717110 - DNA, 20 bp, Homo sapiens
ggcagtgggtcccacttccc

SEQ ID NO: 2717111 - DNA, 23 bp, Homo sapiens
ggcatatccattgtggaaactgg

SEQ ID NO: 2717112 - DNA, 13 bp, Homo sapiens
ggcatcacagggc

SEQ ID NO: 2717113 - DNA, 19 bp, Homo sapiens
ggcatctctgagtgtctct

SEQ ID NO: 2717114 - DNA, 14 bp, Homo sapiens
ggcatgacactcta

SEQ ID NO: 2717115 - DNA, 15 bp, Homo sapiens
ggcatgacactctag

SEQ ID NO: 2717116 - DNA, 15 bp, Homo sapiens
ggcattcctgcttat

SEQ ID NO: 2717117 - DNA, 14 bp, Homo sapiens
ggcatttggtgaga

SEQ ID NO: 2717118 - DNA, 16 bp, Homo sapiens
ggccaaggctgagagc

SEQ ID NO: 2717119 - DNA, 22 bp, Homo sapiens
ggccacagaaaggccactcagg

SEQ ID NO: 2717120 - DNA, 21 bp, Homo sapiens
gtaagcattctgagctgggct

SEQ ID NO: 2717121 - DNA, 16 bp, Homo sapiens
gtaagtataacaaact

SEQ ID NO: 2717122 - DNA, 12 bp, Homo sapiens
gtaagtcttttt

SEQ ID NO: 2717123 - DNA, 20 bp, Homo sapiens
gtaatatattgctgctggta

SEQ ID NO: 2717124 - DNA, 16 bp, Homo sapiens
gtaatatgaaagccac

SEQ ID NO: 2717125 - DNA, 17 bp, Homo sapiens
gtaatccatcactagcc

SEQ ID NO: 2717126 - DNA, 14 bp, Homo sapiens
gtaatttgtatctg

SEQ ID NO: 2717127 - DNA, 18 bp, Homo sapiens
gtaatttttaaagcaaat

SEQ ID NO: 2717128 - DNA, 20 bp, Homo sapiens
gtaatttttttttgtaaagt

SEQ ID NO: 2717129 - DNA, 18 bp, Homo sapiens
gtacaaggtatgtacagt

SEQ ID NO: 2717130 - DNA, 14 bp, Homo sapiens
gtacagcagggtct

SEQ ID NO: 2717131 - DNA, 15 bp, Homo sapiens
gtacagcagggtctt

SEQ ID NO: 2717132 - DNA, 20 bp, Homo sapiens
gtacagcagggtcttgctgt

SEQ ID NO: 2717133 - DNA, 17 bp, Homo sapiens
gtacagtctcaattttg

SEQ ID NO: 2717134 - DNA, 19 bp, Homo sapiens
gtacagttcagttcctctt

SEQ ID NO: 2717135 - DNA, 17 bp, Homo sapiens
gtacagttcataaattt

SEQ ID NO: 2717136 - DNA, 16 bp, Homo sapiens
gtacattactgtatgt

SEQ ID NO: 2717137 - DNA, 21 bp, Homo sapiens
gtaccaagccaccgcagctgc

SEQ ID NO: 2717138 - DNA, 23 bp, Homo sapiens
gtaccaagccaccgcagctgctg

SEQ ID NO: 2717139 - DNA, 23 bp, Homo sapiens
gtaccacaccctgcctgctgtgg

SEQ ID NO: 2717140 - DNA, 15 bp, Homo sapiens
gtaccaggcacatgg

SEQ ID NO: 2717141 - DNA, 22 bp, Homo sapiens
gtaccaggcacatggctggggg

SEQ ID NO: 2717142 - DNA, 18 bp, Homo sapiens
gtaccaggtctcctccac

SEQ ID NO: 2717143 - DNA, 19 bp, Homo sapiens
gtacccccgcccaggctgg

SEQ ID NO: 2717144 - DNA, 17 bp, Homo sapiens
gtactgaaggcttctgc

SEQ ID NO: 2717145 - DNA, 19 bp, Homo sapiens
gtagatttttgctcttctg

SEQ ID NO: 2717146 - DNA, 13 bp, Homo sapiens
gtagcgagctgct

SEQ ID NO: 2717147 - DNA, 22 bp, Homo sapiens
gtaggaaagcaccgcagcatgt

SEQ ID NO: 2717148 - DNA, 17 bp, Homo sapiens
gtaggttttaaaaataa

SEQ ID NO: 2717149 - DNA, 20 bp, Homo sapiens
gtaggttttaaaaataagtt

SEQ ID NO: 2717150 - DNA, 21 bp, Homo sapiens
gtaggttttaaaaataagttt

SEQ ID NO: 2717151 - DNA, 23 bp, Homo sapiens
gtaggttttaaaaataagtttta

SEQ ID NO: 2717152 - DNA, 14 bp, Homo sapiens
gtagtagtgtcttc

SEQ ID NO: 2717153 - DNA, 22 bp, Homo sapiens
gtagtgtcttcctagtatatta

SEQ ID NO: 2717154 - DNA, 15 bp, Homo sapiens
gtagtgtgttgataa

SEQ ID NO: 2717155 - DNA, 18 bp, Homo sapiens
gtataaaataaagcaaat

SEQ ID NO: 2717156 - DNA, 18 bp, Homo sapiens
gtataaacaaattagcaa

SEQ ID NO: 2717157 - DNA, 19 bp, Homo sapiens
gtataaattatgaaggacc

SEQ ID NO: 2717158 - DNA, 15 bp, Homo sapiens
gtataacaaactatg

SEQ ID NO: 2717159 - DNA, 18 bp, Homo sapiens
gtataacaaactatgtaa

SEQ ID NO: 2717160 - DNA, 21 bp, Homo sapiens
gtataaggatcttttgtaaat

SEQ ID NO: 2717161 - DNA, 12 bp, Homo sapiens
gtatacaaacag

SEQ ID NO: 2717162 - DNA, 17 bp, Homo sapiens
gtatacaaacaggtgct

SEQ ID NO: 2717163 - DNA, 18 bp, Homo sapiens
gtatacaaacaggtgcta

SEQ ID NO: 2717164 - DNA, 15 bp, Homo sapiens
gtatagagatatgca

SEQ ID NO: 2717165 - DNA, 15 bp, Homo sapiens
gtatatgtatatcta

SEQ ID NO: 2717166 - DNA, 18 bp, Homo sapiens
gtatcaatccttgttcag

SEQ ID NO: 2717167 - DNA, 13 bp, Homo sapiens
gtatcctgctggt

SEQ ID NO: 2717168 - DNA, 11 bp, Homo sapiens
gtatctgaagg

SEQ ID NO: 2717169 - DNA, 19 bp, Homo sapiens
gtatctgcatgtaaaatct

SEQ ID NO: 2717170 - DNA, 21 bp, Homo sapiens
gtatctgcatgtaaaatcttc

SEQ ID NO: 2717171 - DNA, 22 bp, Homo sapiens
gtatgcaagtgggagatgaaaa

SEQ ID NO: 2717172 - DNA, 14 bp, Homo sapiens
gtatgggaagccat

SEQ ID NO: 2717173 - DNA, 13 bp, Homo sapiens
gtatgtataaatt

SEQ ID NO: 2717174 - DNA, 15 bp, Homo sapiens
gtatgtgccaatttt

SEQ ID NO: 2717175 - DNA, 19 bp, Homo sapiens
gtattaggggtaatatatt

SEQ ID NO: 2717176 - DNA, 16 bp, Homo sapiens
gtattttgatcagtgt

SEQ ID NO: 2717177 - DNA, 23 bp, Homo sapiens
gtattttttttttaaataaaagc

SEQ ID NO: 2717178 - DNA, 15 bp, Homo sapiens
gtcaactttcatttg

SEQ ID NO: 2717179 - DNA, 18 bp, Homo sapiens
gtcaagttccctcctgca

SEQ ID NO: 2717180 - DNA, 15 bp, Homo sapiens
gtcacagctcttgtt

SEQ ID NO: 2717181 - DNA, 13 bp, Homo sapiens
gtcaccatgcaag

SEQ ID NO: 2717182 - DNA, 17 bp, Homo sapiens
gtcacccctctgtccag

SEQ ID NO: 2717183 - DNA, 14 bp, Homo sapiens
gtcaccctcctgag

SEQ ID NO: 2717184 - DNA, 16 bp, Homo sapiens
gtcaccctcctgagcc

SEQ ID NO: 2717185 - DNA, 17 bp, Homo sapiens
gtcaccctcctgagcct

SEQ ID NO: 2717186 - DNA, 16 bp, Homo sapiens
gtcaccctggccacca

SEQ ID NO: 2717187 - DNA, 14 bp, Homo sapiens
gtcactggctgcct

SEQ ID NO: 2717188 - DNA, 19 bp, Homo sapiens
gtcactgtttattttttta

SEQ ID NO: 2717189 - DNA, 18 bp, Homo sapiens
gtcagaccagtactggga

SEQ ID NO: 2717190 - DNA, 24 bp, Homo sapiens
gtcagactgctgggactggccagg

SEQ ID NO: 2717191 - DNA, 22 bp, Homo sapiens
gtcagccttccccctcccaggg

SEQ ID NO: 2717192 - DNA, 23 bp, Homo sapiens
gtcagtgccgccgcctcgcccac

SEQ ID NO: 2717193 - DNA, 21 bp, Homo sapiens
gtcattaaaacagaagcaaat

SEQ ID NO: 2717194 - DNA, 22 bp, Homo sapiens
gtcattatttgataacattttg

SEQ ID NO: 2717195 - DNA, 17 bp, Homo sapiens
gtcattatttttgttag

SEQ ID NO: 2717196 - DNA, 21 bp, Homo sapiens
gtcattgtaacctcgtgtcta

SEQ ID NO: 2717197 - DNA, 16 bp, Homo sapiens
gtccaacccagcctga

SEQ ID NO: 2717198 - DNA, 14 bp, Homo sapiens
gtccaacccctccc

SEQ ID NO: 2717199 - DNA, 15 bp, Homo sapiens
gtccaaggcagttct

SEQ ID NO: 2717200 - DNA, 21 bp, Homo sapiens
gtccaaggcagttctgtgtcc

SEQ ID NO: 2717201 - DNA, 16 bp, Homo sapiens
gtccacagtggaacca

SEQ ID NO: 2717202 - DNA, 18 bp, Homo sapiens
gtccagaccattgtcttc

SEQ ID NO: 2717203 - DNA, 19 bp, Homo sapiens
gtccagggcgggagtgggg

SEQ ID NO: 2717204 - DNA, 21 bp, Homo sapiens
gtccagggcgggagtgggggc

SEQ ID NO: 2717205 - DNA, 20 bp, Homo sapiens
gtccaggggagggaaaagct

SEQ ID NO: 2717206 - DNA, 18 bp, Homo sapiens
gtccagtcctttgttgct

SEQ ID NO: 2717207 - DNA, 13 bp, Homo sapiens
gtccagtgcccat

SEQ ID NO: 2717208 - DNA, 11 bp, Homo sapiens
gtccataaagt

SEQ ID NO: 2717209 - DNA, 19 bp, Homo sapiens
gtccatcctcctctccatg

SEQ ID NO: 2717210 - DNA, 22 bp, Homo sapiens
gtccatcctcctctccatgcaa

SEQ ID NO: 2717211 - DNA, 23 bp, Homo sapiens
gtccatcctcctctccatgcaag

SEQ ID NO: 2717212 - DNA, 20 bp, Homo sapiens
gtccatttcttatttaatta

SEQ ID NO: 2717213 - DNA, 19 bp, Homo sapiens
gtcccagacagctggaccc

SEQ ID NO: 2717214 - DNA, 16 bp, Homo sapiens
gtcccatgtgcatgga

SEQ ID NO: 2717215 - DNA, 16 bp, Homo sapiens
gtcccctcacagactc

SEQ ID NO: 2717216 - DNA, 13 bp, Homo sapiens
gtcccctcttgcc

SEQ ID NO: 2717217 - DNA, 13 bp, Homo sapiens
gtcccctggggct

SEQ ID NO: 2717218 - DNA, 17 bp, Homo sapiens
gtcccggttcaccttgc

SEQ ID NO: 2717219 - DNA, 11 bp, Homo sapiens
gtccctcctgt

SEQ ID NO: 2717220 - DNA, 12 bp, Homo sapiens
gtccctctagct

SEQ ID NO: 2717221 - DNA, 20 bp, Homo sapiens
gtccctctcgccctggccag

SEQ ID NO: 2717222 - DNA, 21 bp, Homo sapiens
gtccctctcggaaggctggct

SEQ ID NO: 2717223 - DNA, 13 bp, Homo sapiens
gtccctgaagtct

SEQ ID NO: 2717224 - DNA, 18 bp, Homo sapiens
gtccctgtccctctcgcc

SEQ ID NO: 2717225 - DNA, 14 bp, Homo sapiens
gtccctgtgttctg

SEQ ID NO: 2717226 - DNA, 17 bp, Homo sapiens
gtcccttccatttctac

SEQ ID NO: 2717227 - DNA, 16 bp, Homo sapiens
gtccggagcgaccctg

SEQ ID NO: 2717228 - DNA, 19 bp, Homo sapiens
gtcctagagctcctgtccc

SEQ ID NO: 2717229 - DNA, 13 bp, Homo sapiens
gtcctcacagcct

SEQ ID NO: 2717230 - DNA, 15 bp, Homo sapiens
gtcctcacagcctct

SEQ ID NO: 2717231 - DNA, 17 bp, Homo sapiens
gtcctcacagcctctcc

SEQ ID NO: 2717232 - DNA, 18 bp, Homo sapiens
gtcctcacagcctctccc

SEQ ID NO: 2717233 - DNA, 20 bp, Homo sapiens
gtcctcacagcctctccctt

SEQ ID NO: 2717234 - DNA, 17 bp, Homo sapiens
gtcctcgtagccatctc

SEQ ID NO: 2717235 - DNA, 16 bp, Homo sapiens
gtcctctcagagcctc

SEQ ID NO: 2717236 - DNA, 17 bp, Homo sapiens
gtcctctcagagcctca

SEQ ID NO: 2717237 - DNA, 20 bp, Homo sapiens
gtcctctcagagcctcagct

SEQ ID NO: 2717238 - DNA, 21 bp, Homo sapiens
gtcctgacttcaggggctgcc

SEQ ID NO: 2717239 - DNA, 23 bp, Homo sapiens
gtcctgacttcaggggctgcccg

SEQ ID NO: 2717240 - DNA, 17 bp, Homo sapiens
gtcctgaggagtgtcct

SEQ ID NO: 2717241 - DNA, 18 bp, Homo sapiens
gtcctgaggagtgtcctg

SEQ ID NO: 2717242 - DNA, 16 bp, Homo sapiens
gtcctgctccacagtg

SEQ ID NO: 2717243 - DNA, 19 bp, Homo sapiens
gtcctgctccacagtgttg

SEQ ID NO: 2717244 - DNA, 14 bp, Homo sapiens
taagctgcagcttc

SEQ ID NO: 2717245 - DNA, 16 bp, Homo sapiens
taagctgcagcttcct

SEQ ID NO: 2717246 - DNA, 22 bp, Homo sapiens
taagctgtagaactctgcaggc

SEQ ID NO: 2717247 - DNA, 19 bp, Homo sapiens
taaggatatgattaatatt

SEQ ID NO: 2717248 - DNA, 13 bp, Homo sapiens
taaggatcttttg

SEQ ID NO: 2717249 - DNA, 20 bp, Homo sapiens
taaggatggagccagctctg

SEQ ID NO: 2717250 - DNA, 23 bp, Homo sapiens
taaggtataaggatcttttgtaa

SEQ ID NO: 2717251 - DNA, 21 bp, Homo sapiens
taaggtatctggtatctgcat

SEQ ID NO: 2717252 - DNA, 19 bp, Homo sapiens
taagtactatctttgtcta

SEQ ID NO: 2717253 - DNA, 19 bp, Homo sapiens
taagtcatggtcctggctg

SEQ ID NO: 2717254 - DNA, 15 bp, Homo sapiens
taagtgtaagtaaat

SEQ ID NO: 2717255 - DNA, 14 bp, Homo sapiens
taagtgtggatgtt

SEQ ID NO: 2717256 - DNA, 17 bp, Homo sapiens
taagtgtggatgttcag

SEQ ID NO: 2717257 - DNA, 18 bp, Homo sapiens
taagtttatgtctaaaga

SEQ ID NO: 2717258 - DNA, 17 bp, Homo sapiens
taagttttatacataaa

SEQ ID NO: 2717259 - DNA, 16 bp, Homo sapiens
taataggatgaatggg

SEQ ID NO: 2717260 - DNA, 14 bp, Homo sapiens
taatatattgctgc

SEQ ID NO: 2717261 - DNA, 17 bp, Homo sapiens
taatatctgagaagtgt

SEQ ID NO: 2717262 - DNA, 22 bp, Homo sapiens
taatatgcaatcctacttctat

SEQ ID NO: 2717263 - DNA, 17 bp, Homo sapiens
taatattctctgatgtt

SEQ ID NO: 2717264 - DNA, 22 bp, Homo sapiens
taatattcttttgttattaaaa

SEQ ID NO: 2717265 - DNA, 20 bp, Homo sapiens
taatcaagagtctctccagc

SEQ ID NO: 2717266 - DNA, 13 bp, Homo sapiens
taatcataacata

SEQ ID NO: 2717267 - DNA, 16 bp, Homo sapiens
taatccatgtgctgct

SEQ ID NO: 2717268 - DNA, 22 bp, Homo sapiens
taatccatgtgctgctgtggca

SEQ ID NO: 2717269 - DNA, 18 bp, Homo sapiens
taatcttttaaaaatgat

SEQ ID NO: 2717270 - DNA, 20 bp, Homo sapiens
taatcttttaaaaatgatga

SEQ ID NO: 2717271 - DNA, 22 bp, Homo sapiens
taatgagctcctgctcattgtg

SEQ ID NO: 2717272 - DNA, 14 bp, Homo sapiens
taatgcaacaatgt

SEQ ID NO: 2717273 - DNA, 22 bp, Homo sapiens
taattaaaccagactctgttgc

SEQ ID NO: 2717274 - DNA, 16 bp, Homo sapiens
taattattttccaaaa

SEQ ID NO: 2717275 - DNA, 22 bp, Homo sapiens
taattcaaagctctattaagat

SEQ ID NO: 2717276 - DNA, 15 bp, Homo sapiens
taattcattaatctg

SEQ ID NO: 2717277 - DNA, 12 bp, Homo sapiens
taattgtcatta

SEQ ID NO: 2717278 - DNA, 22 bp, Homo sapiens
taatttaccattattttacagt

SEQ ID NO: 2717279 - DNA, 22 bp, Homo sapiens
taatttgtgcatcagaaaatgc

SEQ ID NO: 2717280 - DNA, 14 bp, Homo sapiens
taatttttataaat

SEQ ID NO: 2717281 - DNA, 22 bp, Homo sapiens
taatttttataaatatgtgaaa

SEQ ID NO: 2717282 - DNA, 18 bp, Homo sapiens
taatttttccttttgcca

SEQ ID NO: 2717283 - DNA, 14 bp, Homo sapiens
taatttttttcaca

SEQ ID NO: 2717284 - DNA, 19 bp, Homo sapiens
tacaaaaaaaatctttaat

SEQ ID NO: 2717285 - DNA, 9 bp, Homo sapiens
tacaaacat

SEQ ID NO: 2717286 - DNA, 14 bp, Homo sapiens
tacaaagccttggt

SEQ ID NO: 2717287 - DNA, 15 bp, Homo sapiens
tacaacctatgtaat

SEQ ID NO: 2717288 - DNA, 16 bp, Homo sapiens
tacaactttcatttaa

SEQ ID NO: 2717289 - DNA, 20 bp, Homo sapiens
tacaataaatcctttacttt

SEQ ID NO: 2717290 - DNA, 12 bp, Homo sapiens
tacaataaatgc

SEQ ID NO: 2717291 - DNA, 16 bp, Homo sapiens
tacaataataaatcct

SEQ ID NO: 2717292 - DNA, 20 bp, Homo sapiens
tacaataataaatcctcagg

SEQ ID NO: 2717293 - DNA, 20 bp, Homo sapiens
tacacacccccaagccacag

SEQ ID NO: 2717294 - DNA, 15 bp, Homo sapiens
tacacatatatgtat

SEQ ID NO: 2717295 - DNA, 14 bp, Homo sapiens
tacacccttggact

SEQ ID NO: 2717296 - DNA, 18 bp, Homo sapiens
tacagagaaattctgtgg

SEQ ID NO: 2717297 - DNA, 19 bp, Homo sapiens
tacagccgtgcacaccagt

SEQ ID NO: 2717298 - DNA, 20 bp, Homo sapiens
tacaggggtagtttgtttta

SEQ ID NO: 2717299 - DNA, 18 bp, Homo sapiens
tacagtaaataaattgtt

SEQ ID NO: 2717300 - DNA, 15 bp, Homo sapiens
tacagtctcaatttt

SEQ ID NO: 2717301 - DNA, 18 bp, Homo sapiens
tacagtctcaattttgta

SEQ ID NO: 2717302 - DNA, 20 bp, Homo sapiens
tacagtctcaattttgtatt

SEQ ID NO: 2717303 - DNA, 21 bp, Homo sapiens
tacagtctcaattttgtattt

SEQ ID NO: 2717304 - DNA, 14 bp, Homo sapiens
tacagtgtatttaa

SEQ ID NO: 2717305 - DNA, 15 bp, Homo sapiens
tacagttcataaatt

SEQ ID NO: 2717306 - DNA, 17 bp, Homo sapiens
tacagttcataaatttg

SEQ ID NO: 2717307 - DNA, 15 bp, Homo sapiens
tacataaacagtttt

SEQ ID NO: 2717308 - DNA, 14 bp, Homo sapiens
tacataatttgcaa

SEQ ID NO: 2717309 - DNA, 21 bp, Homo sapiens
tacatacaacctatgtaattt

SEQ ID NO: 2717310 - DNA, 20 bp, Homo sapiens
tacatcttttcaacaagtaa

SEQ ID NO: 2717311 - DNA, 14 bp, Homo sapiens
tacatgctgctaat

SEQ ID NO: 2717312 - DNA, 16 bp, Homo sapiens
tacatggccagtgtga

SEQ ID NO: 2717313 - DNA, 16 bp, Homo sapiens
tacattatattcctct

SEQ ID NO: 2717314 - DNA, 15 bp, Homo sapiens
tacatttcatacaac

SEQ ID NO: 2717315 - DNA, 19 bp, Homo sapiens
tacatttttcgactgtgaa

SEQ ID NO: 2717316 - DNA, 13 bp, Homo sapiens
taccaagccaccg

SEQ ID NO: 2717317 - DNA, 14 bp, Homo sapiens
taccacaccctgcc

SEQ ID NO: 2717318 - DNA, 15 bp, Homo sapiens
taccacaccctgcct

SEQ ID NO: 2717319 - DNA, 23 bp, Homo sapiens
taccacaccctgcctgctgtgga

SEQ ID NO: 2717320 - DNA, 15 bp, Homo sapiens
taccaggcacatggc

SEQ ID NO: 2717321 - DNA, 19 bp, Homo sapiens
taccaggcacatggctggg

SEQ ID NO: 2717322 - DNA, 19 bp, Homo sapiens
taccagtgggcatgtatta

SEQ ID NO: 2717323 - DNA, 23 bp, Homo sapiens
taccattgtgattattgttacta

SEQ ID NO: 2717324 - DNA, 14 bp, Homo sapiens
taccccatttgatt

SEQ ID NO: 2717325 - DNA, 12 bp, Homo sapiens
tacccccgccca

SEQ ID NO: 2717326 - DNA, 10 bp, Homo sapiens
tacccctccc

SEQ ID NO: 2717327 - DNA, 14 bp, Homo sapiens
tacccctcccagct

SEQ ID NO: 2717328 - DNA, 14 bp, Homo sapiens
taccctccctgctg

SEQ ID NO: 2717329 - DNA, 18 bp, Homo sapiens
taccctggtaggaaagca

SEQ ID NO: 2717330 - DNA, 20 bp, Homo sapiens
taccctgttcccaagcaaag

SEQ ID NO: 2717331 - DNA, 19 bp, Homo sapiens
tacccttcctcatctgtgc

SEQ ID NO: 2717332 - DNA, 21 bp, Homo sapiens
tacccttcctcatctgtgcct

SEQ ID NO: 2717333 - DNA, 12 bp, Homo sapiens
tacccttggttt

SEQ ID NO: 2717334 - DNA, 22 bp, Homo sapiens
tacccttggtttgcacataaaa

SEQ ID NO: 2717335 - DNA, 19 bp, Homo sapiens
taccgcatggcagctgggc

SEQ ID NO: 2717336 - DNA, 14 bp, Homo sapiens
tacctcagcctaga

SEQ ID NO: 2717337 - DNA, 17 bp, Homo sapiens
tacctgattgtattttt

SEQ ID NO: 2717338 - DNA, 17 bp, Homo sapiens
tacctgcctgttctcca

SEQ ID NO: 2717339 - DNA, 19 bp, Homo sapiens
tacctgcctgttctccaga

SEQ ID NO: 2717340 - DNA, 22 bp, Homo sapiens
tacctgcctgttctccagatgg

SEQ ID NO: 2717341 - DNA, 17 bp, Homo sapiens
taccttaatttgactgt

SEQ ID NO: 2717342 - DNA, 16 bp, Homo sapiens
taccttgtctttcaaa

SEQ ID NO: 2717343 - DNA, 14 bp, Homo sapiens
tacgacaacttgca

SEQ ID NO: 2717344 - DNA, 15 bp, Homo sapiens
tacgacaacttgcac

SEQ ID NO: 2717345 - DNA, 14 bp, Homo sapiens
tactaaaatatgca

SEQ ID NO: 2717346 - DNA, 16 bp, Homo sapiens
tactaaaatatgcagg

SEQ ID NO: 2717347 - DNA, 20 bp, Homo sapiens
tactatctttgtctaaacaa

SEQ ID NO: 2717348 - DNA, 16 bp, Homo sapiens
tactcagaagcctgag

SEQ ID NO: 2717349 - DNA, 15 bp, Homo sapiens
tactcagagctgcgg

SEQ ID NO: 2717350 - DNA, 17 bp, Homo sapiens
tactcagagctgcgggc

SEQ ID NO: 2717351 - DNA, 19 bp, Homo sapiens
tactcagagctgcgggctg

SEQ ID NO: 2717352 - DNA, 23 bp, Homo sapiens
tactcagagctgcgggctgaggg

SEQ ID NO: 2717353 - DNA, 16 bp, Homo sapiens
tactctcacctcgtga

SEQ ID NO: 2717354 - DNA, 16 bp, Homo sapiens
tactctcttgccagca

SEQ ID NO: 2717355 - DNA, 16 bp, Homo sapiens
tactgatcttaccttt

SEQ ID NO: 2717356 - DNA, 21 bp, Homo sapiens
tactggcctcgcctggcctga

SEQ ID NO: 2717357 - DNA, 22 bp, Homo sapiens
tactggctctttgtgtgtctcc

SEQ ID NO: 2717358 - DNA, 15 bp, Homo sapiens
tactgtataaacaaa

SEQ ID NO: 2717359 - DNA, 13 bp, Homo sapiens
tacttcccccacc

SEQ ID NO: 2717360 - DNA, 19 bp, Homo sapiens
tacttcccccaccctgggt

SEQ ID NO: 2717361 - DNA, 20 bp, Homo sapiens
tacttcccccaccctgggtt

SEQ ID NO: 2717362 - DNA, 16 bp, Homo sapiens
tacttgatatttcctt

SEQ ID NO: 2717363 - DNA, 13 bp, Homo sapiens
tactttgtgcaaa

SEQ ID NO: 2717364 - DNA, 14 bp, Homo sapiens
tactttgtgctgat

SEQ ID NO: 2717365 - DNA, 16 bp, Homo sapiens
tactttttaaaatgtt

SEQ ID NO: 2717366 - DNA, 21 bp, Homo sapiens
tagaacctcgaggtttctcaa

SEQ ID NO: 2717367 - DNA, 19 bp, Homo sapiens
tagaagatctgcttccctg

SEQ ID NO: 2717368 - DNA, 17 bp, Homo sapiens
tccagccagctcctgca

SEQ ID NO: 2717369 - DNA, 18 bp, Homo sapiens
tccagcctcacagatgct

SEQ ID NO: 2717370 - DNA, 19 bp, Homo sapiens
tccagcctcacagatgctg

SEQ ID NO: 2717371 - DNA, 20 bp, Homo sapiens
tccagcctcacagatgctgg

SEQ ID NO: 2717372 - DNA, 21 bp, Homo sapiens
tccagcctcacagatgctggc

SEQ ID NO: 2717373 - DNA, 17 bp, Homo sapiens
tccagcttcctctgagc

SEQ ID NO: 2717374 - DNA, 18 bp, Homo sapiens
tccagcttcctctgagcc

SEQ ID NO: 2717375 - DNA, 15 bp, Homo sapiens
tccagcttctcttga

SEQ ID NO: 2717376 - DNA, 22 bp, Homo sapiens
tccagggaccactgggtgagag

SEQ ID NO: 2717377 - DNA, 14 bp, Homo sapiens
tccaggggagggaa

SEQ ID NO: 2717378 - DNA, 21 bp, Homo sapiens
tccagtcaagttccctcctgc

SEQ ID NO: 2717379 - DNA, 15 bp, Homo sapiens
tccagtcctgctggc

SEQ ID NO: 2717380 - DNA, 17 bp, Homo sapiens
tccagtcctgctggcct

SEQ ID NO: 2717381 - DNA, 21 bp, Homo sapiens
tccagtcctttgttgctgttg

SEQ ID NO: 2717382 - DNA, 18 bp, Homo sapiens
tccagtgctggctgctgg

SEQ ID NO: 2717383 - DNA, 16 bp, Homo sapiens
tccatcctcctctcca

SEQ ID NO: 2717384 - DNA, 20 bp, Homo sapiens
tccatcctcctctccatgca

SEQ ID NO: 2717385 - DNA, 23 bp, Homo sapiens
tccatcctcctctccatgcaagt

SEQ ID NO: 2717386 - DNA, 17 bp, Homo sapiens
tccatgtgctgctgtgg

SEQ ID NO: 2717387 - DNA, 21 bp, Homo sapiens
tccattattttattttatagt

SEQ ID NO: 2717388 - DNA, 22 bp, Homo sapiens
tccatttctactgtataaacaa

SEQ ID NO: 2717389 - DNA, 19 bp, Homo sapiens
tccatttggcagaactgct

SEQ ID NO: 2717390 - DNA, 21 bp, Homo sapiens
tccatttggcagaactgctgg

SEQ ID NO: 2717391 - DNA, 22 bp, Homo sapiens
tccatttggcagaactgctggg

SEQ ID NO: 2717392 - DNA, 23 bp, Homo sapiens
tccatttggcagaactgctgggg

SEQ ID NO: 2717393 - DNA, 20 bp, Homo sapiens
tcccaaagtgctaggattac

SEQ ID NO: 2717394 - DNA, 20 bp, Homo sapiens
tcccaagtagctgagattac

SEQ ID NO: 2717395 - DNA, 19 bp, Homo sapiens
tcccacaggtggtacagcc

SEQ ID NO: 2717396 - DNA, 19 bp, Homo sapiens
tcccacggggaccactggg

SEQ ID NO: 2717397 - DNA, 15 bp, Homo sapiens
tcccacgtgcacagc

SEQ ID NO: 2717398 - DNA, 22 bp, Homo sapiens
tcccactaagctttctcctttg

SEQ ID NO: 2717399 - DNA, 11 bp, Homo sapiens
tcccactccta

SEQ ID NO: 2717400 - DNA, 20 bp, Homo sapiens
tcccacttcccctcctaccc

SEQ ID NO: 2717401 - DNA, 19 bp, Homo sapiens
tcccagaaggctgggtcca

SEQ ID NO: 2717402 - DNA, 15 bp, Homo sapiens
tcccagacagctgga

SEQ ID NO: 2717403 - DNA, 17 bp, Homo sapiens
tcccagacagctggacc

SEQ ID NO: 2717404 - DNA, 18 bp, Homo sapiens
tcccagacagctggaccc

SEQ ID NO: 2717405 - DNA, 22 bp, Homo sapiens
tcccagcatctcagagtccagt

SEQ ID NO: 2717406 - DNA, 15 bp, Homo sapiens
tcccagcgctggctc

SEQ ID NO: 2717407 - DNA, 23 bp, Homo sapiens
tcccagctactcagaagcctgag

SEQ ID NO: 2717408 - DNA, 20 bp, Homo sapiens
tcccagctgacagtcctctc

SEQ ID NO: 2717409 - DNA, 22 bp, Homo sapiens
tcccagctgacagtcctctcca

SEQ ID NO: 2717410 - DNA, 21 bp, Homo sapiens
tcccagggccagggccctgca

SEQ ID NO: 2717411 - DNA, 22 bp, Homo sapiens
tcccagggccagggccctgcag

SEQ ID NO: 2717412 - DNA, 23 bp, Homo sapiens
tcccagggccagggccctgcaga

SEQ ID NO: 2717413 - DNA, 19 bp, Homo sapiens
tcccaggtaagcaggagga

SEQ ID NO: 2717414 - DNA, 21 bp, Homo sapiens
tcccagtgagaagggcctgct

SEQ ID NO: 2717415 - DNA, 15 bp, Homo sapiens
tcccagtgtcttcct

SEQ ID NO: 2717416 - DNA, 17 bp, Homo sapiens
tcccagtgtcttcctgt

SEQ ID NO: 2717417 - DNA, 19 bp, Homo sapiens
tcccagtgtcttcctgtgg

SEQ ID NO: 2717418 - DNA, 17 bp, Homo sapiens
tcccatctaagctgcag

SEQ ID NO: 2717419 - DNA, 20 bp, Homo sapiens
tcccatctaagctgcagctt

SEQ ID NO: 2717420 - DNA, 13 bp, Homo sapiens
tcccatggccttc

SEQ ID NO: 2717421 - DNA, 17 bp, Homo sapiens
tcccatttcgtgtaata

SEQ ID NO: 2717422 - DNA, 14 bp, Homo sapiens
tcccattttagaaa

SEQ ID NO: 2717423 - DNA, 20 bp, Homo sapiens
tccccaatccatttggcaga

SEQ ID NO: 2717424 - DNA, 23 bp, Homo sapiens
tccccaatccatttggcagaact

SEQ ID NO: 2717425 - DNA, 14 bp, Homo sapiens
tccccaccagagct

SEQ ID NO: 2717426 - DNA, 17 bp, Homo sapiens
tccccaccagagctgcc

SEQ ID NO: 2717427 - DNA, 20 bp, Homo sapiens
tccccaccagagctgcctcc

SEQ ID NO: 2717428 - DNA, 21 bp, Homo sapiens
tccccaccagagctgcctccc

SEQ ID NO: 2717429 - DNA, 20 bp, Homo sapiens
tccccaccttcaattcctgg

SEQ ID NO: 2717430 - DNA, 22 bp, Homo sapiens
tccccaccttcaattcctgggc

SEQ ID NO: 2717431 - DNA, 17 bp, Homo sapiens
tccccagtgctcctgtg

SEQ ID NO: 2717432 - DNA, 19 bp, Homo sapiens
tccccattagagtcagcct

SEQ ID NO: 2717433 - DNA, 17 bp, Homo sapiens
tcccccacgtctctctg

SEQ ID NO: 2717434 - DNA, 19 bp, Homo sapiens
tcccccacgtctctctgcc

SEQ ID NO: 2717435 - DNA, 14 bp, Homo sapiens
tcccccccggggct

SEQ ID NO: 2717436 - DNA, 18 bp, Homo sapiens
tcccccccggggctgggt

SEQ ID NO: 2717437 - DNA, 12 bp, Homo sapiens
tcccccctcacc

SEQ ID NO: 2717438 - DNA, 21 bp, Homo sapiens
tccccctaccgcatggcagct

SEQ ID NO: 2717439 - DNA, 18 bp, Homo sapiens
tccccctcccagggccag

SEQ ID NO: 2717440 - DNA, 12 bp, Homo sapiens
tccccctgggct

SEQ ID NO: 2717441 - DNA, 23 bp, Homo sapiens
tccccctgggctctgccccagct

SEQ ID NO: 2717442 - DNA, 19 bp, Homo sapiens
tccccgaaaacccccagca

SEQ ID NO: 2717443 - DNA, 19 bp, Homo sapiens
tccccggccacgtctgtgc

SEQ ID NO: 2717444 - DNA, 17 bp, Homo sapiens
tcccctcacagactctt

SEQ ID NO: 2717445 - DNA, 22 bp, Homo sapiens
tcccctcacagactcttccacc

SEQ ID NO: 2717446 - DNA, 17 bp, Homo sapiens
tcccctcctacccctcc

SEQ ID NO: 2717447 - DNA, 19 bp, Homo sapiens
tcccctcctacccctccca

SEQ ID NO: 2717448 - DNA, 22 bp, Homo sapiens
tcccctcctacccctcccagct

SEQ ID NO: 2717449 - DNA, 18 bp, Homo sapiens
tcccctcctttaccccac

SEQ ID NO: 2717450 - DNA, 15 bp, Homo sapiens
tcccctcttgcccca

SEQ ID NO: 2717451 - DNA, 21 bp, Homo sapiens
tcccctgaggctggcatcctg

SEQ ID NO: 2717452 - DNA, 15 bp, Homo sapiens
tcccctgtcccctgg

SEQ ID NO: 2717453 - DNA, 20 bp, Homo sapiens
tcccctgtcccctggggctg

SEQ ID NO: 2717454 - DNA, 15 bp, Homo sapiens
tccccttgcccttcc

SEQ ID NO: 2717455 - DNA, 18 bp, Homo sapiens
tccccttgcccttcctga

SEQ ID NO: 2717456 - DNA, 20 bp, Homo sapiens
tccccttgcccttcctgacc

SEQ ID NO: 2717457 - DNA, 15 bp, Homo sapiens
tccccttgtccctgg

SEQ ID NO: 2717458 - DNA, 16 bp, Homo sapiens
tccccttgtccctggg

SEQ ID NO: 2717459 - DNA, 19 bp, Homo sapiens
tcccgaggatgctgtcagg

SEQ ID NO: 2717460 - DNA, 16 bp, Homo sapiens
tcccggttcaccttgc

SEQ ID NO: 2717461 - DNA, 20 bp, Homo sapiens
tcccgtgaaaacactcgtgt

SEQ ID NO: 2717462 - DNA, 12 bp, Homo sapiens
tcccgtggcccc

SEQ ID NO: 2717463 - DNA, 22 bp, Homo sapiens
tcccgtggccccagcctggccc

SEQ ID NO: 2717464 - DNA, 15 bp, Homo sapiens
tccctacccactctt

SEQ ID NO: 2717465 - DNA, 15 bp, Homo sapiens
tccctcctcacactc

SEQ ID NO: 2717466 - DNA, 18 bp, Homo sapiens
tccctcctcacactccag

SEQ ID NO: 2717467 - DNA, 13 bp, Homo sapiens
tccctcctggagc

SEQ ID NO: 2717468 - DNA, 18 bp, Homo sapiens
tccctcctggagcatccc

SEQ ID NO: 2717469 - DNA, 23 bp, Homo sapiens
tccctctcggaaggctggctggg

SEQ ID NO: 2717470 - DNA, 12 bp, Homo sapiens
tccctctgcctc

SEQ ID NO: 2717471 - DNA, 15 bp, Homo sapiens
tccctctgcctcatc

SEQ ID NO: 2717472 - DNA, 17 bp, Homo sapiens
tccctctgcctcatcct

SEQ ID NO: 2717473 - DNA, 16 bp, Homo sapiens
tccctgacactgcggg

SEQ ID NO: 2717474 - DNA, 22 bp, Homo sapiens
tccctgacactgcggggcttgg

SEQ ID NO: 2717475 - DNA, 15 bp, Homo sapiens
tccctgaccttctcc

SEQ ID NO: 2717476 - DNA, 16 bp, Homo sapiens
tccctgaccttctcca

SEQ ID NO: 2717477 - DNA, 23 bp, Homo sapiens
  misc_feature (14)..(14): n is a, c, g or t
tccctgcacctgcnttgtccctg

SEQ ID NO: 2717478 - DNA, 22 bp, Homo sapiens
tccctgcttttctcccagaagg

SEQ ID NO: 2717479 - DNA, 20 bp, Homo sapiens
tccctgggcctcagcctcca

SEQ ID NO: 2717480 - DNA, 15 bp, Homo sapiens
tccctggggcactcc

SEQ ID NO: 2717481 - DNA, 18 bp, Homo sapiens
tccctggggcactccccc

SEQ ID NO: 2717482 - DNA, 19 bp, Homo sapiens
tccctggggcactccccca

SEQ ID NO: 2717483 - DNA, 22 bp, Homo sapiens
tccctggggcactcccccagga

SEQ ID NO: 2717484 - DNA, 19 bp, Homo sapiens
tccctggtcccttggagac

SEQ ID NO: 2717485 - DNA, 13 bp, Homo sapiens
tccctgtgttctg

SEQ ID NO: 2717486 - DNA, 18 bp, Homo sapiens
tcccttgccttcctgcct

SEQ ID NO: 2717487 - DNA, 13 bp, Homo sapiens
tcccttgtgtgtg

SEQ ID NO: 2717488 - DNA, 15 bp, Homo sapiens
tcccttgtgtgtgtg

SEQ ID NO: 2717489 - DNA, 20 bp, Homo sapiens
tccgcctagaggtcccctca

SEQ ID NO: 2717490 - DNA, 21 bp, Homo sapiens
tgcaaaaacatatgtctgtct

SEQ ID NO: 2717491 - DNA, 23 bp, Homo sapiens
tgcaacatggattccaaagcatt

SEQ ID NO: 2717492 - DNA, 23 bp, Homo sapiens
tgcaaccctggtgtgctgggcga

SEQ ID NO: 2717493 - DNA, 16 bp, Homo sapiens
tgcaactgaatacttg

SEQ ID NO: 2717494 - DNA, 14 bp, Homo sapiens
tgcaagctctgcct

SEQ ID NO: 2717495 - DNA, 17 bp, Homo sapiens
tgcaagctctgcctccc

SEQ ID NO: 2717496 - DNA, 17 bp, Homo sapiens
tgcaaggggaaacctgt

SEQ ID NO: 2717497 - DNA, 20 bp, Homo sapiens
tgcaagtgggagatgaaaac

SEQ ID NO: 2717498 - DNA, 21 bp, Homo sapiens
tgcaagtgggagatgaaaacc

SEQ ID NO: 2717499 - DNA, 14 bp, Homo sapiens
tgcaatagtcagag

SEQ ID NO: 2717500 - DNA, 23 bp, Homo sapiens
tgcaatttcaggaatttaattta

SEQ ID NO: 2717501 - DNA, 20 bp, Homo sapiens
tgcaattttaattgattatt

SEQ ID NO: 2717502 - DNA, 10 bp, Homo sapiens
tgcacagagg

SEQ ID NO: 2717503 - DNA, 12 bp, Homo sapiens
tgcacagagggc

SEQ ID NO: 2717504 - DNA, 15 bp, Homo sapiens
tgcacagcttcctga

SEQ ID NO: 2717505 - DNA, 22 bp, Homo sapiens
tgcacagtaatatgaaagccac

SEQ ID NO: 2717506 - DNA, 19 bp, Homo sapiens
tgcacagttggcccgggtg

SEQ ID NO: 2717507 - DNA, 19 bp, Homo sapiens
tgcacattggaagctccca

SEQ ID NO: 2717508 - DNA, 19 bp, Homo sapiens
tgcacattttgtacaaaga

SEQ ID NO: 2717509 - DNA, 13 bp, Homo sapiens
tgcaccaaagaca

SEQ ID NO: 2717510 - DNA, 15 bp, Homo sapiens
tgcaccaacccagcc

SEQ ID NO: 2717511 - DNA, 19 bp, Homo sapiens
tgcaccaacccagccgctg

SEQ ID NO: 2717512 - DNA, 22 bp, Homo sapiens
tgcaccaacccagccgctgccc

SEQ ID NO: 2717513 - DNA, 18 bp, Homo sapiens
tgcaccccctcctgctgc

SEQ ID NO: 2717514 - DNA, 19 bp, Homo sapiens
tgcacctatggcccagcca

SEQ ID NO: 2717515 - DNA, 16 bp, Homo sapiens
tgcacctgtactcagg

SEQ ID NO: 2717516 - DNA, 20 bp, Homo sapiens
tgcacgtcaccctcctgagc

SEQ ID NO: 2717517 - DNA, 16 bp, Homo sapiens
tgcacgttaacagcgt

SEQ ID NO: 2717518 - DNA, 12 bp, Homo sapiens
tgcactccagcc

SEQ ID NO: 2717519 - DNA, 13 bp, Homo sapiens
tgcactctgtgcc

SEQ ID NO: 2717520 - DNA, 21 bp, Homo sapiens
tgcactctgtgcccatgggca

SEQ ID NO: 2717521 - DNA, 12 bp, Homo sapiens
tgcactgtcctg

SEQ ID NO: 2717522 - DNA, 16 bp, Homo sapiens
tgcactgtcctgctcc

SEQ ID NO: 2717523 - DNA, 17 bp, Homo sapiens
tgcactgtcctgctcca

SEQ ID NO: 2717524 - DNA, 16 bp, Homo sapiens
tgcagaggaggagaaa

SEQ ID NO: 2717525 - DNA, 21 bp, Homo sapiens
tgcagaggaggagaaaagtga

SEQ ID NO: 2717526 - DNA, 15 bp, Homo sapiens
tgcagaggggcaggc

SEQ ID NO: 2717527 - DNA, 17 bp, Homo sapiens
tgcagaggggcaggccc

SEQ ID NO: 2717528 - DNA, 20 bp, Homo sapiens
tgcagaggggctttctggag

SEQ ID NO: 2717529 - DNA, 20 bp, Homo sapiens
tgcagaggtgagcagaggag

SEQ ID NO: 2717530 - DNA, 23 bp, Homo sapiens
tgcagatagtgcctctgcaaact

SEQ ID NO: 2717531 - DNA, 14 bp, Homo sapiens
tgcagcaatattct

SEQ ID NO: 2717532 - DNA, 16 bp, Homo sapiens
tgcagcacaggaggct

SEQ ID NO: 2717533 - DNA, 22 bp, Homo sapiens
tgcagccacgaacacgcatgcc

SEQ ID NO: 2717534 - DNA, 15 bp, Homo sapiens
tgcagccttaaacag

SEQ ID NO: 2717535 - DNA, 21 bp, Homo sapiens
tgcagccttaaacagtgtcca

SEQ ID NO: 2717536 - DNA, 22 bp, Homo sapiens
tgcagcctttcacaggactctg

SEQ ID NO: 2717537 - DNA, 11 bp, Homo sapiens
tgcagcttcct

SEQ ID NO: 2717538 - DNA, 23 bp, Homo sapiens
tgcaggcaacattaccttgtctt

SEQ ID NO: 2717539 - DNA, 21 bp, Homo sapiens
tgcaggccaagagcagaggca

SEQ ID NO: 2717540 - DNA, 14 bp, Homo sapiens
tgcaggcccagcag

SEQ ID NO: 2717541 - DNA, 14 bp, Homo sapiens
tgcagggagccgag

SEQ ID NO: 2717542 - DNA, 24 bp, Homo sapiens
tgcagggataggaagtgccccagg

SEQ ID NO: 2717543 - DNA, 16 bp, Homo sapiens
tgcaggggactgggcc

SEQ ID NO: 2717544 - DNA, 17 bp, Homo sapiens
tgcaggggactgggcca

SEQ ID NO: 2717545 - DNA, 22 bp, Homo sapiens
tgcagtgacgtgcacctgtact

SEQ ID NO: 2717546 - DNA, 14 bp, Homo sapiens
tgcagttttccagg

SEQ ID NO: 2717547 - DNA, 20 bp, Homo sapiens
tgcatcagctttttgtatta

SEQ ID NO: 2717548 - DNA, 15 bp, Homo sapiens
tgcatgcaggtctcc

SEQ ID NO: 2717549 - DNA, 18 bp, Homo sapiens
tgcatggaaatgtcctcc

SEQ ID NO: 2717550 - DNA, 21 bp, Homo sapiens
tgcatgtaaaatcttcagctg

SEQ ID NO: 2717551 - DNA, 21 bp, Homo sapiens
tgcattcacagcgcctcctgg

SEQ ID NO: 2717552 - DNA, 19 bp, Homo sapiens
tgcattgaatttagtcatt

SEQ ID NO: 2717553 - DNA, 19 bp, Homo sapiens
tgccacaccaagctgtgcc

SEQ ID NO: 2717554 - DNA, 14 bp, Homo sapiens
tgccaccctgggct

SEQ ID NO: 2717555 - DNA, 18 bp, Homo sapiens
tgccaccctgggctctgt

SEQ ID NO: 2717556 - DNA, 19 bp, Homo sapiens
tgccaccctgggctctgtg

SEQ ID NO: 2717557 - DNA, 21 bp, Homo sapiens
tgccaccctgggctctgtggg

SEQ ID NO: 2717558 - DNA, 22 bp, Homo sapiens
tgccaccctgggctctgtgggc

SEQ ID NO: 2717559 - DNA, 15 bp, Homo sapiens
tgccactctgctgcc

SEQ ID NO: 2717560 - DNA, 11 bp, Homo sapiens
tgccagccaca

SEQ ID NO: 2717561 - DNA, 17 bp, Homo sapiens
tgccagcctggcttctg

SEQ ID NO: 2717562 - DNA, 18 bp, Homo sapiens
tgccagcctggcttctgg

SEQ ID NO: 2717563 - DNA, 20 bp, Homo sapiens
tgccagcctggcttctggag

SEQ ID NO: 2717564 - DNA, 12 bp, Homo sapiens
tgccagctctgt

SEQ ID NO: 2717565 - DNA, 20 bp, Homo sapiens
tgccaggctagagtgcagtg

SEQ ID NO: 2717566 - DNA, 16 bp, Homo sapiens
tgccaggctgtaagca

SEQ ID NO: 2717567 - DNA, 21 bp, Homo sapiens
tgccaggctgtaagcattctg

SEQ ID NO: 2717568 - DNA, 23 bp, Homo sapiens
tgccagtcgcgctgcctgtgtgg

SEQ ID NO: 2717569 - DNA, 12 bp, Homo sapiens
tgccattcccac

SEQ ID NO: 2717570 - DNA, 16 bp, Homo sapiens
tgccatttgcaccctc

SEQ ID NO: 2717571 - DNA, 14 bp, Homo sapiens
tgcccaatccaggc

SEQ ID NO: 2717572 - DNA, 11 bp, Homo sapiens
tgcccacacac

SEQ ID NO: 2717573 - DNA, 19 bp, Homo sapiens
tgcccacacacactccttc

SEQ ID NO: 2717574 - DNA, 21 bp, Homo sapiens
tgcccacacacactccttccc

SEQ ID NO: 2717575 - DNA, 11 bp, Homo sapiens
tgcccactgcc

SEQ ID NO: 2717576 - DNA, 14 bp, Homo sapiens
tgcccactgccgat

SEQ ID NO: 2717577 - DNA, 17 bp, Homo sapiens
tgcccactgtctctcct

SEQ ID NO: 2717578 - DNA, 17 bp, Homo sapiens
tgcccagaagaactttg

SEQ ID NO: 2717579 - DNA, 20 bp, Homo sapiens
tgcccagagggcccaggcag

SEQ ID NO: 2717580 - DNA, 21 bp, Homo sapiens
tgcccagagggcccaggcagg

SEQ ID NO: 2717581 - DNA, 16 bp, Homo sapiens
tgcccagcctgcccca

SEQ ID NO: 2717582 - DNA, 21 bp, Homo sapiens
tgcccaggacggggccggcca

SEQ ID NO: 2717583 - DNA, 13 bp, Homo sapiens
tgcccaggctgga

SEQ ID NO: 2717584 - DNA, 17 bp, Homo sapiens
tgcccagggtcagtgta

SEQ ID NO: 2717585 - DNA, 21 bp, Homo sapiens
tgcccagggtcagtgtatcta

SEQ ID NO: 2717586 - DNA, 17 bp, Homo sapiens
tgcccatgggcactgct

SEQ ID NO: 2717587 - DNA, 14 bp, Homo sapiens
tgccccagcctccc

SEQ ID NO: 2717588 - DNA, 13 bp, Homo sapiens
tgccccagctctg

SEQ ID NO: 2717589 - DNA, 19 bp, Homo sapiens
tgccccagctctggcttcc

SEQ ID NO: 2717590 - DNA, 13 bp, Homo sapiens
tgccccccatcct

SEQ ID NO: 2717591 - DNA, 19 bp, Homo sapiens
tgccccccatcctggccca

SEQ ID NO: 2717592 - DNA, 20 bp, Homo sapiens
tgccccccatcctggcccat

SEQ ID NO: 2717593 - DNA, 23 bp, Homo sapiens
tgccccccatcctggcccatcag

SEQ ID NO: 2717594 - DNA, 15 bp, Homo sapiens
tgccccctcgtgcca

SEQ ID NO: 2717595 - DNA, 18 bp, Homo sapiens
tgccccctcgtgccagtc

SEQ ID NO: 2717596 - DNA, 22 bp, Homo sapiens
tgccccctggtggacagtcctg

SEQ ID NO: 2717597 - DNA, 18 bp, Homo sapiens
tgccccttgtcctctcag

SEQ ID NO: 2717598 - DNA, 19 bp, Homo sapiens
tgcccgcagagcccacgcc

SEQ ID NO: 2717599 - DNA, 13 bp, Homo sapiens
tgcccgctcccag

SEQ ID NO: 2717600 - DNA, 15 bp, Homo sapiens
tgcccgctcccagtg

SEQ ID NO: 2717601 - DNA, 16 bp, Homo sapiens
tgcccggattctggga

SEQ ID NO: 2717602 - DNA, 16 bp, Homo sapiens
tgcccggcgccctctg

SEQ ID NO: 2717603 - DNA, 21 bp, Homo sapiens
tgcccggcgccctctgtcctg

SEQ ID NO: 2717604 - DNA, 18 bp, Homo sapiens
tgccctctggacagcttg

SEQ ID NO: 2717605 - DNA, 23 bp, Homo sapiens
tgccgagagaggcgcgtctgccc

SEQ ID NO: 2717606 - DNA, 15 bp, Homo sapiens
tgccgccgcctcgcc

SEQ ID NO: 2717607 - DNA, 19 bp, Homo sapiens
tgccgccgtctctgtcccg

SEQ ID NO: 2717608 - DNA, 12 bp, Homo sapiens
tgccgcctcccg

SEQ ID NO: 2717609 - DNA, 13 bp, Homo sapiens
tgccgcctcccgg

SEQ ID NO: 2717610 - DNA, 16 bp, Homo sapiens
tgccggtaccagcctg

SEQ ID NO: 2717611 - DNA, 15 bp, Homo sapiens
tgccgtccctcctgt

SEQ ID NO: 2717612 - DNA, 22 bp, Homo sapiens
tgcctagctcttgggcctgacc

SEQ ID NO: 2717613 - DNA, 23 bp, Homo sapiens
tgcctagctcttgggcctgacct

SEQ ID NO: 2717614 - DNA, 20 bp, Homo sapiens
tgtgcatggaaatgtcctcc

SEQ ID NO: 2717615 - DNA, 17 bp, Homo sapiens
tgtgccaccctgggctc

SEQ ID NO: 2717616 - DNA, 21 bp, Homo sapiens
tgtgcccaccagcggccttga

SEQ ID NO: 2717617 - DNA, 19 bp, Homo sapiens
tgtgcccatgggcactgct

SEQ ID NO: 2717618 - DNA, 16 bp, Homo sapiens
tgtgccccccatcctg

SEQ ID NO: 2717619 - DNA, 21 bp, Homo sapiens
tgtgccccccatcctggccca

SEQ ID NO: 2717620 - DNA, 23 bp, Homo sapiens
tgtgccccccatcctggcccatc

SEQ ID NO: 2717621 - DNA, 21 bp, Homo sapiens
tgtgccgtgaactgcgtgcca

SEQ ID NO: 2717622 - DNA, 12 bp, Homo sapiens
tgtgcctgcagc

SEQ ID NO: 2717623 - DNA, 19 bp, Homo sapiens
tgtgctcagcagccccacc

SEQ ID NO: 2717624 - DNA, 11 bp, Homo sapiens
tgtgctcccac

SEQ ID NO: 2717625 - DNA, 13 bp, Homo sapiens
tgtgctcccacgg

SEQ ID NO: 2717626 - DNA, 15 bp, Homo sapiens
tgtgctctcggcttc

SEQ ID NO: 2717627 - DNA, 18 bp, Homo sapiens
tgtgctgctgtggcatca

SEQ ID NO: 2717628 - DNA, 15 bp, Homo sapiens
tgtggaaagcctctg

SEQ ID NO: 2717629 - DNA, 16 bp, Homo sapiens
tgtggactctctgcct

SEQ ID NO: 2717630 - DNA, 20 bp, Homo sapiens
tgtggatgttcagaattttg

SEQ ID NO: 2717631 - DNA, 17 bp, Homo sapiens
tgtggcatcaggaaagg

SEQ ID NO: 2717632 - DNA, 17 bp, Homo sapiens
tgtggccaaggctgaga

SEQ ID NO: 2717633 - DNA, 17 bp, Homo sapiens
tgtgggaaaaaagaaat

SEQ ID NO: 2717634 - DNA, 13 bp, Homo sapiens
tgtgggctgcact

SEQ ID NO: 2717635 - DNA, 22 bp, Homo sapiens
tgtgggctgcactctgtgccca

SEQ ID NO: 2717636 - DNA, 12 bp, Homo sapiens
tgtggggccttg

SEQ ID NO: 2717637 - DNA, 15 bp, Homo sapiens
tgtgtaccacaccct

SEQ ID NO: 2717638 - DNA, 18 bp, Homo sapiens
tgtgtaccacaccctgcc

SEQ ID NO: 2717639 - DNA, 19 bp, Homo sapiens
tgtgtaccacaccctgcct

SEQ ID NO: 2717640 - DNA, 20 bp, Homo sapiens
tgtgtaccacaccctgcctg

SEQ ID NO: 2717641 - DNA, 23 bp, Homo sapiens
tgtgtaccacaccctgcctgctg

SEQ ID NO: 2717642 - DNA, 21 bp, Homo sapiens
tgtgtatgagaagtactttgt

SEQ ID NO: 2717643 - DNA, 14 bp, Homo sapiens
tgtgtcctctccag

SEQ ID NO: 2717644 - DNA, 21 bp, Homo sapiens
tgtgtgtaccacaccctgcct

SEQ ID NO: 2717645 - DNA, 12 bp, Homo sapiens
tgtgtgtctcac

SEQ ID NO: 2717646 - DNA, 16 bp, Homo sapiens
tgtgtgtctcacccct

SEQ ID NO: 2717647 - DNA, 22 bp, Homo sapiens
tgtgtgttgatcccaagacaat

SEQ ID NO: 2717648 - DNA, 23 bp, Homo sapiens
tgtgttgcataaacaatccaaat

SEQ ID NO: 2717649 - DNA, 22 bp, Homo sapiens
tgtgttggctttacaaataatt

SEQ ID NO: 2717650 - DNA, 12 bp, Homo sapiens
tgtgttgtgtta

SEQ ID NO: 2717651 - DNA, 20 bp, Homo sapiens
tgttacttccctccaagagg

SEQ ID NO: 2717652 - DNA, 21 bp, Homo sapiens
tgttagagaggtagcgagctg

SEQ ID NO: 2717653 - DNA, 20 bp, Homo sapiens
tgttaggcctggcacagtgt

SEQ ID NO: 2717654 - DNA, 18 bp, Homo sapiens
tgttattaaaaaaacaca

SEQ ID NO: 2717655 - DNA, 20 bp, Homo sapiens
tgttattaaaaaaacacaaa

SEQ ID NO: 2717656 - DNA, 16 bp, Homo sapiens
tgttattcttttccag

SEQ ID NO: 2717657 - DNA, 14 bp, Homo sapiens
tgttattggaattt

SEQ ID NO: 2717658 - DNA, 16 bp, Homo sapiens
tgttattggaattttc

SEQ ID NO: 2717659 - DNA, 23 bp, Homo sapiens
tgttattggaattttctttcata

SEQ ID NO: 2717660 - DNA, 13 bp, Homo sapiens
tgttcacactcct

SEQ ID NO: 2717661 - DNA, 19 bp, Homo sapiens
tgttcagaattttggaaaa

SEQ ID NO: 2717662 - DNA, 15 bp, Homo sapiens
tgttccccagctgat

SEQ ID NO: 2717663 - DNA, 16 bp, Homo sapiens
tgttctacttgatatt

SEQ ID NO: 2717664 - DNA, 21 bp, Homo sapiens
tgttctgtccagtttccaaag

SEQ ID NO: 2717665 - DNA, 17 bp, Homo sapiens
tgttgagtctctgaaca

SEQ ID NO: 2717666 - DNA, 17 bp, Homo sapiens
tgttgatttgagaaatt

SEQ ID NO: 2717667 - DNA, 16 bp, Homo sapiens
tgttgcactgaaaacc

SEQ ID NO: 2717668 - DNA, 16 bp, Homo sapiens
tgttgctgttgctgtt

SEQ ID NO: 2717669 - DNA, 20 bp, Homo sapiens
tgttggcgagaggaggggcc

SEQ ID NO: 2717670 - DNA, 17 bp, Homo sapiens
tgttggctttacaaata

SEQ ID NO: 2717671 - DNA, 22 bp, Homo sapiens
tgttgggtcctctgcttcctga

SEQ ID NO: 2717672 - DNA, 21 bp, Homo sapiens
tgttggtgcaattaactctgg

SEQ ID NO: 2717673 - DNA, 14 bp, Homo sapiens
tgttgtcatgtgta

SEQ ID NO: 2717674 - DNA, 16 bp, Homo sapiens
tgttgtcatgtgtatg

SEQ ID NO: 2717675 - DNA, 13 bp, Homo sapiens
tgttgtgaatgtc

SEQ ID NO: 2717676 - DNA, 20 bp, Homo sapiens
tgtttccattttaaggatat

SEQ ID NO: 2717677 - DNA, 16 bp, Homo sapiens
tgtttctccccctggg

SEQ ID NO: 2717678 - DNA, 22 bp, Homo sapiens
tgtttctcggcaccagtgcctc

SEQ ID NO: 2717679 - DNA, 18 bp, Homo sapiens
tgtttgcacagagggcgc

SEQ ID NO: 2717680 - DNA, 15 bp, Homo sapiens
tgtttgttcacactc

SEQ ID NO: 2717681 - DNA, 19 bp, Homo sapiens
tgttttaaaagtttgtcct

SEQ ID NO: 2717682 - DNA, 21 bp, Homo sapiens
tgttttaaagtcagatttgta

SEQ ID NO: 2717683 - DNA, 16 bp, Homo sapiens
tgttttagaaccagcc

SEQ ID NO: 2717684 - DNA, 23 bp, Homo sapiens
tgttttcccgagcaaagtctaaa

SEQ ID NO: 2717685 - DNA, 18 bp, Homo sapiens
tgttttcttcatttctct

SEQ ID NO: 2717686 - DNA, 16 bp, Homo sapiens
tgttttgttgtttgat

SEQ ID NO: 2717687 - DNA, 12 bp, Homo sapiens
tgttttttaagt

SEQ ID NO: 2717688 - DNA, 14 bp, Homo sapiens
ttaaaaatcttggt

SEQ ID NO: 2717689 - DNA, 18 bp, Homo sapiens
ttaaaatagcacatgatt

SEQ ID NO: 2717690 - DNA, 16 bp, Homo sapiens
ttaaaatgaagcaatt

SEQ ID NO: 2717691 - DNA, 19 bp, Homo sapiens
ttaaaatgaagcaatttat

SEQ ID NO: 2717692 - DNA, 14 bp, Homo sapiens
ttaaacatgcagaa

SEQ ID NO: 2717693 - DNA, 15 bp, Homo sapiens
ttaaacatgcagaag

SEQ ID NO: 2717694 - DNA, 21 bp, Homo sapiens
ttaaagagaaaaatggcctgc

SEQ ID NO: 2717695 - DNA, 16 bp, Homo sapiens
ttaaagcacatgccag

SEQ ID NO: 2717696 - DNA, 16 bp, Homo sapiens
ttaaaggacaaacagt

SEQ ID NO: 2717697 - DNA, 17 bp, Homo sapiens
ttaaaggacaaacagtg

SEQ ID NO: 2717698 - DNA, 20 bp, Homo sapiens
ttaaaggacaaacagtgaat

SEQ ID NO: 2717699 - DNA, 18 bp, Homo sapiens
ttaaagtatgttattgca

SEQ ID NO: 2717700 - DNA, 23 bp, Homo sapiens
ttaaagtatgttattgcataatt

SEQ ID NO: 2717701 - DNA, 16 bp, Homo sapiens
ttaaataaaagcacaa

SEQ ID NO: 2717702 - DNA, 22 bp, Homo sapiens
ttaaatgagaaaggatttcctt

SEQ ID NO: 2717703 - DNA, 14 bp, Homo sapiens
ttaaattctctcta

SEQ ID NO: 2717704 - DNA, 23 bp, Homo sapiens
ttaaattctctctaacataacaa

SEQ ID NO: 2717705 - DNA, 17 bp, Homo sapiens
ttaaattgttataactt

SEQ ID NO: 2717706 - DNA, 21 bp, Homo sapiens
ttaacaaagttactggctctt

SEQ ID NO: 2717707 - DNA, 19 bp, Homo sapiens
ttaacagcgtgtcaacttt

SEQ ID NO: 2717708 - DNA, 18 bp, Homo sapiens
ttaacaggttttcttcta

SEQ ID NO: 2717709 - DNA, 22 bp, Homo sapiens
ttaacttgagggtaataaactt

SEQ ID NO: 2717710 - DNA, 18 bp, Homo sapiens
ttaagaaaaaaagcaaaa

SEQ ID NO: 2717711 - DNA, 16 bp, Homo sapiens
ttaagaaagggaaagc

SEQ ID NO: 2717712 - DNA, 20 bp, Homo sapiens
ttaagaaagggaaagctgtg

SEQ ID NO: 2717713 - DNA, 17 bp, Homo sapiens
ttaagaatagtctctgg

SEQ ID NO: 2717714 - DNA, 22 bp, Homo sapiens
ttaagccaatatttactcatca

SEQ ID NO: 2717715 - DNA, 23 bp, Homo sapiens
ttaaggagatagacgggttgaaa

SEQ ID NO: 2717716 - DNA, 16 bp, Homo sapiens
ttaagtactatctttg

SEQ ID NO: 2717717 - DNA, 18 bp, Homo sapiens
ttaatatctgatactgta

SEQ ID NO: 2717718 - DNA, 17 bp, Homo sapiens
ttaatcttccattcctt

SEQ ID NO: 2717719 - DNA, 17 bp, Homo sapiens
ttaatgatttttgtgta

SEQ ID NO: 2717720 - DNA, 15 bp, Homo sapiens
ttaattatcttttct

SEQ ID NO: 2717721 - DNA, 19 bp, Homo sapiens
ttaattcattaatctgttt

SEQ ID NO: 2717722 - DNA, 22 bp, Homo sapiens
ttaattgattattctgattcca

SEQ ID NO: 2717723 - DNA, 14 bp, Homo sapiens
ttacacattatgtt

SEQ ID NO: 2717724 - DNA, 15 bp, Homo sapiens
ttacagatcatataa

SEQ ID NO: 2717725 - DNA, 13 bp, Homo sapiens
ttacagtaaataa

SEQ ID NO: 2717726 - DNA, 16 bp, Homo sapiens
ttacagtaaataaatt

SEQ ID NO: 2717727 - DNA, 17 bp, Homo sapiens
ttacagtaaataaattg

SEQ ID NO: 2717728 - DNA, 20 bp, Homo sapiens
ttacagtctctgttgtaaat

SEQ ID NO: 2717729 - DNA, 14 bp, Homo sapiens
ttacagtgtattta

SEQ ID NO: 2717730 - DNA, 17 bp, Homo sapiens
ttacagtgtatttaaga

SEQ ID NO: 2717731 - DNA, 14 bp, Homo sapiens
ttacattgcagaac

SEQ ID NO: 2717732 - DNA, 20 bp, Homo sapiens
ttaccaaagcatcaatacaa

SEQ ID NO: 2717733 - DNA, 19 bp, Homo sapiens
ttaccattattttacagtc

SEQ ID NO: 2717734 - DNA, 23 bp, Homo sapiens
ttacccttcctcatctgtgcctg

SEQ ID NO: 2717735 - DNA, 14 bp, Homo sapiens
ttaccttgtctttc

SEQ ID NO: 2717736 - DNA, 14 bp, Homo sapiens
ttactcagagctgc

SEQ ID NO: 2717737 - DNA, 13 bp, Homo sapiens
tttgcacataaaa

SEQ ID NO: 2717738 - DNA, 14 bp, Homo sapiens
tttgcaccaaagac

SEQ ID NO: 2717739 - DNA, 19 bp, Homo sapiens
tttgcaggggactgggcca

SEQ ID NO: 2717740 - DNA, 20 bp, Homo sapiens
tttgcaggggactgggccat

SEQ ID NO: 2717741 - DNA, 17 bp, Homo sapiens
tttgcagtcttttgctg

SEQ ID NO: 2717742 - DNA, 15 bp, Homo sapiens
tttgcgcaaacttta

SEQ ID NO: 2717743 - DNA, 23 bp, Homo sapiens
tttgctcacacggggtattttag

SEQ ID NO: 2717744 - DNA, 15 bp, Homo sapiens
tttgctgctgtggaa

SEQ ID NO: 2717745 - DNA, 21 bp, Homo sapiens
tttgctgctgtggaaaggatt

SEQ ID NO: 2717746 - DNA, 23 bp, Homo sapiens
tttgctgtgctgtacattactgt

SEQ ID NO: 2717747 - DNA, 21 bp, Homo sapiens
tttggaaaaatgtcactgaag

SEQ ID NO: 2717748 - DNA, 16 bp, Homo sapiens
tttggacgtgtgagga

SEQ ID NO: 2717749 - DNA, 17 bp, Homo sapiens
tttggagaaaaattaca

SEQ ID NO: 2717750 - DNA, 19 bp, Homo sapiens
tttggagaaaaattacaga

SEQ ID NO: 2717751 - DNA, 20 bp, Homo sapiens
tttggagccgggaaagctgt

SEQ ID NO: 2717752 - DNA, 16 bp, Homo sapiens
tttggagggatcattt

SEQ ID NO: 2717753 - DNA, 17 bp, Homo sapiens
tttggcagaactgctgg

SEQ ID NO: 2717754 - DNA, 17 bp, Homo sapiens
tttggcttcagaattgt

SEQ ID NO: 2717755 - DNA, 23 bp, Homo sapiens
tttgggcaggagtcaccatgcaa

SEQ ID NO: 2717756 - DNA, 14 bp, Homo sapiens
tttgggctaacatt

SEQ ID NO: 2717757 - DNA, 12 bp, Homo sapiens
tttgtaattatt

SEQ ID NO: 2717758 - DNA, 12 bp, Homo sapiens
tttgtacattat

SEQ ID NO: 2717759 - DNA, 16 bp, Homo sapiens
tttgtacattatgtta

SEQ ID NO: 2717760 - DNA, 22 bp, Homo sapiens
tttgtacattatgttattggaa

SEQ ID NO: 2717761 - DNA, 14 bp, Homo sapiens
tttgtatttaatga

SEQ ID NO: 2717762 - DNA, 23 bp, Homo sapiens
tttgtatttaatgatttttgtgt

SEQ ID NO: 2717763 - DNA, 17 bp, Homo sapiens
tttgtcagtaaatactc

SEQ ID NO: 2717764 - DNA, 16 bp, Homo sapiens
tttgtcgaatttttat

SEQ ID NO: 2717765 - DNA, 20 bp, Homo sapiens
tttgtcgaatttttattatt

SEQ ID NO: 2717766 - DNA, 15 bp, Homo sapiens
tttgttagcaaagat

SEQ ID NO: 2717767 - DNA, 18 bp, Homo sapiens
tttgttattaaaaaaaca

SEQ ID NO: 2717768 - DNA, 17 bp, Homo sapiens
tttgttatttgtacagt

SEQ ID NO: 2717769 - DNA, 16 bp, Homo sapiens
tttgttgtcatgtgta

SEQ ID NO: 2717770 - DNA, 13 bp, Homo sapiens
tttgttttcttca

SEQ ID NO: 2717771 - DNA, 16 bp, Homo sapiens
tttgttttcttcattt

SEQ ID NO: 2717772 - DNA, 12 bp, Homo sapiens
ttttaaacagtg

SEQ ID NO: 2717773 - DNA, 17 bp, Homo sapiens
ttttaaagaaaatgtgt

SEQ ID NO: 2717774 - DNA, 20 bp, Homo sapiens
ttttaaagagtgaaaaatga

SEQ ID NO: 2717775 - DNA, 16 bp, Homo sapiens
ttttaaaggacaaaca

SEQ ID NO: 2717776 - DNA, 21 bp, Homo sapiens
ttttaaataaaagcacaagta

SEQ ID NO: 2717777 - DNA, 17 bp, Homo sapiens
ttttaagaaaaaaagca

SEQ ID NO: 2717778 - DNA, 19 bp, Homo sapiens
ttttaataaagattctatt

SEQ ID NO: 2717779 - DNA, 21 bp, Homo sapiens
ttttacaaataaagatggcta

SEQ ID NO: 2717780 - DNA, 17 bp, Homo sapiens
ttttaccaaagcatcaa

SEQ ID NO: 2717781 - DNA, 14 bp, Homo sapiens
ttttactgacagaa

SEQ ID NO: 2717782 - DNA, 14 bp, Homo sapiens
ttttagaaaatcag

SEQ ID NO: 2717783 - DNA, 17 bp, Homo sapiens
ttttagcttcatatcta

SEQ ID NO: 2717784 - DNA, 18 bp, Homo sapiens
ttttaggcagggatttga

SEQ ID NO: 2717785 - DNA, 18 bp, Homo sapiens
ttttatacataaacagtt

SEQ ID NO: 2717786 - DNA, 17 bp, Homo sapiens
ttttatttccacataaa

SEQ ID NO: 2717787 - DNA, 20 bp, Homo sapiens
ttttattttgtaattattgt

SEQ ID NO: 2717788 - DNA, 21 bp, Homo sapiens
ttttcagcatcaaacatgaaa

SEQ ID NO: 2717789 - DNA, 15 bp, Homo sapiens
ttttcagcttctgct

SEQ ID NO: 2717790 - DNA, 17 bp, Homo sapiens
ttttcagcttctgctgg

SEQ ID NO: 2717791 - DNA, 20 bp, Homo sapiens
ttttcagcttctgctgggct

SEQ ID NO: 2717792 - DNA, 20 bp, Homo sapiens
ttttcatttctaacataagt

SEQ ID NO: 2717793 - DNA, 14 bp, Homo sapiens
ttttcctctagaag

SEQ ID NO: 2717794 - DNA, 23 bp, Homo sapiens
ttttctacctttttttctctcct

SEQ ID NO: 2717795 - DNA, 17 bp, Homo sapiens
ttttctactttttttaa

SEQ ID NO: 2717796 - DNA, 22 bp, Homo sapiens
ttttctgcccaactttcattgg

SEQ ID NO: 2717797 - DNA, 14 bp, Homo sapiens
ttttctttcataca

SEQ ID NO: 2717798 - DNA, 13 bp, Homo sapiens
ttttctttccaaa

SEQ ID NO: 2717799 - DNA, 23 bp, Homo sapiens
ttttgacagagttggtgttcata

SEQ ID NO: 2717800 - DNA, 20 bp, Homo sapiens
ttttgcaggggactgggcca

SEQ ID NO: 2717801 - DNA, 17 bp, Homo sapiens
ttttgcagtcttttgct

SEQ ID NO: 2717802 - DNA, 12 bp, Homo sapiens
ttttgcatgaaa

SEQ ID NO: 2717803 - DNA, 22 bp, Homo sapiens
ttttgctggagactatttaagt

SEQ ID NO: 2717804 - DNA, 10 bp, Homo sapiens
ttttgtaaag

SEQ ID NO: 2717805 - DNA, 19 bp, Homo sapiens
ttttgtaaatgagacacat

SEQ ID NO: 2717806 - DNA, 11 bp, Homo sapiens
ttttgtaacta

SEQ ID NO: 2717807 - DNA, 17 bp, Homo sapiens
ttttgtaattattgtga

SEQ ID NO: 2717808 - DNA, 17 bp, Homo sapiens
ttttgtattaacaaagt

SEQ ID NO: 2717809 - DNA, 22 bp, Homo sapiens
ttttgtcgaatttttattattt

SEQ ID NO: 2717810 - DNA, 15 bp, Homo sapiens
ttttgttagcaaaga

SEQ ID NO: 2717811 - DNA, 17 bp, Homo sapiens
ttttgttcttggtctcc

SEQ ID NO: 2717812 - DNA, 12 bp, Homo sapiens
tttttaaaaggt

SEQ ID NO: 2717813 - DNA, 12 bp, Homo sapiens
tttttaaagcaa

SEQ ID NO: 2717814 - DNA, 18 bp, Homo sapiens
tttttaaaggacaaacag

SEQ ID NO: 2717815 - DNA, 16 bp, Homo sapiens
tttttaaataaaagca

SEQ ID NO: 2717816 - DNA, 17 bp, Homo sapiens
tttttaaataaaagcac

SEQ ID NO: 2717817 - DNA, 14 bp, Homo sapiens
tttttaaataaaat

SEQ ID NO: 2717818 - DNA, 23 bp, Homo sapiens
tttttaagctgtaaaaagagaga

SEQ ID NO: 2717819 - DNA, 14 bp, Homo sapiens
tttttcaagagatc

SEQ ID NO: 2717820 - DNA, 17 bp, Homo sapiens
tttttctgcctgagatt

SEQ ID NO: 2717821 - DNA, 18 bp, Homo sapiens
tttttctgcctgagattc

SEQ ID NO: 2717822 - DNA, 16 bp, Homo sapiens
tttttgaatgtcataa

SEQ ID NO: 2717823 - DNA, 19 bp, Homo sapiens
tttttgctcttctgtatgt

SEQ ID NO: 2717824 - DNA, 14 bp, Homo sapiens
tttttgtacattat

SEQ ID NO: 2717825 - DNA, 20 bp, Homo sapiens
tttttgtaccatattgctct

SEQ ID NO: 2717826 - DNA, 15 bp, Homo sapiens
tttttgtattaacaa

SEQ ID NO: 2717827 - DNA, 14 bp, Homo sapiens
ttttttaaagaaaa

SEQ ID NO: 2717828 - DNA, 15 bp, Homo sapiens
aaacttcagagaaat

SEQ ID NO: 2717829 - DNA, 16 bp, Homo sapiens
aaagaaaatgtgtctg

SEQ ID NO: 2717830 - DNA, 18 bp, Homo sapiens
aaagaaacactaaattag

SEQ ID NO: 2717831 - DNA, 14 bp, Homo sapiens
aaagaactgcccca

SEQ ID NO: 2717832 - DNA, 15 bp, Homo sapiens
aaagaactgccccat

SEQ ID NO: 2717833 - DNA, 21 bp, Homo sapiens
aaagaagagccttcacatgaa

SEQ ID NO: 2717834 - DNA, 20 bp, Homo sapiens
aaagaagtttgggctaacat

SEQ ID NO: 2717835 - DNA, 23 bp, Homo sapiens
aaagaagtttgggctaacattta

SEQ ID NO: 2717836 - DNA, 14 bp, Homo sapiens
aaagaatacatttt

SEQ ID NO: 2717837 - DNA, 14 bp, Homo sapiens
aaagaatcccaccc

SEQ ID NO: 2717838 - DNA, 15 bp, Homo sapiens
aaagacacctgcctt

SEQ ID NO: 2717839 - DNA, 11 bp, Homo sapiens
aaagacatcaa

SEQ ID NO: 2717840 - DNA, 12 bp, Homo sapiens
aaagacatcaat

SEQ ID NO: 2717841 - DNA, 14 bp, Homo sapiens
aaagacatcaatga

SEQ ID NO: 2717842 - DNA, 16 bp, Homo sapiens
aaagaccaaattttga

SEQ ID NO: 2717843 - DNA, 18 bp, Homo sapiens
aaagagagaaaacttatt

SEQ ID NO: 2717844 - DNA, 14 bp, Homo sapiens
aaagatcagctatt

SEQ ID NO: 2717845 - DNA, 15 bp, Homo sapiens
aaagatcagctattc

SEQ ID NO: 2717846 - DNA, 22 bp, Homo sapiens
aaagatgtgctcccaccaggca

SEQ ID NO: 2717847 - DNA, 15 bp, Homo sapiens
aaagattatatatca

SEQ ID NO: 2717848 - DNA, 21 bp, Homo sapiens
aaagattatatatcataaagt

SEQ ID NO: 2717849 - DNA, 20 bp, Homo sapiens
aaagcaaatatataatgcaa

SEQ ID NO: 2717850 - DNA, 18 bp, Homo sapiens
aaagcacaagtacttttg

SEQ ID NO: 2717851 - DNA, 16 bp, Homo sapiens
aaagcatcacctcagg

SEQ ID NO: 2717852 - DNA, 17 bp, Homo sapiens
aaagcatcacctcaggc

SEQ ID NO: 2717853 - DNA, 17 bp, Homo sapiens
aaagccaaactctgcca

SEQ ID NO: 2717854 - DNA, 20 bp, Homo sapiens
aaagctctatggattatcca

SEQ ID NO: 2717855 - DNA, 19 bp, Homo sapiens
aaagctgcctcgtttccct

SEQ ID NO: 2717856 - DNA, 14 bp, Homo sapiens
aaagctgtgccttt

SEQ ID NO: 2717857 - DNA, 19 bp, Homo sapiens
aaagctgtgtctctgtata

SEQ ID NO: 2717858 - DNA, 20 bp, Homo sapiens
aaaggattttaccaaagcat

SEQ ID NO: 2717859 - DNA, 13 bp, Homo sapiens
aaaggcttctcca

SEQ ID NO: 2717860 - DNA, 19 bp, Homo sapiens
aaaggctttggcaacagaa

SEQ ID NO: 2717861 - DNA, 16 bp, Homo sapiens
aaaggttttattttgt

SEQ ID NO: 2717862 - DNA, 14 bp, Homo sapiens
aaagtatatattct

SEQ ID NO: 2717863 - DNA, 17 bp, Homo sapiens
aaagtatttttgaaaga

SEQ ID NO: 2717864 - DNA, 16 bp, Homo sapiens
aaagtctaaagtttac

SEQ ID NO: 2717865 - DNA, 19 bp, Homo sapiens
aaagttcatataatttaaa

SEQ ID NO: 2717866 - DNA, 16 bp, Homo sapiens
aaagttgacatttaac

SEQ ID NO: 2717867 - DNA, 18 bp, Homo sapiens
aaagtttacagtaaataa

SEQ ID NO: 2717868 - DNA, 12 bp, Homo sapiens
aaagttttcaga

SEQ ID NO: 2717869 - DNA, 15 bp, Homo sapiens
aaataaaaaaaaaac

SEQ ID NO: 2717870 - DNA, 19 bp, Homo sapiens
aaataaaactaaggaaccc

SEQ ID NO: 2717871 - DNA, 12 bp, Homo sapiens
aaataaaagcac

SEQ ID NO: 2717872 - DNA, 12 bp, Homo sapiens
aaataaaataga

SEQ ID NO: 2717873 - DNA, 20 bp, Homo sapiens
aaataaaatagagtctggaa

SEQ ID NO: 2717874 - DNA, 21 bp, Homo sapiens
aaataaaccttgtttctttct

SEQ ID NO: 2717875 - DNA, 17 bp, Homo sapiens
aaataaactactttgaa

SEQ ID NO: 2717876 - DNA, 15 bp, Homo sapiens
aaataaattgtttga

SEQ ID NO: 2717877 - DNA, 21 bp, Homo sapiens
aaataattttttgcagtcttt

SEQ ID NO: 2717878 - DNA, 19 bp, Homo sapiens
aaatactccattattttat

SEQ ID NO: 2717879 - DNA, 20 bp, Homo sapiens
aaatactccattattttatt

SEQ ID NO: 2717880 - DNA, 15 bp, Homo sapiens
aaatagcacatgatt

SEQ ID NO: 2717881 - DNA, 16 bp, Homo sapiens
aaatagggtccttgaa

SEQ ID NO: 2717882 - DNA, 19 bp, Homo sapiens
aaatatagttgtctttctt

SEQ ID NO: 2717883 - DNA, 16 bp, Homo sapiens
aaatatgtgaaaatga

SEQ ID NO: 2717884 - DNA, 17 bp, Homo sapiens
aaatattggtttgttat

SEQ ID NO: 2717885 - DNA, 11 bp, Homo sapiens
aaatcaatttt

SEQ ID NO: 2717886 - DNA, 13 bp, Homo sapiens
aaatcaatttttt

SEQ ID NO: 2717887 - DNA, 19 bp, Homo sapiens
aaatcaattttttaaacca

SEQ ID NO: 2717888 - DNA, 17 bp, Homo sapiens
aaatcctggtttgtaat

SEQ ID NO: 2717889 - DNA, 22 bp, Homo sapiens
aaatcgccttatgagaacatgg

SEQ ID NO: 2717890 - DNA, 11 bp, Homo sapiens
aaatcttcagc

SEQ ID NO: 2717891 - DNA, 13 bp, Homo sapiens
aaatcttcagctg

SEQ ID NO: 2717892 - DNA, 15 bp, Homo sapiens
aaatcttcagctggt

SEQ ID NO: 2717893 - DNA, 13 bp, Homo sapiens
aaatcttggtttg

SEQ ID NO: 2717894 - DNA, 14 bp, Homo sapiens
aaatgaaagtgaga

SEQ ID NO: 2717895 - DNA, 19 bp, Homo sapiens
aaatgaagcaatttatatc

SEQ ID NO: 2717896 - DNA, 16 bp, Homo sapiens
aaatgatgataatcat

SEQ ID NO: 2717897 - DNA, 11 bp, Homo sapiens
aaatgcattca

SEQ ID NO: 2717898 - DNA, 14 bp, Homo sapiens
aaatgcattcatgt

SEQ ID NO: 2717899 - DNA, 15 bp, Homo sapiens
aaatgcattcatgtt

SEQ ID NO: 2717900 - DNA, 15 bp, Homo sapiens
aaatgccttggtttg

SEQ ID NO: 2717901 - DNA, 14 bp, Homo sapiens
aaatgctgtgcaaa

SEQ ID NO: 2717902 - DNA, 19 bp, Homo sapiens
aaatgctgtgcaaacagtg

SEQ ID NO: 2717903 - DNA, 14 bp, Homo sapiens
aaatggacaatacc

SEQ ID NO: 2717904 - DNA, 17 bp, Homo sapiens
aaatggacaataccaga

SEQ ID NO: 2717905 - DNA, 14 bp, Homo sapiens
aaatggttaagaca

SEQ ID NO: 2717906 - DNA, 22 bp, Homo sapiens
aaatgtcactgaagtgattgaa

SEQ ID NO: 2717907 - DNA, 23 bp, Homo sapiens
aaatgtgtcccagtgaacagttt

SEQ ID NO: 2717908 - DNA, 20 bp, Homo sapiens
aaatgtgtctgcaacatgga

SEQ ID NO: 2717909 - DNA, 13 bp, Homo sapiens
aaatgttggtgca

SEQ ID NO: 2717910 - DNA, 16 bp, Homo sapiens
aaattaatcttttaaa

SEQ ID NO: 2717911 - DNA, 22 bp, Homo sapiens
aaattaatcttttaaaaatgat

SEQ ID NO: 2717912 - DNA, 20 bp, Homo sapiens
aaattcaacctgtgtcttat

SEQ ID NO: 2717913 - DNA, 14 bp, Homo sapiens
aaattgatcattca

SEQ ID NO: 2717914 - DNA, 20 bp, Homo sapiens
aaattgtctgtctgctctta

SEQ ID NO: 2717915 - DNA, 23 bp, Homo sapiens
aaattgtctgtctgctcttattt

SEQ ID NO: 2717916 - DNA, 19 bp, Homo sapiens
aaattttactgacagaaat

SEQ ID NO: 2717917 - DNA, 15 bp, Homo sapiens
aaatttttttccaga

SEQ ID NO: 2717918 - DNA, 21 bp, Homo sapiens
aacaaatggcttacttacaaa

SEQ ID NO: 2717919 - DNA, 23 bp, Homo sapiens
aacaaggtaatttttttttgtaa

SEQ ID NO: 2717920 - DNA, 13 bp, Homo sapiens
aacaataaagagc

SEQ ID NO: 2717921 - DNA, 20 bp, Homo sapiens
aacaatcacaaaagctgtgt

SEQ ID NO: 2717922 - DNA, 17 bp, Homo sapiens
aacacacagactctgtg

SEQ ID NO: 2717923 - DNA, 13 bp, Homo sapiens
aacacccactggc

SEQ ID NO: 2717924 - DNA, 14 bp, Homo sapiens
aacacccactggcc

SEQ ID NO: 2717925 - DNA, 17 bp, Homo sapiens
aacacccactggccagt

SEQ ID NO: 2717926 - DNA, 20 bp, Homo sapiens
aacacccggaaagactgaaa

SEQ ID NO: 2717927 - DNA, 18 bp, Homo sapiens
aacacgcatgcctcagcc

SEQ ID NO: 2717928 - DNA, 14 bp, Homo sapiens
aacacggcagctgt

SEQ ID NO: 2717929 - DNA, 13 bp, Homo sapiens
aacagaaattatt

SEQ ID NO: 2717930 - DNA, 17 bp, Homo sapiens
aacagactatttaactt

SEQ ID NO: 2717931 - DNA, 19 bp, Homo sapiens
aacagagtgagaccctgtc

SEQ ID NO: 2717932 - DNA, 15 bp, Homo sapiens
aacagatgtccctga

SEQ ID NO: 2717933 - DNA, 22 bp, Homo sapiens
aacagatgtccctgaagtcttg

SEQ ID NO: 2717934 - DNA, 22 bp, Homo sapiens
aacagcgtgtcaactttcattt

SEQ ID NO: 2717935 - DNA, 12 bp, Homo sapiens
aacagtgaattt

SEQ ID NO: 2717936 - DNA, 17 bp, Homo sapiens
aacagtgctctgcctct

SEQ ID NO: 2717937 - DNA, 23 bp, Homo sapiens
aacagtgttaggcctggcacagt

SEQ ID NO: 2717938 - DNA, 19 bp, Homo sapiens
aacagttttggagaaaaat

SEQ ID NO: 2717939 - DNA, 20 bp, Homo sapiens
aacagttttggagaaaaatt

SEQ ID NO: 2717940 - DNA, 21 bp, Homo sapiens
aacagttttggagaaaaatta

SEQ ID NO: 2717941 - DNA, 12 bp, Homo sapiens
aacataaaaaaa

SEQ ID NO: 2717942 - DNA, 15 bp, Homo sapiens
aacataacaaccttt

SEQ ID NO: 2717943 - DNA, 12 bp, Homo sapiens
aacatgcagaag

SEQ ID NO: 2717944 - DNA, 15 bp, Homo sapiens
aacatggattccaaa

SEQ ID NO: 2717945 - DNA, 20 bp, Homo sapiens
aacatggattccaaagcatt

SEQ ID NO: 2717946 - DNA, 20 bp, Homo sapiens
aacatggtgtgtgtctctga

SEQ ID NO: 2717947 - DNA, 21 bp, Homo sapiens
aacattaccttgtctttcaaa

SEQ ID NO: 2717948 - DNA, 15 bp, Homo sapiens
aacattgatgaatga

SEQ ID NO: 2717949 - DNA, 15 bp, Homo sapiens
aacattgcaatagaa

SEQ ID NO: 2717950 - DNA, 15 bp, Homo sapiens
aacatttaggagaag

SEQ ID NO: 2717951 - DNA, 19 bp, Homo sapiens
aacatttaggagaagttgg

SEQ ID NO: 2717952 - DNA, 22 bp, Homo sapiens
aacatttcttacattgcagaac

SEQ ID NO: 2717953 - DNA, 21 bp, Homo sapiens
aaggacaaacagtgaatttaa

SEQ ID NO: 2717954 - DNA, 21 bp, Homo sapiens
aaggacaacctgcccctcccc

SEQ ID NO: 2717955 - DNA, 14 bp, Homo sapiens
aaggactgtaagca

SEQ ID NO: 2717956 - DNA, 22 bp, Homo sapiens
aaggagatagacgggttgaaag

SEQ ID NO: 2717957 - DNA, 18 bp, Homo sapiens
aaggagattttccttcct

SEQ ID NO: 2717958 - DNA, 16 bp, Homo sapiens
aaggagccagccagga

SEQ ID NO: 2717959 - DNA, 13 bp, Homo sapiens
aaggaggctggct

SEQ ID NO: 2717960 - DNA, 18 bp, Homo sapiens
aaggaggctggctggggc

SEQ ID NO: 2717961 - DNA, 16 bp, Homo sapiens
aaggatcttttgtaaa

SEQ ID NO: 2717962 - DNA, 18 bp, Homo sapiens
aaggatcttttgtaaatg

SEQ ID NO: 2717963 - DNA, 18 bp, Homo sapiens
aaggattttaccaaagca

SEQ ID NO: 2717964 - DNA, 19 bp, Homo sapiens
aaggattttaccaaagcat

SEQ ID NO: 2717965 - DNA, 18 bp, Homo sapiens
aaggatttttcaagagat

SEQ ID NO: 2717966 - DNA, 13 bp, Homo sapiens
aaggccacactgg

SEQ ID NO: 2717967 - DNA, 23 bp, Homo sapiens
aaggccagggcacagctggagac

SEQ ID NO: 2717968 - DNA, 19 bp, Homo sapiens
aaggcctcccacagtgact

SEQ ID NO: 2717969 - DNA, 12 bp, Homo sapiens
aaggcctcccct

SEQ ID NO: 2717970 - DNA, 14 bp, Homo sapiens
aaggcctcccctga

SEQ ID NO: 2717971 - DNA, 16 bp, Homo sapiens
aaggcctcccctgagg

SEQ ID NO: 2717972 - DNA, 17 bp, Homo sapiens
aaggctgagagctctct

SEQ ID NO: 2717973 - DNA, 16 bp, Homo sapiens
aaggctttgccatggg

SEQ ID NO: 2717974 - DNA, 21 bp, Homo sapiens
aaggctttgccatgggcctgc

SEQ ID NO: 2717975 - DNA, 20 bp, Homo sapiens
aagggagggagctgaggcct

SEQ ID NO: 2717976 - DNA, 15 bp, Homo sapiens
aagggcacaagctca

SEQ ID NO: 2717977 - DNA, 17 bp, Homo sapiens
aagggctcagagctgct

SEQ ID NO: 2717978 - DNA, 19 bp, Homo sapiens
aagggctcagagctgctga

SEQ ID NO: 2717979 - DNA, 18 bp, Homo sapiens
aaggggaaacctgtgaaa

SEQ ID NO: 2717980 - DNA, 14 bp, Homo sapiens
aaggggccctggtc

SEQ ID NO: 2717981 - DNA, 21 bp, Homo sapiens
aaggggccctggtccttccag

SEQ ID NO: 2717982 - DNA, 17 bp, Homo sapiens
aagggtatcctgtgcta

SEQ ID NO: 2717983 - DNA, 21 bp, Homo sapiens
aagggttttccaccctggaat

SEQ ID NO: 2717984 - DNA, 17 bp, Homo sapiens
aaggtaataaatacaca

SEQ ID NO: 2717985 - DNA, 21 bp, Homo sapiens
aaggtaatttttttttgtaaa

SEQ ID NO: 2717986 - DNA, 22 bp, Homo sapiens
aaggtacggtgagactctgagg

SEQ ID NO: 2717987 - DNA, 20 bp, Homo sapiens
aaggtataaggatcttttgt

SEQ ID NO: 2717988 - DNA, 14 bp, Homo sapiens
aaggtcgcacctcc

SEQ ID NO: 2717989 - DNA, 19 bp, Homo sapiens
aaggtctataaacatgaag

SEQ ID NO: 2717990 - DNA, 22 bp, Homo sapiens
aaggtctcacactcctcctgcc

SEQ ID NO: 2717991 - DNA, 20 bp, Homo sapiens
aaggtgggctgagccctggc

SEQ ID NO: 2717992 - DNA, 17 bp, Homo sapiens
aaggtgtcatttgacaa

SEQ ID NO: 2717993 - DNA, 21 bp, Homo sapiens
aaggtttcccagtgagcctct

SEQ ID NO: 2717994 - DNA, 23 bp, Homo sapiens
aaggtttcccagtgagcctctgc

SEQ ID NO: 2717995 - DNA, 20 bp, Homo sapiens
aagtaagtaccactcaggcc

SEQ ID NO: 2717996 - DNA, 21 bp, Homo sapiens
aagtaagtaccactcaggcca

SEQ ID NO: 2717997 - DNA, 14 bp, Homo sapiens
aagtagtagtgtct

SEQ ID NO: 2717998 - DNA, 15 bp, Homo sapiens
aagtagtggagcccc

SEQ ID NO: 2717999 - DNA, 14 bp, Homo sapiens
aagtatatattcta

SEQ ID NO: 2718000 - DNA, 13 bp, Homo sapiens
aagtatttttgaa

SEQ ID NO: 2718001 - DNA, 16 bp, Homo sapiens
aagtatttttgaaaga

SEQ ID NO: 2718002 - DNA, 22 bp, Homo sapiens
aagtatttttgaaagaattcta

SEQ ID NO: 2718003 - DNA, 18 bp, Homo sapiens
aagtcatggtcctggctg

SEQ ID NO: 2718004 - DNA, 14 bp, Homo sapiens
aagtccacagtgga

SEQ ID NO: 2718005 - DNA, 11 bp, Homo sapiens
aagtctaaagt

SEQ ID NO: 2718006 - DNA, 20 bp, Homo sapiens
aagtctaaagtttacagtaa

SEQ ID NO: 2718007 - DNA, 15 bp, Homo sapiens
aagtctctgctgcta

SEQ ID NO: 2718008 - DNA, 15 bp, Homo sapiens
aagtgaataaacttc

SEQ ID NO: 2718009 - DNA, 15 bp, Homo sapiens
aagtgagtggcatgt

SEQ ID NO: 2718010 - DNA, 17 bp, Homo sapiens
aagtgatttttttgtcc

SEQ ID NO: 2718011 - DNA, 14 bp, Homo sapiens
aagtgcagctcagg

SEQ ID NO: 2718012 - DNA, 21 bp, Homo sapiens
aagtgccagtcttgtgtctgc

SEQ ID NO: 2718013 - DNA, 20 bp, Homo sapiens
aagtgctgtttgggcaggag

SEQ ID NO: 2718014 - DNA, 14 bp, Homo sapiens
aagtggccagggct

SEQ ID NO: 2718015 - DNA, 21 bp, Homo sapiens
aagtgtcctggaccctggcct

SEQ ID NO: 2718016 - DNA, 17 bp, Homo sapiens
aagtgtcgagtccagtc

SEQ ID NO: 2718017 - DNA, 21 bp, Homo sapiens
aagtgtctcttgactggctca

SEQ ID NO: 2718018 - DNA, 13 bp, Homo sapiens
aagtgtggaattg

SEQ ID NO: 2718019 - DNA, 19 bp, Homo sapiens
aagttcaatctgtttttca

SEQ ID NO: 2718020 - DNA, 17 bp, Homo sapiens
aagttcatataatttaa

SEQ ID NO: 2718021 - DNA, 17 bp, Homo sapiens
aagttccagttttgttt

SEQ ID NO: 2718022 - DNA, 14 bp, Homo sapiens
aagttccctcctgc

SEQ ID NO: 2718023 - DNA, 15 bp, Homo sapiens
aagttggtcttactt

SEQ ID NO: 2718024 - DNA, 22 bp, Homo sapiens
aagtttacagtaaataaattgt

SEQ ID NO: 2718025 - DNA, 17 bp, Homo sapiens
aagtttgggctaacatt

SEQ ID NO: 2718026 - DNA, 18 bp, Homo sapiens
aagtttgggctaacattt

SEQ ID NO: 2718027 - DNA, 15 bp, Homo sapiens
aagttttaactatgc

SEQ ID NO: 2718028 - DNA, 20 bp, Homo sapiens
aagttttatacataaacagt

SEQ ID NO: 2718029 - DNA, 11 bp, Homo sapiens
aagttttgcac

SEQ ID NO: 2718030 - DNA, 17 bp, Homo sapiens
aagttttgcacttttgt

SEQ ID NO: 2718031 - DNA, 15 bp, Homo sapiens
aagttttgtaaattt

SEQ ID NO: 2718032 - DNA, 20 bp, Homo sapiens
aataaaaaaatatatacaga

SEQ ID NO: 2718033 - DNA, 10 bp, Homo sapiens
aataaaaaac

SEQ ID NO: 2718034 - DNA, 23 bp, Homo sapiens
aataaaatagagtctggaatgct

SEQ ID NO: 2718035 - DNA, 14 bp, Homo sapiens
aataaaattgtaaa

SEQ ID NO: 2718036 - DNA, 22 bp, Homo sapiens
aataaacacagtgtttcctgag

SEQ ID NO: 2718037 - DNA, 17 bp, Homo sapiens
aataaaccttgtttctt

SEQ ID NO: 2718038 - DNA, 22 bp, Homo sapiens
aataaaccttgtttctttctga

SEQ ID NO: 2718039 - DNA, 12 bp, Homo sapiens
aataaagagctc

SEQ ID NO: 2718040 - DNA, 19 bp, Homo sapiens
aataactctgattttgata

SEQ ID NO: 2718041 - DNA, 19 bp, Homo sapiens
aataagttttatacataaa

SEQ ID NO: 2718042 - DNA, 16 bp, Homo sapiens
aataattttttgcagt

SEQ ID NO: 2718043 - DNA, 22 bp, Homo sapiens
aataattttttgcagtcttttg

SEQ ID NO: 2718044 - DNA, 20 bp, Homo sapiens
aatacaaccagcccaaccat

SEQ ID NO: 2718045 - DNA, 15 bp, Homo sapiens
aatacagtcaactta

SEQ ID NO: 2718046 - DNA, 14 bp, Homo sapiens
aatacatgctgcta

SEQ ID NO: 2718047 - DNA, 20 bp, Homo sapiens
aatacgatcctgcagggtag

SEQ ID NO: 2718048 - DNA, 13 bp, Homo sapiens
aatagcaaggcca

SEQ ID NO: 2718049 - DNA, 20 bp, Homo sapiens
aataggatgaatgggaaagt

SEQ ID NO: 2718050 - DNA, 23 bp, Homo sapiens
aataggatgaatgggaaagtatt

SEQ ID NO: 2718051 - DNA, 14 bp, Homo sapiens
aatagtcagagtgt

SEQ ID NO: 2718052 - DNA, 13 bp, Homo sapiens
aatataaattttg

SEQ ID NO: 2718053 - DNA, 14 bp, Homo sapiens
aatataataatgat

SEQ ID NO: 2718054 - DNA, 17 bp, Homo sapiens
aatataataatgatgat

SEQ ID NO: 2718055 - DNA, 18 bp, Homo sapiens
aatatagttgtctttctt

SEQ ID NO: 2718056 - DNA, 17 bp, Homo sapiens
aatatataatgcaacaa

SEQ ID NO: 2718057 - DNA, 22 bp, Homo sapiens
aatatatacagattcctgttgt

SEQ ID NO: 2718058 - DNA, 15 bp, Homo sapiens
aatatatatttatca

SEQ ID NO: 2718059 - DNA, 21 bp, Homo sapiens
aatatattgctgctggtaatt

SEQ ID NO: 2718060 - DNA, 21 bp, Homo sapiens
aatatctgagaagtgtatata

SEQ ID NO: 2718061 - DNA, 23 bp, Homo sapiens
aatatctgagaagtgtatatagt

SEQ ID NO: 2718062 - DNA, 18 bp, Homo sapiens
aatatgattgcactaaat

SEQ ID NO: 2718063 - DNA, 18 bp, Homo sapiens
aatattctgataatgtat

SEQ ID NO: 2718064 - DNA, 19 bp, Homo sapiens
aatattctgataatgtatt

SEQ ID NO: 2718065 - DNA, 16 bp, Homo sapiens
aatatttcttcaagtg

SEQ ID NO: 2718066 - DNA, 15 bp, Homo sapiens
aatcaacttttctga

SEQ ID NO: 2718067 - DNA, 20 bp, Homo sapiens
aatcaagagtctctccagcc

SEQ ID NO: 2718068 - DNA, 13 bp, Homo sapiens
aatcacaaaagct

SEQ ID NO: 2718069 - DNA, 15 bp, Homo sapiens
aatcacaaacatatg

SEQ ID NO: 2718070 - DNA, 13 bp, Homo sapiens
aatcactgctccc

SEQ ID NO: 2718071 - DNA, 14 bp, Homo sapiens
aatcataacatagt

SEQ ID NO: 2718072 - DNA, 21 bp, Homo sapiens
aatcataacatagttgaaaaa

SEQ ID NO: 2718073 - DNA, 14 bp, Homo sapiens
aatcatattaatta

SEQ ID NO: 2718074 - DNA, 15 bp, Homo sapiens
aatcatattaattat

SEQ ID NO: 2718075 - DNA, 15 bp, Homo sapiens
aatccatttggcaga

SEQ ID NO: 2718076 - DNA, 18 bp, Homo sapiens
aatcgccttatgagaaca

SEQ ID NO: 2718077 - DNA, 18 bp, Homo sapiens
actcctcctgccagctct

SEQ ID NO: 2718078 - DNA, 22 bp, Homo sapiens
actcctcctgccagctctgtca

SEQ ID NO: 2718079 - DNA, 16 bp, Homo sapiens
actcctcttatttgct

SEQ ID NO: 2718080 - DNA, 15 bp, Homo sapiens
actcctgacctcgtg

SEQ ID NO: 2718081 - DNA, 17 bp, Homo sapiens
actccttccccttgtcc

SEQ ID NO: 2718082 - DNA, 17 bp, Homo sapiens
actcgggctcctgtgcc

SEQ ID NO: 2718083 - DNA, 19 bp, Homo sapiens
actctaattggtcattcct

SEQ ID NO: 2718084 - DNA, 22 bp, Homo sapiens
actctaccctggtaggaaagca

SEQ ID NO: 2718085 - DNA, 14 bp, Homo sapiens
actctcacctcgtg

SEQ ID NO: 2718086 - DNA, 15 bp, Homo sapiens
actctgattttgata

SEQ ID NO: 2718087 - DNA, 21 bp, Homo sapiens
actctgcaactgaatacttga

SEQ ID NO: 2718088 - DNA, 12 bp, Homo sapiens
actctgcaggaa

SEQ ID NO: 2718089 - DNA, 14 bp, Homo sapiens
actctgcaggaaat

SEQ ID NO: 2718090 - DNA, 11 bp, Homo sapiens
actctgctgcc

SEQ ID NO: 2718091 - DNA, 23 bp, Homo sapiens
actctgtgcccatgggcactgct

SEQ ID NO: 2718092 - DNA, 24 bp, Homo sapiens
actctgtgcccatgggcactgctg

SEQ ID NO: 2718093 - DNA, 20 bp, Homo sapiens
actcttcctttatcccctcc

SEQ ID NO: 2718094 - DNA, 15 bp, Homo sapiens
actcttggccagagc

SEQ ID NO: 2718095 - DNA, 19 bp, Homo sapiens
actctttgctacaataaat

SEQ ID NO: 2718096 - DNA, 20 bp, Homo sapiens
actctttgctacaataaatg

SEQ ID NO: 2718097 - DNA, 17 bp, Homo sapiens
actgaaacctcttcggt

SEQ ID NO: 2718098 - DNA, 18 bp, Homo sapiens
actgaagacctccacatt

SEQ ID NO: 2718099 - DNA, 22 bp, Homo sapiens
actgaaggcttctgcagctttg

SEQ ID NO: 2718100 - DNA, 16 bp, Homo sapiens
actgaagtgattgaaa

SEQ ID NO: 2718101 - DNA, 18 bp, Homo sapiens
actgaagtgcagctcagg

SEQ ID NO: 2718102 - DNA, 20 bp, Homo sapiens
actgcaagctctgcctcccg

SEQ ID NO: 2718103 - DNA, 15 bp, Homo sapiens
actgcaccccctcct

SEQ ID NO: 2718104 - DNA, 20 bp, Homo sapiens
actgcaccccctcctgctgc

SEQ ID NO: 2718105 - DNA, 15 bp, Homo sapiens
actgccaaaacaatg

SEQ ID NO: 2718106 - DNA, 12 bp, Homo sapiens
actgcccaggga

SEQ ID NO: 2718107 - DNA, 15 bp, Homo sapiens
actgcccagggaagc

SEQ ID NO: 2718108 - DNA, 19 bp, Homo sapiens
actgcgggatggtcctggg

SEQ ID NO: 2718109 - DNA, 16 bp, Homo sapiens
actgcggggcttggct

SEQ ID NO: 2718110 - DNA, 18 bp, Homo sapiens
actgcggggcttggctga

SEQ ID NO: 2718111 - DNA, 18 bp, Homo sapiens
actgcggtgtctgcagct

SEQ ID NO: 2718112 - DNA, 12 bp, Homo sapiens
actgctggggct

SEQ ID NO: 2718113 - DNA, 14 bp, Homo sapiens
actgctggggctgg

SEQ ID NO: 2718114 - DNA, 12 bp, Homo sapiens
actgctgggtgg

SEQ ID NO: 2718115 - DNA, 13 bp, Homo sapiens
actgctgggtggc

SEQ ID NO: 2718116 - DNA, 18 bp, Homo sapiens
actgctgggtggcccatc

SEQ ID NO: 2718117 - DNA, 17 bp, Homo sapiens
actggacgcccagctga

SEQ ID NO: 2718118 - DNA, 22 bp, Homo sapiens
actggacgcccagctgaggctg

SEQ ID NO: 2718119 - DNA, 15 bp, Homo sapiens
actggcatctccctg

SEQ ID NO: 2718120 - DNA, 13 bp, Homo sapiens
actggccagtcct

SEQ ID NO: 2718121 - DNA, 19 bp, Homo sapiens
actggccagtcctagagct

SEQ ID NO: 2718122 - DNA, 23 bp, Homo sapiens
actggccagtcctagagctcctg

SEQ ID NO: 2718123 - DNA, 13 bp, Homo sapiens
actggccgtggct

SEQ ID NO: 2718124 - DNA, 16 bp, Homo sapiens
actggcctcgcctggc

SEQ ID NO: 2718125 - DNA, 23 bp, Homo sapiens
actggcctcgcctggcctgaggt

SEQ ID NO: 2718126 - DNA, 12 bp, Homo sapiens
actggctcaaga

SEQ ID NO: 2718127 - DNA, 21 bp, Homo sapiens
actggctgcctccactcccac

SEQ ID NO: 2718128 - DNA, 12 bp, Homo sapiens
actgggcccctc

SEQ ID NO: 2718129 - DNA, 14 bp, Homo sapiens
actgggcccctcag

SEQ ID NO: 2718130 - DNA, 15 bp, Homo sapiens
actgggctctgagga

SEQ ID NO: 2718131 - DNA, 22 bp, Homo sapiens
actgggctctgaggagtggagt

SEQ ID NO: 2718132 - DNA, 19 bp, Homo sapiens
actggggcagggcagcagg

SEQ ID NO: 2718133 - DNA, 16 bp, Homo sapiens
actgtatgtataaatt

SEQ ID NO: 2718134 - DNA, 21 bp, Homo sapiens
actgtcccaggagcaaatgct

SEQ ID NO: 2718135 - DNA, 12 bp, Homo sapiens
actgtcctgctc

SEQ ID NO: 2718136 - DNA, 19 bp, Homo sapiens
actgtctcaactactcagc

SEQ ID NO: 2718137 - DNA, 12 bp, Homo sapiens
actgtgctccca

SEQ ID NO: 2718138 - DNA, 14 bp, Homo sapiens
actgtgctcccacg

SEQ ID NO: 2718139 - DNA, 20 bp, Homo sapiens
actgtgctcccacggggacc

SEQ ID NO: 2718140 - DNA, 18 bp, Homo sapiens
actgtttcatgagcccaa

SEQ ID NO: 2718141 - DNA, 21 bp, Homo sapiens
actgttttgtgcttctcctaa

SEQ ID NO: 2718142 - DNA, 13 bp, Homo sapiens
acttaaaatcaaa

SEQ ID NO: 2718143 - DNA, 21 bp, Homo sapiens
acttaaaatcaaatttttctg

SEQ ID NO: 2718144 - DNA, 18 bp, Homo sapiens
acttaaacatcattggat

SEQ ID NO: 2718145 - DNA, 14 bp, Homo sapiens
acttacaaaagcag

SEQ ID NO: 2718146 - DNA, 20 bp, Homo sapiens
acttacaaaagcagctttta

SEQ ID NO: 2718147 - DNA, 18 bp, Homo sapiens
acttagaataaaattgta

SEQ ID NO: 2718148 - DNA, 17 bp, Homo sapiens
acttagtttttataaaa

SEQ ID NO: 2718149 - DNA, 16 bp, Homo sapiens
acttattattttgcaa

SEQ ID NO: 2718150 - DNA, 14 bp, Homo sapiens
acttcactgcagcc

SEQ ID NO: 2718151 - DNA, 18 bp, Homo sapiens
acttcactgcagcctttc

SEQ ID NO: 2718152 - DNA, 11 bp, Homo sapiens
acttcagcacc

SEQ ID NO: 2718153 - DNA, 18 bp, Homo sapiens
acttcaggagctgacaga

SEQ ID NO: 2718154 - DNA, 15 bp, Homo sapiens
acttcaggggctgcc

SEQ ID NO: 2718155 - DNA, 16 bp, Homo sapiens
acttcatgcccactgc

SEQ ID NO: 2718156 - DNA, 19 bp, Homo sapiens
acttccatgatactttaat

SEQ ID NO: 2718157 - DNA, 16 bp, Homo sapiens
acttcccccaccctgg

SEQ ID NO: 2718158 - DNA, 17 bp, Homo sapiens
acttcccccaccctggg

SEQ ID NO: 2718159 - DNA, 17 bp, Homo sapiens
acttcccctcctacccc

SEQ ID NO: 2718160 - DNA, 17 bp, Homo sapiens
acttcttgaaacagcct

SEQ ID NO: 2718161 - DNA, 15 bp, Homo sapiens
acttgaaacccattt

SEQ ID NO: 2718162 - DNA, 18 bp, Homo sapiens
acttgaattttcccactg

SEQ ID NO: 2718163 - DNA, 19 bp, Homo sapiens
acttgaattttcccactgc

SEQ ID NO: 2718164 - DNA, 15 bp, Homo sapiens
acttgagaaaatgca

SEQ ID NO: 2718165 - DNA, 19 bp, Homo sapiens
acttgagaaaatgcaggag

SEQ ID NO: 2718166 - DNA, 20 bp, Homo sapiens
acttgagaaaatgcaggaga

SEQ ID NO: 2718167 - DNA, 18 bp, Homo sapiens
acttgaggattttgagta

SEQ ID NO: 2718168 - DNA, 15 bp, Homo sapiens
acttgagggtaataa

SEQ ID NO: 2718169 - DNA, 13 bp, Homo sapiens
acttgattcttgt

SEQ ID NO: 2718170 - DNA, 13 bp, Homo sapiens
acttgcctggggc

SEQ ID NO: 2718171 - DNA, 14 bp, Homo sapiens
acttgcctggggcc

SEQ ID NO: 2718172 - DNA, 15 bp, Homo sapiens
actttaaaataaaat

SEQ ID NO: 2718173 - DNA, 19 bp, Homo sapiens
actttgaaggtaataaata

SEQ ID NO: 2718174 - DNA, 14 bp, Homo sapiens
actttgcttgatta

SEQ ID NO: 2718175 - DNA, 16 bp, Homo sapiens
actttgcttgattaaa

SEQ ID NO: 2718176 - DNA, 19 bp, Homo sapiens
actttgggaggctgaggcg

SEQ ID NO: 2718177 - DNA, 17 bp, Homo sapiens
actttgtgcaaaagcag

SEQ ID NO: 2718178 - DNA, 18 bp, Homo sapiens
actttttaaaatgttggt

SEQ ID NO: 2718179 - DNA, 16 bp, Homo sapiens
actttttaaacagtgt

SEQ ID NO: 2718180 - DNA, 22 bp, Homo sapiens
actttttaaacagtgtttatga

SEQ ID NO: 2718181 - DNA, 22 bp, Homo sapiens
actttttgaatgtcataaagaa

SEQ ID NO: 2718182 - DNA, 20 bp, Homo sapiens
actttttttttttctgcctg

SEQ ID NO: 2718183 - DNA, 21 bp, Homo sapiens
actttttttttttctgcctga

SEQ ID NO: 2718184 - DNA, 17 bp, Homo sapiens
agaaaaccctaagtgtg

SEQ ID NO: 2718185 - DNA, 20 bp, Homo sapiens
agaaaaccctaagtgtggat

SEQ ID NO: 2718186 - DNA, 17 bp, Homo sapiens
agaaaagcaatactgtt

SEQ ID NO: 2718187 - DNA, 14 bp, Homo sapiens
agaaaatcaatgaa

SEQ ID NO: 2718188 - DNA, 15 bp, Homo sapiens
agaaaatgcaggaga

SEQ ID NO: 2718189 - DNA, 13 bp, Homo sapiens
agaaaatgtgtct

SEQ ID NO: 2718190 - DNA, 23 bp, Homo sapiens
agaaaatgtgtctgcaacatgga

SEQ ID NO: 2718191 - DNA, 13 bp, Homo sapiens
agaaacactaaat

SEQ ID NO: 2718192 - DNA, 14 bp, Homo sapiens
agaaacactaaatt

SEQ ID NO: 2718193 - DNA, 20 bp, Homo sapiens
agaaacatgttcctgttcct

SEQ ID NO: 2718194 - DNA, 14 bp, Homo sapiens
agaaagaaaatgaa

SEQ ID NO: 2718195 - DNA, 16 bp, Homo sapiens
agaaagggaaagctgt

SEQ ID NO: 2718196 - DNA, 14 bp, Homo sapiens
agaaatcaattttt

SEQ ID NO: 2718197 - DNA, 19 bp, Homo sapiens
agaaatcctggtttgtaat

SEQ ID NO: 2718198 - DNA, 20 bp, Homo sapiens
agaaatcgccttatgagaac

SEQ ID NO: 2718199 - DNA, 13 bp, Homo sapiens
agaaattctgtgg

SEQ ID NO: 2718200 - DNA, 18 bp, Homo sapiens
agaaattgtgaaaaatga

SEQ ID NO: 2718201 - DNA, 17 bp, Homo sapiens
agaaatttttttccaga

SEQ ID NO: 2718202 - DNA, 21 bp, Homo sapiens
aggaagggagggagctgaggc

SEQ ID NO: 2718203 - DNA, 20 bp, Homo sapiens
aggaagggcatccttctgcc

SEQ ID NO: 2718204 - DNA, 18 bp, Homo sapiens
aggaataagggggcaaca

SEQ ID NO: 2718205 - DNA, 13 bp, Homo sapiens
aggacaaacagtg

SEQ ID NO: 2718206 - DNA, 15 bp, Homo sapiens
aggacaaacagtgaa

SEQ ID NO: 2718207 - DNA, 14 bp, Homo sapiens
aggacaacctgccc

SEQ ID NO: 2718208 - DNA, 18 bp, Homo sapiens
aggacaacctgcccctcc

SEQ ID NO: 2718209 - DNA, 19 bp, Homo sapiens
aggacagtgcttcagcctg

SEQ ID NO: 2718210 - DNA, 22 bp, Homo sapiens
aggacagtgcttcagcctgagg

SEQ ID NO: 2718211 - DNA, 21 bp, Homo sapiens
aggacggggccggccaggtgg

SEQ ID NO: 2718212 - DNA, 17 bp, Homo sapiens
aggactctgaggctctt

SEQ ID NO: 2718213 - DNA, 14 bp, Homo sapiens
aggactctgcagat

SEQ ID NO: 2718214 - DNA, 19 bp, Homo sapiens
aggactggccgtggctcca

SEQ ID NO: 2718215 - DNA, 21 bp, Homo sapiens
aggactggccgtggctccaga

SEQ ID NO: 2718216 - DNA, 11 bp, Homo sapiens
aggagaagttg

SEQ ID NO: 2718217 - DNA, 20 bp, Homo sapiens
aggagaatcgtttgcacccg

SEQ ID NO: 2718218 - DNA, 17 bp, Homo sapiens
aggagagagcagcttct

SEQ ID NO: 2718219 - DNA, 22 bp, Homo sapiens
aggagatagacgggttgaaaga

SEQ ID NO: 2718220 - DNA, 16 bp, Homo sapiens
aggagattgctctggg

SEQ ID NO: 2718221 - DNA, 14 bp, Homo sapiens
aggagcaaatgctg

SEQ ID NO: 2718222 - DNA, 18 bp, Homo sapiens
aggagcaaccgtgcagcc

SEQ ID NO: 2718223 - DNA, 13 bp, Homo sapiens
aggaggctgaggg

SEQ ID NO: 2718224 - DNA, 20 bp, Homo sapiens
aggaggtggaggttgcagtg

SEQ ID NO: 2718225 - DNA, 17 bp, Homo sapiens
aggaggtggcagccctg

SEQ ID NO: 2718226 - DNA, 19 bp, Homo sapiens
aggagtcaccatgcaaggg

SEQ ID NO: 2718227 - DNA, 15 bp, Homo sapiens
aggagtgtcctgtct

SEQ ID NO: 2718228 - DNA, 16 bp, Homo sapiens
aggagttcgagaccag

SEQ ID NO: 2718229 - DNA, 20 bp, Homo sapiens
aggagtttgaggctgcagcg

SEQ ID NO: 2718230 - DNA, 13 bp, Homo sapiens
aggatatgattaa

SEQ ID NO: 2718231 - DNA, 19 bp, Homo sapiens
aggatatgattaatattat

SEQ ID NO: 2718232 - DNA, 19 bp, Homo sapiens
aggatcactggagcccagg

SEQ ID NO: 2718233 - DNA, 18 bp, Homo sapiens
aggatcccctgtcccctg

SEQ ID NO: 2718234 - DNA, 23 bp, Homo sapiens
aggatcccctgtcccctggggct

SEQ ID NO: 2718235 - DNA, 14 bp, Homo sapiens
aggatgctgtcagg

SEQ ID NO: 2718236 - DNA, 19 bp, Homo sapiens
aggatgtcctttgtgtcca

SEQ ID NO: 2718237 - DNA, 17 bp, Homo sapiens
aggattctaaacagatg

SEQ ID NO: 2718238 - DNA, 19 bp, Homo sapiens
aggatttcttattttcttg

SEQ ID NO: 2718239 - DNA, 13 bp, Homo sapiens
aggattttaccaa

SEQ ID NO: 2718240 - DNA, 16 bp, Homo sapiens
aggattttaccaaagc

SEQ ID NO: 2718241 - DNA, 18 bp, Homo sapiens
aggattttaccaaagcat

SEQ ID NO: 2718242 - DNA, 19 bp, Homo sapiens
aggattttaccaaagcatc

SEQ ID NO: 2718243 - DNA, 13 bp, Homo sapiens
aggcacatggctg

SEQ ID NO: 2718244 - DNA, 16 bp, Homo sapiens
aggcacatggctgggg

SEQ ID NO: 2718245 - DNA, 22 bp, Homo sapiens
aggcacccccaggattcccaga

SEQ ID NO: 2718246 - DNA, 13 bp, Homo sapiens
aggcacctgctgg

SEQ ID NO: 2718247 - DNA, 14 bp, Homo sapiens
aggcacctgctgga

SEQ ID NO: 2718248 - DNA, 16 bp, Homo sapiens
aggcacctgctggaaa

SEQ ID NO: 2718249 - DNA, 18 bp, Homo sapiens
aggcagatctttaaatac

SEQ ID NO: 2718250 - DNA, 20 bp, Homo sapiens
aggcagatttactgtcccag

SEQ ID NO: 2718251 - DNA, 14 bp, Homo sapiens
aggcagcctgccgc

SEQ ID NO: 2718252 - DNA, 17 bp, Homo sapiens
aggcagcgcctgtcccc

SEQ ID NO: 2718253 - DNA, 14 bp, Homo sapiens
aggcaggatatccc

SEQ ID NO: 2718254 - DNA, 16 bp, Homo sapiens
aggcaggtctgggcca

SEQ ID NO: 2718255 - DNA, 21 bp, Homo sapiens
aggcagtgaacacactcagca

SEQ ID NO: 2718256 - DNA, 16 bp, Homo sapiens
aggcagtgggtcccac

SEQ ID NO: 2718257 - DNA, 16 bp, Homo sapiens
aggcagttctgtgtcc

SEQ ID NO: 2718258 - DNA, 16 bp, Homo sapiens
aggcatctgagtgtga

SEQ ID NO: 2718259 - DNA, 17 bp, Homo sapiens
aggccaaattaatcttt

SEQ ID NO: 2718260 - DNA, 17 bp, Homo sapiens
aggccaagagcagaggc

SEQ ID NO: 2718261 - DNA, 20 bp, Homo sapiens
aggccacctgtcttctctcc

SEQ ID NO: 2718262 - DNA, 17 bp, Homo sapiens
aggccctgcactgtcct

SEQ ID NO: 2718263 - DNA, 13 bp, Homo sapiens
aggcctcccacag

SEQ ID NO: 2718264 - DNA, 15 bp, Homo sapiens
aggcctcccacagtg

SEQ ID NO: 2718265 - DNA, 12 bp, Homo sapiens
aggcctcccctg

SEQ ID NO: 2718266 - DNA, 22 bp, Homo sapiens
aggcctcccctgaggatcccct

SEQ ID NO: 2718267 - DNA, 18 bp, Homo sapiens
aggcctggcacagtgtct

SEQ ID NO: 2718268 - DNA, 23 bp, Homo sapiens
aggcctggcacagtgtctgggct

SEQ ID NO: 2718269 - DNA, 16 bp, Homo sapiens
aggcgcgtctgcccca

SEQ ID NO: 2718270 - DNA, 14 bp, Homo sapiens
aggctagagtgcag

SEQ ID NO: 2718271 - DNA, 17 bp, Homo sapiens
aggctagagtgcagtgg

SEQ ID NO: 2718272 - DNA, 23 bp, Homo sapiens
aggctagtctcttctcagagcag

SEQ ID NO: 2718273 - DNA, 16 bp, Homo sapiens
aggctcagtctcagga

SEQ ID NO: 2718274 - DNA, 19 bp, Homo sapiens
aggctcagtctcaggagca

SEQ ID NO: 2718275 - DNA, 19 bp, Homo sapiens
aggctccgtgagcccttgg

SEQ ID NO: 2718276 - DNA, 15 bp, Homo sapiens
aggctcctccctctg

SEQ ID NO: 2718277 - DNA, 19 bp, Homo sapiens
aggctcctccctctgcctc

SEQ ID NO: 2718278 - DNA, 21 bp, Homo sapiens
aggctcctccctctgcctcat

SEQ ID NO: 2718279 - DNA, 23 bp, Homo sapiens
aggctcctccctctgcctcatcc

SEQ ID NO: 2718280 - DNA, 16 bp, Homo sapiens
aggctgagactgcggg

SEQ ID NO: 2718281 - DNA, 21 bp, Homo sapiens
aggctgaggcgggtggatcac

SEQ ID NO: 2718282 - DNA, 15 bp, Homo sapiens
aggctgcagcgagct

SEQ ID NO: 2718283 - DNA, 17 bp, Homo sapiens
aggctgcgtcctgagga

SEQ ID NO: 2718284 - DNA, 19 bp, Homo sapiens
aggctggaaaagggctcag

SEQ ID NO: 2718285 - DNA, 21 bp, Homo sapiens
aggctggatggctcccctgag

SEQ ID NO: 2718286 - DNA, 18 bp, Homo sapiens
aggctggcatcctggctg

SEQ ID NO: 2718287 - DNA, 19 bp, Homo sapiens
aggctggccagccccacag

SEQ ID NO: 2718288 - DNA, 20 bp, Homo sapiens
aggctggccagccccacagc

SEQ ID NO: 2718289 - DNA, 17 bp, Homo sapiens
aggctggctggggccta

SEQ ID NO: 2718290 - DNA, 22 bp, Homo sapiens
aggctgggggcgggggagccaa

SEQ ID NO: 2718291 - DNA, 19 bp, Homo sapiens
aggctgggtccaggggagg

SEQ ID NO: 2718292 - DNA, 21 bp, Homo sapiens
aggctggtctcgaactcctga

SEQ ID NO: 2718293 - DNA, 13 bp, Homo sapiens
aggcttcagggga

SEQ ID NO: 2718294 - DNA, 13 bp, Homo sapiens
aggcttccttggc

SEQ ID NO: 2718295 - DNA, 17 bp, Homo sapiens
aggcttctcccggacct

SEQ ID NO: 2718296 - DNA, 19 bp, Homo sapiens
aggctttgccatgggcctg

SEQ ID NO: 2718297 - DNA, 21 bp, Homo sapiens
aggctttgccatgggcctgct

SEQ ID NO: 2718298 - DNA, 22 bp, Homo sapiens
aggctttggcaacagaaaacaa

SEQ ID NO: 2718299 - DNA, 13 bp, Homo sapiens
agggaagcaggga

SEQ ID NO: 2718300 - DNA, 12 bp, Homo sapiens
agggaagccctc

SEQ ID NO: 2718301 - DNA, 18 bp, Homo sapiens
agggaattcctagctgta

SEQ ID NO: 2718302 - DNA, 17 bp, Homo sapiens
agggacatgtctttggc

SEQ ID NO: 2718303 - DNA, 13 bp, Homo sapiens
agggaccacagca

SEQ ID NO: 2718304 - DNA, 14 bp, Homo sapiens
agggaccacagcaa

SEQ ID NO: 2718305 - DNA, 23 bp, Homo sapiens
agggaccacagcaaggcacctgc

SEQ ID NO: 2718306 - DNA, 16 bp, Homo sapiens
agggactgctgaccca

SEQ ID NO: 2718307 - DNA, 18 bp, Homo sapiens
agggagagatgagtgggt

SEQ ID NO: 2718308 - DNA, 13 bp, Homo sapiens
agggagataaaag

SEQ ID NO: 2718309 - DNA, 14 bp, Homo sapiens
agggagctgaggcc

SEQ ID NO: 2718310 - DNA, 16 bp, Homo sapiens
agggagctgaggcctc

SEQ ID NO: 2718311 - DNA, 17 bp, Homo sapiens
agggatgctgcctgagt

SEQ ID NO: 2718312 - DNA, 12 bp, Homo sapiens
agggatttgagg

SEQ ID NO: 2718313 - DNA, 22 bp, Homo sapiens
agggcaacaatacatgctgcta

SEQ ID NO: 2718314 - DNA, 23 bp, Homo sapiens
agggcatctctgagtgtctctgc

SEQ ID NO: 2718315 - DNA, 15 bp, Homo sapiens
agggccagggccctg

SEQ ID NO: 2718316 - DNA, 19 bp, Homo sapiens
agggccagggccctgcaga

SEQ ID NO: 2718317 - DNA, 22 bp, Homo sapiens
agggccagggccctgcagaggg

SEQ ID NO: 2718318 - DNA, 15 bp, Homo sapiens
agggccatctcctcc

SEQ ID NO: 2718319 - DNA, 15 bp, Homo sapiens
agggcccaggcaggc

SEQ ID NO: 2718320 - DNA, 18 bp, Homo sapiens
agggcctcggaggctcct

SEQ ID NO: 2718321 - DNA, 19 bp, Homo sapiens
agggcctcggaggctcctc

SEQ ID NO: 2718322 - DNA, 23 bp, Homo sapiens
agggcctcggaggctcctccctc

SEQ ID NO: 2718323 - DNA, 14 bp, Homo sapiens
agggcgctcctgtt

SEQ ID NO: 2718324 - DNA, 14 bp, Homo sapiens
agggctcagagctg

SEQ ID NO: 2718325 - DNA, 21 bp, Homo sapiens
agggctcagagctgctgagca

SEQ ID NO: 2718326 - DNA, 14 bp, Homo sapiens
atccaactcctcta

SEQ ID NO: 2718327 - DNA, 15 bp, Homo sapiens
atccaggcttctccc

SEQ ID NO: 2718328 - DNA, 16 bp, Homo sapiens
atccaggcttctcccg

SEQ ID NO: 2718329 - DNA, 22 bp, Homo sapiens
atccaggcttctcccggacctg

SEQ ID NO: 2718330 - DNA, 14 bp, Homo sapiens
atccagtagggaaa

SEQ ID NO: 2718331 - DNA, 14 bp, Homo sapiens
atccatttggcaga

SEQ ID NO: 2718332 - DNA, 19 bp, Homo sapiens
atcccactgattggccagc

SEQ ID NO: 2718333 - DNA, 12 bp, Homo sapiens
atcccagcatct

SEQ ID NO: 2718334 - DNA, 12 bp, Homo sapiens
atcccagctatt

SEQ ID NO: 2718335 - DNA, 19 bp, Homo sapiens
atcccccagcgcttagaaa

SEQ ID NO: 2718336 - DNA, 16 bp, Homo sapiens
atcccctgtcccctgg

SEQ ID NO: 2718337 - DNA, 21 bp, Homo sapiens
atcccctgtcccctggggctg

SEQ ID NO: 2718338 - DNA, 21 bp, Homo sapiens
atcctattttcataatttttc

SEQ ID NO: 2718339 - DNA, 15 bp, Homo sapiens
atcctccatttttgt

SEQ ID NO: 2718340 - DNA, 18 bp, Homo sapiens
atcctccccaccagagct

SEQ ID NO: 2718341 - DNA, 19 bp, Homo sapiens
atcctccccaccagagctg

SEQ ID NO: 2718342 - DNA, 13 bp, Homo sapiens
atcctcctcctca

SEQ ID NO: 2718343 - DNA, 18 bp, Homo sapiens
atcctcctctccatgcaa

SEQ ID NO: 2718344 - DNA, 19 bp, Homo sapiens
atcctcctctccatgcaag

SEQ ID NO: 2718345 - DNA, 21 bp, Homo sapiens
atcctgacacattttcaagtg

SEQ ID NO: 2718346 - DNA, 15 bp, Homo sapiens
atcctggctggctgt

SEQ ID NO: 2718347 - DNA, 18 bp, Homo sapiens
atcctggctggctgtgtc

SEQ ID NO: 2718348 - DNA, 20 bp, Homo sapiens
atcctgggcatgatgggccg

SEQ ID NO: 2718349 - DNA, 12 bp, Homo sapiens
atcctgggcccc

SEQ ID NO: 2718350 - DNA, 14 bp, Homo sapiens
atcctgggccccca

SEQ ID NO: 2718351 - DNA, 16 bp, Homo sapiens
atcctgggcccccaga

SEQ ID NO: 2718352 - DNA, 18 bp, Homo sapiens
atccttggagagcagctg

SEQ ID NO: 2718353 - DNA, 20 bp, Homo sapiens
atccttggagagcagctggc

SEQ ID NO: 2718354 - DNA, 24 bp, Homo sapiens
atccttggagagcagctggctctc

SEQ ID NO: 2718355 - DNA, 15 bp, Homo sapiens
atccttttctgcaga

SEQ ID NO: 2718356 - DNA, 14 bp, Homo sapiens
atcgatatgaaaaa

SEQ ID NO: 2718357 - DNA, 18 bp, Homo sapiens
atcgccttatttatattc

SEQ ID NO: 2718358 - DNA, 23 bp, Homo sapiens
atcgcgccactacactccagcct

SEQ ID NO: 2718359 - DNA, 13 bp, Homo sapiens
atctaaattgatc

SEQ ID NO: 2718360 - DNA, 14 bp, Homo sapiens
atctaagctgcagc

SEQ ID NO: 2718361 - DNA, 23 bp, Homo sapiens
atctattgtgttggctttacaaa

SEQ ID NO: 2718362 - DNA, 21 bp, Homo sapiens
atctcagcagccagctcctgg

SEQ ID NO: 2718363 - DNA, 14 bp, Homo sapiens
atctccctcccaca

SEQ ID NO: 2718364 - DNA, 16 bp, Homo sapiens
atctccctgaccttct

SEQ ID NO: 2718365 - DNA, 21 bp, Homo sapiens
atctccctgaccttctccagg

SEQ ID NO: 2718366 - DNA, 17 bp, Homo sapiens
atctcctcccatggcct

SEQ ID NO: 2718367 - DNA, 22 bp, Homo sapiens
atctcctcccatggccttccct

SEQ ID NO: 2718368 - DNA, 15 bp, Homo sapiens
atctcctttcaggga

SEQ ID NO: 2718369 - DNA, 13 bp, Homo sapiens
atctcgctagcca

SEQ ID NO: 2718370 - DNA, 15 bp, Homo sapiens
atctctaaactgctg

SEQ ID NO: 2718371 - DNA, 21 bp, Homo sapiens
atctctctactcctacctcag

SEQ ID NO: 2718372 - DNA, 23 bp, Homo sapiens
atctctctactcctacctcagcc

SEQ ID NO: 2718373 - DNA, 19 bp, Homo sapiens
atctctgagtgtctctgcc

SEQ ID NO: 2718374 - DNA, 18 bp, Homo sapiens
atctgcatgtaaaatctt

SEQ ID NO: 2718375 - DNA, 21 bp, Homo sapiens
atctgcatgtaaaatcttcag

SEQ ID NO: 2718376 - DNA, 23 bp, Homo sapiens
atctgcatgtaaaatcttcagct

SEQ ID NO: 2718377 - DNA, 13 bp, Homo sapiens
atctgcccaggac

SEQ ID NO: 2718378 - DNA, 22 bp, Homo sapiens
atctgtcaaagaaaacttccaa

SEQ ID NO: 2718379 - DNA, 16 bp, Homo sapiens
atctgtggaaatgaca

SEQ ID NO: 2718380 - DNA, 19 bp, Homo sapiens
atctgtggattcagcttct

SEQ ID NO: 2718381 - DNA, 13 bp, Homo sapiens
atctgttgtttga

SEQ ID NO: 2718382 - DNA, 14 bp, Homo sapiens
atctgtttgcttct

SEQ ID NO: 2718383 - DNA, 17 bp, Homo sapiens
atctgtttgcttctaaa

SEQ ID NO: 2718384 - DNA, 15 bp, Homo sapiens
atcttacctttatga

SEQ ID NO: 2718385 - DNA, 15 bp, Homo sapiens
atcttcacgcctggg

SEQ ID NO: 2718386 - DNA, 14 bp, Homo sapiens
atcttcagctggtg

SEQ ID NO: 2718387 - DNA, 23 bp, Homo sapiens
atcttccttaatcctattttcat

SEQ ID NO: 2718388 - DNA, 19 bp, Homo sapiens
atcttgctggcagggcctg

SEQ ID NO: 2718389 - DNA, 19 bp, Homo sapiens
atcttggtttggtacagtt

SEQ ID NO: 2718390 - DNA, 20 bp, Homo sapiens
atctttaaatacagtcaact

SEQ ID NO: 2718391 - DNA, 22 bp, Homo sapiens
atctttctttccaaaacatttc

SEQ ID NO: 2718392 - DNA, 16 bp, Homo sapiens
atctttgtctaaacaa

SEQ ID NO: 2718393 - DNA, 16 bp, Homo sapiens
atcttttaaaaatgat

SEQ ID NO: 2718394 - DNA, 20 bp, Homo sapiens
atgaaaaacacggcagctgt

SEQ ID NO: 2718395 - DNA, 12 bp, Homo sapiens
atgaaaagcaac

SEQ ID NO: 2718396 - DNA, 16 bp, Homo sapiens
atgaaagtgagacttt

SEQ ID NO: 2718397 - DNA, 20 bp, Homo sapiens
atgaaattgtctagcagagc

SEQ ID NO: 2718398 - DNA, 16 bp, Homo sapiens
atgaaccgtttacagt

SEQ ID NO: 2718399 - DNA, 21 bp, Homo sapiens
atgaagacaggacagtgcttc

SEQ ID NO: 2718400 - DNA, 17 bp, Homo sapiens
atgaagcaaacacacag

SEQ ID NO: 2718401 - DNA, 20 bp, Homo sapiens
atgaagcaatttatatcttt

SEQ ID NO: 2718402 - DNA, 14 bp, Homo sapiens
atgaagctgtataa

SEQ ID NO: 2718403 - DNA, 22 bp, Homo sapiens
atgaagggaaaattagctttta

SEQ ID NO: 2718404 - DNA, 22 bp, Homo sapiens
atgaatgaggaacaatcacaaa

SEQ ID NO: 2718405 - DNA, 18 bp, Homo sapiens
atgaattcacaaacaaat

SEQ ID NO: 2718406 - DNA, 22 bp, Homo sapiens
atgaattcacaaacaaatggct

SEQ ID NO: 2718407 - DNA, 21 bp, Homo sapiens
atgaatttggagactctgtgg

SEQ ID NO: 2718408 - DNA, 22 bp, Homo sapiens
atgacactctagtgacttcctg

SEQ ID NO: 2718409 - DNA, 18 bp, Homo sapiens
atgactgagtctggcaaa

SEQ ID NO: 2718410 - DNA, 17 bp, Homo sapiens
atgacttttccatgtat

SEQ ID NO: 2718411 - DNA, 17 bp, Homo sapiens
atgagaaaatgtcttta

SEQ ID NO: 2718412 - DNA, 22 bp, Homo sapiens
atgagaaactttgatctctgct

SEQ ID NO: 2718413 - DNA, 23 bp, Homo sapiens
atgagaagtactttgtgctgatc

SEQ ID NO: 2718414 - DNA, 18 bp, Homo sapiens
atgagagttccagattgt

SEQ ID NO: 2718415 - DNA, 13 bp, Homo sapiens
atgagccaccatg

SEQ ID NO: 2718416 - DNA, 17 bp, Homo sapiens
atgagcttgtaaatact

SEQ ID NO: 2718417 - DNA, 18 bp, Homo sapiens
atgaggaacaatcacaaa

SEQ ID NO: 2718418 - DNA, 21 bp, Homo sapiens
atgaggaacaatcacaaaagc

SEQ ID NO: 2718419 - DNA, 18 bp, Homo sapiens
atgatataataaatatat

SEQ ID NO: 2718420 - DNA, 14 bp, Homo sapiens
atgatgatgaaaac

SEQ ID NO: 2718421 - DNA, 21 bp, Homo sapiens
atgatgcatggagtgtttgac

SEQ ID NO: 2718422 - DNA, 24 bp, Homo sapiens
atgatgccacaccaagctgtgcca

SEQ ID NO: 2718423 - DNA, 17 bp, Homo sapiens
atgatggagcgcacctg

SEQ ID NO: 2718424 - DNA, 22 bp, Homo sapiens
atgattgaatttttaagcaaat

SEQ ID NO: 2718425 - DNA, 14 bp, Homo sapiens
atgattgcactaaa

SEQ ID NO: 2718426 - DNA, 15 bp, Homo sapiens
atgattgtttgcaca

SEQ ID NO: 2718427 - DNA, 17 bp, Homo sapiens
atgattgtttgcacaga

SEQ ID NO: 2718428 - DNA, 20 bp, Homo sapiens
atgatttagggaagcaggga

SEQ ID NO: 2718429 - DNA, 14 bp, Homo sapiens
atgattttcttttg

SEQ ID NO: 2718430 - DNA, 16 bp, Homo sapiens
atgatttttaaagaaa

SEQ ID NO: 2718431 - DNA, 16 bp, Homo sapiens
atgcaaaaacatatgt

SEQ ID NO: 2718432 - DNA, 23 bp, Homo sapiens
atgcaaaaacatatgtctgtctt

SEQ ID NO: 2718433 - DNA, 21 bp, Homo sapiens
atgcaaaataatacctgtcca

SEQ ID NO: 2718434 - DNA, 20 bp, Homo sapiens
atgcaagacttcactgcagc

SEQ ID NO: 2718435 - DNA, 21 bp, Homo sapiens
atgcaagacttcactgcagcc

SEQ ID NO: 2718436 - DNA, 22 bp, Homo sapiens
atgcaagacttcactgcagcct

SEQ ID NO: 2718437 - DNA, 16 bp, Homo sapiens
atgcaagggtgctgtg

SEQ ID NO: 2718438 - DNA, 20 bp, Homo sapiens
atgcaagtgggagatgaaaa

SEQ ID NO: 2718439 - DNA, 21 bp, Homo sapiens
atgcaagtgggagatgaaaac

SEQ ID NO: 2718440 - DNA, 22 bp, Homo sapiens
atgcaagtgggagatgaaaacc

SEQ ID NO: 2718441 - DNA, 14 bp, Homo sapiens
atgcacgttaacag

SEQ ID NO: 2718442 - DNA, 17 bp, Homo sapiens
atgcactctctctctgt

SEQ ID NO: 2718443 - DNA, 20 bp, Homo sapiens
atgcactctctctctgttaa

SEQ ID NO: 2718444 - DNA, 17 bp, Homo sapiens
atgcagaggaggagaaa

SEQ ID NO: 2718445 - DNA, 14 bp, Homo sapiens
atgcaggagagctt

SEQ ID NO: 2718446 - DNA, 22 bp, Homo sapiens
atgcatggagtgtttgacgaag

SEQ ID NO: 2718447 - DNA, 22 bp, Homo sapiens
atgcattcccggtgcagaacag

SEQ ID NO: 2718448 - DNA, 20 bp, Homo sapiens
atgccacaccaagctgtgcc

SEQ ID NO: 2718449 - DNA, 23 bp, Homo sapiens
cacaggggcaaagaactgcccca

SEQ ID NO: 2718450 - DNA, 15 bp, Homo sapiens
cacaggtcttgccca

SEQ ID NO: 2718451 - DNA, 20 bp, Homo sapiens
cacagtaatatgaaagccac

SEQ ID NO: 2718452 - DNA, 17 bp, Homo sapiens
cacagtcctcacagcct

SEQ ID NO: 2718453 - DNA, 17 bp, Homo sapiens
cacagtgtctgggctga

SEQ ID NO: 2718454 - DNA, 20 bp, Homo sapiens
cacagtgtctgggctgactg

SEQ ID NO: 2718455 - DNA, 21 bp, Homo sapiens
cacagtgtctgggctgactgg

SEQ ID NO: 2718456 - DNA, 13 bp, Homo sapiens
cacagtgtttcct

SEQ ID NO: 2718457 - DNA, 17 bp, Homo sapiens
cacagtgtttcctgagt

SEQ ID NO: 2718458 - DNA, 22 bp, Homo sapiens
cacataaaacgtatagtcaata

SEQ ID NO: 2718459 - DNA, 10 bp, Homo sapiens
cacataaagg

SEQ ID NO: 2718460 - DNA, 22 bp, Homo sapiens
cacatctaaattgatcattcat

SEQ ID NO: 2718461 - DNA, 13 bp, Homo sapiens
cacatgattttct

SEQ ID NO: 2718462 - DNA, 14 bp, Homo sapiens
cacatgattttctt

SEQ ID NO: 2718463 - DNA, 23 bp, Homo sapiens
cacatggctgggggagggactgc

SEQ ID NO: 2718464 - DNA, 18 bp, Homo sapiens
cacattatgttagagagg

SEQ ID NO: 2718465 - DNA, 14 bp, Homo sapiens
caccaaagacatca

SEQ ID NO: 2718466 - DNA, 13 bp, Homo sapiens
caccaacccagcc

SEQ ID NO: 2718467 - DNA, 17 bp, Homo sapiens
caccaacccagccgctg

SEQ ID NO: 2718468 - DNA, 20 bp, Homo sapiens
caccaacccagccgctgccc

SEQ ID NO: 2718469 - DNA, 19 bp, Homo sapiens
caccacattctgtctctgc

SEQ ID NO: 2718470 - DNA, 20 bp, Homo sapiens
caccacattctgtctctgct

SEQ ID NO: 2718471 - DNA, 21 bp, Homo sapiens
caccacattctgtctctgctt

SEQ ID NO: 2718472 - DNA, 21 bp, Homo sapiens
caccactagggtcctggccct

SEQ ID NO: 2718473 - DNA, 23 bp, Homo sapiens
caccactagggtcctggccctct

SEQ ID NO: 2718474 - DNA, 18 bp, Homo sapiens
caccagagcaggggctgc

SEQ ID NO: 2718475 - DNA, 12 bp, Homo sapiens
caccagagctgc

SEQ ID NO: 2718476 - DNA, 13 bp, Homo sapiens
caccagagctgcc

SEQ ID NO: 2718477 - DNA, 13 bp, Homo sapiens
caccagcggcctt

SEQ ID NO: 2718478 - DNA, 18 bp, Homo sapiens
caccagcggccttgaaga

SEQ ID NO: 2718479 - DNA, 12 bp, Homo sapiens
caccaggggcag

SEQ ID NO: 2718480 - DNA, 17 bp, Homo sapiens
caccaggggcaggcaca

SEQ ID NO: 2718481 - DNA, 18 bp, Homo sapiens
caccaggggcaggcacag

SEQ ID NO: 2718482 - DNA, 19 bp, Homo sapiens
caccaggggcaggcacagc

SEQ ID NO: 2718483 - DNA, 13 bp, Homo sapiens
caccagtgcctca

SEQ ID NO: 2718484 - DNA, 20 bp, Homo sapiens
caccagtgcctcagtgctgc

SEQ ID NO: 2718485 - DNA, 20 bp, Homo sapiens
caccagtgtcgtgtctgctg

SEQ ID NO: 2718486 - DNA, 11 bp, Homo sapiens
caccatgcaag

SEQ ID NO: 2718487 - DNA, 14 bp, Homo sapiens
caccattctttctt

SEQ ID NO: 2718488 - DNA, 19 bp, Homo sapiens
cacccaacctgtccttact

SEQ ID NO: 2718489 - DNA, 16 bp, Homo sapiens
cacccactggccagtc

SEQ ID NO: 2718490 - DNA, 21 bp, Homo sapiens
cacccagggctccctcctgga

SEQ ID NO: 2718491 - DNA, 24 bp, Homo sapiens
cacccagggctccctcctggagca

SEQ ID NO: 2718492 - DNA, 15 bp, Homo sapiens
cacccatgaagacag

SEQ ID NO: 2718493 - DNA, 10 bp, Homo sapiens
caccccagca

SEQ ID NO: 2718494 - DNA, 19 bp, Homo sapiens
caccccagcacagctcctc

SEQ ID NO: 2718495 - DNA, 21 bp, Homo sapiens
caccccatattgttcttcaaa

SEQ ID NO: 2718496 - DNA, 17 bp, Homo sapiens
cacccggaaagactgaa

SEQ ID NO: 2718497 - DNA, 13 bp, Homo sapiens
cacccgggctcag

SEQ ID NO: 2718498 - DNA, 22 bp, Homo sapiens
caccctccaaacactgggctct

SEQ ID NO: 2718499 - DNA, 13 bp, Homo sapiens
caccctcccctcc

SEQ ID NO: 2718500 - DNA, 15 bp, Homo sapiens
caccctcctggcaca

SEQ ID NO: 2718501 - DNA, 13 bp, Homo sapiens
caccctgcccctt

SEQ ID NO: 2718502 - DNA, 15 bp, Homo sapiens
caccctgcctgctgt

SEQ ID NO: 2718503 - DNA, 22 bp, Homo sapiens
caccctgcctgctgtggagccc

SEQ ID NO: 2718504 - DNA, 11 bp, Homo sapiens
caccctggaat

SEQ ID NO: 2718505 - DNA, 22 bp, Homo sapiens
caccctggaatacgatcctgca

SEQ ID NO: 2718506 - DNA, 15 bp, Homo sapiens
caccctgggctctgt

SEQ ID NO: 2718507 - DNA, 21 bp, Homo sapiens
caccctgggctctgtgggctg

SEQ ID NO: 2718508 - DNA, 20 bp, Homo sapiens
caccctgggtttggcccctg

SEQ ID NO: 2718509 - DNA, 14 bp, Homo sapiens
cacccttggacttg

SEQ ID NO: 2718510 - DNA, 22 bp, Homo sapiens
caccgagaggaaaaaggcttct

SEQ ID NO: 2718511 - DNA, 12 bp, Homo sapiens
caccgcagctgc

SEQ ID NO: 2718512 - DNA, 15 bp, Homo sapiens
caccgcagctgctgc

SEQ ID NO: 2718513 - DNA, 17 bp, Homo sapiens
caccgcagctgctgcca

SEQ ID NO: 2718514 - DNA, 22 bp, Homo sapiens
caccgcagctgctgccactctg

SEQ ID NO: 2718515 - DNA, 14 bp, Homo sapiens
caccgcatgccccc

SEQ ID NO: 2718516 - DNA, 22 bp, Homo sapiens
caccgcatgccccctcgtgcca

SEQ ID NO: 2718517 - DNA, 16 bp, Homo sapiens
caccgccatggcttcc

SEQ ID NO: 2718518 - DNA, 16 bp, Homo sapiens
cacctagtggctgtcc

SEQ ID NO: 2718519 - DNA, 21 bp, Homo sapiens
cacctagtggctgtccagtgc

SEQ ID NO: 2718520 - DNA, 23 bp, Homo sapiens
cacctagtggctgtccagtgccc

SEQ ID NO: 2718521 - DNA, 20 bp, Homo sapiens
cacctatggcccagccactg

SEQ ID NO: 2718522 - DNA, 16 bp, Homo sapiens
cacctcacgctctgga

SEQ ID NO: 2718523 - DNA, 18 bp, Homo sapiens
cacctcacgctctggaca

SEQ ID NO: 2718524 - DNA, 18 bp, Homo sapiens
cacctgcaggttgggcca

SEQ ID NO: 2718525 - DNA, 20 bp, Homo sapiens
cacctgccagcctggcttct

SEQ ID NO: 2718526 - DNA, 22 bp, Homo sapiens
cacctgccatttgcaccctccg

SEQ ID NO: 2718527 - DNA, 14 bp, Homo sapiens
cacctgccccctgg

SEQ ID NO: 2718528 - DNA, 20 bp, Homo sapiens
cacctgcctagctcttgggc

SEQ ID NO: 2718529 - DNA, 22 bp, Homo sapiens
cacctgctggaaaccacacttc

SEQ ID NO: 2718530 - DNA, 18 bp, Homo sapiens
cacctggccccttctcca

SEQ ID NO: 2718531 - DNA, 24 bp, Homo sapiens
cacctggccccttctccagcaagc

SEQ ID NO: 2718532 - DNA, 23 bp, Homo sapiens
cacctgtactcaggaggctgagg

SEQ ID NO: 2718533 - DNA, 18 bp, Homo sapiens
caccttcaattcctgggc

SEQ ID NO: 2718534 - DNA, 20 bp, Homo sapiens
cacctttgggatcagcctcc

SEQ ID NO: 2718535 - DNA, 12 bp, Homo sapiens
cacgactcttcc

SEQ ID NO: 2718536 - DNA, 20 bp, Homo sapiens
cacgcatgcctcagccagcc

SEQ ID NO: 2718537 - DNA, 18 bp, Homo sapiens
cacgcctatgatcccagc

SEQ ID NO: 2718538 - DNA, 17 bp, Homo sapiens
cacgcttattgcccagg

SEQ ID NO: 2718539 - DNA, 13 bp, Homo sapiens
cacggcactccag

SEQ ID NO: 2718540 - DNA, 19 bp, Homo sapiens
cacggcactccagcctggg

SEQ ID NO: 2718541 - DNA, 20 bp, Homo sapiens
cacggcactccagcctgggc

SEQ ID NO: 2718542 - DNA, 15 bp, Homo sapiens
cacgtaccaagccac

SEQ ID NO: 2718543 - DNA, 23 bp, Homo sapiens
cacgtaccaagccaccgcagctg

SEQ ID NO: 2718544 - DNA, 16 bp, Homo sapiens
cacgtcaccctcctga

SEQ ID NO: 2718545 - DNA, 19 bp, Homo sapiens
cacgtcaccctcctgagcc

SEQ ID NO: 2718546 - DNA, 22 bp, Homo sapiens
cacgtcaccctcctgagcctca

SEQ ID NO: 2718547 - DNA, 16 bp, Homo sapiens
cacgtccagaattttt

SEQ ID NO: 2718548 - DNA, 16 bp, Homo sapiens
cacgtctctctgcctg

SEQ ID NO: 2718549 - DNA, 17 bp, Homo sapiens
cacgtctctctgcctgc

SEQ ID NO: 2718550 - DNA, 19 bp, Homo sapiens
cacgtctctctgcctgctg

SEQ ID NO: 2718551 - DNA, 22 bp, Homo sapiens
cacgtctctctgcctgctgggc

SEQ ID NO: 2718552 - DNA, 23 bp, Homo sapiens
cacgtctctctgcctgctgggct

SEQ ID NO: 2718553 - DNA, 14 bp, Homo sapiens
cacgtctgtgctct

SEQ ID NO: 2718554 - DNA, 15 bp, Homo sapiens
cacgtctgtgctctg

SEQ ID NO: 2718555 - DNA, 15 bp, Homo sapiens
cacgtgaccagcccc

SEQ ID NO: 2718556 - DNA, 12 bp, Homo sapiens
cacgtgcacagc

SEQ ID NO: 2718557 - DNA, 14 bp, Homo sapiens
cacgtgtatgcaag

SEQ ID NO: 2718558 - DNA, 15 bp, Homo sapiens
cacgttttctggctt

SEQ ID NO: 2718559 - DNA, 17 bp, Homo sapiens
cactaaaatgtttaatt

SEQ ID NO: 2718560 - DNA, 18 bp, Homo sapiens
cactaaataaactacttt

SEQ ID NO: 2718561 - DNA, 20 bp, Homo sapiens
cactaaattagtttaaaatg

SEQ ID NO: 2718562 - DNA, 20 bp, Homo sapiens
cactaagtcatggtcctggc

SEQ ID NO: 2718563 - DNA, 22 bp, Homo sapiens
cactaagtcatggtcctggctg

SEQ ID NO: 2718564 - DNA, 12 bp, Homo sapiens
cactacaaacat

SEQ ID NO: 2718565 - DNA, 19 bp, Homo sapiens
cactacactccagcctgag

SEQ ID NO: 2718566 - DNA, 20 bp, Homo sapiens
cactacactccagcctgagc

SEQ ID NO: 2718567 - DNA, 14 bp, Homo sapiens
cactacctttgtcc

SEQ ID NO: 2718568 - DNA, 17 bp, Homo sapiens
cactagcattttcttga

SEQ ID NO: 2718569 - DNA, 16 bp, Homo sapiens
cactaggactctgagg

SEQ ID NO: 2718570 - DNA, 13 bp, Homo sapiens
cactcactgccaa

SEQ ID NO: 2718571 - DNA, 22 bp, Homo sapiens
cactcagagggaggagtttttc

SEQ ID NO: 2718572 - DNA, 12 bp, Homo sapiens
cactcagcagcc

SEQ ID NO: 2718573 - DNA, 13 bp, Homo sapiens
cactcagcagccc

SEQ ID NO: 2718574 - DNA, 23 bp, Homo sapiens
cactcaggtagggagctaaggaa

SEQ ID NO: 2718575 - DNA, 17 bp, Homo sapiens
cactccacctccaccca

SEQ ID NO: 2718576 - DNA, 23 bp, Homo sapiens
cactccagaattacccttcctca

SEQ ID NO: 2718577 - DNA, 15 bp, Homo sapiens
cactccagcctgagc

SEQ ID NO: 2718578 - DNA, 21 bp, Homo sapiens
cactccagcctgggcgacaga

SEQ ID NO: 2718579 - DNA, 13 bp, Homo sapiens
cactcccacttcc

SEQ ID NO: 2718580 - DNA, 14 bp, Homo sapiens
cactcccacttccc

SEQ ID NO: 2718581 - DNA, 14 bp, Homo sapiens
cactccccaccttc

SEQ ID NO: 2718582 - DNA, 15 bp, Homo sapiens
cactccccaccttca

SEQ ID NO: 2718583 - DNA, 14 bp, Homo sapiens
cactccccagtgct

SEQ ID NO: 2718584 - DNA, 20 bp, Homo sapiens
cactccccagtgctcctgtg

SEQ ID NO: 2718585 - DNA, 21 bp, Homo sapiens
cactccggtgtgcctgcagcc

SEQ ID NO: 2718586 - DNA, 21 bp, Homo sapiens
cactcctcctgccagctctgt

SEQ ID NO: 2718587 - DNA, 13 bp, Homo sapiens
cactccttcccct

SEQ ID NO: 2718588 - DNA, 14 bp, Homo sapiens
cactccttcccctt

SEQ ID NO: 2718589 - DNA, 21 bp, Homo sapiens
cactccttccccttgtccctg

SEQ ID NO: 2718590 - DNA, 22 bp, Homo sapiens
cactccttccccttgtccctgg

SEQ ID NO: 2718591 - DNA, 22 bp, Homo sapiens
cactctagtgacttcctggtga

SEQ ID NO: 2718592 - DNA, 14 bp, Homo sapiens
cactctgctgcctg

SEQ ID NO: 2718593 - DNA, 14 bp, Homo sapiens
cactctgtgcccat

SEQ ID NO: 2718594 - DNA, 18 bp, Homo sapiens
cactctgtgcccatgggc

SEQ ID NO: 2718595 - DNA, 14 bp, Homo sapiens
cactctttgctaca

SEQ ID NO: 2718596 - DNA, 17 bp, Homo sapiens
cactctttgctacaata

SEQ ID NO: 2718597 - DNA, 19 bp, Homo sapiens
cactctttgctacaataaa

SEQ ID NO: 2718598 - DNA, 21 bp, Homo sapiens
cactctttgctacaataaatg

SEQ ID NO: 2718599 - DNA, 14 bp, Homo sapiens
cactgaattgcttg

SEQ ID NO: 2718600 - DNA, 16 bp, Homo sapiens
cactgcaagctctgcc

SEQ ID NO: 2718601 - DNA, 17 bp, Homo sapiens
cactgcaagctctgcct

SEQ ID NO: 2718602 - DNA, 16 bp, Homo sapiens
cactgcaccccctcct

SEQ ID NO: 2718603 - DNA, 20 bp, Homo sapiens
cactgcaccccctcctgctg

SEQ ID NO: 2718604 - DNA, 21 bp, Homo sapiens
cactgcaccccctcctgctgc

SEQ ID NO: 2718605 - DNA, 13 bp, Homo sapiens
cactgcagcacag

SEQ ID NO: 2718606 - DNA, 13 bp, Homo sapiens
cactgcccaggga

SEQ ID NO: 2718607 - DNA, 16 bp, Homo sapiens
cactgccgatgcccaa

SEQ ID NO: 2718608 - DNA, 21 bp, Homo sapiens
cactgcggggcttggctgaga

SEQ ID NO: 2718609 - DNA, 12 bp, Homo sapiens
cactgctctgcc

SEQ ID NO: 2718610 - DNA, 16 bp, Homo sapiens
cactgctctgccccca

SEQ ID NO: 2718611 - DNA, 20 bp, Homo sapiens
cactgctgggtggcccatcc

SEQ ID NO: 2718612 - DNA, 22 bp, Homo sapiens
cactgctgggtggcccatcccc

SEQ ID NO: 2718613 - DNA, 12 bp, Homo sapiens
cactggccagtc

SEQ ID NO: 2718614 - DNA, 19 bp, Homo sapiens
cactggccagtcctagagc

SEQ ID NO: 2718615 - DNA, 14 bp, Homo sapiens
cactggctgcctcc

SEQ ID NO: 2718616 - DNA, 15 bp, Homo sapiens
cactggctgcctcca

SEQ ID NO: 2718617 - DNA, 17 bp, Homo sapiens
cactggctgcctccact

SEQ ID NO: 2718618 - DNA, 19 bp, Homo sapiens
cactggctgcctccactcc

SEQ ID NO: 2718619 - DNA, 20 bp, Homo sapiens
cactggctgcctccactccc

SEQ ID NO: 2718620 - DNA, 21 bp, Homo sapiens
cactggctgcctccactccca

SEQ ID NO: 2718621 - DNA, 16 bp, Homo sapiens
cactgggctctgagga

SEQ ID NO: 2718622 - DNA, 20 bp, Homo sapiens
cactggggtttgggggcttc

SEQ ID NO: 2718623 - DNA, 18 bp, Homo sapiens
cactgtatgctggacggc

SEQ ID NO: 2718624 - DNA, 17 bp, Homo sapiens
cactgtccgcctctgcc

SEQ ID NO: 2718625 - DNA, 11 bp, Homo sapiens
cactgtcctgc

SEQ ID NO: 2718626 - DNA, 13 bp, Homo sapiens
cactgtcctgctc

SEQ ID NO: 2718627 - DNA, 17 bp, Homo sapiens
cactgtttcatgagccc

SEQ ID NO: 2718628 - DNA, 18 bp, Homo sapiens
cactgtttcatgagccca

SEQ ID NO: 2718629 - DNA, 13 bp, Homo sapiens
cacttaaaatcaa

SEQ ID NO: 2718630 - DNA, 22 bp, Homo sapiens
cacttaaaatcaaatttttctg

SEQ ID NO: 2718631 - DNA, 21 bp, Homo sapiens
cacttcccctcctacccctcc

SEQ ID NO: 2718632 - DNA, 15 bp, Homo sapiens
cacttccctgacact

SEQ ID NO: 2718633 - DNA, 21 bp, Homo sapiens
cacttctcacatcttatgcta

SEQ ID NO: 2718634 - DNA, 15 bp, Homo sapiens
cacttcttgaaacag

SEQ ID NO: 2718635 - DNA, 19 bp, Homo sapiens
cacttcttgaaacagcctg

SEQ ID NO: 2718636 - DNA, 21 bp, Homo sapiens
cactttgaaggtaataaatac

SEQ ID NO: 2718637 - DNA, 13 bp, Homo sapiens
cacttttaaaact

SEQ ID NO: 2718638 - DNA, 16 bp, Homo sapiens
cactttttttttttct

SEQ ID NO: 2718639 - DNA, 18 bp, Homo sapiens
cagaaaacaattgttctg

SEQ ID NO: 2718640 - DNA, 20 bp, Homo sapiens
cagaaactcgatgaatgtgt

SEQ ID NO: 2718641 - DNA, 14 bp, Homo sapiens
cagaaatagctatg

SEQ ID NO: 2718642 - DNA, 22 bp, Homo sapiens
cagaactaggagtcttcactgc

SEQ ID NO: 2718643 - DNA, 18 bp, Homo sapiens
cagaactgctggggctgg

SEQ ID NO: 2718644 - DNA, 21 bp, Homo sapiens
cagaactggacgcccagctga

SEQ ID NO: 2718645 - DNA, 17 bp, Homo sapiens
cagaagatgtttaaaaa

SEQ ID NO: 2718646 - DNA, 13 bp, Homo sapiens
cagaagcaggagt

SEQ ID NO: 2718647 - DNA, 20 bp, Homo sapiens
cagaaggctgggtccagggg

SEQ ID NO: 2718648 - DNA, 16 bp, Homo sapiens
cagaagtaactcccac

SEQ ID NO: 2718649 - DNA, 23 bp, Homo sapiens
cagaatcctgggcccccagagac

SEQ ID NO: 2718650 - DNA, 22 bp, Homo sapiens
cagaatgcacattggaagctcc

SEQ ID NO: 2718651 - DNA, 13 bp, Homo sapiens
cagaatgtgctgc

SEQ ID NO: 2718652 - DNA, 17 bp, Homo sapiens
cagaatgtgctgccttt

SEQ ID NO: 2718653 - DNA, 16 bp, Homo sapiens
cagaattacccttcct

SEQ ID NO: 2718654 - DNA, 18 bp, Homo sapiens
cagaattacccttcctca

SEQ ID NO: 2718655 - DNA, 21 bp, Homo sapiens
cagaattacccttcctcatct

SEQ ID NO: 2718656 - DNA, 16 bp, Homo sapiens
cagaattgaaggagaa

SEQ ID NO: 2718657 - DNA, 23 bp, Homo sapiens
cagaattgcttgaacccaggagg

SEQ ID NO: 2718658 - DNA, 14 bp, Homo sapiens
cagaattttggaaa

SEQ ID NO: 2718659 - DNA, 19 bp, Homo sapiens
cagaattttggaaaaatgt

SEQ ID NO: 2718660 - DNA, 12 bp, Homo sapiens
cagacagctgga

SEQ ID NO: 2718661 - DNA, 17 bp, Homo sapiens
cagaccagtactgggaa

SEQ ID NO: 2718662 - DNA, 15 bp, Homo sapiens
cagaccattgtcttc

SEQ ID NO: 2718663 - DNA, 21 bp, Homo sapiens
cagaccattgtcttccaaccc

SEQ ID NO: 2718664 - DNA, 24 bp, Homo sapiens
cagaccattgtcttccaaccccag

SEQ ID NO: 2718665 - DNA, 22 bp, Homo sapiens
cagacctctgaatgtcccagag

SEQ ID NO: 2718666 - DNA, 20 bp, Homo sapiens
cagactcttccaccagagca

SEQ ID NO: 2718667 - DNA, 18 bp, Homo sapiens
cagactgcatgtagttgg

SEQ ID NO: 2718668 - DNA, 19 bp, Homo sapiens
cagactgcggagcagcctc

SEQ ID NO: 2718669 - DNA, 15 bp, Homo sapiens
cagactgctgggact

SEQ ID NO: 2718670 - DNA, 16 bp, Homo sapiens
cagactgctgggactg

SEQ ID NO: 2718671 - DNA, 16 bp, Homo sapiens
cagactggctggctgc

SEQ ID NO: 2718672 - DNA, 15 bp, Homo sapiens
cagagaaattctgtg

SEQ ID NO: 2718673 - DNA, 13 bp, Homo sapiens
cagagacctttgc

SEQ ID NO: 2718674 - DNA, 19 bp, Homo sapiens
cagagacctttgcccacac

SEQ ID NO: 2718675 - DNA, 14 bp, Homo sapiens
cagagagcatcttt

SEQ ID NO: 2718676 - DNA, 14 bp, Homo sapiens
cagagcaggggcag

SEQ ID NO: 2718677 - DNA, 13 bp, Homo sapiens
cagagcaggggct

SEQ ID NO: 2718678 - DNA, 23 bp, Homo sapiens
cagagcaggggctgctgggggct

SEQ ID NO: 2718679 - DNA, 13 bp, Homo sapiens
cagagccagaggc

SEQ ID NO: 2718680 - DNA, 12 bp, Homo sapiens
cagagcctcagc

SEQ ID NO: 2718681 - DNA, 13 bp, Homo sapiens
cagagcctcagct

SEQ ID NO: 2718682 - DNA, 20 bp, Homo sapiens
cagagcgaggaaaggatttt

SEQ ID NO: 2718683 - DNA, 19 bp, Homo sapiens
cagagctgcctccccaatc

SEQ ID NO: 2718684 - DNA, 20 bp, Homo sapiens
cagagctgcctccccaatcc

SEQ ID NO: 2718685 - DNA, 13 bp, Homo sapiens
cagagctgcgggc

SEQ ID NO: 2718686 - DNA, 24 bp, Homo sapiens
cagagctgcgggctgagggcatct

SEQ ID NO: 2718687 - DNA, 24 bp, Homo sapiens
cagagcttttcgaactgtgctccc

SEQ ID NO: 2718688 - DNA, 16 bp, Homo sapiens
cagaggggcaggccct

SEQ ID NO: 2718689 - DNA, 17 bp, Homo sapiens
cagaggtgagcagagga

SEQ ID NO: 2718690 - DNA, 18 bp, Homo sapiens
cagaggtgagcagaggag

SEQ ID NO: 2718691 - DNA, 22 bp, Homo sapiens
cagaggtgagcagaggagtcca

SEQ ID NO: 2718692 - DNA, 15 bp, Homo sapiens
cagaggtttggagcc

SEQ ID NO: 2718693 - DNA, 19 bp, Homo sapiens
cagagtgagaccctgtctc

SEQ ID NO: 2718694 - DNA, 17 bp, Homo sapiens
cagagttggtgttcata

SEQ ID NO: 2718695 - DNA, 17 bp, Homo sapiens
cagatagtgcctctgca

SEQ ID NO: 2718696 - DNA, 18 bp, Homo sapiens
catgatttagggaagcag

SEQ ID NO: 2718697 - DNA, 21 bp, Homo sapiens
catgatttagggaagcaggga

SEQ ID NO: 2718698 - DNA, 12 bp, Homo sapiens
catgattttctt

SEQ ID NO: 2718699 - DNA, 18 bp, Homo sapiens
catgcaagacttcactgc

SEQ ID NO: 2718700 - DNA, 14 bp, Homo sapiens
catgcaagtgctgt

SEQ ID NO: 2718701 - DNA, 18 bp, Homo sapiens
catgcattctagtgcaga

SEQ ID NO: 2718702 - DNA, 20 bp, Homo sapiens
catgccgcggtaggtaaggg

SEQ ID NO: 2718703 - DNA, 19 bp, Homo sapiens
catgcctcagccagccctg

SEQ ID NO: 2718704 - DNA, 22 bp, Homo sapiens
catgcctcagccagccctggag

SEQ ID NO: 2718705 - DNA, 17 bp, Homo sapiens
catgccttcataaatta

SEQ ID NO: 2718706 - DNA, 16 bp, Homo sapiens
catgctggcggcgcag

SEQ ID NO: 2718707 - DNA, 16 bp, Homo sapiens
catgctggtgtggcca

SEQ ID NO: 2718708 - DNA, 20 bp, Homo sapiens
catgctggtgtggccaaggc

SEQ ID NO: 2718709 - DNA, 15 bp, Homo sapiens
catgctttctccttt

SEQ ID NO: 2718710 - DNA, 16 bp, Homo sapiens
catgctttctcctttt

SEQ ID NO: 2718711 - DNA, 22 bp, Homo sapiens
catggattccaaagcattttca

SEQ ID NO: 2718712 - DNA, 12 bp, Homo sapiens
catggcagctgg

SEQ ID NO: 2718713 - DNA, 14 bp, Homo sapiens
catggcagctgggc

SEQ ID NO: 2718714 - DNA, 19 bp, Homo sapiens
catggcagctgggcccaca

SEQ ID NO: 2718715 - DNA, 20 bp, Homo sapiens
catggcagctgggcccacag

SEQ ID NO: 2718716 - DNA, 22 bp, Homo sapiens
catggccacttgggtcttccct

SEQ ID NO: 2718717 - DNA, 12 bp, Homo sapiens
catggccttccc

SEQ ID NO: 2718718 - DNA, 13 bp, Homo sapiens
catggctggggga

SEQ ID NO: 2718719 - DNA, 17 bp, Homo sapiens
catgggactgtgccttt

SEQ ID NO: 2718720 - DNA, 17 bp, Homo sapiens
catgggcactgctgggt

SEQ ID NO: 2718721 - DNA, 15 bp, Homo sapiens
catgggcctgctgcg

SEQ ID NO: 2718722 - DNA, 21 bp, Homo sapiens
catgggcgaccagggccatct

SEQ ID NO: 2718723 - DNA, 14 bp, Homo sapiens
catggtcctggctg

SEQ ID NO: 2718724 - DNA, 15 bp, Homo sapiens
catggtcctggctgg

SEQ ID NO: 2718725 - DNA, 23 bp, Homo sapiens
catggtgtgaaagtcagatgccc

SEQ ID NO: 2718726 - DNA, 17 bp, Homo sapiens
catggtgtgtgtctctg

SEQ ID NO: 2718727 - DNA, 21 bp, Homo sapiens
catgtaaaatcttcagctggt

SEQ ID NO: 2718728 - DNA, 14 bp, Homo sapiens
catgtaatcagttt

SEQ ID NO: 2718729 - DNA, 16 bp, Homo sapiens
catgtatcactcactg

SEQ ID NO: 2718730 - DNA, 16 bp, Homo sapiens
catgtatgtggataca

SEQ ID NO: 2718731 - DNA, 22 bp, Homo sapiens
catgtatgtggatacagtcatt

SEQ ID NO: 2718732 - DNA, 22 bp, Homo sapiens
catgtctttggcttcagaattg

SEQ ID NO: 2718733 - DNA, 15 bp, Homo sapiens
catgtgcaactcttg

SEQ ID NO: 2718734 - DNA, 16 bp, Homo sapiens
catgtgcaactcttgt

SEQ ID NO: 2718735 - DNA, 18 bp, Homo sapiens
catgtgcaactcttgtat

SEQ ID NO: 2718736 - DNA, 19 bp, Homo sapiens
catgtgcacctatggccca

SEQ ID NO: 2718737 - DNA, 23 bp, Homo sapiens
catgtggcattctctctgctcag

SEQ ID NO: 2718738 - DNA, 21 bp, Homo sapiens
cattaagcgggatcccagcat

SEQ ID NO: 2718739 - DNA, 14 bp, Homo sapiens
cattacatggctgt

SEQ ID NO: 2718740 - DNA, 17 bp, Homo sapiens
cattaccacttccctgc

SEQ ID NO: 2718741 - DNA, 15 bp, Homo sapiens
cattatcttcatgtt

SEQ ID NO: 2718742 - DNA, 22 bp, Homo sapiens
cattatgttattggaattttct

SEQ ID NO: 2718743 - DNA, 13 bp, Homo sapiens
cattattttacag

SEQ ID NO: 2718744 - DNA, 15 bp, Homo sapiens
cattattttacagtc

SEQ ID NO: 2718745 - DNA, 16 bp, Homo sapiens
cattattttattttat

SEQ ID NO: 2718746 - DNA, 19 bp, Homo sapiens
cattattttattttatagt

SEQ ID NO: 2718747 - DNA, 16 bp, Homo sapiens
cattcaaaatgtccag

SEQ ID NO: 2718748 - DNA, 19 bp, Homo sapiens
cattcacagcgcctcctgg

SEQ ID NO: 2718749 - DNA, 22 bp, Homo sapiens
cattcacagcgcctcctggacc

SEQ ID NO: 2718750 - DNA, 13 bp, Homo sapiens
cattcacatttca

SEQ ID NO: 2718751 - DNA, 15 bp, Homo sapiens
cattcatctggaggc

SEQ ID NO: 2718752 - DNA, 16 bp, Homo sapiens
cattcatgttttaaaa

SEQ ID NO: 2718753 - DNA, 20 bp, Homo sapiens
cattcccactaagctttctc

SEQ ID NO: 2718754 - DNA, 23 bp, Homo sapiens
cattcccactaagctttctcctt

SEQ ID NO: 2718755 - DNA, 19 bp, Homo sapiens
cattccctcgggaccctcc

SEQ ID NO: 2718756 - DNA, 22 bp, Homo sapiens
cattccctcgggaccctcccag

SEQ ID NO: 2718757 - DNA, 13 bp, Homo sapiens
cattcctcacctt

SEQ ID NO: 2718758 - DNA, 18 bp, Homo sapiens
cattcgaggtgtcaccct

SEQ ID NO: 2718759 - DNA, 23 bp, Homo sapiens
cattcgaggtgtcaccctgcaga

SEQ ID NO: 2718760 - DNA, 13 bp, Homo sapiens
cattctgagctgg

SEQ ID NO: 2718761 - DNA, 15 bp, Homo sapiens
cattctgtctctgct

SEQ ID NO: 2718762 - DNA, 17 bp, Homo sapiens
cattctttcttggtgca

SEQ ID NO: 2718763 - DNA, 12 bp, Homo sapiens
cattgaaagctc

SEQ ID NO: 2718764 - DNA, 22 bp, Homo sapiens
cattgatgaatgaggaacaatc

SEQ ID NO: 2718765 - DNA, 13 bp, Homo sapiens
cattgcaatagaa

SEQ ID NO: 2718766 - DNA, 15 bp, Homo sapiens
cattgcaatagaaat

SEQ ID NO: 2718767 - DNA, 15 bp, Homo sapiens
cattggaagctccca

SEQ ID NO: 2718768 - DNA, 18 bp, Homo sapiens
cattggacccacatgagg

SEQ ID NO: 2718769 - DNA, 20 bp, Homo sapiens
cattggcagcaggtgctgct

SEQ ID NO: 2718770 - DNA, 12 bp, Homo sapiens
cattgtcttcca

SEQ ID NO: 2718771 - DNA, 13 bp, Homo sapiens
cattgtcttccaa

SEQ ID NO: 2718772 - DNA, 18 bp, Homo sapiens
cattgtcttccaacccca

SEQ ID NO: 2718773 - DNA, 22 bp, Homo sapiens
cattgtcttccaaccccagctg

SEQ ID NO: 2718774 - DNA, 19 bp, Homo sapiens
catttaactagcactttat

SEQ ID NO: 2718775 - DNA, 16 bp, Homo sapiens
catttaggagaagttg

SEQ ID NO: 2718776 - DNA, 18 bp, Homo sapiens
catttaggagaagttggt

SEQ ID NO: 2718777 - DNA, 17 bp, Homo sapiens
catttcaagatccaaat

SEQ ID NO: 2718778 - DNA, 14 bp, Homo sapiens
catttgacaacaca

SEQ ID NO: 2718779 - DNA, 18 bp, Homo sapiens
catttgacaacacatgtg

SEQ ID NO: 2718780 - DNA, 14 bp, Homo sapiens
catttgccagattg

SEQ ID NO: 2718781 - DNA, 19 bp, Homo sapiens
catttgcctaattcctggc

SEQ ID NO: 2718782 - DNA, 22 bp, Homo sapiens
catttggcagaactgctggggc

SEQ ID NO: 2718783 - DNA, 21 bp, Homo sapiens
catttggtgagagtcaaagct

SEQ ID NO: 2718784 - DNA, 22 bp, Homo sapiens
catttggtgagagtcaaagctg

SEQ ID NO: 2718785 - DNA, 20 bp, Homo sapiens
cattttatataaagaaaatc

SEQ ID NO: 2718786 - DNA, 22 bp, Homo sapiens
cattttcagcatcaaacatgaa

SEQ ID NO: 2718787 - DNA, 14 bp, Homo sapiens
cattttcttgtcaa

SEQ ID NO: 2718788 - DNA, 19 bp, Homo sapiens
cattttgaaaacccctggc

SEQ ID NO: 2718789 - DNA, 23 bp, Homo sapiens
cattttgaaaacccctggctgaa

SEQ ID NO: 2718790 - DNA, 20 bp, Homo sapiens
cattttgaatgtgatcatct

SEQ ID NO: 2718791 - DNA, 15 bp, Homo sapiens
catttttgtacatta

SEQ ID NO: 2718792 - DNA, 13 bp, Homo sapiens
ccaaaacatttct

SEQ ID NO: 2718793 - DNA, 18 bp, Homo sapiens
ccaaaacatttctggaca

SEQ ID NO: 2718794 - DNA, 22 bp, Homo sapiens
ccaaaagctagaggagattgct

SEQ ID NO: 2718795 - DNA, 18 bp, Homo sapiens
ccaaatgcattcatgttt

SEQ ID NO: 2718796 - DNA, 14 bp, Homo sapiens
ccaaattaatcttt

SEQ ID NO: 2718797 - DNA, 17 bp, Homo sapiens
ccaaattaatcttttaa

SEQ ID NO: 2718798 - DNA, 19 bp, Homo sapiens
ccaaattaatcttttaaaa

SEQ ID NO: 2718799 - DNA, 22 bp, Homo sapiens
ccaaattgtctgtctgctctta

SEQ ID NO: 2718800 - DNA, 22 bp, Homo sapiens
ccaaattttattaaaagagtag

SEQ ID NO: 2718801 - DNA, 16 bp, Homo sapiens
ccaacaataaagagct

SEQ ID NO: 2718802 - DNA, 17 bp, Homo sapiens
ccaacaataaagagctc

SEQ ID NO: 2718803 - DNA, 20 bp, Homo sapiens
ccaacagtgttaggcctggc

SEQ ID NO: 2718804 - DNA, 23 bp, Homo sapiens
ccaacagtgttaggcctggcaca

SEQ ID NO: 2718805 - DNA, 16 bp, Homo sapiens
ccaacatctccctccc

SEQ ID NO: 2718806 - DNA, 19 bp, Homo sapiens
ccaacccagccgctgcccg

SEQ ID NO: 2718807 - DNA, 12 bp, Homo sapiens
ccaaccccagct

SEQ ID NO: 2718808 - DNA, 14 bp, Homo sapiens
ccaaccccagctgg

SEQ ID NO: 2718809 - DNA, 17 bp, Homo sapiens
ccaaccccagctggcct

SEQ ID NO: 2718810 - DNA, 18 bp, Homo sapiens
ccaaccccagctggcctc

SEQ ID NO: 2718811 - DNA, 19 bp, Homo sapiens
ccaaccccagctggcctct

SEQ ID NO: 2718812 - DNA, 15 bp, Homo sapiens
ccaacccccagcacc

SEQ ID NO: 2718813 - DNA, 21 bp, Homo sapiens
ccaacccccagcacccgggct

SEQ ID NO: 2718814 - DNA, 12 bp, Homo sapiens
ccaactttcatt

SEQ ID NO: 2718815 - DNA, 10 bp, Homo sapiens
ccaagcaaag

SEQ ID NO: 2718816 - DNA, 13 bp, Homo sapiens
ccaagccaccgca

SEQ ID NO: 2718817 - DNA, 20 bp, Homo sapiens
ccaagccaccgcagctgctg

SEQ ID NO: 2718818 - DNA, 23 bp, Homo sapiens
ccaagccaccgcagctgctgcca

SEQ ID NO: 2718819 - DNA, 18 bp, Homo sapiens
ccaagccctccgcctaga

SEQ ID NO: 2718820 - DNA, 22 bp, Homo sapiens
cccagtgtgtgctcagcagccc

SEQ ID NO: 2718821 - DNA, 14 bp, Homo sapiens
cccatcccccctca

SEQ ID NO: 2718822 - DNA, 13 bp, Homo sapiens
cccatcctggccc

SEQ ID NO: 2718823 - DNA, 16 bp, Homo sapiens
cccatctaagctgcag

SEQ ID NO: 2718824 - DNA, 18 bp, Homo sapiens
cccatctaagctgcagct

SEQ ID NO: 2718825 - DNA, 13 bp, Homo sapiens
cccatctcctccc

SEQ ID NO: 2718826 - DNA, 15 bp, Homo sapiens
cccatctcctcccat

SEQ ID NO: 2718827 - DNA, 14 bp, Homo sapiens
cccatctgcccagg

SEQ ID NO: 2718828 - DNA, 13 bp, Homo sapiens
cccatctgtccat

SEQ ID NO: 2718829 - DNA, 22 bp, Homo sapiens
cccatctgtccatcctcctctc

SEQ ID NO: 2718830 - DNA, 24 bp, Homo sapiens
cccatctgtccatcctcctctcca

SEQ ID NO: 2718831 - DNA, 18 bp, Homo sapiens
cccatgggcactgctggg

SEQ ID NO: 2718832 - DNA, 21 bp, Homo sapiens
cccatgggcactgctgggtgg

SEQ ID NO: 2718833 - DNA, 17 bp, Homo sapiens
cccatggtagactgtga

SEQ ID NO: 2718834 - DNA, 19 bp, Homo sapiens
cccatgttggtcaggctgg

SEQ ID NO: 2718835 - DNA, 14 bp, Homo sapiens
cccattcctcacct

SEQ ID NO: 2718836 - DNA, 14 bp, Homo sapiens
ccccaaaggcatcc

SEQ ID NO: 2718837 - DNA, 13 bp, Homo sapiens
ccccaagccacag

SEQ ID NO: 2718838 - DNA, 21 bp, Homo sapiens
ccccaagtgtcctggaccctg

SEQ ID NO: 2718839 - DNA, 15 bp, Homo sapiens
ccccacagcccacgt

SEQ ID NO: 2718840 - DNA, 21 bp, Homo sapiens
ccccacagcccacgtcctgtc

SEQ ID NO: 2718841 - DNA, 12 bp, Homo sapiens
ccccacagtcct

SEQ ID NO: 2718842 - DNA, 16 bp, Homo sapiens
ccccaccagagctgcc

SEQ ID NO: 2718843 - DNA, 17 bp, Homo sapiens
ccccaccccaccctgcc

SEQ ID NO: 2718844 - DNA, 19 bp, Homo sapiens
ccccaccccagcacagctc

SEQ ID NO: 2718845 - DNA, 21 bp, Homo sapiens
ccccaccttcaattcctgggc

SEQ ID NO: 2718846 - DNA, 20 bp, Homo sapiens
ccccacgtctctctgcctgc

SEQ ID NO: 2718847 - DNA, 14 bp, Homo sapiens
ccccactccccacc

SEQ ID NO: 2718848 - DNA, 13 bp, Homo sapiens
ccccagacctctg

SEQ ID NO: 2718849 - DNA, 14 bp, Homo sapiens
ccccagacctctga

SEQ ID NO: 2718850 - DNA, 17 bp, Homo sapiens
ccccagagacctttgcc

SEQ ID NO: 2718851 - DNA, 20 bp, Homo sapiens
ccccagagacctttgcccac

SEQ ID NO: 2718852 - DNA, 21 bp, Homo sapiens
ccccagagccactacctttgt

SEQ ID NO: 2718853 - DNA, 18 bp, Homo sapiens
ccccagcacagctcctcc

SEQ ID NO: 2718854 - DNA, 15 bp, Homo sapiens
ccccagcacccgggc

SEQ ID NO: 2718855 - DNA, 19 bp, Homo sapiens
ccccagcacccgggctcag

SEQ ID NO: 2718856 - DNA, 12 bp, Homo sapiens
ccccagcctggc

SEQ ID NO: 2718857 - DNA, 13 bp, Homo sapiens
ccccagcctggcc

SEQ ID NO: 2718858 - DNA, 18 bp, Homo sapiens
ccccagcctggcccagct

SEQ ID NO: 2718859 - DNA, 16 bp, Homo sapiens
ccccagcgcttagaaa

SEQ ID NO: 2718860 - DNA, 17 bp, Homo sapiens
ccccagctctggcttcc

SEQ ID NO: 2718861 - DNA, 12 bp, Homo sapiens
ccccagctggcc

SEQ ID NO: 2718862 - DNA, 16 bp, Homo sapiens
ccccagtgctcctgtg

SEQ ID NO: 2718863 - DNA, 17 bp, Homo sapiens
ccccatcctggcccatc

SEQ ID NO: 2718864 - DNA, 21 bp, Homo sapiens
ccccatctcctcccatggcct

SEQ ID NO: 2718865 - DNA, 22 bp, Homo sapiens
cccccaagtgtcctggaccctg

SEQ ID NO: 2718866 - DNA, 21 bp, Homo sapiens
cccccacgtctctctgcctgc

SEQ ID NO: 2718867 - DNA, 22 bp, Homo sapiens
cccccacgtctctctgcctgct

SEQ ID NO: 2718868 - DNA, 22 bp, Homo sapiens
cccccactcacagggagctggc

SEQ ID NO: 2718869 - DNA, 15 bp, Homo sapiens
cccccagagaccttt

SEQ ID NO: 2718870 - DNA, 18 bp, Homo sapiens
cccccaggattcccagag

SEQ ID NO: 2718871 - DNA, 18 bp, Homo sapiens
cccccaggattgtgcaat

SEQ ID NO: 2718872 - DNA, 13 bp, Homo sapiens
cccccatcctggc

SEQ ID NO: 2718873 - DNA, 14 bp, Homo sapiens
cccccctcaccagg

SEQ ID NO: 2718874 - DNA, 13 bp, Homo sapiens
cccccgcccaggc

SEQ ID NO: 2718875 - DNA, 20 bp, Homo sapiens
ccccctaccgcatggcagct

SEQ ID NO: 2718876 - DNA, 12 bp, Homo sapiens
ccccctcctgct

SEQ ID NO: 2718877 - DNA, 15 bp, Homo sapiens
ccccctcctgctgca

SEQ ID NO: 2718878 - DNA, 18 bp, Homo sapiens
ccccctcgtgccagtcgc

SEQ ID NO: 2718879 - DNA, 16 bp, Homo sapiens
ccccgcccaggctggc

SEQ ID NO: 2718880 - DNA, 23 bp, Homo sapiens
ccccgggaggggcccgcttgcct

SEQ ID NO: 2718881 - DNA, 15 bp, Homo sapiens
ccccggggctgggtt

SEQ ID NO: 2718882 - DNA, 17 bp, Homo sapiens
cccctaccgcatggcag

SEQ ID NO: 2718883 - DNA, 22 bp, Homo sapiens
cccctaccgcatggcagctggg

SEQ ID NO: 2718884 - DNA, 17 bp, Homo sapiens
cccctcaccaggggcag

SEQ ID NO: 2718885 - DNA, 16 bp, Homo sapiens
cccctcaggggaagct

SEQ ID NO: 2718886 - DNA, 15 bp, Homo sapiens
cccctcccccacgtc

SEQ ID NO: 2718887 - DNA, 19 bp, Homo sapiens
cccctcctacccctcccag

SEQ ID NO: 2718888 - DNA, 23 bp, Homo sapiens
cccctcctacccctcccagctga

SEQ ID NO: 2718889 - DNA, 14 bp, Homo sapiens
cccctcctgctgca

SEQ ID NO: 2718890 - DNA, 14 bp, Homo sapiens
cccctcgtgccagt

SEQ ID NO: 2718891 - DNA, 15 bp, Homo sapiens
cccctcgtgccagtc

SEQ ID NO: 2718892 - DNA, 21 bp, Homo sapiens
cccctgaggatcccctgtccc

SEQ ID NO: 2718893 - DNA, 22 bp, Homo sapiens
cccctggaacctttcccttgtg

SEQ ID NO: 2718894 - DNA, 23 bp, Homo sapiens
cccctggctgaacagtgctctgc

SEQ ID NO: 2718895 - DNA, 21 bp, Homo sapiens
cccctgggctctgccccagct

SEQ ID NO: 2718896 - DNA, 14 bp, Homo sapiens
cccctggggctggt

SEQ ID NO: 2718897 - DNA, 23 bp, Homo sapiens
cccctggggctggtggattgggc

SEQ ID NO: 2718898 - DNA, 15 bp, Homo sapiens
cccctggtggacagt

SEQ ID NO: 2718899 - DNA, 17 bp, Homo sapiens
ccccttgtccctggggc

SEQ ID NO: 2718900 - DNA, 20 bp, Homo sapiens
ccccttgtccctggggcact

SEQ ID NO: 2718901 - DNA, 15 bp, Homo sapiens
ccccttgtcctctca

SEQ ID NO: 2718902 - DNA, 16 bp, Homo sapiens
ccccttgtcctctcag

SEQ ID NO: 2718903 - DNA, 16 bp, Homo sapiens
ccccttttcagcttct

SEQ ID NO: 2718904 - DNA, 19 bp, Homo sapiens
ccccttttcagcttctgct

SEQ ID NO: 2718905 - DNA, 22 bp, Homo sapiens
ccccttttcagcttctgctggg

SEQ ID NO: 2718906 - DNA, 15 bp, Homo sapiens
cccgactagcaggca

SEQ ID NO: 2718907 - DNA, 22 bp, Homo sapiens
cccgagctactctcttgccagc

SEQ ID NO: 2718908 - DNA, 20 bp, Homo sapiens
cccgagggatgatgccacac

SEQ ID NO: 2718909 - DNA, 13 bp, Homo sapiens
cccgcccagctgc

SEQ ID NO: 2718910 - DNA, 12 bp, Homo sapiens
cccgcccaggct

SEQ ID NO: 2718911 - DNA, 15 bp, Homo sapiens
cccgcccaggctggc

SEQ ID NO: 2718912 - DNA, 17 bp, Homo sapiens
cccgcccaggctggcca

SEQ ID NO: 2718913 - DNA, 20 bp, Homo sapiens
cccgccccttccccgaggga

SEQ ID NO: 2718914 - DNA, 15 bp, Homo sapiens
cccgctcccagtgtc

SEQ ID NO: 2718915 - DNA, 17 bp, Homo sapiens
cccgcttattctcctcc

SEQ ID NO: 2718916 - DNA, 11 bp, Homo sapiens
cccgcttgcct

SEQ ID NO: 2718917 - DNA, 12 bp, Homo sapiens
cccgcttgcctc

SEQ ID NO: 2718918 - DNA, 21 bp, Homo sapiens
cccgcttgcctcggctcctgc

SEQ ID NO: 2718919 - DNA, 16 bp, Homo sapiens
cccggattctgggagg

SEQ ID NO: 2718920 - DNA, 21 bp, Homo sapiens
cccggattggccctgcccctc

SEQ ID NO: 2718921 - DNA, 14 bp, Homo sapiens
cccggcgccctctg

SEQ ID NO: 2718922 - DNA, 16 bp, Homo sapiens
cccgggaagcatcctc

SEQ ID NO: 2718923 - DNA, 17 bp, Homo sapiens
cccgggaagcatcctcc

SEQ ID NO: 2718924 - DNA, 23 bp, Homo sapiens
cccgggaggggcccgcttgcctc

SEQ ID NO: 2718925 - DNA, 13 bp, Homo sapiens
cccgtggccccag

SEQ ID NO: 2718926 - DNA, 22 bp, Homo sapiens
cccgtggccccagcctggccca

SEQ ID NO: 2718927 - DNA, 17 bp, Homo sapiens
cccgtgggggcagggga

SEQ ID NO: 2718928 - DNA, 20 bp, Homo sapiens
cccgtgtagccccgggctga

SEQ ID NO: 2718929 - DNA, 16 bp, Homo sapiens
cccgtgttcacaccat

SEQ ID NO: 2718930 - DNA, 20 bp, Homo sapiens
cccgttgtctccctggccct

SEQ ID NO: 2718931 - DNA, 17 bp, Homo sapiens
ccctaccgcatggcagc

SEQ ID NO: 2718932 - DNA, 18 bp, Homo sapiens
ccctaccgcatggcagct

SEQ ID NO: 2718933 - DNA, 23 bp, Homo sapiens
ccctagatccaggcttctcccgg

SEQ ID NO: 2718934 - DNA, 15 bp, Homo sapiens
ccctcaaaccctgtg

SEQ ID NO: 2718935 - DNA, 16 bp, Homo sapiens
ccctcaaaccctgtgg

SEQ ID NO: 2718936 - DNA, 18 bp, Homo sapiens
ccctcaaggcctcccaca

SEQ ID NO: 2718937 - DNA, 21 bp, Homo sapiens
ccctcaaggcctcccacagtg

SEQ ID NO: 2718938 - DNA, 13 bp, Homo sapiens
ccctcagctgcct

SEQ ID NO: 2718939 - DNA, 15 bp, Homo sapiens
ccctcaggggaagct

SEQ ID NO: 2718940 - DNA, 16 bp, Homo sapiens
ccctcaggggaagctg

SEQ ID NO: 2718941 - DNA, 21 bp, Homo sapiens
ccctccaaacactgggctctg

SEQ ID NO: 2718942 - DNA, 13 bp, Homo sapiens
ccctcccagctga

SEQ ID NO: 2718943 - DNA, 20 bp, Homo sapiens
ccctcccagctgacagtcct

SEQ ID NO: 2718944 - DNA, 19 bp, Homo sapiens
cctggaatgaagcatgtag

SEQ ID NO: 2718945 - DNA, 16 bp, Homo sapiens
cctggactagggcctc

SEQ ID NO: 2718946 - DNA, 19 bp, Homo sapiens
cctggactagggcctcgga

SEQ ID NO: 2718947 - DNA, 22 bp, Homo sapiens
cctggactagggcctcggaggc

SEQ ID NO: 2718948 - DNA, 23 bp, Homo sapiens
cctggactagggcctcggaggct

SEQ ID NO: 2718949 - DNA, 16 bp, Homo sapiens
cctggagctgccagca

SEQ ID NO: 2718950 - DNA, 13 bp, Homo sapiens
cctggaggctgga

SEQ ID NO: 2718951 - DNA, 12 bp, Homo sapiens
cctggcacagtg

SEQ ID NO: 2718952 - DNA, 21 bp, Homo sapiens
cctggcacagtgtctgggctg

SEQ ID NO: 2718953 - DNA, 22 bp, Homo sapiens
cctggcacagtgtctgggctga

SEQ ID NO: 2718954 - DNA, 23 bp, Homo sapiens
cctggcacagtgtctgggctgac

SEQ ID NO: 2718955 - DNA, 19 bp, Homo sapiens
cctggccaccacccaacct

SEQ ID NO: 2718956 - DNA, 22 bp, Homo sapiens
cctggccaccacccaacctgtc

SEQ ID NO: 2718957 - DNA, 11 bp, Homo sapiens
cctggccaggg

SEQ ID NO: 2718958 - DNA, 14 bp, Homo sapiens
cctggcccagctcc

SEQ ID NO: 2718959 - DNA, 19 bp, Homo sapiens
cctggccccttctccagca

SEQ ID NO: 2718960 - DNA, 14 bp, Homo sapiens
cctggccctcttct

SEQ ID NO: 2718961 - DNA, 18 bp, Homo sapiens
cctggctgaacagtgctc

SEQ ID NO: 2718962 - DNA, 22 bp, Homo sapiens
cctggctgaacagtgctctgcc

SEQ ID NO: 2718963 - DNA, 11 bp, Homo sapiens
cctggctggaa

SEQ ID NO: 2718964 - DNA, 13 bp, Homo sapiens
cctggctggaagg

SEQ ID NO: 2718965 - DNA, 16 bp, Homo sapiens
cctggctggctgtgtc

SEQ ID NO: 2718966 - DNA, 17 bp, Homo sapiens
cctggcttctggagccc

SEQ ID NO: 2718967 - DNA, 17 bp, Homo sapiens
cctgggagaacctcagg

SEQ ID NO: 2718968 - DNA, 18 bp, Homo sapiens
cctgggagaacctcaggc

SEQ ID NO: 2718969 - DNA, 19 bp, Homo sapiens
cctgggcctcagcctccag

SEQ ID NO: 2718970 - DNA, 14 bp, Homo sapiens
cctgggcgacagag

SEQ ID NO: 2718971 - DNA, 17 bp, Homo sapiens
cctgggcgacagagcaa

SEQ ID NO: 2718972 - DNA, 12 bp, Homo sapiens
cctgggctctgc

SEQ ID NO: 2718973 - DNA, 22 bp, Homo sapiens
cctgggctctgtgggctgcact

SEQ ID NO: 2718974 - DNA, 14 bp, Homo sapiens
cctggggcactccc

SEQ ID NO: 2718975 - DNA, 21 bp, Homo sapiens
cctggggcactcccccaggat

SEQ ID NO: 2718976 - DNA, 18 bp, Homo sapiens
cctggggctctgtgcagg

SEQ ID NO: 2718977 - DNA, 15 bp, Homo sapiens
cctggggctggtgga

SEQ ID NO: 2718978 - DNA, 14 bp, Homo sapiens
cctgggtttggccc

SEQ ID NO: 2718979 - DNA, 22 bp, Homo sapiens
cctgggtttggcccctggaacc

SEQ ID NO: 2718980 - DNA, 14 bp, Homo sapiens
cctggtacagcagg

SEQ ID NO: 2718981 - DNA, 18 bp, Homo sapiens
cctggtactgcacatttt

SEQ ID NO: 2718982 - DNA, 16 bp, Homo sapiens
cctggtaggaaagcac

SEQ ID NO: 2718983 - DNA, 19 bp, Homo sapiens
cctggtccttccaggcccc

SEQ ID NO: 2718984 - DNA, 17 bp, Homo sapiens
cctggtgaccccttttc

SEQ ID NO: 2718985 - DNA, 14 bp, Homo sapiens
cctggtgagggagc

SEQ ID NO: 2718986 - DNA, 14 bp, Homo sapiens
cctggtggacagtc

SEQ ID NO: 2718987 - DNA, 19 bp, Homo sapiens
cctggtggacagtcctggg

SEQ ID NO: 2718988 - DNA, 12 bp, Homo sapiens
cctgtcagtgcc

SEQ ID NO: 2718989 - DNA, 14 bp, Homo sapiens
cctgtccataaagt

SEQ ID NO: 2718990 - DNA, 15 bp, Homo sapiens
cctgtccataaagta

SEQ ID NO: 2718991 - DNA, 15 bp, Homo sapiens
cctgtcccctcacag

SEQ ID NO: 2718992 - DNA, 12 bp, Homo sapiens
cctgtccctacc

SEQ ID NO: 2718993 - DNA, 16 bp, Homo sapiens
cctgtccctacccact

SEQ ID NO: 2718994 - DNA, 18 bp, Homo sapiens
cctgtccctacccactct

SEQ ID NO: 2718995 - DNA, 18 bp, Homo sapiens
cctgtccggagcgaccct

SEQ ID NO: 2718996 - DNA, 19 bp, Homo sapiens
cctgtccttactcagagct

SEQ ID NO: 2718997 - DNA, 21 bp, Homo sapiens
cctgtccttactcagagctgc

SEQ ID NO: 2718998 - DNA, 22 bp, Homo sapiens
cctgtccttactcagagctgcg

SEQ ID NO: 2718999 - DNA, 14 bp, Homo sapiens
cctgtctgctgggc

SEQ ID NO: 2719000 - DNA, 13 bp, Homo sapiens
cctgtctgtccaa

SEQ ID NO: 2719001 - DNA, 21 bp, Homo sapiens
cctgtctgtccaacccctccc

SEQ ID NO: 2719002 - DNA, 23 bp, Homo sapiens
cctgtctgtccaacccctccccc

SEQ ID NO: 2719003 - DNA, 17 bp, Homo sapiens
cctgtcttctctcccac

SEQ ID NO: 2719004 - DNA, 18 bp, Homo sapiens
cctgtgactatggctctg

SEQ ID NO: 2719005 - DNA, 21 bp, Homo sapiens
cctgtggggcctgatggtgct

SEQ ID NO: 2719006 - DNA, 20 bp, Homo sapiens
cctgtggtcacttatcctga

SEQ ID NO: 2719007 - DNA, 17 bp, Homo sapiens
cctgttcccaagcaaag

SEQ ID NO: 2719008 - DNA, 17 bp, Homo sapiens
cctgttctccagatgga

SEQ ID NO: 2719009 - DNA, 17 bp, Homo sapiens
cctgtttaaaaaaagta

SEQ ID NO: 2719010 - DNA, 17 bp, Homo sapiens
cctgtttttaacatgtg

SEQ ID NO: 2719011 - DNA, 19 bp, Homo sapiens
ccttacaaccacatttctg

SEQ ID NO: 2719012 - DNA, 16 bp, Homo sapiens
ccttactcagagctgc

SEQ ID NO: 2719013 - DNA, 20 bp, Homo sapiens
ccttactcagagctgcgggc

SEQ ID NO: 2719014 - DNA, 19 bp, Homo sapiens
ccttagaagatctgcttcc

SEQ ID NO: 2719015 - DNA, 15 bp, Homo sapiens
ccttattcaggaaaa

SEQ ID NO: 2719016 - DNA, 23 bp, Homo sapiens
ccttatttgtcggggaagatgaa

SEQ ID NO: 2719017 - DNA, 17 bp, Homo sapiens
ccttcaagttagctcag

SEQ ID NO: 2719018 - DNA, 15 bp, Homo sapiens
ccttcaattcctggg

SEQ ID NO: 2719019 - DNA, 16 bp, Homo sapiens
ccttcaattcctgggc

SEQ ID NO: 2719020 - DNA, 15 bp, Homo sapiens
ccttcaccacctcat

SEQ ID NO: 2719021 - DNA, 14 bp, Homo sapiens
ccttcataaattat

SEQ ID NO: 2719022 - DNA, 19 bp, Homo sapiens
ccttccaaatcaggctggg

SEQ ID NO: 2719023 - DNA, 13 bp, Homo sapiens
ccttccaggcccc

SEQ ID NO: 2719024 - DNA, 16 bp, Homo sapiens
ccttccccctcccagg

SEQ ID NO: 2719025 - DNA, 15 bp, Homo sapiens
ccttccccttgtccc

SEQ ID NO: 2719026 - DNA, 17 bp, Homo sapiens
ccttccccttgtccctg

SEQ ID NO: 2719027 - DNA, 12 bp, Homo sapiens
ccttcctcatct

SEQ ID NO: 2719028 - DNA, 12 bp, Homo sapiens
ccttcctgaccc

SEQ ID NO: 2719029 - DNA, 23 bp, Homo sapiens
ccttctcccccccggggctgggt

SEQ ID NO: 2719030 - DNA, 15 bp, Homo sapiens
ccttgaatctgcagg

SEQ ID NO: 2719031 - DNA, 11 bp, Homo sapiens
ccttgctattt

SEQ ID NO: 2719032 - DNA, 13 bp, Homo sapiens
ccttggacttgag

SEQ ID NO: 2719033 - DNA, 15 bp, Homo sapiens
ccttggacttgagga

SEQ ID NO: 2719034 - DNA, 15 bp, Homo sapiens
ccttggagagcagct

SEQ ID NO: 2719035 - DNA, 17 bp, Homo sapiens
ccttggagagcagctgg

SEQ ID NO: 2719036 - DNA, 19 bp, Homo sapiens
ccttggagagcagctggct

SEQ ID NO: 2719037 - DNA, 22 bp, Homo sapiens
ccttggagagcagctggctctc

SEQ ID NO: 2719038 - DNA, 16 bp, Homo sapiens
ccttggagtgctgcag

SEQ ID NO: 2719039 - DNA, 14 bp, Homo sapiens
ccttggtcccagac

SEQ ID NO: 2719040 - DNA, 21 bp, Homo sapiens
ccttgtccctggggcactccc

SEQ ID NO: 2719041 - DNA, 13 bp, Homo sapiens
ccttgtcctctca

SEQ ID NO: 2719042 - DNA, 23 bp, Homo sapiens
ccttgtgtgtaccacaccctgcc

SEQ ID NO: 2719043 - DNA, 23 bp, Homo sapiens
cctttaaaggtcgcacctccttg

SEQ ID NO: 2719044 - DNA, 18 bp, Homo sapiens
cctttaggcagcctgccg

SEQ ID NO: 2719045 - DNA, 20 bp, Homo sapiens
cctttcagggaatttcagga

SEQ ID NO: 2719046 - DNA, 20 bp, Homo sapiens
cctttcctgaagtgtcgagt

SEQ ID NO: 2719047 - DNA, 22 bp, Homo sapiens
cctttcctgccgtccctcctgt

SEQ ID NO: 2719048 - DNA, 15 bp, Homo sapiens
cctttgcaggcccag

SEQ ID NO: 2719049 - DNA, 18 bp, Homo sapiens
cctttgcaggcccagcag

SEQ ID NO: 2719050 - DNA, 12 bp, Homo sapiens
cctttgcccaca

SEQ ID NO: 2719051 - DNA, 20 bp, Homo sapiens
cctttgcccacacacactcc

SEQ ID NO: 2719052 - DNA, 18 bp, Homo sapiens
cctttgggatcagcctcc

SEQ ID NO: 2719053 - DNA, 17 bp, Homo sapiens
ccttttcagcttctgct

SEQ ID NO: 2719054 - DNA, 20 bp, Homo sapiens
ccttttcagcttctgctggg

SEQ ID NO: 2719055 - DNA, 21 bp, Homo sapiens
ccttttcagcttctgctgggc

SEQ ID NO: 2719056 - DNA, 16 bp, Homo sapiens
ccttttcccggggagg

SEQ ID NO: 2719057 - DNA, 23 bp, Homo sapiens
cctttttgcaggggactgggcca

SEQ ID NO: 2719058 - DNA, 22 bp, Homo sapiens
ccttttttatttttttaagctg

SEQ ID NO: 2719059 - DNA, 19 bp, Homo sapiens
cgaaacctgtccataaagt

SEQ ID NO: 2719060 - DNA, 14 bp, Homo sapiens
cgaactgtgctccc

SEQ ID NO: 2719061 - DNA, 15 bp, Homo sapiens
cgaactgtgctccca

SEQ ID NO: 2719062 - DNA, 21 bp, Homo sapiens
cgaagaacaatgtcagaaact

SEQ ID NO: 2719063 - DNA, 13 bp, Homo sapiens
cgaaggggccctg

SEQ ID NO: 2719064 - DNA, 13 bp, Homo sapiens
cgaccccatctca

SEQ ID NO: 2719065 - DNA, 14 bp, Homo sapiens
cgaccccatctgcc

SEQ ID NO: 2719066 - DNA, 16 bp, Homo sapiens
cgaccccatctgccca

SEQ ID NO: 2719067 - DNA, 17 bp, Homo sapiens
cgaccccatctgcccag

SEQ ID NO: 2719068 - DNA, 17 bp, Homo sapiens
ctctccacctagtggct

SEQ ID NO: 2719069 - DNA, 22 bp, Homo sapiens
ctctccacctagtggctgtcca

SEQ ID NO: 2719070 - DNA, 14 bp, Homo sapiens
ctctccatgcaagt

SEQ ID NO: 2719071 - DNA, 18 bp, Homo sapiens
ctctccatgcaagtgctg

SEQ ID NO: 2719072 - DNA, 18 bp, Homo sapiens
ctctcggaaggctggctg

SEQ ID NO: 2719073 - DNA, 13 bp, Homo sapiens
ctctctaacataa

SEQ ID NO: 2719074 - DNA, 22 bp, Homo sapiens
ctctctactcctacctcagcct

SEQ ID NO: 2719075 - DNA, 15 bp, Homo sapiens
ctctctctctttcct

SEQ ID NO: 2719076 - DNA, 14 bp, Homo sapiens
ctctctcttctctg

SEQ ID NO: 2719077 - DNA, 12 bp, Homo sapiens
ctctctgcctgc

SEQ ID NO: 2719078 - DNA, 14 bp, Homo sapiens
ctctctgcctgctg

SEQ ID NO: 2719079 - DNA, 15 bp, Homo sapiens
ctctctgcctgctgg

SEQ ID NO: 2719080 - DNA, 20 bp, Homo sapiens
ctctctgcctgctgggctct

SEQ ID NO: 2719081 - DNA, 15 bp, Homo sapiens
ctctctgcctgcttc

SEQ ID NO: 2719082 - DNA, 12 bp, Homo sapiens
ctctctgctcag

SEQ ID NO: 2719083 - DNA, 23 bp, Homo sapiens
ctctctggggcagggttattcct

SEQ ID NO: 2719084 - DNA, 13 bp, Homo sapiens
ctctcttctgtgt

SEQ ID NO: 2719085 - DNA, 13 bp, Homo sapiens
ctctcttgccagc

SEQ ID NO: 2719086 - DNA, 13 bp, Homo sapiens
ctctgacctgcag

SEQ ID NO: 2719087 - DNA, 13 bp, Homo sapiens
ctctgagccgcag

SEQ ID NO: 2719088 - DNA, 22 bp, Homo sapiens
ctctgagccgcagggcctgcta

SEQ ID NO: 2719089 - DNA, 16 bp, Homo sapiens
ctctgaggagtggagt

SEQ ID NO: 2719090 - DNA, 13 bp, Homo sapiens
ctctgagtgtctc

SEQ ID NO: 2719091 - DNA, 20 bp, Homo sapiens
ctctgagtgtctctgcctgg

SEQ ID NO: 2719092 - DNA, 19 bp, Homo sapiens
ctctgcagatagtgcctct

SEQ ID NO: 2719093 - DNA, 17 bp, Homo sapiens
ctctgcagcaatattct

SEQ ID NO: 2719094 - DNA, 23 bp, Homo sapiens
ctctgcaggcagatttactgtcc

SEQ ID NO: 2719095 - DNA, 20 bp, Homo sapiens
ctctgcatgttttttttaaa

SEQ ID NO: 2719096 - DNA, 15 bp, Homo sapiens
ctctgcccagcctgc

SEQ ID NO: 2719097 - DNA, 17 bp, Homo sapiens
ctctgcccagcctgccc

SEQ ID NO: 2719098 - DNA, 16 bp, Homo sapiens
ctctgccccagctctg

SEQ ID NO: 2719099 - DNA, 22 bp, Homo sapiens
ctctgcccccaactcccggagg

SEQ ID NO: 2719100 - DNA, 16 bp, Homo sapiens
ctctgcccgcagagcc

SEQ ID NO: 2719101 - DNA, 19 bp, Homo sapiens
ctctgcctcatcctcctcc

SEQ ID NO: 2719102 - DNA, 21 bp, Homo sapiens
ctctgcctcatcctcctcctc

SEQ ID NO: 2719103 - DNA, 20 bp, Homo sapiens
ctctgcctctaactccctcc

SEQ ID NO: 2719104 - DNA, 17 bp, Homo sapiens
ctctgcctgaccccagg

SEQ ID NO: 2719105 - DNA, 12 bp, Homo sapiens
ctctgcctgctg

SEQ ID NO: 2719106 - DNA, 16 bp, Homo sapiens
ctctgcctgctgggct

SEQ ID NO: 2719107 - DNA, 17 bp, Homo sapiens
ctctgcctgcttcctgg

SEQ ID NO: 2719108 - DNA, 11 bp, Homo sapiens
ctctgctcagt

SEQ ID NO: 2719109 - DNA, 15 bp, Homo sapiens
ctctgctgccatggc

SEQ ID NO: 2719110 - DNA, 12 bp, Homo sapiens
ctctgctgcctg

SEQ ID NO: 2719111 - DNA, 13 bp, Homo sapiens
ctctgctgcctgt

SEQ ID NO: 2719112 - DNA, 22 bp, Homo sapiens
ctctgcttactaatgtgcccca

SEQ ID NO: 2719113 - DNA, 21 bp, Homo sapiens
ctctgcttggcttcccctcca

SEQ ID NO: 2719114 - DNA, 22 bp, Homo sapiens
ctctgcttggcttcccctccac

SEQ ID NO: 2719115 - DNA, 15 bp, Homo sapiens
ctctggctcagctgt

SEQ ID NO: 2719116 - DNA, 20 bp, Homo sapiens
ctctggctcagctgtggtcc

SEQ ID NO: 2719117 - DNA, 23 bp, Homo sapiens
ctctggctcagctgtggtcccac

SEQ ID NO: 2719118 - DNA, 19 bp, Homo sapiens
ctctgggccaggttggaaa

SEQ ID NO: 2719119 - DNA, 21 bp, Homo sapiens
ctctgggtttacaacaaacac

SEQ ID NO: 2719120 - DNA, 23 bp, Homo sapiens
ctctgggtttacaacaaacactg

SEQ ID NO: 2719121 - DNA, 19 bp, Homo sapiens
ctctgtcaccctggccacc

SEQ ID NO: 2719122 - DNA, 19 bp, Homo sapiens
ctctgtccagccagctcct

SEQ ID NO: 2719123 - DNA, 21 bp, Homo sapiens
ctctgtcccggttcaccttgc

SEQ ID NO: 2719124 - DNA, 18 bp, Homo sapiens
ctctgtcctgacttcagg

SEQ ID NO: 2719125 - DNA, 23 bp, Homo sapiens
ctctgtgacctgccccgcccagc

SEQ ID NO: 2719126 - DNA, 12 bp, Homo sapiens
ctctgtgcccat

SEQ ID NO: 2719127 - DNA, 20 bp, Homo sapiens
ctctgtgcccatgggcactg

SEQ ID NO: 2719128 - DNA, 14 bp, Homo sapiens
ctctgtgggctgca

SEQ ID NO: 2719129 - DNA, 17 bp, Homo sapiens
ctctgtgtcactggctg

SEQ ID NO: 2719130 - DNA, 21 bp, Homo sapiens
ctctgttaaagatcagctatt

SEQ ID NO: 2719131 - DNA, 19 bp, Homo sapiens
ctctgttctagagtgacag

SEQ ID NO: 2719132 - DNA, 16 bp, Homo sapiens
ctcttaaaaatcttgg

SEQ ID NO: 2719133 - DNA, 18 bp, Homo sapiens
ctcttacttcccccaccc

SEQ ID NO: 2719134 - DNA, 20 bp, Homo sapiens
ctcttacttcccccaccctg

SEQ ID NO: 2719135 - DNA, 15 bp, Homo sapiens
ctcttatttttgtac

SEQ ID NO: 2719136 - DNA, 15 bp, Homo sapiens
ctcttccaccagagc

SEQ ID NO: 2719137 - DNA, 17 bp, Homo sapiens
ctcttccaccagagcag

SEQ ID NO: 2719138 - DNA, 21 bp, Homo sapiens
ctcttccaccagagcaggggc

SEQ ID NO: 2719139 - DNA, 16 bp, Homo sapiens
ctcttgactggctcaa

SEQ ID NO: 2719140 - DNA, 17 bp, Homo sapiens
ctcttgccccaaatcac

SEQ ID NO: 2719141 - DNA, 16 bp, Homo sapiens
ctcttggccagagctg

SEQ ID NO: 2719142 - DNA, 12 bp, Homo sapiens
ctcttgggcctg

SEQ ID NO: 2719143 - DNA, 17 bp, Homo sapiens
ctcttgggcctgacctc

SEQ ID NO: 2719144 - DNA, 23 bp, Homo sapiens
ctcttgtattgctccattttctt

SEQ ID NO: 2719145 - DNA, 17 bp, Homo sapiens
ctctttgctacaataaa

SEQ ID NO: 2719146 - DNA, 19 bp, Homo sapiens
ctctttgctacaataaatg

SEQ ID NO: 2719147 - DNA, 20 bp, Homo sapiens
ctctttgctacaataaatgc

SEQ ID NO: 2719148 - DNA, 23 bp, Homo sapiens
ctctttgctacaataaatgctga

SEQ ID NO: 2719149 - DNA, 15 bp, Homo sapiens
ctctttgtgtgtctc

SEQ ID NO: 2719150 - DNA, 19 bp, Homo sapiens
ctctttttgtacctggtga

SEQ ID NO: 2719151 - DNA, 13 bp, Homo sapiens
ctgaacaaaagct

SEQ ID NO: 2719152 - DNA, 12 bp, Homo sapiens
ctgaacagtgct

SEQ ID NO: 2719153 - DNA, 19 bp, Homo sapiens
ctgaacagtgctctgcctc

SEQ ID NO: 2719154 - DNA, 15 bp, Homo sapiens
ctgaacatattatct

SEQ ID NO: 2719155 - DNA, 17 bp, Homo sapiens
ctgaaccgtgtgctcct

SEQ ID NO: 2719156 - DNA, 18 bp, Homo sapiens
ctgaaccgtgtgctcctc

SEQ ID NO: 2719157 - DNA, 14 bp, Homo sapiens
ctgaagccattgtc

SEQ ID NO: 2719158 - DNA, 20 bp, Homo sapiens
ctgaaggagattttccttcc

SEQ ID NO: 2719159 - DNA, 21 bp, Homo sapiens
ctgaaggagattttccttcct

SEQ ID NO: 2719160 - DNA, 22 bp, Homo sapiens
ctgaagtcattgtcgctcagca

SEQ ID NO: 2719161 - DNA, 13 bp, Homo sapiens
ctgaagtcttgca

SEQ ID NO: 2719162 - DNA, 14 bp, Homo sapiens
ctgaagtgattgaa

SEQ ID NO: 2719163 - DNA, 22 bp, Homo sapiens
ctgaagtgtcgagtccagtcct

SEQ ID NO: 2719164 - DNA, 16 bp, Homo sapiens
ctgaatacttgaagta

SEQ ID NO: 2719165 - DNA, 19 bp, Homo sapiens
ctgaatacttgaagtagga

SEQ ID NO: 2719166 - DNA, 16 bp, Homo sapiens
ctgaatggcatggaga

SEQ ID NO: 2719167 - DNA, 18 bp, Homo sapiens
ctgaatggcatggagacc

SEQ ID NO: 2719168 - DNA, 13 bp, Homo sapiens
ctgaatgtcccag

SEQ ID NO: 2719169 - DNA, 14 bp, Homo sapiens
ctgaatgtcccaga

SEQ ID NO: 2719170 - DNA, 15 bp, Homo sapiens
ctgaatgtcccagag

SEQ ID NO: 2719171 - DNA, 18 bp, Homo sapiens
ctgaatgtcccagaggct

SEQ ID NO: 2719172 - DNA, 23 bp, Homo sapiens
ctgaatgtcctttctccagtgta

SEQ ID NO: 2719173 - DNA, 19 bp, Homo sapiens
ctgacaatgcgtggcacat

SEQ ID NO: 2719174 - DNA, 13 bp, Homo sapiens
ctgacactgcggg

SEQ ID NO: 2719175 - DNA, 15 bp, Homo sapiens
ctgacagagccagag

SEQ ID NO: 2719176 - DNA, 17 bp, Homo sapiens
ctgacagagccagaggc

SEQ ID NO: 2719177 - DNA, 21 bp, Homo sapiens
ctgacagtcctctccacctag

SEQ ID NO: 2719178 - DNA, 12 bp, Homo sapiens
ctgacatttcta

SEQ ID NO: 2719179 - DNA, 14 bp, Homo sapiens
ctgacccagtgtgt

SEQ ID NO: 2719180 - DNA, 17 bp, Homo sapiens
ctgacctccagtcctgc

SEQ ID NO: 2719181 - DNA, 19 bp, Homo sapiens
ctgacctccagtcctgctg

SEQ ID NO: 2719182 - DNA, 22 bp, Homo sapiens
ctgacctccagtcctgctggcc

SEQ ID NO: 2719183 - DNA, 13 bp, Homo sapiens
ctgacctgcaggc

SEQ ID NO: 2719184 - DNA, 15 bp, Homo sapiens
ctgaccttctccagg

SEQ ID NO: 2719185 - DNA, 16 bp, Homo sapiens
ctgaccttctccaggg

SEQ ID NO: 2719186 - DNA, 20 bp, Homo sapiens
ctgaccttctccagggacag

SEQ ID NO: 2719187 - DNA, 16 bp, Homo sapiens
ctgactctctgtgacc

SEQ ID NO: 2719188 - DNA, 14 bp, Homo sapiens
ctgacttcaggggc

SEQ ID NO: 2719189 - DNA, 16 bp, Homo sapiens
ctgactttctcttcta

SEQ ID NO: 2719190 - DNA, 17 bp, Homo sapiens
ctgagaagtgtatatag

SEQ ID NO: 2719191 - DNA, 14 bp, Homo sapiens
ctgagactgcggga

SEQ ID NO: 2719192 - DNA, 23 bp, Homo sapiens
ctgtgccaccctgggctctgtgg

SEQ ID NO: 2719193 - DNA, 12 bp, Homo sapiens
ctgtgcccatgg

SEQ ID NO: 2719194 - DNA, 20 bp, Homo sapiens
ctgtgcccatgggcactgct

SEQ ID NO: 2719195 - DNA, 18 bp, Homo sapiens
ctgtgctctgtccttgtg

SEQ ID NO: 2719196 - DNA, 20 bp, Homo sapiens
ctgtggattcagcttctgtt

SEQ ID NO: 2719197 - DNA, 11 bp, Homo sapiens
ctgtggcctgg

SEQ ID NO: 2719198 - DNA, 14 bp, Homo sapiens
ctgtggcctgggca

SEQ ID NO: 2719199 - DNA, 16 bp, Homo sapiens
ctgtggcctgggcaag

SEQ ID NO: 2719200 - DNA, 22 bp, Homo sapiens
ctgtgggctgcactctgtgccc

SEQ ID NO: 2719201 - DNA, 22 bp, Homo sapiens
ctgtgggggaagagcacagccc

SEQ ID NO: 2719202 - DNA, 19 bp, Homo sapiens
ctgtgggtctgactttctc

SEQ ID NO: 2719203 - DNA, 16 bp, Homo sapiens
ctgtggtcccacccag

SEQ ID NO: 2719204 - DNA, 17 bp, Homo sapiens
ctgtggtcccacccagg

SEQ ID NO: 2719205 - DNA, 19 bp, Homo sapiens
ctgtggtcccacccaggaa

SEQ ID NO: 2719206 - DNA, 14 bp, Homo sapiens
ctgtgtcactggct

SEQ ID NO: 2719207 - DNA, 19 bp, Homo sapiens
ctgtgtcactggctgcctc

SEQ ID NO: 2719208 - DNA, 22 bp, Homo sapiens
ctgtgtcactggctgcctccac

SEQ ID NO: 2719209 - DNA, 17 bp, Homo sapiens
ctgtgtcctcgcactgc

SEQ ID NO: 2719210 - DNA, 15 bp, Homo sapiens
ctgtgtcctctccag

SEQ ID NO: 2719211 - DNA, 18 bp, Homo sapiens
ctgtgtctctgtatatag

SEQ ID NO: 2719212 - DNA, 18 bp, Homo sapiens
ctgtgttgcgtgtcgtgg

SEQ ID NO: 2719213 - DNA, 20 bp, Homo sapiens
ctgtgttgcgtgtcgtgggt

SEQ ID NO: 2719214 - DNA, 14 bp, Homo sapiens
ctgtgttgttcata

SEQ ID NO: 2719215 - DNA, 18 bp, Homo sapiens
ctgttctagagtgacagg

SEQ ID NO: 2719216 - DNA, 12 bp, Homo sapiens
ctgttgctgttg

SEQ ID NO: 2719217 - DNA, 13 bp, Homo sapiens
ctgttgctgttgc

SEQ ID NO: 2719218 - DNA, 14 bp, Homo sapiens
ctgttgctgttgct

SEQ ID NO: 2719219 - DNA, 18 bp, Homo sapiens
ctgttgctgttgctgttg

SEQ ID NO: 2719220 - DNA, 21 bp, Homo sapiens
ctgttgttgttacttccctcc

SEQ ID NO: 2719221 - DNA, 18 bp, Homo sapiens
ctgtttaaaaaaagtata

SEQ ID NO: 2719222 - DNA, 17 bp, Homo sapiens
ctgtttcatgagcccaa

SEQ ID NO: 2719223 - DNA, 18 bp, Homo sapiens
cttaaaagcatcataata

SEQ ID NO: 2719224 - DNA, 18 bp, Homo sapiens
cttacaaccacatttctg

SEQ ID NO: 2719225 - DNA, 19 bp, Homo sapiens
cttacataatttgcaattt

SEQ ID NO: 2719226 - DNA, 15 bp, Homo sapiens
cttacggtgcacagt

SEQ ID NO: 2719227 - DNA, 20 bp, Homo sapiens
cttactcagagctgcgggct

SEQ ID NO: 2719228 - DNA, 16 bp, Homo sapiens
cttacttcccccaccc

SEQ ID NO: 2719229 - DNA, 22 bp, Homo sapiens
cttagaagatctgcttccctgg

SEQ ID NO: 2719230 - DNA, 13 bp, Homo sapiens
cttagattttctg

SEQ ID NO: 2719231 - DNA, 17 bp, Homo sapiens
cttaggtgccaggctgt

SEQ ID NO: 2719232 - DNA, 23 bp, Homo sapiens
cttagtttctaaccaaagagtct

SEQ ID NO: 2719233 - DNA, 22 bp, Homo sapiens
cttataatctcctctaaaacaa

SEQ ID NO: 2719234 - DNA, 23 bp, Homo sapiens
cttatgagaacatggtgtgtgtc

SEQ ID NO: 2719235 - DNA, 22 bp, Homo sapiens
cttattcatgctttctcctttt

SEQ ID NO: 2719236 - DNA, 13 bp, Homo sapiens
cttattgcccagg

SEQ ID NO: 2719237 - DNA, 13 bp, Homo sapiens
cttatttttgtac

SEQ ID NO: 2719238 - DNA, 20 bp, Homo sapiens
cttcaagtgagtggcatgtg

SEQ ID NO: 2719239 - DNA, 17 bp, Homo sapiens
cttcaagttagctcagg

SEQ ID NO: 2719240 - DNA, 15 bp, Homo sapiens
cttcaattcctgggc

SEQ ID NO: 2719241 - DNA, 23 bp, Homo sapiens
cttcaccacctcatgtcatttct

SEQ ID NO: 2719242 - DNA, 14 bp, Homo sapiens
cttcacgcctgggt

SEQ ID NO: 2719243 - DNA, 15 bp, Homo sapiens
cttcacgcctgggtg

SEQ ID NO: 2719244 - DNA, 23 bp, Homo sapiens
cttcactccggtgtgcctgcagc

SEQ ID NO: 2719245 - DNA, 12 bp, Homo sapiens
cttcactgcagc

SEQ ID NO: 2719246 - DNA, 15 bp, Homo sapiens
cttcactgcagcctt

SEQ ID NO: 2719247 - DNA, 17 bp, Homo sapiens
cttcactgcagcctttc

SEQ ID NO: 2719248 - DNA, 15 bp, Homo sapiens
cttcacttaaaatca

SEQ ID NO: 2719249 - DNA, 23 bp, Homo sapiens
cttcagaattgtttttagaaatt

SEQ ID NO: 2719250 - DNA, 10 bp, Homo sapiens
cttcagcacc

SEQ ID NO: 2719251 - DNA, 20 bp, Homo sapiens
cttcagcctgaggctgagac

SEQ ID NO: 2719252 - DNA, 14 bp, Homo sapiens
cttcagctggtgga

SEQ ID NO: 2719253 - DNA, 23 bp, Homo sapiens
cttcaggggactgttctcacctt

SEQ ID NO: 2719254 - DNA, 15 bp, Homo sapiens
cttcaggggctgccc

SEQ ID NO: 2719255 - DNA, 16 bp, Homo sapiens
cttcaggggctgcccg

SEQ ID NO: 2719256 - DNA, 18 bp, Homo sapiens
cttcaggggctgcccgct

SEQ ID NO: 2719257 - DNA, 19 bp, Homo sapiens
cttcaggggctgcccgctc

SEQ ID NO: 2719258 - DNA, 14 bp, Homo sapiens
cttcagttgttttc

SEQ ID NO: 2719259 - DNA, 18 bp, Homo sapiens
cttcataaattatttcta

SEQ ID NO: 2719260 - DNA, 11 bp, Homo sapiens
cttcatatcta

SEQ ID NO: 2719261 - DNA, 16 bp, Homo sapiens
cttcatatctaattta

SEQ ID NO: 2719262 - DNA, 13 bp, Homo sapiens
cttcatgcccact

SEQ ID NO: 2719263 - DNA, 21 bp, Homo sapiens
cttcatgtggcattctctctg

SEQ ID NO: 2719264 - DNA, 17 bp, Homo sapiens
cttccaaatcaggctgg

SEQ ID NO: 2719265 - DNA, 15 bp, Homo sapiens
cttccaaccccagct

SEQ ID NO: 2719266 - DNA, 17 bp, Homo sapiens
cttccaaccccagctgg

SEQ ID NO: 2719267 - DNA, 18 bp, Homo sapiens
cttccaaccccagctggc

SEQ ID NO: 2719268 - DNA, 16 bp, Homo sapiens
cttccaaggtggtctg

SEQ ID NO: 2719269 - DNA, 18 bp, Homo sapiens
cttccaaggtggtctgct

SEQ ID NO: 2719270 - DNA, 21 bp, Homo sapiens
cttccaaggtggtctgctcgg

SEQ ID NO: 2719271 - DNA, 18 bp, Homo sapiens
cttccagcttcctctgag

SEQ ID NO: 2719272 - DNA, 17 bp, Homo sapiens
cttcccaattgccacat

SEQ ID NO: 2719273 - DNA, 23 bp, Homo sapiens
cttccccgagggatgatgccaca

SEQ ID NO: 2719274 - DNA, 16 bp, Homo sapiens
cttcccctccacccta

SEQ ID NO: 2719275 - DNA, 20 bp, Homo sapiens
cttccctccccacagtcctc

SEQ ID NO: 2719276 - DNA, 23 bp, Homo sapiens
cttccctgcttttctcccagaag

SEQ ID NO: 2719277 - DNA, 13 bp, Homo sapiens
cttccctgggcct

SEQ ID NO: 2719278 - DNA, 15 bp, Homo sapiens
cttccctgggcctca

SEQ ID NO: 2719279 - DNA, 21 bp, Homo sapiens
cttcctcatctgtgcctgtct

SEQ ID NO: 2719280 - DNA, 17 bp, Homo sapiens
cttcctctgagccgcag

SEQ ID NO: 2719281 - DNA, 19 bp, Homo sapiens
cttcctggtgaggcccagc

SEQ ID NO: 2719282 - DNA, 20 bp, Homo sapiens
cttcctggtgaggcccagcc

SEQ ID NO: 2719283 - DNA, 17 bp, Homo sapiens
cttccttgctgtcctag

SEQ ID NO: 2719284 - DNA, 19 bp, Homo sapiens
cttccttgctgtcctaggc

SEQ ID NO: 2719285 - DNA, 20 bp, Homo sapiens
cttccttgctgtcctaggcc

SEQ ID NO: 2719286 - DNA, 19 bp, Homo sapiens
cttccttggcatcacaggg

SEQ ID NO: 2719287 - DNA, 23 bp, Homo sapiens
cttctaaaggtttcactgttcat

SEQ ID NO: 2719288 - DNA, 22 bp, Homo sapiens
cttctaatcataacatagttga

SEQ ID NO: 2719289 - DNA, 13 bp, Homo sapiens
cttctatatcatt

SEQ ID NO: 2719290 - DNA, 21 bp, Homo sapiens
cttctccagggacagaagcag

SEQ ID NO: 2719291 - DNA, 18 bp, Homo sapiens
cttctcccccccggggct

SEQ ID NO: 2719292 - DNA, 20 bp, Homo sapiens
cttctcccccccggggctgg

SEQ ID NO: 2719293 - DNA, 14 bp, Homo sapiens
cttctcccggacct

SEQ ID NO: 2719294 - DNA, 16 bp, Homo sapiens
cttctcccggacctgg

SEQ ID NO: 2719295 - DNA, 20 bp, Homo sapiens
cttctcccggacctggacta

SEQ ID NO: 2719296 - DNA, 20 bp, Homo sapiens
cttctcgacttcaggagctg

SEQ ID NO: 2719297 - DNA, 15 bp, Homo sapiens
cttctgcctcagctt

SEQ ID NO: 2719298 - DNA, 11 bp, Homo sapiens
cttctggagcc

SEQ ID NO: 2719299 - DNA, 13 bp, Homo sapiens
cttctggagccct

SEQ ID NO: 2719300 - DNA, 17 bp, Homo sapiens
cttcttgaaacagcctg

SEQ ID NO: 2719301 - DNA, 20 bp, Homo sapiens
cttcttgaaacagcctgggt

SEQ ID NO: 2719302 - DNA, 15 bp, Homo sapiens
cttcttgagcagacc

SEQ ID NO: 2719303 - DNA, 18 bp, Homo sapiens
cttcttgtaatatttctt

SEQ ID NO: 2719304 - DNA, 15 bp, Homo sapiens
cttcttgtgtcctga

SEQ ID NO: 2719305 - DNA, 14 bp, Homo sapiens
cttgaaacagcctg

SEQ ID NO: 2719306 - DNA, 15 bp, Homo sapiens
cttgaaacagcctgg

SEQ ID NO: 2719307 - DNA, 17 bp, Homo sapiens
cttgaaacagcctgggt

SEQ ID NO: 2719308 - DNA, 15 bp, Homo sapiens
cttgaaacctttcta

SEQ ID NO: 2719309 - DNA, 15 bp, Homo sapiens
cttgaacccaggagg

SEQ ID NO: 2719310 - DNA, 17 bp, Homo sapiens
cttgaagaggcaggtct

SEQ ID NO: 2719311 - DNA, 16 bp, Homo sapiens
cttgaatttcatgctt

SEQ ID NO: 2719312 - DNA, 20 bp, Homo sapiens
cttgagaaaatgcaggagag

SEQ ID NO: 2719313 - DNA, 20 bp, Homo sapiens
cttgagcttggcagctgaac

SEQ ID NO: 2719314 - DNA, 16 bp, Homo sapiens
cttgagtaggccctgc

SEQ ID NO: 2719315 - DNA, 22 bp, Homo sapiens
cttgattaaacagcaaagccat

SEQ ID NO: 2719316 - DNA, 12 bp, Homo sapiens
gatgactgagtc

SEQ ID NO: 2719317 - DNA, 18 bp, Homo sapiens
gatgagaaaactgagagg

SEQ ID NO: 2719318 - DNA, 15 bp, Homo sapiens
gatgatgccacacca

SEQ ID NO: 2719319 - DNA, 13 bp, Homo sapiens
gatgctggcctct

SEQ ID NO: 2719320 - DNA, 16 bp, Homo sapiens
gatgctggcctcttgg

SEQ ID NO: 2719321 - DNA, 14 bp, Homo sapiens
gatgctgggctggg

SEQ ID NO: 2719322 - DNA, 22 bp, Homo sapiens
gatggagcgcacctgccccctg

SEQ ID NO: 2719323 - DNA, 24 bp, Homo sapiens
gatggagtctcgctctgctgccca

SEQ ID NO: 2719324 - DNA, 19 bp, Homo sapiens
gatggcttatttgtataat

SEQ ID NO: 2719325 - DNA, 23 bp, Homo sapiens
gatggtctgcatcagctttttgt

SEQ ID NO: 2719326 - DNA, 20 bp, Homo sapiens
gatggtcttgatctcctgag

SEQ ID NO: 2719327 - DNA, 17 bp, Homo sapiens
gatggtgacttttgaag

SEQ ID NO: 2719328 - DNA, 20 bp, Homo sapiens
gatggtgacttttgaagaac

SEQ ID NO: 2719329 - DNA, 12 bp, Homo sapiens
gatgtcagcctt

SEQ ID NO: 2719330 - DNA, 17 bp, Homo sapiens
gatgtcatcaagctcca

SEQ ID NO: 2719331 - DNA, 21 bp, Homo sapiens
gattaaacagcaaagccatat

SEQ ID NO: 2719332 - DNA, 20 bp, Homo sapiens
gattaactttcaaaagcaaa

SEQ ID NO: 2719333 - DNA, 13 bp, Homo sapiens
gattacaataaat

SEQ ID NO: 2719334 - DNA, 20 bp, Homo sapiens
gattatatatcataaagtat

SEQ ID NO: 2719335 - DNA, 17 bp, Homo sapiens
gattattctgattccac

SEQ ID NO: 2719336 - DNA, 19 bp, Homo sapiens
gattattctgattccactt

SEQ ID NO: 2719337 - DNA, 22 bp, Homo sapiens
gattatttgttatttgtacagt

SEQ ID NO: 2719338 - DNA, 12 bp, Homo sapiens
gattcagcaaaa

SEQ ID NO: 2719339 - DNA, 16 bp, Homo sapiens
gattcaggagctcagt

SEQ ID NO: 2719340 - DNA, 18 bp, Homo sapiens
gattccaaagcattttca

SEQ ID NO: 2719341 - DNA, 13 bp, Homo sapiens
gattcccagagag

SEQ ID NO: 2719342 - DNA, 14 bp, Homo sapiens
gattcccagagaga

SEQ ID NO: 2719343 - DNA, 18 bp, Homo sapiens
gattcctcccccagagcc

SEQ ID NO: 2719344 - DNA, 15 bp, Homo sapiens
gattctcacctgcct

SEQ ID NO: 2719345 - DNA, 13 bp, Homo sapiens
gattgcactaaat

SEQ ID NO: 2719346 - DNA, 14 bp, Homo sapiens
gattgcactaaata

SEQ ID NO: 2719347 - DNA, 18 bp, Homo sapiens
gattggcacaagctccct

SEQ ID NO: 2719348 - DNA, 13 bp, Homo sapiens
gattggccctgcc

SEQ ID NO: 2719349 - DNA, 14 bp, Homo sapiens
gattggccctgccc

SEQ ID NO: 2719350 - DNA, 16 bp, Homo sapiens
gatttcccgtggcccc

SEQ ID NO: 2719351 - DNA, 21 bp, Homo sapiens
gatttcccgtggccccagcct

SEQ ID NO: 2719352 - DNA, 12 bp, Homo sapiens
gatttctagaat

SEQ ID NO: 2719353 - DNA, 20 bp, Homo sapiens
gatttcttattttcttggaa

SEQ ID NO: 2719354 - DNA, 22 bp, Homo sapiens
gatttgaggagcagcttcagtt

SEQ ID NO: 2719355 - DNA, 23 bp, Homo sapiens
gatttggaagagaggcacctgct

SEQ ID NO: 2719356 - DNA, 22 bp, Homo sapiens
gatttgtctttggtgaacattg

SEQ ID NO: 2719357 - DNA, 15 bp, Homo sapiens
gattttaccaaagca

SEQ ID NO: 2719358 - DNA, 19 bp, Homo sapiens
gattttaccaaagcatcaa

SEQ ID NO: 2719359 - DNA, 23 bp, Homo sapiens
gattttcttttgttttcttcatt

SEQ ID NO: 2719360 - DNA, 18 bp, Homo sapiens
gcaaaaacatatgtctgt

SEQ ID NO: 2719361 - DNA, 21 bp, Homo sapiens
gcaaacacacagactctgtga

SEQ ID NO: 2719362 - DNA, 15 bp, Homo sapiens
gcaaagccatattct

SEQ ID NO: 2719363 - DNA, 20 bp, Homo sapiens
gcaaagccatattctaaatt

SEQ ID NO: 2719364 - DNA, 15 bp, Homo sapiens
gcaaagtctaaagtt

SEQ ID NO: 2719365 - DNA, 16 bp, Homo sapiens
gcaaagtctaaagttt

SEQ ID NO: 2719366 - DNA, 13 bp, Homo sapiens
gcaaagttatatt

SEQ ID NO: 2719367 - DNA, 14 bp, Homo sapiens
gcaaagttatattt

SEQ ID NO: 2719368 - DNA, 14 bp, Homo sapiens
gcaaagttttcaga

SEQ ID NO: 2719369 - DNA, 19 bp, Homo sapiens
gcaacagagtgagaccctg

SEQ ID NO: 2719370 - DNA, 16 bp, Homo sapiens
gcaaccgtgcagccac

SEQ ID NO: 2719371 - DNA, 15 bp, Homo sapiens
gcaactcctgttctt

SEQ ID NO: 2719372 - DNA, 19 bp, Homo sapiens
gcaagacgtcctggaatga

SEQ ID NO: 2719373 - DNA, 17 bp, Homo sapiens
gcaagcaaaattatttt

SEQ ID NO: 2719374 - DNA, 19 bp, Homo sapiens
gcaaggacaacctgcccct

SEQ ID NO: 2719375 - DNA, 14 bp, Homo sapiens
gcaaggcacctgca

SEQ ID NO: 2719376 - DNA, 16 bp, Homo sapiens
gcaaggggaaacctgt

SEQ ID NO: 2719377 - DNA, 23 bp, Homo sapiens
gcaagtgctgtttgggcaggagt

SEQ ID NO: 2719378 - DNA, 16 bp, Homo sapiens
gcaatcctacttctat

SEQ ID NO: 2719379 - DNA, 14 bp, Homo sapiens
gcaattaactctgg

SEQ ID NO: 2719380 - DNA, 21 bp, Homo sapiens
gcaatttcaggaatttaattt

SEQ ID NO: 2719381 - DNA, 22 bp, Homo sapiens
gcacaacgctctaccctgcagc

SEQ ID NO: 2719382 - DNA, 14 bp, Homo sapiens
gcacaagctccctg

SEQ ID NO: 2719383 - DNA, 22 bp, Homo sapiens
gcacagcaaggaggctggctgg

SEQ ID NO: 2719384 - DNA, 11 bp, Homo sapiens
gcacagccctc

SEQ ID NO: 2719385 - DNA, 17 bp, Homo sapiens
gcacagccctcccgccc

SEQ ID NO: 2719386 - DNA, 22 bp, Homo sapiens
gcacagccctcccgccccttcc

SEQ ID NO: 2719387 - DNA, 11 bp, Homo sapiens
gcacagctcct

SEQ ID NO: 2719388 - DNA, 16 bp, Homo sapiens
gcacagctcctcccct

SEQ ID NO: 2719389 - DNA, 20 bp, Homo sapiens
gcacagctcctcccctgccg

SEQ ID NO: 2719390 - DNA, 22 bp, Homo sapiens
gcacagctcctcccctgccgcc

SEQ ID NO: 2719391 - DNA, 21 bp, Homo sapiens
gcacagcttcctgagtcaccc

SEQ ID NO: 2719392 - DNA, 23 bp, Homo sapiens
gcacaggaggctccgtgagccct

SEQ ID NO: 2719393 - DNA, 15 bp, Homo sapiens
gcacagggaggctgc

SEQ ID NO: 2719394 - DNA, 18 bp, Homo sapiens
gcacagtgtctgggctga

SEQ ID NO: 2719395 - DNA, 23 bp, Homo sapiens
gcacatctaaattgatcattcat

SEQ ID NO: 2719396 - DNA, 16 bp, Homo sapiens
gcacatggctggggga

SEQ ID NO: 2719397 - DNA, 10 bp, Homo sapiens
gcaccaaaga

SEQ ID NO: 2719398 - DNA, 18 bp, Homo sapiens
gcaccaacccagccgctg

SEQ ID NO: 2719399 - DNA, 22 bp, Homo sapiens
gcaccaacccagccgctgcccg

SEQ ID NO: 2719400 - DNA, 15 bp, Homo sapiens
gcacccccaaattca

SEQ ID NO: 2719401 - DNA, 16 bp, Homo sapiens
gcacccccaaattcaa

SEQ ID NO: 2719402 - DNA, 17 bp, Homo sapiens
gcaccccctcctgctgc

SEQ ID NO: 2719403 - DNA, 23 bp, Homo sapiens
gcacccgggctcagggaccacag

SEQ ID NO: 2719404 - DNA, 23 bp, Homo sapiens
gcaccctcattccctcgggaccc

SEQ ID NO: 2719405 - DNA, 19 bp, Homo sapiens
gcaccctccaaacactggg

SEQ ID NO: 2719406 - DNA, 14 bp, Homo sapiens
gcacctatggccca

SEQ ID NO: 2719407 - DNA, 19 bp, Homo sapiens
gcacctatggcccagccac

SEQ ID NO: 2719408 - DNA, 14 bp, Homo sapiens
gcacctgccagcct

SEQ ID NO: 2719409 - DNA, 15 bp, Homo sapiens
gcacctgccagcctg

SEQ ID NO: 2719410 - DNA, 14 bp, Homo sapiens
gcacctgcctagct

SEQ ID NO: 2719411 - DNA, 19 bp, Homo sapiens
gcacctgtactcaggaggc

SEQ ID NO: 2719412 - DNA, 21 bp, Homo sapiens
gcacctgtactcaggaggctg

SEQ ID NO: 2719413 - DNA, 15 bp, Homo sapiens
gcacgtattttaata

SEQ ID NO: 2719414 - DNA, 17 bp, Homo sapiens
gcacgtcaccctcctga

SEQ ID NO: 2719415 - DNA, 20 bp, Homo sapiens
gcacgtcaccctcctgagcc

SEQ ID NO: 2719416 - DNA, 21 bp, Homo sapiens
gcacgtcaccctcctgagcct

SEQ ID NO: 2719417 - DNA, 21 bp, Homo sapiens
gcacgttttctggcttctgct

SEQ ID NO: 2719418 - DNA, 22 bp, Homo sapiens
gcactagcattttcttgaacca

SEQ ID NO: 2719419 - DNA, 13 bp, Homo sapiens
gcactccagcctg

SEQ ID NO: 2719420 - DNA, 16 bp, Homo sapiens
gcactccagcctgggc

SEQ ID NO: 2719421 - DNA, 17 bp, Homo sapiens
gcactccagcctgggcg

SEQ ID NO: 2719422 - DNA, 19 bp, Homo sapiens
gcactccagcctgggcgac

SEQ ID NO: 2719423 - DNA, 14 bp, Homo sapiens
gcactcccccagga

SEQ ID NO: 2719424 - DNA, 15 bp, Homo sapiens
gcactcccccaggat

SEQ ID NO: 2719425 - DNA, 19 bp, Homo sapiens
gcactcctcggtactccca

SEQ ID NO: 2719426 - DNA, 11 bp, Homo sapiens
gcactctgtgc

SEQ ID NO: 2719427 - DNA, 14 bp, Homo sapiens
gcactctgtgccca

SEQ ID NO: 2719428 - DNA, 19 bp, Homo sapiens
gcactgcccagggaagccc

SEQ ID NO: 2719429 - DNA, 17 bp, Homo sapiens
gcactgctgggtggccc

SEQ ID NO: 2719430 - DNA, 19 bp, Homo sapiens
gcactgctgggtggcccat

SEQ ID NO: 2719431 - DNA, 15 bp, Homo sapiens
gcactgtcctgctcc

SEQ ID NO: 2719432 - DNA, 16 bp, Homo sapiens
gcactgtcctgctcca

SEQ ID NO: 2719433 - DNA, 18 bp, Homo sapiens
gcactgtcctgctccaca

SEQ ID NO: 2719434 - DNA, 19 bp, Homo sapiens
gcactgtcctgctccacag

SEQ ID NO: 2719435 - DNA, 21 bp, Homo sapiens
gcactgtcctgctccacagtg

SEQ ID NO: 2719436 - DNA, 21 bp, Homo sapiens
gcactttgggaggctgaggcg

SEQ ID NO: 2719437 - DNA, 22 bp, Homo sapiens
gcagaaaatcttttactagtgt

SEQ ID NO: 2719438 - DNA, 16 bp, Homo sapiens
gcagaactgctggggc

SEQ ID NO: 2719439 - DNA, 17 bp, Homo sapiens
gcagaactgctggggct

SEQ ID NO: 2719440 - DNA, 15 bp, Homo sapiens
gtgtagccccgggct

SEQ ID NO: 2719441 - DNA, 16 bp, Homo sapiens
gtgtagccccgggctg

SEQ ID NO: 2719442 - DNA, 22 bp, Homo sapiens
gtgtatgcaagtgggagatgaa

SEQ ID NO: 2719443 - DNA, 12 bp, Homo sapiens
gtgtatttaaga

SEQ ID NO: 2719444 - DNA, 22 bp, Homo sapiens
gtgtcaactttcatttgaaagt

SEQ ID NO: 2719445 - DNA, 14 bp, Homo sapiens
gtgtcaccctgcag

SEQ ID NO: 2719446 - DNA, 18 bp, Homo sapiens
gtgtcaccctgcagagct

SEQ ID NO: 2719447 - DNA, 14 bp, Homo sapiens
gtgtcactggctgc

SEQ ID NO: 2719448 - DNA, 16 bp, Homo sapiens
gtgtcactggctgcct

SEQ ID NO: 2719449 - DNA, 22 bp, Homo sapiens
gtgtccagaccattgtcttcca

SEQ ID NO: 2719450 - DNA, 17 bp, Homo sapiens
gtgtcctgtctgctggg

SEQ ID NO: 2719451 - DNA, 19 bp, Homo sapiens
gtgtcctgtctgctgggct

SEQ ID NO: 2719452 - DNA, 19 bp, Homo sapiens
gtgtctccaggtaactttg

SEQ ID NO: 2719453 - DNA, 20 bp, Homo sapiens
gtgtctctgcctggagcagg

SEQ ID NO: 2719454 - DNA, 23 bp, Homo sapiens
gtgtctctgcctggagcaggggt

SEQ ID NO: 2719455 - DNA, 14 bp, Homo sapiens
gtgtctgcaacatg

SEQ ID NO: 2719456 - DNA, 13 bp, Homo sapiens
gtgtctgggctga

SEQ ID NO: 2719457 - DNA, 12 bp, Homo sapiens
gtgtcttcctgt

SEQ ID NO: 2719458 - DNA, 13 bp, Homo sapiens
gtgtcttcctgtg

SEQ ID NO: 2719459 - DNA, 14 bp, Homo sapiens
gtgtcttcctgtgg

SEQ ID NO: 2719460 - DNA, 20 bp, Homo sapiens
gtgtgccccccatcctggcc

SEQ ID NO: 2719461 - DNA, 21 bp, Homo sapiens
gtgtgccccccatcctggccc

SEQ ID NO: 2719462 - DNA, 14 bp, Homo sapiens
gtgtgcctgcagcc

SEQ ID NO: 2719463 - DNA, 15 bp, Homo sapiens
gtgtgcctgcagccc

SEQ ID NO: 2719464 - DNA, 20 bp, Homo sapiens
gtgtgttcagtagttccagg

SEQ ID NO: 2719465 - DNA, 18 bp, Homo sapiens
gtgttaggcctggcacag

SEQ ID NO: 2719466 - DNA, 19 bp, Homo sapiens
gtgttaggcctggcacagt

SEQ ID NO: 2719467 - DNA, 24 bp, Homo sapiens
gtgttaggcctggcacagtgtctg

SEQ ID NO: 2719468 - DNA, 15 bp, Homo sapiens
gtgttggctttacaa

SEQ ID NO: 2719469 - DNA, 15 bp, Homo sapiens
gttaattctttctca

SEQ ID NO: 2719470 - DNA, 22 bp, Homo sapiens
gttactggctctttgtgtgtct

SEQ ID NO: 2719471 - DNA, 18 bp, Homo sapiens
gttagagaggtagcgagc

SEQ ID NO: 2719472 - DNA, 13 bp, Homo sapiens
gttaggcctggca

SEQ ID NO: 2719473 - DNA, 17 bp, Homo sapiens
gttatgatctactcatt

SEQ ID NO: 2719474 - DNA, 22 bp, Homo sapiens
gttattcttttccagaaagaaa

SEQ ID NO: 2719475 - DNA, 22 bp, Homo sapiens
gttatttttctctttaaaaaaa

SEQ ID NO: 2719476 - DNA, 21 bp, Homo sapiens
gttcaacagtttctcaagttt

SEQ ID NO: 2719477 - DNA, 12 bp, Homo sapiens
gttcaaggacta

SEQ ID NO: 2719478 - DNA, 15 bp, Homo sapiens
gttcagacttagttt

SEQ ID NO: 2719479 - DNA, 14 bp, Homo sapiens
gttcataatttcag

SEQ ID NO: 2719480 - DNA, 19 bp, Homo sapiens
gttcatgtgtaacttctag

SEQ ID NO: 2719481 - DNA, 22 bp, Homo sapiens
gttcattcaaaatgtccagctt

SEQ ID NO: 2719482 - DNA, 12 bp, Homo sapiens
gttccctcctgc

SEQ ID NO: 2719483 - DNA, 23 bp, Homo sapiens
gttcctcgggatgaaaagccata

SEQ ID NO: 2719484 - DNA, 13 bp, Homo sapiens
gttcctctttgca

SEQ ID NO: 2719485 - DNA, 19 bp, Homo sapiens
gttcgagaccagcctggcc

SEQ ID NO: 2719486 - DNA, 17 bp, Homo sapiens
gttctatttatttattg

SEQ ID NO: 2719487 - DNA, 12 bp, Homo sapiens
gttcttgtcatc

SEQ ID NO: 2719488 - DNA, 17 bp, Homo sapiens
gttgaaaaaagaagttt

SEQ ID NO: 2719489 - DNA, 13 bp, Homo sapiens
gttgaaagacatc

SEQ ID NO: 2719490 - DNA, 15 bp, Homo sapiens
gttgaaagacatcaa

SEQ ID NO: 2719491 - DNA, 17 bp, Homo sapiens
gttgaaagacatcaatg

SEQ ID NO: 2719492 - DNA, 15 bp, Homo sapiens
gttgaatatttaaag

SEQ ID NO: 2719493 - DNA, 16 bp, Homo sapiens
gttgaatggcctgcct

SEQ ID NO: 2719494 - DNA, 15 bp, Homo sapiens
gttgacccctcctga

SEQ ID NO: 2719495 - DNA, 16 bp, Homo sapiens
gttgaggggctcctgg

SEQ ID NO: 2719496 - DNA, 17 bp, Homo sapiens
gttgaggggctcctgga

SEQ ID NO: 2719497 - DNA, 18 bp, Homo sapiens
gttgcagtgaactgagac

SEQ ID NO: 2719498 - DNA, 20 bp, Homo sapiens
gttgctgttggcatcttgct

SEQ ID NO: 2719499 - DNA, 18 bp, Homo sapiens
gttggcagtgtttgtata

SEQ ID NO: 2719500 - DNA, 22 bp, Homo sapiens
gttggctttacaaataattttt

SEQ ID NO: 2719501 - DNA, 20 bp, Homo sapiens
gttgggccatactggcctcg

SEQ ID NO: 2719502 - DNA, 13 bp, Homo sapiens
gttgtctccctgg

SEQ ID NO: 2719503 - DNA, 19 bp, Homo sapiens
gttgtctccctggccctca

SEQ ID NO: 2719504 - DNA, 15 bp, Homo sapiens
gttgtcttgaaacct

SEQ ID NO: 2719505 - DNA, 21 bp, Homo sapiens
gttgtgatcatcccatctaag

SEQ ID NO: 2719506 - DNA, 19 bp, Homo sapiens
gttgtggaaagcctctgct

SEQ ID NO: 2719507 - DNA, 19 bp, Homo sapiens
gttgtgttaattctttctc

SEQ ID NO: 2719508 - DNA, 20 bp, Homo sapiens
gttgtgttaattctttctca

SEQ ID NO: 2719509 - DNA, 15 bp, Homo sapiens
gttgttagtttcttt

SEQ ID NO: 2719510 - DNA, 17 bp, Homo sapiens
gtttaaaaaaagtatat

SEQ ID NO: 2719511 - DNA, 19 bp, Homo sapiens
gtttaagcaatgcttctgc

SEQ ID NO: 2719512 - DNA, 18 bp, Homo sapiens
gtttacaacaaacactgt

SEQ ID NO: 2719513 - DNA, 15 bp, Homo sapiens
gtttacagtaaataa

SEQ ID NO: 2719514 - DNA, 13 bp, Homo sapiens
gtttatgtctaaa

SEQ ID NO: 2719515 - DNA, 15 bp, Homo sapiens
gtttatgtctaaaga

SEQ ID NO: 2719516 - DNA, 22 bp, Homo sapiens
gtttccagctaagcctgatgat

SEQ ID NO: 2719517 - DNA, 17 bp, Homo sapiens
gtttctcaaagaaattt

SEQ ID NO: 2719518 - DNA, 13 bp, Homo sapiens
gtttctcaagttt

SEQ ID NO: 2719519 - DNA, 14 bp, Homo sapiens
gtttctccccctgg

SEQ ID NO: 2719520 - DNA, 22 bp, Homo sapiens
gtttctccccctgggctctgcc

SEQ ID NO: 2719521 - DNA, 14 bp, Homo sapiens
gtttcttgcttctg

SEQ ID NO: 2719522 - DNA, 16 bp, Homo sapiens
gtttgatttctagtat

SEQ ID NO: 2719523 - DNA, 14 bp, Homo sapiens
gtttgcacataaaa

SEQ ID NO: 2719524 - DNA, 22 bp, Homo sapiens
gtttgcactgtatgctggacgg

SEQ ID NO: 2719525 - DNA, 19 bp, Homo sapiens
gtttgcttctaaaggtttc

SEQ ID NO: 2719526 - DNA, 21 bp, Homo sapiens
gtttgggggcttccctgggcc

SEQ ID NO: 2719527 - DNA, 16 bp, Homo sapiens
gtttgtcagtaaatac

SEQ ID NO: 2719528 - DNA, 17 bp, Homo sapiens
gttttagatttttaaaa

SEQ ID NO: 2719529 - DNA, 23 bp, Homo sapiens
gttttcagattgtaaaggtaggt

SEQ ID NO: 2719530 - DNA, 22 bp, Homo sapiens
gttttcccgagcaaagtctaaa

SEQ ID NO: 2719531 - DNA, 16 bp, Homo sapiens
gttttggagaaaaatt

SEQ ID NO: 2719532 - DNA, 12 bp, Homo sapiens
gttttgtaaatt

SEQ ID NO: 2719533 - DNA, 14 bp, Homo sapiens
gtttttcttacata

SEQ ID NO: 2719534 - DNA, 20 bp, Homo sapiens
gtttttgttgagtctctgaa

SEQ ID NO: 2719535 - DNA, 20 bp, Homo sapiens
taaaaaaaaaactgctttat

SEQ ID NO: 2719536 - DNA, 18 bp, Homo sapiens
taaaaaaagtatatattc

SEQ ID NO: 2719537 - DNA, 18 bp, Homo sapiens
taaaaaaatatatacaga

SEQ ID NO: 2719538 - DNA, 20 bp, Homo sapiens
taaaaagagagaaaacttat

SEQ ID NO: 2719539 - DNA, 19 bp, Homo sapiens
taaaaccccatctctacta

SEQ ID NO: 2719540 - DNA, 19 bp, Homo sapiens
taaaactaggctcaaaata

SEQ ID NO: 2719541 - DNA, 22 bp, Homo sapiens
taaaagatgcaattcaaagata

SEQ ID NO: 2719542 - DNA, 18 bp, Homo sapiens
taaaatagcacatgattt

SEQ ID NO: 2719543 - DNA, 20 bp, Homo sapiens
taaaatctggcaaagttata

SEQ ID NO: 2719544 - DNA, 13 bp, Homo sapiens
taaaatgctttaa

SEQ ID NO: 2719545 - DNA, 12 bp, Homo sapiens
taaaatgtttaa

SEQ ID NO: 2719546 - DNA, 17 bp, Homo sapiens
taaaattaatttgtgca

SEQ ID NO: 2719547 - DNA, 14 bp, Homo sapiens
taaaattgcacttt

SEQ ID NO: 2719548 - DNA, 14 bp, Homo sapiens
taaaattgtaaaat

SEQ ID NO: 2719549 - DNA, 16 bp, Homo sapiens
taaaattgtaaaattg

SEQ ID NO: 2719550 - DNA, 13 bp, Homo sapiens
taaaatttcaaca

SEQ ID NO: 2719551 - DNA, 23 bp, Homo sapiens
taaacagactatttaacttgagg

SEQ ID NO: 2719552 - DNA, 20 bp, Homo sapiens
taaacagcaaagccatattc

SEQ ID NO: 2719553 - DNA, 15 bp, Homo sapiens
taaacatacatgttg

SEQ ID NO: 2719554 - DNA, 20 bp, Homo sapiens
taaaccactaatgcttgcca

SEQ ID NO: 2719555 - DNA, 17 bp, Homo sapiens
taaaccttgtttctttc

SEQ ID NO: 2719556 - DNA, 22 bp, Homo sapiens
taaacgtattttgatcagtgtt

SEQ ID NO: 2719557 - DNA, 18 bp, Homo sapiens
taaactactttgaataga

SEQ ID NO: 2719558 - DNA, 15 bp, Homo sapiens
taaacttagaataaa

SEQ ID NO: 2719559 - DNA, 20 bp, Homo sapiens
taaacttagaataaaattgt

SEQ ID NO: 2719560 - DNA, 12 bp, Homo sapiens
taaacttcagca

SEQ ID NO: 2719561 - DNA, 16 bp, Homo sapiens
taaagaaaagttttgt

SEQ ID NO: 2719562 - DNA, 16 bp, Homo sapiens
taaagaaaatcaatga

SEQ ID NO: 2719563 - DNA, 13 bp, Homo sapiens
taaagaaaatgtg

SEQ ID NO: 2719564 - DNA, 17 bp, Homo sapiens
tcaagttccctcctgca

SEQ ID NO: 2719565 - DNA, 13 bp, Homo sapiens
tcaagtttaaagt

SEQ ID NO: 2719566 - DNA, 15 bp, Homo sapiens
tcaagtttaaagtca

SEQ ID NO: 2719567 - DNA, 15 bp, Homo sapiens
tcaatattaaatgac

SEQ ID NO: 2719568 - DNA, 17 bp, Homo sapiens
tcaatgaaggatttctt

SEQ ID NO: 2719569 - DNA, 12 bp, Homo sapiens
tcaattcattgt

SEQ ID NO: 2719570 - DNA, 15 bp, Homo sapiens
tcaattttgtattta

SEQ ID NO: 2719571 - DNA, 20 bp, Homo sapiens
tcaattttgtatttaatgat

SEQ ID NO: 2719572 - DNA, 19 bp, Homo sapiens
tcacaaaagctgtgtctct

SEQ ID NO: 2719573 - DNA, 20 bp, Homo sapiens
tcacaaaagctgtgtctctg

SEQ ID NO: 2719574 - DNA, 16 bp, Homo sapiens
tcacaaacaaatggct

SEQ ID NO: 2719575 - DNA, 21 bp, Homo sapiens
tcacaaacatatgtatctttg

SEQ ID NO: 2719576 - DNA, 17 bp, Homo sapiens
tcacacggggtatttta

SEQ ID NO: 2719577 - DNA, 14 bp, Homo sapiens
tcacactcctcctg

SEQ ID NO: 2719578 - DNA, 22 bp, Homo sapiens
tcacactcctcctgccagctct

SEQ ID NO: 2719579 - DNA, 18 bp, Homo sapiens
tcacagactcttccacca

SEQ ID NO: 2719580 - DNA, 13 bp, Homo sapiens
tcacagatgctgg

SEQ ID NO: 2719581 - DNA, 21 bp, Homo sapiens
tcacagatgctggcctcttgg

SEQ ID NO: 2719582 - DNA, 23 bp, Homo sapiens
tcacagatggaagaagttttaac

SEQ ID NO: 2719583 - DNA, 15 bp, Homo sapiens
tcacagcctctccct

SEQ ID NO: 2719584 - DNA, 14 bp, Homo sapiens
tcacagcgcctcct

SEQ ID NO: 2719585 - DNA, 17 bp, Homo sapiens
tcacagcgcctcctgga

SEQ ID NO: 2719586 - DNA, 18 bp, Homo sapiens
tcacaggactctgcagat

SEQ ID NO: 2719587 - DNA, 14 bp, Homo sapiens
tcacagggagctgg

SEQ ID NO: 2719588 - DNA, 15 bp, Homo sapiens
tcacagggcagagcc

SEQ ID NO: 2719589 - DNA, 19 bp, Homo sapiens
tcacaggtcttgcccaaag

SEQ ID NO: 2719590 - DNA, 22 bp, Homo sapiens
tcacagttaccctaaactctct

SEQ ID NO: 2719591 - DNA, 20 bp, Homo sapiens
tcacagttattattcttcta

SEQ ID NO: 2719592 - DNA, 22 bp, Homo sapiens
tcacatataaaagttaaactac

SEQ ID NO: 2719593 - DNA, 22 bp, Homo sapiens
tcaccacaacctccacctcctg

SEQ ID NO: 2719594 - DNA, 21 bp, Homo sapiens
tcaccatgcaagggtgacatc

SEQ ID NO: 2719595 - DNA, 12 bp, Homo sapiens
tcaccctcctga

SEQ ID NO: 2719596 - DNA, 13 bp, Homo sapiens
tcaccctcctgag

SEQ ID NO: 2719597 - DNA, 18 bp, Homo sapiens
tcaccctcctgagcctca

SEQ ID NO: 2719598 - DNA, 19 bp, Homo sapiens
tcaccctcctgagcctcac

SEQ ID NO: 2719599 - DNA, 20 bp, Homo sapiens
tcaccctcctgagcctcacc

SEQ ID NO: 2719600 - DNA, 13 bp, Homo sapiens
tcaccctgcagag

SEQ ID NO: 2719601 - DNA, 15 bp, Homo sapiens
tcaccctgcagagct

SEQ ID NO: 2719602 - DNA, 15 bp, Homo sapiens
tcaccctggccacca

SEQ ID NO: 2719603 - DNA, 13 bp, Homo sapiens
tcaccttcctagt

SEQ ID NO: 2719604 - DNA, 13 bp, Homo sapiens
tcaccttgcattt

SEQ ID NO: 2719605 - DNA, 19 bp, Homo sapiens
tcaccttgccgagagaggc

SEQ ID NO: 2719606 - DNA, 21 bp, Homo sapiens
tcaccttgccgagagaggcgc

SEQ ID NO: 2719607 - DNA, 21 bp, Homo sapiens
tcacgcctatgatcccagcac

SEQ ID NO: 2719608 - DNA, 18 bp, Homo sapiens
tcacgcttattgcccagg

SEQ ID NO: 2719609 - DNA, 18 bp, Homo sapiens
tcactattcaagtattag

SEQ ID NO: 2719610 - DNA, 17 bp, Homo sapiens
tcactccggtgtgcctg

SEQ ID NO: 2719611 - DNA, 20 bp, Homo sapiens
tcactccggtgtgcctgcag

SEQ ID NO: 2719612 - DNA, 23 bp, Homo sapiens
tcactccggtgtgcctgcagccc

SEQ ID NO: 2719613 - DNA, 17 bp, Homo sapiens
tcactgcaagctctgcc

SEQ ID NO: 2719614 - DNA, 18 bp, Homo sapiens
tcactgcaagctctgcct

SEQ ID NO: 2719615 - DNA, 22 bp, Homo sapiens
tcactgcagcctccttctcctg

SEQ ID NO: 2719616 - DNA, 14 bp, Homo sapiens
tcactgctctgccc

SEQ ID NO: 2719617 - DNA, 17 bp, Homo sapiens
tcactgctctgccccca

SEQ ID NO: 2719618 - DNA, 13 bp, Homo sapiens
tcactggagccca

SEQ ID NO: 2719619 - DNA, 15 bp, Homo sapiens
tcactggagcccagg

SEQ ID NO: 2719620 - DNA, 17 bp, Homo sapiens
tcactggagcccaggag

SEQ ID NO: 2719621 - DNA, 18 bp, Homo sapiens
tcactggctgcctccact

SEQ ID NO: 2719622 - DNA, 13 bp, Homo sapiens
tcacttatcctga

SEQ ID NO: 2719623 - DNA, 16 bp, Homo sapiens
tcacttgggtctctgg

SEQ ID NO: 2719624 - DNA, 14 bp, Homo sapiens
tcagaacaaaatca

SEQ ID NO: 2719625 - DNA, 16 bp, Homo sapiens
tcagaagtaactccca

SEQ ID NO: 2719626 - DNA, 17 bp, Homo sapiens
tcagaagtaactcccac

SEQ ID NO: 2719627 - DNA, 18 bp, Homo sapiens
tcagaagtaactcccact

SEQ ID NO: 2719628 - DNA, 17 bp, Homo sapiens
tcagaattttggaaaaa

SEQ ID NO: 2719629 - DNA, 20 bp, Homo sapiens
tcagaattttggaaaaatgt

SEQ ID NO: 2719630 - DNA, 21 bp, Homo sapiens
tcagaattttggaaaaatgtc

SEQ ID NO: 2719631 - DNA, 22 bp, Homo sapiens
tcagaattttggaaaaatgtca

SEQ ID NO: 2719632 - DNA, 15 bp, Homo sapiens
tcagacattccaagg

SEQ ID NO: 2719633 - DNA, 13 bp, Homo sapiens
tcagactcctggc

SEQ ID NO: 2719634 - DNA, 17 bp, Homo sapiens
tcagactgctgggactg

SEQ ID NO: 2719635 - DNA, 23 bp, Homo sapiens
tcagactgctgggactggccagg

SEQ ID NO: 2719636 - DNA, 21 bp, Homo sapiens
tcagactggctggctgcagtg

SEQ ID NO: 2719637 - DNA, 17 bp, Homo sapiens
tcagacttagtttttat

SEQ ID NO: 2719638 - DNA, 15 bp, Homo sapiens
tcagagaaaacttca

SEQ ID NO: 2719639 - DNA, 20 bp, Homo sapiens
tcagagagcatcttttcctc

SEQ ID NO: 2719640 - DNA, 14 bp, Homo sapiens
tcagagcctcagct

SEQ ID NO: 2719641 - DNA, 12 bp, Homo sapiens
tcagagctgcgg

SEQ ID NO: 2719642 - DNA, 13 bp, Homo sapiens
tcagagctgcggg

SEQ ID NO: 2719643 - DNA, 14 bp, Homo sapiens
tcagagctgcgggc

SEQ ID NO: 2719644 - DNA, 23 bp, Homo sapiens
tcagagctgcgggctgagggcat

SEQ ID NO: 2719645 - DNA, 14 bp, Homo sapiens
tcagagctgctgag

SEQ ID NO: 2719646 - DNA, 15 bp, Homo sapiens
tcagagctgctgagc

SEQ ID NO: 2719647 - DNA, 15 bp, Homo sapiens
tcagatcctgggcat

SEQ ID NO: 2719648 - DNA, 21 bp, Homo sapiens
tcagatgcccagagggcccag

SEQ ID NO: 2719649 - DNA, 24 bp, Homo sapiens
tcagatgtgttgacgtaagctcta

SEQ ID NO: 2719650 - DNA, 24 bp, Homo sapiens
tcagattgtaaaggtaggtgcatg

SEQ ID NO: 2719651 - DNA, 13 bp, Homo sapiens
tcagatttgtata

SEQ ID NO: 2719652 - DNA, 14 bp, Homo sapiens
tcagattttctcct

SEQ ID NO: 2719653 - DNA, 17 bp, Homo sapiens
tcagcaatagggtgcag

SEQ ID NO: 2719654 - DNA, 12 bp, Homo sapiens
tcagcagccccc

SEQ ID NO: 2719655 - DNA, 18 bp, Homo sapiens
tcagccagccctggaggc

SEQ ID NO: 2719656 - DNA, 20 bp, Homo sapiens
tcagcctcatgccccaggcc

SEQ ID NO: 2719657 - DNA, 20 bp, Homo sapiens
tcagcctcccaagtagctgg

SEQ ID NO: 2719658 - DNA, 11 bp, Homo sapiens
tcagcctcctg

SEQ ID NO: 2719659 - DNA, 18 bp, Homo sapiens
tcagcctgaggctgagac

SEQ ID NO: 2719660 - DNA, 15 bp, Homo sapiens
tcagctctcctgctg

SEQ ID NO: 2719661 - DNA, 19 bp, Homo sapiens
tcagctggtggatggtgac

SEQ ID NO: 2719662 - DNA, 21 bp, Homo sapiens
tcagctgtgaacatggactct

SEQ ID NO: 2719663 - DNA, 17 bp, Homo sapiens
tcagctgtggtcccacc

SEQ ID NO: 2719664 - DNA, 20 bp, Homo sapiens
tcagctgtggtcccacccag

SEQ ID NO: 2719665 - DNA, 21 bp, Homo sapiens
tcagctgtggtcccacccagg

SEQ ID NO: 2719666 - DNA, 16 bp, Homo sapiens
tcagcttctgctgggc

SEQ ID NO: 2719667 - DNA, 19 bp, Homo sapiens
tcagcttctgctgggctgg

SEQ ID NO: 2719668 - DNA, 14 bp, Homo sapiens
tcagctttttgtat

SEQ ID NO: 2719669 - DNA, 18 bp, Homo sapiens
tcaggaaaagcctctgtg

SEQ ID NO: 2719670 - DNA, 18 bp, Homo sapiens
tcaggaatttaatttata

SEQ ID NO: 2719671 - DNA, 21 bp, Homo sapiens
tcaggagctgacagagccaga

SEQ ID NO: 2719672 - DNA, 17 bp, Homo sapiens
tcaggaggggaagaggc

SEQ ID NO: 2719673 - DNA, 21 bp, Homo sapiens
tcaggatgtcctttgtgtcca

SEQ ID NO: 2719674 - DNA, 21 bp, Homo sapiens
tcaggctgggttgtcactgag

SEQ ID NO: 2719675 - DNA, 14 bp, Homo sapiens
tcaggcttccttgg

SEQ ID NO: 2719676 - DNA, 23 bp, Homo sapiens
tcaggcttccttggcatcacagg

SEQ ID NO: 2719677 - DNA, 23 bp, Homo sapiens
tcagggctgtcggtgtgctgtca

SEQ ID NO: 2719678 - DNA, 20 bp, Homo sapiens
tcaggggactgttctcacct

SEQ ID NO: 2719679 - DNA, 16 bp, Homo sapiens
tcaggggctgcccgct

SEQ ID NO: 2719680 - DNA, 14 bp, Homo sapiens
tcagtagttccagg

SEQ ID NO: 2719681 - DNA, 14 bp, Homo sapiens
tcagtgaaatcata

SEQ ID NO: 2719682 - DNA, 22 bp, Homo sapiens
tcagtgtacccccgcccaggct

SEQ ID NO: 2719683 - DNA, 23 bp, Homo sapiens
tcagtgtacccccgcccaggctg

SEQ ID NO: 2719684 - DNA, 14 bp, Homo sapiens
tcagtgtgcccccc

SEQ ID NO: 2719685 - DNA, 13 bp, Homo sapiens
tcataactagaac

SEQ ID NO: 2719686 - DNA, 15 bp, Homo sapiens
tcataactagaactg

SEQ ID NO: 2719687 - DNA, 12 bp, Homo sapiens
tcataattcacc

SEQ ID NO: 2719688 - DNA, 18 bp, Homo sapiens
tctattaagatttccaag

SEQ ID NO: 2719689 - DNA, 16 bp, Homo sapiens
tctattgtttattctt

SEQ ID NO: 2719690 - DNA, 17 bp, Homo sapiens
tctattgtttattcttt

SEQ ID NO: 2719691 - DNA, 15 bp, Homo sapiens
tctcacactcctcct

SEQ ID NO: 2719692 - DNA, 16 bp, Homo sapiens
tctcacactcctcctg

SEQ ID NO: 2719693 - DNA, 20 bp, Homo sapiens
tctcagagcagcactggggt

SEQ ID NO: 2719694 - DNA, 14 bp, Homo sapiens
tctcagagcctcag

SEQ ID NO: 2719695 - DNA, 20 bp, Homo sapiens
tctcagcagccagctcctgg

SEQ ID NO: 2719696 - DNA, 22 bp, Homo sapiens
tctccacagggacacagtctgg

SEQ ID NO: 2719697 - DNA, 15 bp, Homo sapiens
tctccacctagtggc

SEQ ID NO: 2719698 - DNA, 22 bp, Homo sapiens
tctccacctagtggctgtccag

SEQ ID NO: 2719699 - DNA, 19 bp, Homo sapiens
tctccactgtttcatgagc

SEQ ID NO: 2719700 - DNA, 21 bp, Homo sapiens
tctccactgtttcatgagccc

SEQ ID NO: 2719701 - DNA, 18 bp, Homo sapiens
tctccagcaagcagtgcc

SEQ ID NO: 2719702 - DNA, 11 bp, Homo sapiens
tctccagcctc

SEQ ID NO: 2719703 - DNA, 21 bp, Homo sapiens
tctccagctttccctccccag

SEQ ID NO: 2719704 - DNA, 17 bp, Homo sapiens
tctccatgcaagtgctg

SEQ ID NO: 2719705 - DNA, 18 bp, Homo sapiens
tctcccacgtgcacagct

SEQ ID NO: 2719706 - DNA, 21 bp, Homo sapiens
tctcccacgtgcacagcttcc

SEQ ID NO: 2719707 - DNA, 13 bp, Homo sapiens
tctcccccccggg

SEQ ID NO: 2719708 - DNA, 20 bp, Homo sapiens
tctccccctgggctctgccc

SEQ ID NO: 2719709 - DNA, 14 bp, Homo sapiens
tctcctccaccgcc

SEQ ID NO: 2719710 - DNA, 23 bp, Homo sapiens
tctcctcccaccagtggccccca

SEQ ID NO: 2719711 - DNA, 21 bp, Homo sapiens
tctcctcccatggccttccct

SEQ ID NO: 2719712 - DNA, 18 bp, Homo sapiens
tctcctgaacaatatttt

SEQ ID NO: 2719713 - DNA, 16 bp, Homo sapiens
tctcctgcctcagcct

SEQ ID NO: 2719714 - DNA, 23 bp, Homo sapiens
tctcctgcctcagcctcctgagt

SEQ ID NO: 2719715 - DNA, 14 bp, Homo sapiens
tctcctgtatcatt

SEQ ID NO: 2719716 - DNA, 14 bp, Homo sapiens
tctcctttcaggga

SEQ ID NO: 2719717 - DNA, 12 bp, Homo sapiens
tctcgctctgct

SEQ ID NO: 2719718 - DNA, 19 bp, Homo sapiens
tctcgctgatgctgggctg

SEQ ID NO: 2719719 - DNA, 21 bp, Homo sapiens
tctcggacctttcagctgtga

SEQ ID NO: 2719720 - DNA, 19 bp, Homo sapiens
tctcggcaccagtgcctca

SEQ ID NO: 2719721 - DNA, 14 bp, Homo sapiens
tctcggtggtacca

SEQ ID NO: 2719722 - DNA, 20 bp, Homo sapiens
tctctaaactgctgttaatt

SEQ ID NO: 2719723 - DNA, 20 bp, Homo sapiens
tctctactcctacctcagcc

SEQ ID NO: 2719724 - DNA, 21 bp, Homo sapiens
tctctactcctacctcagcct

SEQ ID NO: 2719725 - DNA, 20 bp, Homo sapiens
tctctagtccctgtgttctg

SEQ ID NO: 2719726 - DNA, 20 bp, Homo sapiens
tctctccagcctcacagatg

SEQ ID NO: 2719727 - DNA, 19 bp, Homo sapiens
tctctcccacgtgcacagc

SEQ ID NO: 2719728 - DNA, 17 bp, Homo sapiens
tctctctaacataacaa

SEQ ID NO: 2719729 - DNA, 12 bp, Homo sapiens
tctctctgcctg

SEQ ID NO: 2719730 - DNA, 14 bp, Homo sapiens
tctctctgctcagt

SEQ ID NO: 2719731 - DNA, 21 bp, Homo sapiens
tctctgacaatgcgtggcaca

SEQ ID NO: 2719732 - DNA, 20 bp, Homo sapiens
tctctgagtgtctctgcctg

SEQ ID NO: 2719733 - DNA, 13 bp, Homo sapiens
tctctgcctgctg

SEQ ID NO: 2719734 - DNA, 16 bp, Homo sapiens
tctctgcctgctgggc

SEQ ID NO: 2719735 - DNA, 18 bp, Homo sapiens
tctctgcctgctgggctc

SEQ ID NO: 2719736 - DNA, 18 bp, Homo sapiens
tctctgcctgcttcctgg

SEQ ID NO: 2719737 - DNA, 19 bp, Homo sapiens
tctctgcctgcttcctgga

SEQ ID NO: 2719738 - DNA, 20 bp, Homo sapiens
tctctgcctgcttcctggac

SEQ ID NO: 2719739 - DNA, 14 bp, Homo sapiens
tctctgctcagtga

SEQ ID NO: 2719740 - DNA, 15 bp, Homo sapiens
tctctggattcctgt

SEQ ID NO: 2719741 - DNA, 23 bp, Homo sapiens
tctctggctcagctgtggtccca

SEQ ID NO: 2719742 - DNA, 14 bp, Homo sapiens
tctctgttgtaaat

SEQ ID NO: 2719743 - DNA, 17 bp, Homo sapiens
tctctgttgtaaataac

SEQ ID NO: 2719744 - DNA, 14 bp, Homo sapiens
tctcttctctgtta

SEQ ID NO: 2719745 - DNA, 21 bp, Homo sapiens
tctcttgccccaaatcacaaa

SEQ ID NO: 2719746 - DNA, 15 bp, Homo sapiens
tctgaacaaaagctt

SEQ ID NO: 2719747 - DNA, 12 bp, Homo sapiens
tctgaaggagat

SEQ ID NO: 2719748 - DNA, 23 bp, Homo sapiens
tctgaaggcgtcaacgtgcattt

SEQ ID NO: 2719749 - DNA, 21 bp, Homo sapiens
tctgaatattaagaaacaatt

SEQ ID NO: 2719750 - DNA, 14 bp, Homo sapiens
tctgaatgtcccag

SEQ ID NO: 2719751 - DNA, 17 bp, Homo sapiens
tctgaccgggtctgctt

SEQ ID NO: 2719752 - DNA, 12 bp, Homo sapiens
tctgacctgcag

SEQ ID NO: 2719753 - DNA, 16 bp, Homo sapiens
tctgacctgcaggcca

SEQ ID NO: 2719754 - DNA, 13 bp, Homo sapiens
tctgaggagtgga

SEQ ID NO: 2719755 - DNA, 23 bp, Homo sapiens
tctgaggagtggagttctctgtt

SEQ ID NO: 2719756 - DNA, 19 bp, Homo sapiens
tctgaggctctttctgggc

SEQ ID NO: 2719757 - DNA, 17 bp, Homo sapiens
tctgagtgtctctgcct

SEQ ID NO: 2719758 - DNA, 20 bp, Homo sapiens
tctgataatgtattgcagtg

SEQ ID NO: 2719759 - DNA, 13 bp, Homo sapiens
tctgattccactt

SEQ ID NO: 2719760 - DNA, 22 bp, Homo sapiens
tctgattttgatattttcacag

SEQ ID NO: 2719761 - DNA, 13 bp, Homo sapiens
tctgcaactgaat

SEQ ID NO: 2719762 - DNA, 18 bp, Homo sapiens
tctgcagctttggctgca

SEQ ID NO: 2719763 - DNA, 21 bp, Homo sapiens
tctgcagctttggctgcacgt

SEQ ID NO: 2719764 - DNA, 14 bp, Homo sapiens
tctgcatcagcttt

SEQ ID NO: 2719765 - DNA, 21 bp, Homo sapiens
tctgcatgtaaaatcttcagc

SEQ ID NO: 2719766 - DNA, 21 bp, Homo sapiens
tctgcattcacagcgcctcct

SEQ ID NO: 2719767 - DNA, 15 bp, Homo sapiens
tctgccacttcccag

SEQ ID NO: 2719768 - DNA, 17 bp, Homo sapiens
tctgcccaactttcatt

SEQ ID NO: 2719769 - DNA, 23 bp, Homo sapiens
tctgcccaggacggggccggcca

SEQ ID NO: 2719770 - DNA, 15 bp, Homo sapiens
tctgccccaccctca

SEQ ID NO: 2719771 - DNA, 16 bp, Homo sapiens
tctgccccagctctgg

SEQ ID NO: 2719772 - DNA, 17 bp, Homo sapiens
tctgccccagctctggc

SEQ ID NO: 2719773 - DNA, 20 bp, Homo sapiens
tctgccccagctctggcttc

SEQ ID NO: 2719774 - DNA, 19 bp, Homo sapiens
tctgcccccaactcccgga

SEQ ID NO: 2719775 - DNA, 13 bp, Homo sapiens
tctgcccgcagag

SEQ ID NO: 2719776 - DNA, 14 bp, Homo sapiens
tctgcccgcagagc

SEQ ID NO: 2719777 - DNA, 22 bp, Homo sapiens
tctgcccgcctcggcctcccaa

SEQ ID NO: 2719778 - DNA, 14 bp, Homo sapiens
tctgcctcagcttc

SEQ ID NO: 2719779 - DNA, 14 bp, Homo sapiens
tctgcctcatcctc

SEQ ID NO: 2719780 - DNA, 19 bp, Homo sapiens
tctgcctcatcctcctcct

SEQ ID NO: 2719781 - DNA, 17 bp, Homo sapiens
tctgcctctaactccct

SEQ ID NO: 2719782 - DNA, 17 bp, Homo sapiens
tctgcctgagattcttt

SEQ ID NO: 2719783 - DNA, 13 bp, Homo sapiens
tctgcctgctggg

SEQ ID NO: 2719784 - DNA, 14 bp, Homo sapiens
tctgcctgctgggc

SEQ ID NO: 2719785 - DNA, 15 bp, Homo sapiens
tctgcctgctgggct

SEQ ID NO: 2719786 - DNA, 16 bp, Homo sapiens
tctgcctgctgggctc

SEQ ID NO: 2719787 - DNA, 18 bp, Homo sapiens
tctgcctgctgggctctt

SEQ ID NO: 2719788 - DNA, 18 bp, Homo sapiens
tctgcctgcttcctggac

SEQ ID NO: 2719789 - DNA, 13 bp, Homo sapiens
tctgcctggagca

SEQ ID NO: 2719790 - DNA, 17 bp, Homo sapiens
tctgctcgggcccaggc

SEQ ID NO: 2719791 - DNA, 22 bp, Homo sapiens
tctgctcgggcccaggccatct

SEQ ID NO: 2719792 - DNA, 12 bp, Homo sapiens
tctgctgcccag

SEQ ID NO: 2719793 - DNA, 12 bp, Homo sapiens
tctgcttctgca

SEQ ID NO: 2719794 - DNA, 16 bp, Homo sapiens
tctgcttttcctgtct

SEQ ID NO: 2719795 - DNA, 15 bp, Homo sapiens
tctggacagtacctg

SEQ ID NO: 2719796 - DNA, 23 bp, Homo sapiens
tctggacagtacctgattgtatt

SEQ ID NO: 2719797 - DNA, 17 bp, Homo sapiens
tctggacctctcttgtg

SEQ ID NO: 2719798 - DNA, 16 bp, Homo sapiens
tctggagcccttgggt

SEQ ID NO: 2719799 - DNA, 21 bp, Homo sapiens
tctggatttttacaaataaag

SEQ ID NO: 2719800 - DNA, 22 bp, Homo sapiens
tctggatttttacaaataaaga

SEQ ID NO: 2719801 - DNA, 19 bp, Homo sapiens
tctggcaaacatgtgcaac

SEQ ID NO: 2719802 - DNA, 14 bp, Homo sapiens
tctggccacactgg

SEQ ID NO: 2719803 - DNA, 14 bp, Homo sapiens
tctggctcagctgt

SEQ ID NO: 2719804 - DNA, 21 bp, Homo sapiens
tctggctttgttcttgtcatc

SEQ ID NO: 2719805 - DNA, 14 bp, Homo sapiens
tctgggaagaaaat

SEQ ID NO: 2719806 - DNA, 18 bp, Homo sapiens
tctgggaatgggagaggg

SEQ ID NO: 2719807 - DNA, 16 bp, Homo sapiens
tctgggccaagttcct

SEQ ID NO: 2719808 - DNA, 18 bp, Homo sapiens
tctgggtttacaacaaac

SEQ ID NO: 2719809 - DNA, 20 bp, Homo sapiens
tctgtatatagctctacaca

SEQ ID NO: 2719810 - DNA, 16 bp, Homo sapiens
tctgtcaccctggcca

SEQ ID NO: 2719811 - DNA, 19 bp, Homo sapiens
tctgtccaacccctccccc

SEQ ID NO: 2719812 - DNA, 16 bp, Homo sapiens
tggacccatttgccag

SEQ ID NO: 2719813 - DNA, 13 bp, Homo sapiens
tggaccctggcct

SEQ ID NO: 2719814 - DNA, 17 bp, Homo sapiens
tggacgttcggggcatg

SEQ ID NO: 2719815 - DNA, 15 bp, Homo sapiens
tggactctctgcctg

SEQ ID NO: 2719816 - DNA, 16 bp, Homo sapiens
tggactctctgcctgc

SEQ ID NO: 2719817 - DNA, 17 bp, Homo sapiens
tggactctctgcctgct

SEQ ID NO: 2719818 - DNA, 17 bp, Homo sapiens
tggacttgagcttggca

SEQ ID NO: 2719819 - DNA, 18 bp, Homo sapiens
tggagaaaagcacaatca

SEQ ID NO: 2719820 - DNA, 22 bp, Homo sapiens
tggagacgatcttgctggcagg

SEQ ID NO: 2719821 - DNA, 21 bp, Homo sapiens
tggagaggagggatgctgcct

SEQ ID NO: 2719822 - DNA, 17 bp, Homo sapiens
tggagatggtctgcatc

SEQ ID NO: 2719823 - DNA, 14 bp, Homo sapiens
tggagcatcccagg

SEQ ID NO: 2719824 - DNA, 15 bp, Homo sapiens
tggagcatcccaggc

SEQ ID NO: 2719825 - DNA, 16 bp, Homo sapiens
tggagcgcacctgccc

SEQ ID NO: 2719826 - DNA, 12 bp, Homo sapiens
tggagctgccag

SEQ ID NO: 2719827 - DNA, 20 bp, Homo sapiens
tggagctgccagcaccaagc

SEQ ID NO: 2719828 - DNA, 16 bp, Homo sapiens
tggaggaacattggga

SEQ ID NO: 2719829 - DNA, 21 bp, Homo sapiens
tggaggctgcgtcctgaggag

SEQ ID NO: 2719830 - DNA, 20 bp, Homo sapiens
tggagggtagccctggggcc

SEQ ID NO: 2719831 - DNA, 21 bp, Homo sapiens
tggaggtctcccctgatccag

SEQ ID NO: 2719832 - DNA, 22 bp, Homo sapiens
tggaggtctcccctgatccaga

SEQ ID NO: 2719833 - DNA, 15 bp, Homo sapiens
tggagtgctgcagct

SEQ ID NO: 2719834 - DNA, 22 bp, Homo sapiens
tggagtgtttgacgaagaaaca

SEQ ID NO: 2719835 - DNA, 22 bp, Homo sapiens
tggatccacgtgctcgcctctg

SEQ ID NO: 2719836 - DNA, 12 bp, Homo sapiens
tggatggctccc

SEQ ID NO: 2719837 - DNA, 18 bp, Homo sapiens
tggatggtgacttttgaa

SEQ ID NO: 2719838 - DNA, 20 bp, Homo sapiens
tggatggtgacttttgaaga

SEQ ID NO: 2719839 - DNA, 20 bp, Homo sapiens
tggattccaaagcattttca

SEQ ID NO: 2719840 - DNA, 22 bp, Homo sapiens
tggattgggcagaatcctgggc

SEQ ID NO: 2719841 - DNA, 17 bp, Homo sapiens
tggcaaacatgtgcaac

SEQ ID NO: 2719842 - DNA, 22 bp, Homo sapiens
tggcaatgccctacctgcctgt

SEQ ID NO: 2719843 - DNA, 21 bp, Homo sapiens
tggcacaacgctctaccctgc

SEQ ID NO: 2719844 - DNA, 20 bp, Homo sapiens
tggcacctgcctagctcttg

SEQ ID NO: 2719845 - DNA, 12 bp, Homo sapiens
tggcactgaccg

SEQ ID NO: 2719846 - DNA, 22 bp, Homo sapiens
tggcactgaccgccgcttccag

SEQ ID NO: 2719847 - DNA, 15 bp, Homo sapiens
tggcagaactgctgg

SEQ ID NO: 2719848 - DNA, 16 bp, Homo sapiens
tggcagaactgctggg

SEQ ID NO: 2719849 - DNA, 19 bp, Homo sapiens
tggcagaactgctggggct

SEQ ID NO: 2719850 - DNA, 17 bp, Homo sapiens
tggcagccctgtaggga

SEQ ID NO: 2719851 - DNA, 13 bp, Homo sapiens
tggcagctgggcc

SEQ ID NO: 2719852 - DNA, 14 bp, Homo sapiens
tggcagctgggccc

SEQ ID NO: 2719853 - DNA, 22 bp, Homo sapiens
tggcaggatgaccctgcgaagg

SEQ ID NO: 2719854 - DNA, 22 bp, Homo sapiens
tggcatcctggctggctgtgtc

SEQ ID NO: 2719855 - DNA, 16 bp, Homo sapiens
tggcattctctctgct

SEQ ID NO: 2719856 - DNA, 17 bp, Homo sapiens
tggcattctctctgctc

SEQ ID NO: 2719857 - DNA, 14 bp, Homo sapiens
tggcattggcagca

SEQ ID NO: 2719858 - DNA, 18 bp, Homo sapiens
tggccaaggctgagagct

SEQ ID NO: 2719859 - DNA, 13 bp, Homo sapiens
tggccaccaccca

SEQ ID NO: 2719860 - DNA, 13 bp, Homo sapiens
tggccagagctga

SEQ ID NO: 2719861 - DNA, 12 bp, Homo sapiens
tggccagcccca

SEQ ID NO: 2719862 - DNA, 13 bp, Homo sapiens
tggccagggcctc

SEQ ID NO: 2719863 - DNA, 15 bp, Homo sapiens
tggccagggcttgtg

SEQ ID NO: 2719864 - DNA, 16 bp, Homo sapiens
tggcccacagctctgc

SEQ ID NO: 2719865 - DNA, 20 bp, Homo sapiens
tggcccacagctctgctgga

SEQ ID NO: 2719866 - DNA, 15 bp, Homo sapiens
tggcccagccactgc

SEQ ID NO: 2719867 - DNA, 18 bp, Homo sapiens
tggcccagccactgcagc

SEQ ID NO: 2719868 - DNA, 12 bp, Homo sapiens
tggcccatcagt

SEQ ID NO: 2719869 - DNA, 16 bp, Homo sapiens
tggcccatcccccctc

SEQ ID NO: 2719870 - DNA, 16 bp, Homo sapiens
tggccccagcctggcc

SEQ ID NO: 2719871 - DNA, 21 bp, Homo sapiens
tggccccagcctggcccagct

SEQ ID NO: 2719872 - DNA, 18 bp, Homo sapiens
tggccctcaaggcctccc

SEQ ID NO: 2719873 - DNA, 23 bp, Homo sapiens
tggccctcaaggcctcccacagt

SEQ ID NO: 2719874 - DNA, 13 bp, Homo sapiens
tggccctcttctt

SEQ ID NO: 2719875 - DNA, 14 bp, Homo sapiens
tggccctgcccctc

SEQ ID NO: 2719876 - DNA, 17 bp, Homo sapiens
tggccctgcccctcccc

SEQ ID NO: 2719877 - DNA, 18 bp, Homo sapiens
tggccctgcccctccccc

SEQ ID NO: 2719878 - DNA, 23 bp, Homo sapiens
tggcctattttggacgtgtgagg

SEQ ID NO: 2719879 - DNA, 21 bp, Homo sapiens
tggcctctagaacacccactg

SEQ ID NO: 2719880 - DNA, 22 bp, Homo sapiens
tggcctctagaacacccactgg

SEQ ID NO: 2719881 - DNA, 15 bp, Homo sapiens
tggcctcttggcacc

SEQ ID NO: 2719882 - DNA, 11 bp, Homo sapiens
tggcctgggca

SEQ ID NO: 2719883 - DNA, 23 bp, Homo sapiens
tggccttgtccccagctccacct

SEQ ID NO: 2719884 - DNA, 14 bp, Homo sapiens
tggcgcaccctccc

SEQ ID NO: 2719885 - DNA, 18 bp, Homo sapiens
tggcggtgcgtgcctgta

SEQ ID NO: 2719886 - DNA, 16 bp, Homo sapiens
tggcgtgatctcggct

SEQ ID NO: 2719887 - DNA, 20 bp, Homo sapiens
tggctccagaatgtgctgcc

SEQ ID NO: 2719888 - DNA, 15 bp, Homo sapiens
tggctcccctgaggc

SEQ ID NO: 2719889 - DNA, 16 bp, Homo sapiens
tggctctccaccttgt

SEQ ID NO: 2719890 - DNA, 12 bp, Homo sapiens
tggctctgccag

SEQ ID NO: 2719891 - DNA, 12 bp, Homo sapiens
tggctctttgtg

SEQ ID NO: 2719892 - DNA, 18 bp, Homo sapiens
tggctgaacagtgctctg

SEQ ID NO: 2719893 - DNA, 20 bp, Homo sapiens
tggctgcctccactcccact

SEQ ID NO: 2719894 - DNA, 12 bp, Homo sapiens
tggctgggcatg

SEQ ID NO: 2719895 - DNA, 22 bp, Homo sapiens
tggctggggcctatcagtgtgc

SEQ ID NO: 2719896 - DNA, 16 bp, Homo sapiens
tggctgggggagggac

SEQ ID NO: 2719897 - DNA, 11 bp, Homo sapiens
tggctgtaaaa

SEQ ID NO: 2719898 - DNA, 13 bp, Homo sapiens
tggctgtaaaact

SEQ ID NO: 2719899 - DNA, 12 bp, Homo sapiens
tggctgtccagt

SEQ ID NO: 2719900 - DNA, 15 bp, Homo sapiens
tggctgtccagtgcc

SEQ ID NO: 2719901 - DNA, 18 bp, Homo sapiens
tggctgtccagtgcccat

SEQ ID NO: 2719902 - DNA, 21 bp, Homo sapiens
tggctgtggttcctaagcctg

SEQ ID NO: 2719903 - DNA, 13 bp, Homo sapiens
tggctgtgtcctc

SEQ ID NO: 2719904 - DNA, 15 bp, Homo sapiens
tggcttcagaattgt

SEQ ID NO: 2719905 - DNA, 22 bp, Homo sapiens
tggcttccagaaaaccccagca

SEQ ID NO: 2719906 - DNA, 23 bp, Homo sapiens
tggcttccagaaaaccccagcat

SEQ ID NO: 2719907 - DNA, 13 bp, Homo sapiens
tgggaatgggaga

SEQ ID NO: 2719908 - DNA, 23 bp, Homo sapiens
tgggagaacctcaggcttccttg

SEQ ID NO: 2719909 - DNA, 13 bp, Homo sapiens
tgggagagcccgt

SEQ ID NO: 2719910 - DNA, 13 bp, Homo sapiens
tgggaggaagcag

SEQ ID NO: 2719911 - DNA, 20 bp, Homo sapiens
tgggagtgagaatgccgggc

SEQ ID NO: 2719912 - DNA, 13 bp, Homo sapiens
tgggatcagcctc

SEQ ID NO: 2719913 - DNA, 19 bp, Homo sapiens
tgggattttatctgtggat

SEQ ID NO: 2719914 - DNA, 22 bp, Homo sapiens
tgggcagaatcctgggccccca

SEQ ID NO: 2719915 - DNA, 23 bp, Homo sapiens
tgggcagaatcctgggcccccag

SEQ ID NO: 2719916 - DNA, 19 bp, Homo sapiens
tgggcaggagtcaccatgc

SEQ ID NO: 2719917 - DNA, 17 bp, Homo sapiens
tgggcatttggtgagag

SEQ ID NO: 2719918 - DNA, 15 bp, Homo sapiens
tgggccatactggcc

SEQ ID NO: 2719919 - DNA, 16 bp, Homo sapiens
tgggccatactggcct

SEQ ID NO: 2719920 - DNA, 17 bp, Homo sapiens
tgggccatactggcctc

SEQ ID NO: 2719921 - DNA, 18 bp, Homo sapiens
tgggccatactggcctcg

SEQ ID NO: 2719922 - DNA, 24 bp, Homo sapiens
tgggccatactggcctcgcctggc

SEQ ID NO: 2719923 - DNA, 16 bp, Homo sapiens
tgggcccacagccccc

SEQ ID NO: 2719924 - DNA, 19 bp, Homo sapiens
tgggcccacagcccccacc

SEQ ID NO: 2719925 - DNA, 14 bp, Homo sapiens
tgggcccccagaga

SEQ ID NO: 2719926 - DNA, 22 bp, Homo sapiens
tgggcccccagagacctttgcc

SEQ ID NO: 2719927 - DNA, 14 bp, Homo sapiens
tgggcccctcaggg

SEQ ID NO: 2719928 - DNA, 14 bp, Homo sapiens
tgggccgagccacc

SEQ ID NO: 2719929 - DNA, 15 bp, Homo sapiens
tgggccgagccacct

SEQ ID NO: 2719930 - DNA, 18 bp, Homo sapiens
tgggcctcatctgctcct

SEQ ID NO: 2719931 - DNA, 21 bp, Homo sapiens
tgggcctgacctccagtcctg

SEQ ID NO: 2719932 - DNA, 12 bp, Homo sapiens
tgggcctgctgc

SEQ ID NO: 2719933 - DNA, 18 bp, Homo sapiens
tgggcgggcagcacagca

SEQ ID NO: 2719934 - DNA, 18 bp, Homo sapiens
tgggctacaaaccaggag

SEQ ID NO: 2719935 - DNA, 12 bp, Homo sapiens
tgggctctgccc

SEQ ID NO: 2719936 - DNA, 19 bp, Homo sapiens
ttccagtgtattttctgtg

SEQ ID NO: 2719937 - DNA, 17 bp, Homo sapiens
ttccagttttgttttga

SEQ ID NO: 2719938 - DNA, 16 bp, Homo sapiens
ttccatgatactttaa

SEQ ID NO: 2719939 - DNA, 22 bp, Homo sapiens
ttccatttctactgtataaaca

SEQ ID NO: 2719940 - DNA, 21 bp, Homo sapiens
ttcccactaagctttctcctt

SEQ ID NO: 2719941 - DNA, 24 bp, Homo sapiens
ttcccactgcaccccctcctgctg

SEQ ID NO: 2719942 - DNA, 14 bp, Homo sapiens
ttcccagtgagcct

SEQ ID NO: 2719943 - DNA, 15 bp, Homo sapiens
ttcccagtgagcctc

SEQ ID NO: 2719944 - DNA, 16 bp, Homo sapiens
ttcccagtgagcctct

SEQ ID NO: 2719945 - DNA, 22 bp, Homo sapiens
ttccccatgttggtcaggctgg

SEQ ID NO: 2719946 - DNA, 17 bp, Homo sapiens
ttcccccaaggctgatg

SEQ ID NO: 2719947 - DNA, 16 bp, Homo sapiens
ttcccccaccctgggt

SEQ ID NO: 2719948 - DNA, 16 bp, Homo sapiens
ttccccgagggatgat

SEQ ID NO: 2719949 - DNA, 22 bp, Homo sapiens
ttccccgagggatgatgccaca

SEQ ID NO: 2719950 - DNA, 13 bp, Homo sapiens
ttcccctcctacc

SEQ ID NO: 2719951 - DNA, 22 bp, Homo sapiens
ttcccgagcaaagtctaaagtt

SEQ ID NO: 2719952 - DNA, 23 bp, Homo sapiens
ttcccgagcaaagtctaaagttt

SEQ ID NO: 2719953 - DNA, 15 bp, Homo sapiens
ttcccgtggccccag

SEQ ID NO: 2719954 - DNA, 20 bp, Homo sapiens
ttccctccccacagtcctca

SEQ ID NO: 2719955 - DNA, 14 bp, Homo sapiens
ttccctcgggaccc

SEQ ID NO: 2719956 - DNA, 19 bp, Homo sapiens
ttccgtggcaaccctcagc

SEQ ID NO: 2719957 - DNA, 18 bp, Homo sapiens
ttcctacacccttggact

SEQ ID NO: 2719958 - DNA, 21 bp, Homo sapiens
ttcctcgggatgaaaagccat

SEQ ID NO: 2719959 - DNA, 23 bp, Homo sapiens
ttcctcgggatgaaaagccatat

SEQ ID NO: 2719960 - DNA, 12 bp, Homo sapiens
ttcctctttgca

SEQ ID NO: 2719961 - DNA, 22 bp, Homo sapiens
ttcctgacccggattggccctg

SEQ ID NO: 2719962 - DNA, 17 bp, Homo sapiens
ttcctgttgtgtaataa

SEQ ID NO: 2719963 - DNA, 18 bp, Homo sapiens
ttcgaactgtgctcccac

SEQ ID NO: 2719964 - DNA, 16 bp, Homo sapiens
ttcgagaccagcctgg

SEQ ID NO: 2719965 - DNA, 15 bp, Homo sapiens
ttcgaggtgtcaccc

SEQ ID NO: 2719966 - DNA, 22 bp, Homo sapiens
ttcgatgtacagtctcaatttt

SEQ ID NO: 2719967 - DNA, 18 bp, Homo sapiens
ttcgtgtaatattctctg

SEQ ID NO: 2719968 - DNA, 11 bp, Homo sapiens
ttctaaacaga

SEQ ID NO: 2719969 - DNA, 23 bp, Homo sapiens
ttctaaacagaaattattttcta

SEQ ID NO: 2719970 - DNA, 13 bp, Homo sapiens
ttctaacataagt

SEQ ID NO: 2719971 - DNA, 16 bp, Homo sapiens
ttctacacgtcctttc

SEQ ID NO: 2719972 - DNA, 17 bp, Homo sapiens
ttctattgtttattctt

SEQ ID NO: 2719973 - DNA, 12 bp, Homo sapiens
ttctattttgct

SEQ ID NO: 2719974 - DNA, 15 bp, Homo sapiens
ttctattttgctgga

SEQ ID NO: 2719975 - DNA, 19 bp, Homo sapiens
ttctcaagtttaaagtcat

SEQ ID NO: 2719976 - DNA, 20 bp, Homo sapiens
ttctcaccttaactcagcca

SEQ ID NO: 2719977 - DNA, 14 bp, Homo sapiens
ttctcatggatttg

SEQ ID NO: 2719978 - DNA, 20 bp, Homo sapiens
ttctcccccccggggctggg

SEQ ID NO: 2719979 - DNA, 17 bp, Homo sapiens
ttctccccctgggctct

SEQ ID NO: 2719980 - DNA, 12 bp, Homo sapiens
ttctcctgcctc

SEQ ID NO: 2719981 - DNA, 22 bp, Homo sapiens
ttctcctgcctcagcctcctga

SEQ ID NO: 2719982 - DNA, 21 bp, Homo sapiens
ttctcggcaccagtgcctcag

SEQ ID NO: 2719983 - DNA, 21 bp, Homo sapiens
ttctcttaggtggctctggga

SEQ ID NO: 2719984 - DNA, 22 bp, Homo sapiens
ttctcttaggtggctctgggaa

SEQ ID NO: 2719985 - DNA, 18 bp, Homo sapiens
ttctgaagtctactttgt

SEQ ID NO: 2719986 - DNA, 20 bp, Homo sapiens
ttctgacttacttaaccagg

SEQ ID NO: 2719987 - DNA, 23 bp, Homo sapiens
ttctgcattcacagcgcctcctg

SEQ ID NO: 2719988 - DNA, 14 bp, Homo sapiens
ttctgcctcagctt

SEQ ID NO: 2719989 - DNA, 11 bp, Homo sapiens
ttctgcctgag

SEQ ID NO: 2719990 - DNA, 18 bp, Homo sapiens
ttctgcctgagattcttt

SEQ ID NO: 2719991 - DNA, 15 bp, Homo sapiens
ttctgccttttttat

SEQ ID NO: 2719992 - DNA, 20 bp, Homo sapiens
ttctgctgggctggggcctg

SEQ ID NO: 2719993 - DNA, 14 bp, Homo sapiens
ttctggctttgttc

SEQ ID NO: 2719994 - DNA, 20 bp, Homo sapiens
ttctgggggagacatgctct

SEQ ID NO: 2719995 - DNA, 15 bp, Homo sapiens
ttctgggtgatttct

SEQ ID NO: 2719996 - DNA, 18 bp, Homo sapiens
ttctgtccagtttccaaa

SEQ ID NO: 2719997 - DNA, 13 bp, Homo sapiens
ttctgtctctgct

SEQ ID NO: 2719998 - DNA, 16 bp, Homo sapiens
ttctgtctctgcttgg

SEQ ID NO: 2719999 - DNA, 18 bp, Homo sapiens
ttctgtctctgcttggct

SEQ ID NO: 2720000 - DNA, 13 bp, Homo sapiens
ttctgttctactt

SEQ ID NO: 2720001 - DNA, 22 bp, Homo sapiens
ttcttcatcccttgcttaagaa

SEQ ID NO: 2720002 - DNA, 14 bp, Homo sapiens
ttcttggtatgatc

SEQ ID NO: 2720003 - DNA, 16 bp, Homo sapiens
ttcttggtatgatcat

SEQ ID NO: 2720004 - DNA, 15 bp, Homo sapiens
ttcttggtgcattcg

SEQ ID NO: 2720005 - DNA, 21 bp, Homo sapiens
ttctttaagaattacaggttg

SEQ ID NO: 2720006 - DNA, 16 bp, Homo sapiens
ttctttgcaccaaaga

SEQ ID NO: 2720007 - DNA, 22 bp, Homo sapiens
ttctttgcaccaaagacatcag

SEQ ID NO: 2720008 - DNA, 15 bp, Homo sapiens
ttcttttctctatga

SEQ ID NO: 2720009 - DNA, 16 bp, Homo sapiens
ttgaaaacccctggct

SEQ ID NO: 2720010 - DNA, 13 bp, Homo sapiens
ttgaaacagaaaa

SEQ ID NO: 2720011 - DNA, 16 bp, Homo sapiens
ttgaaagacatcaatg

SEQ ID NO: 2720012 - DNA, 17 bp, Homo sapiens
ttgaaagacatcaatga

SEQ ID NO: 2720013 - DNA, 19 bp, Homo sapiens
ttgaagaacaaaaggcttt

SEQ ID NO: 2720014 - DNA, 13 bp, Homo sapiens
ttgaagccactga

SEQ ID NO: 2720015 - DNA, 18 bp, Homo sapiens
ttgaaggtaataaataca

SEQ ID NO: 2720016 - DNA, 21 bp, Homo sapiens
ttgaatagaggccaaattaat

SEQ ID NO: 2720017 - DNA, 18 bp, Homo sapiens
ttgaatgtaagaacatga

SEQ ID NO: 2720018 - DNA, 17 bp, Homo sapiens
ttgaattttcccactgc

SEQ ID NO: 2720019 - DNA, 18 bp, Homo sapiens
ttgaattttcccactgca

SEQ ID NO: 2720020 - DNA, 21 bp, Homo sapiens
ttgataaattccactggactt

SEQ ID NO: 2720021 - DNA, 15 bp, Homo sapiens
ttgataacattttgt

SEQ ID NO: 2720022 - DNA, 18 bp, Homo sapiens
ttgataagagtgtaacat

SEQ ID NO: 2720023 - DNA, 13 bp, Homo sapiens
ttgatcattcata

SEQ ID NO: 2720024 - DNA, 13 bp, Homo sapiens
ttgatctcctgag

SEQ ID NO: 2720025 - DNA, 16 bp, Homo sapiens
ttgatgtcagccttgc

SEQ ID NO: 2720026 - DNA, 21 bp, Homo sapiens
ttgattaaacagcaaagccat

SEQ ID NO: 2720027 - DNA, 23 bp, Homo sapiens
ttgattaaacagcaaagccatat

SEQ ID NO: 2720028 - DNA, 15 bp, Homo sapiens
ttgattgcgagaatt

SEQ ID NO: 2720029 - DNA, 15 bp, Homo sapiens
ttgatttgagaaatt

SEQ ID NO: 2720030 - DNA, 15 bp, Homo sapiens
ttgcaatagaaatcc

SEQ ID NO: 2720031 - DNA, 22 bp, Homo sapiens
ttgcaatagaaatccaattgga

SEQ ID NO: 2720032 - DNA, 14 bp, Homo sapiens
ttgcactgaaaacc

SEQ ID NO: 2720033 - DNA, 17 bp, Homo sapiens
ttgcaggcccagcagac

SEQ ID NO: 2720034 - DNA, 17 bp, Homo sapiens
ttgcaggggactgggcc

SEQ ID NO: 2720035 - DNA, 22 bp, Homo sapiens
ttgcagtcttttgctgtgctgt

SEQ ID NO: 2720036 - DNA, 18 bp, Homo sapiens
ttgcataaacaatccaaa

SEQ ID NO: 2720037 - DNA, 20 bp, Homo sapiens
ttgcatgaattcacaaacaa

SEQ ID NO: 2720038 - DNA, 23 bp, Homo sapiens
ttgcattgaatttagtcattatt

SEQ ID NO: 2720039 - DNA, 14 bp, Homo sapiens
ttgccaagaaatcg

SEQ ID NO: 2720040 - DNA, 18 bp, Homo sapiens
ttgccatgggcctgctgc

SEQ ID NO: 2720041 - DNA, 17 bp, Homo sapiens
ttgcccacacacactcc

SEQ ID NO: 2720042 - DNA, 18 bp, Homo sapiens
ttgcccacacacactcct

SEQ ID NO: 2720043 - DNA, 22 bp, Homo sapiens
ttgcccacacacactccttccc

SEQ ID NO: 2720044 - DNA, 23 bp, Homo sapiens
ttgcccacacacactccttcccc

SEQ ID NO: 2720045 - DNA, 17 bp, Homo sapiens
ttgccccaacccccagc

SEQ ID NO: 2720046 - DNA, 17 bp, Homo sapiens
ttgcccggattctggga

SEQ ID NO: 2720047 - DNA, 13 bp, Homo sapiens
ttgcccttcctga

SEQ ID NO: 2720048 - DNA, 15 bp, Homo sapiens
ttgcccttcctgacc

SEQ ID NO: 2720049 - DNA, 16 bp, Homo sapiens
ttgcctcggctcctgc

SEQ ID NO: 2720050 - DNA, 22 bp, Homo sapiens
ttgcctcggctcctgctgcacc

SEQ ID NO: 2720051 - DNA, 15 bp, Homo sapiens
ttgccttaagtttcc

SEQ ID NO: 2720052 - DNA, 18 bp, Homo sapiens
ttgctacaataaatgctg

SEQ ID NO: 2720053 - DNA, 16 bp, Homo sapiens
ttgctagcaaacaaat

SEQ ID NO: 2720054 - DNA, 16 bp, Homo sapiens
ttgctccattttcttg

SEQ ID NO: 2720055 - DNA, 20 bp, Homo sapiens
ttgctccattttcttgtcaa

SEQ ID NO: 2720056 - DNA, 14 bp, Homo sapiens
ttgctgctgtggaa

SEQ ID NO: 2720057 - DNA, 12 bp, Homo sapiens
ttgctggagact

SEQ ID NO: 2720058 - DNA, 15 bp, Homo sapiens
ttgctggcagggcct

SEQ ID NO: 2720059 - DNA, 15 bp, Homo sapiens
ttgctgtcctaggcc

SEQ ID NO: 2720060 - DNA, 13 bp, Homo sapiens
aaaaaaaaacaaa

SEQ ID NO: 2720061 - DNA, 12 bp, Homo sapiens
aaaaaagcaaaa

SEQ ID NO: 2720062 - DNA, 10 bp, Homo sapiens
aaaaacagct

SEQ ID NO: 2720063 - DNA, 13 bp, Homo sapiens
aaaaagattatat

SEQ ID NO: 2720064 - DNA, 18 bp, Homo sapiens
aaaaagattatatatcat

SEQ ID NO: 2720065 - DNA, 21 bp, Homo sapiens
aaaaagtaagtaccactcagg

SEQ ID NO: 2720066 - DNA, 11 bp, Homo sapiens
aaaaagtatat

SEQ ID NO: 2720067 - DNA, 14 bp, Homo sapiens
aaaaagtatatatt

SEQ ID NO: 2720068 - DNA, 12 bp, Homo sapiens
aaaaataagttt

SEQ ID NO: 2720069 - DNA, 10 bp, Homo sapiens
aaaaataata

SEQ ID NO: 2720070 - DNA, 19 bp, Homo sapiens
aaaaattaaattctctcta

SEQ ID NO: 2720071 - DNA, 22 bp, Homo sapiens
aaaacaatgtattgctgataat

SEQ ID NO: 2720072 - DNA, 13 bp, Homo sapiens
aaaacagaagcaa

SEQ ID NO: 2720073 - DNA, 17 bp, Homo sapiens
aaaacataaaaattcag

SEQ ID NO: 2720074 - DNA, 13 bp, Homo sapiens
aaaactaaacata

SEQ ID NO: 2720075 - DNA, 17 bp, Homo sapiens
aaaactaggctcaaaat

SEQ ID NO: 2720076 - DNA, 23 bp, Homo sapiens
aaaagaagtttgggctaacattt

SEQ ID NO: 2720077 - DNA, 13 bp, Homo sapiens
aaaagaataaaca

SEQ ID NO: 2720078 - DNA, 19 bp, Homo sapiens
aaaagagagaaaacttatt

SEQ ID NO: 2720079 - DNA, 13 bp, Homo sapiens
aaaagattatata

SEQ ID NO: 2720080 - DNA, 15 bp, Homo sapiens
aaaagattatatatc

SEQ ID NO: 2720081 - DNA, 12 bp, Homo sapiens
aaaagcagcttt

SEQ ID NO: 2720082 - DNA, 23 bp, Homo sapiens
aaaagcagcttttagttcagact

SEQ ID NO: 2720083 - DNA, 20 bp, Homo sapiens
aaaagctgtagctggagaag

SEQ ID NO: 2720084 - DNA, 13 bp, Homo sapiens
aaaagctgtgtct

SEQ ID NO: 2720085 - DNA, 15 bp, Homo sapiens
aaaaggttttatttt

SEQ ID NO: 2720086 - DNA, 17 bp, Homo sapiens
aaaaggttttattttgt

SEQ ID NO: 2720087 - DNA, 23 bp, Homo sapiens
aaaagtaagtaccactcaggcca

SEQ ID NO: 2720088 - DNA, 19 bp, Homo sapiens
aaaagtcagactgctggga

SEQ ID NO: 2720089 - DNA, 22 bp, Homo sapiens
aaaagttcatataatttaaaga

SEQ ID NO: 2720090 - DNA, 23 bp, Homo sapiens
aaaagtttgtcctttaactatca

SEQ ID NO: 2720091 - DNA, 19 bp, Homo sapiens
aagtctaaagtttacagta

SEQ ID NO: 2720092 - DNA, 13 bp, Homo sapiens
aagtctctgctgc

SEQ ID NO: 2720093 - DNA, 12 bp, Homo sapiens
aagtgaataaac

SEQ ID NO: 2720094 - DNA, 17 bp, Homo sapiens
aagtgaataaacttcag

SEQ ID NO: 2720095 - DNA, 18 bp, Homo sapiens
aagtgaataaacttcagc

SEQ ID NO: 2720096 - DNA, 22 bp, Homo sapiens
aagtgacagatcctccattttt

SEQ ID NO: 2720097 - DNA, 18 bp, Homo sapiens
aagtgagactttgagggt

SEQ ID NO: 2720098 - DNA, 17 bp, Homo sapiens
aagtgcagctcaggaga

SEQ ID NO: 2720099 - DNA, 21 bp, Homo sapiens
aagtgctgtttgggcaggagt

SEQ ID NO: 2720100 - DNA, 18 bp, Homo sapiens
aagtgggagatgaaaacc

SEQ ID NO: 2720101 - DNA, 17 bp, Homo sapiens
aagtgtcctggaccctg

SEQ ID NO: 2720102 - DNA, 20 bp, Homo sapiens
aagtgtctcttgactggctc

SEQ ID NO: 2720103 - DNA, 20 bp, Homo sapiens
aagttactggctctttgtgt

SEQ ID NO: 2720104 - DNA, 13 bp, Homo sapiens
aagttagctcagg

SEQ ID NO: 2720105 - DNA, 12 bp, Homo sapiens
aagttatattta

SEQ ID NO: 2720106 - DNA, 15 bp, Homo sapiens
aagttgacatttaac

SEQ ID NO: 2720107 - DNA, 12 bp, Homo sapiens
aagtttacagta

SEQ ID NO: 2720108 - DNA, 21 bp, Homo sapiens
aagtttacagtaaataaattg

SEQ ID NO: 2720109 - DNA, 14 bp, Homo sapiens
aagtttgcactgta

SEQ ID NO: 2720110 - DNA, 17 bp, Homo sapiens
aagttttatacataaac

SEQ ID NO: 2720111 - DNA, 17 bp, Homo sapiens
aagttttatatgtagaa

SEQ ID NO: 2720112 - DNA, 14 bp, Homo sapiens
aataaaaaaatata

SEQ ID NO: 2720113 - DNA, 12 bp, Homo sapiens
aataaaatagag

SEQ ID NO: 2720114 - DNA, 14 bp, Homo sapiens
aataaaattgcact

SEQ ID NO: 2720115 - DNA, 15 bp, Homo sapiens
aataaaccttgtttc

SEQ ID NO: 2720116 - DNA, 21 bp, Homo sapiens
aataaacttagaataaaattg

SEQ ID NO: 2720117 - DNA, 12 bp, Homo sapiens
aataaagcaaat

SEQ ID NO: 2720118 - DNA, 13 bp, Homo sapiens
aataaagcagagt

SEQ ID NO: 2720119 - DNA, 17 bp, Homo sapiens
aataaatcctttacttt

SEQ ID NO: 2720120 - DNA, 16 bp, Homo sapiens
aataaccacactgaaa

SEQ ID NO: 2720121 - DNA, 23 bp, Homo sapiens
aataataaaaaaatatatacaga

SEQ ID NO: 2720122 - DNA, 14 bp, Homo sapiens
aataattttttgca

SEQ ID NO: 2720123 - DNA, 19 bp, Homo sapiens
aatacacagcatgcagact

SEQ ID NO: 2720124 - DNA, 16 bp, Homo sapiens
aatactccattatttt

SEQ ID NO: 2720125 - DNA, 22 bp, Homo sapiens
aatagaggccaaattaatcttt

SEQ ID NO: 2720126 - DNA, 22 bp, Homo sapiens
aatagatttcagctatgcagaa

SEQ ID NO: 2720127 - DNA, 19 bp, Homo sapiens
aataggatgaatgggaaag

SEQ ID NO: 2720128 - DNA, 22 bp, Homo sapiens
aatagtctctgggtttacaaca

SEQ ID NO: 2720129 - DNA, 14 bp, Homo sapiens
aatagttttttact

SEQ ID NO: 2720130 - DNA, 22 bp, Homo sapiens
aatatagttgtctttctttgct

SEQ ID NO: 2720131 - DNA, 19 bp, Homo sapiens
aatatatacagattcctgt

SEQ ID NO: 2720132 - DNA, 17 bp, Homo sapiens
aatatgattgcactaaa

SEQ ID NO: 2720133 - DNA, 19 bp, Homo sapiens
aatatgattgcactaaata

SEQ ID NO: 2720134 - DNA, 17 bp, Homo sapiens
aatatgtgaaaatgatt

SEQ ID NO: 2720135 - DNA, 18 bp, Homo sapiens
aatatgtgaaaatgatta

SEQ ID NO: 2720136 - DNA, 15 bp, Homo sapiens
aatattaagaaacaa

SEQ ID NO: 2720137 - DNA, 18 bp, Homo sapiens
aatattaagaaacaattt

SEQ ID NO: 2720138 - DNA, 18 bp, Homo sapiens
aatattaatggaaacatg

SEQ ID NO: 2720139 - DNA, 17 bp, Homo sapiens
aatattcagagaaaact

SEQ ID NO: 2720140 - DNA, 16 bp, Homo sapiens
aatattcttttgttat

SEQ ID NO: 2720141 - DNA, 13 bp, Homo sapiens
aatattggtttgt

SEQ ID NO: 2720142 - DNA, 17 bp, Homo sapiens
aatattgttgtttacca

SEQ ID NO: 2720143 - DNA, 19 bp, Homo sapiens
aatcaacagtgaacagctt

SEQ ID NO: 2720144 - DNA, 17 bp, Homo sapiens
aatcaagagtctctcca

SEQ ID NO: 2720145 - DNA, 23 bp, Homo sapiens
aatcaagagtctctccagcctca

SEQ ID NO: 2720146 - DNA, 20 bp, Homo sapiens
aatcaagtctgtgaaagtct

SEQ ID NO: 2720147 - DNA, 16 bp, Homo sapiens
aatcacaaacatatgt

SEQ ID NO: 2720148 - DNA, 16 bp, Homo sapiens
aatccaaatgcattca

SEQ ID NO: 2720149 - DNA, 15 bp, Homo sapiens
aatccagtagggaaa

SEQ ID NO: 2720150 - DNA, 13 bp, Homo sapiens
aatcctgggcccc

SEQ ID NO: 2720151 - DNA, 17 bp, Homo sapiens
aatcctggtttgtaatg

SEQ ID NO: 2720152 - DNA, 21 bp, Homo sapiens
aatccttaaactagctaaaac

SEQ ID NO: 2720153 - DNA, 16 bp, Homo sapiens
aatcgccttatgagaa

SEQ ID NO: 2720154 - DNA, 14 bp, Homo sapiens
aatcttcagctggt

SEQ ID NO: 2720155 - DNA, 20 bp, Homo sapiens
aatcttcagctggtggatgg

SEQ ID NO: 2720156 - DNA, 17 bp, Homo sapiens
aatgaaccgtttacagt

SEQ ID NO: 2720157 - DNA, 18 bp, Homo sapiens
aatgaaccgtttacagtg

SEQ ID NO: 2720158 - DNA, 13 bp, Homo sapiens
aatgagacacata

SEQ ID NO: 2720159 - DNA, 14 bp, Homo sapiens
aatgagactatgcg

SEQ ID NO: 2720160 - DNA, 18 bp, Homo sapiens
aatgagcttgtaaatact

SEQ ID NO: 2720161 - DNA, 22 bp, Homo sapiens
aatgaggaacaatcacaaaagc

SEQ ID NO: 2720162 - DNA, 12 bp, Homo sapiens
aatgatgataat

SEQ ID NO: 2720163 - DNA, 16 bp, Homo sapiens
aatgatgataatcatc

SEQ ID NO: 2720164 - DNA, 21 bp, Homo sapiens
aatgatgatgatgatgatgaa

SEQ ID NO: 2720165 - DNA, 17 bp, Homo sapiens
aatgatttttgtgtatc

SEQ ID NO: 2720166 - DNA, 18 bp, Homo sapiens
aatgcagaggaggagaaa

SEQ ID NO: 2720167 - DNA, 17 bp, Homo sapiens
aatgcaggagagcttcc

SEQ ID NO: 2720168 - DNA, 21 bp, Homo sapiens
aatgcataattggcaaaaaaa

SEQ ID NO: 2720169 - DNA, 15 bp, Homo sapiens
aatgcattcatgttt

SEQ ID NO: 2720170 - DNA, 13 bp, Homo sapiens
aatgccttggttt

SEQ ID NO: 2720171 - DNA, 21 bp, Homo sapiens
aatgctgcccagggtcagtgt

SEQ ID NO: 2720172 - DNA, 20 bp, Homo sapiens
aatggaactccccagggcct

SEQ ID NO: 2720173 - DNA, 18 bp, Homo sapiens
aatggcacgatctcagct

SEQ ID NO: 2720174 - DNA, 20 bp, Homo sapiens
aatggcctgccttgaagcca

SEQ ID NO: 2720175 - DNA, 17 bp, Homo sapiens
aatggtgttactaaagt

SEQ ID NO: 2720176 - DNA, 21 bp, Homo sapiens
aatgtcactgaagtgattgaa

SEQ ID NO: 2720177 - DNA, 22 bp, Homo sapiens
aatgtcattatttgataacatt

SEQ ID NO: 2720178 - DNA, 18 bp, Homo sapiens
aatgtcctgcatgcataa

SEQ ID NO: 2720179 - DNA, 14 bp, Homo sapiens
aatgtgtcattgga

SEQ ID NO: 2720180 - DNA, 13 bp, Homo sapiens
aatgttgcactga

SEQ ID NO: 2720181 - DNA, 18 bp, Homo sapiens
aatgttgcactgaaaacc

SEQ ID NO: 2720182 - DNA, 13 bp, Homo sapiens
aatgtttaattca

SEQ ID NO: 2720183 - DNA, 14 bp, Homo sapiens
aatgtttaattcat

SEQ ID NO: 2720184 - DNA, 18 bp, Homo sapiens
aatgtttgtcagtaaata

SEQ ID NO: 2720185 - DNA, 22 bp, Homo sapiens
aatgtttgtcagtaaatactcc

SEQ ID NO: 2720186 - DNA, 23 bp, Homo sapiens
aattaactccgtttccaaataca

SEQ ID NO: 2720187 - DNA, 14 bp, Homo sapiens
aattaactctggac

SEQ ID NO: 2720188 - DNA, 14 bp, Homo sapiens
aattaatcttttaa

SEQ ID NO: 2720189 - DNA, 17 bp, Homo sapiens
aattaatcttttaaaaa

SEQ ID NO: 2720190 - DNA, 21 bp, Homo sapiens
aattatttattttaatgtatt

SEQ ID NO: 2720191 - DNA, 18 bp, Homo sapiens
aattattttccaaaatct

SEQ ID NO: 2720192 - DNA, 15 bp, Homo sapiens
aattcactgttgaat

SEQ ID NO: 2720193 - DNA, 16 bp, Homo sapiens
aaggtgtcatttgaca

SEQ ID NO: 2720194 - DNA, 19 bp, Homo sapiens
aaggtttcccagtgagcct

SEQ ID NO: 2720195 - DNA, 20 bp, Homo sapiens
aaggtttcccagtgagcctc

SEQ ID NO: 2720196 - DNA, 13 bp, Homo sapiens
aagtaaattttac

SEQ ID NO: 2720197 - DNA, 19 bp, Homo sapiens
aagtaactcccactcctaa

SEQ ID NO: 2720198 - DNA, 18 bp, Homo sapiens
aagtaagtaccactcagg

SEQ ID NO: 2720199 - DNA, 16 bp, Homo sapiens
aagtagtagtgtcttc

SEQ ID NO: 2720200 - DNA, 20 bp, Homo sapiens
aagtataggataaattacat

SEQ ID NO: 2720201 - DNA, 22 bp, Homo sapiens
aagtataggataaattacatta

SEQ ID NO: 2720202 - DNA, 23 bp, Homo sapiens
aagtatatattctacacatatat

SEQ ID NO: 2720203 - DNA, 20 bp, Homo sapiens
aagtattaggggtaatatat

SEQ ID NO: 2720204 - DNA, 22 bp, Homo sapiens
aagtatttttatttaaattatt

SEQ ID NO: 2720205 - DNA, 16 bp, Homo sapiens
aagtcaacactcttct

SEQ ID NO: 2720206 - DNA, 19 bp, Homo sapiens
aagtcaacactcttcttga

SEQ ID NO: 2720207 - DNA, 20 bp, Homo sapiens
aagtcagactgctgggactg

SEQ ID NO: 2720208 - DNA, 20 bp, Homo sapiens
aagtcattgtcgctcagcaa

SEQ ID NO: 2720209 - DNA, 19 bp, Homo sapiens
aagtccctgactctctgtg

SEQ ID NO: 2720210 - DNA, 15 bp, Homo sapiens
aagtctaaagtttac

SEQ ID NO: 2720211 - DNA, 17 bp, Homo sapiens
aagtctaaagtttacag

SEQ ID NO: 2720212 - DNA, 17 bp, Homo sapiens
acgttttctggcttctg

SEQ ID NO: 2720213 - DNA, 19 bp, Homo sapiens
actaaaatgtttaattcat

SEQ ID NO: 2720214 - DNA, 18 bp, Homo sapiens
actaaataaactactttg

SEQ ID NO: 2720215 - DNA, 13 bp, Homo sapiens
actaaattagttt

SEQ ID NO: 2720216 - DNA, 18 bp, Homo sapiens
actaaattagtttaaaat

SEQ ID NO: 2720217 - DNA, 20 bp, Homo sapiens
actaacgaacgttttaaagc

SEQ ID NO: 2720218 - DNA, 15 bp, Homo sapiens
actacactccagcct

SEQ ID NO: 2720219 - DNA, 18 bp, Homo sapiens
actacactccagcctgag

SEQ ID NO: 2720220 - DNA, 18 bp, Homo sapiens
actaccagtgggcatgta

SEQ ID NO: 2720221 - DNA, 15 bp, Homo sapiens
actagaaatctgcca

SEQ ID NO: 2720222 - DNA, 16 bp, Homo sapiens
actagaactgaatttt

SEQ ID NO: 2720223 - DNA, 17 bp, Homo sapiens
actagattctcacctgc

SEQ ID NO: 2720224 - DNA, 21 bp, Homo sapiens
actagcactttataagccaat

SEQ ID NO: 2720225 - DNA, 16 bp, Homo sapiens
actaggactctgaggc

SEQ ID NO: 2720226 - DNA, 12 bp, Homo sapiens
actagggcctcg

SEQ ID NO: 2720227 - DNA, 21 bp, Homo sapiens
actagggcctcggaggctcct

SEQ ID NO: 2720228 - DNA, 22 bp, Homo sapiens
actatctttttgcttacagttt

SEQ ID NO: 2720229 - DNA, 23 bp, Homo sapiens
actatgccgtgtagtttctggta

SEQ ID NO: 2720230 - DNA, 23 bp, Homo sapiens
actatgtaatgcttatgtgttgc

SEQ ID NO: 2720231 - DNA, 13 bp, Homo sapiens
actattcaagtat

SEQ ID NO: 2720232 - DNA, 19 bp, Homo sapiens
actattggagggtgggaga

SEQ ID NO: 2720233 - DNA, 15 bp, Homo sapiens
actatttaacttgag

SEQ ID NO: 2720234 - DNA, 20 bp, Homo sapiens
actatttaagtactatcttt

SEQ ID NO: 2720235 - DNA, 13 bp, Homo sapiens
actcagaagcctg

SEQ ID NO: 2720236 - DNA, 14 bp, Homo sapiens
actcagaagcctga

SEQ ID NO: 2720237 - DNA, 18 bp, Homo sapiens
actcagaagcctgaggct

SEQ ID NO: 2720238 - DNA, 15 bp, Homo sapiens
actcagactcctggc

SEQ ID NO: 2720239 - DNA, 19 bp, Homo sapiens
actcagactcctggcttca

SEQ ID NO: 2720240 - DNA, 14 bp, Homo sapiens
actcagagctgcgg

SEQ ID NO: 2720241 - DNA, 21 bp, Homo sapiens
actcagagctgcgggctgagg

SEQ ID NO: 2720242 - DNA, 21 bp, Homo sapiens
actcagccagaaagatgccct

SEQ ID NO: 2720243 - DNA, 17 bp, Homo sapiens
actcagctctcctgctg

SEQ ID NO: 2720244 - DNA, 19 bp, Homo sapiens
actcagctctcctgctgca

SEQ ID NO: 2720245 - DNA, 16 bp, Homo sapiens
actcaggaggctgagg

SEQ ID NO: 2720246 - DNA, 18 bp, Homo sapiens
actcaggaggctgagggg

SEQ ID NO: 2720247 - DNA, 21 bp, Homo sapiens
actcaggtagggagctaagga

SEQ ID NO: 2720248 - DNA, 15 bp, Homo sapiens
actccacctccaccc

SEQ ID NO: 2720249 - DNA, 19 bp, Homo sapiens
actccagaattacccttcc

SEQ ID NO: 2720250 - DNA, 20 bp, Homo sapiens
actccagaattacccttcct

SEQ ID NO: 2720251 - DNA, 22 bp, Homo sapiens
actccagaattacccttcctca

SEQ ID NO: 2720252 - DNA, 19 bp, Homo sapiens
actccagcctgagcaacag

SEQ ID NO: 2720253 - DNA, 20 bp, Homo sapiens
actccagcctgagcaacaga

SEQ ID NO: 2720254 - DNA, 13 bp, Homo sapiens
actccagcctggg

SEQ ID NO: 2720255 - DNA, 18 bp, Homo sapiens
actccagcctgggcgaca

SEQ ID NO: 2720256 - DNA, 20 bp, Homo sapiens
actccagtgatgttcttcaa

SEQ ID NO: 2720257 - DNA, 21 bp, Homo sapiens
actcccagcgctggctccagg

SEQ ID NO: 2720258 - DNA, 19 bp, Homo sapiens
actccccagggcctccagg

SEQ ID NO: 2720259 - DNA, 13 bp, Homo sapiens
actccccagtgct

SEQ ID NO: 2720260 - DNA, 19 bp, Homo sapiens
actccccagtgctcctgtg

SEQ ID NO: 2720261 - DNA, 13 bp, Homo sapiens
actcccccaggat

SEQ ID NO: 2720262 - DNA, 16 bp, Homo sapiens
actccgctggatgggg

SEQ ID NO: 2720263 - DNA, 22 bp, Homo sapiens
actccgctggatggggagtctc

SEQ ID NO: 2720264 - DNA, 23 bp, Homo sapiens
actccgctggatggggagtctca

SEQ ID NO: 2720265 - DNA, 19 bp, Homo sapiens
actccggtgtgcctgcagc

SEQ ID NO: 2720266 - DNA, 14 bp, Homo sapiens
actccgtttccaaa

SEQ ID NO: 2720267 - DNA, 16 bp, Homo sapiens
actcctaatcaagagt

SEQ ID NO: 2720268 - DNA, 16 bp, Homo sapiens
actcctacctcagcct

SEQ ID NO: 2720269 - DNA, 17 bp, Homo sapiens
actcctacctcagccta

SEQ ID NO: 2720270 - DNA, 15 bp, Homo sapiens
actcctcctgccagc

SEQ ID NO: 2720271 - DNA, 16 bp, Homo sapiens
actcctcctgccagct

SEQ ID NO: 2720272 - DNA, 14 bp, Homo sapiens
actcctcttatttg

SEQ ID NO: 2720273 - DNA, 13 bp, Homo sapiens
actcctgacctcg

SEQ ID NO: 2720274 - DNA, 16 bp, Homo sapiens
actcctggcttcatgt

SEQ ID NO: 2720275 - DNA, 20 bp, Homo sapiens
actccttccccttgtccctg

SEQ ID NO: 2720276 - DNA, 21 bp, Homo sapiens
actccttccccttgtccctgg

SEQ ID NO: 2720277 - DNA, 16 bp, Homo sapiens
actctaattggtcatt

SEQ ID NO: 2720278 - DNA, 17 bp, Homo sapiens
actctactcccagcgct

SEQ ID NO: 2720279 - DNA, 18 bp, Homo sapiens
actctagtgacttcctgg

SEQ ID NO: 2720280 - DNA, 20 bp, Homo sapiens
actctagtgacttcctggtg

SEQ ID NO: 2720281 - DNA, 21 bp, Homo sapiens
actctcacctcgtgatatcca

SEQ ID NO: 2720282 - DNA, 12 bp, Homo sapiens
actctctgcctg

SEQ ID NO: 2720283 - DNA, 21 bp, Homo sapiens
actctctgcctgcttcctgga

SEQ ID NO: 2720284 - DNA, 21 bp, Homo sapiens
actctgaggctctttctgggc

SEQ ID NO: 2720285 - DNA, 16 bp, Homo sapiens
actctgcaactgaata

SEQ ID NO: 2720286 - DNA, 13 bp, Homo sapiens
actctgccagcca

SEQ ID NO: 2720287 - DNA, 13 bp, Homo sapiens
actctgctgcctg

SEQ ID NO: 2720288 - DNA, 19 bp, Homo sapiens
actctggacctctcttgtg

SEQ ID NO: 2720289 - DNA, 14 bp, Homo sapiens
actctggcacccag

SEQ ID NO: 2720290 - DNA, 18 bp, Homo sapiens
actctgtgcccatgggca

SEQ ID NO: 2720291 - DNA, 21 bp, Homo sapiens
actctgtgcccatgggcactg

SEQ ID NO: 2720292 - DNA, 23 bp, Homo sapiens
actcttaccatcccggtgcatgc

SEQ ID NO: 2720293 - DNA, 14 bp, Homo sapiens
agaactgctggggc

SEQ ID NO: 2720294 - DNA, 18 bp, Homo sapiens
agaactggacgcccagct

SEQ ID NO: 2720295 - DNA, 18 bp, Homo sapiens
agaactttgccttaagtt

SEQ ID NO: 2720296 - DNA, 23 bp, Homo sapiens
agaactttgccttaagtttccct

SEQ ID NO: 2720297 - DNA, 16 bp, Homo sapiens
agaagaactttgcctt

SEQ ID NO: 2720298 - DNA, 17 bp, Homo sapiens
agaagaactttgcctta

SEQ ID NO: 2720299 - DNA, 17 bp, Homo sapiens
agaagagccttcacatg

SEQ ID NO: 2720300 - DNA, 22 bp, Homo sapiens
agaagatctgcttccctggggc

SEQ ID NO: 2720301 - DNA, 16 bp, Homo sapiens
agaaggagcaagagaa

SEQ ID NO: 2720302 - DNA, 13 bp, Homo sapiens
agaaggcctcccc

SEQ ID NO: 2720303 - DNA, 14 bp, Homo sapiens
agaaggcctcccct

SEQ ID NO: 2720304 - DNA, 15 bp, Homo sapiens
agaaggcctcccctg

SEQ ID NO: 2720305 - DNA, 19 bp, Homo sapiens
agaaggcctcccctgagga

SEQ ID NO: 2720306 - DNA, 15 bp, Homo sapiens
agaagggcctgctct

SEQ ID NO: 2720307 - DNA, 22 bp, Homo sapiens
agaagggttttccaccctggaa

SEQ ID NO: 2720308 - DNA, 23 bp, Homo sapiens
agaagggttttccaccctggaat

SEQ ID NO: 2720309 - DNA, 19 bp, Homo sapiens
agaagtaactcccactcct

SEQ ID NO: 2720310 - DNA, 14 bp, Homo sapiens
agaagtaagcagag

SEQ ID NO: 2720311 - DNA, 13 bp, Homo sapiens
agaagtggccagg

SEQ ID NO: 2720312 - DNA, 22 bp, Homo sapiens
agaagtttgggctaacatttag

SEQ ID NO: 2720313 - DNA, 16 bp, Homo sapiens
agaagttttaactatg

SEQ ID NO: 2720314 - DNA, 12 bp, Homo sapiens
agaataaaattg

SEQ ID NO: 2720315 - DNA, 12 bp, Homo sapiens
agaatagtctct

SEQ ID NO: 2720316 - DNA, 23 bp, Homo sapiens
agaatcccacccccacttcatgc

SEQ ID NO: 2720317 - DNA, 15 bp, Homo sapiens
agaatcctgggcccc

SEQ ID NO: 2720318 - DNA, 20 bp, Homo sapiens
agaatcctgggcccccagag

SEQ ID NO: 2720319 - DNA, 14 bp, Homo sapiens
agaatgtgctgcct

SEQ ID NO: 2720320 - DNA, 15 bp, Homo sapiens
agaatgtgctgcctt

SEQ ID NO: 2720321 - DNA, 13 bp, Homo sapiens
agaattctatttt

SEQ ID NO: 2720322 - DNA, 16 bp, Homo sapiens
agaattctattttgct

SEQ ID NO: 2720323 - DNA, 23 bp, Homo sapiens
agaattgcttgaacccaggaggt

SEQ ID NO: 2720324 - DNA, 21 bp, Homo sapiens
agaattgtatatcattttgcc

SEQ ID NO: 2720325 - DNA, 18 bp, Homo sapiens
agaattttggaaaaatgt

SEQ ID NO: 2720326 - DNA, 21 bp, Homo sapiens
agaattttggaaaaatgtcac

SEQ ID NO: 2720327 - DNA, 16 bp, Homo sapiens
agacacagcccagaca

SEQ ID NO: 2720328 - DNA, 21 bp, Homo sapiens
agacaggacagtgcttcagcc

SEQ ID NO: 2720329 - DNA, 20 bp, Homo sapiens
agacagtggcactaaaatgt

SEQ ID NO: 2720330 - DNA, 13 bp, Homo sapiens
agacatcaatgaa

SEQ ID NO: 2720331 - DNA, 14 bp, Homo sapiens
agaccaaattttga

SEQ ID NO: 2720332 - DNA, 21 bp, Homo sapiens
agaccaaattttgaggtcttt

SEQ ID NO: 2720333 - DNA, 18 bp, Homo sapiens
agaccattgtcttccaac

SEQ ID NO: 2720334 - DNA, 21 bp, Homo sapiens
agaccctctatttacctgcga

SEQ ID NO: 2720335 - DNA, 21 bp, Homo sapiens
agacctcagagatggcttcct

SEQ ID NO: 2720336 - DNA, 15 bp, Homo sapiens
agacctcagatgtgt

SEQ ID NO: 2720337 - DNA, 13 bp, Homo sapiens
agacctccacatt

SEQ ID NO: 2720338 - DNA, 23 bp, Homo sapiens
agacctctgaatgtcccagaggc

SEQ ID NO: 2720339 - DNA, 14 bp, Homo sapiens
agacctttgcccac

SEQ ID NO: 2720340 - DNA, 18 bp, Homo sapiens
agacgatcttgctggcag

SEQ ID NO: 2720341 - DNA, 23 bp, Homo sapiens
agacgatcttgctggcagggcct

SEQ ID NO: 2720342 - DNA, 23 bp, Homo sapiens
agacgctgtgattggcaggaggc

SEQ ID NO: 2720343 - DNA, 18 bp, Homo sapiens
agacggggtttccccatg

SEQ ID NO: 2720344 - DNA, 13 bp, Homo sapiens
acatatttttaaa

SEQ ID NO: 2720345 - DNA, 13 bp, Homo sapiens
acatcaatgaaac

SEQ ID NO: 2720346 - DNA, 20 bp, Homo sapiens
acatcaccaagtgtggaatt

SEQ ID NO: 2720347 - DNA, 13 bp, Homo sapiens
acatcagttatat

SEQ ID NO: 2720348 - DNA, 21 bp, Homo sapiens
acatcatctttatctcctggg

SEQ ID NO: 2720349 - DNA, 21 bp, Homo sapiens
acatcgcaatagttttttact

SEQ ID NO: 2720350 - DNA, 12 bp, Homo sapiens
acatctaaattg

SEQ ID NO: 2720351 - DNA, 22 bp, Homo sapiens
acatctaaattgatcattcata

SEQ ID NO: 2720352 - DNA, 17 bp, Homo sapiens
acatgaaaacattgatg

SEQ ID NO: 2720353 - DNA, 17 bp, Homo sapiens
acatgaagctgtataat

SEQ ID NO: 2720354 - DNA, 18 bp, Homo sapiens
acatgaattgcattttac

SEQ ID NO: 2720355 - DNA, 12 bp, Homo sapiens
acatgattttct

SEQ ID NO: 2720356 - DNA, 19 bp, Homo sapiens
acatgctcatcccaaaagc

SEQ ID NO: 2720357 - DNA, 19 bp, Homo sapiens
acatggattccaaagcatt

SEQ ID NO: 2720358 - DNA, 15 bp, Homo sapiens
acatggccagtgtga

SEQ ID NO: 2720359 - DNA, 13 bp, Homo sapiens
acatggctggggg

SEQ ID NO: 2720360 - DNA, 21 bp, Homo sapiens
acatggctgggggagggactg

SEQ ID NO: 2720361 - DNA, 15 bp, Homo sapiens
acatggtgtgtgtct

SEQ ID NO: 2720362 - DNA, 18 bp, Homo sapiens
acatgtatgtggatacag

SEQ ID NO: 2720363 - DNA, 21 bp, Homo sapiens
acatgtctttggcttcagaat

SEQ ID NO: 2720364 - DNA, 11 bp, Homo sapiens
acatgtgcaac

SEQ ID NO: 2720365 - DNA, 15 bp, Homo sapiens
acatgtgcaactctt

SEQ ID NO: 2720366 - DNA, 18 bp, Homo sapiens
acatgtgcaactcttgta

SEQ ID NO: 2720367 - DNA, 15 bp, Homo sapiens
acatgttttactcac

SEQ ID NO: 2720368 - DNA, 20 bp, Homo sapiens
acattaaaatagcacatgat

SEQ ID NO: 2720369 - DNA, 21 bp, Homo sapiens
acattaaaatagcacatgatt

SEQ ID NO: 2720370 - DNA, 15 bp, Homo sapiens
acattaagtggcttt

SEQ ID NO: 2720371 - DNA, 22 bp, Homo sapiens
acattaattgaggcttacagta

SEQ ID NO: 2720372 - DNA, 20 bp, Homo sapiens
acattatctttgatatgtga

SEQ ID NO: 2720373 - DNA, 21 bp, Homo sapiens
acattatgttattggaatttt

SEQ ID NO: 2720374 - DNA, 14 bp, Homo sapiens
acattcatctggag

SEQ ID NO: 2720375 - DNA, 20 bp, Homo sapiens
acattccagtgtattttctg

SEQ ID NO: 2720376 - DNA, 15 bp, Homo sapiens
acattgaaagctcta

SEQ ID NO: 2720377 - DNA, 14 bp, Homo sapiens
acattgatgaatga

SEQ ID NO: 2720378 - DNA, 14 bp, Homo sapiens
acattgcaatagaa

SEQ ID NO: 2720379 - DNA, 16 bp, Homo sapiens
acattgcaatagaaat

SEQ ID NO: 2720380 - DNA, 19 bp, Homo sapiens
acatttcaagatccaaatg

SEQ ID NO: 2720381 - DNA, 18 bp, Homo sapiens
acattttatatctggatt

SEQ ID NO: 2720382 - DNA, 12 bp, Homo sapiens
acattttcattt

SEQ ID NO: 2720383 - DNA, 18 bp, Homo sapiens
acattttgacacaatgtt

SEQ ID NO: 2720384 - DNA, 14 bp, Homo sapiens
acatttttaaaaca

SEQ ID NO: 2720385 - DNA, 20 bp, Homo sapiens
accaaaaactagacattatt

SEQ ID NO: 2720386 - DNA, 13 bp, Homo sapiens
accaaagacatca

SEQ ID NO: 2720387 - DNA, 17 bp, Homo sapiens
accaaagagtctctggc

SEQ ID NO: 2720388 - DNA, 13 bp, Homo sapiens
accaaagcatcaa

SEQ ID NO: 2720389 - DNA, 19 bp, Homo sapiens
accaaattttgaggtcttt

SEQ ID NO: 2720390 - DNA, 22 bp, Homo sapiens
accaaattttgaggtcttttac

SEQ ID NO: 2720391 - DNA, 16 bp, Homo sapiens
accaacccagccgctg

SEQ ID NO: 2720392 - DNA, 13 bp, Homo sapiens
accaagctgtgcc

SEQ ID NO: 2720393 - DNA, 21 bp, Homo sapiens
accaaggtctcacactcctcc

SEQ ID NO: 2720394 - DNA, 21 bp, Homo sapiens
accacaacctccacctcctgg

SEQ ID NO: 2720395 - DNA, 17 bp, Homo sapiens
accacaccctgcctgct

SEQ ID NO: 2720396 - DNA, 18 bp, Homo sapiens
accacagcaaggcacctg

SEQ ID NO: 2720397 - DNA, 19 bp, Homo sapiens
accactagggtcctggccc

SEQ ID NO: 2720398 - DNA, 16 bp, Homo sapiens
accactgtgtatttaa

SEQ ID NO: 2720399 - DNA, 20 bp, Homo sapiens
accagagcaggggctgctgg

SEQ ID NO: 2720400 - DNA, 23 bp, Homo sapiens
accagagcaggggctgctggggg

SEQ ID NO: 2720401 - DNA, 11 bp, Homo sapiens
accagagctgc

SEQ ID NO: 2720402 - DNA, 12 bp, Homo sapiens
accagagctgcc

SEQ ID NO: 2720403 - DNA, 13 bp, Homo sapiens
accagagctgcct

SEQ ID NO: 2720404 - DNA, 13 bp, Homo sapiens
accagcctgacta

SEQ ID NO: 2720405 - DNA, 23 bp, Homo sapiens
accaggagcaaccgtgcagccac

SEQ ID NO: 2720406 - DNA, 17 bp, Homo sapiens
accaggggcaggcacag

SEQ ID NO: 2720407 - DNA, 18 bp, Homo sapiens
accaggggcaggcacagc

SEQ ID NO: 2720408 - DNA, 18 bp, Homo sapiens
accaggggtaccaggcac

SEQ ID NO: 2720409 - DNA, 19 bp, Homo sapiens
accaggtctcctccaccgc

SEQ ID NO: 2720410 - DNA, 18 bp, Homo sapiens
accagtagtcacctctgg

SEQ ID NO: 2720411 - DNA, 22 bp, Homo sapiens
accagtgtcgtgtctgctgttg

SEQ ID NO: 2720412 - DNA, 15 bp, Homo sapiens
accatattgctctta

SEQ ID NO: 2720413 - DNA, 16 bp, Homo sapiens
accatattgctcttaa

SEQ ID NO: 2720414 - DNA, 17 bp, Homo sapiens
accatattgctcttaaa

SEQ ID NO: 2720415 - DNA, 13 bp, Homo sapiens
accatgaaaaata

SEQ ID NO: 2720416 - DNA, 11 bp, Homo sapiens
accatgcaagg

SEQ ID NO: 2720417 - DNA, 17 bp, Homo sapiens
accattattttacagtc

SEQ ID NO: 2720418 - DNA, 13 bp, Homo sapiens
accattctttctt

SEQ ID NO: 2720419 - DNA, 14 bp, Homo sapiens
accattgtcttcca

SEQ ID NO: 2720420 - DNA, 22 bp, Homo sapiens
accattgtcttccaaccccagc

SEQ ID NO: 2720421 - DNA, 23 bp, Homo sapiens
accattgtcttccaaccccagct

SEQ ID NO: 2720422 - DNA, 22 bp, Homo sapiens
acccaacctgtccttactcaga

SEQ ID NO: 2720423 - DNA, 16 bp, Homo sapiens
acccaagaaaacctgt

SEQ ID NO: 2720424 - DNA, 23 bp, Homo sapiens
acccactctttgctacaataaat

SEQ ID NO: 2720425 - DNA, 16 bp, Homo sapiens
acccactgtccgcctc

SEQ ID NO: 2720426 - DNA, 18 bp, Homo sapiens
acccactgtccgcctctg

SEQ ID NO: 2720427 - DNA, 19 bp, Homo sapiens
acccagaactggacgccca

SEQ ID NO: 2720428 - DNA, 13 bp, Homo sapiens
acccagaaggacc

SEQ ID NO: 2720429 - DNA, 13 bp, Homo sapiens
acccagccgctgc

SEQ ID NO: 2720430 - DNA, 14 bp, Homo sapiens
acccagccgctgcc

SEQ ID NO: 2720431 - DNA, 16 bp, Homo sapiens
acccagccgctgcccg

SEQ ID NO: 2720432 - DNA, 16 bp, Homo sapiens
acccagtctgttcccc

SEQ ID NO: 2720433 - DNA, 17 bp, Homo sapiens
acccagtgtgtgctcag

SEQ ID NO: 2720434 - DNA, 19 bp, Homo sapiens
acccagtgtgtgctcagca

SEQ ID NO: 2720435 - DNA, 19 bp, Homo sapiens
acccatcttcacgcctggg

SEQ ID NO: 2720436 - DNA, 15 bp, Homo sapiens
acccatcttccccgg

SEQ ID NO: 2720437 - DNA, 15 bp, Homo sapiens
acccatgactctgta

SEQ ID NO: 2720438 - DNA, 16 bp, Homo sapiens
acccatttcaggaggt

SEQ ID NO: 2720439 - DNA, 13 bp, Homo sapiens
accccagcatcct

SEQ ID NO: 2720440 - DNA, 11 bp, Homo sapiens
accccagctgg

SEQ ID NO: 2720441 - DNA, 12 bp, Homo sapiens
accccagctggc

SEQ ID NO: 2720442 - DNA, 13 bp, Homo sapiens
accccagctggcc

SEQ ID NO: 2720443 - DNA, 14 bp, Homo sapiens
accccagctggcct

SEQ ID NO: 2720444 - DNA, 15 bp, Homo sapiens
accccagctggcctc

SEQ ID NO: 2720445 - DNA, 16 bp, Homo sapiens
accccagctggcctct

SEQ ID NO: 2720446 - DNA, 16 bp, Homo sapiens
accccatctgcccagg

SEQ ID NO: 2720447 - DNA, 21 bp, Homo sapiens
acccccaggattcccagagag

SEQ ID NO: 2720448 - DNA, 15 bp, Homo sapiens
acccccgcccaggct

SEQ ID NO: 2720449 - DNA, 19 bp, Homo sapiens
acccccgcccaggctggcc

SEQ ID NO: 2720450 - DNA, 20 bp, Homo sapiens
acccccgcccaggctggcca

SEQ ID NO: 2720451 - DNA, 21 bp, Homo sapiens
acccccgcccaggctggccag

SEQ ID NO: 2720452 - DNA, 14 bp, Homo sapiens
acccctcccagctg

SEQ ID NO: 2720453 - DNA, 15 bp, Homo sapiens
acccctcccagctga

SEQ ID NO: 2720454 - DNA, 15 bp, Homo sapiens
acccctcccccacgt

SEQ ID NO: 2720455 - DNA, 19 bp, Homo sapiens
acccctcccccacgtctct

SEQ ID NO: 2720456 - DNA, 22 bp, Homo sapiens
acccctcccccacgtctctctg

SEQ ID NO: 2720457 - DNA, 24 bp, Homo sapiens
acccctcccccacgtctctctgcc

SEQ ID NO: 2720458 - DNA, 14 bp, Homo sapiens
acccctcctgaact

SEQ ID NO: 2720459 - DNA, 21 bp, Homo sapiens
acccctcctgaactggccact

SEQ ID NO: 2720460 - DNA, 19 bp, Homo sapiens
accccttttcagcttctgc

SEQ ID NO: 2720461 - DNA, 20 bp, Homo sapiens
accccttttcagcttctgct

SEQ ID NO: 2720462 - DNA, 16 bp, Homo sapiens
acccgccttttataaa

SEQ ID NO: 2720463 - DNA, 12 bp, Homo sapiens
acccggaaagac

SEQ ID NO: 2720464 - DNA, 18 bp, Homo sapiens
acccggattggccctgcc

SEQ ID NO: 2720465 - DNA, 20 bp, Homo sapiens
acccggattggccctgcccc

SEQ ID NO: 2720466 - DNA, 12 bp, Homo sapiens
acccgggctcag

SEQ ID NO: 2720467 - DNA, 14 bp, Homo sapiens
accctaaagtctca

SEQ ID NO: 2720468 - DNA, 24 bp, Homo sapiens
accctaagtgtggatgttcagaat

SEQ ID NO: 2720469 - DNA, 16 bp, Homo sapiens
accctcagctgcctca

SEQ ID NO: 2720470 - DNA, 17 bp, Homo sapiens
accctcagctgcctcat

SEQ ID NO: 2720471 - DNA, 14 bp, Homo sapiens
accctccaaacact

SEQ ID NO: 2720472 - DNA, 18 bp, Homo sapiens
accctccaaacactgggc

SEQ ID NO: 2720473 - DNA, 14 bp, Homo sapiens
accctcccagtgag

SEQ ID NO: 2720474 - DNA, 14 bp, Homo sapiens
accctccctgctgt

SEQ ID NO: 2720475 - DNA, 15 bp, Homo sapiens
accctccctgctgtc

SEQ ID NO: 2720476 - DNA, 20 bp, Homo sapiens
accctccctgctgtcccctc

SEQ ID NO: 2720477 - DNA, 19 bp, Homo sapiens
accctcctctatttcttta

SEQ ID NO: 2720478 - DNA, 12 bp, Homo sapiens
accctcctgagc

SEQ ID NO: 2720479 - DNA, 17 bp, Homo sapiens
accctcctgagcctcac

SEQ ID NO: 2720480 - DNA, 13 bp, Homo sapiens
accctcctggcac

SEQ ID NO: 2720481 - DNA, 15 bp, Homo sapiens
accctgcctgctgtg

SEQ ID NO: 2720482 - DNA, 22 bp, Homo sapiens
accctgcctgctgtggagccca

SEQ ID NO: 2720483 - DNA, 20 bp, Homo sapiens
accctgcgaaggggccctgg

SEQ ID NO: 2720484 - DNA, 23 bp, Homo sapiens
accctgctgggaccccagctagg

SEQ ID NO: 2720485 - DNA, 24 bp, Homo sapiens
accctggaaactaccagtgggcat

SEQ ID NO: 2720486 - DNA, 15 bp, Homo sapiens
accctggccaccacc

SEQ ID NO: 2720487 - DNA, 19 bp, Homo sapiens
accctgggctctgtgggct

SEQ ID NO: 2720488 - DNA, 20 bp, Homo sapiens
accctgggctctgtgggctg

SEQ ID NO: 2720489 - DNA, 19 bp, Homo sapiens
accctgggtttggcccctg

SEQ ID NO: 2720490 - DNA, 21 bp, Homo sapiens
accctgtctcttaaagaaaaa

SEQ ID NO: 2720491 - DNA, 14 bp, Homo sapiens
acccttatgactcc

SEQ ID NO: 2720492 - DNA, 13 bp, Homo sapiens
acccttcctcatc

SEQ ID NO: 2720493 - DNA, 20 bp, Homo sapiens
acccttcctcatctgtgcct

SEQ ID NO: 2720494 - DNA, 13 bp, Homo sapiens
acccttggacttg

SEQ ID NO: 2720495 - DNA, 18 bp, Homo sapiens
acccttggacttgaggat

SEQ ID NO: 2720496 - DNA, 16 bp, Homo sapiens
acccttggtttgcaca

SEQ ID NO: 2720497 - DNA, 17 bp, Homo sapiens
accgacgatccctcgac

SEQ ID NO: 2720498 - DNA, 21 bp, Homo sapiens
accgagaggaaaaaggcttct

SEQ ID NO: 2720499 - DNA, 14 bp, Homo sapiens
accgcagctgctgc

SEQ ID NO: 2720500 - DNA, 16 bp, Homo sapiens
accgcagctgctgcca

SEQ ID NO: 2720501 - DNA, 18 bp, Homo sapiens
accgcagctgctgccact

SEQ ID NO: 2720502 - DNA, 20 bp, Homo sapiens
accgcagctgctgccactct

SEQ ID NO: 2720503 - DNA, 21 bp, Homo sapiens
accgcagctgctgccactctg

SEQ ID NO: 2720504 - DNA, 19 bp, Homo sapiens
accgcatggcagctgggcc

SEQ ID NO: 2720505 - DNA, 19 bp, Homo sapiens
accgcgtagagagccgggc

SEQ ID NO: 2720506 - DNA, 17 bp, Homo sapiens
accgtattagccaggat

SEQ ID NO: 2720507 - DNA, 20 bp, Homo sapiens
accgtcattgatggagcctg

SEQ ID NO: 2720508 - DNA, 11 bp, Homo sapiens
accgtccctga

SEQ ID NO: 2720509 - DNA, 13 bp, Homo sapiens
accgtggactctt

SEQ ID NO: 2720510 - DNA, 17 bp, Homo sapiens
accgtgtgctcctcggc

SEQ ID NO: 2720511 - DNA, 14 bp, Homo sapiens
accgtttacagtgt

SEQ ID NO: 2720512 - DNA, 16 bp, Homo sapiens
acctagtggctgtcca

SEQ ID NO: 2720513 - DNA, 17 bp, Homo sapiens
acctagtggctgtccag

SEQ ID NO: 2720514 - DNA, 16 bp, Homo sapiens
acctatggcccagcca

SEQ ID NO: 2720515 - DNA, 17 bp, Homo sapiens
acctatggcccagccac

SEQ ID NO: 2720516 - DNA, 18 bp, Homo sapiens
acctatggcccagccact

SEQ ID NO: 2720517 - DNA, 20 bp, Homo sapiens
acctcaggccaggtgcagtg

SEQ ID NO: 2720518 - DNA, 18 bp, Homo sapiens
acctcaggcttccttggc

SEQ ID NO: 2720519 - DNA, 22 bp, Homo sapiens
acctccacccactgtccgcctc

SEQ ID NO: 2720520 - DNA, 12 bp, Homo sapiens
acctccagtcct

SEQ ID NO: 2720521 - DNA, 17 bp, Homo sapiens
acctccagtcctgctgg

SEQ ID NO: 2720522 - DNA, 19 bp, Homo sapiens
acctccagtcctgctggcc

SEQ ID NO: 2720523 - DNA, 22 bp, Homo sapiens
acctccagtcctgctggcctgc

SEQ ID NO: 2720524 - DNA, 16 bp, Homo sapiens
acctcctatccttgga

SEQ ID NO: 2720525 - DNA, 17 bp, Homo sapiens
acctcctatccttggag

SEQ ID NO: 2720526 - DNA, 23 bp, Homo sapiens
acctcgtgtctagtagaacaatg

SEQ ID NO: 2720527 - DNA, 19 bp, Homo sapiens
acctcgttactctcacctc

SEQ ID NO: 2720528 - DNA, 12 bp, Homo sapiens
acctctcttgtg

SEQ ID NO: 2720529 - DNA, 24 bp, Homo sapiens
acctctgaatgtcccagaggctag

SEQ ID NO: 2720530 - DNA, 16 bp, Homo sapiens
acctgaactctgcaac

SEQ ID NO: 2720531 - DNA, 18 bp, Homo sapiens
acctgagtctgctatatt

SEQ ID NO: 2720532 - DNA, 15 bp, Homo sapiens
acctgattgtatttt

SEQ ID NO: 2720533 - DNA, 16 bp, Homo sapiens
acctgattgtattttt

SEQ ID NO: 2720534 - DNA, 22 bp, Homo sapiens
acctgcaggttgggccatactg

SEQ ID NO: 2720535 - DNA, 10 bp, Homo sapiens
acctgcattt

SEQ ID NO: 2720536 - DNA, 15 bp, Homo sapiens
acctgcatttttaaa

SEQ ID NO: 2720537 - DNA, 14 bp, Homo sapiens
acctgccagcctgg

SEQ ID NO: 2720538 - DNA, 18 bp, Homo sapiens
acctgccatttgcaccct

SEQ ID NO: 2720539 - DNA, 19 bp, Homo sapiens
acctgccatttgcaccctc

SEQ ID NO: 2720540 - DNA, 15 bp, Homo sapiens
acctgccccctggtg

SEQ ID NO: 2720541 - DNA, 17 bp, Homo sapiens
acctgccccgcccagct

SEQ ID NO: 2720542 - DNA, 20 bp, Homo sapiens
acctgcctagctcttgggcc

SEQ ID NO: 2720543 - DNA, 18 bp, Homo sapiens
acctgcctgttctccaga

SEQ ID NO: 2720544 - DNA, 19 bp, Homo sapiens
acctgctggaaaccacact

SEQ ID NO: 2720545 - DNA, 19 bp, Homo sapiens
acctgggcatttggtgaga

SEQ ID NO: 2720546 - DNA, 20 bp, Homo sapiens
acctggggtgtggttccaga

SEQ ID NO: 2720547 - DNA, 12 bp, Homo sapiens
acctgtactcag

SEQ ID NO: 2720548 - DNA, 20 bp, Homo sapiens
acctgtccttactcagagct

SEQ ID NO: 2720549 - DNA, 15 bp, Homo sapiens
acctgtttttaacat

SEQ ID NO: 2720550 - DNA, 15 bp, Homo sapiens
accttaactcagcca

SEQ ID NO: 2720551 - DNA, 16 bp, Homo sapiens
accttaatttgactgt

SEQ ID NO: 2720552 - DNA, 23 bp, Homo sapiens
accttctccagggacagaagcag

SEQ ID NO: 2720553 - DNA, 19 bp, Homo sapiens
accttgcatctcattgctc

SEQ ID NO: 2720554 - DNA, 16 bp, Homo sapiens
accttgccgagagagg

SEQ ID NO: 2720555 - DNA, 18 bp, Homo sapiens
accttgccgagagaggcg

SEQ ID NO: 2720556 - DNA, 15 bp, Homo sapiens
accttgtctttcaaa

SEQ ID NO: 2720557 - DNA, 17 bp, Homo sapiens
accttgtctttcaaaag

SEQ ID NO: 2720558 - DNA, 16 bp, Homo sapiens
accttgtttctttctg

SEQ ID NO: 2720559 - DNA, 17 bp, Homo sapiens
acctttcagctgtgaac

SEQ ID NO: 2720560 - DNA, 14 bp, Homo sapiens
acctttcccatttc

SEQ ID NO: 2720561 - DNA, 22 bp, Homo sapiens
acctttgcccacacacactcct

SEQ ID NO: 2720562 - DNA, 15 bp, Homo sapiens
acctttttttctctc

SEQ ID NO: 2720563 - DNA, 18 bp, Homo sapiens
acctttttttctctccta

SEQ ID NO: 2720564 - DNA, 19 bp, Homo sapiens
acctttttttctctcctaa

SEQ ID NO: 2720565 - DNA, 23 bp, Homo sapiens
acgcatgcctcagccagccctgg

SEQ ID NO: 2720566 - DNA, 22 bp, Homo sapiens
acgccactgcactccagcctgg

SEQ ID NO: 2720567 - DNA, 19 bp, Homo sapiens
acgcccagctgaggctggg

SEQ ID NO: 2720568 - DNA, 15 bp, Homo sapiens
acgcctactggggca

SEQ ID NO: 2720569 - DNA, 17 bp, Homo sapiens
acgcctatgatcccagc

SEQ ID NO: 2720570 - DNA, 23 bp, Homo sapiens
acgcgggcaagcgtgctgcctct

SEQ ID NO: 2720571 - DNA, 16 bp, Homo sapiens
acgcttattgcccagg

SEQ ID NO: 2720572 - DNA, 15 bp, Homo sapiens
acggcagctgtagct

SEQ ID NO: 2720573 - DNA, 16 bp, Homo sapiens
acggggaccactgggc

SEQ ID NO: 2720574 - DNA, 14 bp, Homo sapiens
acggggccggccag

SEQ ID NO: 2720575 - DNA, 14 bp, Homo sapiens
acgggttgaaagac

SEQ ID NO: 2720576 - DNA, 16 bp, Homo sapiens
acgggttgaaagacat

SEQ ID NO: 2720577 - DNA, 19 bp, Homo sapiens
acgggttgaaagacatcaa

SEQ ID NO: 2720578 - DNA, 20 bp, Homo sapiens
acgggttgaaagacatcaat

SEQ ID NO: 2720579 - DNA, 18 bp, Homo sapiens
acggtcctttaggcagcc

SEQ ID NO: 2720580 - DNA, 23 bp, Homo sapiens
acgtaccaagccaccgcagctgc

SEQ ID NO: 2720581 - DNA, 22 bp, Homo sapiens
acgtagatttttgctcttctgt

SEQ ID NO: 2720582 - DNA, 19 bp, Homo sapiens
acgtattttgatcagtgtt

SEQ ID NO: 2720583 - DNA, 22 bp, Homo sapiens
acgtattttgatcagtgttaca

SEQ ID NO: 2720584 - DNA, 17 bp, Homo sapiens
acgtcaccctcctgagc

SEQ ID NO: 2720585 - DNA, 18 bp, Homo sapiens
acgtccagaatttttcat

SEQ ID NO: 2720586 - DNA, 13 bp, Homo sapiens
acgtcctggaatg

SEQ ID NO: 2720587 - DNA, 15 bp, Homo sapiens
acgtcctgtcagtgc

SEQ ID NO: 2720588 - DNA, 12 bp, Homo sapiens
acgtctctctgc

SEQ ID NO: 2720589 - DNA, 14 bp, Homo sapiens
acgtctctctgcct

SEQ ID NO: 2720590 - DNA, 16 bp, Homo sapiens
acgtctctctgcctgc

SEQ ID NO: 2720591 - DNA, 17 bp, Homo sapiens
acgtctctctgcctgct

SEQ ID NO: 2720592 - DNA, 22 bp, Homo sapiens
acgtctctctgcctgctgggct

SEQ ID NO: 2720593 - DNA, 19 bp, Homo sapiens
acgtgaaagatgcaagcac

SEQ ID NO: 2720594 - DNA, 14 bp, Homo sapiens
acgtgaccagcccc

SEQ ID NO: 2720595 - DNA, 14 bp, Homo sapiens
acgtgactcagagc

SEQ ID NO: 2720596 - DNA, 15 bp, Homo sapiens
acgtgactcagagct

SEQ ID NO: 2720597 - DNA, 21 bp, Homo sapiens
acgtgcacctgtactcaggag

SEQ ID NO: 2720598 - DNA, 13 bp, Homo sapiens
acgttgctcccca

SEQ ID NO: 2720599 - DNA, 13 bp, Homo sapiens
cacagctctgctg

SEQ ID NO: 2720600 - DNA, 14 bp, Homo sapiens
cacagctctgctgg

SEQ ID NO: 2720601 - DNA, 16 bp, Homo sapiens
cacaggactctgcaga

SEQ ID NO: 2720602 - DNA, 13 bp, Homo sapiens
cacaggaggctcc

SEQ ID NO: 2720603 - DNA, 16 bp, Homo sapiens
cacagggaggctgcag

SEQ ID NO: 2720604 - DNA, 15 bp, Homo sapiens
cacagggatccgact

SEQ ID NO: 2720605 - DNA, 22 bp, Homo sapiens
cacaggggcaaagaactgcccc

SEQ ID NO: 2720606 - DNA, 13 bp, Homo sapiens
cacagtcctcaca

SEQ ID NO: 2720607 - DNA, 20 bp, Homo sapiens
cacagtcctcacagcctctc

SEQ ID NO: 2720608 - DNA, 19 bp, Homo sapiens
cacagtgactcgggctcct

SEQ ID NO: 2720609 - DNA, 22 bp, Homo sapiens
cacagtgactcgggctcctgtg

SEQ ID NO: 2720610 - DNA, 13 bp, Homo sapiens
cacagtgtctggg

SEQ ID NO: 2720611 - DNA, 17 bp, Homo sapiens
cacagtgttggcgagag

SEQ ID NO: 2720612 - DNA, 20 bp, Homo sapiens
cacagttggcccgggtgcag

SEQ ID NO: 2720613 - DNA, 20 bp, Homo sapiens
cacataaaggtatttagaat

SEQ ID NO: 2720614 - DNA, 22 bp, Homo sapiens
cacatacaaaaaaaatctttaa

SEQ ID NO: 2720615 - DNA, 20 bp, Homo sapiens
cacatataaaagttaaacta

SEQ ID NO: 2720616 - DNA, 21 bp, Homo sapiens
cacatattaagaatagtctct

SEQ ID NO: 2720617 - DNA, 23 bp, Homo sapiens
cacatattaagaatagtctctgg

SEQ ID NO: 2720618 - DNA, 16 bp, Homo sapiens
cacatattattggtca

SEQ ID NO: 2720619 - DNA, 20 bp, Homo sapiens
cacatcatctttatctcctg

SEQ ID NO: 2720620 - DNA, 22 bp, Homo sapiens
cacatcatctttatctcctggg

SEQ ID NO: 2720621 - DNA, 18 bp, Homo sapiens
cacatgattttcttttgt

SEQ ID NO: 2720622 - DNA, 15 bp, Homo sapiens
cacattctgtctctg

SEQ ID NO: 2720623 - DNA, 20 bp, Homo sapiens
cacatttctggccatttaac

SEQ ID NO: 2720624 - DNA, 14 bp, Homo sapiens
cacattttgacaca

SEQ ID NO: 2720625 - DNA, 20 bp, Homo sapiens
cacattttgacacaatgttg

SEQ ID NO: 2720626 - DNA, 22 bp, Homo sapiens
cacattttgacacaatgttgca

SEQ ID NO: 2720627 - DNA, 16 bp, Homo sapiens
caccaagctgtgccac

SEQ ID NO: 2720628 - DNA, 18 bp, Homo sapiens
caccaagctgtgccaccc

SEQ ID NO: 2720629 - DNA, 20 bp, Homo sapiens
caccaagctgtgccaccctg

SEQ ID NO: 2720630 - DNA, 21 bp, Homo sapiens
caccaaggtctcacactcctc

SEQ ID NO: 2720631 - DNA, 23 bp, Homo sapiens
caccaaggtctcacactcctcct

SEQ ID NO: 2720632 - DNA, 15 bp, Homo sapiens
caccacaacctccac

SEQ ID NO: 2720633 - DNA, 19 bp, Homo sapiens
caccacccaacctgtcctt

SEQ ID NO: 2720634 - DNA, 20 bp, Homo sapiens
caccactaggactctgaggc

SEQ ID NO: 2720635 - DNA, 19 bp, Homo sapiens
caccagagcaggggctgct

SEQ ID NO: 2720636 - DNA, 21 bp, Homo sapiens
caccagagcaggggctgctgg

SEQ ID NO: 2720637 - DNA, 23 bp, Homo sapiens
caccagagcaggggctgctgggg

SEQ ID NO: 2720638 - DNA, 14 bp, Homo sapiens
caccagagctgcct

SEQ ID NO: 2720639 - DNA, 15 bp, Homo sapiens
caccagagctgcctc

SEQ ID NO: 2720640 - DNA, 19 bp, Homo sapiens
caccagagctgcctcccca

SEQ ID NO: 2720641 - DNA, 21 bp, Homo sapiens
caccagatgggatgggctttc

SEQ ID NO: 2720642 - DNA, 23 bp, Homo sapiens
caccagcggccttgaagaggcag

SEQ ID NO: 2720643 - DNA, 16 bp, Homo sapiens
caccaggcagctccag

SEQ ID NO: 2720644 - DNA, 17 bp, Homo sapiens
caccaggcagctccagc

SEQ ID NO: 2720645 - DNA, 20 bp, Homo sapiens
caccaggggcaggcacagca

SEQ ID NO: 2720646 - DNA, 17 bp, Homo sapiens
caccagtgcctcagtgc

SEQ ID NO: 2720647 - DNA, 18 bp, Homo sapiens
caccagtgcctcagtgct

SEQ ID NO: 2720648 - DNA, 19 bp, Homo sapiens
caccagtgcctcagtgctg

SEQ ID NO: 2720649 - DNA, 16 bp, Homo sapiens
caccatattcagtgct

SEQ ID NO: 2720650 - DNA, 15 bp, Homo sapiens
caccattctcctgcc

SEQ ID NO: 2720651 - DNA, 16 bp, Homo sapiens
caccattctcctgcct

SEQ ID NO: 2720652 - DNA, 19 bp, Homo sapiens
caccattgcatgaattcac

SEQ ID NO: 2720653 - DNA, 14 bp, Homo sapiens
cacccactggccag

SEQ ID NO: 2720654 - DNA, 15 bp, Homo sapiens
cacccactggccagt

SEQ ID NO: 2720655 - DNA, 23 bp, Homo sapiens
cacccactggccagtcctagagc

SEQ ID NO: 2720656 - DNA, 14 bp, Homo sapiens
cacccactgtccgc

SEQ ID NO: 2720657 - DNA, 19 bp, Homo sapiens
cacccactgtccgcctctg

SEQ ID NO: 2720658 - DNA, 14 bp, Homo sapiens
cacccaggaaggga

SEQ ID NO: 2720659 - DNA, 16 bp, Homo sapiens
cacccagggctccctc

SEQ ID NO: 2720660 - DNA, 22 bp, Homo sapiens
cacccagggctccctcctggag

SEQ ID NO: 2720661 - DNA, 22 bp, Homo sapiens
cacccatgaagacaggacagtg

SEQ ID NO: 2720662 - DNA, 16 bp, Homo sapiens
caccccaccctgcccc

SEQ ID NO: 2720663 - DNA, 17 bp, Homo sapiens
caccccaccctgcccct

SEQ ID NO: 2720664 - DNA, 17 bp, Homo sapiens
caccccctcctgctgca

SEQ ID NO: 2720665 - DNA, 15 bp, Homo sapiens
cacccctctgtccag

SEQ ID NO: 2720666 - DNA, 16 bp, Homo sapiens
cacccgccttttataa

SEQ ID NO: 2720667 - DNA, 20 bp, Homo sapiens
cacccgtcttggggctcgcc

SEQ ID NO: 2720668 - DNA, 21 bp, Homo sapiens
cacccgtcttggggctcgccc

SEQ ID NO: 2720669 - DNA, 18 bp, Homo sapiens
caccctaaagtctcaggt

SEQ ID NO: 2720670 - DNA, 21 bp, Homo sapiens
caccctagctttatattttgt

SEQ ID NO: 2720671 - DNA, 13 bp, Homo sapiens
caccctcctgagc

SEQ ID NO: 2720672 - DNA, 14 bp, Homo sapiens
caccctcctgagcc

SEQ ID NO: 2720673 - DNA, 15 bp, Homo sapiens
caccctcctgagcct

SEQ ID NO: 2720674 - DNA, 18 bp, Homo sapiens
caccctcctgagcctcac

SEQ ID NO: 2720675 - DNA, 11 bp, Homo sapiens
caccctgcaga

SEQ ID NO: 2720676 - DNA, 13 bp, Homo sapiens
caccctgcagagc

SEQ ID NO: 2720677 - DNA, 13 bp, Homo sapiens
caccctgcctgct

SEQ ID NO: 2720678 - DNA, 17 bp, Homo sapiens
caccctgcctgctgtgg

SEQ ID NO: 2720679 - DNA, 17 bp, Homo sapiens
caccctggccaccaccc

SEQ ID NO: 2720680 - DNA, 22 bp, Homo sapiens
caccctgggcaatgcagtgcag

SEQ ID NO: 2720681 - DNA, 19 bp, Homo sapiens
caccctgggtttggcccct

SEQ ID NO: 2720682 - DNA, 21 bp, Homo sapiens
caccctgggtttggcccctgg

SEQ ID NO: 2720683 - DNA, 13 bp, Homo sapiens
cacccttggactt

SEQ ID NO: 2720684 - DNA, 14 bp, Homo sapiens
caccgcagctgctg

SEQ ID NO: 2720685 - DNA, 21 bp, Homo sapiens
caccgcagctgctgccactct

SEQ ID NO: 2720686 - DNA, 15 bp, Homo sapiens
caccgcatgccccct

SEQ ID NO: 2720687 - DNA, 16 bp, Homo sapiens
caccgcatgccccctc

SEQ ID NO: 2720688 - DNA, 22 bp, Homo sapiens
caccgccatggcttccaaggtg

SEQ ID NO: 2720689 - DNA, 19 bp, Homo sapiens
caccgcgcccagccaagaa

SEQ ID NO: 2720690 - DNA, 21 bp, Homo sapiens
caccgtcattgatggagcctg

SEQ ID NO: 2720691 - DNA, 18 bp, Homo sapiens
cacctagtggctgtccag

SEQ ID NO: 2720692 - DNA, 22 bp, Homo sapiens
cacctagtggctgtccagtgcc

SEQ ID NO: 2720693 - DNA, 23 bp, Homo sapiens
  misc_feature (7)..(7): n is a, c, g or t
  misc_feature (14)..(14): n is a, c, g or t
cacctanccccccnacccccagt

SEQ ID NO: 2720694 - DNA, 13 bp, Homo sapiens
cacctatggccca

SEQ ID NO: 2720695 - DNA, 19 bp, Homo sapiens
cacctcgttactctcacct

SEQ ID NO: 2720696 - DNA, 23 bp, Homo sapiens
cacctgcaggttgggccatactg

SEQ ID NO: 2720697 - DNA, 15 bp, Homo sapiens
cacctgccagcctgg

SEQ ID NO: 2720698 - DNA, 15 bp, Homo sapiens
cacctgccccctggt

SEQ ID NO: 2720699 - DNA, 21 bp, Homo sapiens
cacctgccccctggtggacag

SEQ ID NO: 2720700 - DNA, 23 bp, Homo sapiens
cacctgcctagctcttgggcctg

SEQ ID NO: 2720701 - DNA, 15 bp, Homo sapiens
cacctgccttatgca

SEQ ID NO: 2720702 - DNA, 10 bp, Homo sapiens
cacctgctgg

SEQ ID NO: 2720703 - DNA, 11 bp, Homo sapiens
cacctgctgga

SEQ ID NO: 2720704 - DNA, 16 bp, Homo sapiens
cacctgtactcaggag

SEQ ID NO: 2720705 - DNA, 17 bp, Homo sapiens
caccttaactcagccag

SEQ ID NO: 2720706 - DNA, 17 bp, Homo sapiens
caccttcaattcctggg

SEQ ID NO: 2720707 - DNA, 18 bp, Homo sapiens
caccttgccgagagaggc

SEQ ID NO: 2720708 - DNA, 19 bp, Homo sapiens
caccttgccgagagaggcg

SEQ ID NO: 2720709 - DNA, 14 bp, Homo sapiens
cacctttgggatca

SEQ ID NO: 2720710 - DNA, 23 bp, Homo sapiens
cacctttgggatcagcctccgcc

SEQ ID NO: 2720711 - DNA, 19 bp, Homo sapiens
cacgacctcggctcactgc

SEQ ID NO: 2720712 - DNA, 19 bp, Homo sapiens
cacgactcttcctgcaaag

SEQ ID NO: 2720713 - DNA, 21 bp, Homo sapiens
cacgaggaagcagcaattaat

SEQ ID NO: 2720714 - DNA, 14 bp, Homo sapiens
cacgcatgcctcag

SEQ ID NO: 2720715 - DNA, 12 bp, Homo sapiens
cacgcctgggtg

SEQ ID NO: 2720716 - DNA, 14 bp, Homo sapiens
cacgctctggacat

SEQ ID NO: 2720717 - DNA, 14 bp, Homo sapiens
cacggcactccagc

SEQ ID NO: 2720718 - DNA, 14 bp, Homo sapiens
cacgtaccaagcca

SEQ ID NO: 2720719 - DNA, 21 bp, Homo sapiens
cacgtaccaagccaccgcagc

SEQ ID NO: 2720720 - DNA, 15 bp, Homo sapiens
cacgtcaccctcctg

SEQ ID NO: 2720721 - DNA, 20 bp, Homo sapiens
cacgtcaccctcctgagcct

SEQ ID NO: 2720722 - DNA, 14 bp, Homo sapiens
cacgtcctgtcagt

SEQ ID NO: 2720723 - DNA, 19 bp, Homo sapiens
cacgtcctgtcagtgccgc

SEQ ID NO: 2720724 - DNA, 23 bp, Homo sapiens
cacgtcctgtcagtgccgccgcc

SEQ ID NO: 2720725 - DNA, 22 bp, Homo sapiens
atttcctcaacgttgctcccca

SEQ ID NO: 2720726 - DNA, 18 bp, Homo sapiens
atttcctttgcgcaaact

SEQ ID NO: 2720727 - DNA, 14 bp, Homo sapiens
atttcgatgtacag

SEQ ID NO: 2720728 - DNA, 20 bp, Homo sapiens
atttcgtgtaatattctctg

SEQ ID NO: 2720729 - DNA, 15 bp, Homo sapiens
atttctagtatctat

SEQ ID NO: 2720730 - DNA, 18 bp, Homo sapiens
atttctagtatctattgt

SEQ ID NO: 2720731 - DNA, 22 bp, Homo sapiens
atttctatgtatgtgccaattt

SEQ ID NO: 2720732 - DNA, 12 bp, Homo sapiens
cacagcctctcc

SEQ ID NO: 2720733 - DNA, 14 bp, Homo sapiens
cacagcctctccct

SEQ ID NO: 2720734 - DNA, 13 bp, Homo sapiens
cacagcgcctcct

SEQ ID NO: 2720735 - DNA, 15 bp, Homo sapiens
cacagcgcctcctgg

SEQ ID NO: 2720736 - DNA, 16 bp, Homo sapiens
cacagctcctcccctg

SEQ ID NO: 2720737 - DNA, 19 bp, Homo sapiens
ataaatcaattcattgtgt

SEQ ID NO: 2720738 - DNA, 16 bp, Homo sapiens
ataaattatttctaaa

SEQ ID NO: 2720739 - DNA, 20 bp, Homo sapiens
ataaattatttctaaaacat

SEQ ID NO: 2720740 - DNA, 17 bp, Homo sapiens
ataaattgtttgaccat

SEQ ID NO: 2720741 - DNA, 16 bp, Homo sapiens
ataaatttgttgtcat

SEQ ID NO: 2720742 - DNA, 17 bp, Homo sapiens
ataaatttgttgtcatg

SEQ ID NO: 2720743 - DNA, 15 bp, Homo sapiens
ataacattttgttta

SEQ ID NO: 2720744 - DNA, 18 bp, Homo sapiens
ataacattttgtttatgt

SEQ ID NO: 2720745 - DNA, 18 bp, Homo sapiens
ataagaaacatgatgtga

SEQ ID NO: 2720746 - DNA, 15 bp, Homo sapiens
ataagagtgtaacat

SEQ ID NO: 2720747 - DNA, 17 bp, Homo sapiens
ataagatgatgttaaat

SEQ ID NO: 2720748 - DNA, 23 bp, Homo sapiens
ataaggcccagagcgaggaaagg

SEQ ID NO: 2720749 - DNA, 19 bp, Homo sapiens
ataaggtataaggatcttt

SEQ ID NO: 2720750 - DNA, 17 bp, Homo sapiens
ataagttttatacataa

SEQ ID NO: 2720751 - DNA, 19 bp, Homo sapiens
ataagttttatacataaac

SEQ ID NO: 2720752 - DNA, 16 bp, Homo sapiens
ataataaatatatatt

SEQ ID NO: 2720753 - DNA, 19 bp, Homo sapiens
ataatgaaccgtttacagt

SEQ ID NO: 2720754 - DNA, 23 bp, Homo sapiens
ataatgaaccgtttacagtgtat

SEQ ID NO: 2720755 - DNA, 21 bp, Homo sapiens
ataatggtgttactaaagtca

SEQ ID NO: 2720756 - DNA, 14 bp, Homo sapiens
ataattaattgtca

SEQ ID NO: 2720757 - DNA, 14 bp, Homo sapiens
ataattcaccaaaa

SEQ ID NO: 2720758 - DNA, 19 bp, Homo sapiens
ataatttgcaatttcagga

SEQ ID NO: 2720759 - DNA, 17 bp, Homo sapiens
ataattttattgctgga

SEQ ID NO: 2720760 - DNA, 14 bp, Homo sapiens
ataattttttgcag

SEQ ID NO: 2720761 - DNA, 17 bp, Homo sapiens
atacaaaaaaaatcttt

SEQ ID NO: 2720762 - DNA, 18 bp, Homo sapiens
atacaaaaaaaatcttta

SEQ ID NO: 2720763 - DNA, 23 bp, Homo sapiens
atacaaaaaaaatctttaatggt

SEQ ID NO: 2720764 - DNA, 13 bp, Homo sapiens
atacaaacaggtg

SEQ ID NO: 2720765 - DNA, 15 bp, Homo sapiens
atacaacctatgtaa

SEQ ID NO: 2720766 - DNA, 16 bp, Homo sapiens
atacaagcaagcaaaa

SEQ ID NO: 2720767 - DNA, 20 bp, Homo sapiens
atacacatttttaaaacaac

SEQ ID NO: 2720768 - DNA, 20 bp, Homo sapiens
atacattatattcctctaaa

SEQ ID NO: 2720769 - DNA, 23 bp, Homo sapiens
atacattccagtgtattttctgt

SEQ ID NO: 2720770 - DNA, 17 bp, Homo sapiens
atactggcctcgcctgg

SEQ ID NO: 2720771 - DNA, 15 bp, Homo sapiens
atactttaattttta

SEQ ID NO: 2720772 - DNA, 16 bp, Homo sapiens
atactttaatttttat

SEQ ID NO: 2720773 - DNA, 18 bp, Homo sapiens
atagacgggttgaaagac

SEQ ID NO: 2720774 - DNA, 21 bp, Homo sapiens
atagacgggttgaaagacatc

SEQ ID NO: 2720775 - DNA, 23 bp, Homo sapiens
atagaggccaaattaatctttta

SEQ ID NO: 2720776 - DNA, 17 bp, Homo sapiens
atagaggggttttagat

SEQ ID NO: 2720777 - DNA, 17 bp, Homo sapiens
atagatgagaaaactga

SEQ ID NO: 2720778 - DNA, 15 bp, Homo sapiens
atagcaaggccaggg

SEQ ID NO: 2720779 - DNA, 18 bp, Homo sapiens
atagcgtcataactagaa

SEQ ID NO: 2720780 - DNA, 20 bp, Homo sapiens
atagcgtcataactagaact

SEQ ID NO: 2720781 - DNA, 19 bp, Homo sapiens
atagctctacacaacatgt

SEQ ID NO: 2720782 - DNA, 20 bp, Homo sapiens
atagctctacacaacatgta

SEQ ID NO: 2720783 - DNA, 23 bp, Homo sapiens
atagctctacacaacatgtatgt

SEQ ID NO: 2720784 - DNA, 17 bp, Homo sapiens
ataggataaattaatga

SEQ ID NO: 2720785 - DNA, 17 bp, Homo sapiens
ataggataaattacatt

SEQ ID NO: 2720786 - DNA, 15 bp, Homo sapiens
ataggcagatcttta

SEQ ID NO: 2720787 - DNA, 23 bp, Homo sapiens
ataggcagatctttaaatacagt

SEQ ID NO: 2720788 - DNA, 17 bp, Homo sapiens
atagtcagagtgtccct

SEQ ID NO: 2720789 - DNA, 18 bp, Homo sapiens
atagttgtctttctttgc

SEQ ID NO: 2720790 - DNA, 19 bp, Homo sapiens
atagttgtctttctttgct

SEQ ID NO: 2720791 - DNA, 23 bp, Homo sapiens
atagttgtctttctttgctgctg

SEQ ID NO: 2720792 - DNA, 16 bp, Homo sapiens
atataagcaagacagt

SEQ ID NO: 2720793 - DNA, 14 bp, Homo sapiens
atataatttaaaga

SEQ ID NO: 2720794 - DNA, 19 bp, Homo sapiens
atatacagattcctgttgt

SEQ ID NO: 2720795 - DNA, 20 bp, Homo sapiens
atatagctctacacaacatg

SEQ ID NO: 2720796 - DNA, 22 bp, Homo sapiens
atatagttgtctttctttgctg

SEQ ID NO: 2720797 - DNA, 24 bp, Homo sapiens
atatagtttgtggtaaaaagatta

SEQ ID NO: 2720798 - DNA, 14 bp, Homo sapiens
atatatcataaagt

SEQ ID NO: 2720799 - DNA, 12 bp, Homo sapiens
atatatgtatat

SEQ ID NO: 2720800 - DNA, 14 bp, Homo sapiens
atatcaggagggga

SEQ ID NO: 2720801 - DNA, 13 bp, Homo sapiens
atatcataaagta

SEQ ID NO: 2720802 - DNA, 15 bp, Homo sapiens
atatcataaagtatg

SEQ ID NO: 2720803 - DNA, 13 bp, Homo sapiens
atatcatttttat

SEQ ID NO: 2720804 - DNA, 13 bp, Homo sapiens
atatctaatttac

SEQ ID NO: 2720805 - DNA, 16 bp, Homo sapiens
atatctaatttaccat

SEQ ID NO: 2720806 - DNA, 15 bp, Homo sapiens
atatctctagtccct

SEQ ID NO: 2720807 - DNA, 22 bp, Homo sapiens
atatctctagtccctgtgttct

SEQ ID NO: 2720808 - DNA, 16 bp, Homo sapiens
atatctgatactgtat

SEQ ID NO: 2720809 - DNA, 14 bp, Homo sapiens
atatctttatgcaa

SEQ ID NO: 2720810 - DNA, 21 bp, Homo sapiens
atatgaaagccacactttgaa

SEQ ID NO: 2720811 - DNA, 19 bp, Homo sapiens
atatggtactaaggagaat

SEQ ID NO: 2720812 - DNA, 22 bp, Homo sapiens
atatgtatatctatatctctaa

SEQ ID NO: 2720813 - DNA, 19 bp, Homo sapiens
atatgtctgtctttgcaaa

SEQ ID NO: 2720814 - DNA, 18 bp, Homo sapiens
atatgttaggaatactct

SEQ ID NO: 2720815 - DNA, 19 bp, Homo sapiens
atattaaatgactttttga

SEQ ID NO: 2720816 - DNA, 13 bp, Homo sapiens
atattaagaaaca

SEQ ID NO: 2720817 - DNA, 18 bp, Homo sapiens
atattaagaaacaattta

SEQ ID NO: 2720818 - DNA, 22 bp, Homo sapiens
atattagtttgatttaatatct

SEQ ID NO: 2720819 - DNA, 17 bp, Homo sapiens
atattattcattcattt

SEQ ID NO: 2720820 - DNA, 14 bp, Homo sapiens
atattcttttgtta

SEQ ID NO: 2720821 - DNA, 22 bp, Homo sapiens
atattgaccatgtgattatgga

SEQ ID NO: 2720822 - DNA, 17 bp, Homo sapiens
atattggttctatttat

SEQ ID NO: 2720823 - DNA, 22 bp, Homo sapiens
atattgtcagagttctgctcta

SEQ ID NO: 2720824 - DNA, 21 bp, Homo sapiens
atatttaaaagacaaacacct

SEQ ID NO: 2720825 - DNA, 22 bp, Homo sapiens
atatttaaaagacaaacacctt

SEQ ID NO: 2720826 - DNA, 14 bp, Homo sapiens
atatttactttaaa

SEQ ID NO: 2720827 - DNA, 15 bp, Homo sapiens
atatttctgatataa

SEQ ID NO: 2720828 - DNA, 19 bp, Homo sapiens
atatttcttcaagtgagtg

SEQ ID NO: 2720829 - DNA, 19 bp, Homo sapiens
atattttctgagtagcata

SEQ ID NO: 2720830 - DNA, 16 bp, Homo sapiens
atgatctactcatttg

SEQ ID NO: 2720831 - DNA, 18 bp, Homo sapiens
atgatgccacaccaagct

SEQ ID NO: 2720832 - DNA, 16 bp, Homo sapiens
atgatgggccgagcca

SEQ ID NO: 2720833 - DNA, 15 bp, Homo sapiens
atgattgaattttta

SEQ ID NO: 2720834 - DNA, 15 bp, Homo sapiens
atgattttcttttgt

SEQ ID NO: 2720835 - DNA, 24 bp, Homo sapiens
atgcaaaaacatatgtctgtcttt

SEQ ID NO: 2720836 - DNA, 19 bp, Homo sapiens
atgcaacttgattcttgtg

SEQ ID NO: 2720837 - DNA, 18 bp, Homo sapiens
atgcaatcctacttctat

SEQ ID NO: 2720838 - DNA, 13 bp, Homo sapiens
atgcactctctct

SEQ ID NO: 2720839 - DNA, 16 bp, Homo sapiens
atgcaggcaacattac

SEQ ID NO: 2720840 - DNA, 14 bp, Homo sapiens
atgcaggtctccat

SEQ ID NO: 2720841 - DNA, 21 bp, Homo sapiens
atgcaggtctccatgaagaag

SEQ ID NO: 2720842 - DNA, 22 bp, Homo sapiens
atgcaggtctgattcccagaaa

SEQ ID NO: 2720843 - DNA, 14 bp, Homo sapiens
atgcatgtaaggtc

SEQ ID NO: 2720844 - DNA, 21 bp, Homo sapiens
atgcatgtaaggtcttcttgt

SEQ ID NO: 2720845 - DNA, 19 bp, Homo sapiens
atgcattagattatcaaaa

SEQ ID NO: 2720846 - DNA, 20 bp, Homo sapiens
atgcattctagtgcagaagc

SEQ ID NO: 2720847 - DNA, 20 bp, Homo sapiens
atgcccagagggcccaggca

SEQ ID NO: 2720848 - DNA, 22 bp, Homo sapiens
atgcccagagggcccaggcagg

SEQ ID NO: 2720849 - DNA, 23 bp, Homo sapiens
atgcccagagggcccaggcaggc

SEQ ID NO: 2720850 - DNA, 17 bp, Homo sapiens
attaatcttttaaaaat

SEQ ID NO: 2720851 - DNA, 20 bp, Homo sapiens
attaatcttttaaaaatgat

SEQ ID NO: 2720852 - DNA, 12 bp, Homo sapiens
attaatgagttt

SEQ ID NO: 2720853 - DNA, 19 bp, Homo sapiens
attaattagatcaacactt

SEQ ID NO: 2720854 - DNA, 19 bp, Homo sapiens
attaattattttccaaaat

SEQ ID NO: 2720855 - DNA, 15 bp, Homo sapiens
attacaataaatcct

SEQ ID NO: 2720856 - DNA, 16 bp, Homo sapiens
attacccttcctcatc

SEQ ID NO: 2720857 - DNA, 20 bp, Homo sapiens
attaccttgtctttcaaaag

SEQ ID NO: 2720858 - DNA, 16 bp, Homo sapiens
attactgtatgtataa

SEQ ID NO: 2720859 - DNA, 15 bp, Homo sapiens
attactttgtcccgc

SEQ ID NO: 2720860 - DNA, 16 bp, Homo sapiens
attaggtttagaatca

SEQ ID NO: 2720861 - DNA, 13 bp, Homo sapiens
attagtttaaaat

SEQ ID NO: 2720862 - DNA, 21 bp, Homo sapiens
attagtttgatttaatatctg

SEQ ID NO: 2720863 - DNA, 23 bp, Homo sapiens
attatattcctctaaaactctca

SEQ ID NO: 2720864 - DNA, 14 bp, Homo sapiens
attatgttattgga

SEQ ID NO: 2720865 - DNA, 20 bp, Homo sapiens
attatgttattggaattttc

SEQ ID NO: 2720866 - DNA, 21 bp, Homo sapiens
attatgttattggaattttct

SEQ ID NO: 2720867 - DNA, 22 bp, Homo sapiens
attatgttattggaattttctt

SEQ ID NO: 2720868 - DNA, 19 bp, Homo sapiens
attattgtgatttcccgtg

SEQ ID NO: 2720869 - DNA, 13 bp, Homo sapiens
attatttaaagca

SEQ ID NO: 2720870 - DNA, 14 bp, Homo sapiens
attatttgttttcc

SEQ ID NO: 2720871 - DNA, 19 bp, Homo sapiens
attattttacagtctctgt

SEQ ID NO: 2720872 - DNA, 23 bp, Homo sapiens
attcaaagaaaaccctaagtgtg

SEQ ID NO: 2720873 - DNA, 14 bp, Homo sapiens
attcaacctgtgtc

SEQ ID NO: 2720874 - DNA, 12 bp, Homo sapiens
attcaagtatta

SEQ ID NO: 2720875 - DNA, 23 bp, Homo sapiens
attcacaaacaaatggctgtaaa

SEQ ID NO: 2720876 - DNA, 17 bp, Homo sapiens
attcacagcgcctcctg

SEQ ID NO: 2720877 - DNA, 12 bp, Homo sapiens
attcactcccac

SEQ ID NO: 2720878 - DNA, 12 bp, Homo sapiens
attcactgttga

SEQ ID NO: 2720879 - DNA, 17 bp, Homo sapiens
attcaggaggctgaggc

SEQ ID NO: 2720880 - DNA, 19 bp, Homo sapiens
attcatcaaataaaccttg

SEQ ID NO: 2720881 - DNA, 14 bp, Homo sapiens
attcatctggaggc

SEQ ID NO: 2720882 - DNA, 19 bp, Homo sapiens
attcatctggaggctgcgt

SEQ ID NO: 2720883 - DNA, 16 bp, Homo sapiens
attcatgctttctcct

SEQ ID NO: 2720884 - DNA, 18 bp, Homo sapiens
attcattaatctgtttgt

SEQ ID NO: 2720885 - DNA, 19 bp, Homo sapiens
attccaataaagcagagtt

SEQ ID NO: 2720886 - DNA, 22 bp, Homo sapiens
attccatgcactctctctctgt

SEQ ID NO: 2720887 - DNA, 19 bp, Homo sapiens
attcccactaagctttctc

SEQ ID NO: 2720888 - DNA, 22 bp, Homo sapiens
attcccatggtagactgtgaca

SEQ ID NO: 2720889 - DNA, 20 bp, Homo sapiens
attccccggggcgtttcttt

SEQ ID NO: 2720890 - DNA, 19 bp, Homo sapiens
attcctggcatgacactct

SEQ ID NO: 2720891 - DNA, 24 bp, Homo sapiens
attcctgttgtgtaataacagaac

SEQ ID NO: 2720892 - DNA, 15 bp, Homo sapiens
attctaaacagatgt

SEQ ID NO: 2720893 - DNA, 22 bp, Homo sapiens
attctaataaatcaatgtgagt

SEQ ID NO: 2720894 - DNA, 24 bp, Homo sapiens
attctacacatatatgtatatgta

SEQ ID NO: 2720895 - DNA, 20 bp, Homo sapiens
attctattttgctggagact

SEQ ID NO: 2720896 - DNA, 14 bp, Homo sapiens
attctcacctgcct

SEQ ID NO: 2720897 - DNA, 14 bp, Homo sapiens
attctcctgcctca

SEQ ID NO: 2720898 - DNA, 17 bp, Homo sapiens
attctctctaacataac

SEQ ID NO: 2720899 - DNA, 13 bp, Homo sapiens
attctctctgctc

SEQ ID NO: 2720900 - DNA, 20 bp, Homo sapiens
attctctctgctcagtgatc

SEQ ID NO: 2720901 - DNA, 16 bp, Homo sapiens
attctgaacaattctc

SEQ ID NO: 2720902 - DNA, 17 bp, Homo sapiens
attctgaagccattgtc

SEQ ID NO: 2720903 - DNA, 17 bp, Homo sapiens
attctgataatgtattg

SEQ ID NO: 2720904 - DNA, 18 bp, Homo sapiens
attctgataatgtattgc

SEQ ID NO: 2720905 - DNA, 13 bp, Homo sapiens
attctgattccac

SEQ ID NO: 2720906 - DNA, 19 bp, Homo sapiens
attctgttctacttgatat

SEQ ID NO: 2720907 - DNA, 23 bp, Homo sapiens
attcttaaaactttctaaatgca

SEQ ID NO: 2720908 - DNA, 18 bp, Homo sapiens
attctttaaggagataga

SEQ ID NO: 2720909 - DNA, 19 bp, Homo sapiens
attcttttgttattaaaaa

SEQ ID NO: 2720910 - DNA, 16 bp, Homo sapiens
attctttttaaagtat

SEQ ID NO: 2720911 - DNA, 16 bp, Homo sapiens
attgaatttagtcatt

SEQ ID NO: 2720912 - DNA, 16 bp, Homo sapiens
attgaccatgtgatta

SEQ ID NO: 2720913 - DNA, 15 bp, Homo sapiens
attgagcgtgattct

SEQ ID NO: 2720914 - DNA, 19 bp, Homo sapiens
attgcactaaataaactac

SEQ ID NO: 2720915 - DNA, 13 bp, Homo sapiens
attgcacttttaa

SEQ ID NO: 2720916 - DNA, 15 bp, Homo sapiens
attgcagtgcggctc

SEQ ID NO: 2720917 - DNA, 21 bp, Homo sapiens
attgcagtgcggctcacatca

SEQ ID NO: 2720918 - DNA, 23 bp, Homo sapiens
attgcatgaattcacaaacaaat

SEQ ID NO: 2720919 - DNA, 16 bp, Homo sapiens
attgcgagaattttca

SEQ ID NO: 2720920 - DNA, 19 bp, Homo sapiens
attgctccattttcttgtc

SEQ ID NO: 2720921 - DNA, 18 bp, Homo sapiens
attgctcttaaaaatctt

SEQ ID NO: 2720922 - DNA, 13 bp, Homo sapiens
attggaattttct

SEQ ID NO: 2720923 - DNA, 19 bp, Homo sapiens
attggcagcaggtgctgct

SEQ ID NO: 2720924 - DNA, 14 bp, Homo sapiens
attggcaggaggca

SEQ ID NO: 2720925 - DNA, 15 bp, Homo sapiens
attggccctgcccct

SEQ ID NO: 2720926 - DNA, 17 bp, Homo sapiens
attggccctgcccctcc

SEQ ID NO: 2720927 - DNA, 23 bp, Homo sapiens
attggtttgttattcttttccag

SEQ ID NO: 2720928 - DNA, 21 bp, Homo sapiens
attgtatagagatatgcagaa

SEQ ID NO: 2720929 - DNA, 22 bp, Homo sapiens
attgtatagagatatgcagaag

SEQ ID NO: 2720930 - DNA, 14 bp, Homo sapiens
attgtatcctgagg

SEQ ID NO: 2720931 - DNA, 17 bp, Homo sapiens
attgtctgtctgctctt

SEQ ID NO: 2720932 - DNA, 11 bp, Homo sapiens
attgtcttcca

SEQ ID NO: 2720933 - DNA, 19 bp, Homo sapiens
attgtcttccaaccccagc

SEQ ID NO: 2720934 - DNA, 23 bp, Homo sapiens
attgtgatttcccgtggccccag

SEQ ID NO: 2720935 - DNA, 15 bp, Homo sapiens
attgtgcaatagtca

SEQ ID NO: 2720936 - DNA, 10 bp, Homo sapiens
attgttctgg

SEQ ID NO: 2720937 - DNA, 13 bp, Homo sapiens
atttaaaagacaa

SEQ ID NO: 2720938 - DNA, 15 bp, Homo sapiens
atttaaagaaacact

SEQ ID NO: 2720939 - DNA, 21 bp, Homo sapiens
atttaaagaaacactaaatta

SEQ ID NO: 2720940 - DNA, 14 bp, Homo sapiens
atttaaattgttat

SEQ ID NO: 2720941 - DNA, 19 bp, Homo sapiens
atttaaattgttataactt

SEQ ID NO: 2720942 - DNA, 21 bp, Homo sapiens
atttaacttgagggtaataaa

SEQ ID NO: 2720943 - DNA, 24 bp, Homo sapiens
atttaatgatttttgtgtatccag

SEQ ID NO: 2720944 - DNA, 20 bp, Homo sapiens
atttacatgaattgcatttt

SEQ ID NO: 2720945 - DNA, 21 bp, Homo sapiens
atttaccattattttacagtc

SEQ ID NO: 2720946 - DNA, 17 bp, Homo sapiens
atttacctgcgaacttg

SEQ ID NO: 2720947 - DNA, 15 bp, Homo sapiens
atttactacttttgc

SEQ ID NO: 2720948 - DNA, 14 bp, Homo sapiens
atttactgtcccag

SEQ ID NO: 2720949 - DNA, 16 bp, Homo sapiens
atttactgtcccagga

SEQ ID NO: 2720950 - DNA, 18 bp, Homo sapiens
atttactttttaaacagt

SEQ ID NO: 2720951 - DNA, 14 bp, Homo sapiens
atttagaatatatt

SEQ ID NO: 2720952 - DNA, 14 bp, Homo sapiens
atttaggagaagtt

SEQ ID NO: 2720953 - DNA, 17 bp, Homo sapiens
atttaggagaagttggt

SEQ ID NO: 2720954 - DNA, 14 bp, Homo sapiens
atttatatctttat

SEQ ID NO: 2720955 - DNA, 16 bp, Homo sapiens
atttatattcatcaaa

SEQ ID NO: 2720956 - DNA, 20 bp, Homo sapiens
atttatgcctctgtatttaa

SEQ ID NO: 2720957 - DNA, 23 bp, Homo sapiens
atttcaaaatggtaactttacaa

SEQ ID NO: 2720958 - DNA, 23 bp, Homo sapiens
atttcaacaagtagctaaagtct

SEQ ID NO: 2720959 - DNA, 20 bp, Homo sapiens
atttcaggaatttaatttat

SEQ ID NO: 2720960 - DNA, 21 bp, Homo sapiens
atttccatggattcccctgga

SEQ ID NO: 2720961 - DNA, 15 bp, Homo sapiens
atttcccgtggcccc

SEQ ID NO: 2720962 - DNA, 23 bp, Homo sapiens
atttcccgtggccccagcctggc

SEQ ID NO: 2720963 - DNA, 17 bp, Homo sapiens
agatagaggggttttag

SEQ ID NO: 2720964 - DNA, 15 bp, Homo sapiens
agatagtgcctctgc

SEQ ID NO: 2720965 - DNA, 23 bp, Homo sapiens
agatatttacatgaattgcattt

SEQ ID NO: 2720966 - DNA, 21 bp, Homo sapiens
agatcagctattcccttctga

SEQ ID NO: 2720967 - DNA, 13 bp, Homo sapiens
agatccaggcttc

SEQ ID NO: 2720968 - DNA, 16 bp, Homo sapiens
agatccaggcttctcc

SEQ ID NO: 2720969 - DNA, 22 bp, Homo sapiens
agatccagttgaatatttaaag

SEQ ID NO: 2720970 - DNA, 19 bp, Homo sapiens
agatctgcttccctggggc

SEQ ID NO: 2720971 - DNA, 20 bp, Homo sapiens
agatctgcttccctggggcc

SEQ ID NO: 2720972 - DNA, 21 bp, Homo sapiens
agatctttctttccaaaacat

SEQ ID NO: 2720973 - DNA, 14 bp, Homo sapiens
agatgactgagtcc

SEQ ID NO: 2720974 - DNA, 15 bp, Homo sapiens
agatgactgagtcct

SEQ ID NO: 2720975 - DNA, 22 bp, Homo sapiens
agatgagtgggttagctacctg

SEQ ID NO: 2720976 - DNA, 15 bp, Homo sapiens
agatgatgttaaatg

SEQ ID NO: 2720977 - DNA, 22 bp, Homo sapiens
agatgcccagagggcccaggca

SEQ ID NO: 2720978 - DNA, 15 bp, Homo sapiens
agatggaagagtcat

SEQ ID NO: 2720979 - DNA, 22 bp, Homo sapiens
agatgggatgggctttctcagt

SEQ ID NO: 2720980 - DNA, 21 bp, Homo sapiens
agatgggcctgtgtgcaccca

SEQ ID NO: 2720981 - DNA, 15 bp, Homo sapiens
agatgtcagactggc

SEQ ID NO: 2720982 - DNA, 18 bp, Homo sapiens
agatgtccctgaagtctt

SEQ ID NO: 2720983 - DNA, 20 bp, Homo sapiens
agatgtgctcccaccaggca

SEQ ID NO: 2720984 - DNA, 22 bp, Homo sapiens
agatgtgggctcagatcctggg

SEQ ID NO: 2720985 - DNA, 15 bp, Homo sapiens
agattacaataaatc

SEQ ID NO: 2720986 - DNA, 22 bp, Homo sapiens
agattcctgttgtgtaataaca

SEQ ID NO: 2720987 - DNA, 19 bp, Homo sapiens
agattctttaaggagatag

SEQ ID NO: 2720988 - DNA, 20 bp, Homo sapiens
agattctttaaggagataga

SEQ ID NO: 2720989 - DNA, 13 bp, Homo sapiens
agattgctctggg

SEQ ID NO: 2720990 - DNA, 15 bp, Homo sapiens
agattgtaaaggtag

SEQ ID NO: 2720991 - DNA, 20 bp, Homo sapiens
agatttcagctatgcagaaa

SEQ ID NO: 2720992 - DNA, 13 bp, Homo sapiens
agattttccttcc

SEQ ID NO: 2720993 - DNA, 11 bp, Homo sapiens
agcaaagccat

SEQ ID NO: 2720994 - DNA, 23 bp, Homo sapiens
agcaaagtctaaagtttacagta

SEQ ID NO: 2720995 - DNA, 21 bp, Homo sapiens
agcaaatatataatgcaacaa

SEQ ID NO: 2720996 - DNA, 16 bp, Homo sapiens
agcaaccgtgcagcca

SEQ ID NO: 2720997 - DNA, 21 bp, Homo sapiens
agcaactcctgttctttgggc

SEQ ID NO: 2720998 - DNA, 19 bp, Homo sapiens
agcaagacgtcctggaatg

SEQ ID NO: 2720999 - DNA, 21 bp, Homo sapiens
agcaagccggcagaaatagct

SEQ ID NO: 2721000 - DNA, 13 bp, Homo sapiens
agcaaggcacctg

SEQ ID NO: 2721001 - DNA, 16 bp, Homo sapiens
agcaaggccagggcac

SEQ ID NO: 2721002 - DNA, 22 bp, Homo sapiens
agcaaggccagggcacagctgg

SEQ ID NO: 2721003 - DNA, 18 bp, Homo sapiens
agcaatactgtttccatt

SEQ ID NO: 2721004 - DNA, 13 bp, Homo sapiens
agcaatcatttta

SEQ ID NO: 2721005 - DNA, 15 bp, Homo sapiens
agcaatttatatctt

SEQ ID NO: 2721006 - DNA, 17 bp, Homo sapiens
agcaatttatatcttta

SEQ ID NO: 2721007 - DNA, 11 bp, Homo sapiens
agcaatttttg

SEQ ID NO: 2721008 - DNA, 17 bp, Homo sapiens
agcacaccattgcatga

SEQ ID NO: 2721009 - DNA, 23 bp, Homo sapiens
agcacagcaaggaggctggctgg

SEQ ID NO: 2721010 - DNA, 13 bp, Homo sapiens
agcacagccctcc

SEQ ID NO: 2721011 - DNA, 14 bp, Homo sapiens
agcacagccctccc

SEQ ID NO: 2721012 - DNA, 13 bp, Homo sapiens
agcacagctcctc

SEQ ID NO: 2721013 - DNA, 15 bp, Homo sapiens
agcacagctcctccc

SEQ ID NO: 2721014 - DNA, 18 bp, Homo sapiens
agcacagctcctcccctg

SEQ ID NO: 2721015 - DNA, 16 bp, Homo sapiens
agcacatgattttctt

SEQ ID NO: 2721016 - DNA, 17 bp, Homo sapiens
agcacatgccagggaaa

SEQ ID NO: 2721017 - DNA, 17 bp, Homo sapiens
agcactttataagccaa

SEQ ID NO: 2721018 - DNA, 21 bp, Homo sapiens
agcactttgggaggctgaggc

SEQ ID NO: 2721019 - DNA, 15 bp, Homo sapiens
agcagagcaggggca

SEQ ID NO: 2721020 - DNA, 17 bp, Homo sapiens
agcagaggagtccaggg

SEQ ID NO: 2721021 - DNA, 18 bp, Homo sapiens
aatttgtatctgaaggag

SEQ ID NO: 2721022 - DNA, 19 bp, Homo sapiens
aatttgttgtcatgtgtat

SEQ ID NO: 2721023 - DNA, 21 bp, Homo sapiens
aatttgttgtcatgtgtatga

SEQ ID NO: 2721024 - DNA, 18 bp, Homo sapiens
aattttctttcatacatt

SEQ ID NO: 2721025 - DNA, 19 bp, Homo sapiens
aattttctttcatacatta

SEQ ID NO: 2721026 - DNA, 20 bp, Homo sapiens
aattttctttcatacattat

SEQ ID NO: 2721027 - DNA, 21 bp, Homo sapiens
aattttctttcatacattata

SEQ ID NO: 2721028 - DNA, 22 bp, Homo sapiens
aattttggaaaaatgtcactga

SEQ ID NO: 2721029 - DNA, 13 bp, Homo sapiens
aattttgtaaaaa

SEQ ID NO: 2721030 - DNA, 15 bp, Homo sapiens
aatttttaagcaaat

SEQ ID NO: 2721031 - DNA, 18 bp, Homo sapiens
aatttttataaatatgtg

SEQ ID NO: 2721032 - DNA, 15 bp, Homo sapiens
aatttttttttgtaa

SEQ ID NO: 2721033 - DNA, 22 bp, Homo sapiens
acaaaaggctttggcaacagaa

SEQ ID NO: 2721034 - DNA, 13 bp, Homo sapiens
acaaacagtgaat

SEQ ID NO: 2721035 - DNA, 17 bp, Homo sapiens
acaaacagtgaatttaa

SEQ ID NO: 2721036 - DNA, 17 bp, Homo sapiens
acaaagacttgctttaa

SEQ ID NO: 2721037 - DNA, 21 bp, Homo sapiens
acaaagttactggctctttgt

SEQ ID NO: 2721038 - DNA, 16 bp, Homo sapiens
acaaatggctgtaaaa

SEQ ID NO: 2721039 - DNA, 13 bp, Homo sapiens
acaacacatgtgg

SEQ ID NO: 2721040 - DNA, 21 bp, Homo sapiens
acaacatcgcaatagtttttt

SEQ ID NO: 2721041 - DNA, 17 bp, Homo sapiens
acaacctccacctcctg

SEQ ID NO: 2721042 - DNA, 18 bp, Homo sapiens
acaacctccacctcctgg

SEQ ID NO: 2721043 - DNA, 16 bp, Homo sapiens
acaacctgcccctccc

SEQ ID NO: 2721044 - DNA, 24 bp, Homo sapiens
acaacttgcacgtattttaatagc

SEQ ID NO: 2721045 - DNA, 17 bp, Homo sapiens
acaagaaggtttctgtc

SEQ ID NO: 2721046 - DNA, 20 bp, Homo sapiens
acaaggtgcacagacctcag

SEQ ID NO: 2721047 - DNA, 18 bp, Homo sapiens
acaataataaatcctcag

SEQ ID NO: 2721048 - DNA, 16 bp, Homo sapiens
acaatacatgctgcta

SEQ ID NO: 2721049 - DNA, 22 bp, Homo sapiens
acaatccaaatgcattcatgtt

SEQ ID NO: 2721050 - DNA, 21 bp, Homo sapiens
acaatgcgtggcacatctaaa

SEQ ID NO: 2721051 - DNA, 15 bp, Homo sapiens
acaatggccatggaa

SEQ ID NO: 2721052 - DNA, 20 bp, Homo sapiens
acaatgttgcactgaaaacc

SEQ ID NO: 2721053 - DNA, 13 bp, Homo sapiens
acacacactcctt

SEQ ID NO: 2721054 - DNA, 12 bp, Homo sapiens
acacactccttc

SEQ ID NO: 2721055 - DNA, 13 bp, Homo sapiens
acacactccttcc

SEQ ID NO: 2721056 - DNA, 15 bp, Homo sapiens
acacactccttcccc

SEQ ID NO: 2721057 - DNA, 12 bp, Homo sapiens
acacagactctg

SEQ ID NO: 2721058 - DNA, 19 bp, Homo sapiens
acacagactctgtgagatt

SEQ ID NO: 2721059 - DNA, 17 bp, Homo sapiens
acacagtgtttcctgag

SEQ ID NO: 2721060 - DNA, 23 bp, Homo sapiens
acacagtgtttcctgagtagcag

SEQ ID NO: 2721061 - DNA, 17 bp, Homo sapiens
acaccaagctgtgccac

SEQ ID NO: 2721062 - DNA, 21 bp, Homo sapiens
acaccaagctgtgccaccctg

SEQ ID NO: 2721063 - DNA, 19 bp, Homo sapiens
acaccattgcatgaattca

SEQ ID NO: 2721064 - DNA, 13 bp, Homo sapiens
acacccactggcc

SEQ ID NO: 2721065 - DNA, 15 bp, Homo sapiens
acacccactggccag

SEQ ID NO: 2721066 - DNA, 21 bp, Homo sapiens
acaccccccgccccccacctt

SEQ ID NO: 2721067 - DNA, 11 bp, Homo sapiens
acaccctgcct

SEQ ID NO: 2721068 - DNA, 16 bp, Homo sapiens
acaccctgcctgctgt

SEQ ID NO: 2721069 - DNA, 18 bp, Homo sapiens
acaccctgcctgctgtgg

SEQ ID NO: 2721070 - DNA, 21 bp, Homo sapiens
acaccctgcctgctgtggagc

SEQ ID NO: 2721071 - DNA, 23 bp, Homo sapiens
acaccctgcctgctgtggagccc

SEQ ID NO: 2721072 - DNA, 16 bp, Homo sapiens
acacccttggacttga

SEQ ID NO: 2721073 - DNA, 20 bp, Homo sapiens
acactaaattagtttaaaat

SEQ ID NO: 2721074 - DNA, 23 bp, Homo sapiens
acactaaattagtttaaaatgaa

SEQ ID NO: 2721075 - DNA, 17 bp, Homo sapiens
acactacttgagaaaat

SEQ ID NO: 2721076 - DNA, 22 bp, Homo sapiens
acactccagaattacccttcct

SEQ ID NO: 2721077 - DNA, 14 bp, Homo sapiens
acactccagcctga

SEQ ID NO: 2721078 - DNA, 17 bp, Homo sapiens
acactccagcctgagca

SEQ ID NO: 2721079 - DNA, 17 bp, Homo sapiens
acactcctcctgccagc

SEQ ID NO: 2721080 - DNA, 19 bp, Homo sapiens
acacttcttgaaacagcct

SEQ ID NO: 2721081 - DNA, 23 bp, Homo sapiens
acacttgttcaacagtttctcaa

SEQ ID NO: 2721082 - DNA, 17 bp, Homo sapiens
acagaaaccagaaaagc

SEQ ID NO: 2721083 - DNA, 17 bp, Homo sapiens
acagaaaggccactcag

SEQ ID NO: 2721084 - DNA, 23 bp, Homo sapiens
acagaactcgtggcgtggggcag

SEQ ID NO: 2721085 - DNA, 20 bp, Homo sapiens
acagactcttccaccagagc

SEQ ID NO: 2721086 - DNA, 18 bp, Homo sapiens
acagagaaattctgtggt

SEQ ID NO: 2721087 - DNA, 15 bp, Homo sapiens
acagagggcgctcct

SEQ ID NO: 2721088 - DNA, 21 bp, Homo sapiens
acagagtaaatagcattctct

SEQ ID NO: 2721089 - DNA, 15 bp, Homo sapiens
acagatgctggcctc

SEQ ID NO: 2721090 - DNA, 20 bp, Homo sapiens
acagatgctggcctcttggc

SEQ ID NO: 2721091 - DNA, 13 bp, Homo sapiens
acagattcctgtt

SEQ ID NO: 2721092 - DNA, 17 bp, Homo sapiens
acagattcctgttgtgt

SEQ ID NO: 2721093 - DNA, 16 bp, Homo sapiens
acagcaaggaggctgg

SEQ ID NO: 2721094 - DNA, 23 bp, Homo sapiens
acagcaaggaggctggctggggc

SEQ ID NO: 2721095 - DNA, 18 bp, Homo sapiens
acagcagggtcttgctgt

SEQ ID NO: 2721096 - DNA, 14 bp, Homo sapiens
acagcatgcagact

SEQ ID NO: 2721097 - DNA, 17 bp, Homo sapiens
acagcccacgtcctgtc

SEQ ID NO: 2721098 - DNA, 14 bp, Homo sapiens
acagcccccacccc

SEQ ID NO: 2721099 - DNA, 15 bp, Homo sapiens
acagcccccacccca

SEQ ID NO: 2721100 - DNA, 16 bp, Homo sapiens
acagcccccaccccag

SEQ ID NO: 2721101 - DNA, 23 bp, Homo sapiens
acagccgcagcctccctctgacc

SEQ ID NO: 2721102 - DNA, 15 bp, Homo sapiens
acagcgcctcctgga

SEQ ID NO: 2721103 - DNA, 12 bp, Homo sapiens
acagctctgctg

SEQ ID NO: 2721104 - DNA, 16 bp, Homo sapiens
acagctctgctggaag

SEQ ID NO: 2721105 - DNA, 16 bp, Homo sapiens
acaggaggctccgtga

SEQ ID NO: 2721106 - DNA, 15 bp, Homo sapiens
acaggattgggccaa

SEQ ID NO: 2721107 - DNA, 12 bp, Homo sapiens
acaggcaccaga

SEQ ID NO: 2721108 - DNA, 19 bp, Homo sapiens
acaggcatgagccaccatg

SEQ ID NO: 2721109 - DNA, 15 bp, Homo sapiens
acaggtcttgcccaa

SEQ ID NO: 2721110 - DNA, 13 bp, Homo sapiens
acagtaaataaat

SEQ ID NO: 2721111 - DNA, 23 bp, Homo sapiens
acagtaaataaattgtttgacca

SEQ ID NO: 2721112 - DNA, 19 bp, Homo sapiens
acagtacctgattgtattt

SEQ ID NO: 2721113 - DNA, 15 bp, Homo sapiens
acagtcagcacagaa

SEQ ID NO: 2721114 - DNA, 22 bp, Homo sapiens
acagtcattatttaaagcacat

SEQ ID NO: 2721115 - DNA, 14 bp, Homo sapiens
acagtctcaatttt

SEQ ID NO: 2721116 - DNA, 16 bp, Homo sapiens
aaatatatatttatca

SEQ ID NO: 2721117 - DNA, 21 bp, Homo sapiens
aaatatccctttttcacatat

SEQ ID NO: 2721118 - DNA, 14 bp, Homo sapiens
ctcagcctcctgag

SEQ ID NO: 2721119 - DNA, 19 bp, Homo sapiens
ctcagctctcctgctgcag

SEQ ID NO: 2721120 - DNA, 17 bp, Homo sapiens
ccttaattcactcccac

SEQ ID NO: 2721121 - DNA, 20 bp, Homo sapiens
ccttacaaccacatttctgg

SEQ ID NO: 2721122 - DNA, 17 bp, Homo sapiens
ccttactcagagctgcg

SEQ ID NO: 2721123 - DNA, 14 bp, Homo sapiens
ccttagttgttatc

SEQ ID NO: 2721124 - DNA, 13 bp, Homo sapiens
ccttcacatgaaa

SEQ ID NO: 2721125 - DNA, 20 bp, Homo sapiens
ccttcactccggtgtgcctg

SEQ ID NO: 2721126 - DNA, 21 bp, Homo sapiens
ccttccaaatcaggctgggtt

SEQ ID NO: 2721127 - DNA, 13 bp, Homo sapiens
ccttccccgaggg

SEQ ID NO: 2721128 - DNA, 21 bp, Homo sapiens
ccttccccttgtccctggggc

SEQ ID NO: 2721129 - DNA, 20 bp, Homo sapiens
ccttcctacacccttggact

SEQ ID NO: 2721130 - DNA, 17 bp, Homo sapiens
ccttcctcatctgtgcc

SEQ ID NO: 2721131 - DNA, 18 bp, Homo sapiens
ccttcctcatctgtgcct

SEQ ID NO: 2721132 - DNA, 12 bp, Homo sapiens
ccttctccagca

SEQ ID NO: 2721133 - DNA, 15 bp, Homo sapiens
ccttctccagggaca

SEQ ID NO: 2721134 - DNA, 22 bp, Homo sapiens
ccttctcccccccggggctggg

SEQ ID NO: 2721135 - DNA, 17 bp, Homo sapiens
ccttcttaactctgcag

SEQ ID NO: 2721136 - DNA, 22 bp, Homo sapiens
ccttgaagccactgaagctggg

SEQ ID NO: 2721137 - DNA, 16 bp, Homo sapiens
ccttgagtaggccctg

SEQ ID NO: 2721138 - DNA, 16 bp, Homo sapiens
ccttgctgtcctaggc

SEQ ID NO: 2721139 - DNA, 14 bp, Homo sapiens
ccttggagagcagc

SEQ ID NO: 2721140 - DNA, 19 bp, Homo sapiens
ccttggcatcacagggcag

SEQ ID NO: 2721141 - DNA, 17 bp, Homo sapiens
ccttggtcccagacagc

SEQ ID NO: 2721142 - DNA, 18 bp, Homo sapiens
ccttggtcccagacagct

SEQ ID NO: 2721143 - DNA, 20 bp, Homo sapiens
ccttggtcccagacagctgg

SEQ ID NO: 2721144 - DNA, 15 bp, Homo sapiens
ccttgtcctctcaga

SEQ ID NO: 2721145 - DNA, 21 bp, Homo sapiens
ccttgtcctctcagagcctca

SEQ ID NO: 2721146 - DNA, 22 bp, Homo sapiens
cctttaaaggtcgcacctcctt

SEQ ID NO: 2721147 - DNA, 15 bp, Homo sapiens
cctttacttgacctc

SEQ ID NO: 2721148 - DNA, 15 bp, Homo sapiens
cctttaggcagcctg

SEQ ID NO: 2721149 - DNA, 16 bp, Homo sapiens
cctttaggcagcctgc

SEQ ID NO: 2721150 - DNA, 16 bp, Homo sapiens
cctttatcccctcctt

SEQ ID NO: 2721151 - DNA, 19 bp, Homo sapiens
cctttcacaggactctgca

SEQ ID NO: 2721152 - DNA, 15 bp, Homo sapiens
cctttcagctgtgaa

SEQ ID NO: 2721153 - DNA, 19 bp, Homo sapiens
cctttgaggcaaaggccag

SEQ ID NO: 2721154 - DNA, 20 bp, Homo sapiens
cctttgcaggcccagcagac

SEQ ID NO: 2721155 - DNA, 19 bp, Homo sapiens
cctttgcccacacacactc

SEQ ID NO: 2721156 - DNA, 21 bp, Homo sapiens
ccttttataaacctctaattt

SEQ ID NO: 2721157 - DNA, 21 bp, Homo sapiens
ccttttcccggggaggagaga

SEQ ID NO: 2721158 - DNA, 16 bp, Homo sapiens
cctttttctacctttt

SEQ ID NO: 2721159 - DNA, 20 bp, Homo sapiens
cctttttgcaggggactggg

SEQ ID NO: 2721160 - DNA, 19 bp, Homo sapiens
ccttttttatgatgctatt

SEQ ID NO: 2721161 - DNA, 14 bp, Homo sapiens
cgaacacgcatgcc

SEQ ID NO: 2721162 - DNA, 20 bp, Homo sapiens
cgaactgtgctcccacgggg

SEQ ID NO: 2721163 - DNA, 17 bp, Homo sapiens
cgaatttttcagatgat

SEQ ID NO: 2721164 - DNA, 15 bp, Homo sapiens
cgaccctggctctgc

SEQ ID NO: 2721165 - DNA, 16 bp, Homo sapiens
cgaccctggctctgcc

SEQ ID NO: 2721166 - DNA, 19 bp, Homo sapiens
cgaccctggctctgccagc

SEQ ID NO: 2721167 - DNA, 13 bp, Homo sapiens
cgactagcaggca

SEQ ID NO: 2721168 - DNA, 15 bp, Homo sapiens
cgactcttcctgcaa

SEQ ID NO: 2721169 - DNA, 18 bp, Homo sapiens
cgacttgaattttcccac

SEQ ID NO: 2721170 - DNA, 22 bp, Homo sapiens
cgacttttctaaagctctgaac

SEQ ID NO: 2721171 - DNA, 16 bp, Homo sapiens
cgagaaccaggctgct

SEQ ID NO: 2721172 - DNA, 12 bp, Homo sapiens
cgagaattttca

SEQ ID NO: 2721173 - DNA, 14 bp, Homo sapiens
cgagaccagcctgg

SEQ ID NO: 2721174 - DNA, 15 bp, Homo sapiens
cgagaccagcctggc

SEQ ID NO: 2721175 - DNA, 23 bp, Homo sapiens
cgagagaccctacagacagtatg

SEQ ID NO: 2721176 - DNA, 14 bp, Homo sapiens
cgagagtctgtctc

SEQ ID NO: 2721177 - DNA, 20 bp, Homo sapiens
cgagatcacgccactgcact

SEQ ID NO: 2721178 - DNA, 22 bp, Homo sapiens
cgagcatgccctgagctctctg

SEQ ID NO: 2721179 - DNA, 21 bp, Homo sapiens
cgagctactctcttgccagca

SEQ ID NO: 2721180 - DNA, 14 bp, Homo sapiens
cgagctgctctgct

SEQ ID NO: 2721181 - DNA, 13 bp, Homo sapiens
cgaggaaaggatt

SEQ ID NO: 2721182 - DNA, 18 bp, Homo sapiens
cgaggaaaggattttacc

SEQ ID NO: 2721183 - DNA, 23 bp, Homo sapiens
cgaggaaaggattttaccaaagc

SEQ ID NO: 2721184 - DNA, 20 bp, Homo sapiens
cgaggaagcagcaattaatt

SEQ ID NO: 2721185 - DNA, 13 bp, Homo sapiens
cgagggatgatgc

SEQ ID NO: 2721186 - DNA, 21 bp, Homo sapiens
cgaggtgtcaccctgcagagc

SEQ ID NO: 2721187 - DNA, 19 bp, Homo sapiens
cgatgcccaatccaggccc

SEQ ID NO: 2721188 - DNA, 11 bp, Homo sapiens
cgcacctcctt

SEQ ID NO: 2721189 - DNA, 17 bp, Homo sapiens
cgcacctgccccctggt

SEQ ID NO: 2721190 - DNA, 11 bp, Homo sapiens
cgcagctgctg

SEQ ID NO: 2721191 - DNA, 14 bp, Homo sapiens
cgcagctgctgcca

SEQ ID NO: 2721192 - DNA, 18 bp, Homo sapiens
cgcagctgctgccactct

SEQ ID NO: 2721193 - DNA, 14 bp, Homo sapiens
cgcatgccccctcg

SEQ ID NO: 2721194 - DNA, 18 bp, Homo sapiens
cgcatgcctcagccagcc

SEQ ID NO: 2721195 - DNA, 13 bp, Homo sapiens
cgcatggcagctg

SEQ ID NO: 2721196 - DNA, 17 bp, Homo sapiens
cgcatggcagctgggcc

SEQ ID NO: 2721197 - DNA, 24 bp, Homo sapiens
cgcatggcagctgggcccacagcc

SEQ ID NO: 2721198 - DNA, 21 bp, Homo sapiens
cgccactacactccagcctga

SEQ ID NO: 2721199 - DNA, 18 bp, Homo sapiens
cgcccagctgaggctggg

SEQ ID NO: 2721200 - DNA, 12 bp, Homo sapiens
cgcccaggctgg

SEQ ID NO: 2721201 - DNA, 15 bp, Homo sapiens
cgcccaggctggcca

SEQ ID NO: 2721202 - DNA, 19 bp, Homo sapiens
cgcccaggctggccagccc

SEQ ID NO: 2721203 - DNA, 12 bp, Homo sapiens
cgccccccacct

SEQ ID NO: 2721204 - DNA, 13 bp, Homo sapiens
cgccgcctcgccc

SEQ ID NO: 2721205 - DNA, 16 bp, Homo sapiens
cgcctatgatcccagc

SEQ ID NO: 2721206 - DNA, 21 bp, Homo sapiens
cgcctccatttttgttgttat

SEQ ID NO: 2721207 - DNA, 21 bp, Homo sapiens
cgcctcccgggaagcatcctc

SEQ ID NO: 2721208 - DNA, 13 bp, Homo sapiens
cgcctcgcccacc

SEQ ID NO: 2721209 - DNA, 14 bp, Homo sapiens
cgcctcgcccaccg

SEQ ID NO: 2721210 - DNA, 19 bp, Homo sapiens
cgcctcgcccaccgcatgc

SEQ ID NO: 2721211 - DNA, 20 bp, Homo sapiens
cgcctcggcctcccaaagtg

SEQ ID NO: 2721212 - DNA, 16 bp, Homo sapiens
cgcctctgcccgcaga

SEQ ID NO: 2721213 - DNA, 12 bp, Homo sapiens
cgcctggcctga

SEQ ID NO: 2721214 - DNA, 14 bp, Homo sapiens
cgcctgtcccctca

SEQ ID NO: 2721215 - DNA, 23 bp, Homo sapiens
cgcgccactacactccagcctga

SEQ ID NO: 2721216 - DNA, 13 bp, Homo sapiens
cgcgctgcctgtg

SEQ ID NO: 2721217 - DNA, 17 bp, Homo sapiens
cgcgtctgccccaccct

SEQ ID NO: 2721218 - DNA, 16 bp, Homo sapiens
cgctaacactgtcctg

SEQ ID NO: 2721219 - DNA, 20 bp, Homo sapiens
cgctactaacctgacatcac

SEQ ID NO: 2721220 - DNA, 21 bp, Homo sapiens
cgctcccagtgtcttcctgtg

SEQ ID NO: 2721221 - DNA, 17 bp, Homo sapiens
cgctctaccctgcagct

SEQ ID NO: 2721222 - DNA, 12 bp, Homo sapiens
cgctctggacat

SEQ ID NO: 2721223 - DNA, 13 bp, Homo sapiens
cgctgatgctggg

SEQ ID NO: 2721224 - DNA, 23 bp, Homo sapiens
cgctggatggggagtctcatgca

SEQ ID NO: 2721225 - DNA, 20 bp, Homo sapiens
cgctggggaagggggctcca

SEQ ID NO: 2721226 - DNA, 23 bp, Homo sapiens
cgctggggaagggggctccatgc

SEQ ID NO: 2721227 - DNA, 15 bp, Homo sapiens
cgctgtgagtgagtg

SEQ ID NO: 2721228 - DNA, 14 bp, Homo sapiens
cgcttagaaacatg

SEQ ID NO: 2721229 - DNA, 20 bp, Homo sapiens
ctggccagccccacagccca

SEQ ID NO: 2721230 - DNA, 10 bp, Homo sapiens
ctggccaggg

SEQ ID NO: 2721231 - DNA, 18 bp, Homo sapiens
ctggccagggcctctgtg

SEQ ID NO: 2721232 - DNA, 17 bp, Homo sapiens
ctggccagtcctagagc

SEQ ID NO: 2721233 - DNA, 18 bp, Homo sapiens
ctggccagtcctagagct

SEQ ID NO: 2721234 - DNA, 12 bp, Homo sapiens
ctggcccagctc

SEQ ID NO: 2721235 - DNA, 17 bp, Homo sapiens
ctggccctcaaggcctc

SEQ ID NO: 2721236 - DNA, 22 bp, Homo sapiens
ctggccctcaaggcctcccaca

SEQ ID NO: 2721237 - DNA, 23 bp, Homo sapiens
ctggccctcaaggcctcccacag

SEQ ID NO: 2721238 - DNA, 19 bp, Homo sapiens
ctggccgtggctccagaat

SEQ ID NO: 2721239 - DNA, 18 bp, Homo sapiens
ctggcctcgcctggcctg

SEQ ID NO: 2721240 - DNA, 15 bp, Homo sapiens
ctggcctctagaaca

SEQ ID NO: 2721241 - DNA, 22 bp, Homo sapiens
ctggcctctagaacacccactg

SEQ ID NO: 2721242 - DNA, 14 bp, Homo sapiens
ctggcctcttggca

SEQ ID NO: 2721243 - DNA, 15 bp, Homo sapiens
ctggcctcttggcac

SEQ ID NO: 2721244 - DNA, 14 bp, Homo sapiens
ctggcctgctctta

SEQ ID NO: 2721245 - DNA, 12 bp, Homo sapiens
ctggctcagctg

SEQ ID NO: 2721246 - DNA, 17 bp, Homo sapiens
ctggctcagctgtggtc

SEQ ID NO: 2721247 - DNA, 18 bp, Homo sapiens
ctggctcagctgtggtcc

SEQ ID NO: 2721248 - DNA, 19 bp, Homo sapiens
ctggctgaacagtgctctg

SEQ ID NO: 2721249 - DNA, 21 bp, Homo sapiens
ctggctgaacagtgctctgcc

SEQ ID NO: 2721250 - DNA, 16 bp, Homo sapiens
ctggctgcctccactc

SEQ ID NO: 2721251 - DNA, 20 bp, Homo sapiens
ctggctgcctccactcccac

SEQ ID NO: 2721252 - DNA, 19 bp, Homo sapiens
ctggctgctggcccacagc

SEQ ID NO: 2721253 - DNA, 21 bp, Homo sapiens
ctggctggggcctatcagtgt

SEQ ID NO: 2721254 - DNA, 24 bp, Homo sapiens
ctggctggggcctatcagtgtgcc

SEQ ID NO: 2721255 - DNA, 16 bp, Homo sapiens
ctggctgtgtcctctc

SEQ ID NO: 2721256 - DNA, 15 bp, Homo sapiens
ctggcttctggagcc

SEQ ID NO: 2721257 - DNA, 13 bp, Homo sapiens
ctgggactggcca

SEQ ID NO: 2721258 - DNA, 14 bp, Homo sapiens
ctgggactggccag

SEQ ID NO: 2721259 - DNA, 17 bp, Homo sapiens
ctgggagaacctcaggc

SEQ ID NO: 2721260 - DNA, 14 bp, Homo sapiens
ctgggaggaagcag

SEQ ID NO: 2721261 - DNA, 17 bp, Homo sapiens
ctgggcaatgcagtgca

SEQ ID NO: 2721262 - DNA, 22 bp, Homo sapiens
ctgggcaggaaaccccagcggc

SEQ ID NO: 2721263 - DNA, 18 bp, Homo sapiens
ctgggccatgggtcctcg

SEQ ID NO: 2721264 - DNA, 14 bp, Homo sapiens
ctgggcccccagag

SEQ ID NO: 2721265 - DNA, 14 bp, Homo sapiens
ctgggcccctcagg

SEQ ID NO: 2721266 - DNA, 19 bp, Homo sapiens
ctgggcctcagcctccagg

SEQ ID NO: 2721267 - DNA, 15 bp, Homo sapiens
ctgggcgacagagca

SEQ ID NO: 2721268 - DNA, 18 bp, Homo sapiens
ctgggctacaaaccagga

SEQ ID NO: 2721269 - DNA, 14 bp, Homo sapiens
ctgggctctgagga

SEQ ID NO: 2721270 - DNA, 17 bp, Homo sapiens
ctgggctctgccccagc

SEQ ID NO: 2721271 - DNA, 23 bp, Homo sapiens
ctgggctctgccccagctctggc

SEQ ID NO: 2721272 - DNA, 22 bp, Homo sapiens
ctgggctctgtgggctgcactc

SEQ ID NO: 2721273 - DNA, 18 bp, Homo sapiens
ctgggctggggcctgatg

SEQ ID NO: 2721274 - DNA, 22 bp, Homo sapiens
ctgggctgggtgcgaccccatc

SEQ ID NO: 2721275 - DNA, 14 bp, Homo sapiens
ctggggcaagtccc

SEQ ID NO: 2721276 - DNA, 21 bp, Homo sapiens
ctggggcctatcagtgtgccc

SEQ ID NO: 2721277 - DNA, 22 bp, Homo sapiens
ctggggcctatcagtgtgcccc

SEQ ID NO: 2721278 - DNA, 11 bp, Homo sapiens
ctggggctggt

SEQ ID NO: 2721279 - DNA, 12 bp, Homo sapiens
ctggggctggtg

SEQ ID NO: 2721280 - DNA, 23 bp, Homo sapiens
ctgggggagggactgctgaccca

SEQ ID NO: 2721281 - DNA, 16 bp, Homo sapiens
ctgggggcgggggagc

SEQ ID NO: 2721282 - DNA, 18 bp, Homo sapiens
ctgggggctccccttgcc

SEQ ID NO: 2721283 - DNA, 23 bp, Homo sapiens
ctggggtttgggggcttccctgg

SEQ ID NO: 2721284 - DNA, 14 bp, Homo sapiens
ctgggtccagggga

SEQ ID NO: 2721285 - DNA, 12 bp, Homo sapiens
ctgggtggccca

SEQ ID NO: 2721286 - DNA, 13 bp, Homo sapiens
ctgggtggcccat

SEQ ID NO: 2721287 - DNA, 14 bp, Homo sapiens
ctgggtggcccatc

SEQ ID NO: 2721288 - DNA, 21 bp, Homo sapiens
ctgggtggcccatcccccctc

SEQ ID NO: 2721289 - DNA, 22 bp, Homo sapiens
ctgggttggcgcaccctcccct

SEQ ID NO: 2721290 - DNA, 17 bp, Homo sapiens
ctgggttgtcactgaga

SEQ ID NO: 2721291 - DNA, 16 bp, Homo sapiens
ctgggtttaagcaatg

SEQ ID NO: 2721292 - DNA, 23 bp, Homo sapiens
ctgggtttacaacaaacactgtg

SEQ ID NO: 2721293 - DNA, 16 bp, Homo sapiens
ctgggtttggcccctg

SEQ ID NO: 2721294 - DNA, 17 bp, Homo sapiens
ctggtaatttgtatctg

SEQ ID NO: 2721295 - DNA, 21 bp, Homo sapiens
ctggtaatttgtatctgaagg

SEQ ID NO: 2721296 - DNA, 22 bp, Homo sapiens
ctggtaatttgtatctgaagga

SEQ ID NO: 2721297 - DNA, 14 bp, Homo sapiens
ctggtacagcaggg

SEQ ID NO: 2721298 - DNA, 17 bp, Homo sapiens
ctggtacagcagggtct

SEQ ID NO: 2721299 - DNA, 22 bp, Homo sapiens
ctggtacagcagggtcttgctg

SEQ ID NO: 2721300 - DNA, 13 bp, Homo sapiens
ctggtaggaaagc

SEQ ID NO: 2721301 - DNA, 18 bp, Homo sapiens
ctggtctcgaactcctga

SEQ ID NO: 2721302 - DNA, 19 bp, Homo sapiens
ctggtctcgaactcctgac

SEQ ID NO: 2721303 - DNA, 22 bp, Homo sapiens
ctggtctcgaactcctgacctc

SEQ ID NO: 2721304 - DNA, 18 bp, Homo sapiens
ctggtgaggcccagcctg

SEQ ID NO: 2721305 - DNA, 23 bp, Homo sapiens
ctggtgaggccggccctgcccct

SEQ ID NO: 2721306 - DNA, 16 bp, Homo sapiens
ctggtggatggtgact

SEQ ID NO: 2721307 - DNA, 19 bp, Homo sapiens
ctgtaagcagattacaata

SEQ ID NO: 2721308 - DNA, 13 bp, Homo sapiens
ctgtacttcccaa

SEQ ID NO: 2721309 - DNA, 18 bp, Homo sapiens
ctgtagctggagaagccc

SEQ ID NO: 2721310 - DNA, 14 bp, Homo sapiens
ctgtatacaaacag

SEQ ID NO: 2721311 - DNA, 17 bp, Homo sapiens
ctgtatacaaacaggtg

SEQ ID NO: 2721312 - DNA, 19 bp, Homo sapiens
ctgtatacaaacaggtgct

SEQ ID NO: 2721313 - DNA, 20 bp, Homo sapiens
ctgtatacaaacaggtgcta

SEQ ID NO: 2721314 - DNA, 17 bp, Homo sapiens
ctgtatataacttattt

SEQ ID NO: 2721315 - DNA, 15 bp, Homo sapiens
ctgtatgtataaatt

SEQ ID NO: 2721316 - DNA, 19 bp, Homo sapiens
ctgtatgtgacaacatttt

SEQ ID NO: 2721317 - DNA, 21 bp, Homo sapiens
ctgtcaccctggccaccaccc

SEQ ID NO: 2721318 - DNA, 17 bp, Homo sapiens
ctgtcagtgccgccgcc

SEQ ID NO: 2721319 - DNA, 17 bp, Homo sapiens
ctgtccagccagctcct

SEQ ID NO: 2721320 - DNA, 18 bp, Homo sapiens
ctgtccagtgcccattcc

SEQ ID NO: 2721321 - DNA, 13 bp, Homo sapiens
ctgtccataaagt

SEQ ID NO: 2721322 - DNA, 15 bp, Homo sapiens
ctgtccatcctcctc

SEQ ID NO: 2721323 - DNA, 22 bp, Homo sapiens
ctgtcccaggagcaaatgctgg

SEQ ID NO: 2721324 - DNA, 15 bp, Homo sapiens
ctgtcccctcacaga

SEQ ID NO: 2721325 - DNA, 18 bp, Homo sapiens
ctgtcccctcacagactc

SEQ ID NO: 2721326 - DNA, 22 bp, Homo sapiens
ctgtcccctcacagactcttcc

SEQ ID NO: 2721327 - DNA, 16 bp, Homo sapiens
ctgtcccctcttgccc

SEQ ID NO: 2721328 - DNA, 17 bp, Homo sapiens
ctgtcccctcttgcccc

SEQ ID NO: 2721329 - DNA, 19 bp, Homo sapiens
ctgtcccctcttgccccaa

SEQ ID NO: 2721330 - DNA, 23 bp, Homo sapiens
ggagggagctgaggcctcccttg

SEQ ID NO: 2721331 - DNA, 21 bp, Homo sapiens
ggagggatgctgcctgagtca

SEQ ID NO: 2721332 - DNA, 13 bp, Homo sapiens
ggaggggcccgct

SEQ ID NO: 2721333 - DNA, 15 bp, Homo sapiens
ggagggtagccctgg

SEQ ID NO: 2721334 - DNA, 19 bp, Homo sapiens
ggagggtgggagagcccag

SEQ ID NO: 2721335 - DNA, 21 bp, Homo sapiens
ggagtacattcatctggaggc

SEQ ID NO: 2721336 - DNA, 13 bp, Homo sapiens
ggagtcttcactg

SEQ ID NO: 2721337 - DNA, 19 bp, Homo sapiens
ggagtcttcactgctctgc

SEQ ID NO: 2721338 - DNA, 16 bp, Homo sapiens
ggagtgtcctgtctgc

SEQ ID NO: 2721339 - DNA, 20 bp, Homo sapiens
ggagttcaagaccagcctgg

SEQ ID NO: 2721340 - DNA, 15 bp, Homo sapiens
ggataaattacatta

SEQ ID NO: 2721341 - DNA, 16 bp, Homo sapiens
ggatatttttaattta

SEQ ID NO: 2721342 - DNA, 11 bp, Homo sapiens
ggatcagcctc

SEQ ID NO: 2721343 - DNA, 20 bp, Homo sapiens
ggatcccctgtcccctgggg

SEQ ID NO: 2721344 - DNA, 21 bp, Homo sapiens
ggatcccctgtcccctggggc

SEQ ID NO: 2721345 - DNA, 22 bp, Homo sapiens
ggatcccctgtcccctggggct

SEQ ID NO: 2721346 - DNA, 15 bp, Homo sapiens
ggatgaaaagccata

SEQ ID NO: 2721347 - DNA, 14 bp, Homo sapiens
ggatgatgccacac

SEQ ID NO: 2721348 - DNA, 14 bp, Homo sapiens
ggatgctgcctgag

SEQ ID NO: 2721349 - DNA, 18 bp, Homo sapiens
ggatgggctttctcagtg

SEQ ID NO: 2721350 - DNA, 16 bp, Homo sapiens
ggatggtcctggggct

SEQ ID NO: 2721351 - DNA, 22 bp, Homo sapiens
ggatggtcctggggctctgtgc

SEQ ID NO: 2721352 - DNA, 13 bp, Homo sapiens
ggatggtgacttt

SEQ ID NO: 2721353 - DNA, 15 bp, Homo sapiens
ggatggtgacttttg

SEQ ID NO: 2721354 - DNA, 23 bp, Homo sapiens
ggatggtgacttttgaagaacaa

SEQ ID NO: 2721355 - DNA, 16 bp, Homo sapiens
ggattccaaagcattt

SEQ ID NO: 2721356 - DNA, 16 bp, Homo sapiens
ggattcccctggacat

SEQ ID NO: 2721357 - DNA, 14 bp, Homo sapiens
ggattggccctgcc

SEQ ID NO: 2721358 - DNA, 15 bp, Homo sapiens
ggattggccctgccc

SEQ ID NO: 2721359 - DNA, 19 bp, Homo sapiens
ggattggccctgcccctcc

SEQ ID NO: 2721360 - DNA, 21 bp, Homo sapiens
ggattggccctgcccctcccc

SEQ ID NO: 2721361 - DNA, 22 bp, Homo sapiens
ggattggccctgcccctccccc

SEQ ID NO: 2721362 - DNA, 23 bp, Homo sapiens
ggatttcaccgtattagccagga

SEQ ID NO: 2721363 - DNA, 14 bp, Homo sapiens
ggattttaccaaag

SEQ ID NO: 2721364 - DNA, 12 bp, Homo sapiens
ggattttgagta

SEQ ID NO: 2721365 - DNA, 23 bp, Homo sapiens
ggcaaaagtctgaggcacctgca

SEQ ID NO: 2721366 - DNA, 18 bp, Homo sapiens
ggcaaagaactgccccat

SEQ ID NO: 2721367 - DNA, 20 bp, Homo sapiens
gctgccactctgctgcctgt

SEQ ID NO: 2721368 - DNA, 23 bp, Homo sapiens
gctgccatggcgtgtccctctcg

SEQ ID NO: 2721369 - DNA, 13 bp, Homo sapiens
gctgcccgctccc

SEQ ID NO: 2721370 - DNA, 19 bp, Homo sapiens
gctgcccggcgccctctgt

SEQ ID NO: 2721371 - DNA, 20 bp, Homo sapiens
gctgccgggtggggggaggg

SEQ ID NO: 2721372 - DNA, 17 bp, Homo sapiens
gctgcctccactcccac

SEQ ID NO: 2721373 - DNA, 12 bp, Homo sapiens
gctgcctcccca

SEQ ID NO: 2721374 - DNA, 17 bp, Homo sapiens
gctgcctccccaatcca

SEQ ID NO: 2721375 - DNA, 18 bp, Homo sapiens
gctgcctctcttctgtgt

SEQ ID NO: 2721376 - DNA, 16 bp, Homo sapiens
gctgcgggctgagggc

SEQ ID NO: 2721377 - DNA, 19 bp, Homo sapiens
gctgctaggggaaggactg

SEQ ID NO: 2721378 - DNA, 12 bp, Homo sapiens
gctgctgccact

SEQ ID NO: 2721379 - DNA, 18 bp, Homo sapiens
gctgctgccactctgctg

SEQ ID NO: 2721380 - DNA, 16 bp, Homo sapiens
gctgctggcccacagc

SEQ ID NO: 2721381 - DNA, 19 bp, Homo sapiens
gctgctggcccacagctct

SEQ ID NO: 2721382 - DNA, 11 bp, Homo sapiens
gctgctggggg

SEQ ID NO: 2721383 - DNA, 12 bp, Homo sapiens
gctgctgggggc

SEQ ID NO: 2721384 - DNA, 19 bp, Homo sapiens
gctgctttccaacacacaa

SEQ ID NO: 2721385 - DNA, 17 bp, Homo sapiens
gctggaagaactgcatg

SEQ ID NO: 2721386 - DNA, 15 bp, Homo sapiens
gctggaaggagccag

SEQ ID NO: 2721387 - DNA, 14 bp, Homo sapiens
gctggacaacccag

SEQ ID NO: 2721388 - DNA, 15 bp, Homo sapiens
gctggacaacccaga

SEQ ID NO: 2721389 - DNA, 16 bp, Homo sapiens
gctggactctggcacc

SEQ ID NO: 2721390 - DNA, 12 bp, Homo sapiens
gctggaggaaca

SEQ ID NO: 2721391 - DNA, 14 bp, Homo sapiens
gctggatgagcaac

SEQ ID NO: 2721392 - DNA, 13 bp, Homo sapiens
gctggcagggcct

SEQ ID NO: 2721393 - DNA, 14 bp, Homo sapiens
gctggcagggcctg

SEQ ID NO: 2721394 - DNA, 20 bp, Homo sapiens
gctggcatcctggctggctg

SEQ ID NO: 2721395 - DNA, 16 bp, Homo sapiens
gctggccagccccaca

SEQ ID NO: 2721396 - DNA, 14 bp, Homo sapiens
gctggcctcttggc

SEQ ID NO: 2721397 - DNA, 19 bp, Homo sapiens
gctggcctcttggcacctg

SEQ ID NO: 2721398 - DNA, 20 bp, Homo sapiens
gctggcctcttggcacctgc

SEQ ID NO: 2721399 - DNA, 17 bp, Homo sapiens
gctggcctgctcttact

SEQ ID NO: 2721400 - DNA, 17 bp, Homo sapiens
gctggcggcgcagaggg

SEQ ID NO: 2721401 - DNA, 13 bp, Homo sapiens
gctggctctccac

SEQ ID NO: 2721402 - DNA, 17 bp, Homo sapiens
gctggctgtgtcctctc

SEQ ID NO: 2721403 - DNA, 21 bp, Homo sapiens
gctggctgtgtcctctccagc

SEQ ID NO: 2721404 - DNA, 15 bp, Homo sapiens
gctgggactggccag

SEQ ID NO: 2721405 - DNA, 16 bp, Homo sapiens
gctgggactggccagg

SEQ ID NO: 2721406 - DNA, 22 bp, Homo sapiens
gctgggctacaaaccaggagca

SEQ ID NO: 2721407 - DNA, 14 bp, Homo sapiens
gctgggctggggcc

SEQ ID NO: 2721408 - DNA, 24 bp, Homo sapiens
gctggggaagggggctccatgctg

SEQ ID NO: 2721409 - DNA, 20 bp, Homo sapiens
gctggggcctatcagtgtgc

SEQ ID NO: 2721410 - DNA, 15 bp, Homo sapiens
gctggggcctgatgg

SEQ ID NO: 2721411 - DNA, 23 bp, Homo sapiens
gctgggggctccccttgcccttc

SEQ ID NO: 2721412 - DNA, 18 bp, Homo sapiens
gctgggtgcgaccccatc

SEQ ID NO: 2721413 - DNA, 22 bp, Homo sapiens
gctgggtgcgaccccatctgcc

SEQ ID NO: 2721414 - DNA, 13 bp, Homo sapiens
gctgggtggccca

SEQ ID NO: 2721415 - DNA, 21 bp, Homo sapiens
gctgggtggcccatcccccct

SEQ ID NO: 2721416 - DNA, 18 bp, Homo sapiens
gctgggttgtcactgaga

SEQ ID NO: 2721417 - DNA, 23 bp, Homo sapiens
gctggtaatttgtatctgaagga

SEQ ID NO: 2721418 - DNA, 20 bp, Homo sapiens
gctggtctcgaactcctgac

SEQ ID NO: 2721419 - DNA, 20 bp, Homo sapiens
gctggtgaggccggccctgc

SEQ ID NO: 2721420 - DNA, 16 bp, Homo sapiens
gctggtggatggtgac

SEQ ID NO: 2721421 - DNA, 20 bp, Homo sapiens
gctggtggattgggcagaat

SEQ ID NO: 2721422 - DNA, 13 bp, Homo sapiens
gctggtgtggcca

SEQ ID NO: 2721423 - DNA, 23 bp, Homo sapiens
gctgtaactcagacattccaagg

SEQ ID NO: 2721424 - DNA, 13 bp, Homo sapiens
gctgtaagcattc

SEQ ID NO: 2721425 - DNA, 15 bp, Homo sapiens
gctgtagaactctgc

SEQ ID NO: 2721426 - DNA, 18 bp, Homo sapiens
gctgtatacaaacaggtg

SEQ ID NO: 2721427 - DNA, 16 bp, Homo sapiens
gctgtccagtgcccat

SEQ ID NO: 2721428 - DNA, 17 bp, Homo sapiens
gctgtcccctcttgccc

SEQ ID NO: 2721429 - DNA, 20 bp, Homo sapiens
gctgtcccctcttgccccaa

SEQ ID NO: 2721430 - DNA, 23 bp, Homo sapiens
gctgtcccctcttgccccaaccc

SEQ ID NO: 2721431 - DNA, 16 bp, Homo sapiens
gctgtcctaggccaca

SEQ ID NO: 2721432 - DNA, 18 bp, Homo sapiens
gctgtgattggcaggagg

SEQ ID NO: 2721433 - DNA, 13 bp, Homo sapiens
gctgtgccaccct

SEQ ID NO: 2721434 - DNA, 19 bp, Homo sapiens
gctgtgccaccctgggctc

SEQ ID NO: 2721435 - DNA, 21 bp, Homo sapiens
gctgtgccaccctgggctctg

SEQ ID NO: 2721436 - DNA, 18 bp, Homo sapiens
gctgtggcatcaggaaag

SEQ ID NO: 2721437 - DNA, 15 bp, Homo sapiens
gctgtggcctgggca

SEQ ID NO: 2721438 - DNA, 13 bp, Homo sapiens
gctgtgtctctgt

SEQ ID NO: 2721439 - DNA, 14 bp, Homo sapiens
gctgttacctgaga

SEQ ID NO: 2721440 - DNA, 14 bp, Homo sapiens
gctgttgctgttgc

SEQ ID NO: 2721441 - DNA, 21 bp, Homo sapiens
gctgttggcatcttgctgcta

SEQ ID NO: 2721442 - DNA, 17 bp, Homo sapiens
gcttatcaataaacctg

SEQ ID NO: 2721443 - DNA, 20 bp, Homo sapiens
gcttatttagcacattttga

SEQ ID NO: 2721444 - DNA, 19 bp, Homo sapiens
gcttcaggggactgttctc

SEQ ID NO: 2721445 - DNA, 13 bp, Homo sapiens
gcttcatatctaa

SEQ ID NO: 2721446 - DNA, 18 bp, Homo sapiens
gcttccaaggtggtctgc

SEQ ID NO: 2721447 - DNA, 13 bp, Homo sapiens
gcttccagcttcc

SEQ ID NO: 2721448 - DNA, 13 bp, Homo sapiens
gcaaggaggctgg

SEQ ID NO: 2721449 - DNA, 15 bp, Homo sapiens
gcaaggaggctggct

SEQ ID NO: 2721450 - DNA, 12 bp, Homo sapiens
gcaaggccaggg

SEQ ID NO: 2721451 - DNA, 13 bp, Homo sapiens
gcaaggccagggc

SEQ ID NO: 2721452 - DNA, 21 bp, Homo sapiens
gcaaggccagggcacagctgg

SEQ ID NO: 2721453 - DNA, 14 bp, Homo sapiens
gcaagggtgacatc

SEQ ID NO: 2721454 - DNA, 14 bp, Homo sapiens
gcaagggtgctgtg

SEQ ID NO: 2721455 - DNA, 22 bp, Homo sapiens
gcaagtccctgactctctgtga

SEQ ID NO: 2721456 - DNA, 20 bp, Homo sapiens
gcaagtgctgtttgggcagg

SEQ ID NO: 2721457 - DNA, 21 bp, Homo sapiens
gcaatagttttttacttctct

SEQ ID NO: 2721458 - DNA, 20 bp, Homo sapiens
gcaatgccctacctgcctgt

SEQ ID NO: 2721459 - DNA, 14 bp, Homo sapiens
gcaatgtcctgcat

SEQ ID NO: 2721460 - DNA, 13 bp, Homo sapiens
gcaattaactctg

SEQ ID NO: 2721461 - DNA, 19 bp, Homo sapiens
gcaatttatatctttatgc

SEQ ID NO: 2721462 - DNA, 19 bp, Homo sapiens
gcaattttaattgattatt

SEQ ID NO: 2721463 - DNA, 22 bp, Homo sapiens
gcacaagctcaggtcctgctgc

SEQ ID NO: 2721464 - DNA, 13 bp, Homo sapiens
gcacagagggcgc

SEQ ID NO: 2721465 - DNA, 18 bp, Homo sapiens
gcacagagggcgctcctg

SEQ ID NO: 2721466 - DNA, 17 bp, Homo sapiens
gcacagcaaggaggctg

SEQ ID NO: 2721467 - DNA, 16 bp, Homo sapiens
gcacagccctcccgcc

SEQ ID NO: 2721468 - DNA, 18 bp, Homo sapiens
gcacagccctcccgcccc

SEQ ID NO: 2721469 - DNA, 19 bp, Homo sapiens
gcacagccctcccgcccct

SEQ ID NO: 2721470 - DNA, 14 bp, Homo sapiens
gcacagctcctccc

SEQ ID NO: 2721471 - DNA, 19 bp, Homo sapiens
gcacagctcctcccctgcc

SEQ ID NO: 2721472 - DNA, 16 bp, Homo sapiens
gcacagcttcctgagt

SEQ ID NO: 2721473 - DNA, 15 bp, Homo sapiens
gcacagtaatatgaa

SEQ ID NO: 2721474 - DNA, 17 bp, Homo sapiens
gcacagtgtctgggctg

SEQ ID NO: 2721475 - DNA, 19 bp, Homo sapiens
gcacagtgtctgggctgac

SEQ ID NO: 2721476 - DNA, 21 bp, Homo sapiens
gcacagtgtctgggctgactg

SEQ ID NO: 2721477 - DNA, 18 bp, Homo sapiens
gcacagttggcccgggtg

SEQ ID NO: 2721478 - DNA, 10 bp, Homo sapiens
gcacataaaa

SEQ ID NO: 2721479 - DNA, 21 bp, Homo sapiens
gcacatggctgggggagggac

SEQ ID NO: 2721480 - DNA, 19 bp, Homo sapiens
gcacattggaagctcccac

SEQ ID NO: 2721481 - DNA, 12 bp, Homo sapiens
gcaccaaagaca

SEQ ID NO: 2721482 - DNA, 22 bp, Homo sapiens
gcaccaaagacatcagtctcca

SEQ ID NO: 2721483 - DNA, 17 bp, Homo sapiens
gcaccaacccagccgct

SEQ ID NO: 2721484 - DNA, 23 bp, Homo sapiens
gcaccagatgggatgggctttct

SEQ ID NO: 2721485 - DNA, 22 bp, Homo sapiens
gcaccagtgcctcagtgctgca

SEQ ID NO: 2721486 - DNA, 20 bp, Homo sapiens
gcacccccaggattcccaga

SEQ ID NO: 2721487 - DNA, 12 bp, Homo sapiens
gcaccccctcct

SEQ ID NO: 2721488 - DNA, 18 bp, Homo sapiens
gcaccccctcctgctgca

SEQ ID NO: 2721489 - DNA, 16 bp, Homo sapiens
gcacccgggctcaggg

SEQ ID NO: 2721490 - DNA, 21 bp, Homo sapiens
gcaccctcattccctcgggac

SEQ ID NO: 2721491 - DNA, 15 bp, Homo sapiens
gcaccctcccctccc

SEQ ID NO: 2721492 - DNA, 17 bp, Homo sapiens
gcacctatagtcccagc

SEQ ID NO: 2721493 - DNA, 18 bp, Homo sapiens
gcacctatagtcccagct

SEQ ID NO: 2721494 - DNA, 18 bp, Homo sapiens
gcacctatggcccagcca

SEQ ID NO: 2721495 - DNA, 22 bp, Homo sapiens
gcacctatggcccagccactgc

SEQ ID NO: 2721496 - DNA, 20 bp, Homo sapiens
gcacctgcaggttgggccat

SEQ ID NO: 2721497 - DNA, 13 bp, Homo sapiens
gcacctgccagcc

SEQ ID NO: 2721498 - DNA, 15 bp, Homo sapiens
gcacctgccccctgg

SEQ ID NO: 2721499 - DNA, 17 bp, Homo sapiens
gcacctgccccctggtg

SEQ ID NO: 2721500 - DNA, 15 bp, Homo sapiens
gcacctgcctagctc

SEQ ID NO: 2721501 - DNA, 16 bp, Homo sapiens
gcacctgcctagctct

SEQ ID NO: 2721502 - DNA, 21 bp, Homo sapiens
gcacctgcctagctcttgggc

SEQ ID NO: 2721503 - DNA, 18 bp, Homo sapiens
  misc_feature (9)..(9): n is a, c, g or t
gcacctgcnttgtccctg

SEQ ID NO: 2721504 - DNA, 12 bp, Homo sapiens
gcacctgctgga

SEQ ID NO: 2721505 - DNA, 17 bp, Homo sapiens
gcacgatctcagctcac

SEQ ID NO: 2721506 - DNA, 16 bp, Homo sapiens
gcacgccgtggagcat

SEQ ID NO: 2721507 - DNA, 15 bp, Homo sapiens
gcacgtcaccctcct

SEQ ID NO: 2721508 - DNA, 14 bp, Homo sapiens
gcacgtcccatgtg

SEQ ID NO: 2721509 - DNA, 23 bp, Homo sapiens
gcactaaaacccatcttccccgg

SEQ ID NO: 2721510 - DNA, 14 bp, Homo sapiens
gcactaaaatgttt

SEQ ID NO: 2721511 - DNA, 15 bp, Homo sapiens
gcactccagcctggg

SEQ ID NO: 2721512 - DNA, 18 bp, Homo sapiens
gcactccagcctgggcga

SEQ ID NO: 2721513 - DNA, 12 bp, Homo sapiens
gcactcccccag

SEQ ID NO: 2721514 - DNA, 12 bp, Homo sapiens
gcactctgtgcc

SEQ ID NO: 2721515 - DNA, 21 bp, Homo sapiens
gccaatgaagcaaacacacag

SEQ ID NO: 2721516 - DNA, 13 bp, Homo sapiens
gccacaccaagct

SEQ ID NO: 2721517 - DNA, 15 bp, Homo sapiens
gccacaccaagctgt

SEQ ID NO: 2721518 - DNA, 22 bp, Homo sapiens
gccacaccaagctgtgccaccc

SEQ ID NO: 2721519 - DNA, 23 bp, Homo sapiens
gccacaccaagctgtgccaccct

SEQ ID NO: 2721520 - DNA, 13 bp, Homo sapiens
gccacagccagcc

SEQ ID NO: 2721521 - DNA, 11 bp, Homo sapiens
gccacattttg

SEQ ID NO: 2721522 - DNA, 20 bp, Homo sapiens
gccaccagcttccctctgcc

SEQ ID NO: 2721523 - DNA, 23 bp, Homo sapiens
gccaccagcttccctctgcctga

SEQ ID NO: 2721524 - DNA, 14 bp, Homo sapiens
gccaccctgggctc

SEQ ID NO: 2721525 - DNA, 18 bp, Homo sapiens
gccaccctgggctctgtg

SEQ ID NO: 2721526 - DNA, 16 bp, Homo sapiens
gccaccgcagctgctg

SEQ ID NO: 2721527 - DNA, 14 bp, Homo sapiens
gccacctgtcttct

SEQ ID NO: 2721528 - DNA, 18 bp, Homo sapiens
gccacgtctgtgctctgt

SEQ ID NO: 2721529 - DNA, 17 bp, Homo sapiens
gccactacactccagcc

SEQ ID NO: 2721530 - DNA, 20 bp, Homo sapiens
gccactacactccagcctga

SEQ ID NO: 2721531 - DNA, 21 bp, Homo sapiens
gccactacactccagcctgag

SEQ ID NO: 2721532 - DNA, 22 bp, Homo sapiens
gccactacctttgtccaggcct

SEQ ID NO: 2721533 - DNA, 16 bp, Homo sapiens
gccactctgctgcctg

SEQ ID NO: 2721534 - DNA, 15 bp, Homo sapiens
gccactgaagctggg

SEQ ID NO: 2721535 - DNA, 18 bp, Homo sapiens
gccactgcactccagcct

SEQ ID NO: 2721536 - DNA, 22 bp, Homo sapiens
gccactgcactccagcctgggc

SEQ ID NO: 2721537 - DNA, 16 bp, Homo sapiens
gccacttatttccatg

SEQ ID NO: 2721538 - DNA, 21 bp, Homo sapiens
gccactttggtacatggccag

SEQ ID NO: 2721539 - DNA, 22 bp, Homo sapiens
gccactttggtacatggccagt

SEQ ID NO: 2721540 - DNA, 23 bp, Homo sapiens
gccactttggtacatggccagtg

SEQ ID NO: 2721541 - DNA, 18 bp, Homo sapiens
gccagatgtgggctcaga

SEQ ID NO: 2721542 - DNA, 22 bp, Homo sapiens
gccagatgtgggctcagatcct

SEQ ID NO: 2721543 - DNA, 12 bp, Homo sapiens
gccagcaccaag

SEQ ID NO: 2721544 - DNA, 13 bp, Homo sapiens
gccagcaggcagc

SEQ ID NO: 2721545 - DNA, 15 bp, Homo sapiens
gccagcaggcagcgc

SEQ ID NO: 2721546 - DNA, 18 bp, Homo sapiens
gccagcaggcagcgcctg

SEQ ID NO: 2721547 - DNA, 21 bp, Homo sapiens
gccagcattttcacattttgc

SEQ ID NO: 2721548 - DNA, 17 bp, Homo sapiens
gccagccaggactcctt

SEQ ID NO: 2721549 - DNA, 16 bp, Homo sapiens
gccagccccacagccc

SEQ ID NO: 2721550 - DNA, 18 bp, Homo sapiens
gccagccccacagcccac

SEQ ID NO: 2721551 - DNA, 19 bp, Homo sapiens
gccagccccacagcccacg

SEQ ID NO: 2721552 - DNA, 18 bp, Homo sapiens
gccagccctggaggctgg

SEQ ID NO: 2721553 - DNA, 23 bp, Homo sapiens
gccagccctggaggctggatggc

SEQ ID NO: 2721554 - DNA, 16 bp, Homo sapiens
gccagcctggcttctg

SEQ ID NO: 2721555 - DNA, 20 bp, Homo sapiens
gccagcctgtcgtgtccagc

SEQ ID NO: 2721556 - DNA, 13 bp, Homo sapiens
gccagctcctggt

SEQ ID NO: 2721557 - DNA, 13 bp, Homo sapiens
gccagctctgtca

SEQ ID NO: 2721558 - DNA, 14 bp, Homo sapiens
gccagctctgtcac

SEQ ID NO: 2721559 - DNA, 15 bp, Homo sapiens
gccagctctgtcacc

SEQ ID NO: 2721560 - DNA, 16 bp, Homo sapiens
gccagctctgtcaccc

SEQ ID NO: 2721561 - DNA, 24 bp, Homo sapiens
gccaggattggcacaagctccctg

SEQ ID NO: 2721562 - DNA, 15 bp, Homo sapiens
gccaggctgtaagca

SEQ ID NO: 2721563 - DNA, 16 bp, Homo sapiens
gccagggcacagctgg

SEQ ID NO: 2721564 - DNA, 13 bp, Homo sapiens
gccagggccctgc

SEQ ID NO: 2721565 - DNA, 19 bp, Homo sapiens
gccagggccctgcagaggg

SEQ ID NO: 2721566 - DNA, 15 bp, Homo sapiens
gccagggcctctgtg

SEQ ID NO: 2721567 - DNA, 17 bp, Homo sapiens
gccagggcttgtggact

SEQ ID NO: 2721568 - DNA, 18 bp, Homo sapiens
gccaggtgggcgggcagc

SEQ ID NO: 2721569 - DNA, 22 bp, Homo sapiens
gccaggtttctgcccacattgg

SEQ ID NO: 2721570 - DNA, 23 bp, Homo sapiens
gccagtacagagaaattctgtgg

SEQ ID NO: 2721571 - DNA, 14 bp, Homo sapiens
gccagtatttttta

SEQ ID NO: 2721572 - DNA, 13 bp, Homo sapiens
gccagtcctagag

SEQ ID NO: 2721573 - DNA, 14 bp, Homo sapiens
gccagtcctagagc

SEQ ID NO: 2721574 - DNA, 24 bp, Homo sapiens
gccagtcctagagctcctgtccct

SEQ ID NO: 2721575 - DNA, 19 bp, Homo sapiens
gccagtcgcgctgcctgtg

SEQ ID NO: 2721576 - DNA, 13 bp, Homo sapiens
gccagtcttgtgt

SEQ ID NO: 2721577 - DNA, 13 bp, Homo sapiens
gccatggagttgt

SEQ ID NO: 2721578 - DNA, 15 bp, Homo sapiens
gccatgggcctgctg

SEQ ID NO: 2721579 - DNA, 21 bp, Homo sapiens
gccatgtgcacctatggccca

SEQ ID NO: 2721580 - DNA, 22 bp, Homo sapiens
gccattccaagtcaacactctt

SEQ ID NO: 2721581 - DNA, 21 bp, Homo sapiens
ctgtgatgttgggaagctatt

SEQ ID NO: 2721582 - DNA, 17 bp, Homo sapiens
ctgtgattggcaggagg

SEQ ID NO: 2721583 - DNA, 22 bp, Homo sapiens
ctgtgcaaacagtgtaagctta

SEQ ID NO: 2721584 - DNA, 15 bp, Homo sapiens
ctgtgcagggaggag

SEQ ID NO: 2721585 - DNA, 23 bp, Homo sapiens
ctgtgcagggataggaagtgccc

SEQ ID NO: 2721586 - DNA, 13 bp, Homo sapiens
ctgtgccaccctg

SEQ ID NO: 2721587 - DNA, 18 bp, Homo sapiens
ctgtgcccatgggcactg

SEQ ID NO: 2721588 - DNA, 21 bp, Homo sapiens
ctgtgcccatgggcactgctg

SEQ ID NO: 2721589 - DNA, 18 bp, Homo sapiens
ctgtgcctgtctgtccaa

SEQ ID NO: 2721590 - DNA, 12 bp, Homo sapiens
ctgtgcctttgg

SEQ ID NO: 2721591 - DNA, 18 bp, Homo sapiens
ctgtgcctttgggaggca

SEQ ID NO: 2721592 - DNA, 17 bp, Homo sapiens
ctgtgccttttttagct

SEQ ID NO: 2721593 - DNA, 21 bp, Homo sapiens
ctgtggattcagcttctgttg

SEQ ID NO: 2721594 - DNA, 15 bp, Homo sapiens
ctgtgggctgcactc

SEQ ID NO: 2721595 - DNA, 20 bp, Homo sapiens
ctgtgggctgcactctgtgc

SEQ ID NO: 2721596 - DNA, 23 bp, Homo sapiens
ctgtgggctgcactctgtgccca

SEQ ID NO: 2721597 - DNA, 19 bp, Homo sapiens
ctgtggggccttggttccc

SEQ ID NO: 2721598 - DNA, 21 bp, Homo sapiens
ctgtgggggaagagcacagcc

SEQ ID NO: 2721599 - DNA, 18 bp, Homo sapiens
ctgtggtcccacccagga

SEQ ID NO: 2721600 - DNA, 20 bp, Homo sapiens
ctgtggtcccacccaggaag

SEQ ID NO: 2721601 - DNA, 19 bp, Homo sapiens
ctgtggttcctaagcctgt

SEQ ID NO: 2721602 - DNA, 20 bp, Homo sapiens
ctgtggttcctaagcctgtt

SEQ ID NO: 2721603 - DNA, 17 bp, Homo sapiens
ctgtgtcactggctgcc

SEQ ID NO: 2721604 - DNA, 18 bp, Homo sapiens
ctgtgtcactggctgcct

SEQ ID NO: 2721605 - DNA, 21 bp, Homo sapiens
ctgtgtcactggctgcctcca

SEQ ID NO: 2721606 - DNA, 18 bp, Homo sapiens
ctgtgtcctcgcactgcc

SEQ ID NO: 2721607 - DNA, 19 bp, Homo sapiens
ctgtgtcctctccagcttt

SEQ ID NO: 2721608 - DNA, 22 bp, Homo sapiens
ctgtgtggtgtcgcgccttctc

SEQ ID NO: 2721609 - DNA, 21 bp, Homo sapiens
ctgttattttttatttccaca

SEQ ID NO: 2721610 - DNA, 16 bp, Homo sapiens
ctgttcccaagcaaag

SEQ ID NO: 2721611 - DNA, 14 bp, Homo sapiens
ctgttctcacctta

SEQ ID NO: 2721612 - DNA, 23 bp, Homo sapiens
ctgttctcaccttaactcagcca

SEQ ID NO: 2721613 - DNA, 15 bp, Homo sapiens
ctgttgctgaagtca

SEQ ID NO: 2721614 - DNA, 16 bp, Homo sapiens
ctgttgctgaagtcat

SEQ ID NO: 2721615 - DNA, 15 bp, Homo sapiens
ctgttgctgttggca

SEQ ID NO: 2721616 - DNA, 23 bp, Homo sapiens
ctgttgtaaataaccacactgaa

SEQ ID NO: 2721617 - DNA, 15 bp, Homo sapiens
ctgttgtgggaccgt

SEQ ID NO: 2721618 - DNA, 23 bp, Homo sapiens
ctgttgttgttacttccctccaa

SEQ ID NO: 2721619 - DNA, 14 bp, Homo sapiens
ctgttgtttgaaga

SEQ ID NO: 2721620 - DNA, 19 bp, Homo sapiens
ctgtttaaaaaaagtatat

SEQ ID NO: 2721621 - DNA, 18 bp, Homo sapiens
ctgtttcatgagcccaaa

SEQ ID NO: 2721622 - DNA, 13 bp, Homo sapiens
ctgtttgggcagg

SEQ ID NO: 2721623 - DNA, 21 bp, Homo sapiens
ctgtttgggcaggagtcacca

SEQ ID NO: 2721624 - DNA, 12 bp, Homo sapiens
ctgtttttaaca

SEQ ID NO: 2721625 - DNA, 13 bp, Homo sapiens
ctgtttttaacat

SEQ ID NO: 2721626 - DNA, 15 bp, Homo sapiens
cttaaaaatcttggt

SEQ ID NO: 2721627 - DNA, 16 bp, Homo sapiens
cttaactctgcaggaa

SEQ ID NO: 2721628 - DNA, 20 bp, Homo sapiens
cttaaggtactctggacttt

SEQ ID NO: 2721629 - DNA, 18 bp, Homo sapiens
cttaagtttccctgtgtt

SEQ ID NO: 2721630 - DNA, 15 bp, Homo sapiens
cttacagtaggagtg

SEQ ID NO: 2721631 - DNA, 14 bp, Homo sapiens
cttacccttggttt

SEQ ID NO: 2721632 - DNA, 19 bp, Homo sapiens
cttacccttggtttgcaca

SEQ ID NO: 2721633 - DNA, 22 bp, Homo sapiens
cttacggtgcacagtaatatga

SEQ ID NO: 2721634 - DNA, 23 bp, Homo sapiens
cttacggtgcacagtaatatgaa

SEQ ID NO: 2721635 - DNA, 17 bp, Homo sapiens
cttactaatgtgcccca

SEQ ID NO: 2721636 - DNA, 23 bp, Homo sapiens
cttactaatgtgccccatgtcca

SEQ ID NO: 2721637 - DNA, 13 bp, Homo sapiens
cttacttacaaaa

SEQ ID NO: 2721638 - DNA, 15 bp, Homo sapiens
cttacttcccccacc

SEQ ID NO: 2721639 - DNA, 14 bp, Homo sapiens
cttactttgtgcaa

SEQ ID NO: 2721640 - DNA, 15 bp, Homo sapiens
cttactttgtgcaaa

SEQ ID NO: 2721641 - DNA, 19 bp, Homo sapiens
cttactttgtgcaaaagca

SEQ ID NO: 2721642 - DNA, 14 bp, Homo sapiens
cttagaaacatgtt

SEQ ID NO: 2721643 - DNA, 21 bp, Homo sapiens
cttagaagatctgcttccctg

SEQ ID NO: 2721644 - DNA, 16 bp, Homo sapiens
cttagaagtggaagta

SEQ ID NO: 2721645 - DNA, 15 bp, Homo sapiens
cttagaataaaattg

SEQ ID NO: 2721646 - DNA, 20 bp, Homo sapiens
cttagaataaaattgtaaaa

SEQ ID NO: 2721647 - DNA, 14 bp, Homo sapiens
cttaggtgccaggc

SEQ ID NO: 2721648 - DNA, 15 bp, Homo sapiens
cttaggtgccaggct

SEQ ID NO: 2721649 - DNA, 18 bp, Homo sapiens
cttatatgtgtattgcta

SEQ ID NO: 2721650 - DNA, 20 bp, Homo sapiens
cttatgagaacatggtgtgt

SEQ ID NO: 2721651 - DNA, 22 bp, Homo sapiens
cttatgcaaggggaaacctgtg

SEQ ID NO: 2721652 - DNA, 20 bp, Homo sapiens
cttatgcaggacatgtgctc

SEQ ID NO: 2721653 - DNA, 14 bp, Homo sapiens
cttatgtgttgcat

SEQ ID NO: 2721654 - DNA, 21 bp, Homo sapiens
cttattcaggaaaagcctctg

SEQ ID NO: 2721655 - DNA, 16 bp, Homo sapiens
cttattgcccaggctg

SEQ ID NO: 2721656 - DNA, 14 bp, Homo sapiens
cttatttgtataat

SEQ ID NO: 2721657 - DNA, 16 bp, Homo sapiens
cttattttcttggaat

SEQ ID NO: 2721658 - DNA, 17 bp, Homo sapiens
cttatttttgtaccata

SEQ ID NO: 2721659 - DNA, 18 bp, Homo sapiens
cttcaagtgagtggcatg

SEQ ID NO: 2721660 - DNA, 18 bp, Homo sapiens
cttcaagttagctcagga

SEQ ID NO: 2721661 - DNA, 16 bp, Homo sapiens
cttcaattcctgggcc

SEQ ID NO: 2721662 - DNA, 19 bp, Homo sapiens
cttcacgcctgggtgaccc

SEQ ID NO: 2721663 - DNA, 24 bp, Homo sapiens
cttcactccggtgtgcctgcagcc

SEQ ID NO: 2721664 - DNA, 13 bp, Homo sapiens
cttcactgcagcc

SEQ ID NO: 2721665 - DNA, 20 bp, Homo sapiens
cttcacttaaaatcaaattt

SEQ ID NO: 2721666 - DNA, 15 bp, Homo sapiens
cttcagcctgaggct

SEQ ID NO: 2721667 - DNA, 16 bp, Homo sapiens
cttcaggagctgacag

SEQ ID NO: 2721668 - DNA, 22 bp, Homo sapiens
cttcaggggctgcccgctccca

SEQ ID NO: 2721669 - DNA, 16 bp, Homo sapiens
cttcataaaactcatg

SEQ ID NO: 2721670 - DNA, 16 bp, Homo sapiens
cttcataaattatttc

SEQ ID NO: 2721671 - DNA, 15 bp, Homo sapiens
cttcatatctaattt

SEQ ID NO: 2721672 - DNA, 12 bp, Homo sapiens
cttcatgcccac

SEQ ID NO: 2721673 - DNA, 21 bp, Homo sapiens
cttccaaaaagatttattaat

SEQ ID NO: 2721674 - DNA, 20 bp, Homo sapiens
cttccaaggtggtctgctcg

SEQ ID NO: 2721675 - DNA, 20 bp, Homo sapiens
cttccaccagagcaggggct

SEQ ID NO: 2721676 - DNA, 21 bp, Homo sapiens
cttccaccagagcaggggctg

SEQ ID NO: 2721677 - DNA, 22 bp, Homo sapiens
ctcttgggcctgacctccagtc

SEQ ID NO: 2721678 - DNA, 22 bp, Homo sapiens
ctcttgtttggagggatcattt

SEQ ID NO: 2721679 - DNA, 23 bp, Homo sapiens
ctctttaaaaaaaatagaagcta

SEQ ID NO: 2721680 - DNA, 12 bp, Homo sapiens
ctctttctgggc

SEQ ID NO: 2721681 - DNA, 14 bp, Homo sapiens
ctctttgctacaat

SEQ ID NO: 2721682 - DNA, 23 bp, Homo sapiens
ctgaaaacccaggccacaaatgt

SEQ ID NO: 2721683 - DNA, 14 bp, Homo sapiens
ctgaacaaagagag

SEQ ID NO: 2721684 - DNA, 14 bp, Homo sapiens
ctgaacaatatttt

SEQ ID NO: 2721685 - DNA, 16 bp, Homo sapiens
ctgaacaattctctct

SEQ ID NO: 2721686 - DNA, 14 bp, Homo sapiens
ctgaacagtgctct

SEQ ID NO: 2721687 - DNA, 15 bp, Homo sapiens
ctgaacagtgctctg

SEQ ID NO: 2721688 - DNA, 20 bp, Homo sapiens
ctgaacagtgctctgcctct

SEQ ID NO: 2721689 - DNA, 21 bp, Homo sapiens
ctgaacagtgctctgcctcta

SEQ ID NO: 2721690 - DNA, 15 bp, Homo sapiens
ctgaaccgtgtgctc

SEQ ID NO: 2721691 - DNA, 14 bp, Homo sapiens
ctgaactggccact

SEQ ID NO: 2721692 - DNA, 18 bp, Homo sapiens
ctgaaggagattttcctt

SEQ ID NO: 2721693 - DNA, 14 bp, Homo sapiens
ctgaaggcttctgc

SEQ ID NO: 2721694 - DNA, 18 bp, Homo sapiens
ctgaagtcttgcattgaa

SEQ ID NO: 2721695 - DNA, 19 bp, Homo sapiens
ctgaagtcttgcattgaat

SEQ ID NO: 2721696 - DNA, 15 bp, Homo sapiens
ctgaagtgattgaaa

SEQ ID NO: 2721697 - DNA, 20 bp, Homo sapiens
ctgaagtgcagctcaggaga

SEQ ID NO: 2721698 - DNA, 18 bp, Homo sapiens
ctgaagtgtcgagtccag

SEQ ID NO: 2721699 - DNA, 14 bp, Homo sapiens
ctgaatattaagaa

SEQ ID NO: 2721700 - DNA, 23 bp, Homo sapiens
ctgaatgtcattatttgataaca

SEQ ID NO: 2721701 - DNA, 23 bp, Homo sapiens
ctgacactgcggggcttggctga

SEQ ID NO: 2721702 - DNA, 13 bp, Homo sapiens
ctgacagagccag

SEQ ID NO: 2721703 - DNA, 19 bp, Homo sapiens
ctgacagtcctctccacct

SEQ ID NO: 2721704 - DNA, 17 bp, Homo sapiens
ctgacccaccaaggtct

SEQ ID NO: 2721705 - DNA, 19 bp, Homo sapiens
ctgacccaccaaggtctca

SEQ ID NO: 2721706 - DNA, 18 bp, Homo sapiens
ctgacccagtgtgtgctc

SEQ ID NO: 2721707 - DNA, 21 bp, Homo sapiens
ctgacccagtgtgtgctcagc

SEQ ID NO: 2721708 - DNA, 22 bp, Homo sapiens
ctgacccagtgtgtgctcagca

SEQ ID NO: 2721709 - DNA, 21 bp, Homo sapiens
ctgacccggattggccctgcc

SEQ ID NO: 2721710 - DNA, 22 bp, Homo sapiens
ctgacccggattggccctgccc

SEQ ID NO: 2721711 - DNA, 20 bp, Homo sapiens
ctgaccctcctccactccac

SEQ ID NO: 2721712 - DNA, 19 bp, Homo sapiens
ctgaccgccgcttccagct

SEQ ID NO: 2721713 - DNA, 16 bp, Homo sapiens
ctgaccgggtctgctt

SEQ ID NO: 2721714 - DNA, 21 bp, Homo sapiens
ctgacctccagtcctgctggc

SEQ ID NO: 2721715 - DNA, 24 bp, Homo sapiens
ctgacctccagtcctgctggcctg

SEQ ID NO: 2721716 - DNA, 23 bp, Homo sapiens
ctgacctcgtgatttgcctgcct

SEQ ID NO: 2721717 - DNA, 13 bp, Homo sapiens
ctgactctctgtg

SEQ ID NO: 2721718 - DNA, 20 bp, Homo sapiens
ctgacttcaggggctgcccg

SEQ ID NO: 2721719 - DNA, 21 bp, Homo sapiens
ctgacttcaggggctgcccgc

SEQ ID NO: 2721720 - DNA, 22 bp, Homo sapiens
ctgacttcaggggctgcccgct

SEQ ID NO: 2721721 - DNA, 16 bp, Homo sapiens
ctgagaagtgtatata

SEQ ID NO: 2721722 - DNA, 21 bp, Homo sapiens
ctgagactagattctcacctg

SEQ ID NO: 2721723 - DNA, 22 bp, Homo sapiens
ctgagattctttaaggagatag

SEQ ID NO: 2721724 - DNA, 23 bp, Homo sapiens
ctgagattctttaaggagataga

SEQ ID NO: 2721725 - DNA, 23 bp, Homo sapiens
ctgagcaacagagtgagaccctg

SEQ ID NO: 2721726 - DNA, 14 bp, Homo sapiens
ctgagccctggcag

SEQ ID NO: 2721727 - DNA, 15 bp, Homo sapiens
ctgagccctggcagg

SEQ ID NO: 2721728 - DNA, 13 bp, Homo sapiens
ctgagctggccta

SEQ ID NO: 2721729 - DNA, 12 bp, Homo sapiens
ctgagctgggct

SEQ ID NO: 2721730 - DNA, 14 bp, Homo sapiens
ctgaggagtgtcct

SEQ ID NO: 2721731 - DNA, 17 bp, Homo sapiens
ctgaggatcccctgtcc

SEQ ID NO: 2721732 - DNA, 23 bp, Homo sapiens
ctgaggatcccctgtcccctggg

SEQ ID NO: 2721733 - DNA, 15 bp, Homo sapiens
ctgaggcacctgcat

SEQ ID NO: 2721734 - DNA, 18 bp, Homo sapiens
ctgaggcgggtggatcac

SEQ ID NO: 2721735 - DNA, 18 bp, Homo sapiens
ctgaggctctttctgggc

SEQ ID NO: 2721736 - DNA, 17 bp, Homo sapiens
ctgaggctggcatcctg

SEQ ID NO: 2721737 - DNA, 24 bp, Homo sapiens
ctgaggctggcatcctggctggct

SEQ ID NO: 2721738 - DNA, 12 bp, Homo sapiens
ctgagggcatct

SEQ ID NO: 2721739 - DNA, 21 bp, Homo sapiens
ctgagtctgctatattttcat

SEQ ID NO: 2721740 - DNA, 14 bp, Homo sapiens
ctgagtctggcaaa

SEQ ID NO: 2721741 - DNA, 20 bp, Homo sapiens
ctgagtctggcaaacatgtg

SEQ ID NO: 2721742 - DNA, 22 bp, Homo sapiens
ctgagtctggcaaacatgtgca

SEQ ID NO: 2721743 - DNA, 21 bp, Homo sapiens
ctgagtggcagccgcctccct

SEQ ID NO: 2721744 - DNA, 17 bp, Homo sapiens
ctgagtgtctctgcctg

SEQ ID NO: 2721745 - DNA, 18 bp, Homo sapiens
ctgagtgtctctgcctgg

SEQ ID NO: 2721746 - DNA, 22 bp, Homo sapiens
ctgagtgtgagaccctgttcta

SEQ ID NO: 2721747 - DNA, 19 bp, Homo sapiens
ctgatatctgtttgcttct

SEQ ID NO: 2721748 - DNA, 22 bp, Homo sapiens
ctgatatctgtttgcttctaaa

SEQ ID NO: 2721749 - DNA, 18 bp, Homo sapiens
ctgatccagacaagtggg

SEQ ID NO: 2721750 - DNA, 11 bp, Homo sapiens
ctgatcttgga

SEQ ID NO: 2721751 - DNA, 14 bp, Homo sapiens
ctgatgctgggctg

SEQ ID NO: 2721752 - DNA, 16 bp, Homo sapiens
ctgatgctgggctggg

SEQ ID NO: 2721753 - DNA, 17 bp, Homo sapiens
ctgatgctgggctgggt

SEQ ID NO: 2721754 - DNA, 18 bp, Homo sapiens
ctgatgctgggctgggtg

SEQ ID NO: 2721755 - DNA, 16 bp, Homo sapiens
ctgattcggctgtctc

SEQ ID NO: 2721756 - DNA, 20 bp, Homo sapiens
ctgcaagatttcacatcagc

SEQ ID NO: 2721757 - DNA, 18 bp, Homo sapiens
ctgcaatgtttttgtgta

SEQ ID NO: 2721758 - DNA, 16 bp, Homo sapiens
ctgcaccaacccagcc

SEQ ID NO: 2721759 - DNA, 21 bp, Homo sapiens
ctgcaccaacccagccgctgc

SEQ ID NO: 2721760 - DNA, 19 bp, Homo sapiens
ctgcaccccctcctgctgc

SEQ ID NO: 2721761 - DNA, 16 bp, Homo sapiens
ctgcacctgccagcct

SEQ ID NO: 2721762 - DNA, 17 bp, Homo sapiens
ctgcacctgccagcctg

SEQ ID NO: 2721763 - DNA, 15 bp, Homo sapiens
ctgcacgtcaccctc

SEQ ID NO: 2721764 - DNA, 22 bp, Homo sapiens
ctgcacgtcaccctcctgagcc

SEQ ID NO: 2721765 - DNA, 13 bp, Homo sapiens
ctgcactctgtgc

SEQ ID NO: 2721766 - DNA, 17 bp, Homo sapiens
ctgcactctgtgcccat

SEQ ID NO: 2721767 - DNA, 21 bp, Homo sapiens
ctgcactctgtgcccatgggc

SEQ ID NO: 2721768 - DNA, 14 bp, Homo sapiens
ctgcactgtcctgc

SEQ ID NO: 2721769 - DNA, 15 bp, Homo sapiens
ctgcactgtcctgct

SEQ ID NO: 2721770 - DNA, 15 bp, Homo sapiens
ctgcagagctatggt

SEQ ID NO: 2721771 - DNA, 21 bp, Homo sapiens
ctgcagaggggaaaccagtgt

SEQ ID NO: 2721772 - DNA, 14 bp, Homo sapiens
ctgcagaggggcag

SEQ ID NO: 2721773 - DNA, 21 bp, Homo sapiens
ctgcagaggggcaggccctgc

SEQ ID NO: 2721774 - DNA, 18 bp, Homo sapiens
ctgcagatagtgcctctg

SEQ ID NO: 2721775 - DNA, 14 bp, Homo sapiens
ctgcagctttggct

SEQ ID NO: 2721776 - DNA, 18 bp, Homo sapiens
ctgcagctttgggaaagc

SEQ ID NO: 2721777 - DNA, 21 bp, Homo sapiens
ctgcagctttgggaaagctgc

SEQ ID NO: 2721778 - DNA, 21 bp, Homo sapiens
ctgcaggcagatttactgtcc

SEQ ID NO: 2721779 - DNA, 19 bp, Homo sapiens
ctgcaggccaagagcagag

SEQ ID NO: 2721780 - DNA, 23 bp, Homo sapiens
ctgcagggagcaactctccactc

SEQ ID NO: 2721781 - DNA, 21 bp, Homo sapiens
ctgcatatctctagtccctgt

SEQ ID NO: 2721782 - DNA, 16 bp, Homo sapiens
ctgcatggggagtaca

SEQ ID NO: 2721783 - DNA, 18 bp, Homo sapiens
ctgcatgtaaaatcttca

SEQ ID NO: 2721784 - DNA, 23 bp, Homo sapiens
ctgcattcacagcgcctcctgga

SEQ ID NO: 2721785 - DNA, 24 bp, Homo sapiens
ctgcattcacagcgcctcctggac

SEQ ID NO: 2721786 - DNA, 19 bp, Homo sapiens
ctgcatttttaaaggacaa

SEQ ID NO: 2721787 - DNA, 23 bp, Homo sapiens
ctgcatttttaaaggacaaacag

SEQ ID NO: 2721788 - DNA, 14 bp, Homo sapiens
ctgccactctgctg

SEQ ID NO: 2721789 - DNA, 11 bp, Homo sapiens
cgcttgcctcg

SEQ ID NO: 2721790 - DNA, 13 bp, Homo sapiens
cgcttgcctcggc

SEQ ID NO: 2721791 - DNA, 16 bp, Homo sapiens
cgcttgcctcggctcc

SEQ ID NO: 2721792 - DNA, 23 bp, Homo sapiens
cgcttgcctcggctcctgctgca

SEQ ID NO: 2721793 - DNA, 16 bp, Homo sapiens
cggaaagactgaaaga

SEQ ID NO: 2721794 - DNA, 18 bp, Homo sapiens
cggacctggactagggcc

SEQ ID NO: 2721795 - DNA, 19 bp, Homo sapiens
cggacgttggttctgcact

SEQ ID NO: 2721796 - DNA, 19 bp, Homo sapiens
cggactcagactcctggct

SEQ ID NO: 2721797 - DNA, 16 bp, Homo sapiens
cggagcagcctccagt

SEQ ID NO: 2721798 - DNA, 21 bp, Homo sapiens
cggagcagcctccagtgctgg

SEQ ID NO: 2721799 - DNA, 22 bp, Homo sapiens
cggagcagcctccagtgctggc

SEQ ID NO: 2721800 - DNA, 17 bp, Homo sapiens
cggaggctcctccctct

SEQ ID NO: 2721801 - DNA, 21 bp, Homo sapiens
cggaggctcctccctctgcct

SEQ ID NO: 2721802 - DNA, 22 bp, Homo sapiens
cggaggctcctccctctgcctc

SEQ ID NO: 2721803 - DNA, 16 bp, Homo sapiens
cggcaccagtgcctca

SEQ ID NO: 2721804 - DNA, 23 bp, Homo sapiens
cggcacgccaacagcccccccct

SEQ ID NO: 2721805 - DNA, 14 bp, Homo sapiens
cggcactatttctg

SEQ ID NO: 2721806 - DNA, 10 bp, Homo sapiens
cggcagctgt

SEQ ID NO: 2721807 - DNA, 14 bp, Homo sapiens
cggcagctgtagct

SEQ ID NO: 2721808 - DNA, 15 bp, Homo sapiens
cggcccatctgtcca

SEQ ID NO: 2721809 - DNA, 16 bp, Homo sapiens
cggcccatctgtccat

SEQ ID NO: 2721810 - DNA, 20 bp, Homo sapiens
cggcccatctgtccatcctc

SEQ ID NO: 2721811 - DNA, 14 bp, Homo sapiens
cggccctgcccctc

SEQ ID NO: 2721812 - DNA, 16 bp, Homo sapiens
cggccctgcccctccc

SEQ ID NO: 2721813 - DNA, 15 bp, Homo sapiens
cggccttgaagaggc

SEQ ID NO: 2721814 - DNA, 23 bp, Homo sapiens
cggctcctgctgcaccaacccag

SEQ ID NO: 2721815 - DNA, 17 bp, Homo sapiens
cggctctggcctccaag

SEQ ID NO: 2721816 - DNA, 16 bp, Homo sapiens
cggctgtctcagactc

SEQ ID NO: 2721817 - DNA, 22 bp, Homo sapiens
cggcttgcctgtaatcccagca

SEQ ID NO: 2721818 - DNA, 14 bp, Homo sapiens
cgggaggggcccgc

SEQ ID NO: 2721819 - DNA, 16 bp, Homo sapiens
cgggatgaaaagccat

SEQ ID NO: 2721820 - DNA, 17 bp, Homo sapiens
cgggatgaaaagccata

SEQ ID NO: 2721821 - DNA, 12 bp, Homo sapiens
cgggcattttga

SEQ ID NO: 2721822 - DNA, 13 bp, Homo sapiens
cgggcccaggcca

SEQ ID NO: 2721823 - DNA, 18 bp, Homo sapiens
cgggctcagggaccacag

SEQ ID NO: 2721824 - DNA, 22 bp, Homo sapiens
cgggctgagggcatctctgagt

SEQ ID NO: 2721825 - DNA, 14 bp, Homo sapiens
cgggctgccctgcc

SEQ ID NO: 2721826 - DNA, 22 bp, Homo sapiens
cggggaaggtttttatgtgcct

SEQ ID NO: 2721827 - DNA, 18 bp, Homo sapiens
cggggaccactgggcccc

SEQ ID NO: 2721828 - DNA, 17 bp, Homo sapiens
cggggcgtttctttgcc

SEQ ID NO: 2721829 - DNA, 14 bp, Homo sapiens
cggggcttggctga

SEQ ID NO: 2721830 - DNA, 19 bp, Homo sapiens
cgggggagccaacagcagc

SEQ ID NO: 2721831 - DNA, 16 bp, Homo sapiens
cggggtggattggatt

SEQ ID NO: 2721832 - DNA, 14 bp, Homo sapiens
cggggtttccccat

SEQ ID NO: 2721833 - DNA, 16 bp, Homo sapiens
cgggtctgcttctgca

SEQ ID NO: 2721834 - DNA, 18 bp, Homo sapiens
cgggtggatcacctgagg

SEQ ID NO: 2721835 - DNA, 19 bp, Homo sapiens
cgggtggatcacctgaggt

SEQ ID NO: 2721836 - DNA, 18 bp, Homo sapiens
cgggtggggggagggcac

SEQ ID NO: 2721837 - DNA, 12 bp, Homo sapiens
cgggttgaaaga

SEQ ID NO: 2721838 - DNA, 19 bp, Homo sapiens
cgggttgaaagacatcaat

SEQ ID NO: 2721839 - DNA, 12 bp, Homo sapiens
cggtactcccat

SEQ ID NO: 2721840 - DNA, 22 bp, Homo sapiens
cggtcctttaggcagcctgccg

SEQ ID NO: 2721841 - DNA, 14 bp, Homo sapiens
cggtgagactctga

SEQ ID NO: 2721842 - DNA, 19 bp, Homo sapiens
cgtaagatggcttatttgt

SEQ ID NO: 2721843 - DNA, 21 bp, Homo sapiens
cgtagatttttgctcttctgt

SEQ ID NO: 2721844 - DNA, 20 bp, Homo sapiens
cgtagccaaggtgggctgag

SEQ ID NO: 2721845 - DNA, 20 bp, Homo sapiens
cgtagtcctttttgtaacta

SEQ ID NO: 2721846 - DNA, 22 bp, Homo sapiens
cgtataatttagtcccttaaaa

SEQ ID NO: 2721847 - DNA, 23 bp, Homo sapiens
cgtatgtcggcacgtcccatgtg

SEQ ID NO: 2721848 - DNA, 17 bp, Homo sapiens
cgtcaacgtgcatttta

SEQ ID NO: 2721849 - DNA, 17 bp, Homo sapiens
cgtcaccctcctgagcc

SEQ ID NO: 2721850 - DNA, 19 bp, Homo sapiens
cgtcattgatggagcctga

SEQ ID NO: 2721851 - DNA, 22 bp, Homo sapiens
cgtccaaggcagttctgtgtcc

SEQ ID NO: 2721852 - DNA, 16 bp, Homo sapiens
cgtccatttcttattt

SEQ ID NO: 2721853 - DNA, 19 bp, Homo sapiens
cgtcctgaggagtgtcctg

SEQ ID NO: 2721854 - DNA, 20 bp, Homo sapiens
cgtcctgaggagtgtcctgt

SEQ ID NO: 2721855 - DNA, 14 bp, Homo sapiens
cgtcctgtcagtgc

SEQ ID NO: 2721856 - DNA, 16 bp, Homo sapiens
cgtcgacgtagaacct

SEQ ID NO: 2721857 - DNA, 20 bp, Homo sapiens
cgtcgctggacaacccagaa

SEQ ID NO: 2721858 - DNA, 21 bp, Homo sapiens
cgtctactcattccccggggc

SEQ ID NO: 2721859 - DNA, 12 bp, Homo sapiens
cgtctctctgcc

SEQ ID NO: 2721860 - DNA, 13 bp, Homo sapiens
cgtctctctgcct

SEQ ID NO: 2721861 - DNA, 15 bp, Homo sapiens
cgtctctctgcctgc

SEQ ID NO: 2721862 - DNA, 15 bp, Homo sapiens
cgtctgccccaccct

SEQ ID NO: 2721863 - DNA, 16 bp, Homo sapiens
cgtctgccccaccctc

SEQ ID NO: 2721864 - DNA, 18 bp, Homo sapiens
cgtctgccccaccctcaa

SEQ ID NO: 2721865 - DNA, 14 bp, Homo sapiens
cgtgaactgcgtgc

SEQ ID NO: 2721866 - DNA, 15 bp, Homo sapiens
cgtgaataggctgct

SEQ ID NO: 2721867 - DNA, 15 bp, Homo sapiens
cgtgacactgtgggt

SEQ ID NO: 2721868 - DNA, 14 bp, Homo sapiens
cgtgactcagagct

SEQ ID NO: 2721869 - DNA, 18 bp, Homo sapiens
cgtgatctcggctcactg

SEQ ID NO: 2721870 - DNA, 23 bp, Homo sapiens
cgtgatttggaagagaggcacct

SEQ ID NO: 2721871 - DNA, 17 bp, Homo sapiens
cgtgcacagcttcctga

SEQ ID NO: 2721872 - DNA, 17 bp, Homo sapiens
cgtgccagtcgcgctgc

SEQ ID NO: 2721873 - DNA, 20 bp, Homo sapiens
cgtgccagtcgcgctgcctg

SEQ ID NO: 2721874 - DNA, 22 bp, Homo sapiens
cgtgccagtcgcgctgcctgtg

SEQ ID NO: 2721875 - DNA, 17 bp, Homo sapiens
cgtggccccagcctggc

SEQ ID NO: 2721876 - DNA, 23 bp, Homo sapiens
cgtgggtgtgtgtagccaaggtc

SEQ ID NO: 2721877 - DNA, 15 bp, Homo sapiens
cgtggtagaagccag

SEQ ID NO: 2721878 - DNA, 15 bp, Homo sapiens
cgtgtcgtgggtgtg

SEQ ID NO: 2721879 - DNA, 14 bp, Homo sapiens
cgtgtctgctgttg

SEQ ID NO: 2721880 - DNA, 15 bp, Homo sapiens
cgttactctcacctc

SEQ ID NO: 2721881 - DNA, 19 bp, Homo sapiens
cgttcgcttgttttaaaag

SEQ ID NO: 2721882 - DNA, 15 bp, Homo sapiens
cgttggttctgcact

SEQ ID NO: 2721883 - DNA, 16 bp, Homo sapiens
cgttgtctccctggcc

SEQ ID NO: 2721884 - DNA, 17 bp, Homo sapiens
cgttgtctccctggccc

SEQ ID NO: 2721885 - DNA, 14 bp, Homo sapiens
ctaaaaatattaaa

SEQ ID NO: 2721886 - DNA, 16 bp, Homo sapiens
ctaaacagactattta

SEQ ID NO: 2721887 - DNA, 22 bp, Homo sapiens
ctaaagctctgaacaaaagctt

SEQ ID NO: 2721888 - DNA, 16 bp, Homo sapiens
ctaaagtcacatataa

SEQ ID NO: 2721889 - DNA, 21 bp, Homo sapiens
ctaaagtttacagtaaataaa

SEQ ID NO: 2721890 - DNA, 24 bp, Homo sapiens
ctaaagtttacagtaaataaattg

SEQ ID NO: 2721891 - DNA, 13 bp, Homo sapiens
ctaaatgttcatg

SEQ ID NO: 2721892 - DNA, 15 bp, Homo sapiens
ctaaattagtttaaa

SEQ ID NO: 2721893 - DNA, 19 bp, Homo sapiens
ctaaattagtttaaaatga

SEQ ID NO: 2721894 - DNA, 20 bp, Homo sapiens
ctaaatttcccaattttctg

SEQ ID NO: 2721895 - DNA, 12 bp, Homo sapiens
ctaacaatatga

SEQ ID NO: 2721896 - DNA, 14 bp, Homo sapiens
ctaacacccagtct

SEQ ID NO: 2721897 - DNA, 17 bp, Homo sapiens
ctaacatttaggagaag

SEQ ID NO: 2721898 - DNA, 17 bp, Homo sapiens
ctaaccaaagagtctct

SEQ ID NO: 2721899 - DNA, 18 bp, Homo sapiens
ctaaccaaagagtctctg

SEQ ID NO: 2721900 - DNA, 18 bp, Homo sapiens
ctaacgaacgttttaaag

SEQ ID NO: 2721901 - DNA, 20 bp, Homo sapiens
ctaacgaacgttttaaagct

SEQ ID NO: 2721902 - DNA, 12 bp, Homo sapiens
ctaactccctcc

SEQ ID NO: 2721903 - DNA, 13 bp, Homo sapiens
ctaactccctcct

SEQ ID NO: 2721904 - DNA, 16 bp, Homo sapiens
ctaactccctcctcac

SEQ ID NO: 2721905 - DNA, 18 bp, Homo sapiens
ctaactccctcctcacac

SEQ ID NO: 2721906 - DNA, 12 bp, Homo sapiens
ctaagctgcagc

SEQ ID NO: 2721907 - DNA, 14 bp, Homo sapiens
ctaagtcatggtcc

SEQ ID NO: 2721908 - DNA, 17 bp, Homo sapiens
ctaagtcatggtcctgg

SEQ ID NO: 2721909 - DNA, 21 bp, Homo sapiens
ctaagtcatggtcctggctgg

SEQ ID NO: 2721910 - DNA, 12 bp, Homo sapiens
ctaagtgtggat

SEQ ID NO: 2721911 - DNA, 12 bp, Homo sapiens
ctaataaatcaa

SEQ ID NO: 2721912 - DNA, 16 bp, Homo sapiens
ctaataaatcaatgtg

SEQ ID NO: 2721913 - DNA, 18 bp, Homo sapiens
ctaatcaagagtctctcc

SEQ ID NO: 2721914 - DNA, 22 bp, Homo sapiens
ctaatcaagagtctctccagcc

SEQ ID NO: 2721915 - DNA, 17 bp, Homo sapiens
ctaattggtcattccta

SEQ ID NO: 2721916 - DNA, 21 bp, Homo sapiens
ctaattggtccaacccagcct

SEQ ID NO: 2721917 - DNA, 20 bp, Homo sapiens
ctaatttttgtatttttcgt

SEQ ID NO: 2721918 - DNA, 15 bp, Homo sapiens
ctacaaaccaggagc

SEQ ID NO: 2721919 - DNA, 22 bp, Homo sapiens
ctacaaccaggtcttgacctga

SEQ ID NO: 2721920 - DNA, 16 bp, Homo sapiens
ctacaataaatgctga

SEQ ID NO: 2721921 - DNA, 18 bp, Homo sapiens
ctacaataaatgctgaat

SEQ ID NO: 2721922 - DNA, 13 bp, Homo sapiens
ctacacaacatgt

SEQ ID NO: 2721923 - DNA, 12 bp, Homo sapiens
ctacacatatat

SEQ ID NO: 2721924 - DNA, 18 bp, Homo sapiens
ctacacatatatgtatat

SEQ ID NO: 2721925 - DNA, 14 bp, Homo sapiens
ctacactccagcct

SEQ ID NO: 2721926 - DNA, 18 bp, Homo sapiens
ctacactccagcctgagc

SEQ ID NO: 2721927 - DNA, 11 bp, Homo sapiens
ctacccctccc

SEQ ID NO: 2721928 - DNA, 14 bp, Homo sapiens
ctaccctccctgct

SEQ ID NO: 2721929 - DNA, 15 bp, Homo sapiens
ctaccctccctgctg

SEQ ID NO: 2721930 - DNA, 18 bp, Homo sapiens
ctaccctccctgctgtcc

SEQ ID NO: 2721931 - DNA, 20 bp, Homo sapiens
ctaccctccctgctgtcccc

SEQ ID NO: 2721932 - DNA, 15 bp, Homo sapiens
ctaccctgcagcttg

SEQ ID NO: 2721933 - DNA, 19 bp, Homo sapiens
ctaccctggtaggaaagca

SEQ ID NO: 2721934 - DNA, 13 bp, Homo sapiens
ctaccgcatggca

SEQ ID NO: 2721935 - DNA, 15 bp, Homo sapiens
ctaccgcatggcagc

SEQ ID NO: 2721936 - DNA, 18 bp, Homo sapiens
ctaccgcatggcagctgg

SEQ ID NO: 2721937 - DNA, 19 bp, Homo sapiens
ctaccgcatggcagctggg

SEQ ID NO: 2721938 - DNA, 20 bp, Homo sapiens
ctaccgcatggcagctgggc

SEQ ID NO: 2721939 - DNA, 22 bp, Homo sapiens
ctaccgcatggcagctgggccc

SEQ ID NO: 2721940 - DNA, 23 bp, Homo sapiens
ctaccgcatggcagctgggccca

SEQ ID NO: 2721941 - DNA, 11 bp, Homo sapiens
ctacctcagcc

SEQ ID NO: 2721942 - DNA, 15 bp, Homo sapiens
ctacctgcctgttct

SEQ ID NO: 2721943 - DNA, 20 bp, Homo sapiens
ctacctttttttctctccta

SEQ ID NO: 2721944 - DNA, 16 bp, Homo sapiens
ctactcagaagcctga

SEQ ID NO: 2721945 - DNA, 21 bp, Homo sapiens
ctactcagaagcctgaggctg

SEQ ID NO: 2721946 - DNA, 14 bp, Homo sapiens
ctactcccagcgct

SEQ ID NO: 2721947 - DNA, 21 bp, Homo sapiens
ctactcctacctcagcctaga

SEQ ID NO: 2721948 - DNA, 23 bp, Homo sapiens
ctactctcttgccagcattttca

SEQ ID NO: 2721949 - DNA, 21 bp, Homo sapiens
ctactgtaagcaagaaaaata

SEQ ID NO: 2721950 - DNA, 17 bp, Homo sapiens
ctacttttgcatgaaaa

SEQ ID NO: 2721951 - DNA, 20 bp, Homo sapiens
ctagaaatcacaagaacaaa

SEQ ID NO: 2721952 - DNA, 16 bp, Homo sapiens
ctagaacacccactgg

SEQ ID NO: 2721953 - DNA, 22 bp, Homo sapiens
ctagaacacccactggccagtc

SEQ ID NO: 2721954 - DNA, 12 bp, Homo sapiens
ctagaagcagaa

SEQ ID NO: 2721955 - DNA, 20 bp, Homo sapiens
ctagagctcctgtccctacc

SEQ ID NO: 2721956 - DNA, 24 bp, Homo sapiens
ctagagctcctgtccctacccact

SEQ ID NO: 2721957 - DNA, 15 bp, Homo sapiens
ctagagtgacaggca

SEQ ID NO: 2721958 - DNA, 20 bp, Homo sapiens
ctagagtgacaggcaccaga

SEQ ID NO: 2721959 - DNA, 22 bp, Homo sapiens
ctagatccaggcttctcccgga

SEQ ID NO: 2721960 - DNA, 19 bp, Homo sapiens
ctagctcttgggcctgacc

SEQ ID NO: 2721961 - DNA, 20 bp, Homo sapiens
ctagctcttgggcctgacct

SEQ ID NO: 2721962 - DNA, 12 bp, Homo sapiens
ctaggactctga

SEQ ID NO: 2721963 - DNA, 19 bp, Homo sapiens
ctaggccacaccatctcct

SEQ ID NO: 2721964 - DNA, 22 bp, Homo sapiens
ctagggcctcggaggctcctcc

SEQ ID NO: 2721965 - DNA, 17 bp, Homo sapiens
ctaggggaaggactggc

SEQ ID NO: 2721966 - DNA, 17 bp, Homo sapiens
ctagtctcttctcagag

SEQ ID NO: 2721967 - DNA, 19 bp, Homo sapiens
ctagtgccctccacagccg

SEQ ID NO: 2721968 - DNA, 14 bp, Homo sapiens
ctagtggctgtcca

SEQ ID NO: 2721969 - DNA, 22 bp, Homo sapiens
ctagtggctgtccagtgcccat

SEQ ID NO: 2721970 - DNA, 23 bp, Homo sapiens
ctagttgattgcgagaattttca

SEQ ID NO: 2721971 - DNA, 21 bp, Homo sapiens
  misc_feature (4)..(4): n is a, c, g or t
  misc_feature (11)..(11): n is a, c, g or t
ctanccccccnacccccagtg

SEQ ID NO: 2721972 - DNA, 14 bp, Homo sapiens
ctatatctctaaac

SEQ ID NO: 2721973 - DNA, 16 bp, Homo sapiens
ctatatttatttatgt

SEQ ID NO: 2721974 - DNA, 18 bp, Homo sapiens
ctatcagtgtgcccccca

SEQ ID NO: 2721975 - DNA, 22 bp, Homo sapiens
ctatgatcccagcactttggga

SEQ ID NO: 2721976 - DNA, 18 bp, Homo sapiens
ctatggagtgaaattatt

SEQ ID NO: 2721977 - DNA, 22 bp, Homo sapiens
ctatggcccagccactgcagca

SEQ ID NO: 2721978 - DNA, 18 bp, Homo sapiens
ctatgtaatttttaaagc

SEQ ID NO: 2721979 - DNA, 19 bp, Homo sapiens
ctatgttccaataaaactt

SEQ ID NO: 2721980 - DNA, 20 bp, Homo sapiens
ctattccaataaagcagagt

SEQ ID NO: 2721981 - DNA, 14 bp, Homo sapiens
ctatttaacttgag

SEQ ID NO: 2721982 - DNA, 15 bp, Homo sapiens
ctatttaacttgagg

SEQ ID NO: 2721983 - DNA, 22 bp, Homo sapiens
ctatttcctttgcgcaaacttt

SEQ ID NO: 2721984 - DNA, 17 bp, Homo sapiens
ctatttctatgtatgtg

SEQ ID NO: 2721985 - DNA, 21 bp, Homo sapiens
ctatttctatgtatgtgccaa

SEQ ID NO: 2721986 - DNA, 15 bp, Homo sapiens
ctatttctttaatct

SEQ ID NO: 2721987 - DNA, 14 bp, Homo sapiens
ctcaaaccctgtgg

SEQ ID NO: 2721988 - DNA, 14 bp, Homo sapiens
ctcaactactcagc

SEQ ID NO: 2721989 - DNA, 14 bp, Homo sapiens
ctcaagacttccag

SEQ ID NO: 2721990 - DNA, 15 bp, Homo sapiens
ctcaaggaaaagatg

SEQ ID NO: 2721991 - DNA, 14 bp, Homo sapiens
ctcaaggcctccag

SEQ ID NO: 2721992 - DNA, 12 bp, Homo sapiens
ctcaagtttaaa

SEQ ID NO: 2721993 - DNA, 14 bp, Homo sapiens
ctcaatcactgctc

SEQ ID NO: 2721994 - DNA, 19 bp, Homo sapiens
ctcaattttgtatttaatg

SEQ ID NO: 2721995 - DNA, 21 bp, Homo sapiens
ctcaattttgtatttaatgat

SEQ ID NO: 2721996 - DNA, 12 bp, Homo sapiens
ctcacactcctc

SEQ ID NO: 2721997 - DNA, 14 bp, Homo sapiens
ctcacactcctcct

SEQ ID NO: 2721998 - DNA, 19 bp, Homo sapiens
ctcacactcctcctgccag

SEQ ID NO: 2721999 - DNA, 16 bp, Homo sapiens
ctcacagactcttcca

SEQ ID NO: 2722000 - DNA, 22 bp, Homo sapiens
ctcacagactcttccaccagag

SEQ ID NO: 2722001 - DNA, 15 bp, Homo sapiens
ctcacagatgctggc

SEQ ID NO: 2722002 - DNA, 18 bp, Homo sapiens
ctcacagatgctggcctc

SEQ ID NO: 2722003 - DNA, 19 bp, Homo sapiens
ctcacagatgctggcctct

SEQ ID NO: 2722004 - DNA, 21 bp, Homo sapiens
ctcacagatgctggcctcttg

SEQ ID NO: 2722005 - DNA, 23 bp, Homo sapiens
ctcacagatgctggcctcttggc

SEQ ID NO: 2722006 - DNA, 13 bp, Homo sapiens
ctcacagcctctc

SEQ ID NO: 2722007 - DNA, 14 bp, Homo sapiens
ctcacagcctctcc

SEQ ID NO: 2722008 - DNA, 15 bp, Homo sapiens
ctcacattcccaagg

SEQ ID NO: 2722009 - DNA, 17 bp, Homo sapiens
ctcaccacaacctccac

SEQ ID NO: 2722010 - DNA, 21 bp, Homo sapiens
ctcaccaggggcaggcacagc

SEQ ID NO: 2722011 - DNA, 22 bp, Homo sapiens
ctcaccaggggcaggcacagca

SEQ ID NO: 2722012 - DNA, 23 bp, Homo sapiens
ctcaccaggggcaggcacagcac

SEQ ID NO: 2722013 - DNA, 14 bp, Homo sapiens
ctcacgactcttcc

SEQ ID NO: 2722014 - DNA, 17 bp, Homo sapiens
ctcacgactcttcctgc

SEQ ID NO: 2722015 - DNA, 15 bp, Homo sapiens
ctcacgctctggaca

SEQ ID NO: 2722016 - DNA, 18 bp, Homo sapiens
ctcacgtgaccagccccg

SEQ ID NO: 2722017 - DNA, 11 bp, Homo sapiens
ctcagaagcct

SEQ ID NO: 2722018 - DNA, 14 bp, Homo sapiens
ctcagaagcctgag

SEQ ID NO: 2722019 - DNA, 15 bp, Homo sapiens
ctcagaagcctgagg

SEQ ID NO: 2722020 - DNA, 16 bp, Homo sapiens
ctcagaagcctgaggc

SEQ ID NO: 2722021 - DNA, 17 bp, Homo sapiens
ctcagaagcctgaggct

SEQ ID NO: 2722022 - DNA, 14 bp, Homo sapiens
ctcagacattccaa

SEQ ID NO: 2722023 - DNA, 14 bp, Homo sapiens
ctcagactcctggc

SEQ ID NO: 2722024 - DNA, 16 bp, Homo sapiens
ctcagactcctggctt

SEQ ID NO: 2722025 - DNA, 21 bp, Homo sapiens
ctcagactcctggcttcatgt

SEQ ID NO: 2722026 - DNA, 16 bp, Homo sapiens
ctcagagcagcactgg

SEQ ID NO: 2722027 - DNA, 17 bp, Homo sapiens
ctcagagcctcagcttc

SEQ ID NO: 2722028 - DNA, 18 bp, Homo sapiens
ctcagagcctcagcttct

SEQ ID NO: 2722029 - DNA, 21 bp, Homo sapiens
ctcagagcctcagcttctggg

SEQ ID NO: 2722030 - DNA, 11 bp, Homo sapiens
ctcagagctgc

SEQ ID NO: 2722031 - DNA, 12 bp, Homo sapiens
ctcagagctgcg

SEQ ID NO: 2722032 - DNA, 14 bp, Homo sapiens
ctcagagctgcggg

SEQ ID NO: 2722033 - DNA, 15 bp, Homo sapiens
ctcagagctgcgggc

SEQ ID NO: 2722034 - DNA, 15 bp, Homo sapiens
ctcagagctgctgag

SEQ ID NO: 2722035 - DNA, 23 bp, Homo sapiens
ctcagagcttttcgaactgtgct

SEQ ID NO: 2722036 - DNA, 12 bp, Homo sapiens
ctcagatcctgg

SEQ ID NO: 2722037 - DNA, 20 bp, Homo sapiens
ctcagatcctgggcatgatg

SEQ ID NO: 2722038 - DNA, 19 bp, Homo sapiens
ctcagcaatagggtgcagt

SEQ ID NO: 2722039 - DNA, 11 bp, Homo sapiens
ctcagcagccc

SEQ ID NO: 2722040 - DNA, 12 bp, Homo sapiens
ctcagcagcccc

SEQ ID NO: 2722041 - DNA, 16 bp, Homo sapiens
ctcagccagccctgga

SEQ ID NO: 2722042 - DNA, 13 bp, Homo sapiens
ctcagcctcctga

SEQ ID NO: 2722043 - DNA, 21 bp, Homo sapiens
cctccaagtccacagtggaac

SEQ ID NO: 2722044 - DNA, 15 bp, Homo sapiens
cctccacagccgcag

SEQ ID NO: 2722045 - DNA, 17 bp, Homo sapiens
cctccacagccgcagcc

SEQ ID NO: 2722046 - DNA, 19 bp, Homo sapiens
cctccaccgccatggcttc

SEQ ID NO: 2722047 - DNA, 15 bp, Homo sapiens
cctccacctcctggg

SEQ ID NO: 2722048 - DNA, 13 bp, Homo sapiens
cctccactcccac

SEQ ID NO: 2722049 - DNA, 16 bp, Homo sapiens
cctccagtcctgctgg

SEQ ID NO: 2722050 - DNA, 19 bp, Homo sapiens
cctccagtcctgctggcct

SEQ ID NO: 2722051 - DNA, 12 bp, Homo sapiens
cctccagtgctg

SEQ ID NO: 2722052 - DNA, 16 bp, Homo sapiens
cctccagtgctggctg

SEQ ID NO: 2722053 - DNA, 11 bp, Homo sapiens
cctccagtggg

SEQ ID NO: 2722054 - DNA, 23 bp, Homo sapiens
cctccagtgggaggacagagccg

SEQ ID NO: 2722055 - DNA, 11 bp, Homo sapiens
cctcccagctg

SEQ ID NO: 2722056 - DNA, 21 bp, Homo sapiens
cctcccagtgagaagggcctg

SEQ ID NO: 2722057 - DNA, 23 bp, Homo sapiens
cctcccagtgagaagggcctgct

SEQ ID NO: 2722058 - DNA, 21 bp, Homo sapiens
cctccccattagagtcagcct

SEQ ID NO: 2722059 - DNA, 21 bp, Homo sapiens
cctcccccacgtctctctgcc

SEQ ID NO: 2722060 - DNA, 14 bp, Homo sapiens
cctcccccagagcc

SEQ ID NO: 2722061 - DNA, 23 bp, Homo sapiens
cctccccctaccgcatggcagct

SEQ ID NO: 2722062 - DNA, 21 bp, Homo sapiens
cctccccgaaaacccccagca

SEQ ID NO: 2722063 - DNA, 9 bp, Homo sapiens
cctcccctg

SEQ ID NO: 2722064 - DNA, 20 bp, Homo sapiens
cctcccctgaggatcccctg

SEQ ID NO: 2722065 - DNA, 21 bp, Homo sapiens
cctcccctgccgcctcccggg

SEQ ID NO: 2722066 - DNA, 11 bp, Homo sapiens
cctcccgcccc

SEQ ID NO: 2722067 - DNA, 19 bp, Homo sapiens
cctcccgggaagcatcctc

SEQ ID NO: 2722068 - DNA, 20 bp, Homo sapiens
cctcccgtctactcattccc

SEQ ID NO: 2722069 - DNA, 14 bp, Homo sapiens
cctccctctgacct

SEQ ID NO: 2722070 - DNA, 18 bp, Homo sapiens
cctccctctgacctgcag

SEQ ID NO: 2722071 - DNA, 19 bp, Homo sapiens
cctccctctgacctgcagg

SEQ ID NO: 2722072 - DNA, 14 bp, Homo sapiens
cctccctgctgtcc

SEQ ID NO: 2722073 - DNA, 15 bp, Homo sapiens
cctccctgctgtccc

SEQ ID NO: 2722074 - DNA, 20 bp, Homo sapiens
cctcccttgagtaggccctg

SEQ ID NO: 2722075 - DNA, 19 bp, Homo sapiens
cctcctacccctcccagct

SEQ ID NO: 2722076 - DNA, 16 bp, Homo sapiens
cctcctatccttggag

SEQ ID NO: 2722077 - DNA, 19 bp, Homo sapiens
cctcctatccttggagagc

SEQ ID NO: 2722078 - DNA, 16 bp, Homo sapiens
cctcctcacactccag

SEQ ID NO: 2722079 - DNA, 18 bp, Homo sapiens
cctcctcacactccagaa

SEQ ID NO: 2722080 - DNA, 12 bp, Homo sapiens
cctcctccactc

SEQ ID NO: 2722081 - DNA, 13 bp, Homo sapiens
cctcctcctcatt

SEQ ID NO: 2722082 - DNA, 16 bp, Homo sapiens
cctcctctccatgcaa

SEQ ID NO: 2722083 - DNA, 23 bp, Homo sapiens
cctcctctccatgcaagtgctgt

SEQ ID NO: 2722084 - DNA, 12 bp, Homo sapiens
cctcctgccagc

SEQ ID NO: 2722085 - DNA, 16 bp, Homo sapiens
cctcctgccagctctg

SEQ ID NO: 2722086 - DNA, 20 bp, Homo sapiens
cctcctgccagctctgtcac

SEQ ID NO: 2722087 - DNA, 18 bp, Homo sapiens
cctcctgctgcagagggg

SEQ ID NO: 2722088 - DNA, 21 bp, Homo sapiens
cctcctgctgcagaggggcag

SEQ ID NO: 2722089 - DNA, 21 bp, Homo sapiens
cctcctgggtttaagcaatgc

SEQ ID NO: 2722090 - DNA, 20 bp, Homo sapiens
cctccttccttgctgtccta

SEQ ID NO: 2722091 - DNA, 12 bp, Homo sapiens
cctcgcccaccg

SEQ ID NO: 2722092 - DNA, 13 bp, Homo sapiens
cctcgcccaccgc

SEQ ID NO: 2722093 - DNA, 15 bp, Homo sapiens
cctcggaggctcctc

SEQ ID NO: 2722094 - DNA, 16 bp, Homo sapiens
cctcggaggctcctcc

SEQ ID NO: 2722095 - DNA, 18 bp, Homo sapiens
cctcggaggctcctccct

SEQ ID NO: 2722096 - DNA, 19 bp, Homo sapiens
cctcggaggctcctccctc

SEQ ID NO: 2722097 - DNA, 15 bp, Homo sapiens
cctcggcccatctgt

SEQ ID NO: 2722098 - DNA, 15 bp, Homo sapiens
cctcggcctccagac

SEQ ID NO: 2722099 - DNA, 18 bp, Homo sapiens
cctcggctcctgctgcac

SEQ ID NO: 2722100 - DNA, 20 bp, Homo sapiens
cctcggctcctgctgcacca

SEQ ID NO: 2722101 - DNA, 21 bp, Homo sapiens
cctcgggatgaaaagccatat

SEQ ID NO: 2722102 - DNA, 15 bp, Homo sapiens
cctcggtactcccat

SEQ ID NO: 2722103 - DNA, 19 bp, Homo sapiens
cctcgtgatttgcctgcct

SEQ ID NO: 2722104 - DNA, 14 bp, Homo sapiens
cctcgtgccagtcg

SEQ ID NO: 2722105 - DNA, 15 bp, Homo sapiens
cctcgtttgatagtg

SEQ ID NO: 2722106 - DNA, 16 bp, Homo sapiens
cctctaactccctcct

SEQ ID NO: 2722107 - DNA, 17 bp, Homo sapiens
cctctagaacacccact

SEQ ID NO: 2722108 - DNA, 20 bp, Homo sapiens
cctctagaacacccactggc

SEQ ID NO: 2722109 - DNA, 22 bp, Homo sapiens
cctctagaacacccactggcca

SEQ ID NO: 2722110 - DNA, 14 bp, Homo sapiens
cctctagtgccctc

SEQ ID NO: 2722111 - DNA, 14 bp, Homo sapiens
cctctatttcttta

SEQ ID NO: 2722112 - DNA, 15 bp, Homo sapiens
cctctcagagcctca

SEQ ID NO: 2722113 - DNA, 17 bp, Homo sapiens
cctctcagagcctcagc

SEQ ID NO: 2722114 - DNA, 19 bp, Homo sapiens
cctctcagagcctcagctt

SEQ ID NO: 2722115 - DNA, 23 bp, Homo sapiens
cctctccacctagtggctgtcca

SEQ ID NO: 2722116 - DNA, 12 bp, Homo sapiens
cctctccactgt

SEQ ID NO: 2722117 - DNA, 13 bp, Homo sapiens
cctctccatgcaa

SEQ ID NO: 2722118 - DNA, 15 bp, Homo sapiens
cctctccatgcaagt

SEQ ID NO: 2722119 - DNA, 18 bp, Homo sapiens
cctctccatgcaagtgct

SEQ ID NO: 2722120 - DNA, 23 bp, Homo sapiens
cctctccatgcaagtgctgtttg

SEQ ID NO: 2722121 - DNA, 18 bp, Homo sapiens
cctctcgccctggccagg

SEQ ID NO: 2722122 - DNA, 17 bp, Homo sapiens
cctctcggaaggctggc

SEQ ID NO: 2722123 - DNA, 14 bp, Homo sapiens
cctctcttctgtgt

SEQ ID NO: 2722124 - DNA, 18 bp, Homo sapiens
cctctgaatgtcccagag

SEQ ID NO: 2722125 - DNA, 15 bp, Homo sapiens
cctctgacctgcagg

SEQ ID NO: 2722126 - DNA, 20 bp, Homo sapiens
cctctgacctgcaggccaag

SEQ ID NO: 2722127 - DNA, 14 bp, Homo sapiens
cctctgagccgcag

SEQ ID NO: 2722128 - DNA, 20 bp, Homo sapiens
cctctgcccagcctgcccca

SEQ ID NO: 2722129 - DNA, 14 bp, Homo sapiens
cctctgcccgcaga

SEQ ID NO: 2722130 - DNA, 13 bp, Homo sapiens
cctctgcctcatc

SEQ ID NO: 2722131 - DNA, 18 bp, Homo sapiens
cctctgcctcatcctcct

SEQ ID NO: 2722132 - DNA, 21 bp, Homo sapiens
cctctgcctcatcctcctcct

SEQ ID NO: 2722133 - DNA, 17 bp, Homo sapiens
cctctgctgctttccaa

SEQ ID NO: 2722134 - DNA, 16 bp, Homo sapiens
cctctgcttcctgagc

SEQ ID NO: 2722135 - DNA, 17 bp, Homo sapiens
cctctgtccagccagct

SEQ ID NO: 2722136 - DNA, 22 bp, Homo sapiens
cctctgtccagccagctcctgc

SEQ ID NO: 2722137 - DNA, 14 bp, Homo sapiens
cctctgtcctgact

SEQ ID NO: 2722138 - DNA, 22 bp, Homo sapiens
cctctgtcctgacttcaggggc

SEQ ID NO: 2722139 - DNA, 20 bp, Homo sapiens
ccagctcctggtagctgatg

SEQ ID NO: 2722140 - DNA, 17 bp, Homo sapiens
ccagctctgtcaccctg

SEQ ID NO: 2722141 - DNA, 20 bp, Homo sapiens
ccagctctgtcaccctggcc

SEQ ID NO: 2722142 - DNA, 22 bp, Homo sapiens
ccagctctgtcaccctggccac

SEQ ID NO: 2722143 - DNA, 22 bp, Homo sapiens
ccagctgacagtcctctccacc

SEQ ID NO: 2722144 - DNA, 23 bp, Homo sapiens
ccagctgacagtcctctccacct

SEQ ID NO: 2722145 - DNA, 17 bp, Homo sapiens
ccagctgcacctgccag

SEQ ID NO: 2722146 - DNA, 23 bp, Homo sapiens
ccagctgcacctgccagcctggc

SEQ ID NO: 2722147 - DNA, 12 bp, Homo sapiens
ccagctggcctc

SEQ ID NO: 2722148 - DNA, 14 bp, Homo sapiens
ccagcttccctctg

SEQ ID NO: 2722149 - DNA, 19 bp, Homo sapiens
ccagcttcctctgagccgc

SEQ ID NO: 2722150 - DNA, 16 bp, Homo sapiens
ccaggaagggagggag

SEQ ID NO: 2722151 - DNA, 22 bp, Homo sapiens
ccaggaagggagggagctgagg

SEQ ID NO: 2722152 - DNA, 16 bp, Homo sapiens
ccaggacggggccggc

SEQ ID NO: 2722153 - DNA, 19 bp, Homo sapiens
ccaggacggggccggccag

SEQ ID NO: 2722154 - DNA, 20 bp, Homo sapiens
ccaggacggggccggccagg

SEQ ID NO: 2722155 - DNA, 19 bp, Homo sapiens
ccaggactccttagactga

SEQ ID NO: 2722156 - DNA, 22 bp, Homo sapiens
ccaggactggggcttgccaggc

SEQ ID NO: 2722157 - DNA, 23 bp, Homo sapiens
ccaggactggggcttgccaggct

SEQ ID NO: 2722158 - DNA, 19 bp, Homo sapiens
ccaggagcaaccgtgcagc

SEQ ID NO: 2722159 - DNA, 23 bp, Homo sapiens
ccaggattcccagagagacgctg

SEQ ID NO: 2722160 - DNA, 15 bp, Homo sapiens
ccaggattggcacaa

SEQ ID NO: 2722161 - DNA, 15 bp, Homo sapiens
ccaggcacatggctg

SEQ ID NO: 2722162 - DNA, 17 bp, Homo sapiens
ccaggcagctccagctg

SEQ ID NO: 2722163 - DNA, 16 bp, Homo sapiens
ccaggcagctcgagca

SEQ ID NO: 2722164 - DNA, 16 bp, Homo sapiens
ccaggccacaaatgtg

SEQ ID NO: 2722165 - DNA, 15 bp, Homo sapiens
ccaggcgggcggcac

SEQ ID NO: 2722166 - DNA, 23 bp, Homo sapiens
ccaggcgggcggcacgccaacag

SEQ ID NO: 2722167 - DNA, 12 bp, Homo sapiens
ccaggctgctgc

SEQ ID NO: 2722168 - DNA, 15 bp, Homo sapiens
ccaggctggccagcc

SEQ ID NO: 2722169 - DNA, 17 bp, Homo sapiens
ccaggctggccagcccc

SEQ ID NO: 2722170 - DNA, 21 bp, Homo sapiens
ccaggctggccagccccacag

SEQ ID NO: 2722171 - DNA, 22 bp, Homo sapiens
ccaggctggccagccccacagc

SEQ ID NO: 2722172 - DNA, 23 bp, Homo sapiens
ccaggctggccagccccacagcc

SEQ ID NO: 2722173 - DNA, 22 bp, Homo sapiens
ccaggctgtaagcattctgagc

SEQ ID NO: 2722174 - DNA, 18 bp, Homo sapiens
ccaggcttctcccggacc

SEQ ID NO: 2722175 - DNA, 13 bp, Homo sapiens
ccagggacagaag

SEQ ID NO: 2722176 - DNA, 18 bp, Homo sapiens
ccagggacagaagcagga

SEQ ID NO: 2722177 - DNA, 13 bp, Homo sapiens
ccagggcacagct

SEQ ID NO: 2722178 - DNA, 14 bp, Homo sapiens
ccagggcacagctg

SEQ ID NO: 2722179 - DNA, 18 bp, Homo sapiens
ccagggccagcaggcagc

SEQ ID NO: 2722180 - DNA, 22 bp, Homo sapiens
ccagggccagcaggcagcgcct

SEQ ID NO: 2722181 - DNA, 14 bp, Homo sapiens
ccagggccctgcag

SEQ ID NO: 2722182 - DNA, 13 bp, Homo sapiens
ccagggcttgtgg

SEQ ID NO: 2722183 - DNA, 16 bp, Homo sapiens
ccagggcttgtggact

SEQ ID NO: 2722184 - DNA, 17 bp, Homo sapiens
ccaggggagggaaaagc

SEQ ID NO: 2722185 - DNA, 19 bp, Homo sapiens
ccaggggagggaaaagcta

SEQ ID NO: 2722186 - DNA, 21 bp, Homo sapiens
ccaggggtaccaggcacatgg

SEQ ID NO: 2722187 - DNA, 21 bp, Homo sapiens
ccagggtcccagcctggccac

SEQ ID NO: 2722188 - DNA, 16 bp, Homo sapiens
ccaggtaactttgctt

SEQ ID NO: 2722189 - DNA, 16 bp, Homo sapiens
ccaggtctcctccacc

SEQ ID NO: 2722190 - DNA, 19 bp, Homo sapiens
ccaggtcttgttcaagcag

SEQ ID NO: 2722191 - DNA, 23 bp, Homo sapiens
ccaggtgggcgggcagcacagca

SEQ ID NO: 2722192 - DNA, 14 bp, Homo sapiens
ccaggttggaaaag

SEQ ID NO: 2722193 - DNA, 23 bp, Homo sapiens
ccaggttggaaaagaaatcaatt

SEQ ID NO: 2722194 - DNA, 22 bp, Homo sapiens
ccagtacagagaaattctgtgg

SEQ ID NO: 2722195 - DNA, 19 bp, Homo sapiens
ccagtcctagagctcctgt

SEQ ID NO: 2722196 - DNA, 13 bp, Homo sapiens
ccagtcctgctgg

SEQ ID NO: 2722197 - DNA, 16 bp, Homo sapiens
ccagtcctgctggcct

SEQ ID NO: 2722198 - DNA, 19 bp, Homo sapiens
ccagtcctgctggcctgct

SEQ ID NO: 2722199 - DNA, 22 bp, Homo sapiens
ccagtcctgctggcctgctctt

SEQ ID NO: 2722200 - DNA, 18 bp, Homo sapiens
ccagtcctttgttgctgt

SEQ ID NO: 2722201 - DNA, 21 bp, Homo sapiens
ccagtcctttgttgctgttgc

SEQ ID NO: 2722202 - DNA, 15 bp, Homo sapiens
ccagtcgcgctgcct

SEQ ID NO: 2722203 - DNA, 17 bp, Homo sapiens
ccagtcgcgctgcctgt

SEQ ID NO: 2722204 - DNA, 22 bp, Homo sapiens
ccctctttgtgtacttcagtct

SEQ ID NO: 2722205 - DNA, 18 bp, Homo sapiens
ccctgaccttctccaggg

SEQ ID NO: 2722206 - DNA, 13 bp, Homo sapiens
ccctgactctctg

SEQ ID NO: 2722207 - DNA, 18 bp, Homo sapiens
ccctgactctctgtgacc

SEQ ID NO: 2722208 - DNA, 15 bp, Homo sapiens
ccctgagctctctga

SEQ ID NO: 2722209 - DNA, 16 bp, Homo sapiens
ccctgaggatcccctg

SEQ ID NO: 2722210 - DNA, 20 bp, Homo sapiens
ccctgaggctggcatcctgg

SEQ ID NO: 2722211 - DNA, 21 bp, Homo sapiens
ccctgagttgcaccattcttt

SEQ ID NO: 2722212 - DNA, 23 bp, Homo sapiens
ccctgagttgcaccattctttct

SEQ ID NO: 2722213 - DNA, 16 bp, Homo sapiens
ccctgatccagacaag

SEQ ID NO: 2722214 - DNA, 13 bp, Homo sapiens
ccctgcactgtcc

SEQ ID NO: 2722215 - DNA, 10 bp, Homo sapiens
ccctgcccct

SEQ ID NO: 2722216 - DNA, 19 bp, Homo sapiens
ccctgcccctccccctacc

SEQ ID NO: 2722217 - DNA, 13 bp, Homo sapiens
ccctgccgcctcc

SEQ ID NO: 2722218 - DNA, 15 bp, Homo sapiens
ccctgccgcctcccg

SEQ ID NO: 2722219 - DNA, 18 bp, Homo sapiens
ccctgccgcctcccggga

SEQ ID NO: 2722220 - DNA, 12 bp, Homo sapiens
ccctgcctgctg

SEQ ID NO: 2722221 - DNA, 14 bp, Homo sapiens
ccctgcctgctgtg

SEQ ID NO: 2722222 - DNA, 15 bp, Homo sapiens
ccctgcctgctgtgg

SEQ ID NO: 2722223 - DNA, 16 bp, Homo sapiens
ccctgcctgctgtgga

SEQ ID NO: 2722224 - DNA, 21 bp, Homo sapiens
ccctgcctgctgtggagccca

SEQ ID NO: 2722225 - DNA, 19 bp, Homo sapiens
ccctgcgaaggggccctgg

SEQ ID NO: 2722226 - DNA, 21 bp, Homo sapiens
ccctgcgaaggggccctggtc

SEQ ID NO: 2722227 - DNA, 17 bp, Homo sapiens
ccctgctgtcccctctt

SEQ ID NO: 2722228 - DNA, 15 bp, Homo sapiens
ccctggaacctttcc

SEQ ID NO: 2722229 - DNA, 19 bp, Homo sapiens
ccctggaacctttcccttg

SEQ ID NO: 2722230 - DNA, 21 bp, Homo sapiens
ccctggaacctttcccttgtg

SEQ ID NO: 2722231 - DNA, 22 bp, Homo sapiens
ccctggaatacgatcctgcagg

SEQ ID NO: 2722232 - DNA, 16 bp, Homo sapiens
ccctggaggctggatg

SEQ ID NO: 2722233 - DNA, 13 bp, Homo sapiens
ccctggccaccac

SEQ ID NO: 2722234 - DNA, 22 bp, Homo sapiens
ccctggccctcaaggcctccca

SEQ ID NO: 2722235 - DNA, 23 bp, Homo sapiens
ccctggctgaacagtgctctgcc

SEQ ID NO: 2722236 - DNA, 12 bp, Homo sapiens
ccctgggcctca

SEQ ID NO: 2722237 - DNA, 14 bp, Homo sapiens
ccctgggctctgtg

SEQ ID NO: 2722238 - DNA, 12 bp, Homo sapiens
ccctggggcact

SEQ ID NO: 2722239 - DNA, 13 bp, Homo sapiens
ccctggggcactc

SEQ ID NO: 2722240 - DNA, 14 bp, Homo sapiens
ccctggggcactcc

SEQ ID NO: 2722241 - DNA, 16 bp, Homo sapiens
ccctggtaggaaagca

SEQ ID NO: 2722242 - DNA, 18 bp, Homo sapiens
ccctggtgagggagcctc

SEQ ID NO: 2722243 - DNA, 15 bp, Homo sapiens
ccctggtgcagaggt

SEQ ID NO: 2722244 - DNA, 18 bp, Homo sapiens
ccctgtgactatggctct

SEQ ID NO: 2722245 - DNA, 15 bp, Homo sapiens
ccctgtggggcctga

SEQ ID NO: 2722246 - DNA, 19 bp, Homo sapiens
ccctgttctaactcttaga

SEQ ID NO: 2722247 - DNA, 19 bp, Homo sapiens
cccttccatttctactgta

SEQ ID NO: 2722248 - DNA, 18 bp, Homo sapiens
cccttgcccttcctgacc

SEQ ID NO: 2722249 - DNA, 16 bp, Homo sapiens
cccttgtccctggggc

SEQ ID NO: 2722250 - DNA, 23 bp, Homo sapiens
cccttgtgtgtaccacaccctgc

SEQ ID NO: 2722251 - DNA, 12 bp, Homo sapiens
cccttgtgtgtg

SEQ ID NO: 2722252 - DNA, 23 bp, Homo sapiens
ccctttaaaggtcgcacctcctt

SEQ ID NO: 2722253 - DNA, 20 bp, Homo sapiens
ccctttgcaggcccagcaga

SEQ ID NO: 2722254 - DNA, 23 bp, Homo sapiens
ccctttttgcaggggactgggcc

SEQ ID NO: 2722255 - DNA, 14 bp, Homo sapiens
ccgaccccatctca

SEQ ID NO: 2722256 - DNA, 20 bp, Homo sapiens
ccgacttgaattttcccact

SEQ ID NO: 2722257 - DNA, 16 bp, Homo sapiens
ccgacttgggaggaca

SEQ ID NO: 2722258 - DNA, 16 bp, Homo sapiens
ccgagggatgatgcca

SEQ ID NO: 2722259 - DNA, 16 bp, Homo sapiens
ccgcagctgctgccac

SEQ ID NO: 2722260 - DNA, 12 bp, Homo sapiens
ccgcatggcagc

SEQ ID NO: 2722261 - DNA, 15 bp, Homo sapiens
ccgcatggcagctgg

SEQ ID NO: 2722262 - DNA, 16 bp, Homo sapiens
ccgcatggcagctggg

SEQ ID NO: 2722263 - DNA, 17 bp, Homo sapiens
ccgcatggcagctgggc

SEQ ID NO: 2722264 - DNA, 20 bp, Homo sapiens
ccgcatggcagctgggccca

SEQ ID NO: 2722265 - DNA, 23 bp, Homo sapiens
ccgcatggcagctgggcccacag

SEQ ID NO: 2722266 - DNA, 17 bp, Homo sapiens
ccgcccagctgcacctg

SEQ ID NO: 2722267 - DNA, 18 bp, Homo sapiens
ccgcccaggctggccagc

SEQ ID NO: 2722268 - DNA, 19 bp, Homo sapiens
ccgccccttccccgaggga

SEQ ID NO: 2722269 - DNA, 15 bp, Homo sapiens
ccgccgcctcgccca

SEQ ID NO: 2722270 - DNA, 16 bp, Homo sapiens
ccgccgcctcgcccac

SEQ ID NO: 2722271 - DNA, 14 bp, Homo sapiens
ccgcctcgcccacc

SEQ ID NO: 2722272 - DNA, 17 bp, Homo sapiens
ccgcctcgcccaccgca

SEQ ID NO: 2722273 - DNA, 19 bp, Homo sapiens
ccgcctcgcccaccgcatg

SEQ ID NO: 2722274 - DNA, 15 bp, Homo sapiens
ccgcctcggcctccc

SEQ ID NO: 2722275 - DNA, 21 bp, Homo sapiens
ccgcgtagagagccgggcccc

SEQ ID NO: 2722276 - DNA, 12 bp, Homo sapiens
ccgctcccagtg

SEQ ID NO: 2722277 - DNA, 14 bp, Homo sapiens
ccgctcccagtgtc

SEQ ID NO: 2722278 - DNA, 19 bp, Homo sapiens
ccgctgcccggcgccctct

SEQ ID NO: 2722279 - DNA, 20 bp, Homo sapiens
ccgctggatggggagtctca

SEQ ID NO: 2722280 - DNA, 15 bp, Homo sapiens
ccgcttccagcttcc

SEQ ID NO: 2722281 - DNA, 18 bp, Homo sapiens
ccgcttgcctcggctcct

SEQ ID NO: 2722282 - DNA, 23 bp, Homo sapiens
ccggagggtgacccatttcagga

SEQ ID NO: 2722283 - DNA, 19 bp, Homo sapiens
ccggattggccctgcccct

SEQ ID NO: 2722284 - DNA, 21 bp, Homo sapiens
ccggattggccctgcccctcc

SEQ ID NO: 2722285 - DNA, 22 bp, Homo sapiens
ccggccacgtctgtgctctgtc

SEQ ID NO: 2722286 - DNA, 15 bp, Homo sapiens
ccggccaggtgggcg

SEQ ID NO: 2722287 - DNA, 18 bp, Homo sapiens
ccggcgccctctgtcctg

SEQ ID NO: 2722288 - DNA, 18 bp, Homo sapiens
ccgggaagcatcctcccc

SEQ ID NO: 2722289 - DNA, 21 bp, Homo sapiens
ccgggctcagggaccacagca

SEQ ID NO: 2722290 - DNA, 14 bp, Homo sapiens
ccgggtgccattcc

SEQ ID NO: 2722291 - DNA, 20 bp, Homo sapiens
ccgggtggggggagggcacc

SEQ ID NO: 2722292 - DNA, 16 bp, Homo sapiens
ccggtgtgcctgcagc

SEQ ID NO: 2722293 - DNA, 14 bp, Homo sapiens
ccgtctctgtcccg

SEQ ID NO: 2722294 - DNA, 18 bp, Homo sapiens
ccgtgaaaacactcgtgt

SEQ ID NO: 2722295 - DNA, 16 bp, Homo sapiens
ccgtgatttggaagag

SEQ ID NO: 2722296 - DNA, 22 bp, Homo sapiens
ccgtgatttggaagagaggcac

SEQ ID NO: 2722297 - DNA, 15 bp, Homo sapiens
ccgtggccccagcct

SEQ ID NO: 2722298 - DNA, 23 bp, Homo sapiens
ccgtggccccagcctggcccagc

SEQ ID NO: 2722299 - DNA, 15 bp, Homo sapiens
ccgtgggggcagggg

SEQ ID NO: 2722300 - DNA, 20 bp, Homo sapiens
ccgttgtctccctggccctc

SEQ ID NO: 2722301 - DNA, 11 bp, Homo sapiens
ccgtttacagt

SEQ ID NO: 2722302 - DNA, 12 bp, Homo sapiens
cctaagcctgtt

SEQ ID NO: 2722303 - DNA, 18 bp, Homo sapiens
cctaatcaagagtctctc

SEQ ID NO: 2722304 - DNA, 21 bp, Homo sapiens
cctaatcaagagtctctccag

SEQ ID NO: 2722305 - DNA, 23 bp, Homo sapiens
cctaatcaagagtctctccagcc

SEQ ID NO: 2722306 - DNA, 21 bp, Homo sapiens
cctaattcctggcatgacact

SEQ ID NO: 2722307 - DNA, 17 bp, Homo sapiens
cctacacccttggactt

SEQ ID NO: 2722308 - DNA, 22 bp, Homo sapiens
cctacagacagtatgtctactc

SEQ ID NO: 2722309 - DNA, 12 bp, Homo sapiens
cctacccactct

SEQ ID NO: 2722310 - DNA, 16 bp, Homo sapiens
cctacccactctttgc

SEQ ID NO: 2722311 - DNA, 17 bp, Homo sapiens
cctacccactctttgct

SEQ ID NO: 2722312 - DNA, 14 bp, Homo sapiens
cctacccctcccag

SEQ ID NO: 2722313 - DNA, 16 bp, Homo sapiens
cctacccctcccagct

SEQ ID NO: 2722314 - DNA, 21 bp, Homo sapiens
cctacccctcccagctgacag

SEQ ID NO: 2722315 - DNA, 15 bp, Homo sapiens
cctaccgcatggcag

SEQ ID NO: 2722316 - DNA, 12 bp, Homo sapiens
cctacctgcctg

SEQ ID NO: 2722317 - DNA, 19 bp, Homo sapiens
cctacctgcctgttctcca

SEQ ID NO: 2722318 - DNA, 16 bp, Homo sapiens
cctagaccctcctcct

SEQ ID NO: 2722319 - DNA, 13 bp, Homo sapiens
cctagagctcctg

SEQ ID NO: 2722320 - DNA, 14 bp, Homo sapiens
cctagagctcctgt

SEQ ID NO: 2722321 - DNA, 18 bp, Homo sapiens
cctagagctcctgtccct

SEQ ID NO: 2722322 - DNA, 19 bp, Homo sapiens
cctagagctcctgtcccta

SEQ ID NO: 2722323 - DNA, 21 bp, Homo sapiens
cctagagctcctgtccctacc

SEQ ID NO: 2722324 - DNA, 14 bp, Homo sapiens
cctagcccagcaga

SEQ ID NO: 2722325 - DNA, 16 bp, Homo sapiens
cctagctcttgggcct

SEQ ID NO: 2722326 - DNA, 22 bp, Homo sapiens
cctagctcttgggcctgacctc

SEQ ID NO: 2722327 - DNA, 16 bp, Homo sapiens
cctagtggctgtccag

SEQ ID NO: 2722328 - DNA, 17 bp, Homo sapiens
cctagtggctgtccagt

SEQ ID NO: 2722329 - DNA, 23 bp, Homo sapiens
cctagtggctgtccagtgcccat

SEQ ID NO: 2722330 - DNA, 23 bp, Homo sapiens
cctatcatcagttaggattaggt

SEQ ID NO: 2722331 - DNA, 21 bp, Homo sapiens
ccagtgagaagggcctgctct

SEQ ID NO: 2722332 - DNA, 22 bp, Homo sapiens
ccagtgagaagggcctgctctg

SEQ ID NO: 2722333 - DNA, 18 bp, Homo sapiens
ccagtgagcctctgcgcc

SEQ ID NO: 2722334 - DNA, 13 bp, Homo sapiens
ccagtgctggctg

SEQ ID NO: 2722335 - DNA, 19 bp, Homo sapiens
ccagtgctggctgctggcc

SEQ ID NO: 2722336 - DNA, 20 bp, Homo sapiens
ccagtgggaggacagagccg

SEQ ID NO: 2722337 - DNA, 16 bp, Homo sapiens
ccagtgtgtgctcagc

SEQ ID NO: 2722338 - DNA, 14 bp, Homo sapiens
ccagttctgatgag

SEQ ID NO: 2722339 - DNA, 14 bp, Homo sapiens
ccatactggcctcg

SEQ ID NO: 2722340 - DNA, 17 bp, Homo sapiens
ccatactggcctcgcct

SEQ ID NO: 2722341 - DNA, 21 bp, Homo sapiens
ccatactggcctcgcctggcc

SEQ ID NO: 2722342 - DNA, 16 bp, Homo sapiens
ccatattcacacctca

SEQ ID NO: 2722343 - DNA, 22 bp, Homo sapiens
ccatattcagtgctgtggcctg

SEQ ID NO: 2722344 - DNA, 19 bp, Homo sapiens
ccatattgctcttaaaaat

SEQ ID NO: 2722345 - DNA, 22 bp, Homo sapiens
ccatcagtgtacccccgcccag

SEQ ID NO: 2722346 - DNA, 19 bp, Homo sapiens
ccatcccccctcaccaggg

SEQ ID NO: 2722347 - DNA, 17 bp, Homo sapiens
ccatccctttttttaca

SEQ ID NO: 2722348 - DNA, 15 bp, Homo sapiens
ccatcctcctctcca

SEQ ID NO: 2722349 - DNA, 22 bp, Homo sapiens
ccatcctcctctccatgcaagt

SEQ ID NO: 2722350 - DNA, 13 bp, Homo sapiens
ccatcctggccca

SEQ ID NO: 2722351 - DNA, 17 bp, Homo sapiens
ccatctaagctgcagct

SEQ ID NO: 2722352 - DNA, 18 bp, Homo sapiens
ccatctcctcccatggcc

SEQ ID NO: 2722353 - DNA, 18 bp, Homo sapiens
ccatctcctttcagggaa

SEQ ID NO: 2722354 - DNA, 16 bp, Homo sapiens
ccatctgtccatcctc

SEQ ID NO: 2722355 - DNA, 19 bp, Homo sapiens
ccatctgtccatcctcctc

SEQ ID NO: 2722356 - DNA, 20 bp, Homo sapiens
ccatctgtccatcctcctct

SEQ ID NO: 2722357 - DNA, 22 bp, Homo sapiens
ccatctgtccatcctcctctcc

SEQ ID NO: 2722358 - DNA, 14 bp, Homo sapiens
ccatcttccaggtg

SEQ ID NO: 2722359 - DNA, 18 bp, Homo sapiens
ccatcttggcaaggttca

SEQ ID NO: 2722360 - DNA, 13 bp, Homo sapiens
ccatgaagacagg

SEQ ID NO: 2722361 - DNA, 19 bp, Homo sapiens
ccatgaagacaggacagtg

SEQ ID NO: 2722362 - DNA, 14 bp, Homo sapiens
ccatgatactttaa

SEQ ID NO: 2722363 - DNA, 19 bp, Homo sapiens
ccatgctggcggcgcagag

SEQ ID NO: 2722364 - DNA, 17 bp, Homo sapiens
ccatgggcactgctggg

SEQ ID NO: 2722365 - DNA, 15 bp, Homo sapiens
ccatgggcctgctgc

SEQ ID NO: 2722366 - DNA, 19 bp, Homo sapiens
ccatgggcgaccagggcca

SEQ ID NO: 2722367 - DNA, 21 bp, Homo sapiens
ccatgggtcctcggcccatct

SEQ ID NO: 2722368 - DNA, 19 bp, Homo sapiens
ccatgtcatgtgccacgac

SEQ ID NO: 2722369 - DNA, 17 bp, Homo sapiens
ccatgtgcacctatggc

SEQ ID NO: 2722370 - DNA, 21 bp, Homo sapiens
ccatgtgcacctatggcccag

SEQ ID NO: 2722371 - DNA, 22 bp, Homo sapiens
ccatgtgcatggaaatgtcctc

SEQ ID NO: 2722372 - DNA, 12 bp, Homo sapiens
ccatgtgctgct

SEQ ID NO: 2722373 - DNA, 15 bp, Homo sapiens
ccatgtgctgctgtg

SEQ ID NO: 2722374 - DNA, 16 bp, Homo sapiens
ccattagagtcagcct

SEQ ID NO: 2722375 - DNA, 13 bp, Homo sapiens
ccattattttatt

SEQ ID NO: 2722376 - DNA, 17 bp, Homo sapiens
ccattctcctgcctcag

SEQ ID NO: 2722377 - DNA, 22 bp, Homo sapiens
ccattctcctgcctcagcctcc

SEQ ID NO: 2722378 - DNA, 17 bp, Homo sapiens
ccattgctcacactact

SEQ ID NO: 2722379 - DNA, 16 bp, Homo sapiens
ccattgtcttccaacc

SEQ ID NO: 2722380 - DNA, 20 bp, Homo sapiens
ccattgtcttccaaccccag

SEQ ID NO: 2722381 - DNA, 16 bp, Homo sapiens
ccatttggcagaactg

SEQ ID NO: 2722382 - DNA, 13 bp, Homo sapiens
cccaaattcaaag

SEQ ID NO: 2722383 - DNA, 13 bp, Homo sapiens
cccaacccccagc

SEQ ID NO: 2722384 - DNA, 14 bp, Homo sapiens
cccaagtagctgag

SEQ ID NO: 2722385 - DNA, 19 bp, Homo sapiens
cccaagtagtagtgtcttc

SEQ ID NO: 2722386 - DNA, 22 bp, Homo sapiens
cccaagtagtagtgtcttccta

SEQ ID NO: 2722387 - DNA, 18 bp, Homo sapiens
cccaagtgccagtcttgt

SEQ ID NO: 2722388 - DNA, 13 bp, Homo sapiens
cccacacacactc

SEQ ID NO: 2722389 - DNA, 18 bp, Homo sapiens
cccacacacactccttcc

SEQ ID NO: 2722390 - DNA, 21 bp, Homo sapiens
cccacacacactccttcccct

SEQ ID NO: 2722391 - DNA, 19 bp, Homo sapiens
cccacagcccacgtcctgt

SEQ ID NO: 2722392 - DNA, 20 bp, Homo sapiens
cccacagctctgctggaaga

SEQ ID NO: 2722393 - DNA, 22 bp, Homo sapiens
cccacagtcctcacagcctctc

SEQ ID NO: 2722394 - DNA, 18 bp, Homo sapiens
cccaccaaggtctcacac

SEQ ID NO: 2722395 - DNA, 23 bp, Homo sapiens
cccaccaaggtctcacactcctc

SEQ ID NO: 2722396 - DNA, 23 bp, Homo sapiens
cccacccagggctccctcctgga

SEQ ID NO: 2722397 - DNA, 16 bp, Homo sapiens
cccaccccagcacagc

SEQ ID NO: 2722398 - DNA, 12 bp, Homo sapiens
cccaccctgggt

SEQ ID NO: 2722399 - DNA, 20 bp, Homo sapiens
cccaccgcatgccccctcgt

SEQ ID NO: 2722400 - DNA, 19 bp, Homo sapiens
cccaccttcaattcctggg

SEQ ID NO: 2722401 - DNA, 21 bp, Homo sapiens
cccaccttcaattcctgggcc

SEQ ID NO: 2722402 - DNA, 21 bp, Homo sapiens
cccacctttgggatcagcctc

SEQ ID NO: 2722403 - DNA, 19 bp, Homo sapiens
cccacgtcctgtcagtgcc

SEQ ID NO: 2722404 - DNA, 12 bp, Homo sapiens
cccacgtctctc

SEQ ID NO: 2722405 - DNA, 13 bp, Homo sapiens
cccacgtctctct

SEQ ID NO: 2722406 - DNA, 17 bp, Homo sapiens
cccacgtctctctgcct

SEQ ID NO: 2722407 - DNA, 24 bp, Homo sapiens
cccacgtctctctgcctgctgggc

SEQ ID NO: 2722408 - DNA, 21 bp, Homo sapiens
cccacgtgcacagcttcctga

SEQ ID NO: 2722409 - DNA, 19 bp, Homo sapiens
cccactaagctttctcctt

SEQ ID NO: 2722410 - DNA, 20 bp, Homo sapiens
cccactaagctttctccttt

SEQ ID NO: 2722411 - DNA, 16 bp, Homo sapiens
cccactgcaccccctc

SEQ ID NO: 2722412 - DNA, 20 bp, Homo sapiens
cccactgcaccccctcctgc

SEQ ID NO: 2722413 - DNA, 12 bp, Homo sapiens
cccactggccag

SEQ ID NO: 2722414 - DNA, 13 bp, Homo sapiens
cccactggccagt

SEQ ID NO: 2722415 - DNA, 22 bp, Homo sapiens
cccactggccagtcctagagct

SEQ ID NO: 2722416 - DNA, 19 bp, Homo sapiens
cccacttcccctcctaccc

SEQ ID NO: 2722417 - DNA, 23 bp, Homo sapiens
cccacttcccctcctacccctcc

SEQ ID NO: 2722418 - DNA, 17 bp, Homo sapiens
cccacttccctgacact

SEQ ID NO: 2722419 - DNA, 21 bp, Homo sapiens
cccactttttttttttctgcc

SEQ ID NO: 2722420 - DNA, 16 bp, Homo sapiens
cccagacagctggacc

SEQ ID NO: 2722421 - DNA, 19 bp, Homo sapiens
cccagagagacgctgtgat

SEQ ID NO: 2722422 - DNA, 21 bp, Homo sapiens
cccagagctgtggactttgtt

SEQ ID NO: 2722423 - DNA, 15 bp, Homo sapiens
cccagagggcccagg

SEQ ID NO: 2722424 - DNA, 16 bp, Homo sapiens
cccagagggcccaggc

SEQ ID NO: 2722425 - DNA, 12 bp, Homo sapiens
cccagcacagct

SEQ ID NO: 2722426 - DNA, 14 bp, Homo sapiens
cccagcacagctcc

SEQ ID NO: 2722427 - DNA, 18 bp, Homo sapiens
cccagcacagctcctccc

SEQ ID NO: 2722428 - DNA, 22 bp, Homo sapiens
cccagcacagctcctcccctgc

SEQ ID NO: 2722429 - DNA, 21 bp, Homo sapiens
cccagcacccgggctcaggga

SEQ ID NO: 2722430 - DNA, 21 bp, Homo sapiens
cccagcatccttttctgcaga

SEQ ID NO: 2722431 - DNA, 10 bp, Homo sapiens
cccagccatt

SEQ ID NO: 2722432 - DNA, 19 bp, Homo sapiens
cccagccattaccatggag

SEQ ID NO: 2722433 - DNA, 20 bp, Homo sapiens
cccagccattaccatggaga

SEQ ID NO: 2722434 - DNA, 22 bp, Homo sapiens
cccagccattaccatggagaca

SEQ ID NO: 2722435 - DNA, 14 bp, Homo sapiens
cccagccgctgccc

SEQ ID NO: 2722436 - DNA, 12 bp, Homo sapiens
cccagcctgccc

SEQ ID NO: 2722437 - DNA, 21 bp, Homo sapiens
cccagcctgccccagcctccc

SEQ ID NO: 2722438 - DNA, 13 bp, Homo sapiens
cccagcctggccc

SEQ ID NO: 2722439 - DNA, 15 bp, Homo sapiens
cccagcctggcccag

SEQ ID NO: 2722440 - DNA, 17 bp, Homo sapiens
cccagcctggcccagct

SEQ ID NO: 2722441 - DNA, 19 bp, Homo sapiens
cccagcctgtcctggtaca

SEQ ID NO: 2722442 - DNA, 22 bp, Homo sapiens
cccagcctgtcctggtacagca

SEQ ID NO: 2722443 - DNA, 19 bp, Homo sapiens
cccagcggcagatgggcct

SEQ ID NO: 2722444 - DNA, 14 bp, Homo sapiens
cccagctaattttt

SEQ ID NO: 2722445 - DNA, 21 bp, Homo sapiens
cccagctactcagaagcctga

SEQ ID NO: 2722446 - DNA, 23 bp, Homo sapiens
cccagctactcagaagcctgagg

SEQ ID NO: 2722447 - DNA, 17 bp, Homo sapiens
cccagctgacagtcctc

SEQ ID NO: 2722448 - DNA, 22 bp, Homo sapiens
cccagctgacagtcctctccac

SEQ ID NO: 2722449 - DNA, 13 bp, Homo sapiens
cccagctgcacct

SEQ ID NO: 2722450 - DNA, 15 bp, Homo sapiens
cccaggaagggaggg

SEQ ID NO: 2722451 - DNA, 16 bp, Homo sapiens
cccaggaagggaggga

SEQ ID NO: 2722452 - DNA, 15 bp, Homo sapiens
cccaggattcccaga

SEQ ID NO: 2722453 - DNA, 17 bp, Homo sapiens
cccaggattcccagaga

SEQ ID NO: 2722454 - DNA, 14 bp, Homo sapiens
cccaggccacctgt

SEQ ID NO: 2722455 - DNA, 17 bp, Homo sapiens
cccaggctggagtgcaa

SEQ ID NO: 2722456 - DNA, 15 bp, Homo sapiens
cccaggctggccagc

SEQ ID NO: 2722457 - DNA, 20 bp, Homo sapiens
cccaggctggccagccccac

SEQ ID NO: 2722458 - DNA, 18 bp, Homo sapiens
cccagggaagccctcggc

SEQ ID NO: 2722459 - DNA, 22 bp, Homo sapiens
cccagggaagccctcggcctcc

SEQ ID NO: 2722460 - DNA, 15 bp, Homo sapiens
cccagggccagggcc

SEQ ID NO: 2722461 - DNA, 17 bp, Homo sapiens
cccagggccagggccct

SEQ ID NO: 2722462 - DNA, 21 bp, Homo sapiens
cccagggctccctcctggagc

SEQ ID NO: 2722463 - DNA, 17 bp, Homo sapiens
cccagtctgttccccat

SEQ ID NO: 2722464 - DNA, 21 bp, Homo sapiens
cccagtgagaagggcctgctc

SEQ ID NO: 2722465 - DNA, 14 bp, Homo sapiens
cccagtgctcctgt

SEQ ID NO: 2722466 - DNA, 19 bp, Homo sapiens
cccagtgctcctgtgcagg

SEQ ID NO: 2722467 - DNA, 16 bp, Homo sapiens
cccagtgtcttcctgt

SEQ ID NO: 2722468 - DNA, 17 bp, Homo sapiens
cccagtgtcttcctgtg

SEQ ID NO: 2722469 - DNA, 13 bp, Homo sapiens
cccagtgtgtgct

SEQ ID NO: 2722470 - DNA, 19 bp, Homo sapiens
cccagtgtgtgctcagcag

SEQ ID NO: 2722471 - DNA, 13 bp, Homo sapiens
cccatcagtgtac

SEQ ID NO: 2722472 - DNA, 21 bp, Homo sapiens
cccatcagtgtacccccgccc

SEQ ID NO: 2722473 - DNA, 17 bp, Homo sapiens
cccatccaactcctcta

SEQ ID NO: 2722474 - DNA, 22 bp, Homo sapiens
cccatctaagctgcagcttcct

SEQ ID NO: 2722475 - DNA, 20 bp, Homo sapiens
cccatctcctcccatggcct

SEQ ID NO: 2722476 - DNA, 15 bp, Homo sapiens
cccatctgcccagga

SEQ ID NO: 2722477 - DNA, 16 bp, Homo sapiens
cccatctgcccaggac

SEQ ID NO: 2722478 - DNA, 11 bp, Homo sapiens
cccatctgtcc

SEQ ID NO: 2722479 - DNA, 15 bp, Homo sapiens
cccatctgtccatcc

SEQ ID NO: 2722480 - DNA, 16 bp, Homo sapiens
cccatctgtccatcct

SEQ ID NO: 2722481 - DNA, 22 bp, Homo sapiens
cccatgaagacaggacagtgct

SEQ ID NO: 2722482 - DNA, 15 bp, Homo sapiens
cccatgggcactgct

SEQ ID NO: 2722483 - DNA, 20 bp, Homo sapiens
cccatgggcactgctgggtg

SEQ ID NO: 2722484 - DNA, 13 bp, Homo sapiens
cccattgtggagg

SEQ ID NO: 2722485 - DNA, 19 bp, Homo sapiens
ccccaaacgggctgccctg

SEQ ID NO: 2722486 - DNA, 12 bp, Homo sapiens
ccccacagccca

SEQ ID NO: 2722487 - DNA, 16 bp, Homo sapiens
ccccacagcccacgtc

SEQ ID NO: 2722488 - DNA, 22 bp, Homo sapiens
ccccacagcccacgtcctgtca

SEQ ID NO: 2722489 - DNA, 17 bp, Homo sapiens
ccccaccagagctgcct

SEQ ID NO: 2722490 - DNA, 12 bp, Homo sapiens
ccccaccctggg

SEQ ID NO: 2722491 - DNA, 13 bp, Homo sapiens
ccccaccctgggt

SEQ ID NO: 2722492 - DNA, 16 bp, Homo sapiens
ccccactcacagggag

SEQ ID NO: 2722493 - DNA, 18 bp, Homo sapiens
ccccactgccgcctcctt

SEQ ID NO: 2722494 - DNA, 14 bp, Homo sapiens
ccccagcacagctc

SEQ ID NO: 2722495 - DNA, 17 bp, Homo sapiens
ccccagcacagctcctc

SEQ ID NO: 2722496 - DNA, 14 bp, Homo sapiens
ccccagctccacct

SEQ ID NO: 2722497 - DNA, 14 bp, Homo sapiens
ccccagctggcctc

SEQ ID NO: 2722498 - DNA, 19 bp, Homo sapiens
ccccaggattcccagagag

SEQ ID NO: 2722499 - DNA, 13 bp, Homo sapiens
ccccatcctggcc

SEQ ID NO: 2722500 - DNA, 16 bp, Homo sapiens
ccccatcctggcccat

SEQ ID NO: 2722501 - DNA, 20 bp, Homo sapiens
ccccatctcctcccatggcc

SEQ ID NO: 2722502 - DNA, 14 bp, Homo sapiens
cccccaagccacag

SEQ ID NO: 2722503 - DNA, 22 bp, Homo sapiens
cccccacttcatgcccactgcc

SEQ ID NO: 2722504 - DNA, 16 bp, Homo sapiens
cccccaggattcccag

SEQ ID NO: 2722505 - DNA, 19 bp, Homo sapiens
cccccaggattcccagaga

SEQ ID NO: 2722506 - DNA, 15 bp, Homo sapiens
cccccatcctggccc

SEQ ID NO: 2722507 - DNA, 22 bp, Homo sapiens
cccccgggaggggcccgcttgc

SEQ ID NO: 2722508 - DNA, 23 bp, Homo sapiens
ccccctaccgcatggcagctggg

SEQ ID NO: 2722509 - DNA, 14 bp, Homo sapiens
ccccctcctgctgc

SEQ ID NO: 2722510 - DNA, 13 bp, Homo sapiens
ccccctgggctct

SEQ ID NO: 2722511 - DNA, 21 bp, Homo sapiens
ccccctggtggacagtcctgg

SEQ ID NO: 2722512 - DNA, 20 bp, Homo sapiens
cccccttgaatctgcaggga

SEQ ID NO: 2722513 - DNA, 22 bp, Homo sapiens
ccccgagggatgatgccacacc

SEQ ID NO: 2722514 - DNA, 14 bp, Homo sapiens
ccccggcttgcctg

SEQ ID NO: 2722515 - DNA, 22 bp, Homo sapiens
ccccgtgtagccccgggctgac

SEQ ID NO: 2722516 - DNA, 18 bp, Homo sapiens
cccctaccgcatggcagc

SEQ ID NO: 2722517 - DNA, 21 bp, Homo sapiens
cccctaccgcatggcagctgg

SEQ ID NO: 2722518 - DNA, 13 bp, Homo sapiens
cccctcacagact

SEQ ID NO: 2722519 - DNA, 16 bp, Homo sapiens
cccctcaccaggggca

SEQ ID NO: 2722520 - DNA, 12 bp, Homo sapiens
cccctcccagct

SEQ ID NO: 2722521 - DNA, 14 bp, Homo sapiens
cccctcccagctga

SEQ ID NO: 2722522 - DNA, 12 bp, Homo sapiens
cccctcccaggg

SEQ ID NO: 2722523 - DNA, 21 bp, Homo sapiens
cccctcccccacgtctctctg

SEQ ID NO: 2722524 - DNA, 22 bp, Homo sapiens
cccctcctgctgcagaggggca

SEQ ID NO: 2722525 - DNA, 13 bp, Homo sapiens
cccctcttgcccc

SEQ ID NO: 2722526 - DNA, 14 bp, Homo sapiens
cccctcttgcccca

SEQ ID NO: 2722527 - DNA, 18 bp, Homo sapiens
cccctgaggatcccctgt

SEQ ID NO: 2722528 - DNA, 12 bp, Homo sapiens
cccctgccgcct

SEQ ID NO: 2722529 - DNA, 12 bp, Homo sapiens
cccctggaacct

SEQ ID NO: 2722530 - DNA, 16 bp, Homo sapiens
cccctggggctggtgg

SEQ ID NO: 2722531 - DNA, 22 bp, Homo sapiens
cccctggggtctctgctgcatt

SEQ ID NO: 2722532 - DNA, 19 bp, Homo sapiens
cccctggtggacagtcctg

SEQ ID NO: 2722533 - DNA, 22 bp, Homo sapiens
cccctggtggacagtcctggga

SEQ ID NO: 2722534 - DNA, 23 bp, Homo sapiens
cccctggtggacagtcctgggag

SEQ ID NO: 2722535 - DNA, 14 bp, Homo sapiens
cccctgtcccctgg

SEQ ID NO: 2722536 - DNA, 18 bp, Homo sapiens
cccctgtcccctggggct

SEQ ID NO: 2722537 - DNA, 19 bp, Homo sapiens
cccctgtcccctggggctg

SEQ ID NO: 2722538 - DNA, 14 bp, Homo sapiens
ccccttctccagca

SEQ ID NO: 2722539 - DNA, 15 bp, Homo sapiens
ccccttgcccttcct

SEQ ID NO: 2722540 - DNA, 13 bp, Homo sapiens
ccccttgtccctg

SEQ ID NO: 2722541 - DNA, 19 bp, Homo sapiens
ccccttgtcctctcagagc

SEQ ID NO: 2722542 - DNA, 21 bp, Homo sapiens
ccccttgtcctctcagagcct

SEQ ID NO: 2722543 - DNA, 14 bp, Homo sapiens
cccgaccccatctc

SEQ ID NO: 2722544 - DNA, 18 bp, Homo sapiens
cccgcccaggctggccag

SEQ ID NO: 2722545 - DNA, 15 bp, Homo sapiens
cccgcgcctccttcc

SEQ ID NO: 2722546 - DNA, 12 bp, Homo sapiens
cccgctcccagt

SEQ ID NO: 2722547 - DNA, 16 bp, Homo sapiens
cccggcgccctctgtc

SEQ ID NO: 2722548 - DNA, 22 bp, Homo sapiens
cccgggaagcatcctccccacc

SEQ ID NO: 2722549 - DNA, 22 bp, Homo sapiens
cccgggaggggcccgcttgcct

SEQ ID NO: 2722550 - DNA, 14 bp, Homo sapiens
cccgggctgaccca

SEQ ID NO: 2722551 - DNA, 13 bp, Homo sapiens
cccggtgaggcca

SEQ ID NO: 2722552 - DNA, 17 bp, Homo sapiens
cccgtcgacgtagaacc

SEQ ID NO: 2722553 - DNA, 15 bp, Homo sapiens
cccgtggccccagcc

SEQ ID NO: 2722554 - DNA, 17 bp, Homo sapiens
cccgttgtctccctggc

SEQ ID NO: 2722555 - DNA, 19 bp, Homo sapiens
cccgttgtctccctggccc

SEQ ID NO: 2722556 - DNA, 13 bp, Homo sapiens
ccctacccactct

SEQ ID NO: 2722557 - DNA, 20 bp, Homo sapiens
ccctaccgcatggcagctgg

SEQ ID NO: 2722558 - DNA, 21 bp, Homo sapiens
ccctaccgcatggcagctggg

SEQ ID NO: 2722559 - DNA, 13 bp, Homo sapiens
ccctacctgcctg

SEQ ID NO: 2722560 - DNA, 13 bp, Homo sapiens
ccctagatccagg

SEQ ID NO: 2722561 - DNA, 22 bp, Homo sapiens
ccctcaaggcctcccacagtga

SEQ ID NO: 2722562 - DNA, 19 bp, Homo sapiens
ccctcacagactcttccac

SEQ ID NO: 2722563 - DNA, 17 bp, Homo sapiens
ccctcccagctgacagt

SEQ ID NO: 2722564 - DNA, 22 bp, Homo sapiens
ccctcccagggccagggccctg

SEQ ID NO: 2722565 - DNA, 17 bp, Homo sapiens
ccctccccacagtcctc

SEQ ID NO: 2722566 - DNA, 18 bp, Homo sapiens
ccctccccacagtcctca

SEQ ID NO: 2722567 - DNA, 21 bp, Homo sapiens
ccctccccacagtcctcacag

SEQ ID NO: 2722568 - DNA, 23 bp, Homo sapiens
ccctcccccacgtctctctgcct

SEQ ID NO: 2722569 - DNA, 15 bp, Homo sapiens
ccctccctagatcca

SEQ ID NO: 2722570 - DNA, 19 bp, Homo sapiens
ccctccctagatccaggct

SEQ ID NO: 2722571 - DNA, 14 bp, Homo sapiens
ccctccctgctgtc

SEQ ID NO: 2722572 - DNA, 18 bp, Homo sapiens
ccctcctacccctcccag

SEQ ID NO: 2722573 - DNA, 13 bp, Homo sapiens
ccctcctcacact

SEQ ID NO: 2722574 - DNA, 12 bp, Homo sapiens
ccctcctgagcc

SEQ ID NO: 2722575 - DNA, 11 bp, Homo sapiens
ccctcctgctg

SEQ ID NO: 2722576 - DNA, 13 bp, Homo sapiens
ccctcgtgccagt

SEQ ID NO: 2722577 - DNA, 16 bp, Homo sapiens
ccctcgtgccagtcgc

SEQ ID NO: 2722578 - DNA, 12 bp, Homo sapiens
ccctctgcctca

SEQ ID NO: 2722579 - DNA, 14 bp, Homo sapiens
ccctctgcctcatc

SEQ ID NO: 2722580 - DNA, 16 bp, Homo sapiens
ccctctgcctcatcct

SEQ ID NO: 2722581 - DNA, 20 bp, Homo sapiens
ccctctgcctcatcctcctc

SEQ ID NO: 2722582 - DNA, 13 bp, Homo sapiens
ccctctgtcctga

SEQ ID NO: 2722583 - DNA, 14 bp, Homo sapiens
ccctctgtcctgac

SEQ ID NO: 2722584 - DNA, 12 bp, Homo sapiens
ccctcttgcccc

SEQ ID NO: 2722585 - DNA, 21 bp, Homo sapiens
ttgctcgaagactgtgacatc

SEQ ID NO: 2722586 - DNA, 14 bp, Homo sapiens
ttgctctggctgag

SEQ ID NO: 2722587 - DNA, 13 bp, Homo sapiens
ttgctcttaaaaa

SEQ ID NO: 2722588 - DNA, 12 bp, Homo sapiens
ttgctcttctgt

SEQ ID NO: 2722589 - DNA, 18 bp, Homo sapiens
ttgctgaatgtcattatt

SEQ ID NO: 2722590 - DNA, 13 bp, Homo sapiens
ttgctgctgtgga

SEQ ID NO: 2722591 - DNA, 19 bp, Homo sapiens
ttgctggaatctactagaa

SEQ ID NO: 2722592 - DNA, 17 bp, Homo sapiens
ttgctgtatacaaacag

SEQ ID NO: 2722593 - DNA, 20 bp, Homo sapiens
ttgctgtgctgtacattact

SEQ ID NO: 2722594 - DNA, 15 bp, Homo sapiens
ttgctgttgctgttg

SEQ ID NO: 2722595 - DNA, 18 bp, Homo sapiens
ttgctgttgctgttggca

SEQ ID NO: 2722596 - DNA, 14 bp, Homo sapiens
ttggaaaaatgtca

SEQ ID NO: 2722597 - DNA, 18 bp, Homo sapiens
ttggaactctaccctggt

SEQ ID NO: 2722598 - DNA, 22 bp, Homo sapiens
ttggaagagaggcacctgctgg

SEQ ID NO: 2722599 - DNA, 22 bp, Homo sapiens
ttggaattttctttcatacatt

SEQ ID NO: 2722600 - DNA, 15 bp, Homo sapiens
ttggaattttgtaaa

SEQ ID NO: 2722601 - DNA, 21 bp, Homo sapiens
ttggaattttgtaaaaagaaa

SEQ ID NO: 2722602 - DNA, 15 bp, Homo sapiens
ttggagaaaagcaca

SEQ ID NO: 2722603 - DNA, 20 bp, Homo sapiens
ttggagaaaagcacaatcaa

SEQ ID NO: 2722604 - DNA, 15 bp, Homo sapiens
ttggagactctgtgg

SEQ ID NO: 2722605 - DNA, 16 bp, Homo sapiens
ttggaggcctttagat

SEQ ID NO: 2722606 - DNA, 22 bp, Homo sapiens
ttggagggtgggagagcccagc

SEQ ID NO: 2722607 - DNA, 18 bp, Homo sapiens
ttggcacaagctccctgg

SEQ ID NO: 2722608 - DNA, 16 bp, Homo sapiens
ttggcagaactgctgg

SEQ ID NO: 2722609 - DNA, 15 bp, Homo sapiens
ttggcaggaggcagg

SEQ ID NO: 2722610 - DNA, 15 bp, Homo sapiens
ttggcccctggaacc

SEQ ID NO: 2722611 - DNA, 16 bp, Homo sapiens
ttggcccctggaacct

SEQ ID NO: 2722612 - DNA, 23 bp, Homo sapiens
ttggctgcacgtcaccctcctga

SEQ ID NO: 2722613 - DNA, 15 bp, Homo sapiens
ttgggaggctgaggc

SEQ ID NO: 2722614 - DNA, 19 bp, Homo sapiens
ttgggcagaatcctgggcc

SEQ ID NO: 2722615 - DNA, 18 bp, Homo sapiens
ttgggccatactggcctc

SEQ ID NO: 2722616 - DNA, 23 bp, Homo sapiens
ttgggccatactggcctcgcctg

SEQ ID NO: 2722617 - DNA, 15 bp, Homo sapiens
ttggggaccccctca

SEQ ID NO: 2722618 - DNA, 18 bp, Homo sapiens
ttgggggttaccaaaaat

SEQ ID NO: 2722619 - DNA, 22 bp, Homo sapiens
ttggtacagttcataattcacc

SEQ ID NO: 2722620 - DNA, 23 bp, Homo sapiens
ttggtacagttcataattcacca

SEQ ID NO: 2722621 - DNA, 20 bp, Homo sapiens
ttggtacatggccagtgtga

SEQ ID NO: 2722622 - DNA, 22 bp, Homo sapiens
ttggtcattcctaatgcattag

SEQ ID NO: 2722623 - DNA, 18 bp, Homo sapiens
ttggtcttactttgtgca

SEQ ID NO: 2722624 - DNA, 19 bp, Homo sapiens
ttggtgcaattaactctgg

SEQ ID NO: 2722625 - DNA, 20 bp, Homo sapiens
ttggtgcaattaactctgga

SEQ ID NO: 2722626 - DNA, 15 bp, Homo sapiens
ttggttcctcacata

SEQ ID NO: 2722627 - DNA, 19 bp, Homo sapiens
ttggtttaaaagtcacata

SEQ ID NO: 2722628 - DNA, 17 bp, Homo sapiens
ttgtaaacgtattttga

SEQ ID NO: 2722629 - DNA, 12 bp, Homo sapiens
ttgtaagtttat

SEQ ID NO: 2722630 - DNA, 14 bp, Homo sapiens
ttgtaagtttatgt

SEQ ID NO: 2722631 - DNA, 14 bp, Homo sapiens
ttgtaattattgtg

SEQ ID NO: 2722632 - DNA, 18 bp, Homo sapiens
ttgtaattattgtgattt

SEQ ID NO: 2722633 - DNA, 15 bp, Homo sapiens
ttgtacaaagatatg

SEQ ID NO: 2722634 - DNA, 15 bp, Homo sapiens
ttgtacagttcagtt

SEQ ID NO: 2722635 - DNA, 12 bp, Homo sapiens
ttgtacattatg

SEQ ID NO: 2722636 - DNA, 17 bp, Homo sapiens
ttgtacattatgttatt

SEQ ID NO: 2722637 - DNA, 13 bp, Homo sapiens
ttgtaccatattg

SEQ ID NO: 2722638 - DNA, 15 bp, Homo sapiens
ttgtaccatattgct

SEQ ID NO: 2722639 - DNA, 19 bp, Homo sapiens
ttgtattaacaaagttact

SEQ ID NO: 2722640 - DNA, 23 bp, Homo sapiens
ttgtatttaaatgaaagtgagac

SEQ ID NO: 2722641 - DNA, 19 bp, Homo sapiens
ttgtccctggggcactccc

SEQ ID NO: 2722642 - DNA, 18 bp, Homo sapiens
ttgtcctctcagagcctc

SEQ ID NO: 2722643 - DNA, 14 bp, Homo sapiens
ttgtctccctggcc

SEQ ID NO: 2722644 - DNA, 13 bp, Homo sapiens
ttgtctgtctgct

SEQ ID NO: 2722645 - DNA, 22 bp, Homo sapiens
ttgtcttccaaccccagctggc

SEQ ID NO: 2722646 - DNA, 22 bp, Homo sapiens
ttgtcttgaaacctttctactt

SEQ ID NO: 2722647 - DNA, 15 bp, Homo sapiens
ttgtctttctttgct

SEQ ID NO: 2722648 - DNA, 19 bp, Homo sapiens
ttgtctttggtgaacattg

SEQ ID NO: 2722649 - DNA, 19 bp, Homo sapiens
ttgtgaaattcaacctgtg

SEQ ID NO: 2722650 - DNA, 23 bp, Homo sapiens
ttgtgatttcccgtggccccagc

SEQ ID NO: 2722651 - DNA, 14 bp, Homo sapiens
ttgtgcaaaagcag

SEQ ID NO: 2722652 - DNA, 18 bp, Homo sapiens
ttgtgcaaaagcaggctt

SEQ ID NO: 2722653 - DNA, 10 bp, Homo sapiens
ttgtgcccac

SEQ ID NO: 2722654 - DNA, 17 bp, Homo sapiens
ttgtgcccactgtctct

SEQ ID NO: 2722655 - DNA, 22 bp, Homo sapiens
ttgtgctttataccccatttga

SEQ ID NO: 2722656 - DNA, 18 bp, Homo sapiens
ttgtggaaagcctctgct

SEQ ID NO: 2722657 - DNA, 17 bp, Homo sapiens
ttgtggactctctgcct

SEQ ID NO: 2722658 - DNA, 14 bp, Homo sapiens
ttgtggtaaaaaga

SEQ ID NO: 2722659 - DNA, 13 bp, Homo sapiens
ttgtgtaataaca

SEQ ID NO: 2722660 - DNA, 22 bp, Homo sapiens
ttgtgtgtaccacaccctgcct

SEQ ID NO: 2722661 - DNA, 18 bp, Homo sapiens
ttgtgttaattctttctc

SEQ ID NO: 2722662 - DNA, 19 bp, Homo sapiens
ttgtgttaattctttctca

SEQ ID NO: 2722663 - DNA, 19 bp, Homo sapiens
ttgttataacttcataaaa

SEQ ID NO: 2722664 - DNA, 17 bp, Homo sapiens
ttgtttctccccctggg

SEQ ID NO: 2722665 - DNA, 14 bp, Homo sapiens
ttgtttgttcacac

SEQ ID NO: 2722666 - DNA, 13 bp, Homo sapiens
tttaaaagacaaa

SEQ ID NO: 2722667 - DNA, 21 bp, Homo sapiens
tttaaaagggttcaaggacta

SEQ ID NO: 2722668 - DNA, 15 bp, Homo sapiens
tttaaaagtcacata

SEQ ID NO: 2722669 - DNA, 14 bp, Homo sapiens
tttaaaagtccact

SEQ ID NO: 2722670 - DNA, 18 bp, Homo sapiens
tttaaaagtttgtccttt

SEQ ID NO: 2722671 - DNA, 14 bp, Homo sapiens
tttaaaccactaat

SEQ ID NO: 2722672 - DNA, 11 bp, Homo sapiens
tttaaagaaaa

SEQ ID NO: 2722673 - DNA, 17 bp, Homo sapiens
tttaaagaaaagttttg

SEQ ID NO: 2722674 - DNA, 18 bp, Homo sapiens
tttaaagaaacactaaat

SEQ ID NO: 2722675 - DNA, 19 bp, Homo sapiens
tttaaaggacaaacagtga

SEQ ID NO: 2722676 - DNA, 15 bp, Homo sapiens
tttaaataaaagcac

SEQ ID NO: 2722677 - DNA, 17 bp, Homo sapiens
tttaaataaaagcacaa

SEQ ID NO: 2722678 - DNA, 21 bp, Homo sapiens
tttaaatgaaagtgagacttt

SEQ ID NO: 2722679 - DNA, 19 bp, Homo sapiens
tttaaattgttataacttc

SEQ ID NO: 2722680 - DNA, 18 bp, Homo sapiens
tttaactagcactttata

SEQ ID NO: 2722681 - DNA, 13 bp, Homo sapiens
tttaagctgtaaa

SEQ ID NO: 2722682 - DNA, 14 bp, Homo sapiens
tttaagctgtaaaa

SEQ ID NO: 2722683 - DNA, 21 bp, Homo sapiens
tttaatatctgagaagtgtat

SEQ ID NO: 2722684 - DNA, 17 bp, Homo sapiens
tttaatctgttgtttga

SEQ ID NO: 2722685 - DNA, 15 bp, Homo sapiens
tttacagtgtattta

SEQ ID NO: 2722686 - DNA, 18 bp, Homo sapiens
tttacatgaattgcattt

SEQ ID NO: 2722687 - DNA, 13 bp, Homo sapiens
tttaccaaagcat

SEQ ID NO: 2722688 - DNA, 15 bp, Homo sapiens
tttaccaaagcatca

SEQ ID NO: 2722689 - DNA, 19 bp, Homo sapiens
tttaccattattttacagt

SEQ ID NO: 2722690 - DNA, 13 bp, Homo sapiens
tttactgtcccag

SEQ ID NO: 2722691 - DNA, 16 bp, Homo sapiens
tttagatttttaaaag

SEQ ID NO: 2722692 - DNA, 13 bp, Homo sapiens
tttaggcagcctg

SEQ ID NO: 2722693 - DNA, 13 bp, Homo sapiens
tttagggaagcag

SEQ ID NO: 2722694 - DNA, 13 bp, Homo sapiens
tttagtcattatt

SEQ ID NO: 2722695 - DNA, 17 bp, Homo sapiens
tttataaaaaatggtgc

SEQ ID NO: 2722696 - DNA, 23 bp, Homo sapiens
tttataaaagaataaaattgcac

SEQ ID NO: 2722697 - DNA, 19 bp, Homo sapiens
tttataaatatgtgaaaat

SEQ ID NO: 2722698 - DNA, 21 bp, Homo sapiens
tttataaatatgtgaaaatga

SEQ ID NO: 2722699 - DNA, 22 bp, Homo sapiens
tttataaatatgtgaaaatgat

SEQ ID NO: 2722700 - DNA, 13 bp, Homo sapiens
tttataggcagat

SEQ ID NO: 2722701 - DNA, 16 bp, Homo sapiens
tttatattcatcaaat

SEQ ID NO: 2722702 - DNA, 12 bp, Homo sapiens
tttatctcctgg

SEQ ID NO: 2722703 - DNA, 12 bp, Homo sapiens
tttatctgtgga

SEQ ID NO: 2722704 - DNA, 15 bp, Homo sapiens
tttatgatgctattt

SEQ ID NO: 2722705 - DNA, 15 bp, Homo sapiens
tttatgcaaaaacat

SEQ ID NO: 2722706 - DNA, 16 bp, Homo sapiens
tttattctttttaaag

SEQ ID NO: 2722707 - DNA, 15 bp, Homo sapiens
tttattttaatgtat

SEQ ID NO: 2722708 - DNA, 16 bp, Homo sapiens
tttattttaatgtatt

SEQ ID NO: 2722709 - DNA, 13 bp, Homo sapiens
tttcaaaagacac

SEQ ID NO: 2722710 - DNA, 15 bp, Homo sapiens
tttcaagatccaaat

SEQ ID NO: 2722711 - DNA, 13 bp, Homo sapiens
tttcaatttactt

SEQ ID NO: 2722712 - DNA, 20 bp, Homo sapiens
tttcacttgggtctctggat

SEQ ID NO: 2722713 - DNA, 17 bp, Homo sapiens
ttcccaagcaaagactg

SEQ ID NO: 2722714 - DNA, 16 bp, Homo sapiens
ttcccaattgccacat

SEQ ID NO: 2722715 - DNA, 19 bp, Homo sapiens
ttcccactaagctttctcc

SEQ ID NO: 2722716 - DNA, 19 bp, Homo sapiens
ttcccactgcaccccctcc

SEQ ID NO: 2722717 - DNA, 23 bp, Homo sapiens
ttcccactgcaccccctcctgct

SEQ ID NO: 2722718 - DNA, 17 bp, Homo sapiens
ttcccagagagacgctg

SEQ ID NO: 2722719 - DNA, 19 bp, Homo sapiens
ttcccagagagacgctgtg

SEQ ID NO: 2722720 - DNA, 18 bp, Homo sapiens
ttcccagcaaagttttca

SEQ ID NO: 2722721 - DNA, 18 bp, Homo sapiens
ttcccagtgagcctctgc

SEQ ID NO: 2722722 - DNA, 19 bp, Homo sapiens
ttcccatggtagactgtga

SEQ ID NO: 2722723 - DNA, 20 bp, Homo sapiens
ttcccatggtagactgtgac

SEQ ID NO: 2722724 - DNA, 21 bp, Homo sapiens
ttcccctcctacccctcccag

SEQ ID NO: 2722725 - DNA, 22 bp, Homo sapiens
ttcccctcctacccctcccagc

SEQ ID NO: 2722726 - DNA, 17 bp, Homo sapiens
ttccccttgtccctggg

SEQ ID NO: 2722727 - DNA, 19 bp, Homo sapiens
ttccccttgtccctggggc

SEQ ID NO: 2722728 - DNA, 13 bp, Homo sapiens
ttcccgtggcccc

SEQ ID NO: 2722729 - DNA, 17 bp, Homo sapiens
ttccctgacactgcggg

SEQ ID NO: 2722730 - DNA, 19 bp, Homo sapiens
ttccctgcttttctcccag

SEQ ID NO: 2722731 - DNA, 15 bp, Homo sapiens
ttcctaatgcattag

SEQ ID NO: 2722732 - DNA, 14 bp, Homo sapiens
ttcctagtatatta

SEQ ID NO: 2722733 - DNA, 21 bp, Homo sapiens
ttcctccccattagagtcagc

SEQ ID NO: 2722734 - DNA, 17 bp, Homo sapiens
ttcctcgcctctcccac

SEQ ID NO: 2722735 - DNA, 19 bp, Homo sapiens
ttcctctagtgccctccac

SEQ ID NO: 2722736 - DNA, 13 bp, Homo sapiens
ttcctcttcccca

SEQ ID NO: 2722737 - DNA, 23 bp, Homo sapiens
ttcctgaagtgtcgagtccagtc

SEQ ID NO: 2722738 - DNA, 23 bp, Homo sapiens
ttcctgacccggattggccctgc

SEQ ID NO: 2722739 - DNA, 23 bp, Homo sapiens
ttcctggaccggggccttggtcc

SEQ ID NO: 2722740 - DNA, 12 bp, Homo sapiens
ttcctggtgagg

SEQ ID NO: 2722741 - DNA, 22 bp, Homo sapiens
ttcctggtgaggcccagcctgt

SEQ ID NO: 2722742 - DNA, 17 bp, Homo sapiens
ttcctgtcatagggaag

SEQ ID NO: 2722743 - DNA, 15 bp, Homo sapiens
ttcctgttgtgtaat

SEQ ID NO: 2722744 - DNA, 20 bp, Homo sapiens
ttccttgctgtcctaggcca

SEQ ID NO: 2722745 - DNA, 22 bp, Homo sapiens
ttccttgtttatggggctctca

SEQ ID NO: 2722746 - DNA, 22 bp, Homo sapiens
ttcgaaacctgtccataaagta

SEQ ID NO: 2722747 - DNA, 14 bp, Homo sapiens
ttcgaactgtgctc

SEQ ID NO: 2722748 - DNA, 14 bp, Homo sapiens
ttcgagaccagcct

SEQ ID NO: 2722749 - DNA, 16 bp, Homo sapiens
ttcgaggtgtcaccct

SEQ ID NO: 2722750 - DNA, 18 bp, Homo sapiens
ttctaacataagtaagac

SEQ ID NO: 2722751 - DNA, 15 bp, Homo sapiens
ttctaactcttagaa

SEQ ID NO: 2722752 - DNA, 17 bp, Homo sapiens
ttctacacatatatgta

SEQ ID NO: 2722753 - DNA, 18 bp, Homo sapiens
ttctacacatatatgtat

SEQ ID NO: 2722754 - DNA, 23 bp, Homo sapiens
ttctagtatctattgtgttggct

SEQ ID NO: 2722755 - DNA, 13 bp, Homo sapiens
ttctatgtatgtg

SEQ ID NO: 2722756 - DNA, 15 bp, Homo sapiens
ttctcaaagaaattt

SEQ ID NO: 2722757 - DNA, 19 bp, Homo sapiens
ttctcaaagaaatttccac

SEQ ID NO: 2722758 - DNA, 13 bp, Homo sapiens
ttctcagagcagc

SEQ ID NO: 2722759 - DNA, 23 bp, Homo sapiens
ttctcccccccggggctgggttg

SEQ ID NO: 2722760 - DNA, 18 bp, Homo sapiens
tgtggtttactagcagga

SEQ ID NO: 2722761 - DNA, 13 bp, Homo sapiens
tgtgtaccacacc

SEQ ID NO: 2722762 - DNA, 18 bp, Homo sapiens
tgtgtacttcagtcttgg

SEQ ID NO: 2722763 - DNA, 20 bp, Homo sapiens
tgtgtatccagtatgcacgt

SEQ ID NO: 2722764 - DNA, 22 bp, Homo sapiens
tgtgtatgagaagtactttgtg

SEQ ID NO: 2722765 - DNA, 22 bp, Homo sapiens
tgtgtatgagactgtgtttcta

SEQ ID NO: 2722766 - DNA, 23 bp, Homo sapiens
tgtgtatgagactgtgtttctag

SEQ ID NO: 2722767 - DNA, 13 bp, Homo sapiens
tgtgtcactggct

SEQ ID NO: 2722768 - DNA, 15 bp, Homo sapiens
tgtgtcactggctgc

SEQ ID NO: 2722769 - DNA, 18 bp, Homo sapiens
tgtgtcactggctgcctc

SEQ ID NO: 2722770 - DNA, 23 bp, Homo sapiens
tgtgtcactggctgcctccactc

SEQ ID NO: 2722771 - DNA, 16 bp, Homo sapiens
tgtgtcctctccagct

SEQ ID NO: 2722772 - DNA, 12 bp, Homo sapiens
tgtgtctctgta

SEQ ID NO: 2722773 - DNA, 19 bp, Homo sapiens
tgtgtctgcgtctgtgttg

SEQ ID NO: 2722774 - DNA, 12 bp, Homo sapiens
tgtgtgctcagc

SEQ ID NO: 2722775 - DNA, 19 bp, Homo sapiens
tgtgtgctcagcagcccca

SEQ ID NO: 2722776 - DNA, 13 bp, Homo sapiens
tgtgtgtctccag

SEQ ID NO: 2722777 - DNA, 13 bp, Homo sapiens
tgtgtgtctctga

SEQ ID NO: 2722778 - DNA, 17 bp, Homo sapiens
tgtgttaattctttctc

SEQ ID NO: 2722779 - DNA, 17 bp, Homo sapiens
tgtgttccccagctgat

SEQ ID NO: 2722780 - DNA, 13 bp, Homo sapiens
tgttactaaagtc

SEQ ID NO: 2722781 - DNA, 22 bp, Homo sapiens
tgttactaaagtcacatataaa

SEQ ID NO: 2722782 - DNA, 14 bp, Homo sapiens
tgttacttaaacat

SEQ ID NO: 2722783 - DNA, 18 bp, Homo sapiens
tgttacttaaacatcatt

SEQ ID NO: 2722784 - DNA, 12 bp, Homo sapiens
tgttagagaggt

SEQ ID NO: 2722785 - DNA, 12 bp, Homo sapiens
tgttagcaaaga

SEQ ID NO: 2722786 - DNA, 15 bp, Homo sapiens
tgttagcaaagatta

SEQ ID NO: 2722787 - DNA, 16 bp, Homo sapiens
tgttaggcctggcaca

SEQ ID NO: 2722788 - DNA, 15 bp, Homo sapiens
tgttatgatctactc

SEQ ID NO: 2722789 - DNA, 15 bp, Homo sapiens
tgttatgccttgcta

SEQ ID NO: 2722790 - DNA, 18 bp, Homo sapiens
tgttattcttttccagaa

SEQ ID NO: 2722791 - DNA, 20 bp, Homo sapiens
tgttattttttatttccaca

SEQ ID NO: 2722792 - DNA, 21 bp, Homo sapiens
tgttattttttatttccacat

SEQ ID NO: 2722793 - DNA, 21 bp, Homo sapiens
tgttcacaccattctcctgcc

SEQ ID NO: 2722794 - DNA, 19 bp, Homo sapiens
tgttctagagtgacaggca

SEQ ID NO: 2722795 - DNA, 21 bp, Homo sapiens
tgttctgggtgatttctagaa

SEQ ID NO: 2722796 - DNA, 20 bp, Homo sapiens
tgttctgtccagtttccaaa

SEQ ID NO: 2722797 - DNA, 15 bp, Homo sapiens
tgttcttggtctccc

SEQ ID NO: 2722798 - DNA, 16 bp, Homo sapiens
tgttcttgtcatcagt

SEQ ID NO: 2722799 - DNA, 12 bp, Homo sapiens
tgttgatcccaa

SEQ ID NO: 2722800 - DNA, 17 bp, Homo sapiens
tgttgctcgaagactgt

SEQ ID NO: 2722801 - DNA, 13 bp, Homo sapiens
tgttgctgttgct

SEQ ID NO: 2722802 - DNA, 14 bp, Homo sapiens
tgttgctgttgctg

SEQ ID NO: 2722803 - DNA, 19 bp, Homo sapiens
tgttgggaagctatttcct

SEQ ID NO: 2722804 - DNA, 14 bp, Homo sapiens
tgttggtgcaatta

SEQ ID NO: 2722805 - DNA, 23 bp, Homo sapiens
tgttggtgcaattaactctggac

SEQ ID NO: 2722806 - DNA, 17 bp, Homo sapiens
tgttgtgtaataacaga

SEQ ID NO: 2722807 - DNA, 15 bp, Homo sapiens
tgttgtttgaagaac

SEQ ID NO: 2722808 - DNA, 18 bp, Homo sapiens
tgttgtttttaagtcctg

SEQ ID NO: 2722809 - DNA, 20 bp, Homo sapiens
tgtttaaaaaaagtatatat

SEQ ID NO: 2722810 - DNA, 20 bp, Homo sapiens
tgtttaattcattaatctgt

SEQ ID NO: 2722811 - DNA, 23 bp, Homo sapiens
tgtttaattcattaatctgtttg

SEQ ID NO: 2722812 - DNA, 19 bp, Homo sapiens
tgtttggcactgatgcaat

SEQ ID NO: 2722813 - DNA, 13 bp, Homo sapiens
tgttttcttcatt

SEQ ID NO: 2722814 - DNA, 14 bp, Homo sapiens
tgtttttgtgtaga

SEQ ID NO: 2722815 - DNA, 13 bp, Homo sapiens
ttaaaaaaacaca

SEQ ID NO: 2722816 - DNA, 18 bp, Homo sapiens
ttaaaaaaagtatatatt

SEQ ID NO: 2722817 - DNA, 22 bp, Homo sapiens
ttaaaaaaagtatatattctac

SEQ ID NO: 2722818 - DNA, 15 bp, Homo sapiens
ttaaaactatattta

SEQ ID NO: 2722819 - DNA, 14 bp, Homo sapiens
ttaaaatgaagcaa

SEQ ID NO: 2722820 - DNA, 17 bp, Homo sapiens
ttaaacagcaaagccat

SEQ ID NO: 2722821 - DNA, 22 bp, Homo sapiens
ttaaaccagactctgttgcaat

SEQ ID NO: 2722822 - DNA, 14 bp, Homo sapiens
ttaaagaaacacta

SEQ ID NO: 2722823 - DNA, 22 bp, Homo sapiens
ttaaagaaacactaaattagtt

SEQ ID NO: 2722824 - DNA, 14 bp, Homo sapiens
ttaaaggacaaaca

SEQ ID NO: 2722825 - DNA, 19 bp, Homo sapiens
ttaaaggacaaacagtgaa

SEQ ID NO: 2722826 - DNA, 13 bp, Homo sapiens
ttaaatcgttaga

SEQ ID NO: 2722827 - DNA, 16 bp, Homo sapiens
ttaaatgccttggttt

SEQ ID NO: 2722828 - DNA, 18 bp, Homo sapiens
ttaaattctctctaacat

SEQ ID NO: 2722829 - DNA, 14 bp, Homo sapiens
tggaatgaagcatg

SEQ ID NO: 2722830 - DNA, 16 bp, Homo sapiens
tggaatttgtaagttt

SEQ ID NO: 2722831 - DNA, 23 bp, Homo sapiens
tggaattttctttcatacattat

SEQ ID NO: 2722832 - DNA, 11 bp, Homo sapiens
tggacaaccca

SEQ ID NO: 2722833 - DNA, 14 bp, Homo sapiens
tggacaacccagaa

SEQ ID NO: 2722834 - DNA, 18 bp, Homo sapiens
tggacagtacctgattgt

SEQ ID NO: 2722835 - DNA, 15 bp, Homo sapiens
tggacagtcctggga

SEQ ID NO: 2722836 - DNA, 19 bp, Homo sapiens
tggacatcgatatgaaaaa

SEQ ID NO: 2722837 - DNA, 21 bp, Homo sapiens
tggacatgatttagggaagca

SEQ ID NO: 2722838 - DNA, 19 bp, Homo sapiens
tggacccatttgccaggat

SEQ ID NO: 2722839 - DNA, 14 bp, Homo sapiens
tggactagggcctc

SEQ ID NO: 2722840 - DNA, 15 bp, Homo sapiens
tggactagggcctcg

SEQ ID NO: 2722841 - DNA, 20 bp, Homo sapiens
tggactctctgcctgcttcc

SEQ ID NO: 2722842 - DNA, 17 bp, Homo sapiens
tggagaaaaattacaga

SEQ ID NO: 2722843 - DNA, 20 bp, Homo sapiens
tggagaaacaggctctgaga

SEQ ID NO: 2722844 - DNA, 14 bp, Homo sapiens
tggagagcagctgg

SEQ ID NO: 2722845 - DNA, 22 bp, Homo sapiens
tggagaggagggatgctgcctg

SEQ ID NO: 2722846 - DNA, 23 bp, Homo sapiens
tggagaggagggatgctgcctga

SEQ ID NO: 2722847 - DNA, 14 bp, Homo sapiens
tggagcgcacctgc

SEQ ID NO: 2722848 - DNA, 19 bp, Homo sapiens
tggaggaacattgggaagg

SEQ ID NO: 2722849 - DNA, 18 bp, Homo sapiens
tggagggatcattttctg

SEQ ID NO: 2722850 - DNA, 12 bp, Homo sapiens
tggaggtgatga

SEQ ID NO: 2722851 - DNA, 19 bp, Homo sapiens
tggagtctcgctctgctgc

SEQ ID NO: 2722852 - DNA, 17 bp, Homo sapiens
tggagtgagcagtagaa

SEQ ID NO: 2722853 - DNA, 13 bp, Homo sapiens
tggagtgctgcag

SEQ ID NO: 2722854 - DNA, 14 bp, Homo sapiens
tggagtgctgcagc

SEQ ID NO: 2722855 - DNA, 15 bp, Homo sapiens
tggataaatttgaac

SEQ ID NO: 2722856 - DNA, 17 bp, Homo sapiens
tggatggaggtgatgaa

SEQ ID NO: 2722857 - DNA, 17 bp, Homo sapiens
tggatggctcccctgag

SEQ ID NO: 2722858 - DNA, 12 bp, Homo sapiens
tggatggtgact

SEQ ID NO: 2722859 - DNA, 17 bp, Homo sapiens
tggatggtgacttttga

SEQ ID NO: 2722860 - DNA, 18 bp, Homo sapiens
tggatgttcagaattttg

SEQ ID NO: 2722861 - DNA, 13 bp, Homo sapiens
tggattggatttg

SEQ ID NO: 2722862 - DNA, 14 bp, Homo sapiens
tggcaaacatgtgc

SEQ ID NO: 2722863 - DNA, 20 bp, Homo sapiens
tggcaacagaaaacaattgt

SEQ ID NO: 2722864 - DNA, 16 bp, Homo sapiens
tggcaaccctcagctg

SEQ ID NO: 2722865 - DNA, 23 bp, Homo sapiens
tggcaaccctcagctgcctcatc

SEQ ID NO: 2722866 - DNA, 23 bp, Homo sapiens
tggcaatgccctacctgcctgtt

SEQ ID NO: 2722867 - DNA, 18 bp, Homo sapiens
tggcacctgcctagctct

SEQ ID NO: 2722868 - DNA, 22 bp, Homo sapiens
tggcacctgcctagctcttggg

SEQ ID NO: 2722869 - DNA, 17 bp, Homo sapiens
tggcacgatctcagctc

SEQ ID NO: 2722870 - DNA, 17 bp, Homo sapiens
tggcagaactgctgggg

SEQ ID NO: 2722871 - DNA, 18 bp, Homo sapiens
tggcagaactgctggggc

SEQ ID NO: 2722872 - DNA, 22 bp, Homo sapiens
tggcagaactgctggggctggt

SEQ ID NO: 2722873 - DNA, 20 bp, Homo sapiens
tggcagcaggtgctgctacc

SEQ ID NO: 2722874 - DNA, 12 bp, Homo sapiens
tggcagccctgt

SEQ ID NO: 2722875 - DNA, 15 bp, Homo sapiens
tggcagccgcctccc

SEQ ID NO: 2722876 - DNA, 11 bp, Homo sapiens
tggcagctggg

SEQ ID NO: 2722877 - DNA, 12 bp, Homo sapiens
tggcagctgggc

SEQ ID NO: 2722878 - DNA, 23 bp, Homo sapiens
tggcagctgggcccacagccccc

SEQ ID NO: 2722879 - DNA, 15 bp, Homo sapiens
tggcaggaggcagga

SEQ ID NO: 2722880 - DNA, 13 bp, Homo sapiens
tggcagtgtttgt

SEQ ID NO: 2722881 - DNA, 15 bp, Homo sapiens
tggcatatccattgt

SEQ ID NO: 2722882 - DNA, 18 bp, Homo sapiens
tggcatcacagggcagag

SEQ ID NO: 2722883 - DNA, 19 bp, Homo sapiens
gagaagggcctgctctgct

SEQ ID NO: 2722884 - DNA, 17 bp, Homo sapiens
gagaagtggccagggct

SEQ ID NO: 2722885 - DNA, 15 bp, Homo sapiens
gagaattaaactcct

SEQ ID NO: 2722886 - DNA, 17 bp, Homo sapiens
gagacctttgcccacac

SEQ ID NO: 2722887 - DNA, 18 bp, Homo sapiens
gagacctttgcccacaca

SEQ ID NO: 2722888 - DNA, 15 bp, Homo sapiens
gagactctgaggtgt

SEQ ID NO: 2722889 - DNA, 12 bp, Homo sapiens
gagactctgtgg

SEQ ID NO: 2722890 - DNA, 19 bp, Homo sapiens
gagactgcgggatggtcct

SEQ ID NO: 2722891 - DNA, 13 bp, Homo sapiens
gagagaaaactta

SEQ ID NO: 2722892 - DNA, 15 bp, Homo sapiens
gagagaacagggatg

SEQ ID NO: 2722893 - DNA, 15 bp, Homo sapiens
gagagaagtggccag

SEQ ID NO: 2722894 - DNA, 15 bp, Homo sapiens
gagagagcagcttct

SEQ ID NO: 2722895 - DNA, 10 bp, Homo sapiens
gagagcagct

SEQ ID NO: 2722896 - DNA, 13 bp, Homo sapiens
gagagcagctggc

SEQ ID NO: 2722897 - DNA, 14 bp, Homo sapiens
gagagcagctggct

SEQ ID NO: 2722898 - DNA, 19 bp, Homo sapiens
gagagcagcttctgccact

SEQ ID NO: 2722899 - DNA, 22 bp, Homo sapiens
gagagcagcttctgccacttcc

SEQ ID NO: 2722900 - DNA, 20 bp, Homo sapiens
gagagcccgtgggggcaggg

SEQ ID NO: 2722901 - DNA, 16 bp, Homo sapiens
gagaggcgcgtctgcc

SEQ ID NO: 2722902 - DNA, 23 bp, Homo sapiens
gagaggcgcgtctgccccaccct

SEQ ID NO: 2722903 - DNA, 11 bp, Homo sapiens
gagagtaccat

SEQ ID NO: 2722904 - DNA, 14 bp, Homo sapiens
gagagtaccatgct

SEQ ID NO: 2722905 - DNA, 14 bp, Homo sapiens
gagagtcaaagctg

SEQ ID NO: 2722906 - DNA, 22 bp, Homo sapiens
gagatatttaaaagacaaacac

SEQ ID NO: 2722907 - DNA, 21 bp, Homo sapiens
gagatctttctttccaaaaca

SEQ ID NO: 2722908 - DNA, 15 bp, Homo sapiens
gagatggtctgcatc

SEQ ID NO: 2722909 - DNA, 13 bp, Homo sapiens
gagattatatttc

SEQ ID NO: 2722910 - DNA, 18 bp, Homo sapiens
gagattctttaaggagat

SEQ ID NO: 2722911 - DNA, 23 bp, Homo sapiens
gagattctttaaggagatagacg

SEQ ID NO: 2722912 - DNA, 14 bp, Homo sapiens
gagattgggcctcc

SEQ ID NO: 2722913 - DNA, 12 bp, Homo sapiens
gagattttcctt

SEQ ID NO: 2722914 - DNA, 20 bp, Homo sapiens
gagcaacagagtgagaccct

SEQ ID NO: 2722915 - DNA, 18 bp, Homo sapiens
gagcaactctccactcca

SEQ ID NO: 2722916 - DNA, 19 bp, Homo sapiens
gagcaactctccactccat

SEQ ID NO: 2722917 - DNA, 12 bp, Homo sapiens
gagcacagccct

SEQ ID NO: 2722918 - DNA, 14 bp, Homo sapiens
gagcagcactgggg

SEQ ID NO: 2722919 - DNA, 19 bp, Homo sapiens
gagcagcctccagtgctgg

SEQ ID NO: 2722920 - DNA, 24 bp, Homo sapiens
gagcagcctccagtgctggctgct

SEQ ID NO: 2722921 - DNA, 15 bp, Homo sapiens
gagcagctggctctc

SEQ ID NO: 2722922 - DNA, 17 bp, Homo sapiens
gagcagcttctgccact

SEQ ID NO: 2722923 - DNA, 21 bp, Homo sapiens
gagcagcttctgccacttccc

SEQ ID NO: 2722924 - DNA, 12 bp, Homo sapiens
gagcaggaaccg

SEQ ID NO: 2722925 - DNA, 22 bp, Homo sapiens
gagcatgccctgagctctctga

SEQ ID NO: 2722926 - DNA, 14 bp, Homo sapiens
gagccaacagcagc

SEQ ID NO: 2722927 - DNA, 15 bp, Homo sapiens
gagccactacctttg

SEQ ID NO: 2722928 - DNA, 13 bp, Homo sapiens
gagccagccagga

SEQ ID NO: 2722929 - DNA, 14 bp, Homo sapiens
gagccagccaggac

SEQ ID NO: 2722930 - DNA, 12 bp, Homo sapiens
gagcccaggagt

SEQ ID NO: 2722931 - DNA, 22 bp, Homo sapiens
gagccctctgctgctttccaac

SEQ ID NO: 2722932 - DNA, 20 bp, Homo sapiens
gagccgagatcacgccactg

SEQ ID NO: 2722933 - DNA, 18 bp, Homo sapiens
gagccgcagggcctgcta

SEQ ID NO: 2722934 - DNA, 13 bp, Homo sapiens
gagccgggaaagc

SEQ ID NO: 2722935 - DNA, 15 bp, Homo sapiens
gagccgggccccgga

SEQ ID NO: 2722936 - DNA, 13 bp, Homo sapiens
gagcctcagcttc

SEQ ID NO: 2722937 - DNA, 15 bp, Homo sapiens
gagcctcagcttctg

SEQ ID NO: 2722938 - DNA, 16 bp, Homo sapiens
gagcctcagcttctgg

SEQ ID NO: 2722939 - DNA, 22 bp, Homo sapiens
gagcctcctctctcaaactggg

SEQ ID NO: 2722940 - DNA, 23 bp, Homo sapiens
gagcctcgtccaaggcagttctg

SEQ ID NO: 2722941 - DNA, 18 bp, Homo sapiens
gagcctctgcgcctctcc

SEQ ID NO: 2722942 - DNA, 15 bp, Homo sapiens
gagcgaccctggctc

SEQ ID NO: 2722943 - DNA, 20 bp, Homo sapiens
gagcgaccctggctctgcca

SEQ ID NO: 2722944 - DNA, 13 bp, Homo sapiens
gagcgaggaaagg

SEQ ID NO: 2722945 - DNA, 18 bp, Homo sapiens
gagcgcacctgccccctg

SEQ ID NO: 2722946 - DNA, 14 bp, Homo sapiens
gagcgtgattctgt

SEQ ID NO: 2722947 - DNA, 15 bp, Homo sapiens
gagctactctcttgc

SEQ ID NO: 2722948 - DNA, 20 bp, Homo sapiens
gagctactctcttgccagca

SEQ ID NO: 2722949 - DNA, 21 bp, Homo sapiens
gagctactctcttgccagcat

SEQ ID NO: 2722950 - DNA, 16 bp, Homo sapiens
gagctcctgtccctac

SEQ ID NO: 2722951 - DNA, 17 bp, Homo sapiens
gagctcctgtccctacc

SEQ ID NO: 2722952 - DNA, 21 bp, Homo sapiens
gagctcctgtccctacccact

SEQ ID NO: 2722953 - DNA, 22 bp, Homo sapiens
gagctcctgtccctacccactc

SEQ ID NO: 2722954 - DNA, 23 bp, Homo sapiens
gagctcctgtccctacccactct

SEQ ID NO: 2722955 - DNA, 13 bp, Homo sapiens
gagctgacagagc

SEQ ID NO: 2722956 - DNA, 17 bp, Homo sapiens
gagctgacagagccaga

SEQ ID NO: 2722957 - DNA, 20 bp, Homo sapiens
gagctgcctccccaatccat

SEQ ID NO: 2722958 - DNA, 12 bp, Homo sapiens
gagctgcgggct

SEQ ID NO: 2722959 - DNA, 14 bp, Homo sapiens
gagctgctctgcta

SEQ ID NO: 2722960 - DNA, 14 bp, Homo sapiens
tgagcaattctcct

SEQ ID NO: 2722961 - DNA, 11 bp, Homo sapiens
tgagcagaccg

SEQ ID NO: 2722962 - DNA, 19 bp, Homo sapiens
tgagcttggcagctgaact

SEQ ID NO: 2722963 - DNA, 14 bp, Homo sapiens
tgagcttgtaaata

SEQ ID NO: 2722964 - DNA, 20 bp, Homo sapiens
tgaggagcagcttcagttgt

SEQ ID NO: 2722965 - DNA, 23 bp, Homo sapiens
tgaggatcccctgtcccctgggg

SEQ ID NO: 2722966 - DNA, 20 bp, Homo sapiens
tgaggcacctgcatatctct

SEQ ID NO: 2722967 - DNA, 15 bp, Homo sapiens
tgaggccggccctgc

SEQ ID NO: 2722968 - DNA, 21 bp, Homo sapiens
tgaggccggccctgcccctcc

SEQ ID NO: 2722969 - DNA, 23 bp, Homo sapiens
tgaggccggccctgcccctccct

SEQ ID NO: 2722970 - DNA, 14 bp, Homo sapiens
tgaggcctcccttg

SEQ ID NO: 2722971 - DNA, 17 bp, Homo sapiens
tgaggctctttctgggc

SEQ ID NO: 2722972 - DNA, 17 bp, Homo sapiens
tgaggctggcatcctgg

SEQ ID NO: 2722973 - DNA, 20 bp, Homo sapiens
tgaggctggcatcctggctg

SEQ ID NO: 2722974 - DNA, 18 bp, Homo sapiens
tgaggctggtagcagaat

SEQ ID NO: 2722975 - DNA, 15 bp, Homo sapiens
tgagggcatctctga

SEQ ID NO: 2722976 - DNA, 15 bp, Homo sapiens
tgaggggctcctgga

SEQ ID NO: 2722977 - DNA, 18 bp, Homo sapiens
tgaggtctcgctgatgct

SEQ ID NO: 2722978 - DNA, 16 bp, Homo sapiens
tgaggtgacttgcctg

SEQ ID NO: 2722979 - DNA, 15 bp, Homo sapiens
tgagtacagcagaaa

SEQ ID NO: 2722980 - DNA, 22 bp, Homo sapiens
tgagtaccaaatccacaagcca

SEQ ID NO: 2722981 - DNA, 15 bp, Homo sapiens
tgagtagcatatata

SEQ ID NO: 2722982 - DNA, 11 bp, Homo sapiens
tgagtctctga

SEQ ID NO: 2722983 - DNA, 12 bp, Homo sapiens
tgagtctctgaa

SEQ ID NO: 2722984 - DNA, 14 bp, Homo sapiens
tgagtgattatttg

SEQ ID NO: 2722985 - DNA, 20 bp, Homo sapiens
tgagtgattatttgttattt

SEQ ID NO: 2722986 - DNA, 22 bp, Homo sapiens
tgagtggcatgtgggttgtgat

SEQ ID NO: 2722987 - DNA, 18 bp, Homo sapiens
tgagtgtctctgcctgga

SEQ ID NO: 2722988 - DNA, 14 bp, Homo sapiens
tgagtgtgactttt

SEQ ID NO: 2722989 - DNA, 17 bp, Homo sapiens
tgagttattttaattat

SEQ ID NO: 2722990 - DNA, 23 bp, Homo sapiens
tgagttgcaccattctttcttgg

SEQ ID NO: 2722991 - DNA, 17 bp, Homo sapiens
tgagttttatccaagac

SEQ ID NO: 2722992 - DNA, 16 bp, Homo sapiens
tgataaaatgctttaa

SEQ ID NO: 2722993 - DNA, 17 bp, Homo sapiens
tgataagagtgtaacat

SEQ ID NO: 2722994 - DNA, 12 bp, Homo sapiens
tgatactttaat

SEQ ID NO: 2722995 - DNA, 19 bp, Homo sapiens
tgatagtgcttcttgtaat

SEQ ID NO: 2722996 - DNA, 21 bp, Homo sapiens
tgatatggtactaaggagaat

SEQ ID NO: 2722997 - DNA, 14 bp, Homo sapiens
tgatatttccttca

SEQ ID NO: 2722998 - DNA, 23 bp, Homo sapiens
tgatcatcccatctaagctgcag

SEQ ID NO: 2722999 - DNA, 13 bp, Homo sapiens
tgatcatctttgc

SEQ ID NO: 2723000 - DNA, 13 bp, Homo sapiens
tgatcccagcact

SEQ ID NO: 2723001 - DNA, 21 bp, Homo sapiens
tgatctactcatttgctgaca

SEQ ID NO: 2723002 - DNA, 17 bp, Homo sapiens
tgatcttacctttatga

SEQ ID NO: 2723003 - DNA, 15 bp, Homo sapiens
tgatgatgatgaaaa

SEQ ID NO: 2723004 - DNA, 16 bp, Homo sapiens
tgatgatgatgaaaac

SEQ ID NO: 2723005 - DNA, 14 bp, Homo sapiens
tgatgatggaaggg

SEQ ID NO: 2723006 - DNA, 15 bp, Homo sapiens
tgatgccacaccaag

SEQ ID NO: 2723007 - DNA, 14 bp, Homo sapiens
tgatgctgggctgg

SEQ ID NO: 2723008 - DNA, 18 bp, Homo sapiens
tgatgctgggctgggtgc

SEQ ID NO: 2723009 - DNA, 12 bp, Homo sapiens
tgatgtcagcct

SEQ ID NO: 2723010 - DNA, 17 bp, Homo sapiens
tgatgttgggaagctat

SEQ ID NO: 2723011 - DNA, 22 bp, Homo sapiens
tgatgttgggaagctatttcct

SEQ ID NO: 2723012 - DNA, 16 bp, Homo sapiens
tgatgtttaaaagtcc

SEQ ID NO: 2723013 - DNA, 12 bp, Homo sapiens
tgattaaacagc

SEQ ID NO: 2723014 - DNA, 15 bp, Homo sapiens
tgattaaacagcaaa

SEQ ID NO: 2723015 - DNA, 21 bp, Homo sapiens
tgattaaacagcaaagccata

SEQ ID NO: 2723016 - DNA, 22 bp, Homo sapiens
tgattaaacagcaaagccatat

SEQ ID NO: 2723017 - DNA, 17 bp, Homo sapiens
tgattatggacatcgat

SEQ ID NO: 2723018 - DNA, 18 bp, Homo sapiens
tgattattctgattccac

SEQ ID NO: 2723019 - DNA, 15 bp, Homo sapiens
tgattcctgctgcct

SEQ ID NO: 2723020 - DNA, 19 bp, Homo sapiens
tgattctgttctacttgat

SEQ ID NO: 2723021 - DNA, 14 bp, Homo sapiens
tgattgcactaaat

SEQ ID NO: 2723022 - DNA, 15 bp, Homo sapiens
tgattgcgagaattt

SEQ ID NO: 2723023 - DNA, 16 bp, Homo sapiens
tgattgcgagaatttt

SEQ ID NO: 2723024 - DNA, 14 bp, Homo sapiens
tgattggccagccg

SEQ ID NO: 2723025 - DNA, 17 bp, Homo sapiens
tgattgtttgcacagag

SEQ ID NO: 2723026 - DNA, 20 bp, Homo sapiens
tgattgtttgcacagagggc

SEQ ID NO: 2723027 - DNA, 18 bp, Homo sapiens
tgatttcccgtggcccca

SEQ ID NO: 2723028 - DNA, 13 bp, Homo sapiens
tgatttctagaat

SEQ ID NO: 2723029 - DNA, 20 bp, Homo sapiens
tgatttggaagagaggcacc

SEQ ID NO: 2723030 - DNA, 22 bp, Homo sapiens
tgatttggaagagaggcacctg

SEQ ID NO: 2723031 - DNA, 21 bp, Homo sapiens
tgatttttgtgtatccagtat

SEQ ID NO: 2723032 - DNA, 15 bp, Homo sapiens
tgcaaaagcaggctt

SEQ ID NO: 2723033 - DNA, 12 bp, Homo sapiens
tgcaaacagtgt

SEQ ID NO: 2723034 - DNA, 18 bp, Homo sapiens
tgcaaaggactgtaagca

SEQ ID NO: 2723035 - DNA, 20 bp, Homo sapiens
tgcaaaggactgtaagcaga

SEQ ID NO: 2723036 - DNA, 21 bp, Homo sapiens
tgcaacaaagacttgctttaa

SEQ ID NO: 2723037 - DNA, 21 bp, Homo sapiens
tgcaacatggattccaaagca

SEQ ID NO: 2723038 - DNA, 13 bp, Homo sapiens
tgcaactcttgta

SEQ ID NO: 2723039 - DNA, 15 bp, Homo sapiens
tgcaactcttgtatt

SEQ ID NO: 2723040 - DNA, 17 bp, Homo sapiens
tgcaacttgattcttgt

SEQ ID NO: 2723041 - DNA, 21 bp, Homo sapiens
tgcaagacttcactgcagcct

SEQ ID NO: 2723042 - DNA, 17 bp, Homo sapiens
tgcaatagtcagagtgt

SEQ ID NO: 2723043 - DNA, 11 bp, Homo sapiens
tgcctcagcct

SEQ ID NO: 2723044 - DNA, 16 bp, Homo sapiens
tgcctcagcctcctga

SEQ ID NO: 2723045 - DNA, 20 bp, Homo sapiens
tgcctcatcctcctcctcat

SEQ ID NO: 2723046 - DNA, 13 bp, Homo sapiens
tgcctccactccc

SEQ ID NO: 2723047 - DNA, 14 bp, Homo sapiens
tgcctccactccca

SEQ ID NO: 2723048 - DNA, 16 bp, Homo sapiens
tgcctccactcccact

SEQ ID NO: 2723049 - DNA, 17 bp, Homo sapiens
tgcctccactcccactt

SEQ ID NO: 2723050 - DNA, 15 bp, Homo sapiens
tgcctcggctcctgc

SEQ ID NO: 2723051 - DNA, 19 bp, Homo sapiens
tgcctctaactccctcctc

SEQ ID NO: 2723052 - DNA, 22 bp, Homo sapiens
tgcctctaactccctcctcaca

SEQ ID NO: 2723053 - DNA, 13 bp, Homo sapiens
tgcctgagattct

SEQ ID NO: 2723054 - DNA, 18 bp, Homo sapiens
tgcctgattcggctgtct

SEQ ID NO: 2723055 - DNA, 22 bp, Homo sapiens
tgcctgcagccccgcgcctcct

SEQ ID NO: 2723056 - DNA, 14 bp, Homo sapiens
tgcctgcctgggcc

SEQ ID NO: 2723057 - DNA, 17 bp, Homo sapiens
tgcctgcctgggcctcc

SEQ ID NO: 2723058 - DNA, 14 bp, Homo sapiens
tgcctgctgggctc

SEQ ID NO: 2723059 - DNA, 12 bp, Homo sapiens
tgcctgcttcct

SEQ ID NO: 2723060 - DNA, 14 bp, Homo sapiens
tgcctggagcaggg

SEQ ID NO: 2723061 - DNA, 15 bp, Homo sapiens
tgcctgttctccaga

SEQ ID NO: 2723062 - DNA, 18 bp, Homo sapiens
tgcctgttctccagatgg

SEQ ID NO: 2723063 - DNA, 21 bp, Homo sapiens
tgccttcataaattatttcta

SEQ ID NO: 2723064 - DNA, 19 bp, Homo sapiens
tgcgaccccatctgcccag

SEQ ID NO: 2723065 - DNA, 14 bp, Homo sapiens
tgcgagaattttca

SEQ ID NO: 2723066 - DNA, 19 bp, Homo sapiens
tgcgaggttgttttaaagt

SEQ ID NO: 2723067 - DNA, 22 bp, Homo sapiens
tgcgaggttgttttaaagtcag

SEQ ID NO: 2723068 - DNA, 14 bp, Homo sapiens
tgcggagcagcctc

SEQ ID NO: 2723069 - DNA, 15 bp, Homo sapiens
tgcggagcagcctcc

SEQ ID NO: 2723070 - DNA, 17 bp, Homo sapiens
tgcgggatggtcctggg

SEQ ID NO: 2723071 - DNA, 14 bp, Homo sapiens
tgcgggctgagggc

SEQ ID NO: 2723072 - DNA, 15 bp, Homo sapiens
tgcggtgtctgcagc

SEQ ID NO: 2723073 - DNA, 21 bp, Homo sapiens
tgcggtgtctgcagctcctgg

SEQ ID NO: 2723074 - DNA, 22 bp, Homo sapiens
tgcggtgtctgcagctcctgga

SEQ ID NO: 2723075 - DNA, 18 bp, Homo sapiens
tgctacaaaacaccttgt

SEQ ID NO: 2723076 - DNA, 14 bp, Homo sapiens
tgctacaataaatg

SEQ ID NO: 2723077 - DNA, 15 bp, Homo sapiens
tgctacaataaatgc

SEQ ID NO: 2723078 - DNA, 18 bp, Homo sapiens
tgctacaataaatgctga

SEQ ID NO: 2723079 - DNA, 19 bp, Homo sapiens
tgctacaataaatgctgaa

SEQ ID NO: 2723080 - DNA, 17 bp, Homo sapiens
tgctaccctccctgctg

SEQ ID NO: 2723081 - DNA, 18 bp, Homo sapiens
tgctaccctccctgctgt

SEQ ID NO: 2723082 - DNA, 20 bp, Homo sapiens
tgctaccctccctgctgtcc

SEQ ID NO: 2723083 - DNA, 22 bp, Homo sapiens
tgctatattttcatgacttttc

SEQ ID NO: 2723084 - DNA, 22 bp, Homo sapiens
tgctatcgcaccactgtgtatt

SEQ ID NO: 2723085 - DNA, 17 bp, Homo sapiens
tgctatctcgctagcca

SEQ ID NO: 2723086 - DNA, 14 bp, Homo sapiens
tgctatgcatgtct

SEQ ID NO: 2723087 - DNA, 21 bp, Homo sapiens
tgctcacgactcttcctgcaa

SEQ ID NO: 2723088 - DNA, 15 bp, Homo sapiens
tgctcagcagcccca

SEQ ID NO: 2723089 - DNA, 16 bp, Homo sapiens
tgctcagcagccccac

SEQ ID NO: 2723090 - DNA, 15 bp, Homo sapiens
tgctcattgtggcca

SEQ ID NO: 2723091 - DNA, 18 bp, Homo sapiens
tgctccattttcttgtca

SEQ ID NO: 2723092 - DNA, 16 bp, Homo sapiens
tgctcctagcccagca

SEQ ID NO: 2723093 - DNA, 15 bp, Homo sapiens
tccttctgccttttt

SEQ ID NO: 2723094 - DNA, 19 bp, Homo sapiens
tccttgctgtcctaggcca

SEQ ID NO: 2723095 - DNA, 21 bp, Homo sapiens
tccttgctgtcctaggccaca

SEQ ID NO: 2723096 - DNA, 14 bp, Homo sapiens
tccttggagtgctg

SEQ ID NO: 2723097 - DNA, 17 bp, Homo sapiens
tcctttaactatcagag

SEQ ID NO: 2723098 - DNA, 23 bp, Homo sapiens
tcctttaactatcagagggatct

SEQ ID NO: 2723099 - DNA, 14 bp, Homo sapiens
tcctttaggcagcc

SEQ ID NO: 2723100 - DNA, 16 bp, Homo sapiens
tcctttaggcagcctg

SEQ ID NO: 2723101 - DNA, 15 bp, Homo sapiens
tcctttatcccctcc

SEQ ID NO: 2723102 - DNA, 17 bp, Homo sapiens
tcctttgcgcaaacttt

SEQ ID NO: 2723103 - DNA, 19 bp, Homo sapiens
tccttttgcaacaagacaa

SEQ ID NO: 2723104 - DNA, 21 bp, Homo sapiens
tcgaaacctgtccataaagta

SEQ ID NO: 2723105 - DNA, 13 bp, Homo sapiens
tcgaactcctgac

SEQ ID NO: 2723106 - DNA, 15 bp, Homo sapiens
tcgaactcctgacct

SEQ ID NO: 2723107 - DNA, 21 bp, Homo sapiens
tcgacatcaccgtcattgatg

SEQ ID NO: 2723108 - DNA, 13 bp, Homo sapiens
tcgagaccagcct

SEQ ID NO: 2723109 - DNA, 16 bp, Homo sapiens
tcgagaccagcctggc

SEQ ID NO: 2723110 - DNA, 17 bp, Homo sapiens
tcgagaccagcctggcc

SEQ ID NO: 2723111 - DNA, 23 bp, Homo sapiens
tcgaggtgtcaccctgcagagct

SEQ ID NO: 2723112 - DNA, 22 bp, Homo sapiens
tcgaggtttctcaaagaaattt

SEQ ID NO: 2723113 - DNA, 17 bp, Homo sapiens
tcgagtccagtcctttg

SEQ ID NO: 2723114 - DNA, 22 bp, Homo sapiens
tcgcccaccgcatgccccctcg

SEQ ID NO: 2723115 - DNA, 18 bp, Homo sapiens
tcgccctggccagggcct

SEQ ID NO: 2723116 - DNA, 15 bp, Homo sapiens
tcgcctctgcccagc

SEQ ID NO: 2723117 - DNA, 16 bp, Homo sapiens
tcgcgctgcctgtgtg

SEQ ID NO: 2723118 - DNA, 14 bp, Homo sapiens
tcgctgatgctggg

SEQ ID NO: 2723119 - DNA, 18 bp, Homo sapiens
tcgctgatgctgggctgg

SEQ ID NO: 2723120 - DNA, 20 bp, Homo sapiens
tcgctgatgctgggctgggt

SEQ ID NO: 2723121 - DNA, 15 bp, Homo sapiens
tcgctggacaaccca

SEQ ID NO: 2723122 - DNA, 17 bp, Homo sapiens
tcgctggacaacccaga

SEQ ID NO: 2723123 - DNA, 18 bp, Homo sapiens
tcgctggacaacccagaa

SEQ ID NO: 2723124 - DNA, 21 bp, Homo sapiens
tcgctggggaagggggctcca

SEQ ID NO: 2723125 - DNA, 16 bp, Homo sapiens
tcgcttgttttaaaag

SEQ ID NO: 2723126 - DNA, 15 bp, Homo sapiens
tcggaggctcctccc

SEQ ID NO: 2723127 - DNA, 17 bp, Homo sapiens
tcggaggctcctccctc

SEQ ID NO: 2723128 - DNA, 22 bp, Homo sapiens
tcggaggctcctccctctgcct

SEQ ID NO: 2723129 - DNA, 21 bp, Homo sapiens
tcggcccatctgtccatcctc

SEQ ID NO: 2723130 - DNA, 11 bp, Homo sapiens
tcggctcctgc

SEQ ID NO: 2723131 - DNA, 16 bp, Homo sapiens
tcgggatgaaaagcca

SEQ ID NO: 2723132 - DNA, 12 bp, Homo sapiens
tcgggctcctgt

SEQ ID NO: 2723133 - DNA, 14 bp, Homo sapiens
tcgggctcctgtgc

SEQ ID NO: 2723134 - DNA, 18 bp, Homo sapiens
tcgtccaaggcagttctg

SEQ ID NO: 2723135 - DNA, 22 bp, Homo sapiens
tcgtgatatccacaaatgctat

SEQ ID NO: 2723136 - DNA, 17 bp, Homo sapiens
tcgtgatttgcctgcct

SEQ ID NO: 2723137 - DNA, 19 bp, Homo sapiens
tcgtgatttgcctgcctgg

SEQ ID NO: 2723138 - DNA, 21 bp, Homo sapiens
tcgtgccagtcgcgctgcctg

SEQ ID NO: 2723139 - DNA, 15 bp, Homo sapiens
tcgtgtgcccaccag

SEQ ID NO: 2723140 - DNA, 17 bp, Homo sapiens
tctaaacagaaattatt

SEQ ID NO: 2723141 - DNA, 13 bp, Homo sapiens
tctaaagtttaca

SEQ ID NO: 2723142 - DNA, 17 bp, Homo sapiens
tctaaagtttacagtaa

SEQ ID NO: 2723143 - DNA, 19 bp, Homo sapiens
tctaaagtttacagtaaat

SEQ ID NO: 2723144 - DNA, 12 bp, Homo sapiens
tctaaattcact

SEQ ID NO: 2723145 - DNA, 17 bp, Homo sapiens
tctaaattgatcattca

SEQ ID NO: 2723146 - DNA, 17 bp, Homo sapiens
tctaacataagtaagac

SEQ ID NO: 2723147 - DNA, 20 bp, Homo sapiens
tctaaccaaagagtctctgg

SEQ ID NO: 2723148 - DNA, 12 bp, Homo sapiens
tctaactccctc

SEQ ID NO: 2723149 - DNA, 15 bp, Homo sapiens
tctaactccctcctc

SEQ ID NO: 2723150 - DNA, 22 bp, Homo sapiens
tctaactccctcctcacactcc

SEQ ID NO: 2723151 - DNA, 17 bp, Homo sapiens
tctaagctgcagcttcc

SEQ ID NO: 2723152 - DNA, 15 bp, Homo sapiens
tctaatcataacata

SEQ ID NO: 2723153 - DNA, 14 bp, Homo sapiens
tctaattggtcatt

SEQ ID NO: 2723154 - DNA, 19 bp, Homo sapiens
tctaatttaccattatttt

SEQ ID NO: 2723155 - DNA, 14 bp, Homo sapiens
tctacacaacatgt

SEQ ID NO: 2723156 - DNA, 16 bp, Homo sapiens
tctaccctgcagcttg

SEQ ID NO: 2723157 - DNA, 20 bp, Homo sapiens
tctaccctggtaggaaagca

SEQ ID NO: 2723158 - DNA, 21 bp, Homo sapiens
tctacctttttttctctccta

SEQ ID NO: 2723159 - DNA, 15 bp, Homo sapiens
tctactcccagcgct

SEQ ID NO: 2723160 - DNA, 17 bp, Homo sapiens
tctactcctacctcagc

SEQ ID NO: 2723161 - DNA, 16 bp, Homo sapiens
tctactcctcacagca

SEQ ID NO: 2723162 - DNA, 20 bp, Homo sapiens
tctacttgatatttccttca

SEQ ID NO: 2723163 - DNA, 16 bp, Homo sapiens
tctactttttctgtac

SEQ ID NO: 2723164 - DNA, 15 bp, Homo sapiens
tctagaacacccact

SEQ ID NO: 2723165 - DNA, 20 bp, Homo sapiens
tctagaacacccactggcca

SEQ ID NO: 2723166 - DNA, 21 bp, Homo sapiens
tctagaacacccactggccag

SEQ ID NO: 2723167 - DNA, 11 bp, Homo sapiens
tctaggtcttg

SEQ ID NO: 2723168 - DNA, 11 bp, Homo sapiens
tctagtcaata

SEQ ID NO: 2723169 - DNA, 12 bp, Homo sapiens
tctagtcagcac

SEQ ID NO: 2723170 - DNA, 20 bp, Homo sapiens
tctagttctcaatcactgct

SEQ ID NO: 2723171 - DNA, 22 bp, Homo sapiens
tctagttgattgcgagaatttt

SEQ ID NO: 2723172 - DNA, 14 bp, Homo sapiens
tctataaacatgaa

SEQ ID NO: 2723173 - DNA, 23 bp, Homo sapiens
tctatgtgggaaaaaagaaatcc

SEQ ID NO: 2723174 - DNA, 22 bp, Homo sapiens
tctattgtgttggctttacaaa

SEQ ID NO: 2723175 - DNA, 12 bp, Homo sapiens
tctatttcttta

SEQ ID NO: 2723176 - DNA, 18 bp, Homo sapiens
tctattttgctggagact

SEQ ID NO: 2723177 - DNA, 21 bp, Homo sapiens
tctcaaaatatttttttaaga

SEQ ID NO: 2723178 - DNA, 17 bp, Homo sapiens
tctcaaagaaatttcca

SEQ ID NO: 2723179 - DNA, 12 bp, Homo sapiens
tctcaattttgt

SEQ ID NO: 2723180 - DNA, 11 bp, Homo sapiens
tctcacactcc

SEQ ID NO: 2723181 - DNA, 13 bp, Homo sapiens
tctcacactcctc

SEQ ID NO: 2723182 - DNA, 14 bp, Homo sapiens
tctcacactcctcc

SEQ ID NO: 2723183 - DNA, 21 bp, Homo sapiens
tctcacactcctcctgccagc

SEQ ID NO: 2723184 - DNA, 13 bp, Homo sapiens
tctcagagcctca

SEQ ID NO: 2723185 - DNA, 15 bp, Homo sapiens
tctcagagcctcagc

SEQ ID NO: 2723186 - DNA, 16 bp, Homo sapiens
tctcagagcctcagct

SEQ ID NO: 2723187 - DNA, 21 bp, Homo sapiens
tctcattcaggtgttctcttc

SEQ ID NO: 2723188 - DNA, 23 bp, Homo sapiens
tctccacctagtggctgtccagt

SEQ ID NO: 2723189 - DNA, 20 bp, Homo sapiens
tctccactgtttcatgagcc

SEQ ID NO: 2723190 - DNA, 20 bp, Homo sapiens
tctccagcctcacagatgct

SEQ ID NO: 2723191 - DNA, 17 bp, Homo sapiens
tctccagtatcctgctg

SEQ ID NO: 2723192 - DNA, 16 bp, Homo sapiens
tctgtctttgcaaagg

SEQ ID NO: 2723193 - DNA, 22 bp, Homo sapiens
tctgtgcccatgggcactgctg

SEQ ID NO: 2723194 - DNA, 15 bp, Homo sapiens
tctgtgctctgtcct

SEQ ID NO: 2723195 - DNA, 20 bp, Homo sapiens
tctgtggattcagcttctgt

SEQ ID NO: 2723196 - DNA, 21 bp, Homo sapiens
tctgtggattcagcttctgtt

SEQ ID NO: 2723197 - DNA, 20 bp, Homo sapiens
tctgtgggctgcactctgtg

SEQ ID NO: 2723198 - DNA, 17 bp, Homo sapiens
tctgtgtcactggctgc

SEQ ID NO: 2723199 - DNA, 15 bp, Homo sapiens
tctgttgccaggcta

SEQ ID NO: 2723200 - DNA, 23 bp, Homo sapiens
tcttaaaaatcttggtttggtac

SEQ ID NO: 2723201 - DNA, 14 bp, Homo sapiens
tcttaactgttgct

SEQ ID NO: 2723202 - DNA, 19 bp, Homo sapiens
tcttactttgtgcaaaagc

SEQ ID NO: 2723203 - DNA, 21 bp, Homo sapiens
tcttattcatgctttctcctt

SEQ ID NO: 2723204 - DNA, 13 bp, Homo sapiens
tcttatttaatta

SEQ ID NO: 2723205 - DNA, 11 bp, Homo sapiens
tcttatttgct

SEQ ID NO: 2723206 - DNA, 18 bp, Homo sapiens
tcttattttcttggaatt

SEQ ID NO: 2723207 - DNA, 12 bp, Homo sapiens
tcttcagctggt

SEQ ID NO: 2723208 - DNA, 17 bp, Homo sapiens
tcttccaaccccagctg

SEQ ID NO: 2723209 - DNA, 19 bp, Homo sapiens
tcttccaaccccagctggc

SEQ ID NO: 2723210 - DNA, 13 bp, Homo sapiens
tcttccaggtggg

SEQ ID NO: 2723211 - DNA, 13 bp, Homo sapiens
tcttcctgtgggg

SEQ ID NO: 2723212 - DNA, 18 bp, Homo sapiens
tcttgacctgaactctgc

SEQ ID NO: 2723213 - DNA, 12 bp, Homo sapiens
tcttgagcagac

SEQ ID NO: 2723214 - DNA, 16 bp, Homo sapiens
tcttgcattgaattta

SEQ ID NO: 2723215 - DNA, 15 bp, Homo sapiens
tcttgccccaaatca

SEQ ID NO: 2723216 - DNA, 21 bp, Homo sapiens
tcttgccccaacccccagcac

SEQ ID NO: 2723217 - DNA, 23 bp, Homo sapiens
tcttggaattttgtaaaaagaaa

SEQ ID NO: 2723218 - DNA, 13 bp, Homo sapiens
tcttggcacctgc

SEQ ID NO: 2723219 - DNA, 14 bp, Homo sapiens
tcttggcacctgcc

SEQ ID NO: 2723220 - DNA, 23 bp, Homo sapiens
tcttgggcctgacctccagtcct

SEQ ID NO: 2723221 - DNA, 20 bp, Homo sapiens
tcttggggctcgccccaccc

SEQ ID NO: 2723222 - DNA, 15 bp, Homo sapiens
tcttggtatgatcat

SEQ ID NO: 2723223 - DNA, 17 bp, Homo sapiens
tcttggtttggtacagt

SEQ ID NO: 2723224 - DNA, 16 bp, Homo sapiens
tcttgtcatcagtaag

SEQ ID NO: 2723225 - DNA, 21 bp, Homo sapiens
tcttgtttggagggatcattt

SEQ ID NO: 2723226 - DNA, 17 bp, Homo sapiens
tccccttgtccctgggg

SEQ ID NO: 2723227 - DNA, 15 bp, Homo sapiens
tcccgccccttcccc

SEQ ID NO: 2723228 - DNA, 16 bp, Homo sapiens
tcccgggaagcatcct

SEQ ID NO: 2723229 - DNA, 23 bp, Homo sapiens
tcccgtggccccagcctggccca

SEQ ID NO: 2723230 - DNA, 17 bp, Homo sapiens
tccctagatccaggctt

SEQ ID NO: 2723231 - DNA, 18 bp, Homo sapiens
tccctagcctgcttttgt

SEQ ID NO: 2723232 - DNA, 20 bp, Homo sapiens
tccctccaagaggctggaaa

SEQ ID NO: 2723233 - DNA, 22 bp, Homo sapiens
tccctccccacagtcctcacag

SEQ ID NO: 2723234 - DNA, 12 bp, Homo sapiens
tccctcctcaca

SEQ ID NO: 2723235 - DNA, 17 bp, Homo sapiens
tccctcctgttgtgaaa

SEQ ID NO: 2723236 - DNA, 23 bp, Homo sapiens
tccctctcgccctggccagggcc

SEQ ID NO: 2723237 - DNA, 17 bp, Homo sapiens
tccctctgacctgcagg

SEQ ID NO: 2723238 - DNA, 18 bp, Homo sapiens
tccctctgacctgcaggc

SEQ ID NO: 2723239 - DNA, 11 bp, Homo sapiens
tccctctgcct

SEQ ID NO: 2723240 - DNA, 13 bp, Homo sapiens
tccctctgcctga

SEQ ID NO: 2723241 - DNA, 20 bp, Homo sapiens
tccctgaagtcttgcattga

SEQ ID NO: 2723242 - DNA, 18 bp, Homo sapiens
tccctgaccttctccagg

SEQ ID NO: 2723243 - DNA, 20 bp, Homo sapiens
tccctgaccttctccaggga

SEQ ID NO: 2723244 - DNA, 20 bp, Homo sapiens
tccctgactctctgtgacct

SEQ ID NO: 2723245 - DNA, 21 bp, Homo sapiens
tccctgagttgcaccattctt

SEQ ID NO: 2723246 - DNA, 22 bp, Homo sapiens
tccctgagttgcaccattcttt

SEQ ID NO: 2723247 - DNA, 17 bp, Homo sapiens
tccctgctgtcccctct

SEQ ID NO: 2723248 - DNA, 21 bp, Homo sapiens
tccctgctgtcccctcttgcc

SEQ ID NO: 2723249 - DNA, 22 bp, Homo sapiens
tccctgctgtcccctcttgccc

SEQ ID NO: 2723250 - DNA, 21 bp, Homo sapiens
tccctgcttttctcccagaag

SEQ ID NO: 2723251 - DNA, 23 bp, Homo sapiens
tccctgggcctcagcctccaggc

SEQ ID NO: 2723252 - DNA, 14 bp, Homo sapiens
tccctggggcactc

SEQ ID NO: 2723253 - DNA, 13 bp, Homo sapiens
tccctggtccctt

SEQ ID NO: 2723254 - DNA, 14 bp, Homo sapiens
tccctggtgcagag

SEQ ID NO: 2723255 - DNA, 20 bp, Homo sapiens
tcccttagaagatctgcttc

SEQ ID NO: 2723256 - DNA, 19 bp, Homo sapiens
tcccttatgcaggacatgt

SEQ ID NO: 2723257 - DNA, 15 bp, Homo sapiens
tcccttccatttcta

SEQ ID NO: 2723258 - DNA, 20 bp, Homo sapiens
tcccttgagtaggccctgct

SEQ ID NO: 2723259 - DNA, 22 bp, Homo sapiens
tcccttgtgtgtaccacaccct

SEQ ID NO: 2723260 - DNA, 16 bp, Homo sapiens
tccctttttgcagggg

SEQ ID NO: 2723261 - DNA, 17 bp, Homo sapiens
tccctttttgcagggga

SEQ ID NO: 2723262 - DNA, 22 bp, Homo sapiens
tccctttttgcaggggactggg

SEQ ID NO: 2723263 - DNA, 23 bp, Homo sapiens
tccctttttgcaggggactgggc

SEQ ID NO: 2723264 - DNA, 21 bp, Homo sapiens
tccgacttgaattttcccact

SEQ ID NO: 2723265 - DNA, 17 bp, Homo sapiens
tccgccttcactccggt

SEQ ID NO: 2723266 - DNA, 14 bp, Homo sapiens
tccggagcgaccct

SEQ ID NO: 2723267 - DNA, 20 bp, Homo sapiens
tccgtggcaaccctcagctg

SEQ ID NO: 2723268 - DNA, 18 bp, Homo sapiens
tcctaaatattggtttgt

SEQ ID NO: 2723269 - DNA, 21 bp, Homo sapiens
tcctaatcaagagtctctcca

SEQ ID NO: 2723270 - DNA, 23 bp, Homo sapiens
tcctaatcaagagtctctccagc

SEQ ID NO: 2723271 - DNA, 13 bp, Homo sapiens
tcctacccctccc

SEQ ID NO: 2723272 - DNA, 14 bp, Homo sapiens
tcctacccctccca

SEQ ID NO: 2723273 - DNA, 15 bp, Homo sapiens
tcctacccctcccag

SEQ ID NO: 2723274 - DNA, 18 bp, Homo sapiens
tcctacccctcccagctg

SEQ ID NO: 2723275 - DNA, 13 bp, Homo sapiens
tcctacctcagcc

SEQ ID NO: 2723276 - DNA, 14 bp, Homo sapiens
tcctacctcagcct

SEQ ID NO: 2723277 - DNA, 16 bp, Homo sapiens
tcctagagctcctgtc

SEQ ID NO: 2723278 - DNA, 14 bp, Homo sapiens
tcctagaggacctg

SEQ ID NO: 2723279 - DNA, 15 bp, Homo sapiens
tcctagaggacctga

SEQ ID NO: 2723280 - DNA, 12 bp, Homo sapiens
tcctcacagcct

SEQ ID NO: 2723281 - DNA, 15 bp, Homo sapiens
tcctcacagcctctc

SEQ ID NO: 2723282 - DNA, 16 bp, Homo sapiens
tcctcacagcctctcc

SEQ ID NO: 2723283 - DNA, 15 bp, Homo sapiens
tcctcaccttttccc

SEQ ID NO: 2723284 - DNA, 17 bp, Homo sapiens
tcctcaggtagtactgg

SEQ ID NO: 2723285 - DNA, 17 bp, Homo sapiens
tcctcatgaggccatgc

SEQ ID NO: 2723286 - DNA, 15 bp, Homo sapiens
tcctcattcagacca

SEQ ID NO: 2723287 - DNA, 21 bp, Homo sapiens
tcctccaacaataaagagctc

SEQ ID NO: 2723288 - DNA, 16 bp, Homo sapiens
tcctccactccacctc

SEQ ID NO: 2723289 - DNA, 18 bp, Homo sapiens
tcctcccatggccttccc

SEQ ID NO: 2723290 - DNA, 16 bp, Homo sapiens
tcctccccaccagagc

SEQ ID NO: 2723291 - DNA, 17 bp, Homo sapiens
tcctccccaccagagct

SEQ ID NO: 2723292 - DNA, 14 bp, Homo sapiens
tcctcccccagagc

SEQ ID NO: 2723293 - DNA, 15 bp, Homo sapiens
tcctcccccagagcc

SEQ ID NO: 2723294 - DNA, 15 bp, Homo sapiens
tcctccctctgcctc

SEQ ID NO: 2723295 - DNA, 16 bp, Homo sapiens
tcctccctctgcctca

SEQ ID NO: 2723296 - DNA, 19 bp, Homo sapiens
tcctccctctgcctcatcc

SEQ ID NO: 2723297 - DNA, 16 bp, Homo sapiens
tcctcctctccatgca

SEQ ID NO: 2723298 - DNA, 14 bp, Homo sapiens
tcctcctgccagct

SEQ ID NO: 2723299 - DNA, 20 bp, Homo sapiens
tcctcctgccagctctgtca

SEQ ID NO: 2723300 - DNA, 21 bp, Homo sapiens
tcctcctgccagctctgtcac

SEQ ID NO: 2723301 - DNA, 14 bp, Homo sapiens
tcctcggcccatct

SEQ ID NO: 2723302 - DNA, 19 bp, Homo sapiens
tcctcggcccatctgtcca

SEQ ID NO: 2723303 - DNA, 22 bp, Homo sapiens
tcctcgggatgaaaagccatat

SEQ ID NO: 2723304 - DNA, 16 bp, Homo sapiens
tcctcggtactcccat

SEQ ID NO: 2723305 - DNA, 13 bp, Homo sapiens
tcctctatttctt

SEQ ID NO: 2723306 - DNA, 17 bp, Homo sapiens
tcctctcagagcctcag

SEQ ID NO: 2723307 - DNA, 14 bp, Homo sapiens
tcctctccatgcaa

SEQ ID NO: 2723308 - DNA, 12 bp, Homo sapiens
tcctctgagccg

SEQ ID NO: 2723309 - DNA, 15 bp, Homo sapiens
tcctctgcttcctga

SEQ ID NO: 2723310 - DNA, 13 bp, Homo sapiens
tcctcttatttgc

SEQ ID NO: 2723311 - DNA, 14 bp, Homo sapiens
tcctctttgcatgg

SEQ ID NO: 2723312 - DNA, 21 bp, Homo sapiens
tcctgaatttattattgttct

SEQ ID NO: 2723313 - DNA, 22 bp, Homo sapiens
tcctgacttcaggggctgcccg

SEQ ID NO: 2723314 - DNA, 13 bp, Homo sapiens
tcctgagtagctg

SEQ ID NO: 2723315 - DNA, 23 bp, Homo sapiens
tcctgatgaaaaatatgtgcttg

SEQ ID NO: 2723316 - DNA, 19 bp, Homo sapiens
tcctgcatgcataatgaac

SEQ ID NO: 2723317 - DNA, 20 bp, Homo sapiens
tcctgctgcaccaacccagc

SEQ ID NO: 2723318 - DNA, 21 bp, Homo sapiens
tcctgctgcaccaacccagcc

SEQ ID NO: 2723319 - DNA, 22 bp, Homo sapiens
tcctgctgcaccaacccagccg

SEQ ID NO: 2723320 - DNA, 18 bp, Homo sapiens
tcctgctgcagaggggca

SEQ ID NO: 2723321 - DNA, 12 bp, Homo sapiens
tcctgctggcct

SEQ ID NO: 2723322 - DNA, 16 bp, Homo sapiens
tcctgctggcctgctc

SEQ ID NO: 2723323 - DNA, 20 bp, Homo sapiens
tcctggaatgaagcatgtag

SEQ ID NO: 2723324 - DNA, 14 bp, Homo sapiens
tcctggagcatccc

SEQ ID NO: 2723325 - DNA, 16 bp, Homo sapiens
tcctggagcatcccag

SEQ ID NO: 2723326 - DNA, 16 bp, Homo sapiens
tcctggcatgacactc

SEQ ID NO: 2723327 - DNA, 14 bp, Homo sapiens
tcctggcccatcag

SEQ ID NO: 2723328 - DNA, 18 bp, Homo sapiens
tcctggcccatcagtgta

SEQ ID NO: 2723329 - DNA, 11 bp, Homo sapiens
tcctggctggc

SEQ ID NO: 2723330 - DNA, 18 bp, Homo sapiens
ggccctgcccctccccct

SEQ ID NO: 2723331 - DNA, 23 bp, Homo sapiens
ggccctgcccctccccctaccgc

SEQ ID NO: 2723332 - DNA, 17 bp, Homo sapiens
ggccctgcccctcccta

SEQ ID NO: 2723333 - DNA, 16 bp, Homo sapiens
ggccggccaggtgggc

SEQ ID NO: 2723334 - DNA, 17 bp, Homo sapiens
ggccggccctgcccctc

SEQ ID NO: 2723335 - DNA, 14 bp, Homo sapiens
ggccgtggctccag

SEQ ID NO: 2723336 - DNA, 15 bp, Homo sapiens
ggccgtggctccaga

SEQ ID NO: 2723337 - DNA, 16 bp, Homo sapiens
ggcctatcagtgtgcc

SEQ ID NO: 2723338 - DNA, 17 bp, Homo sapiens
ggcctatcagtgtgccc

SEQ ID NO: 2723339 - DNA, 18 bp, Homo sapiens
ggcctatcagtgtgcccc

SEQ ID NO: 2723340 - DNA, 23 bp, Homo sapiens
ggcctccaagtccacagtggaac

SEQ ID NO: 2723341 - DNA, 12 bp, Homo sapiens
ggcctccagact

SEQ ID NO: 2723342 - DNA, 14 bp, Homo sapiens
ggcctccagactgc

SEQ ID NO: 2723343 - DNA, 22 bp, Homo sapiens
ggcctccagactgcggagcagc

SEQ ID NO: 2723344 - DNA, 15 bp, Homo sapiens
ggcctccaggactgg

SEQ ID NO: 2723345 - DNA, 11 bp, Homo sapiens
ggcctcccctg

SEQ ID NO: 2723346 - DNA, 22 bp, Homo sapiens
ggcctcccttgagtaggccctg

SEQ ID NO: 2723347 - DNA, 17 bp, Homo sapiens
ggcctcgcctggcctga

SEQ ID NO: 2723348 - DNA, 18 bp, Homo sapiens
ggcctcggaggctcctcc

SEQ ID NO: 2723349 - DNA, 21 bp, Homo sapiens
ggcctcggaggctcctccctc

SEQ ID NO: 2723350 - DNA, 17 bp, Homo sapiens
ggcctctagaacaccca

SEQ ID NO: 2723351 - DNA, 21 bp, Homo sapiens
ggcctctagaacacccactgg

SEQ ID NO: 2723352 - DNA, 18 bp, Homo sapiens
ggcctctgtgcagacagt

SEQ ID NO: 2723353 - DNA, 22 bp, Homo sapiens
ggcctcttggcacctgcctagc

SEQ ID NO: 2723354 - DNA, 15 bp, Homo sapiens
ggcctgacctccagt

SEQ ID NO: 2723355 - DNA, 19 bp, Homo sapiens
ggcctgacctccagtcctg

SEQ ID NO: 2723356 - DNA, 21 bp, Homo sapiens
ggcctgaggtctcgctgatgc

SEQ ID NO: 2723357 - DNA, 18 bp, Homo sapiens
ggcctgctctgcttttcc

SEQ ID NO: 2723358 - DNA, 11 bp, Homo sapiens
ggcctgctgcg

SEQ ID NO: 2723359 - DNA, 19 bp, Homo sapiens
ggccttggtcccagacagc

SEQ ID NO: 2723360 - DNA, 11 bp, Homo sapiens
ggcgacagagc

SEQ ID NO: 2723361 - DNA, 23 bp, Homo sapiens
ggcgacagagcgagagtctgtct

SEQ ID NO: 2723362 - DNA, 14 bp, Homo sapiens
ggcgagaggagggg

SEQ ID NO: 2723363 - DNA, 16 bp, Homo sapiens
ggcgccctctgtcctg

SEQ ID NO: 2723364 - DNA, 20 bp, Homo sapiens
ggcgtgatctcggctcactg

SEQ ID NO: 2723365 - DNA, 21 bp, Homo sapiens
ggcgtgtgttccccagctgat

SEQ ID NO: 2723366 - DNA, 18 bp, Homo sapiens
ggctacaaaccaggagca

SEQ ID NO: 2723367 - DNA, 19 bp, Homo sapiens
ggctagtctcttctcagag

SEQ ID NO: 2723368 - DNA, 19 bp, Homo sapiens
ggctcaagaattagggccc

SEQ ID NO: 2723369 - DNA, 23 bp, Homo sapiens
ggctcacgcctatgatcccagca

SEQ ID NO: 2723370 - DNA, 16 bp, Homo sapiens
ggctcagagctgctga

SEQ ID NO: 2723371 - DNA, 21 bp, Homo sapiens
ggctcagagctgctgagcagg

SEQ ID NO: 2723372 - DNA, 13 bp, Homo sapiens
ggctcagctgtgg

SEQ ID NO: 2723373 - DNA, 14 bp, Homo sapiens
ggctcagctgtggt

SEQ ID NO: 2723374 - DNA, 17 bp, Homo sapiens
ggctccgtgagcccttg

SEQ ID NO: 2723375 - DNA, 11 bp, Homo sapiens
ggctcctgctg

SEQ ID NO: 2723376 - DNA, 11 bp, Homo sapiens
ggctcctgtcc

SEQ ID NO: 2723377 - DNA, 16 bp, Homo sapiens
ggctctgaggagtgga

SEQ ID NO: 2723378 - DNA, 14 bp, Homo sapiens
ggctctgccccagc

SEQ ID NO: 2723379 - DNA, 15 bp, Homo sapiens
ggctctgggaatggg

SEQ ID NO: 2723380 - DNA, 15 bp, Homo sapiens
ggctctgtgcaggga

SEQ ID NO: 2723381 - DNA, 12 bp, Homo sapiens
ggctctgtgggc

SEQ ID NO: 2723382 - DNA, 15 bp, Homo sapiens
ggctgacccagtgtg

SEQ ID NO: 2723383 - DNA, 22 bp, Homo sapiens
ggctgacccagtgtgtgctcag

SEQ ID NO: 2723384 - DNA, 21 bp, Homo sapiens
ggctgagactgcgggatggtc

SEQ ID NO: 2723385 - DNA, 23 bp, Homo sapiens
ggctgcacgtcaccctcctgagc

SEQ ID NO: 2723386 - DNA, 17 bp, Homo sapiens
ggctgcactctgtgccc

SEQ ID NO: 2723387 - DNA, 19 bp, Homo sapiens
ggctgcactctgtgcccat

SEQ ID NO: 2723388 - DNA, 20 bp, Homo sapiens
ggctgcactctgtgcccatg

SEQ ID NO: 2723389 - DNA, 22 bp, Homo sapiens
ggctgcagtgacgtgcacctgt

SEQ ID NO: 2723390 - DNA, 18 bp, Homo sapiens
ggctgcccgctcccagtg

SEQ ID NO: 2723391 - DNA, 12 bp, Homo sapiens
ggctgccctgcc

SEQ ID NO: 2723392 - DNA, 22 bp, Homo sapiens
ggctgccgggtggggggagggc

SEQ ID NO: 2723393 - DNA, 16 bp, Homo sapiens
ggctgctggcccacag

SEQ ID NO: 2723394 - DNA, 21 bp, Homo sapiens
ggctgctggcccacagctctg

SEQ ID NO: 2723395 - DNA, 11 bp, Homo sapiens
ggctgctgggg

SEQ ID NO: 2723396 - DNA, 22 bp, Homo sapiens
ggctggaaggagccagccagga

SEQ ID NO: 2723397 - DNA, 14 bp, Homo sapiens
ggctggccagcccc

SEQ ID NO: 2723398 - DNA, 17 bp, Homo sapiens
ggctggccagccccaca

SEQ ID NO: 2723399 - DNA, 18 bp, Homo sapiens
ggctggccagccccacag

SEQ ID NO: 2723400 - DNA, 13 bp, Homo sapiens
ggctggctggggc

SEQ ID NO: 2723401 - DNA, 17 bp, Homo sapiens
ggctgggggagggactg

SEQ ID NO: 2723402 - DNA, 21 bp, Homo sapiens
ggctgggggagggactgctga

SEQ ID NO: 2723403 - DNA, 16 bp, Homo sapiens
ggctgggtccagggga

SEQ ID NO: 2723404 - DNA, 14 bp, Homo sapiens
ggctgggtgcgacc

SEQ ID NO: 2723405 - DNA, 19 bp, Homo sapiens
ggctgggttggcgcaccct

SEQ ID NO: 2723406 - DNA, 20 bp, Homo sapiens
ggctgggttggcgcaccctc

SEQ ID NO: 2723407 - DNA, 21 bp, Homo sapiens
ggctgggttgtcactgagact

SEQ ID NO: 2723408 - DNA, 16 bp, Homo sapiens
ggctggtgaggccggc

SEQ ID NO: 2723409 - DNA, 20 bp, Homo sapiens
ggctggtgaggccggccctg

SEQ ID NO: 2723410 - DNA, 21 bp, Homo sapiens
ggctgtaagcattctgagctg

SEQ ID NO: 2723411 - DNA, 15 bp, Homo sapiens
ggctgtccagtgccc

SEQ ID NO: 2723412 - DNA, 16 bp, Homo sapiens
ggctgtccagtgccca

SEQ ID NO: 2723413 - DNA, 18 bp, Homo sapiens
ggctgtgtcctctccagc

SEQ ID NO: 2723414 - DNA, 19 bp, Homo sapiens
ggcttcaccagggttctga

SEQ ID NO: 2723415 - DNA, 22 bp, Homo sapiens
ggcttccaaggtggtctgctcg

SEQ ID NO: 2723416 - DNA, 21 bp, Homo sapiens
ggcttccagaaaaccccagca

SEQ ID NO: 2723417 - DNA, 13 bp, Homo sapiens
ggcttccctgggc

SEQ ID NO: 2723418 - DNA, 12 bp, Homo sapiens
ggcttgcctgta

SEQ ID NO: 2723419 - DNA, 23 bp, Homo sapiens
ggcttgtggactctctgcctgct

SEQ ID NO: 2723420 - DNA, 12 bp, Homo sapiens
ggctttctggag

SEQ ID NO: 2723421 - DNA, 11 bp, Homo sapiens
gggaaagctgt

SEQ ID NO: 2723422 - DNA, 20 bp, Homo sapiens
gggaaagtatttttgaaaga

SEQ ID NO: 2723423 - DNA, 18 bp, Homo sapiens
gggaagagcacagccctc

SEQ ID NO: 2723424 - DNA, 12 bp, Homo sapiens
gggaagcaggga

SEQ ID NO: 2723425 - DNA, 17 bp, Homo sapiens
gggaagcatcctcccca

SEQ ID NO: 2723426 - DNA, 18 bp, Homo sapiens
gggaagcatcctccccac

SEQ ID NO: 2723427 - DNA, 19 bp, Homo sapiens
gggaagcatcctccccacc

SEQ ID NO: 2723428 - DNA, 16 bp, Homo sapiens
gggaccactgggcccc

SEQ ID NO: 2723429 - DNA, 17 bp, Homo sapiens
gggaccactgggcccct

SEQ ID NO: 2723430 - DNA, 18 bp, Homo sapiens
gggaccactgggcccctc

SEQ ID NO: 2723431 - DNA, 20 bp, Homo sapiens
gggaccactgggcccctcag

SEQ ID NO: 2723432 - DNA, 18 bp, Homo sapiens
gggacctggagctgccag

SEQ ID NO: 2723433 - DNA, 15 bp, Homo sapiens
gggactgtgcctttg

SEQ ID NO: 2723434 - DNA, 15 bp, Homo sapiens
gggagaacctcaggc

SEQ ID NO: 2723435 - DNA, 15 bp, Homo sapiens
gggagaaggcctccc

SEQ ID NO: 2723436 - DNA, 18 bp, Homo sapiens
gggagaaggcctcccctg

SEQ ID NO: 2723437 - DNA, 12 bp, Homo sapiens
gggagctgaggc

SEQ ID NO: 2723438 - DNA, 15 bp, Homo sapiens
gggagctgaggcctc

SEQ ID NO: 2723439 - DNA, 17 bp, Homo sapiens
gggagctgaggcctccc

SEQ ID NO: 2723440 - DNA, 18 bp, Homo sapiens
gggagctgaggcctccct

SEQ ID NO: 2723441 - DNA, 23 bp, Homo sapiens
gggaggaagcaggttgaggggct

SEQ ID NO: 2723442 - DNA, 14 bp, Homo sapiens
gggaggctgaggcg

SEQ ID NO: 2723443 - DNA, 20 bp, Homo sapiens
gggagggactgctgacccac

SEQ ID NO: 2723444 - DNA, 12 bp, Homo sapiens
gggagggagctg

SEQ ID NO: 2723445 - DNA, 13 bp, Homo sapiens
gggagggcacccc

SEQ ID NO: 2723446 - DNA, 20 bp, Homo sapiens
gggcaaagaactgccccatc

SEQ ID NO: 2723447 - DNA, 23 bp, Homo sapiens
gggcacaagctcaggtcctgctg

SEQ ID NO: 2723448 - DNA, 21 bp, Homo sapiens
gggcaccctccaaacactggg

SEQ ID NO: 2723449 - DNA, 16 bp, Homo sapiens
gggcactgctgggtgg

SEQ ID NO: 2723450 - DNA, 21 bp, Homo sapiens
gggcactgctgggtggcccat

SEQ ID NO: 2723451 - DNA, 14 bp, Homo sapiens
gggcagagccggga

SEQ ID NO: 2723452 - DNA, 13 bp, Homo sapiens
gggcaggcacagc

SEQ ID NO: 2723453 - DNA, 15 bp, Homo sapiens
gggcaggcacagcac

SEQ ID NO: 2723454 - DNA, 13 bp, Homo sapiens
gggcaggccctgc

SEQ ID NO: 2723455 - DNA, 20 bp, Homo sapiens
gggcatgatgggccgagcca

SEQ ID NO: 2723456 - DNA, 20 bp, Homo sapiens
gggcatggacgttcggggca

SEQ ID NO: 2723457 - DNA, 18 bp, Homo sapiens
tttttacaaataaagatg

SEQ ID NO: 2723458 - DNA, 21 bp, Homo sapiens
tttttccccccaattgctgcc

SEQ ID NO: 2723459 - DNA, 19 bp, Homo sapiens
tttttggcaacaggagaga

SEQ ID NO: 2723460 - DNA, 16 bp, Homo sapiens
tttttgtattaacaaa

SEQ ID NO: 2723461 - DNA, 14 bp, Homo sapiens
tttttgtgaaattc

SEQ ID NO: 2723462 - DNA, 19 bp, Homo sapiens
tttttgttgagtctctgaa

SEQ ID NO: 2723463 - DNA, 23 bp, Homo sapiens
ttttttaaagaaaatgtgtctgc

SEQ ID NO: 2723464 - DNA, 13 bp, Homo sapiens
ttttttatttcca

SEQ ID NO: 2723465 - DNA, 12 bp, Homo sapiens
tttttttgagat

SEQ ID NO: 2723466 - DNA, 18 bp, Homo sapiens
tttcagattgtaaaggta

SEQ ID NO: 2723467 - DNA, 12 bp, Homo sapiens
tttcagcatcaa

SEQ ID NO: 2723468 - DNA, 21 bp, Homo sapiens
tttcagctattagcaactgtg

SEQ ID NO: 2723469 - DNA, 16 bp, Homo sapiens
tttcaggaatttaatt

SEQ ID NO: 2723470 - DNA, 12 bp, Homo sapiens
tttcatacatta

SEQ ID NO: 2723471 - DNA, 17 bp, Homo sapiens
tttcatacattatattc

SEQ ID NO: 2723472 - DNA, 15 bp, Homo sapiens
tttcatccattaaaa

SEQ ID NO: 2723473 - DNA, 21 bp, Homo sapiens
tttccaaaatctaaaagctgt

SEQ ID NO: 2723474 - DNA, 14 bp, Homo sapiens
tttccaacacacaa

SEQ ID NO: 2723475 - DNA, 23 bp, Homo sapiens
tttccagaaagaaaatgaatttg

SEQ ID NO: 2723476 - DNA, 12 bp, Homo sapiens
tttccagaattg

SEQ ID NO: 2723477 - DNA, 18 bp, Homo sapiens
tttcccagtgagcctctg

SEQ ID NO: 2723478 - DNA, 22 bp, Homo sapiens
tttcccgagcaaagtctaaagt

SEQ ID NO: 2723479 - DNA, 16 bp, Homo sapiens
tttcccgtggccccag

SEQ ID NO: 2723480 - DNA, 18 bp, Homo sapiens
tttccctccccagagttc

SEQ ID NO: 2723481 - DNA, 20 bp, Homo sapiens
tttcccttttcctctagaag

SEQ ID NO: 2723482 - DNA, 21 bp, Homo sapiens
tttccttttgcaacaagacaa

SEQ ID NO: 2723483 - DNA, 19 bp, Homo sapiens
tttctaaagctctgaacaa

SEQ ID NO: 2723484 - DNA, 11 bp, Homo sapiens
tttctactttt

SEQ ID NO: 2723485 - DNA, 22 bp, Homo sapiens
tttctactttttctgtactttt

SEQ ID NO: 2723486 - DNA, 14 bp, Homo sapiens
tttctcaaagaaat

SEQ ID NO: 2723487 - DNA, 15 bp, Homo sapiens
tttctcaagtttaaa

SEQ ID NO: 2723488 - DNA, 13 bp, Homo sapiens
tttctccccctgg

SEQ ID NO: 2723489 - DNA, 14 bp, Homo sapiens
tttctccccctggg

SEQ ID NO: 2723490 - DNA, 19 bp, Homo sapiens
tttctcgtggtagaagcca

SEQ ID NO: 2723491 - DNA, 20 bp, Homo sapiens
tttctgaccaatcactgagt

SEQ ID NO: 2723492 - DNA, 11 bp, Homo sapiens
tttctgcctga

SEQ ID NO: 2723493 - DNA, 20 bp, Homo sapiens
tttctgcctgagattcttta

SEQ ID NO: 2723494 - DNA, 15 bp, Homo sapiens
tttctggcttctgct

SEQ ID NO: 2723495 - DNA, 21 bp, Homo sapiens
tttcttaaggtcattaaaaca

SEQ ID NO: 2723496 - DNA, 19 bp, Homo sapiens
tttcttacataatttgcaa

SEQ ID NO: 2723497 - DNA, 19 bp, Homo sapiens
tttcttcaagtgagtggca

SEQ ID NO: 2723498 - DNA, 16 bp, Homo sapiens
tttctttcatacatta

SEQ ID NO: 2723499 - DNA, 20 bp, Homo sapiens
tttctttccaaaacatttct

SEQ ID NO: 2723500 - DNA, 13 bp, Homo sapiens
tttctttgctgct

SEQ ID NO: 2723501 - DNA, 17 bp, Homo sapiens
tttgaaagaattctatt

SEQ ID NO: 2723502 - DNA, 15 bp, Homo sapiens
tttgaacaaatgtat

SEQ ID NO: 2723503 - DNA, 16 bp, Homo sapiens
tttgaagtacaattgt

SEQ ID NO: 2723504 - DNA, 14 bp, Homo sapiens
tttgacaacacatg

SEQ ID NO: 2723505 - DNA, 19 bp, Homo sapiens
tttgacgaagaaacaaaaa

SEQ ID NO: 2723506 - DNA, 21 bp, Homo sapiens
tttgaggagcagcttcagttg

SEQ ID NO: 2723507 - DNA, 15 bp, Homo sapiens
tttgaggctgcagcg

SEQ ID NO: 2723508 - DNA, 12 bp, Homo sapiens
tttgaggtcttt

SEQ ID NO: 2723509 - DNA, 12 bp, Homo sapiens
tttgataacatt

SEQ ID NO: 2723510 - DNA, 15 bp, Homo sapiens
tttgatattttcaca

SEQ ID NO: 2723511 - DNA, 22 bp, Homo sapiens
tttgcacagagggcgctcctgt

SEQ ID NO: 2723512 - DNA, 15 bp, Homo sapiens
tttgcaccaaagaca

SEQ ID NO: 2723513 - DNA, 17 bp, Homo sapiens
tttgcaccaaagacatc

SEQ ID NO: 2723514 - DNA, 17 bp, Homo sapiens
tttgcactgtatgctgg

SEQ ID NO: 2723515 - DNA, 18 bp, Homo sapiens
tttgcaggcccagcagac

SEQ ID NO: 2723516 - DNA, 21 bp, Homo sapiens
tttgcatggaatttgtaagtt

SEQ ID NO: 2723517 - DNA, 16 bp, Homo sapiens
tttgcctaattcctgg

SEQ ID NO: 2723518 - DNA, 20 bp, Homo sapiens
tttgcctgcctgggcctccc

SEQ ID NO: 2723519 - DNA, 15 bp, Homo sapiens
tttgctacaataaat

SEQ ID NO: 2723520 - DNA, 22 bp, Homo sapiens
tttgctacaataaatgctgaat

SEQ ID NO: 2723521 - DNA, 18 bp, Homo sapiens
tttgctgtatacaaacag

SEQ ID NO: 2723522 - DNA, 17 bp, Homo sapiens
tttgctgtgctgtacat

SEQ ID NO: 2723523 - DNA, 13 bp, Homo sapiens
tttggaaaaatgt

SEQ ID NO: 2723524 - DNA, 19 bp, Homo sapiens
tttggagactctgtggggc

SEQ ID NO: 2723525 - DNA, 17 bp, Homo sapiens
tttggagccgggaaagc

SEQ ID NO: 2723526 - DNA, 22 bp, Homo sapiens
tttggatgtcctcaaagaagtg

SEQ ID NO: 2723527 - DNA, 21 bp, Homo sapiens
tttggctgcacgtcaccctcc

SEQ ID NO: 2723528 - DNA, 15 bp, Homo sapiens
tttgggggcttccct

SEQ ID NO: 2723529 - DNA, 23 bp, Homo sapiens
tttggtgaacattgcaatagaaa

SEQ ID NO: 2723530 - DNA, 21 bp, Homo sapiens
tttggtgagagtcaaagctga

SEQ ID NO: 2723531 - DNA, 22 bp, Homo sapiens
tttgtaaaaagaaattgtgaaa

SEQ ID NO: 2723532 - DNA, 13 bp, Homo sapiens
tttgtaagtttat

SEQ ID NO: 2723533 - DNA, 14 bp, Homo sapiens
tttgtaattattgt

SEQ ID NO: 2723534 - DNA, 14 bp, Homo sapiens
tttgtaccatggtg

SEQ ID NO: 2723535 - DNA, 17 bp, Homo sapiens
tttgtaccatggtgtga

SEQ ID NO: 2723536 - DNA, 17 bp, Homo sapiens
tttgtataccatgatgc

SEQ ID NO: 2723537 - DNA, 19 bp, Homo sapiens
tttgtcacagctcttgttt

SEQ ID NO: 2723538 - DNA, 19 bp, Homo sapiens
tttgtctttggtgaacatt

SEQ ID NO: 2723539 - DNA, 14 bp, Homo sapiens
tttgttagcaaaga

SEQ ID NO: 2723540 - DNA, 14 bp, Homo sapiens
tttgttattaaaaa

SEQ ID NO: 2723541 - DNA, 17 bp, Homo sapiens
tttgttgagtctctgaa

SEQ ID NO: 2723542 - DNA, 14 bp, Homo sapiens
tttgttgtcatgtg

SEQ ID NO: 2723543 - DNA, 14 bp, Homo sapiens
tttgtttggcactg

SEQ ID NO: 2723544 - DNA, 14 bp, Homo sapiens
tttgtttttgtaaa

SEQ ID NO: 2723545 - DNA, 11 bp, Homo sapiens
ttttaaaaata

SEQ ID NO: 2723546 - DNA, 23 bp, Homo sapiens
ttttaaaaataagttttatacat

SEQ ID NO: 2723547 - DNA, 19 bp, Homo sapiens
ttttaaacagtgtttatga

SEQ ID NO: 2723548 - DNA, 15 bp, Homo sapiens
ttttaaagaaaagtt

SEQ ID NO: 2723549 - DNA, 22 bp, Homo sapiens
ttttaaagtatgttattgcata

SEQ ID NO: 2723550 - DNA, 14 bp, Homo sapiens
ttttaaataaagca

SEQ ID NO: 2723551 - DNA, 15 bp, Homo sapiens
ttttaattgattatt

SEQ ID NO: 2723552 - DNA, 21 bp, Homo sapiens
ttttacatgaagctgtataat

SEQ ID NO: 2723553 - DNA, 12 bp, Homo sapiens
ttttaccaaagc

SEQ ID NO: 2723554 - DNA, 13 bp, Homo sapiens
ttttaccaaagca

SEQ ID NO: 2723555 - DNA, 23 bp, Homo sapiens
ttttactcacaaataaaattctt

SEQ ID NO: 2723556 - DNA, 20 bp, Homo sapiens
ttttacttccatgatacttt

SEQ ID NO: 2723557 - DNA, 14 bp, Homo sapiens
ttttagttcagact

SEQ ID NO: 2723558 - DNA, 19 bp, Homo sapiens
ttttatagtctcaaatcaa

SEQ ID NO: 2723559 - DNA, 20 bp, Homo sapiens
ttttatataaagaaaatcaa

SEQ ID NO: 2723560 - DNA, 13 bp, Homo sapiens
ttttattatttgt

SEQ ID NO: 2723561 - DNA, 16 bp, Homo sapiens
ttttattttgtaatta

SEQ ID NO: 2723562 - DNA, 24 bp, Homo sapiens
ttttcagaattgaaggagaaaatg

SEQ ID NO: 2723563 - DNA, 22 bp, Homo sapiens
ttttcagcatcaaacatgaaaa

SEQ ID NO: 2723564 - DNA, 12 bp, Homo sapiens
ttttcagcttct

SEQ ID NO: 2723565 - DNA, 17 bp, Homo sapiens
ttttcatccattaaaat

SEQ ID NO: 2723566 - DNA, 21 bp, Homo sapiens
ttttcattcaggtatttgtaa

SEQ ID NO: 2723567 - DNA, 14 bp, Homo sapiens
ttttccatgtatct

SEQ ID NO: 2723568 - DNA, 21 bp, Homo sapiens
ttttcgaactgtgctcccacg

SEQ ID NO: 2723569 - DNA, 12 bp, Homo sapiens
ttttctcccaga

SEQ ID NO: 2723570 - DNA, 23 bp, Homo sapiens
ttttctctatgaaaagcaactga

SEQ ID NO: 2723571 - DNA, 23 bp, Homo sapiens
ttttctggcttctgcttcatcct

SEQ ID NO: 2723572 - DNA, 18 bp, Homo sapiens
ttttgaaaacccctggct

SEQ ID NO: 2723573 - DNA, 21 bp, Homo sapiens
ttttgaaagaattctattttg

SEQ ID NO: 2723574 - DNA, 20 bp, Homo sapiens
ttttgaatgtcataaagaag

SEQ ID NO: 2723575 - DNA, 16 bp, Homo sapiens
ttttgcaggggactgg

SEQ ID NO: 2723576 - DNA, 21 bp, Homo sapiens
ttttgctggagactatttaag

SEQ ID NO: 2723577 - DNA, 18 bp, Homo sapiens
ttttggaaaaatgtcact

SEQ ID NO: 2723578 - DNA, 16 bp, Homo sapiens
ttttgtaaatgagaca

SEQ ID NO: 2723579 - DNA, 15 bp, Homo sapiens
ttttgtacattatgt

SEQ ID NO: 2723580 - DNA, 17 bp, Homo sapiens
ttttgtacattatgtta

SEQ ID NO: 2723581 - DNA, 15 bp, Homo sapiens
ttttgtatttaatga

SEQ ID NO: 2723582 - DNA, 19 bp, Homo sapiens
ttttgtcacagctcttgtt

SEQ ID NO: 2723583 - DNA, 21 bp, Homo sapiens
ttttgttattaaaaaaacaca

SEQ ID NO: 2723584 - DNA, 22 bp, Homo sapiens
ttttgttattaaaaaaacacaa

SEQ ID NO: 2723585 - DNA, 18 bp, Homo sapiens
ttttgttgagtctctgaa

SEQ ID NO: 2723586 - DNA, 14 bp, Homo sapiens
ttttgttttcttca

SEQ ID NO: 2723587 - DNA, 19 bp, Homo sapiens
ttttgtttttgtaaaaaag

SEQ ID NO: 2723588 - DNA, 22 bp, Homo sapiens
ttttgttttttaagttttgcac

SEQ ID NO: 2723589 - DNA, 23 bp, Homo sapiens
ttttgttttttaagttttgcact

SEQ ID NO: 2723590 - DNA, 14 bp, Homo sapiens
tttttaaagcaaat

SEQ ID NO: 2723591 - DNA, 13 bp, Homo sapiens
tttttaagcaaat

SEQ ID NO: 2723592 - DNA, 14 bp, Homo sapiens
tttttaatttatga

SEQ ID NO: 2723593 - DNA, 22 bp, Homo sapiens
aaagagtctctggctcagctgt

SEQ ID NO: 2723594 - DNA, 23 bp, Homo sapiens
aaccacactgaaacctcttcggt

SEQ ID NO: 2723595 - DNA, 17 bp, Homo sapiens
aaccacacttcttgaaa

SEQ ID NO: 2723596 - DNA, 18 bp, Homo sapiens
aagctctgaacaaaagct

SEQ ID NO: 2723597 - DNA, 12 bp, Homo sapiens
aagctgcagctt

SEQ ID NO: 2723598 - DNA, 17 bp, Homo sapiens
aagctgcagcttcctgt

SEQ ID NO: 2723599 - DNA, 22 bp, Homo sapiens
aagctgggactcattcacattt

SEQ ID NO: 2723600 - DNA, 18 bp, Homo sapiens
aagctgtaaaaagagaga

SEQ ID NO: 2723601 - DNA, 14 bp, Homo sapiens
aagctgtgtctctg

SEQ ID NO: 2723602 - DNA, 22 bp, Homo sapiens
aagcttacccttggtttgcaca

SEQ ID NO: 2723603 - DNA, 23 bp, Homo sapiens
aagcttacccttggtttgcacat

SEQ ID NO: 2723604 - DNA, 19 bp, Homo sapiens
aatcataacatagttgaaa

SEQ ID NO: 2723605 - DNA, 24 bp, Homo sapiens
aatcataaccaccctagctttata

SEQ ID NO: 2723606 - DNA, 12 bp, Homo sapiens
aatcattttata

SEQ ID NO: 2723607 - DNA, 19 bp, Homo sapiens
aatccatgtgctgctgtgg

SEQ ID NO: 2723608 - DNA, 23 bp, Homo sapiens
aatccatttggcagaactgctgg

SEQ ID NO: 2723609 - DNA, 20 bp, Homo sapiens
aatcccagctattcaggagg

SEQ ID NO: 2723610 - DNA, 20 bp, Homo sapiens
aatcccccagcgcttagaaa

SEQ ID NO: 2723611 - DNA, 21 bp, Homo sapiens
aatcccccagcgcttagaaac

SEQ ID NO: 2723612 - DNA, 21 bp, Homo sapiens
aatcctacttctatatcatta

SEQ ID NO: 2723613 - DNA, 11 bp, Homo sapiens
aatcctgggcc

SEQ ID NO: 2723614 - DNA, 12 bp, Homo sapiens
aatcctgggccc

SEQ ID NO: 2723615 - DNA, 19 bp, Homo sapiens
aatcctgggcccccagaga

SEQ ID NO: 2723616 - DNA, 15 bp, Homo sapiens
aatctactagaacct

SEQ ID NO: 2723617 - DNA, 18 bp, Homo sapiens
aatctcctctaaaacaac

SEQ ID NO: 2723618 - DNA, 18 bp, Homo sapiens
aatctgcagggagcaact

SEQ ID NO: 2723619 - DNA, 15 bp, Homo sapiens
acaagctccctggtg

SEQ ID NO: 2723620 - DNA, 15 bp, Homo sapiens
acaaggactcagatg

SEQ ID NO: 2723621 - DNA, 14 bp, Homo sapiens
acaaggtgcacaga

SEQ ID NO: 2723622 - DNA, 20 bp, Homo sapiens
acaagttaaggtatctggta

SEQ ID NO: 2723623 - DNA, 14 bp, Homo sapiens
acaataaagagctc

SEQ ID NO: 2723624 - DNA, 16 bp, Homo sapiens
acaataaagagctcaa

SEQ ID NO: 2723625 - DNA, 11 bp, Homo sapiens
acaataaatgc

SEQ ID NO: 2723626 - DNA, 17 bp, Homo sapiens
acaatatgattgcacta

SEQ ID NO: 2723627 - DNA, 15 bp, Homo sapiens
acaatcaacttttct

SEQ ID NO: 2723628 - DNA, 12 bp, Homo sapiens
acaatccaaatg

SEQ ID NO: 2723629 - DNA, 22 bp, Homo sapiens
acaatgtacaaggtatgtacag

SEQ ID NO: 2723630 - DNA, 13 bp, Homo sapiens
acacaacatgtat

SEQ ID NO: 2723631 - DNA, 21 bp, Homo sapiens
acacaatgttgcactgaaaac

SEQ ID NO: 2723632 - DNA, 14 bp, Homo sapiens
acacactccttccc

SEQ ID NO: 2723633 - DNA, 16 bp, Homo sapiens
acacactccttcccct

SEQ ID NO: 2723634 - DNA, 21 bp, Homo sapiens
acacagctgagctggcctatt

SEQ ID NO: 2723635 - DNA, 13 bp, Homo sapiens
acacatacaaaaa

SEQ ID NO: 2723636 - DNA, 21 bp, Homo sapiens
acacatacaaaaaaaatcttt

SEQ ID NO: 2723637 - DNA, 16 bp, Homo sapiens
acaccaagctgtgcca

SEQ ID NO: 2723638 - DNA, 18 bp, Homo sapiens
acaccaagctgtgccacc

SEQ ID NO: 2723639 - DNA, 22 bp, Homo sapiens
acaccagtgtcgtgtctgctgt

SEQ ID NO: 2723640 - DNA, 17 bp, Homo sapiens
acaccattctcctgcct

SEQ ID NO: 2723641 - DNA, 15 bp, Homo sapiens
aggagccagccagga

SEQ ID NO: 2723642 - DNA, 11 bp, Homo sapiens
aggaggagaaa

SEQ ID NO: 2723643 - DNA, 21 bp, Homo sapiens
aggaggcaggatatccccagg

SEQ ID NO: 2723644 - DNA, 19 bp, Homo sapiens
aggaggctccgtgagccct

SEQ ID NO: 2723645 - DNA, 12 bp, Homo sapiens
aggaggctgagg

SEQ ID NO: 2723646 - DNA, 13 bp, Homo sapiens
aggaggctggctg

SEQ ID NO: 2723647 - DNA, 15 bp, Homo sapiens
aggaggtgccaacag

SEQ ID NO: 2723648 - DNA, 18 bp, Homo sapiens
aggaggtggcagccctgt

SEQ ID NO: 2723649 - DNA, 21 bp, Homo sapiens
aggagtcccttagaagatctg

SEQ ID NO: 2723650 - DNA, 22 bp, Homo sapiens
aggagtggagttctctgttcta

SEQ ID NO: 2723651 - DNA, 18 bp, Homo sapiens
aggagtgtcctgtctgct

SEQ ID NO: 2723652 - DNA, 19 bp, Homo sapiens
aggagtgtcctgtctgctg

SEQ ID NO: 2723653 - DNA, 20 bp, Homo sapiens
aggagtgtcctgtctgctgg

SEQ ID NO: 2723654 - DNA, 22 bp, Homo sapiens
aggagttcgagaccagcctggc

SEQ ID NO: 2723655 - DNA, 15 bp, Homo sapiens
aggataaattacatt

SEQ ID NO: 2723656 - DNA, 19 bp, Homo sapiens
aggatatccccagggaaac

SEQ ID NO: 2723657 - DNA, 14 bp, Homo sapiens
aggatcactggagc

SEQ ID NO: 2723658 - DNA, 16 bp, Homo sapiens
aggatcactggagccc

SEQ ID NO: 2723659 - DNA, 16 bp, Homo sapiens
aggatcccctgtcccc

SEQ ID NO: 2723660 - DNA, 19 bp, Homo sapiens
aggatcccctgtcccctgg

SEQ ID NO: 2723661 - DNA, 20 bp, Homo sapiens
aggatcccctgtcccctggg

SEQ ID NO: 2723662 - DNA, 15 bp, Homo sapiens
aggatgcgctgggac

SEQ ID NO: 2723663 - DNA, 13 bp, Homo sapiens
aggatgctgtcag

SEQ ID NO: 2723664 - DNA, 15 bp, Homo sapiens
aggatgctgtcagga

SEQ ID NO: 2723665 - DNA, 16 bp, Homo sapiens
aggatgctgtcaggag

SEQ ID NO: 2723666 - DNA, 23 bp, Homo sapiens
aggatggtcttgatctcctgagc

SEQ ID NO: 2723667 - DNA, 13 bp, Homo sapiens
aggattcccagag

SEQ ID NO: 2723668 - DNA, 14 bp, Homo sapiens
aggattcccagaga

SEQ ID NO: 2723669 - DNA, 14 bp, Homo sapiens
aggattttaccaaa

SEQ ID NO: 2723670 - DNA, 20 bp, Homo sapiens
aggcaaaggccagcagcaga

SEQ ID NO: 2723671 - DNA, 18 bp, Homo sapiens
aggcacatggctggggga

SEQ ID NO: 2723672 - DNA, 21 bp, Homo sapiens
aggcactaagtcatggtcctg

SEQ ID NO: 2723673 - DNA, 15 bp, Homo sapiens
aggcagcgcctgtcc

SEQ ID NO: 2723674 - DNA, 19 bp, Homo sapiens
aggcagcgcctgtcccctc

SEQ ID NO: 2723675 - DNA, 13 bp, Homo sapiens
aggcagctccagc

SEQ ID NO: 2723676 - DNA, 14 bp, Homo sapiens
aggcagctcgagca

SEQ ID NO: 2723677 - DNA, 16 bp, Homo sapiens
aggcagggatttgagg

SEQ ID NO: 2723678 - DNA, 19 bp, Homo sapiens
aggcagtgggtcccacttc

SEQ ID NO: 2723679 - DNA, 21 bp, Homo sapiens
aggcatccatagtgcactagc

SEQ ID NO: 2723680 - DNA, 21 bp, Homo sapiens
aggccacaccatctcctttca

SEQ ID NO: 2723681 - DNA, 15 bp, Homo sapiens
aggccatcttccagg

SEQ ID NO: 2723682 - DNA, 18 bp, Homo sapiens
aggccatcttccaggtgg

SEQ ID NO: 2723683 - DNA, 15 bp, Homo sapiens
aggccatgcaagggt

SEQ ID NO: 2723684 - DNA, 13 bp, Homo sapiens
aggcccagcctgt

SEQ ID NO: 2723685 - DNA, 18 bp, Homo sapiens
aggcccagcctgtcctgg

SEQ ID NO: 2723686 - DNA, 14 bp, Homo sapiens
aggccccaggccct

SEQ ID NO: 2723687 - DNA, 13 bp, Homo sapiens
aggccctgcactg

SEQ ID NO: 2723688 - DNA, 15 bp, Homo sapiens
aggccctgcactgtc

SEQ ID NO: 2723689 - DNA, 19 bp, Homo sapiens
aggccctgcactgtcctgc

SEQ ID NO: 2723690 - DNA, 22 bp, Homo sapiens
aggccctgcactgtcctgctcc

SEQ ID NO: 2723691 - DNA, 23 bp, Homo sapiens
aggcccttggtagagctggtgcc

SEQ ID NO: 2723692 - DNA, 13 bp, Homo sapiens
aggccggccctgc

SEQ ID NO: 2723693 - DNA, 16 bp, Homo sapiens
aggccggccctgcccc

SEQ ID NO: 2723694 - DNA, 17 bp, Homo sapiens
aggccggccctgcccct

SEQ ID NO: 2723695 - DNA, 18 bp, Homo sapiens
aggccggccctgcccctc

SEQ ID NO: 2723696 - DNA, 19 bp, Homo sapiens
aggccggccctgcccctcc

SEQ ID NO: 2723697 - DNA, 20 bp, Homo sapiens
aggccggccctgcccctccc

SEQ ID NO: 2723698 - DNA, 21 bp, Homo sapiens
aggccggccctgcccctccct

SEQ ID NO: 2723699 - DNA, 23 bp, Homo sapiens
aggccggccctgcccctccctag

SEQ ID NO: 2723700 - DNA, 24 bp, Homo sapiens
aggccggccctgcccctccctaga

SEQ ID NO: 2723701 - DNA, 14 bp, Homo sapiens
aggcctcccacagt

SEQ ID NO: 2723702 - DNA, 18 bp, Homo sapiens
aggcctcccacagtgact

SEQ ID NO: 2723703 - DNA, 13 bp, Homo sapiens
aggcctcccctga

SEQ ID NO: 2723704 - DNA, 14 bp, Homo sapiens
aggcctggcacagt

SEQ ID NO: 2723705 - DNA, 15 bp, Homo sapiens
aggcctggcacagtg

SEQ ID NO: 2723706 - DNA, 16 bp, Homo sapiens
aggcctggcacagtgt

SEQ ID NO: 2723707 - DNA, 20 bp, Homo sapiens
aggctagagtgcagtggcgt

SEQ ID NO: 2723708 - DNA, 20 bp, Homo sapiens
aggctagtctcttctcagag

SEQ ID NO: 2723709 - DNA, 21 bp, Homo sapiens
aggctagtctcttctcagagc

SEQ ID NO: 2723710 - DNA, 15 bp, Homo sapiens
aggctccgtgagccc

SEQ ID NO: 2723711 - DNA, 16 bp, Homo sapiens
aggctccgtgagccct

SEQ ID NO: 2723712 - DNA, 18 bp, Homo sapiens
aggctccgtgagcccttg

SEQ ID NO: 2723713 - DNA, 12 bp, Homo sapiens
aggctcctgtcc

SEQ ID NO: 2723714 - DNA, 15 bp, Homo sapiens
aggctctttctgggc

SEQ ID NO: 2723715 - DNA, 20 bp, Homo sapiens
aggctctttctgggccaagt

SEQ ID NO: 2723716 - DNA, 15 bp, Homo sapiens
aggctgagagctctc

SEQ ID NO: 2723717 - DNA, 15 bp, Homo sapiens
aggctgaggcaccag

SEQ ID NO: 2723718 - DNA, 20 bp, Homo sapiens
aggctgaggcaccagaattg

SEQ ID NO: 2723719 - DNA, 19 bp, Homo sapiens
aggctgatgcattcccggt

SEQ ID NO: 2723720 - DNA, 14 bp, Homo sapiens
aggctgcgtcctga

SEQ ID NO: 2723721 - DNA, 20 bp, Homo sapiens
aggctgctttttgctttctt

SEQ ID NO: 2723722 - DNA, 14 bp, Homo sapiens
aggctggcatcctg

SEQ ID NO: 2723723 - DNA, 19 bp, Homo sapiens
aggctggcatcctggctgg

SEQ ID NO: 2723724 - DNA, 20 bp, Homo sapiens
aggctggcatcctggctggc

SEQ ID NO: 2723725 - DNA, 14 bp, Homo sapiens
aggctggccagccc

SEQ ID NO: 2723726 - DNA, 12 bp, Homo sapiens
aggctggctggg

SEQ ID NO: 2723727 - DNA, 15 bp, Homo sapiens
aggctggctggggcc

SEQ ID NO: 2723728 - DNA, 17 bp, Homo sapiens
aggctgggtccagggga

SEQ ID NO: 2723729 - DNA, 16 bp, Homo sapiens
aggcttaggtgccagg

SEQ ID NO: 2723730 - DNA, 14 bp, Homo sapiens
aggcttctcccgga

SEQ ID NO: 2723731 - DNA, 18 bp, Homo sapiens
aggcttctcccggacctg

SEQ ID NO: 2723732 - DNA, 18 bp, Homo sapiens
aggctttggcaacagaaa

SEQ ID NO: 2723733 - DNA, 19 bp, Homo sapiens
aggctttgtctgctcccaa

SEQ ID NO: 2723734 - DNA, 13 bp, Homo sapiens
agggaacatgcag

SEQ ID NO: 2723735 - DNA, 19 bp, Homo sapiens
agggaacggggtccttcaa

SEQ ID NO: 2723736 - DNA, 15 bp, Homo sapiens
agggaatttcaggaa

SEQ ID NO: 2723737 - DNA, 17 bp, Homo sapiens
agggacactacaaacat

SEQ ID NO: 2723738 - DNA, 23 bp, Homo sapiens
agggaccactgggtgagagagga

SEQ ID NO: 2723739 - DNA, 16 bp, Homo sapiens
agggactcaggccagt

SEQ ID NO: 2723740 - DNA, 23 bp, Homo sapiens
agggagataaaagaaccccagac

SEQ ID NO: 2723741 - DNA, 15 bp, Homo sapiens
agggagctgaggcct

SEQ ID NO: 2723742 - DNA, 19 bp, Homo sapiens
agggagctgaggcctccct

SEQ ID NO: 2723743 - DNA, 14 bp, Homo sapiens
agggagggagctga

SEQ ID NO: 2723744 - DNA, 22 bp, Homo sapiens
agggatgctatctcgctagcca

SEQ ID NO: 2723745 - DNA, 23 bp, Homo sapiens
agggatgctatctcgctagccat

SEQ ID NO: 2723746 - DNA, 18 bp, Homo sapiens
agggatgctgcctgagtc

SEQ ID NO: 2723747 - DNA, 15 bp, Homo sapiens
agggcagagccggga

SEQ ID NO: 2723748 - DNA, 18 bp, Homo sapiens
agggcatccttctgcctt

SEQ ID NO: 2723749 - DNA, 16 bp, Homo sapiens
agggcatctctgagtg

SEQ ID NO: 2723750 - DNA, 14 bp, Homo sapiens
agggccagggccct

SEQ ID NO: 2723751 - DNA, 14 bp, Homo sapiens
agggcccaggcagg

SEQ ID NO: 2723752 - DNA, 17 bp, Homo sapiens
agggcccaggcaggcca

SEQ ID NO: 2723753 - DNA, 21 bp, Homo sapiens
agggccccaactacacacccc

SEQ ID NO: 2723754 - DNA, 13 bp, Homo sapiens
agggcctccagga

SEQ ID NO: 2723755 - DNA, 20 bp, Homo sapiens
agggcctcggaggctcctcc

SEQ ID NO: 2723756 - DNA, 21 bp, Homo sapiens
agggcctcggaggctcctccc

SEQ ID NO: 2723757 - DNA, 22 bp, Homo sapiens
agggcctcggaggctcctccct

SEQ ID NO: 2723758 - DNA, 22 bp, Homo sapiens
agggcctggccttgtccccagc

SEQ ID NO: 2723759 - DNA, 15 bp, Homo sapiens
agggcgggagtgggg

SEQ ID NO: 2723760 - DNA, 22 bp, Homo sapiens
agggcgtcgctggacaacccag

SEQ ID NO: 2723761 - DNA, 14 bp, Homo sapiens
agggctccctcctg

SEQ ID NO: 2723762 - DNA, 22 bp, Homo sapiens
agggctggactctggcacccag

SEQ ID NO: 2723763 - DNA, 23 bp, Homo sapiens
agggcttgtggactctctgcctg

SEQ ID NO: 2723764 - DNA, 14 bp, Homo sapiens
aggggaaggactgg

SEQ ID NO: 2723765 - DNA, 18 bp, Homo sapiens
aggggacctggagctgcc

SEQ ID NO: 2723766 - DNA, 14 bp, Homo sapiens
aggggactgggcca

SEQ ID NO: 2723767 - DNA, 18 bp, Homo sapiens
aggggcaaagaactgccc

SEQ ID NO: 2723768 - DNA, 17 bp, Homo sapiens
aggggcaccctccaaac

SEQ ID NO: 2723769 - DNA, 16 bp, Homo sapiens
aggggcaggcacagca

SEQ ID NO: 2723770 - DNA, 15 bp, Homo sapiens
aggggcccgcttgcc

SEQ ID NO: 2723771 - DNA, 19 bp, Homo sapiens
aggggcccgcttgcctcgg

SEQ ID NO: 2723772 - DNA, 12 bp, Homo sapiens
aggggccctggt

SEQ ID NO: 2723773 - DNA, 13 bp, Homo sapiens
aggggctcctgga

SEQ ID NO: 2723774 - DNA, 12 bp, Homo sapiens
aggggctgcccg

SEQ ID NO: 2723775 - DNA, 16 bp, Homo sapiens
aggggctgcccgctcc

SEQ ID NO: 2723776 - DNA, 13 bp, Homo sapiens
aggggctgctggg

SEQ ID NO: 2723777 - DNA, 14 bp, Homo sapiens
aggggggagggctg

SEQ ID NO: 2723778 - DNA, 15 bp, Homo sapiens
aggggtaccaggcac

SEQ ID NO: 2723779 - DNA, 23 bp, Homo sapiens
aggggtggtttctacggtgacag

SEQ ID NO: 2723780 - DNA, 22 bp, Homo sapiens
agggtaataaacttagaataaa

SEQ ID NO: 2723781 - DNA, 14 bp, Homo sapiens
agggtagccctggg

SEQ ID NO: 2723782 - DNA, 17 bp, Homo sapiens
agggtatgggaagccat

SEQ ID NO: 2723783 - DNA, 17 bp, Homo sapiens
agggtgaacaaagaaaa

SEQ ID NO: 2723784 - DNA, 22 bp, Homo sapiens
agggtgacccatttcaggaggt

SEQ ID NO: 2723785 - DNA, 14 bp, Homo sapiens
aggtaatcattcca

SEQ ID NO: 2723786 - DNA, 17 bp, Homo sapiens
aggtaatttttttttgt

SEQ ID NO: 2723787 - DNA, 14 bp, Homo sapiens
aggtagcgagctgc

SEQ ID NO: 2723788 - DNA, 17 bp, Homo sapiens
aggtagcgagctgctct

SEQ ID NO: 2723789 - DNA, 23 bp, Homo sapiens
aggtcattaaaacagaagcaaat

SEQ ID NO: 2723790 - DNA, 15 bp, Homo sapiens
aggtcgcacctcctt

SEQ ID NO: 2723791 - DNA, 19 bp, Homo sapiens
aggtctcacactcctcctg

SEQ ID NO: 2723792 - DNA, 12 bp, Homo sapiens
aggtctcctcca

SEQ ID NO: 2723793 - DNA, 15 bp, Homo sapiens
aggtctcctccaccg

SEQ ID NO: 2723794 - DNA, 18 bp, Homo sapiens
aggtctcctccaccgcca

SEQ ID NO: 2723795 - DNA, 22 bp, Homo sapiens
aggtctgggccagatgctgggc

SEQ ID NO: 2723796 - DNA, 17 bp, Homo sapiens
aggtcttcttgtgtcct

SEQ ID NO: 2723797 - DNA, 20 bp, Homo sapiens
aggtcttggttagagaagta

SEQ ID NO: 2723798 - DNA, 16 bp, Homo sapiens
aggtgacggactcaga

SEQ ID NO: 2723799 - DNA, 14 bp, Homo sapiens
aggtgacttgcctg

SEQ ID NO: 2723800 - DNA, 19 bp, Homo sapiens
aggtgccgatttcatgcat

SEQ ID NO: 2723801 - DNA, 23 bp, Homo sapiens
aggtgctgctaccctccctgctg

SEQ ID NO: 2723802 - DNA, 18 bp, Homo sapiens
aggtggaggttgcagtga

SEQ ID NO: 2723803 - DNA, 20 bp, Homo sapiens
aggtggaggttgcagtgaac

SEQ ID NO: 2723804 - DNA, 15 bp, Homo sapiens
aggtgggctgagccc

SEQ ID NO: 2723805 - DNA, 17 bp, Homo sapiens
aggtgggctgagccctg

SEQ ID NO: 2723806 - DNA, 18 bp, Homo sapiens
aggtgggctgagccctgg

SEQ ID NO: 2723807 - DNA, 20 bp, Homo sapiens
aggtgggctgagccctggca

SEQ ID NO: 2723808 - DNA, 22 bp, Homo sapiens
aggtggtctgctcgggcccagg

SEQ ID NO: 2723809 - DNA, 20 bp, Homo sapiens
aggtgtcaccctgcagagct

SEQ ID NO: 2723810 - DNA, 22 bp, Homo sapiens
aggtgtcatttgacaacacatg

SEQ ID NO: 2723811 - DNA, 21 bp, Homo sapiens
aggttaggagttcgagaccag

SEQ ID NO: 2723812 - DNA, 15 bp, Homo sapiens
aggttggaaaagaaa

SEQ ID NO: 2723813 - DNA, 20 bp, Homo sapiens
aggtttagaatcaagtctgt

SEQ ID NO: 2723814 - DNA, 19 bp, Homo sapiens
aggtttcccagtgagcctc

SEQ ID NO: 2723815 - DNA, 21 bp, Homo sapiens
aggtttggagccgggaaagct

SEQ ID NO: 2723816 - DNA, 17 bp, Homo sapiens
aggtttttatgtgcctt

SEQ ID NO: 2723817 - DNA, 11 bp, Homo sapiens
agtaaagtttt

SEQ ID NO: 2723818 - DNA, 20 bp, Homo sapiens
agtaagcagagttctttgca

SEQ ID NO: 2723819 - DNA, 17 bp, Homo sapiens
agtaagtataacaaact

SEQ ID NO: 2723820 - DNA, 17 bp, Homo sapiens
agtacaattgttatgat

SEQ ID NO: 2723821 - DNA, 15 bp, Homo sapiens
agtaccactcaggcc

SEQ ID NO: 2723822 - DNA, 17 bp, Homo sapiens
agtacctgattgtattt

SEQ ID NO: 2723823 - DNA, 15 bp, Homo sapiens
agtactgggaaggag

SEQ ID NO: 2723824 - DNA, 12 bp, Homo sapiens
agtagctgagat

SEQ ID NO: 2723825 - DNA, 21 bp, Homo sapiens
agtagctgagattacaggcgc

SEQ ID NO: 2723826 - DNA, 12 bp, Homo sapiens
agtaggccctgc

SEQ ID NO: 2723827 - DNA, 22 bp, Homo sapiens
agtagggaaaatagggtccttg

SEQ ID NO: 2723828 - DNA, 19 bp, Homo sapiens
agtataaaataaagcaaat

SEQ ID NO: 2723829 - DNA, 14 bp, Homo sapiens
agtataacaaacta

SEQ ID NO: 2723830 - DNA, 15 bp, Homo sapiens
agtatatattctaca

SEQ ID NO: 2723831 - DNA, 12 bp, Homo sapiens
agtatctattgt

SEQ ID NO: 2723832 - DNA, 20 bp, Homo sapiens
agtatgtctactcctcacag

SEQ ID NO: 2723833 - DNA, 16 bp, Homo sapiens
agtatttttgaaagaa

SEQ ID NO: 2723834 - DNA, 20 bp, Homo sapiens
agtatttttgaaagaattct

SEQ ID NO: 2723835 - DNA, 23 bp, Homo sapiens
agtatttttgaaagaattctatt

SEQ ID NO: 2723836 - DNA, 21 bp, Homo sapiens
agtcaagttccctcctgcagc

SEQ ID NO: 2723837 - DNA, 22 bp, Homo sapiens
agtcaagttccctcctgcagcc

SEQ ID NO: 2723838 - DNA, 15 bp, Homo sapiens
agtcaatcaaacagg

SEQ ID NO: 2723839 - DNA, 11 bp, Homo sapiens
agtcaccatgc

SEQ ID NO: 2723840 - DNA, 13 bp, Homo sapiens
agtcaccatgcaa

SEQ ID NO: 2723841 - DNA, 15 bp, Homo sapiens
agtcagactgctggg

SEQ ID NO: 2723842 - DNA, 14 bp, Homo sapiens
agtcagatgcccag

SEQ ID NO: 2723843 - DNA, 22 bp, Homo sapiens
agtcagccttccccctcccagg

SEQ ID NO: 2723844 - DNA, 23 bp, Homo sapiens
agtcattattattactttttaaa

SEQ ID NO: 2723845 - DNA, 16 bp, Homo sapiens
agtccaacctgcctgt

SEQ ID NO: 2723846 - DNA, 20 bp, Homo sapiens
agtccagggcgggagtgggg

SEQ ID NO: 2723847 - DNA, 22 bp, Homo sapiens
agtcccagctactcagaagcct

SEQ ID NO: 2723848 - DNA, 19 bp, Homo sapiens
agtccctgactctctgtga

SEQ ID NO: 2723849 - DNA, 21 bp, Homo sapiens
agtccctgactctctgtgacc

SEQ ID NO: 2723850 - DNA, 16 bp, Homo sapiens
agtccctgtgttctgc

SEQ ID NO: 2723851 - DNA, 15 bp, Homo sapiens
agtcccttaaaaatt

SEQ ID NO: 2723852 - DNA, 15 bp, Homo sapiens
agtcctagagctcct

SEQ ID NO: 2723853 - DNA, 22 bp, Homo sapiens
agtcctagagctcctgtcccta

SEQ ID NO: 2723854 - DNA, 13 bp, Homo sapiens
agtcctcacagcc

SEQ ID NO: 2723855 - DNA, 21 bp, Homo sapiens
agtcctcgtagccatctctct

SEQ ID NO: 2723856 - DNA, 13 bp, Homo sapiens
agtcctctccacc

SEQ ID NO: 2723857 - DNA, 14 bp, Homo sapiens
agtcctctccacct

SEQ ID NO: 2723858 - DNA, 19 bp, Homo sapiens
agtcctctccacctagtgg

SEQ ID NO: 2723859 - DNA, 22 bp, Homo sapiens
agtcctgggagaacctcaggct

SEQ ID NO: 2723860 - DNA, 14 bp, Homo sapiens
agtcctttttgtaa

SEQ ID NO: 2723861 - DNA, 13 bp, Homo sapiens
agtcgtcaagttg

SEQ ID NO: 2723862 - DNA, 17 bp, Homo sapiens
agtctaaagtttacagt

SEQ ID NO: 2723863 - DNA, 18 bp, Homo sapiens
agtctaaagtttacagta

SEQ ID NO: 2723864 - DNA, 20 bp, Homo sapiens
agtctaaagtttacagtaaa

SEQ ID NO: 2723865 - DNA, 23 bp, Homo sapiens
agtctaaagtttacagtaaataa

SEQ ID NO: 2723866 - DNA, 17 bp, Homo sapiens
agtctcaattttgtatt

SEQ ID NO: 2723867 - DNA, 19 bp, Homo sapiens
agtctcaattttgtattta

SEQ ID NO: 2723868 - DNA, 13 bp, Homo sapiens
agtctcaggagca

SEQ ID NO: 2723869 - DNA, 17 bp, Homo sapiens
agtctcaggagcatggg

SEQ ID NO: 2723870 - DNA, 16 bp, Homo sapiens
agtctcctgtatcatt

SEQ ID NO: 2723871 - DNA, 20 bp, Homo sapiens
agtctctccagcctcacaga

SEQ ID NO: 2723872 - DNA, 13 bp, Homo sapiens
agtctctggctca

SEQ ID NO: 2723873 - DNA, 16 bp, Homo sapiens
agtctctggctcagct

SEQ ID NO: 2723874 - DNA, 17 bp, Homo sapiens
agtctctggctcagctg

SEQ ID NO: 2723875 - DNA, 19 bp, Homo sapiens
agtctctggctcagctgtg

SEQ ID NO: 2723876 - DNA, 19 bp, Homo sapiens
agtctcttctcagagcagc

SEQ ID NO: 2723877 - DNA, 14 bp, Homo sapiens
agtctgaatggcat

SEQ ID NO: 2723878 - DNA, 19 bp, Homo sapiens
agtctgaggcacctgcata

SEQ ID NO: 2723879 - DNA, 17 bp, Homo sapiens
agtctgctatattttca

SEQ ID NO: 2723880 - DNA, 21 bp, Homo sapiens
agtctggcaaacatgtgcaac

SEQ ID NO: 2723881 - DNA, 12 bp, Homo sapiens
agtcttttgctg

SEQ ID NO: 2723882 - DNA, 20 bp, Homo sapiens
agtgaacacactcagcagcc

SEQ ID NO: 2723883 - DNA, 15 bp, Homo sapiens
agtgaacagcttcac

SEQ ID NO: 2723884 - DNA, 15 bp, Homo sapiens
agtgaacagtttgga

SEQ ID NO: 2723885 - DNA, 17 bp, Homo sapiens
agtgaactaaatatttt

SEQ ID NO: 2723886 - DNA, 12 bp, Homo sapiens
agtgaataaact

SEQ ID NO: 2723887 - DNA, 16 bp, Homo sapiens
agtgaataaacttcag

SEQ ID NO: 2723888 - DNA, 20 bp, Homo sapiens
agtgaataaacttcagcacc

SEQ ID NO: 2723889 - DNA, 21 bp, Homo sapiens
agtgaataaacttcagcacca

SEQ ID NO: 2723890 - DNA, 22 bp, Homo sapiens
agtgaattacactcaaggaaaa

SEQ ID NO: 2723891 - DNA, 20 bp, Homo sapiens
agtgacagatcctccatttt

SEQ ID NO: 2723892 - DNA, 20 bp, Homo sapiens
agtgacgtgactcagagctt

SEQ ID NO: 2723893 - DNA, 14 bp, Homo sapiens
agtgacgtgcacct

SEQ ID NO: 2723894 - DNA, 15 bp, Homo sapiens
agtgactcgggctcc

SEQ ID NO: 2723895 - DNA, 19 bp, Homo sapiens
agtgactcgggctcctgtg

SEQ ID NO: 2723896 - DNA, 21 bp, Homo sapiens
agtgactcgggctcctgtgcc

SEQ ID NO: 2723897 - DNA, 18 bp, Homo sapiens
agtgacttcctggtgagg

SEQ ID NO: 2723898 - DNA, 13 bp, Homo sapiens
agtgagcagtaga

SEQ ID NO: 2723899 - DNA, 17 bp, Homo sapiens
agtgcccattcctcacc

SEQ ID NO: 2723900 - DNA, 17 bp, Homo sapiens
agtgccctccacagccg

SEQ ID NO: 2723901 - DNA, 19 bp, Homo sapiens
agtgccctctggacagctt

SEQ ID NO: 2723902 - DNA, 22 bp, Homo sapiens
agtgccgccgcctcgcccaccg

SEQ ID NO: 2723903 - DNA, 13 bp, Homo sapiens
agtgcctcagtgc

SEQ ID NO: 2723904 - DNA, 15 bp, Homo sapiens
agtgctcctgtgcag

SEQ ID NO: 2723905 - DNA, 12 bp, Homo sapiens
agtgctctgcct

SEQ ID NO: 2723906 - DNA, 14 bp, Homo sapiens
agtgctctgcctct

SEQ ID NO: 2723907 - DNA, 23 bp, Homo sapiens
agtgctctgcctctaactccctc

SEQ ID NO: 2723908 - DNA, 19 bp, Homo sapiens
agtgctgcagctttgggaa

SEQ ID NO: 2723909 - DNA, 11 bp, Homo sapiens
agtgctggctg

SEQ ID NO: 2723910 - DNA, 16 bp, Homo sapiens
agtgctggctgctggc

SEQ ID NO: 2723911 - DNA, 20 bp, Homo sapiens
agtgctgggattacaggcat

SEQ ID NO: 2723912 - DNA, 20 bp, Homo sapiens
agtgctgggattacaggtgt

SEQ ID NO: 2723913 - DNA, 16 bp, Homo sapiens
agtgctgtttgggcag

SEQ ID NO: 2723914 - DNA, 16 bp, Homo sapiens
agtgcttcttgtaata

SEQ ID NO: 2723915 - DNA, 12 bp, Homo sapiens
agtggcactaaa

SEQ ID NO: 2723916 - DNA, 16 bp, Homo sapiens
agtggcagccgcctcc

SEQ ID NO: 2723917 - DNA, 19 bp, Homo sapiens
agtggcccccactcacagg

SEQ ID NO: 2723918 - DNA, 13 bp, Homo sapiens
agtggctgtccag

SEQ ID NO: 2723919 - DNA, 17 bp, Homo sapiens
agtggctgtccagtgcc

SEQ ID NO: 2723920 - DNA, 18 bp, Homo sapiens
agtggctgtccagtgccc

SEQ ID NO: 2723921 - DNA, 18 bp, Homo sapiens
agtgggaggacagagccg

SEQ ID NO: 2723922 - DNA, 15 bp, Homo sapiens
agtgggggctgtgcc

SEQ ID NO: 2723923 - DNA, 21 bp, Homo sapiens
agtgggtcccacttcccctcc

SEQ ID NO: 2723924 - DNA, 22 bp, Homo sapiens
agtgtacccccgcccaggctgg

SEQ ID NO: 2723925 - DNA, 17 bp, Homo sapiens
agtgtagccttgcccgg

SEQ ID NO: 2723926 - DNA, 12 bp, Homo sapiens
agtgtcagagtc

SEQ ID NO: 2723927 - DNA, 23 bp, Homo sapiens
agtgtccagaccattgtcttcca

SEQ ID NO: 2723928 - DNA, 13 bp, Homo sapiens
agtgtcctgtctg

SEQ ID NO: 2723929 - DNA, 17 bp, Homo sapiens
agtgtcctgtctgctgg

SEQ ID NO: 2723930 - DNA, 20 bp, Homo sapiens
agtgtctctgcctggagcag

SEQ ID NO: 2723931 - DNA, 19 bp, Homo sapiens
agtgtctcttgactggctc

SEQ ID NO: 2723932 - DNA, 20 bp, Homo sapiens
agtgtctcttgactggctca

SEQ ID NO: 2723933 - DNA, 14 bp, Homo sapiens
agtgtcttcctgtg

SEQ ID NO: 2723934 - DNA, 19 bp, Homo sapiens
agtgtgccccccatcctgg

SEQ ID NO: 2723935 - DNA, 18 bp, Homo sapiens
agtgtggatgttcagaat

SEQ ID NO: 2723936 - DNA, 17 bp, Homo sapiens
agtgttaggcctggcac

SEQ ID NO: 2723937 - DNA, 20 bp, Homo sapiens
agtgttaggcctggcacagt

SEQ ID NO: 2723938 - DNA, 18 bp, Homo sapiens
agttacctggatgccatt

SEQ ID NO: 2723939 - DNA, 17 bp, Homo sapiens
agttactggctctttgt

SEQ ID NO: 2723940 - DNA, 19 bp, Homo sapiens
agttagctcaggaggcttg

SEQ ID NO: 2723941 - DNA, 18 bp, Homo sapiens
agttaggaagttacctgg

SEQ ID NO: 2723942 - DNA, 12 bp, Homo sapiens
agttatatcttg

SEQ ID NO: 2723943 - DNA, 16 bp, Homo sapiens
agttcagttcctcttt

SEQ ID NO: 2723944 - DNA, 24 bp, Homo sapiens
agttcagttcctctttgcatggaa

SEQ ID NO: 2723945 - DNA, 15 bp, Homo sapiens
agttcataaatttgt

SEQ ID NO: 2723946 - DNA, 15 bp, Homo sapiens
agttcataattcacc

SEQ ID NO: 2723947 - DNA, 20 bp, Homo sapiens
agttcatataatttaaagaa

SEQ ID NO: 2723948 - DNA, 21 bp, Homo sapiens
agttcattcaaaatgtccagc

SEQ ID NO: 2723949 - DNA, 13 bp, Homo sapiens
agttccctcctgc

SEQ ID NO: 2723950 - DNA, 14 bp, Homo sapiens
agttcgagaccagc

SEQ ID NO: 2723951 - DNA, 17 bp, Homo sapiens
agttctagttgattgcg

SEQ ID NO: 2723952 - DNA, 12 bp, Homo sapiens
agttctgatgag

SEQ ID NO: 2723953 - DNA, 18 bp, Homo sapiens
agttctgtgtcctcgcac

SEQ ID NO: 2723954 - DNA, 20 bp, Homo sapiens
agttgaaaaaagaagtttgg

SEQ ID NO: 2723955 - DNA, 16 bp, Homo sapiens
agttgcatatatggac

SEQ ID NO: 2723956 - DNA, 15 bp, Homo sapiens
agttgcattttcata

SEQ ID NO: 2723957 - DNA, 15 bp, Homo sapiens
agttggtcttacttt

SEQ ID NO: 2723958 - DNA, 17 bp, Homo sapiens
agttggtgttcataatt

SEQ ID NO: 2723959 - DNA, 14 bp, Homo sapiens
agttgtctttcttt

SEQ ID NO: 2723960 - DNA, 15 bp, Homo sapiens
agttgtctttctttg

SEQ ID NO: 2723961 - DNA, 13 bp, Homo sapiens
agtttacagtaaa

SEQ ID NO: 2723962 - DNA, 16 bp, Homo sapiens
agtttacagtaaataa

SEQ ID NO: 2723963 - DNA, 17 bp, Homo sapiens
agtttctcaagtttaaa

SEQ ID NO: 2723964 - DNA, 20 bp, Homo sapiens
agtttgcactgtatgctgga

SEQ ID NO: 2723965 - DNA, 15 bp, Homo sapiens
agtttgctgggttta

SEQ ID NO: 2723966 - DNA, 12 bp, Homo sapiens
agttttcagatt

SEQ ID NO: 2723967 - DNA, 22 bp, Homo sapiens
agttttgtttgttcacactcct

SEQ ID NO: 2723968 - DNA, 23 bp, Homo sapiens
agtttttcttacataatttgcaa

SEQ ID NO: 2723969 - DNA, 17 bp, Homo sapiens
ataaaaaaatatataca

SEQ ID NO: 2723970 - DNA, 20 bp, Homo sapiens
ataaaacgtatagtcaatat

SEQ ID NO: 2723971 - DNA, 20 bp, Homo sapiens
ataaaagcacaagtactttt

SEQ ID NO: 2723972 - DNA, 15 bp, Homo sapiens
ataaaataaagcaaa

SEQ ID NO: 2723973 - DNA, 14 bp, Homo sapiens
ataaaatgctttaa

SEQ ID NO: 2723974 - DNA, 11 bp, Homo sapiens
ataaaattgta

SEQ ID NO: 2723975 - DNA, 19 bp, Homo sapiens
ataaacctctaatttattt

SEQ ID NO: 2723976 - DNA, 21 bp, Homo sapiens
ataaacttagaataaaattgt

SEQ ID NO: 2723977 - DNA, 15 bp, Homo sapiens
ataaacttatttgct

SEQ ID NO: 2723978 - DNA, 13 bp, Homo sapiens
ataaagggaacat

SEQ ID NO: 2723979 - DNA, 16 bp, Homo sapiens
ataaagggaacatgca

SEQ ID NO: 2723980 - DNA, 21 bp, Homo sapiens
ataaatatgtgaaaatgatta

SEQ ID NO: 2723981 - DNA, 18 bp, Homo sapiens
ataaatgctgaatgaatc

SEQ ID NO: 2723982 - DNA, 20 bp, Homo sapiens
ataaatttgaactccatggg

SEQ ID NO: 2723983 - DNA, 18 bp, Homo sapiens
ataactctgattttgata

SEQ ID NO: 2723984 - DNA, 16 bp, Homo sapiens
ataagcaagacagtgg

SEQ ID NO: 2723985 - DNA, 15 bp, Homo sapiens
ataaggatcttttgt

SEQ ID NO: 2723986 - DNA, 19 bp, Homo sapiens
ataaggatcttttgtaaat

SEQ ID NO: 2723987 - DNA, 14 bp, Homo sapiens
ataaggtataagga

SEQ ID NO: 2723988 - DNA, 22 bp, Homo sapiens
ataagttttatacataaacagt

SEQ ID NO: 2723989 - DNA, 15 bp, Homo sapiens
ataataaatgaggaa

SEQ ID NO: 2723990 - DNA, 21 bp, Homo sapiens
ataatatcagatttcattaat

SEQ ID NO: 2723991 - DNA, 20 bp, Homo sapiens
ataatctcctctaaaacaac

SEQ ID NO: 2723992 - DNA, 18 bp, Homo sapiens
ataatgaaccgtttacag

SEQ ID NO: 2723993 - DNA, 21 bp, Homo sapiens
ataatgaaccgtttacagtgt

SEQ ID NO: 2723994 - DNA, 16 bp, Homo sapiens
ataatgatgatgatga

SEQ ID NO: 2723995 - DNA, 16 bp, Homo sapiens
ataatgcaacaatgtg

SEQ ID NO: 2723996 - DNA, 21 bp, Homo sapiens
ataattcaccaaaagttcata

SEQ ID NO: 2723997 - DNA, 19 bp, Homo sapiens
ataatttttccttttgcca

SEQ ID NO: 2723998 - DNA, 13 bp, Homo sapiens
ataattttttgca

SEQ ID NO: 2723999 - DNA, 16 bp, Homo sapiens
atacaaaaaaaatctt

SEQ ID NO: 2724000 - DNA, 11 bp, Homo sapiens
atacaaacagg

SEQ ID NO: 2724001 - DNA, 18 bp, Homo sapiens
atacaacagaaaccagaa

SEQ ID NO: 2724002 - DNA, 17 bp, Homo sapiens
atacaacctatgtaatt

SEQ ID NO: 2724003 - DNA, 21 bp, Homo sapiens
atacagtcattatttaaagca

SEQ ID NO: 2724004 - DNA, 24 bp, Homo sapiens
atacagtcattatttaaagcacat

SEQ ID NO: 2724005 - DNA, 14 bp, Homo sapiens
atacataaacagtt

SEQ ID NO: 2724006 - DNA, 15 bp, Homo sapiens
atacataaacagttt

SEQ ID NO: 2724007 - DNA, 17 bp, Homo sapiens
atacataaacagttttg

SEQ ID NO: 2724008 - DNA, 22 bp, Homo sapiens
atacatacaacctatgtaattt

SEQ ID NO: 2724009 - DNA, 17 bp, Homo sapiens
atacatgttgggcatga

SEQ ID NO: 2724010 - DNA, 16 bp, Homo sapiens
atacattttatatctg

SEQ ID NO: 2724011 - DNA, 17 bp, Homo sapiens
atactccattattttat

SEQ ID NO: 2724012 - DNA, 21 bp, Homo sapiens
atactgaagtgcagctcagga

SEQ ID NO: 2724013 - DNA, 16 bp, Homo sapiens
atagacgggttgaaag

SEQ ID NO: 2724014 - DNA, 20 bp, Homo sapiens
atagacgggttgaaagacat

SEQ ID NO: 2724015 - DNA, 16 bp, Homo sapiens
atagagatatttaaaa

SEQ ID NO: 2724016 - DNA, 21 bp, Homo sapiens
atagagatatttaaaagacaa

SEQ ID NO: 2724017 - DNA, 21 bp, Homo sapiens
atagatgagaaaactgagagg

SEQ ID NO: 2724018 - DNA, 23 bp, Homo sapiens
atagcaaggccagggcacagctg

SEQ ID NO: 2724019 - DNA, 17 bp, Homo sapiens
atagcacatgattttct

SEQ ID NO: 2724020 - DNA, 18 bp, Homo sapiens
atagcacatgattttctt

SEQ ID NO: 2724021 - DNA, 19 bp, Homo sapiens
atagctagctatttctatg

SEQ ID NO: 2724022 - DNA, 24 bp, Homo sapiens
agaaaatgtgtctgcaacatggat

SEQ ID NO: 2724023 - DNA, 15 bp, Homo sapiens
agaaacaggctctga

SEQ ID NO: 2724024 - DNA, 21 bp, Homo sapiens
agaaatcaattttttaaacca

SEQ ID NO: 2724025 - DNA, 18 bp, Homo sapiens
agaaatcctggtttgtaa

SEQ ID NO: 2724026 - DNA, 14 bp, Homo sapiens
agaaattagccggg

SEQ ID NO: 2724027 - DNA, 22 bp, Homo sapiens
agaaatttccactcaggtctgt

SEQ ID NO: 2724028 - DNA, 22 bp, Homo sapiens
agaaattttactgacagaaatg

SEQ ID NO: 2724029 - DNA, 23 bp, Homo sapiens
agaaattttactgacagaaatgc

SEQ ID NO: 2724030 - DNA, 16 bp, Homo sapiens
agaaatttttttccag

SEQ ID NO: 2724031 - DNA, 13 bp, Homo sapiens
agaacacccactg

SEQ ID NO: 2724032 - DNA, 14 bp, Homo sapiens
agaacacccactgg

SEQ ID NO: 2724033 - DNA, 17 bp, Homo sapiens
agaacacccactggcca

SEQ ID NO: 2724034 - DNA, 19 bp, Homo sapiens
agaaccagccgtattttac

SEQ ID NO: 2724035 - DNA, 21 bp, Homo sapiens
agaaccagccgtattttacat

SEQ ID NO: 2724036 - DNA, 13 bp, Homo sapiens
agaaccttctaat

SEQ ID NO: 2724037 - DNA, 15 bp, Homo sapiens
agaacgtgcccagcc

SEQ ID NO: 2724038 - DNA, 14 bp, Homo sapiens
agaactctgcaggc

SEQ ID NO: 2724039 - DNA, 12 bp, Homo sapiens
agaactgctggg

SEQ ID NO: 2724040 - DNA, 15 bp, Homo sapiens
agaactgctggggct

SEQ ID NO: 2724041 - DNA, 21 bp, Homo sapiens
agaactttgccttaagtttcc

SEQ ID NO: 2724042 - DNA, 20 bp, Homo sapiens
agaagagccttcacatgaaa

SEQ ID NO: 2724043 - DNA, 23 bp, Homo sapiens
agaagatctgcttccctggggcc

SEQ ID NO: 2724044 - DNA, 10 bp, Homo sapiens
agaagcagaa

SEQ ID NO: 2724045 - DNA, 14 bp, Homo sapiens
agaagcctgaggct

SEQ ID NO: 2724046 - DNA, 19 bp, Homo sapiens
agaaggagggttgtgccca

SEQ ID NO: 2724047 - DNA, 13 bp, Homo sapiens
agaagggcctgct

SEQ ID NO: 2724048 - DNA, 18 bp, Homo sapiens
agaagggcctgctctgct

SEQ ID NO: 2724049 - DNA, 19 bp, Homo sapiens
agaagggcctgctctgctt

SEQ ID NO: 2724050 - DNA, 16 bp, Homo sapiens
agaagggctgaataaa

SEQ ID NO: 2724051 - DNA, 17 bp, Homo sapiens
agaagtggccagggctt

SEQ ID NO: 2724052 - DNA, 12 bp, Homo sapiens
agaagtgtatat

SEQ ID NO: 2724053 - DNA, 13 bp, Homo sapiens
agaagtgtatata

SEQ ID NO: 2724054 - DNA, 19 bp, Homo sapiens
agaagtttgggctaacatt

SEQ ID NO: 2724055 - DNA, 21 bp, Homo sapiens
agaagtttgggctaacattta

SEQ ID NO: 2724056 - DNA, 13 bp, Homo sapiens
agaataaaattgt

SEQ ID NO: 2724057 - DNA, 12 bp, Homo sapiens
agaatacagaaa

SEQ ID NO: 2724058 - DNA, 24 bp, Homo sapiens
agaatcccacccccacttcatgcc

SEQ ID NO: 2724059 - DNA, 14 bp, Homo sapiens
agaatcctgggccc

SEQ ID NO: 2724060 - DNA, 12 bp, Homo sapiens
agaattgcttga

SEQ ID NO: 2724061 - DNA, 22 bp, Homo sapiens
agaattgcttgaacccaggagg

SEQ ID NO: 2724062 - DNA, 22 bp, Homo sapiens
agaattgtatatcattttgcca

SEQ ID NO: 2724063 - DNA, 20 bp, Homo sapiens
agacaagatggctggaagga

SEQ ID NO: 2724064 - DNA, 11 bp, Homo sapiens
agacagctgga

SEQ ID NO: 2724065 - DNA, 14 bp, Homo sapiens
agacagctggaccc

SEQ ID NO: 2724066 - DNA, 12 bp, Homo sapiens
agacatcaatga

SEQ ID NO: 2724067 - DNA, 23 bp, Homo sapiens
agacatcagtctccaacatgttt

SEQ ID NO: 2724068 - DNA, 23 bp, Homo sapiens
agaccaaattttgaggtctttta

SEQ ID NO: 2724069 - DNA, 12 bp, Homo sapiens
agaccagcctgg

SEQ ID NO: 2724070 - DNA, 13 bp, Homo sapiens
agaccagcctggc

SEQ ID NO: 2724071 - DNA, 15 bp, Homo sapiens
agaccagcctggcca

SEQ ID NO: 2724072 - DNA, 13 bp, Homo sapiens
agaccagtactgg

SEQ ID NO: 2724073 - DNA, 17 bp, Homo sapiens
agaccagtactgggaag

SEQ ID NO: 2724074 - DNA, 17 bp, Homo sapiens
agaccattgtcttccaa

SEQ ID NO: 2724075 - DNA, 23 bp, Homo sapiens
agacccccccccccaacagaaca

SEQ ID NO: 2724076 - DNA, 12 bp, Homo sapiens
agaccctgttct

SEQ ID NO: 2724077 - DNA, 19 bp, Homo sapiens
agaccgtgatttggaagag

SEQ ID NO: 2724078 - DNA, 17 bp, Homo sapiens
agacctcagatgtgttg

SEQ ID NO: 2724079 - DNA, 20 bp, Homo sapiens
agacctctgaatgtcccaga

SEQ ID NO: 2724080 - DNA, 22 bp, Homo sapiens
agaccttacaaccacatttctg

SEQ ID NO: 2724081 - DNA, 22 bp, Homo sapiens
agacgatcttgctggcagggcc

SEQ ID NO: 2724082 - DNA, 19 bp, Homo sapiens
agacgggttgaaagacatc

SEQ ID NO: 2724083 - DNA, 14 bp, Homo sapiens
agacgtcctggaat

SEQ ID NO: 2724084 - DNA, 17 bp, Homo sapiens
agactagattctcacct

SEQ ID NO: 2724085 - DNA, 17 bp, Homo sapiens
agactatttaacttgag

SEQ ID NO: 2724086 - DNA, 21 bp, Homo sapiens
agactcaaggcctccagccac

SEQ ID NO: 2724087 - DNA, 20 bp, Homo sapiens
agactctgtgagattctaaa

SEQ ID NO: 2724088 - DNA, 18 bp, Homo sapiens
agactcttccaccagagc

SEQ ID NO: 2724089 - DNA, 21 bp, Homo sapiens
agactgcgccacggcactcca

SEQ ID NO: 2724090 - DNA, 20 bp, Homo sapiens
agactgcgggatggtcctgg

SEQ ID NO: 2724091 - DNA, 22 bp, Homo sapiens
agactgctgggactggccaggt

SEQ ID NO: 2724092 - DNA, 20 bp, Homo sapiens
agactgggaacttgatggct

SEQ ID NO: 2724093 - DNA, 19 bp, Homo sapiens
agactgtgacatcagaagt

SEQ ID NO: 2724094 - DNA, 14 bp, Homo sapiens
agactgtgtttcta

SEQ ID NO: 2724095 - DNA, 18 bp, Homo sapiens
agactgttaaatgaaacc

SEQ ID NO: 2724096 - DNA, 19 bp, Homo sapiens
agacttagtttttataaaa

SEQ ID NO: 2724097 - DNA, 18 bp, Homo sapiens
agacttcaatattaaatg

SEQ ID NO: 2724098 - DNA, 15 bp, Homo sapiens
agacttccagagcct

SEQ ID NO: 2724099 - DNA, 20 bp, Homo sapiens
agagaaaacttatttgagtg

SEQ ID NO: 2724100 - DNA, 18 bp, Homo sapiens
agagaagtggccagggct

SEQ ID NO: 2724101 - DNA, 15 bp, Homo sapiens
agagaccctacagac

SEQ ID NO: 2724102 - DNA, 16 bp, Homo sapiens
agagacctttgcccac

SEQ ID NO: 2724103 - DNA, 17 bp, Homo sapiens
agagacctttgcccaca

SEQ ID NO: 2724104 - DNA, 23 bp, Homo sapiens
agagagcatcttttcctcccatt

SEQ ID NO: 2724105 - DNA, 14 bp, Homo sapiens
agagaggaggagag

SEQ ID NO: 2724106 - DNA, 15 bp, Homo sapiens
agagaggcacctgct

SEQ ID NO: 2724107 - DNA, 22 bp, Homo sapiens
agagaggtagcgagctgctctg

SEQ ID NO: 2724108 - DNA, 17 bp, Homo sapiens
agagatgactgagtcct

SEQ ID NO: 2724109 - DNA, 18 bp, Homo sapiens
agagatgactgagtcctc

SEQ ID NO: 2724110 - DNA, 14 bp, Homo sapiens
agagcaagactctg

SEQ ID NO: 2724111 - DNA, 16 bp, Homo sapiens
agagcagctggctctc

SEQ ID NO: 2724112 - DNA, 20 bp, Homo sapiens
agagcagcttctgccacttc

SEQ ID NO: 2724113 - DNA, 15 bp, Homo sapiens
agagcaggggctgct

SEQ ID NO: 2724114 - DNA, 16 bp, Homo sapiens
agagccactacctttg

SEQ ID NO: 2724115 - DNA, 14 bp, Homo sapiens
agagcctcaaatga

SEQ ID NO: 2724116 - DNA, 18 bp, Homo sapiens
agagcctcagcttctggg

SEQ ID NO: 2724117 - DNA, 15 bp, Homo sapiens
agagctatggtgagg

SEQ ID NO: 2724118 - DNA, 15 bp, Homo sapiens
agagctcctgtccct

SEQ ID NO: 2724119 - DNA, 20 bp, Homo sapiens
agagctcctgtccctaccca

SEQ ID NO: 2724120 - DNA, 14 bp, Homo sapiens
agagctctctcttc

SEQ ID NO: 2724121 - DNA, 12 bp, Homo sapiens
agagctgcctcc

SEQ ID NO: 2724122 - DNA, 13 bp, Homo sapiens
agagctgcctccc

SEQ ID NO: 2724123 - DNA, 15 bp, Homo sapiens
agagctgcgggctga

SEQ ID NO: 2724124 - DNA, 15 bp, Homo sapiens
agagctggtgccaga

SEQ ID NO: 2724125 - DNA, 23 bp, Homo sapiens
agaggcacctaaacttgggtaca

SEQ ID NO: 2724126 - DNA, 13 bp, Homo sapiens
agaggcacctgct

SEQ ID NO: 2724127 - DNA, 19 bp, Homo sapiens
agaggccaaattaatcttt

SEQ ID NO: 2724128 - DNA, 18 bp, Homo sapiens
agaggcgcgtctgcccca

SEQ ID NO: 2724129 - DNA, 20 bp, Homo sapiens
agaggctagtctcttctcag

SEQ ID NO: 2724130 - DNA, 22 bp, Homo sapiens
agaggctggaaaagggctcaga

SEQ ID NO: 2724131 - DNA, 16 bp, Homo sapiens
agagggagagatgagt

SEQ ID NO: 2724132 - DNA, 16 bp, Homo sapiens
agagggcccaggcagg

SEQ ID NO: 2724133 - DNA, 15 bp, Homo sapiens
agagggcgctcctgt

SEQ ID NO: 2724134 - DNA, 17 bp, Homo sapiens
agaggtagcgagctgct

SEQ ID NO: 2724135 - DNA, 13 bp, Homo sapiens
agaggtgagcaga

SEQ ID NO: 2724136 - DNA, 22 bp, Homo sapiens
agaggtttggagccgggaaagc

SEQ ID NO: 2724137 - DNA, 13 bp, Homo sapiens
agagtagaaaagg

SEQ ID NO: 2724138 - DNA, 12 bp, Homo sapiens
agagtctctcca

SEQ ID NO: 2724139 - DNA, 22 bp, Homo sapiens
agagtctctccagcctcacaga

SEQ ID NO: 2724140 - DNA, 19 bp, Homo sapiens
agagtctctggctcagctg

SEQ ID NO: 2724141 - DNA, 23 bp, Homo sapiens
agagtctctggctcagctgtggt

SEQ ID NO: 2724142 - DNA, 13 bp, Homo sapiens
agagtgacaggca

SEQ ID NO: 2724143 - DNA, 21 bp, Homo sapiens
agagtgtccctttttgcaggg

SEQ ID NO: 2724144 - DNA, 14 bp, Homo sapiens
agagttctgctcta

SEQ ID NO: 2724145 - DNA, 18 bp, Homo sapiens
agagttgacccctcctga

SEQ ID NO: 2724146 - DNA, 13 bp, Homo sapiens
agataaagtggtt

SEQ ID NO: 2724147 - DNA, 19 bp, Homo sapiens
agataaggcagaactagga

SEQ ID NO: 2724148 - DNA, 14 bp, Homo sapiens
agatagtgcctctg

SEQ ID NO: 2724149 - DNA, 12 bp, Homo sapiens
acacccactggc

SEQ ID NO: 2724150 - DNA, 13 bp, Homo sapiens
acaccctgcctgc

SEQ ID NO: 2724151 - DNA, 17 bp, Homo sapiens
acacgcatgcctcagcc

SEQ ID NO: 2724152 - DNA, 20 bp, Homo sapiens
acactaaacagactatttaa

SEQ ID NO: 2724153 - DNA, 21 bp, Homo sapiens
acactaaacagactatttaac

SEQ ID NO: 2724154 - DNA, 15 bp, Homo sapiens
acactaaattagttt

SEQ ID NO: 2724155 - DNA, 19 bp, Homo sapiens
acactaaattagtttaaaa

SEQ ID NO: 2724156 - DNA, 13 bp, Homo sapiens
acactacaaacat

SEQ ID NO: 2724157 - DNA, 23 bp, Homo sapiens
acactacttgagaaaatgcagga

SEQ ID NO: 2724158 - DNA, 15 bp, Homo sapiens
acactcaaggaaaag

SEQ ID NO: 2724159 - DNA, 18 bp, Homo sapiens
acactcaaggaaaagatg

SEQ ID NO: 2724160 - DNA, 14 bp, Homo sapiens
acactcagcagccc

SEQ ID NO: 2724161 - DNA, 23 bp, Homo sapiens
acactccagaattacccttcctc

SEQ ID NO: 2724162 - DNA, 16 bp, Homo sapiens
acactccagcctgagc

SEQ ID NO: 2724163 - DNA, 20 bp, Homo sapiens
acactcctcctgccagctct

SEQ ID NO: 2724164 - DNA, 22 bp, Homo sapiens
acactcctcctgccagctctgt

SEQ ID NO: 2724165 - DNA, 19 bp, Homo sapiens
acactctagtgacttcctg

SEQ ID NO: 2724166 - DNA, 17 bp, Homo sapiens
acactggcatctccctg

SEQ ID NO: 2724167 - DNA, 20 bp, Homo sapiens
acactgtcctgtccggagcg

SEQ ID NO: 2724168 - DNA, 18 bp, Homo sapiens
acacttatggaattttta

SEQ ID NO: 2724169 - DNA, 18 bp, Homo sapiens
acactttgaaggtaataa

SEQ ID NO: 2724170 - DNA, 14 bp, Homo sapiens
acagaaacattttc

SEQ ID NO: 2724171 - DNA, 16 bp, Homo sapiens
acagaaaccagaaaag

SEQ ID NO: 2724172 - DNA, 13 bp, Homo sapiens
acagaacactaaa

SEQ ID NO: 2724173 - DNA, 12 bp, Homo sapiens
acagaagcaaat

SEQ ID NO: 2724174 - DNA, 17 bp, Homo sapiens
acagactatttaacttg

SEQ ID NO: 2724175 - DNA, 15 bp, Homo sapiens
acagactcttccacc

SEQ ID NO: 2724176 - DNA, 16 bp, Homo sapiens
acagactcttccacca

SEQ ID NO: 2724177 - DNA, 23 bp, Homo sapiens
acagactcttccaccagagcagg

SEQ ID NO: 2724178 - DNA, 11 bp, Homo sapiens
acagactgcaa

SEQ ID NO: 2724179 - DNA, 13 bp, Homo sapiens
acagagccagagg

SEQ ID NO: 2724180 - DNA, 15 bp, Homo sapiens
acagagccagaggca

SEQ ID NO: 2724181 - DNA, 17 bp, Homo sapiens
acagagttggtgttcat

SEQ ID NO: 2724182 - DNA, 15 bp, Homo sapiens
acagatcctccattt

SEQ ID NO: 2724183 - DNA, 16 bp, Homo sapiens
acagatgctggcctct

SEQ ID NO: 2724184 - DNA, 20 bp, Homo sapiens
acagatggaagaagttttaa

SEQ ID NO: 2724185 - DNA, 21 bp, Homo sapiens
acagatggaagaagttttaac

SEQ ID NO: 2724186 - DNA, 21 bp, Homo sapiens
acagattcctgttgtgtaata

SEQ ID NO: 2724187 - DNA, 13 bp, Homo sapiens
acagcaaagccat

SEQ ID NO: 2724188 - DNA, 14 bp, Homo sapiens
acagcaaagccata

SEQ ID NO: 2724189 - DNA, 15 bp, Homo sapiens
acagcaaagccatat

SEQ ID NO: 2724190 - DNA, 22 bp, Homo sapiens
acagcaaagccatattctaaat

SEQ ID NO: 2724191 - DNA, 18 bp, Homo sapiens
acagcaaggcacctgcag

SEQ ID NO: 2724192 - DNA, 15 bp, Homo sapiens
acagcccacgtcctg

SEQ ID NO: 2724193 - DNA, 19 bp, Homo sapiens
acagcccacgtcctgtcag

SEQ ID NO: 2724194 - DNA, 20 bp, Homo sapiens
acagcccacgtcctgtcagt

SEQ ID NO: 2724195 - DNA, 13 bp, Homo sapiens
acagcccccaccc

SEQ ID NO: 2724196 - DNA, 18 bp, Homo sapiens
acagcccccaccccagca

SEQ ID NO: 2724197 - DNA, 14 bp, Homo sapiens
acagccctcccgcc

SEQ ID NO: 2724198 - DNA, 13 bp, Homo sapiens
acagcctctccct

SEQ ID NO: 2724199 - DNA, 20 bp, Homo sapiens
acagcctgggtgacggtcct

SEQ ID NO: 2724200 - DNA, 20 bp, Homo sapiens
acagcgtgtcaactttcatt

SEQ ID NO: 2724201 - DNA, 13 bp, Homo sapiens
acagctcctcccc

SEQ ID NO: 2724202 - DNA, 18 bp, Homo sapiens
acagctcctcccctgccg

SEQ ID NO: 2724203 - DNA, 13 bp, Homo sapiens
acagctctgctgg

SEQ ID NO: 2724204 - DNA, 14 bp, Homo sapiens
acagctctgctgga

SEQ ID NO: 2724205 - DNA, 17 bp, Homo sapiens
acagctctgctggaaga

SEQ ID NO: 2724206 - DNA, 12 bp, Homo sapiens
acagctcttgtt

SEQ ID NO: 2724207 - DNA, 17 bp, Homo sapiens
acagcttcacttaaaat

SEQ ID NO: 2724208 - DNA, 15 bp, Homo sapiens
acaggagagacagga

SEQ ID NO: 2724209 - DNA, 22 bp, Homo sapiens
acaggaggctccgtgagccctt

SEQ ID NO: 2724210 - DNA, 20 bp, Homo sapiens
acaggcccttggtagagctg

SEQ ID NO: 2724211 - DNA, 17 bp, Homo sapiens
acagggacacagtctgg

SEQ ID NO: 2724212 - DNA, 20 bp, Homo sapiens
acagggacacagtctggtgc

SEQ ID NO: 2724213 - DNA, 16 bp, Homo sapiens
acagggcagagccggg

SEQ ID NO: 2724214 - DNA, 17 bp, Homo sapiens
acaggggcaccctccaa

SEQ ID NO: 2724215 - DNA, 14 bp, Homo sapiens
acagtaaataaatt

SEQ ID NO: 2724216 - DNA, 18 bp, Homo sapiens
acagtaaataaattgttt

SEQ ID NO: 2724217 - DNA, 21 bp, Homo sapiens
acagtacctgattgtattttt

SEQ ID NO: 2724218 - DNA, 14 bp, Homo sapiens
acagtcattattta

SEQ ID NO: 2724219 - DNA, 18 bp, Homo sapiens
acagtcattatttaaagc

SEQ ID NO: 2724220 - DNA, 18 bp, Homo sapiens
acagtcctcacagcctct

SEQ ID NO: 2724221 - DNA, 19 bp, Homo sapiens
acagtcctcacagcctctc

SEQ ID NO: 2724222 - DNA, 20 bp, Homo sapiens
acagtcctcacagcctctcc

SEQ ID NO: 2724223 - DNA, 23 bp, Homo sapiens
acagtcctctccacctagtggct

SEQ ID NO: 2724224 - DNA, 12 bp, Homo sapiens
acagtcctggga

SEQ ID NO: 2724225 - DNA, 21 bp, Homo sapiens
acagtcctgggagaacctcag

SEQ ID NO: 2724226 - DNA, 15 bp, Homo sapiens
acagtctcaattttg

SEQ ID NO: 2724227 - DNA, 21 bp, Homo sapiens
acagtctcaattttgtattta

SEQ ID NO: 2724228 - DNA, 13 bp, Homo sapiens
acagtctctgttg

SEQ ID NO: 2724229 - DNA, 14 bp, Homo sapiens
acagtgctctgcct

SEQ ID NO: 2724230 - DNA, 16 bp, Homo sapiens
acagtgctctgcctct

SEQ ID NO: 2724231 - DNA, 15 bp, Homo sapiens
acagtgcttcagcct

SEQ ID NO: 2724232 - DNA, 20 bp, Homo sapiens
acagtgcttcagcctgaggc

SEQ ID NO: 2724233 - DNA, 22 bp, Homo sapiens
acagtgcttcagcctgaggctg

SEQ ID NO: 2724234 - DNA, 16 bp, Homo sapiens
acagtggcactaaaat

SEQ ID NO: 2724235 - DNA, 21 bp, Homo sapiens
acagtggcactaaaatgttta

SEQ ID NO: 2724236 - DNA, 13 bp, Homo sapiens
acagtgtaagctt

SEQ ID NO: 2724237 - DNA, 23 bp, Homo sapiens
acagtgttaggcctggcacagtg

SEQ ID NO: 2724238 - DNA, 21 bp, Homo sapiens
acagtgtttcctgagtagcag

SEQ ID NO: 2724239 - DNA, 23 bp, Homo sapiens
acagttcataaatttgttgtcat

SEQ ID NO: 2724240 - DNA, 13 bp, Homo sapiens
acagttcatttaa

SEQ ID NO: 2724241 - DNA, 21 bp, Homo sapiens
acataaaacgtatagtcaata

SEQ ID NO: 2724242 - DNA, 13 bp, Homo sapiens
acataaacagttt

SEQ ID NO: 2724243 - DNA, 12 bp, Homo sapiens
acatacagtgat

SEQ ID NO: 2724244 - DNA, 22 bp, Homo sapiens
acatcagaagtaactcccactc

SEQ ID NO: 2724245 - DNA, 19 bp, Homo sapiens
acatcatctttatctcctg

SEQ ID NO: 2724246 - DNA, 19 bp, Homo sapiens
acatcattggataaatttg

SEQ ID NO: 2724247 - DNA, 16 bp, Homo sapiens
acatcgatatgaaaaa

SEQ ID NO: 2724248 - DNA, 20 bp, Homo sapiens
acatctaaattgatcattca

SEQ ID NO: 2724249 - DNA, 20 bp, Homo sapiens
agatatttaaaagacaaaca

SEQ ID NO: 2724250 - DNA, 21 bp, Homo sapiens
agatatttaaaagacaaacac

SEQ ID NO: 2724251 - DNA, 21 bp, Homo sapiens
agatcatataagcaagacagt

SEQ ID NO: 2724252 - DNA, 19 bp, Homo sapiens
agatcattatcttcatgtt

SEQ ID NO: 2724253 - DNA, 19 bp, Homo sapiens
agatccaaatgctgtgcaa

SEQ ID NO: 2724254 - DNA, 20 bp, Homo sapiens
agatccaaatgctgtgcaaa

SEQ ID NO: 2724255 - DNA, 10 bp, Homo sapiens
agatccaggc

SEQ ID NO: 2724256 - DNA, 20 bp, Homo sapiens
agatccaggcttctcccgga

SEQ ID NO: 2724257 - DNA, 21 bp, Homo sapiens
agatctcagcagccagctcct

SEQ ID NO: 2724258 - DNA, 20 bp, Homo sapiens
agatctttctttccaaaaca

SEQ ID NO: 2724259 - DNA, 20 bp, Homo sapiens
agatctttttgtgaaattca

SEQ ID NO: 2724260 - DNA, 18 bp, Homo sapiens
agatgaaaccgtccctga

SEQ ID NO: 2724261 - DNA, 19 bp, Homo sapiens
agatgagaaaactgagagg

SEQ ID NO: 2724262 - DNA, 18 bp, Homo sapiens
agatgggttgagtttgct

SEQ ID NO: 2724263 - DNA, 22 bp, Homo sapiens
agatgtgctcccaccaggcagc

SEQ ID NO: 2724264 - DNA, 23 bp, Homo sapiens
agatgtgggctcagatcctgggc

SEQ ID NO: 2724265 - DNA, 15 bp, Homo sapiens
agattctttaaggag

SEQ ID NO: 2724266 - DNA, 16 bp, Homo sapiens
agattctttaaggaga

SEQ ID NO: 2724267 - DNA, 17 bp, Homo sapiens
agattctttaaggagat

SEQ ID NO: 2724268 - DNA, 20 bp, Homo sapiens
agattgtaaaggtaggtgca

SEQ ID NO: 2724269 - DNA, 13 bp, Homo sapiens
agatttattaatt

SEQ ID NO: 2724270 - DNA, 18 bp, Homo sapiens
agatttcacaggtcttgc

SEQ ID NO: 2724271 - DNA, 19 bp, Homo sapiens
agatttcagctatgcagaa

SEQ ID NO: 2724272 - DNA, 13 bp, Homo sapiens
agcaaaaatctcc

SEQ ID NO: 2724273 - DNA, 21 bp, Homo sapiens
agcaaaaatctcccagtgaca

SEQ ID NO: 2724274 - DNA, 13 bp, Homo sapiens
agcaaacacacag

SEQ ID NO: 2724275 - DNA, 21 bp, Homo sapiens
agcaaagattaaatgtgtcat

SEQ ID NO: 2724276 - DNA, 19 bp, Homo sapiens
agcaaagccacattttgca

SEQ ID NO: 2724277 - DNA, 14 bp, Homo sapiens
agcaaagtctaaag

SEQ ID NO: 2724278 - DNA, 21 bp, Homo sapiens
agcaactctccactccatatt

SEQ ID NO: 2724279 - DNA, 17 bp, Homo sapiens
agcaagacgtcctggaa

SEQ ID NO: 2724280 - DNA, 22 bp, Homo sapiens
agcaaggaggctggctggggcc

SEQ ID NO: 2724281 - DNA, 15 bp, Homo sapiens
agcaaggccagggca

SEQ ID NO: 2724282 - DNA, 14 bp, Homo sapiens
agcaatcattttat

SEQ ID NO: 2724283 - DNA, 22 bp, Homo sapiens
agcaatgcttctgcctcagctt

SEQ ID NO: 2724284 - DNA, 22 bp, Homo sapiens
agcaatttatatctttatgcaa

SEQ ID NO: 2724285 - DNA, 17 bp, Homo sapiens
agcacaatcaacttttc

SEQ ID NO: 2724286 - DNA, 15 bp, Homo sapiens
agcacagccctcccg

SEQ ID NO: 2724287 - DNA, 21 bp, Homo sapiens
agcacagccctcccgcccctt

SEQ ID NO: 2724288 - DNA, 22 bp, Homo sapiens
agcacagccctcccgccccttc

SEQ ID NO: 2724289 - DNA, 17 bp, Homo sapiens
agcacagctcctcccct

SEQ ID NO: 2724290 - DNA, 20 bp, Homo sapiens
agcacagctcctcccctgcc

SEQ ID NO: 2724291 - DNA, 19 bp, Homo sapiens
agcacagtctgatgacaca

SEQ ID NO: 2724292 - DNA, 20 bp, Homo sapiens
agcacatgattttcttttgt

SEQ ID NO: 2724293 - DNA, 15 bp, Homo sapiens
agcacatgccaggga

SEQ ID NO: 2724294 - DNA, 22 bp, Homo sapiens
agcacattttgacacaatgttg

SEQ ID NO: 2724295 - DNA, 20 bp, Homo sapiens
agcaccaagcgtgattcctg

SEQ ID NO: 2724296 - DNA, 14 bp, Homo sapiens
agcaccgcagcatg

SEQ ID NO: 2724297 - DNA, 20 bp, Homo sapiens
agcacgttttctggcttctg

SEQ ID NO: 2724298 - DNA, 22 bp, Homo sapiens
agcacgttttctggcttctgct

SEQ ID NO: 2724299 - DNA, 19 bp, Homo sapiens
agcagaggagtccagggcg

SEQ ID NO: 2724300 - DNA, 23 bp, Homo sapiens
agcagagttctttgcaagcttat

SEQ ID NO: 2724301 - DNA, 15 bp, Homo sapiens
agcagccagctcctg

SEQ ID NO: 2724302 - DNA, 18 bp, Homo sapiens
agcagccgtttctccttg

SEQ ID NO: 2724303 - DNA, 21 bp, Homo sapiens
agcagcctccagtgctggctg

SEQ ID NO: 2724304 - DNA, 23 bp, Homo sapiens
agcagcctccagtgctggctgct

SEQ ID NO: 2724305 - DNA, 16 bp, Homo sapiens
agcagcttcagttgtt

SEQ ID NO: 2724306 - DNA, 17 bp, Homo sapiens
agcagcttctgccactt

SEQ ID NO: 2724307 - DNA, 15 bp, Homo sapiens
agcaggcagcgcctg

SEQ ID NO: 2724308 - DNA, 15 bp, Homo sapiens
agcaggggctgctgg

SEQ ID NO: 2724309 - DNA, 18 bp, Homo sapiens
agcaggggctgctggggg

SEQ ID NO: 2724310 - DNA, 16 bp, Homo sapiens
agcagggtcttgctgt

SEQ ID NO: 2724311 - DNA, 16 bp, Homo sapiens
agcaggtgctgctacc

SEQ ID NO: 2724312 - DNA, 20 bp, Homo sapiens
agcaggtgctgctaccctcc

SEQ ID NO: 2724313 - DNA, 22 bp, Homo sapiens
agcagtgccctctggacagctt

SEQ ID NO: 2724314 - DNA, 16 bp, Homo sapiens
agcatcaaacatgaaa

SEQ ID NO: 2724315 - DNA, 13 bp, Homo sapiens
agcatcacctcag

SEQ ID NO: 2724316 - DNA, 14 bp, Homo sapiens
agcatcacctcagg

SEQ ID NO: 2724317 - DNA, 20 bp, Homo sapiens
agcatcacctcaggccaggt

SEQ ID NO: 2724318 - DNA, 12 bp, Homo sapiens
agcatcctcccc

SEQ ID NO: 2724319 - DNA, 18 bp, Homo sapiens
agcatcctccccaccaga

SEQ ID NO: 2724320 - DNA, 19 bp, Homo sapiens
agcatcctccccaccagag

SEQ ID NO: 2724321 - DNA, 23 bp, Homo sapiens
agcatcctccccaccagagctgc

SEQ ID NO: 2724322 - DNA, 15 bp, Homo sapiens
agcatcttttcctcc

SEQ ID NO: 2724323 - DNA, 17 bp, Homo sapiens
agcatgtggggaagcaa

SEQ ID NO: 2724324 - DNA, 13 bp, Homo sapiens
agcattttcagca

SEQ ID NO: 2724325 - DNA, 13 bp, Homo sapiens
agccaaattttat

SEQ ID NO: 2724326 - DNA, 22 bp, Homo sapiens
agccaaggtgggctgagccctg

SEQ ID NO: 2724327 - DNA, 23 bp, Homo sapiens
agccaaggtgggctgagccctgg

SEQ ID NO: 2724328 - DNA, 13 bp, Homo sapiens
agccaccgcagct

SEQ ID NO: 2724329 - DNA, 18 bp, Homo sapiens
agccaccgcagctgctgc

SEQ ID NO: 2724330 - DNA, 20 bp, Homo sapiens
agccaccgcagctgctgcca

SEQ ID NO: 2724331 - DNA, 23 bp, Homo sapiens
agccaccgcagctgctgccactc

SEQ ID NO: 2724332 - DNA, 22 bp, Homo sapiens
agccaccgcgcccagccaagaa

SEQ ID NO: 2724333 - DNA, 16 bp, Homo sapiens
agccactacctttgtc

SEQ ID NO: 2724334 - DNA, 13 bp, Homo sapiens
agccactgaagct

SEQ ID NO: 2724335 - DNA, 17 bp, Homo sapiens
agccactgcagcacagg

SEQ ID NO: 2724336 - DNA, 12 bp, Homo sapiens
agccagccagga

SEQ ID NO: 2724337 - DNA, 18 bp, Homo sapiens
agccagccctggaggctg

SEQ ID NO: 2724338 - DNA, 23 bp, Homo sapiens
agccagccctggaggctggatgg

SEQ ID NO: 2724339 - DNA, 14 bp, Homo sapiens
agccagctcctgca

SEQ ID NO: 2724340 - DNA, 15 bp, Homo sapiens
agccagctcctgcac

SEQ ID NO: 2724341 - DNA, 15 bp, Homo sapiens
agccagtcattgtaa

SEQ ID NO: 2724342 - DNA, 23 bp, Homo sapiens
agccagtcattgtaacctcgtgt

SEQ ID NO: 2724343 - DNA, 20 bp, Homo sapiens
agccatagagatatttaaaa

SEQ ID NO: 2724344 - DNA, 11 bp, Homo sapiens
agccatatcta

SEQ ID NO: 2724345 - DNA, 17 bp, Homo sapiens
agccatattctaaattc

SEQ ID NO: 2724346 - DNA, 18 bp, Homo sapiens
agccatattctaaattca

SEQ ID NO: 2724347 - DNA, 21 bp, Homo sapiens
agccatccctttttttacatt

SEQ ID NO: 2724348 - DNA, 22 bp, Homo sapiens
agccatctctctactcctacct

SEQ ID NO: 2724349 - DNA, 18 bp, Homo sapiens
agccatgataactgcaat

SEQ ID NO: 2724350 - DNA, 21 bp, Homo sapiens
agcccaaacaccctcctggca

SEQ ID NO: 2724351 - DNA, 23 bp, Homo sapiens
agcccaaacaccctcctggcaca

SEQ ID NO: 2724352 - DNA, 23 bp, Homo sapiens
agcccacgcccgactagcaggca

SEQ ID NO: 2724353 - DNA, 17 bp, Homo sapiens
agcccacgtcctgtcag

SEQ ID NO: 2724354 - DNA, 23 bp, Homo sapiens
agccccaaagtcaattaaaggct

SEQ ID NO: 2724355 - DNA, 13 bp, Homo sapiens
agccccacagccc

SEQ ID NO: 2724356 - DNA, 15 bp, Homo sapiens
agccccacagcccac

SEQ ID NO: 2724357 - DNA, 16 bp, Homo sapiens
agccccacagcccacg

SEQ ID NO: 2724358 - DNA, 23 bp, Homo sapiens
agcccccaccccagcacagctcc

SEQ ID NO: 2724359 - DNA, 22 bp, Homo sapiens
agccccccccttgaatctgcag

SEQ ID NO: 2724360 - DNA, 16 bp, Homo sapiens
agccccgggctgaccc

SEQ ID NO: 2724361 - DNA, 17 bp, Homo sapiens
agccccgggctgaccca

SEQ ID NO: 2724362 - DNA, 19 bp, Homo sapiens
agccctggggcccctcgac

SEQ ID NO: 2724363 - DNA, 18 bp, Homo sapiens
agcccttggttcctcccc

SEQ ID NO: 2724364 - DNA, 22 bp, Homo sapiens
agccgggcgtggtggcgggcac

SEQ ID NO: 2724365 - DNA, 18 bp, Homo sapiens
agccgtattttacatgaa

SEQ ID NO: 2724366 - DNA, 21 bp, Homo sapiens
agcctcaagtcttatttcctc

SEQ ID NO: 2724367 - DNA, 18 bp, Homo sapiens
agcctcacagatgctggc

SEQ ID NO: 2724368 - DNA, 21 bp, Homo sapiens
agcctcacagatgctggcctc

SEQ ID NO: 2724369 - DNA, 22 bp, Homo sapiens
agcctcatgccccaggcctcgt

SEQ ID NO: 2724370 - DNA, 14 bp, Homo sapiens
agcctccagtgctg

SEQ ID NO: 2724371 - DNA, 22 bp, Homo sapiens
agcctccagtgctggctgctgg

SEQ ID NO: 2724372 - DNA, 23 bp, Homo sapiens
agcctccagtgctggctgctggc

SEQ ID NO: 2724373 - DNA, 22 bp, Homo sapiens
agcctcccagctttctgtgtgc

SEQ ID NO: 2724374 - DNA, 13 bp, Homo sapiens
agcctcctctctc

SEQ ID NO: 2724375 - DNA, 16 bp, Homo sapiens
agcctcgtccaaggca

SEQ ID NO: 2724376 - DNA, 15 bp, Homo sapiens
agcctctgtgtcact

SEQ ID NO: 2724377 - DNA, 21 bp, Homo sapiens
agcctctgtgtcactggctgc

SEQ ID NO: 2724378 - DNA, 19 bp, Homo sapiens
agcctgccgccgtctctgt

SEQ ID NO: 2724379 - DNA, 15 bp, Homo sapiens
agcctggcccagctc

SEQ ID NO: 2724380 - DNA, 19 bp, Homo sapiens
agcctggcttctggagccc

SEQ ID NO: 2724381 - DNA, 14 bp, Homo sapiens
agcctgggcgacag

SEQ ID NO: 2724382 - DNA, 20 bp, Homo sapiens
agcctgggcgacagagcaag

SEQ ID NO: 2724383 - DNA, 12 bp, Homo sapiens
agcctgtcctgg

SEQ ID NO: 2724384 - DNA, 19 bp, Homo sapiens
agccttccccctcccaggg

SEQ ID NO: 2724385 - DNA, 22 bp, Homo sapiens
agcctttaccctcctctatttc

SEQ ID NO: 2724386 - DNA, 23 bp, Homo sapiens
agcctttaccctcctctatttct

SEQ ID NO: 2724387 - DNA, 15 bp, Homo sapiens
agcgaccctggctct

SEQ ID NO: 2724388 - DNA, 16 bp, Homo sapiens
agcgagagtctgtctc

SEQ ID NO: 2724389 - DNA, 14 bp, Homo sapiens
agcgagctgctctg

SEQ ID NO: 2724390 - DNA, 15 bp, Homo sapiens
agcgagctgctctgc

SEQ ID NO: 2724391 - DNA, 18 bp, Homo sapiens
agcgagctgctctgctat

SEQ ID NO: 2724392 - DNA, 13 bp, Homo sapiens
agcgaggaaagga

SEQ ID NO: 2724393 - DNA, 14 bp, Homo sapiens
agcgagttgtggaa

SEQ ID NO: 2724394 - DNA, 19 bp, Homo sapiens
agcgatgaatttggagact

SEQ ID NO: 2724395 - DNA, 18 bp, Homo sapiens
agcgcacctgccccctgg

SEQ ID NO: 2724396 - DNA, 19 bp, Homo sapiens
agcgcacctgccccctggt

SEQ ID NO: 2724397 - DNA, 13 bp, Homo sapiens
agcgcttagaaac

SEQ ID NO: 2724398 - DNA, 23 bp, Homo sapiens
agcggaggttgcagggagccgag

SEQ ID NO: 2724399 - DNA, 22 bp, Homo sapiens
agcgggatcccagcatctcaga

SEQ ID NO: 2724400 - DNA, 14 bp, Homo sapiens
agcgtccatttctt

SEQ ID NO: 2724401 - DNA, 15 bp, Homo sapiens
agcgtccatttctta

SEQ ID NO: 2724402 - DNA, 14 bp, Homo sapiens
agcgtgctgcctct

SEQ ID NO: 2724403 - DNA, 15 bp, Homo sapiens
agcgtgctgcctctc

SEQ ID NO: 2724404 - DNA, 17 bp, Homo sapiens
agctaagcctgatgatg

SEQ ID NO: 2724405 - DNA, 16 bp, Homo sapiens
agctaaggaagacaca

SEQ ID NO: 2724406 - DNA, 14 bp, Homo sapiens
agctactcagaagc

SEQ ID NO: 2724407 - DNA, 18 bp, Homo sapiens
agctactcagaagcctga

SEQ ID NO: 2724408 - DNA, 13 bp, Homo sapiens
agctactctcttg

SEQ ID NO: 2724409 - DNA, 13 bp, Homo sapiens
agctagggctgga

SEQ ID NO: 2724410 - DNA, 20 bp, Homo sapiens
agctattagcaactgtgcta

SEQ ID NO: 2724411 - DNA, 15 bp, Homo sapiens
agctattcaggaggc

SEQ ID NO: 2724412 - DNA, 17 bp, Homo sapiens
agctcaggaggcttgga

SEQ ID NO: 2724413 - DNA, 18 bp, Homo sapiens
agctcataagctgtagaa

SEQ ID NO: 2724414 - DNA, 22 bp, Homo sapiens
agctcataagctgtagaactct

SEQ ID NO: 2724415 - DNA, 17 bp, Homo sapiens
agctcatcatcagtctt

SEQ ID NO: 2724416 - DNA, 20 bp, Homo sapiens
agctccaccctcctggcctc

SEQ ID NO: 2724417 - DNA, 23 bp, Homo sapiens
agctcccccgggaggggcccgct

SEQ ID NO: 2724418 - DNA, 21 bp, Homo sapiens
agctccctggtgagggagcct

SEQ ID NO: 2724419 - DNA, 12 bp, Homo sapiens
agctcctcccct

SEQ ID NO: 2724420 - DNA, 13 bp, Homo sapiens
agctcctcccctg

SEQ ID NO: 2724421 - DNA, 18 bp, Homo sapiens
agctcctcccctgccgcc

SEQ ID NO: 2724422 - DNA, 19 bp, Homo sapiens
agctcctcccctgccgcct

SEQ ID NO: 2724423 - DNA, 20 bp, Homo sapiens
agctcctcccctgccgcctc

SEQ ID NO: 2724424 - DNA, 23 bp, Homo sapiens
agctcctcccctgccgcctcccg

SEQ ID NO: 2724425 - DNA, 16 bp, Homo sapiens
agctcctgctcattgt

SEQ ID NO: 2724426 - DNA, 15 bp, Homo sapiens
agctcctgtccctac

SEQ ID NO: 2724427 - DNA, 21 bp, Homo sapiens
agctcctgtccctacccactc

SEQ ID NO: 2724428 - DNA, 21 bp, Homo sapiens
agctctacacaacatgtatgt

SEQ ID NO: 2724429 - DNA, 18 bp, Homo sapiens
agctctatctgcaatgtt

SEQ ID NO: 2724430 - DNA, 13 bp, Homo sapiens
agctctgcattat

SEQ ID NO: 2724431 - DNA, 23 bp, Homo sapiens
agctctgctggaagaactgcatg

SEQ ID NO: 2724432 - DNA, 12 bp, Homo sapiens
agctctggcttc

SEQ ID NO: 2724433 - DNA, 12 bp, Homo sapiens
agctcttgtttg

SEQ ID NO: 2724434 - DNA, 12 bp, Homo sapiens
agctgaaacatg

SEQ ID NO: 2724435 - DNA, 16 bp, Homo sapiens
agctgacagtcctctc

SEQ ID NO: 2724436 - DNA, 21 bp, Homo sapiens
agctgacagtcctctccacct

SEQ ID NO: 2724437 - DNA, 14 bp, Homo sapiens
agctgaggcctccc

SEQ ID NO: 2724438 - DNA, 21 bp, Homo sapiens
agctgcacctgccagcctggc

SEQ ID NO: 2724439 - DNA, 14 bp, Homo sapiens
agctgcagcttcct

SEQ ID NO: 2724440 - DNA, 11 bp, Homo sapiens
agctgccagca

SEQ ID NO: 2724441 - DNA, 16 bp, Homo sapiens
agctgcgggctgaggg

SEQ ID NO: 2724442 - DNA, 22 bp, Homo sapiens
agctgcgggctgagggcatctc

SEQ ID NO: 2724443 - DNA, 12 bp, Homo sapiens
agctgctctgct

SEQ ID NO: 2724444 - DNA, 13 bp, Homo sapiens
agctgctctgcta

SEQ ID NO: 2724445 - DNA, 16 bp, Homo sapiens
agctgctgccactctg

SEQ ID NO: 2724446 - DNA, 19 bp, Homo sapiens
agctgctgccactctgctg

SEQ ID NO: 2724447 - DNA, 22 bp, Homo sapiens
agctgctgccactctgctgcct

SEQ ID NO: 2724448 - DNA, 11 bp, Homo sapiens
agctggaggaa

SEQ ID NO: 2724449 - DNA, 11 bp, Homo sapiens
agctggcctct

SEQ ID NO: 2724450 - DNA, 20 bp, Homo sapiens
agctggcctctagaacaccc

SEQ ID NO: 2724451 - DNA, 20 bp, Homo sapiens
agctgggcccacagccccca

SEQ ID NO: 2724452 - DNA, 12 bp, Homo sapiens
agctggtggatg

SEQ ID NO: 2724453 - DNA, 17 bp, Homo sapiens
agctggtggatggtgac

SEQ ID NO: 2724454 - DNA, 20 bp, Homo sapiens
agctggtggatggtgacttt

SEQ ID NO: 2724455 - DNA, 15 bp, Homo sapiens
agctgtagaactctg

SEQ ID NO: 2724456 - DNA, 17 bp, Homo sapiens
agctgtagaactctgca

SEQ ID NO: 2724457 - DNA, 16 bp, Homo sapiens
agctgtagctcccgag

SEQ ID NO: 2724458 - DNA, 23 bp, Homo sapiens
agctgtataattaattgtcatta

SEQ ID NO: 2724459 - DNA, 19 bp, Homo sapiens
agctgtgccaccctgggct

SEQ ID NO: 2724460 - DNA, 19 bp, Homo sapiens
agctgtggactttgttcac

SEQ ID NO: 2724461 - DNA, 19 bp, Homo sapiens
agctgtggtcccacccagg

SEQ ID NO: 2724462 - DNA, 21 bp, Homo sapiens
agctgtggtcccacccaggaa

SEQ ID NO: 2724463 - DNA, 21 bp, Homo sapiens
agcttacccttggtttgcaca

SEQ ID NO: 2724464 - DNA, 13 bp, Homo sapiens
agcttcatatcta

SEQ ID NO: 2724465 - DNA, 17 bp, Homo sapiens
agcttcccaagtagctg

SEQ ID NO: 2724466 - DNA, 16 bp, Homo sapiens
agcttcctctgagccg

SEQ ID NO: 2724467 - DNA, 18 bp, Homo sapiens
agcttcctctgagccgca

SEQ ID NO: 2724468 - DNA, 15 bp, Homo sapiens
agcttcctgtcaaca

SEQ ID NO: 2724469 - DNA, 16 bp, Homo sapiens
agcttctgctgggctg

SEQ ID NO: 2724470 - DNA, 20 bp, Homo sapiens
agcttgactctactcccagc

SEQ ID NO: 2724471 - DNA, 14 bp, Homo sapiens
agctttctcctttg

SEQ ID NO: 2724472 - DNA, 18 bp, Homo sapiens
agcttttcgaactgtgct

SEQ ID NO: 2724473 - DNA, 19 bp, Homo sapiens
agctttttgtattaacaaa

SEQ ID NO: 2724474 - DNA, 19 bp, Homo sapiens
aggaaaagcctctgtgtca

SEQ ID NO: 2724475 - DNA, 19 bp, Homo sapiens
aggaaaggattttaccaaa

SEQ ID NO: 2724476 - DNA, 22 bp, Homo sapiens
aggaaaggattttaccaaagca

SEQ ID NO: 2724477 - DNA, 23 bp, Homo sapiens
aggaaaggattttaccaaagcat

SEQ ID NO: 2724478 - DNA, 15 bp, Homo sapiens
aggaaatcagagctg

SEQ ID NO: 2724479 - DNA, 18 bp, Homo sapiens
aggaacacccggaaagac

SEQ ID NO: 2724480 - DNA, 18 bp, Homo sapiens
aggaagggcatccttctg

SEQ ID NO: 2724481 - DNA, 20 bp, Homo sapiens
aggacctgaaataaggtata

SEQ ID NO: 2724482 - DNA, 15 bp, Homo sapiens
aggacggggccggcc

SEQ ID NO: 2724483 - DNA, 19 bp, Homo sapiens
aggacggggccggccaggt

SEQ ID NO: 2724484 - DNA, 20 bp, Homo sapiens
aggacggttgtaagcagttg

SEQ ID NO: 2724485 - DNA, 21 bp, Homo sapiens
aggactaacgaacgttttaaa

SEQ ID NO: 2724486 - DNA, 13 bp, Homo sapiens
aggactctgaggc

SEQ ID NO: 2724487 - DNA, 16 bp, Homo sapiens
aggactggccgtggct

SEQ ID NO: 2724488 - DNA, 15 bp, Homo sapiens
aggactggggcttgc

SEQ ID NO: 2724489 - DNA, 21 bp, Homo sapiens
aggactggggcttgccaggct

SEQ ID NO: 2724490 - DNA, 15 bp, Homo sapiens
aggactgtaagcaga

SEQ ID NO: 2724491 - DNA, 14 bp, Homo sapiens
aggagaaaatgcat

SEQ ID NO: 2724492 - DNA, 21 bp, Homo sapiens
aggagagaagtggccagggct

SEQ ID NO: 2724493 - DNA, 13 bp, Homo sapiens
aggagagacagga

SEQ ID NO: 2724494 - DNA, 20 bp, Homo sapiens
aggagagagcagcttctgcc

SEQ ID NO: 2724495 - DNA, 17 bp, Homo sapiens
aggagagccctctgctg

SEQ ID NO: 2724496 - DNA, 18 bp, Homo sapiens
aggagagccctctgctgc

SEQ ID NO: 2724497 - DNA, 21 bp, Homo sapiens
aggagagccctctgctgcttt

SEQ ID NO: 2724498 - DNA, 23 bp, Homo sapiens
aggagatagacgggttgaaagac

SEQ ID NO: 2724499 - DNA, 15 bp, Homo sapiens
aggagattgctctgg

SEQ ID NO: 2724500 - DNA, 16 bp, Homo sapiens
aggagcagcttcagtt

SEQ ID NO: 2724501 - DNA, 19 bp, Homo sapiens
ctgttattttttatttcca

SEQ ID NO: 2724502 - DNA, 23 bp, Homo sapiens
ctgttcccagcaaagttttcaga

SEQ ID NO: 2724503 - DNA, 23 bp, Homo sapiens
ctgttcctcgggatgaaaagcca

SEQ ID NO: 2724504 - DNA, 17 bp, Homo sapiens
ctgttctacttgatatt

SEQ ID NO: 2724505 - DNA, 22 bp, Homo sapiens
ctgttctcaccttaactcagcc

SEQ ID NO: 2724506 - DNA, 15 bp, Homo sapiens
gaaagcctctgctgc

SEQ ID NO: 2724507 - DNA, 16 bp, Homo sapiens
gaaagcctctgctgcc

SEQ ID NO: 2724508 - DNA, 21 bp, Homo sapiens
gaaaggaagatgtaagaagct

SEQ ID NO: 2724509 - DNA, 18 bp, Homo sapiens
gaaaggattctaaacaga

SEQ ID NO: 2724510 - DNA, 12 bp, Homo sapiens
gaaaggatttta

SEQ ID NO: 2724511 - DNA, 19 bp, Homo sapiens
gaaaggattttaccaaagc

SEQ ID NO: 2724512 - DNA, 19 bp, Homo sapiens
gaaaggctcagtctcagga

SEQ ID NO: 2724513 - DNA, 15 bp, Homo sapiens
gaaagtgaataaact

SEQ ID NO: 2724514 - DNA, 20 bp, Homo sapiens
gaaagtgaataaacttcagc

SEQ ID NO: 2724515 - DNA, 21 bp, Homo sapiens
gaaagtgatatcccccagcct

SEQ ID NO: 2724516 - DNA, 18 bp, Homo sapiens
gaaagtgggtttcaattt

SEQ ID NO: 2724517 - DNA, 16 bp, Homo sapiens
gaaatcagagctggca

SEQ ID NO: 2724518 - DNA, 18 bp, Homo sapiens
gaaatgtttttggcaaca

SEQ ID NO: 2724519 - DNA, 12 bp, Homo sapiens
gaaattctgtgg

SEQ ID NO: 2724520 - DNA, 13 bp, Homo sapiens
gaacaaagaaaag

SEQ ID NO: 2724521 - DNA, 14 bp, Homo sapiens
gaacaaagaaaaga

SEQ ID NO: 2724522 - DNA, 16 bp, Homo sapiens
gaacaagcattctcct

SEQ ID NO: 2724523 - DNA, 14 bp, Homo sapiens
gaacacactcagca

SEQ ID NO: 2724524 - DNA, 15 bp, Homo sapiens
gaacacccactggcc

SEQ ID NO: 2724525 - DNA, 19 bp, Homo sapiens
gaacacgcatgcctcagcc

SEQ ID NO: 2724526 - DNA, 16 bp, Homo sapiens
gaacagtgctctgcct

SEQ ID NO: 2724527 - DNA, 17 bp, Homo sapiens
gaacagtgctctgcctc

SEQ ID NO: 2724528 - DNA, 23 bp, Homo sapiens
gaacatgtgtgtgtgttgtgtta

SEQ ID NO: 2724529 - DNA, 13 bp, Homo sapiens
gaaccacagtcat

SEQ ID NO: 2724530 - DNA, 16 bp, Homo sapiens
gaaccagccgtatttt

SEQ ID NO: 2724531 - DNA, 12 bp, Homo sapiens
gaaccagctcta

SEQ ID NO: 2724532 - DNA, 17 bp, Homo sapiens
gaaccaggctgctgcat

SEQ ID NO: 2724533 - DNA, 13 bp, Homo sapiens
gaacccaggaggt

SEQ ID NO: 2724534 - DNA, 14 bp, Homo sapiens
gaaccgtgtgctcc

SEQ ID NO: 2724535 - DNA, 20 bp, Homo sapiens
gaacctaactccccacccca

SEQ ID NO: 2724536 - DNA, 11 bp, Homo sapiens
gaacctcaggc

SEQ ID NO: 2724537 - DNA, 18 bp, Homo sapiens
gaacctcaggcttccttg

SEQ ID NO: 2724538 - DNA, 16 bp, Homo sapiens
gaacggggtccttcaa

SEQ ID NO: 2724539 - DNA, 16 bp, Homo sapiens
gaactccccagggcct

SEQ ID NO: 2724540 - DNA, 21 bp, Homo sapiens
gaactccccagggcctccagg

SEQ ID NO: 2724541 - DNA, 18 bp, Homo sapiens
gaactctaccctggtagg

SEQ ID NO: 2724542 - DNA, 20 bp, Homo sapiens
gaactctaccctggtaggaa

SEQ ID NO: 2724543 - DNA, 16 bp, Homo sapiens
gaactctgcaactgaa

SEQ ID NO: 2724544 - DNA, 14 bp, Homo sapiens
gaactctgcaggca

SEQ ID NO: 2724545 - DNA, 12 bp, Homo sapiens
gaactgccccat

SEQ ID NO: 2724546 - DNA, 18 bp, Homo sapiens
gaactgccccatctcctc

SEQ ID NO: 2724547 - DNA, 14 bp, Homo sapiens
gaactgctggggct

SEQ ID NO: 2724548 - DNA, 15 bp, Homo sapiens
gaactgctggggctg

SEQ ID NO: 2724549 - DNA, 23 bp, Homo sapiens
gaactgctggggctggtgaggcc

SEQ ID NO: 2724550 - DNA, 22 bp, Homo sapiens
gaactggccactccccagtgct

SEQ ID NO: 2724551 - DNA, 21 bp, Homo sapiens
gaagaactttgccttaagttt

SEQ ID NO: 2724552 - DNA, 19 bp, Homo sapiens
gaagacttcaatattaaat

SEQ ID NO: 2724553 - DNA, 19 bp, Homo sapiens
gaagagaggcacctgctgg

SEQ ID NO: 2724554 - DNA, 23 bp, Homo sapiens
gaagagaggcacctgctggaaac

SEQ ID NO: 2724555 - DNA, 13 bp, Homo sapiens
gaagagcacagcc

SEQ ID NO: 2724556 - DNA, 14 bp, Homo sapiens
gaagagcacagccc

SEQ ID NO: 2724557 - DNA, 15 bp, Homo sapiens
gaagagcacagccct

SEQ ID NO: 2724558 - DNA, 20 bp, Homo sapiens
gaagatctgcttccctgggg

SEQ ID NO: 2724559 - DNA, 20 bp, Homo sapiens
gaagatgaaaccgtccctga

SEQ ID NO: 2724560 - DNA, 18 bp, Homo sapiens
gaagcaagacgtcctgga

SEQ ID NO: 2724561 - DNA, 21 bp, Homo sapiens
gaagcaagacgtcctggaatg

SEQ ID NO: 2724562 - DNA, 23 bp, Homo sapiens
gaagcaagacgtcctggaatgaa

SEQ ID NO: 2724563 - DNA, 17 bp, Homo sapiens
gaagcaatttatatctt

SEQ ID NO: 2724564 - DNA, 18 bp, Homo sapiens
gaagcaggttgaggggct

SEQ ID NO: 2724565 - DNA, 19 bp, Homo sapiens
gaagcaggttgaggggctc

SEQ ID NO: 2724566 - DNA, 13 bp, Homo sapiens
gaagcatcctccc

SEQ ID NO: 2724567 - DNA, 14 bp, Homo sapiens
gaagcatcctcccc

SEQ ID NO: 2724568 - DNA, 12 bp, Homo sapiens
gaagcctgaggc

SEQ ID NO: 2724569 - DNA, 17 bp, Homo sapiens
gaaggagccagccagga

SEQ ID NO: 2724570 - DNA, 19 bp, Homo sapiens
gaaggcctcccctgaggat

SEQ ID NO: 2724571 - DNA, 13 bp, Homo sapiens
gaaggctggctgg

SEQ ID NO: 2724572 - DNA, 15 bp, Homo sapiens
gaaggcttctgcagc

SEQ ID NO: 2724573 - DNA, 20 bp, Homo sapiens
gaagggagggagctgaggcc

SEQ ID NO: 2724574 - DNA, 14 bp, Homo sapiens
gaagggcctgctct

SEQ ID NO: 2724575 - DNA, 14 bp, Homo sapiens
gaaggtaataaata

SEQ ID NO: 2724576 - DNA, 19 bp, Homo sapiens
gaaggtatatcaggagggg

SEQ ID NO: 2724577 - DNA, 20 bp, Homo sapiens
gaagtaactcccactcctaa

SEQ ID NO: 2724578 - DNA, 15 bp, Homo sapiens
gaagtactttgtgct

SEQ ID NO: 2724579 - DNA, 13 bp, Homo sapiens
gaagtgtatatag

SEQ ID NO: 2724580 - DNA, 21 bp, Homo sapiens
gaagttggtcttactttgtgc

SEQ ID NO: 2724581 - DNA, 22 bp, Homo sapiens
gaataaaattgtaaaattgtat

SEQ ID NO: 2724582 - DNA, 14 bp, Homo sapiens
gaataaacttcagc

SEQ ID NO: 2724583 - DNA, 15 bp, Homo sapiens
gaataaacttcagca

SEQ ID NO: 2724584 - DNA, 17 bp, Homo sapiens
gaatagtctctgggttt

SEQ ID NO: 2724585 - DNA, 16 bp, Homo sapiens
gaatcaagtctgtgaa

SEQ ID NO: 2724586 - DNA, 21 bp, Homo sapiens
gaatcctgggcccccagagac

SEQ ID NO: 2724587 - DNA, 22 bp, Homo sapiens
gaatgcacattggaagctccca

SEQ ID NO: 2724588 - DNA, 22 bp, Homo sapiens
gaatgcctgtcccagtccaaat

SEQ ID NO: 2724589 - DNA, 19 bp, Homo sapiens
gaatgggaaagtatttttg

SEQ ID NO: 2724590 - DNA, 22 bp, Homo sapiens
gaatgggaaagtatttttgaaa

SEQ ID NO: 2724591 - DNA, 16 bp, Homo sapiens
gaatgtcattatttga

SEQ ID NO: 2724592 - DNA, 14 bp, Homo sapiens
gaatgtcccagagg

SEQ ID NO: 2724593 - DNA, 17 bp, Homo sapiens
gaatgtgattttaaaga

SEQ ID NO: 2724594 - DNA, 13 bp, Homo sapiens
gaatgtgctgcct

SEQ ID NO: 2724595 - DNA, 22 bp, Homo sapiens
gaattaaactcctactgcttcc

SEQ ID NO: 2724596 - DNA, 20 bp, Homo sapiens
gaattacactcaaggaaaag

SEQ ID NO: 2724597 - DNA, 19 bp, Homo sapiens
gaattcacaaacaaatggc

SEQ ID NO: 2724598 - DNA, 13 bp, Homo sapiens
gaattctattttg

SEQ ID NO: 2724599 - DNA, 16 bp, Homo sapiens
gaattctattttgctg

SEQ ID NO: 2724600 - DNA, 23 bp, Homo sapiens
gaattgccttaaggccacactgg

SEQ ID NO: 2724601 - DNA, 22 bp, Homo sapiens
gaattgtttttagaaatttatt

SEQ ID NO: 2724602 - DNA, 14 bp, Homo sapiens
gaatttgactggtt

SEQ ID NO: 2724603 - DNA, 14 bp, Homo sapiens
gaattttcccactg

SEQ ID NO: 2724604 - DNA, 20 bp, Homo sapiens
gaattttctttcatacatta

SEQ ID NO: 2724605 - DNA, 21 bp, Homo sapiens
gaattttctttcatacattat

SEQ ID NO: 2724606 - DNA, 15 bp, Homo sapiens
gaattttggaaaaat

SEQ ID NO: 2724607 - DNA, 12 bp, Homo sapiens
gaattttgtaaa

SEQ ID NO: 2724608 - DNA, 17 bp, Homo sapiens
gaattttgtaaaaagaa

SEQ ID NO: 2724609 - DNA, 16 bp, Homo sapiens
gaatttttaagcaaat

SEQ ID NO: 2724610 - DNA, 14 bp, Homo sapiens
gaatttttattatt

SEQ ID NO: 2724611 - DNA, 14 bp, Homo sapiens
gacaaaattgctta

SEQ ID NO: 2724612 - DNA, 14 bp, Homo sapiens
gacaacacatgtgg

SEQ ID NO: 2724613 - DNA, 21 bp, Homo sapiens
gacaacatttttgtacattat

SEQ ID NO: 2724614 - DNA, 12 bp, Homo sapiens
gacaacccagaa

SEQ ID NO: 2724615 - DNA, 17 bp, Homo sapiens
gacaatgcgtggcacat

SEQ ID NO: 2724616 - DNA, 22 bp, Homo sapiens
gacaatttatatttaataaaat

SEQ ID NO: 2724617 - DNA, 21 bp, Homo sapiens
gacacactgcggtgtctgcag

SEQ ID NO: 2724618 - DNA, 21 bp, Homo sapiens
gacaccccccgccccccacct

SEQ ID NO: 2724619 - DNA, 16 bp, Homo sapiens
gacactgcggggcttg

SEQ ID NO: 2724620 - DNA, 22 bp, Homo sapiens
gacactgcggggcttggctgag

SEQ ID NO: 2724621 - DNA, 17 bp, Homo sapiens
gacagagccagaggcac

SEQ ID NO: 2724622 - DNA, 16 bp, Homo sapiens
gacagatcctccattt

SEQ ID NO: 2724623 - DNA, 13 bp, Homo sapiens
gagctgcgggctg

SEQ ID NO: 2724624 - DNA, 17 bp, Homo sapiens
gagctgcgggctgaggg

SEQ ID NO: 2724625 - DNA, 13 bp, Homo sapiens
gagctgctgagca

SEQ ID NO: 2724626 - DNA, 12 bp, Homo sapiens
gagctggaggaa

SEQ ID NO: 2724627 - DNA, 16 bp, Homo sapiens
gagctggcagcctcca

SEQ ID NO: 2724628 - DNA, 17 bp, Homo sapiens
gagctggcagcctccag

SEQ ID NO: 2724629 - DNA, 13 bp, Homo sapiens
gaggaaaggattt

SEQ ID NO: 2724630 - DNA, 22 bp, Homo sapiens
gaggagaaaagtgacagatcct

SEQ ID NO: 2724631 - DNA, 20 bp, Homo sapiens
gaggagagagcagcttctgc

SEQ ID NO: 2724632 - DNA, 19 bp, Homo sapiens
gaggagggatgctgcctga

SEQ ID NO: 2724633 - DNA, 20 bp, Homo sapiens
gaggaggtggcagccctgta

SEQ ID NO: 2724634 - DNA, 21 bp, Homo sapiens
gaggagtgtcctgtctgctgg

SEQ ID NO: 2724635 - DNA, 22 bp, Homo sapiens
gaggagtgtcctgtctgctggg

SEQ ID NO: 2724636 - DNA, 16 bp, Homo sapiens
gaggatcactggagcc

SEQ ID NO: 2724637 - DNA, 19 bp, Homo sapiens
gaggatcactggagcccag

SEQ ID NO: 2724638 - DNA, 21 bp, Homo sapiens
gaggatcccctgtcccctggg

SEQ ID NO: 2724639 - DNA, 16 bp, Homo sapiens
gaggatgctgtcagga

SEQ ID NO: 2724640 - DNA, 17 bp, Homo sapiens
gaggcaggtctgggcca

SEQ ID NO: 2724641 - DNA, 18 bp, Homo sapiens
gaggcaggtctgggccag

SEQ ID NO: 2724642 - DNA, 18 bp, Homo sapiens
gaggccaaggtttcccag

SEQ ID NO: 2724643 - DNA, 21 bp, Homo sapiens
gaggcccagcctgtcctggta

SEQ ID NO: 2724644 - DNA, 19 bp, Homo sapiens
gaggccggccctgcccctc

SEQ ID NO: 2724645 - DNA, 20 bp, Homo sapiens
gaggccggccctgcccctcc

SEQ ID NO: 2724646 - DNA, 12 bp, Homo sapiens
gaggcggtgggg

SEQ ID NO: 2724647 - DNA, 16 bp, Homo sapiens
gaggctccgtgagccc

SEQ ID NO: 2724648 - DNA, 18 bp, Homo sapiens
gaggctccgtgagccctt

SEQ ID NO: 2724649 - DNA, 21 bp, Homo sapiens
gaggctccgtgagcccttggt

SEQ ID NO: 2724650 - DNA, 12 bp, Homo sapiens
gaggctcctccc

SEQ ID NO: 2724651 - DNA, 14 bp, Homo sapiens
gaggctcctccctc

SEQ ID NO: 2724652 - DNA, 17 bp, Homo sapiens
gaggctcctccctctgc

SEQ ID NO: 2724653 - DNA, 21 bp, Homo sapiens
gaggctcctccctctgcctca

SEQ ID NO: 2724654 - DNA, 20 bp, Homo sapiens
gaggctggatggctcccctg

SEQ ID NO: 2724655 - DNA, 13 bp, Homo sapiens
gaggctggcatcc

SEQ ID NO: 2724656 - DNA, 16 bp, Homo sapiens
gaggctggcatcctgg

SEQ ID NO: 2724657 - DNA, 18 bp, Homo sapiens
gaggctggcatcctggct

SEQ ID NO: 2724658 - DNA, 20 bp, Homo sapiens
gaggctggcatcctggctgg

SEQ ID NO: 2724659 - DNA, 12 bp, Homo sapiens
gaggctggctgg

SEQ ID NO: 2724660 - DNA, 14 bp, Homo sapiens
gagggactgctgac

SEQ ID NO: 2724661 - DNA, 16 bp, Homo sapiens
gagggactgctgaccc

SEQ ID NO: 2724662 - DNA, 21 bp, Homo sapiens
gagggagctgaggcctccctt

SEQ ID NO: 2724663 - DNA, 16 bp, Homo sapiens
gagggatcattttctg

SEQ ID NO: 2724664 - DNA, 17 bp, Homo sapiens
gagggatgctgcctgag

SEQ ID NO: 2724665 - DNA, 16 bp, Homo sapiens
gagggcatctctgagt

SEQ ID NO: 2724666 - DNA, 14 bp, Homo sapiens
gagggcgctcctgt

SEQ ID NO: 2724667 - DNA, 21 bp, Homo sapiens
gaggggaggatcactggagcc

SEQ ID NO: 2724668 - DNA, 15 bp, Homo sapiens
gaggggcaggccctg

SEQ ID NO: 2724669 - DNA, 21 bp, Homo sapiens
gaggggcccgttgtctccctg

SEQ ID NO: 2724670 - DNA, 22 bp, Homo sapiens
gaggtccttggagtgctgcagc

SEQ ID NO: 2724671 - DNA, 20 bp, Homo sapiens
gaggtctcgctgatgctggg

SEQ ID NO: 2724672 - DNA, 16 bp, Homo sapiens
gaggtgacttgcctgg

SEQ ID NO: 2724673 - DNA, 21 bp, Homo sapiens
gaggtgacttgcctggggcca

SEQ ID NO: 2724674 - DNA, 23 bp, Homo sapiens
gaggtgacttgcctggggccaca

SEQ ID NO: 2724675 - DNA, 12 bp, Homo sapiens
gaggtgagcaga

SEQ ID NO: 2724676 - DNA, 19 bp, Homo sapiens
gaggtggaggttgcagtga

SEQ ID NO: 2724677 - DNA, 20 bp, Homo sapiens
gaggtgtcaccctgcagagc

SEQ ID NO: 2724678 - DNA, 13 bp, Homo sapiens
gaggttgcaggga

SEQ ID NO: 2724679 - DNA, 13 bp, Homo sapiens
gaggttgcagtga

SEQ ID NO: 2724680 - DNA, 20 bp, Homo sapiens
gaggtttctcaaagaaattt

SEQ ID NO: 2724681 - DNA, 13 bp, Homo sapiens
gagtacaattgtt

SEQ ID NO: 2724682 - DNA, 15 bp, Homo sapiens
gagtacattcatctg

SEQ ID NO: 2724683 - DNA, 21 bp, Homo sapiens
gagtacattcatctggaggct

SEQ ID NO: 2724684 - DNA, 21 bp, Homo sapiens
gagtaccaaatccacaagcca

SEQ ID NO: 2724685 - DNA, 13 bp, Homo sapiens
gagtagcagtgat

SEQ ID NO: 2724686 - DNA, 21 bp, Homo sapiens
gagtagctgggactacaggca

SEQ ID NO: 2724687 - DNA, 14 bp, Homo sapiens
gagtcaccatgcaa

SEQ ID NO: 2724688 - DNA, 12 bp, Homo sapiens
gagtccagggcg

SEQ ID NO: 2724689 - DNA, 14 bp, Homo sapiens
gagtctcgctctgc

SEQ ID NO: 2724690 - DNA, 16 bp, Homo sapiens
gagtctctgaacatcc

SEQ ID NO: 2724691 - DNA, 12 bp, Homo sapiens
gagtctctggct

SEQ ID NO: 2724692 - DNA, 21 bp, Homo sapiens
gagtctgctatattttcatga

SEQ ID NO: 2724693 - DNA, 14 bp, Homo sapiens
gagtctggaatgct

SEQ ID NO: 2724694 - DNA, 22 bp, Homo sapiens
gagtctggcaaacatgtgcaac

SEQ ID NO: 2724695 - DNA, 22 bp, Homo sapiens
gagtgagaaatttttttccaga

SEQ ID NO: 2724696 - DNA, 11 bp, Homo sapiens
gagtggcatgt

SEQ ID NO: 2724697 - DNA, 20 bp, Homo sapiens
gagtgtccctttttgcaggg

SEQ ID NO: 2724698 - DNA, 23 bp, Homo sapiens
gagtgtccctttttgcaggggac

SEQ ID NO: 2724699 - DNA, 18 bp, Homo sapiens
gagtgtcctgtctgctgg

SEQ ID NO: 2724700 - DNA, 20 bp, Homo sapiens
gagtgtctctgcctggagca

SEQ ID NO: 2724701 - DNA, 14 bp, Homo sapiens
gagttcaagaccag

SEQ ID NO: 2724702 - DNA, 23 bp, Homo sapiens
gagtttcacgcttattgcccagg

SEQ ID NO: 2724703 - DNA, 21 bp, Homo sapiens
gagtttttcttacataatttg

SEQ ID NO: 2724704 - DNA, 17 bp, Homo sapiens
gataaaagaaccccaga

SEQ ID NO: 2724705 - DNA, 14 bp, Homo sapiens
gataaattacatta

SEQ ID NO: 2724706 - DNA, 15 bp, Homo sapiens
gataaattacattaa

SEQ ID NO: 2724707 - DNA, 16 bp, Homo sapiens
gataaattccactgga

SEQ ID NO: 2724708 - DNA, 22 bp, Homo sapiens
gataacatgtatcactcactgc

SEQ ID NO: 2724709 - DNA, 18 bp, Homo sapiens
gataactgcaattttaat

SEQ ID NO: 2724710 - DNA, 11 bp, Homo sapiens
gataatttttc

SEQ ID NO: 2724711 - DNA, 17 bp, Homo sapiens
gatacgacaacttgcac

SEQ ID NO: 2724712 - DNA, 15 bp, Homo sapiens
gatactgaagtgcag

SEQ ID NO: 2724713 - DNA, 22 bp, Homo sapiens
gatactgtatctgggctgattt

SEQ ID NO: 2724714 - DNA, 18 bp, Homo sapiens
gatagacgggttgaaaga

SEQ ID NO: 2724715 - DNA, 24 bp, Homo sapiens
gatagacgggttgaaagacatcaa

SEQ ID NO: 2724716 - DNA, 15 bp, Homo sapiens
gatatccccagggaa

SEQ ID NO: 2724717 - DNA, 15 bp, Homo sapiens
gatatgaaaaataaa

SEQ ID NO: 2724718 - DNA, 13 bp, Homo sapiens
gatattttcacag

SEQ ID NO: 2724719 - DNA, 15 bp, Homo sapiens
gatatttttaattta

SEQ ID NO: 2724720 - DNA, 12 bp, Homo sapiens
gatcactggagc

SEQ ID NO: 2724721 - DNA, 13 bp, Homo sapiens
gatcactggagcc

SEQ ID NO: 2724722 - DNA, 20 bp, Homo sapiens
gatcagctattcccttctga

SEQ ID NO: 2724723 - DNA, 22 bp, Homo sapiens
gatcatcccatctaagctgcag

SEQ ID NO: 2724724 - DNA, 13 bp, Homo sapiens
gatcatctttgct

SEQ ID NO: 2724725 - DNA, 13 bp, Homo sapiens
gatcatggcagga

SEQ ID NO: 2724726 - DNA, 22 bp, Homo sapiens
gatcattacatggctgtggttc

SEQ ID NO: 2724727 - DNA, 18 bp, Homo sapiens
gatcattatcttcatgtt

SEQ ID NO: 2724728 - DNA, 19 bp, Homo sapiens
gcaccaccctttgaacaaa

SEQ ID NO: 2724729 - DNA, 15 bp, Homo sapiens
gcaccagtgcctcag

SEQ ID NO: 2724730 - DNA, 18 bp, Homo sapiens
gcaccagtgcctcagtgc

SEQ ID NO: 2724731 - DNA, 23 bp, Homo sapiens
gcaccagtgcctcagtgctgcaa

SEQ ID NO: 2724732 - DNA, 16 bp, Homo sapiens
gcaccccctcctgctg

SEQ ID NO: 2724733 - DNA, 17 bp, Homo sapiens
gcacccgggctcaggga

SEQ ID NO: 2724734 - DNA, 22 bp, Homo sapiens
gcacccgggctcagggaccaca

SEQ ID NO: 2724735 - DNA, 14 bp, Homo sapiens
gcaccctcccctcc

SEQ ID NO: 2724736 - DNA, 17 bp, Homo sapiens
gcaccctcccctcccgt

SEQ ID NO: 2724737 - DNA, 14 bp, Homo sapiens
gcaccgcagcatgt

SEQ ID NO: 2724738 - DNA, 21 bp, Homo sapiens
gcacctatggcccagccactg

SEQ ID NO: 2724739 - DNA, 15 bp, Homo sapiens
gcacctgcaggttgg

SEQ ID NO: 2724740 - DNA, 21 bp, Homo sapiens
gcacctgcaggttgggccata

SEQ ID NO: 2724741 - DNA, 16 bp, Homo sapiens
gcacctgccagcctgg

SEQ ID NO: 2724742 - DNA, 17 bp, Homo sapiens
gcacctgccagcctggc

SEQ ID NO: 2724743 - DNA, 22 bp, Homo sapiens
gcacctgccagcctggcttctg

SEQ ID NO: 2724744 - DNA, 22 bp, Homo sapiens
gcacctgccccctggtggacag

SEQ ID NO: 2724745 - DNA, 18 bp, Homo sapiens
gcacctgcctagctcttg

SEQ ID NO: 2724746 - DNA, 19 bp, Homo sapiens
gcacctgcctagctcttgg

SEQ ID NO: 2724747 - DNA, 11 bp, Homo sapiens
gcacctgctgg

SEQ ID NO: 2724748 - DNA, 15 bp, Homo sapiens
gcacctgctggaaac

SEQ ID NO: 2724749 - DNA, 23 bp, Homo sapiens
gcacctgctggaaaccacacttc

SEQ ID NO: 2724750 - DNA, 14 bp, Homo sapiens
gcacgatctcagct

SEQ ID NO: 2724751 - DNA, 19 bp, Homo sapiens
gcacgtcaccctcctgagc

SEQ ID NO: 2724752 - DNA, 21 bp, Homo sapiens
gcactaaaatgtttaattcat

SEQ ID NO: 2724753 - DNA, 21 bp, Homo sapiens
gcactaagtcatggtcctggc

SEQ ID NO: 2724754 - DNA, 22 bp, Homo sapiens
gcactaagtcatggtcctggct

SEQ ID NO: 2724755 - DNA, 19 bp, Homo sapiens
gcactctgtgcccatgggc

SEQ ID NO: 2724756 - DNA, 21 bp, Homo sapiens
gcactctgtgcccatgggcac

SEQ ID NO: 2724757 - DNA, 13 bp, Homo sapiens
gcactgctgggtg

SEQ ID NO: 2724758 - DNA, 14 bp, Homo sapiens
gcactgctgggtgg

SEQ ID NO: 2724759 - DNA, 21 bp, Homo sapiens
gcactgctgggtggcccatcc

SEQ ID NO: 2724760 - DNA, 22 bp, Homo sapiens
gcactgctgggtggcccatccc

SEQ ID NO: 2724761 - DNA, 16 bp, Homo sapiens
gcactgtatgctggac

SEQ ID NO: 2724762 - DNA, 20 bp, Homo sapiens
gcactgtcctgctccacagt

SEQ ID NO: 2724763 - DNA, 16 bp, Homo sapiens
gcactttgggaggctg

SEQ ID NO: 2724764 - DNA, 20 bp, Homo sapiens
gcactttgggaggctgaggc

SEQ ID NO: 2724765 - DNA, 15 bp, Homo sapiens
gcagaactgctgggg

SEQ ID NO: 2724766 - DNA, 19 bp, Homo sapiens
gcagaactgctggggctgg

SEQ ID NO: 2724767 - DNA, 17 bp, Homo sapiens
gcagaatcctgggcccc

SEQ ID NO: 2724768 - DNA, 22 bp, Homo sapiens
gcagacttgagtctgaggcccc

SEQ ID NO: 2724769 - DNA, 14 bp, Homo sapiens
gcagagcaggggca

SEQ ID NO: 2724770 - DNA, 15 bp, Homo sapiens
gcagagttctttgca

SEQ ID NO: 2724771 - DNA, 22 bp, Homo sapiens
gcagcacagcaaggaggctggc

SEQ ID NO: 2724772 - DNA, 13 bp, Homo sapiens
gcagcacaggagg

SEQ ID NO: 2724773 - DNA, 15 bp, Homo sapiens
gcagcacaggaggct

SEQ ID NO: 2724774 - DNA, 13 bp, Homo sapiens
gcagcactggggt

SEQ ID NO: 2724775 - DNA, 14 bp, Homo sapiens
gcagcaggtgctgc

SEQ ID NO: 2724776 - DNA, 10 bp, Homo sapiens
gcagcatgtg

SEQ ID NO: 2724777 - DNA, 17 bp, Homo sapiens
gcagcatgtggggaagc

SEQ ID NO: 2724778 - DNA, 15 bp, Homo sapiens
gcagccagctcctgg

SEQ ID NO: 2724779 - DNA, 16 bp, Homo sapiens
gcagccagctcctggt

SEQ ID NO: 2724780 - DNA, 19 bp, Homo sapiens
gcagcctccagtgctggct

SEQ ID NO: 2724781 - DNA, 20 bp, Homo sapiens
gcagcctccagtgctggctg

SEQ ID NO: 2724782 - DNA, 23 bp, Homo sapiens
gcagcctccagtgggaggacaga

SEQ ID NO: 2724783 - DNA, 16 bp, Homo sapiens
gcagcctccctctgac

SEQ ID NO: 2724784 - DNA, 20 bp, Homo sapiens
gcagcctgaccccaggcagc

SEQ ID NO: 2724785 - DNA, 20 bp, Homo sapiens
gcagccttaaacagtgtcca

SEQ ID NO: 2724786 - DNA, 21 bp, Homo sapiens
gcagccttaaacagtgtccag

SEQ ID NO: 2724787 - DNA, 16 bp, Homo sapiens
gcagcgcctgtcccct

SEQ ID NO: 2724788 - DNA, 17 bp, Homo sapiens
gcagcgcctgtcccctc

SEQ ID NO: 2724789 - DNA, 20 bp, Homo sapiens
gcagctcgagcatgccctga

SEQ ID NO: 2724790 - DNA, 11 bp, Homo sapiens
gcagctgctgc

SEQ ID NO: 2724791 - DNA, 13 bp, Homo sapiens
gcagctgggccca

SEQ ID NO: 2724792 - DNA, 22 bp, Homo sapiens
gcagctgggcccacagccccca

SEQ ID NO: 2724793 - DNA, 14 bp, Homo sapiens
gcagcttcctgtca

SEQ ID NO: 2724794 - DNA, 18 bp, Homo sapiens
gcagcttctgccacttcc

SEQ ID NO: 2724795 - DNA, 21 bp, Homo sapiens
gcagcttggagaactccgctg

SEQ ID NO: 2724796 - DNA, 18 bp, Homo sapiens
gcagctttggctgcacgt

SEQ ID NO: 2724797 - DNA, 19 bp, Homo sapiens
gcagctttgggaaagctgc

SEQ ID NO: 2724798 - DNA, 18 bp, Homo sapiens
gcaggaaatcagagctgg

SEQ ID NO: 2724799 - DNA, 15 bp, Homo sapiens
gcaggacatgtgctc

SEQ ID NO: 2724800 - DNA, 14 bp, Homo sapiens
gcaggaggaggtgc

SEQ ID NO: 2724801 - DNA, 15 bp, Homo sapiens
gcaggaggaggtgcc

SEQ ID NO: 2724802 - DNA, 20 bp, Homo sapiens
gcaggaggaggtgccaacag

SEQ ID NO: 2724803 - DNA, 15 bp, Homo sapiens
gcaggaggcaggata

SEQ ID NO: 2724804 - DNA, 15 bp, Homo sapiens
gcaggcacagcacag

SEQ ID NO: 2724805 - DNA, 17 bp, Homo sapiens
gcaggcagcgcctgtcc

SEQ ID NO: 2724806 - DNA, 12 bp, Homo sapiens
gcaggcatgccg

SEQ ID NO: 2724807 - DNA, 15 bp, Homo sapiens
gcaggcccagcagac

SEQ ID NO: 2724808 - DNA, 12 bp, Homo sapiens
gcaggccctgca

SEQ ID NO: 2724809 - DNA, 14 bp, Homo sapiens
gcaggccctgcact

SEQ ID NO: 2724810 - DNA, 15 bp, Homo sapiens
gcagggatttgagga

SEQ ID NO: 2724811 - DNA, 21 bp, Homo sapiens
gcaggggacctggagctgcca

SEQ ID NO: 2724812 - DNA, 14 bp, Homo sapiens
gcaggggctgctgg

SEQ ID NO: 2724813 - DNA, 16 bp, Homo sapiens
gcaggggctgctgggg

SEQ ID NO: 2724814 - DNA, 14 bp, Homo sapiens
gcaggtgctgctac

SEQ ID NO: 2724815 - DNA, 20 bp, Homo sapiens
gcaggttgaggggctcctgg

SEQ ID NO: 2724816 - DNA, 22 bp, Homo sapiens
gcaggttgggccatactggcct

SEQ ID NO: 2724817 - DNA, 23 bp, Homo sapiens
gcaggttgggccatactggcctc

SEQ ID NO: 2724818 - DNA, 16 bp, Homo sapiens
gcagtaaactttctct

SEQ ID NO: 2724819 - DNA, 15 bp, Homo sapiens
gcagtaagtcttttt

SEQ ID NO: 2724820 - DNA, 12 bp, Homo sapiens
gcagtcttttgc

SEQ ID NO: 2724821 - DNA, 14 bp, Homo sapiens
gcagtcttttgctg

SEQ ID NO: 2724822 - DNA, 16 bp, Homo sapiens
gcagtggctcacgcct

SEQ ID NO: 2724823 - DNA, 11 bp, Homo sapiens
gcagtgggtcc

SEQ ID NO: 2724824 - DNA, 18 bp, Homo sapiens
gcagtgggtcccacttcc

SEQ ID NO: 2724825 - DNA, 22 bp, Homo sapiens
gcagtgggtcccacttcccctc

SEQ ID NO: 2724826 - DNA, 23 bp, Homo sapiens
gcagtgggtcccacttcccctcc

SEQ ID NO: 2724827 - DNA, 15 bp, Homo sapiens
gcagttctgtgtcct

SEQ ID NO: 2724828 - DNA, 20 bp, Homo sapiens
gcatcaaacatgaaaacatt

SEQ ID NO: 2724829 - DNA, 14 bp, Homo sapiens
gcatcacagggcag

SEQ ID NO: 2724830 - DNA, 22 bp, Homo sapiens
gcatcacagggcagagccggga

SEQ ID NO: 2724831 - DNA, 13 bp, Homo sapiens
gcatcacctcagg

SEQ ID NO: 2724832 - DNA, 17 bp, Homo sapiens
gcatcctccccaccaga

SEQ ID NO: 2724833 - DNA, 23 bp, Homo sapiens
gcatcctccccaccagagctgcc

SEQ ID NO: 2724834 - DNA, 14 bp, Homo sapiens
gcatcctggctggc

SEQ ID NO: 2724835 - DNA, 16 bp, Homo sapiens
gcatcctggctggctg

SEQ ID NO: 2724836 - DNA, 13 bp, Homo sapiens
gcatctcagagtc

SEQ ID NO: 2724837 - DNA, 23 bp, Homo sapiens
gcatctctatgaagagaaggagg

SEQ ID NO: 2724838 - DNA, 21 bp, Homo sapiens
gcatctctgagtgtctctgcc

SEQ ID NO: 2724839 - DNA, 14 bp, Homo sapiens
gcatgacactctag

SEQ ID NO: 2724840 - DNA, 22 bp, Homo sapiens
gcatgagtggccttaataaata

SEQ ID NO: 2724841 - DNA, 18 bp, Homo sapiens
gcatgatgggccgagcca

SEQ ID NO: 2724842 - DNA, 15 bp, Homo sapiens
gcatgccccctcgtg

SEQ ID NO: 2724843 - DNA, 18 bp, Homo sapiens
gcatgcctcagccagccc

SEQ ID NO: 2724844 - DNA, 15 bp, Homo sapiens
gcatggagtgtttga

SEQ ID NO: 2724845 - DNA, 11 bp, Homo sapiens
gcatggcagct

SEQ ID NO: 2724846 - DNA, 13 bp, Homo sapiens
gcatggcagctgg

SEQ ID NO: 2724847 - DNA, 14 bp, Homo sapiens
gcatggcagctggg

SEQ ID NO: 2724848 - DNA, 21 bp, Homo sapiens
gcatgtaaaatcttcagctgg

SEQ ID NO: 2724849 - DNA, 16 bp, Homo sapiens
gcatgtgggttgtgat

SEQ ID NO: 2724850 - DNA, 19 bp, Homo sapiens
gcattaatattcttttgtt

SEQ ID NO: 2724851 - DNA, 21 bp, Homo sapiens
gcattcacagcgcctcctgga

SEQ ID NO: 2724852 - DNA, 15 bp, Homo sapiens
gcattcatgttttaa

SEQ ID NO: 2724853 - DNA, 14 bp, Homo sapiens
gcattctagtgcag

SEQ ID NO: 2724854 - DNA, 20 bp, Homo sapiens
gcattggcagcaggtgctgc

SEQ ID NO: 2724855 - DNA, 15 bp, Homo sapiens
gcatttggtgagagt

SEQ ID NO: 2724856 - DNA, 22 bp, Homo sapiens
gcatttggtgagagtcaaagct

SEQ ID NO: 2724857 - DNA, 17 bp, Homo sapiens
gccaaactctgccagcc

SEQ ID NO: 2724858 - DNA, 21 bp, Homo sapiens
gccaacagtgttaggcctggc

SEQ ID NO: 2724859 - DNA, 22 bp, Homo sapiens
gccaacagtgttaggcctggca

SEQ ID NO: 2724860 - DNA, 23 bp, Homo sapiens
gccaacagtgttaggcctggcac

SEQ ID NO: 2724861 - DNA, 12 bp, Homo sapiens
gccaagaaatcg

SEQ ID NO: 2724862 - DNA, 23 bp, Homo sapiens
gccaagaaatcgccttatgagaa

SEQ ID NO: 2724863 - DNA, 13 bp, Homo sapiens
gccaagaataaaa

SEQ ID NO: 2724864 - DNA, 12 bp, Homo sapiens
gccaagccctcc

SEQ ID NO: 2724865 - DNA, 18 bp, Homo sapiens
gccaaggtgggctgagcc

SEQ ID NO: 2724866 - DNA, 19 bp, Homo sapiens
gccaaggtgggctgagccc

SEQ ID NO: 2724867 - DNA, 21 bp, Homo sapiens
gccaagttcctctagtgccct

SEQ ID NO: 2724868 - DNA, 15 bp, Homo sapiens
gccacaaatgtgtcc

SEQ ID NO: 2724869 - DNA, 16 bp, Homo sapiens
gccacaccaagctgtg

SEQ ID NO: 2724870 - DNA, 19 bp, Homo sapiens
gccacaccatctcctttca

SEQ ID NO: 2724871 - DNA, 11 bp, Homo sapiens
gccacactggg

SEQ ID NO: 2724872 - DNA, 16 bp, Homo sapiens
gccacactttgaaggt

SEQ ID NO: 2724873 - DNA, 20 bp, Homo sapiens
gccacatagctcataagctg

SEQ ID NO: 2724874 - DNA, 23 bp, Homo sapiens
gccacatcatctttatctcctgg

SEQ ID NO: 2724875 - DNA, 15 bp, Homo sapiens
gccaccacccaacct

SEQ ID NO: 2724876 - DNA, 16 bp, Homo sapiens
gccaccacccaacctg

SEQ ID NO: 2724877 - DNA, 12 bp, Homo sapiens
gccaccctgggc

SEQ ID NO: 2724878 - DNA, 17 bp, Homo sapiens
gccaccctgggctctgt

SEQ ID NO: 2724879 - DNA, 17 bp, Homo sapiens
gccaccgcagctgctgc

SEQ ID NO: 2724880 - DNA, 20 bp, Homo sapiens
gccaccgcagctgctgccac

SEQ ID NO: 2724881 - DNA, 18 bp, Homo sapiens
gccacctgtcttctctcc

SEQ ID NO: 2724882 - DNA, 16 bp, Homo sapiens
gccacgtctgtgctct

SEQ ID NO: 2724883 - DNA, 18 bp, Homo sapiens
gccactacactccagcct

SEQ ID NO: 2724884 - DNA, 20 bp, Homo sapiens
ctgtcaccctggccaccacc

SEQ ID NO: 2724885 - DNA, 14 bp, Homo sapiens
ctgtcagtgccgcc

SEQ ID NO: 2724886 - DNA, 16 bp, Homo sapiens
ctgtccaacccctccc

SEQ ID NO: 2724887 - DNA, 17 bp, Homo sapiens
ctgtccaacccctcccc

SEQ ID NO: 2724888 - DNA, 14 bp, Homo sapiens
ctgtccagtgccca

SEQ ID NO: 2724889 - DNA, 15 bp, Homo sapiens
ctgtccagtgcccat

SEQ ID NO: 2724890 - DNA, 14 bp, Homo sapiens
ctgtccataaagta

SEQ ID NO: 2724891 - DNA, 21 bp, Homo sapiens
ctgtccatcctcctctccatg

SEQ ID NO: 2724892 - DNA, 13 bp, Homo sapiens
ctgtcccctcaca

SEQ ID NO: 2724893 - DNA, 14 bp, Homo sapiens
ctgtcccctcacag

SEQ ID NO: 2724894 - DNA, 17 bp, Homo sapiens
ctgtcccctcacagact

SEQ ID NO: 2724895 - DNA, 12 bp, Homo sapiens
ctgtcccctctt

SEQ ID NO: 2724896 - DNA, 19 bp, Homo sapiens
ctgtcccctggggctggtg

SEQ ID NO: 2724897 - DNA, 18 bp, Homo sapiens
ctgtcccggttcaccttg

SEQ ID NO: 2724898 - DNA, 14 bp, Homo sapiens
ctgtccctacccac

SEQ ID NO: 2724899 - DNA, 18 bp, Homo sapiens
ctgtccctacccactctt

SEQ ID NO: 2724900 - DNA, 23 bp, Homo sapiens
ctgtccctctcgccctggccagg

SEQ ID NO: 2724901 - DNA, 13 bp, Homo sapiens
ctgtccggagcga

SEQ ID NO: 2724902 - DNA, 22 bp, Homo sapiens
ctgtccggagcgaccctggctc

SEQ ID NO: 2724903 - DNA, 15 bp, Homo sapiens
ctgtcctcgcagaga

SEQ ID NO: 2724904 - DNA, 19 bp, Homo sapiens
ctgtcctgctccacagtgt

SEQ ID NO: 2724905 - DNA, 14 bp, Homo sapiens
ctgtcctggtacag

SEQ ID NO: 2724906 - DNA, 17 bp, Homo sapiens
ctgtccttactcagagc

SEQ ID NO: 2724907 - DNA, 19 bp, Homo sapiens
ctgtccttactcagagctg

SEQ ID NO: 2724908 - DNA, 21 bp, Homo sapiens
ctgtccttactcagagctgcg

SEQ ID NO: 2724909 - DNA, 13 bp, Homo sapiens
ctgtctcagactc

SEQ ID NO: 2724910 - DNA, 12 bp, Homo sapiens
ctgtctctgctt

SEQ ID NO: 2724911 - DNA, 13 bp, Homo sapiens
ctgtctgctctta

SEQ ID NO: 2724912 - DNA, 18 bp, Homo sapiens
ctgtctgtatataactta

SEQ ID NO: 2724913 - DNA, 18 bp, Homo sapiens
ctgtctgtccaacccctc

SEQ ID NO: 2724914 - DNA, 19 bp, Homo sapiens
ctgtctgtccaacccctcc

SEQ ID NO: 2724915 - DNA, 21 bp, Homo sapiens
ctgtgaaagtctcctgtatca

SEQ ID NO: 2724916 - DNA, 17 bp, Homo sapiens
ctgtgacacagctgagc

SEQ ID NO: 2724917 - DNA, 14 bp, Homo sapiens
ctgtgcaaacagtg

SEQ ID NO: 2724918 - DNA, 15 bp, Homo sapiens
ctgtgcagacagtgt

SEQ ID NO: 2724919 - DNA, 15 bp, Homo sapiens
ctgtgccaccctggg

SEQ ID NO: 2724920 - DNA, 16 bp, Homo sapiens
ctgtgccaccctgggc

SEQ ID NO: 2724921 - DNA, 17 bp, Homo sapiens
ctgtgccaccctgggct

SEQ ID NO: 2724922 - DNA, 18 bp, Homo sapiens
ctgtgccaccctgggctc

SEQ ID NO: 2724923 - DNA, 17 bp, Homo sapiens
ctgtgcccttattcagg

SEQ ID NO: 2724924 - DNA, 17 bp, Homo sapiens
ctgtgcctgtctgtcca

SEQ ID NO: 2724925 - DNA, 11 bp, Homo sapiens
ctgtgcctttg

SEQ ID NO: 2724926 - DNA, 12 bp, Homo sapiens
ctgtgctcccac

SEQ ID NO: 2724927 - DNA, 13 bp, Homo sapiens
ctgtgctcccacg

SEQ ID NO: 2724928 - DNA, 22 bp, Homo sapiens
ctgtgctcccacggggaccact

SEQ ID NO: 2724929 - DNA, 20 bp, Homo sapiens
ctgtgctctgtccttgtgta

SEQ ID NO: 2724930 - DNA, 14 bp, Homo sapiens
ctgtgggctgcact

SEQ ID NO: 2724931 - DNA, 21 bp, Homo sapiens
ctgtgggctgcactctgtgcc

SEQ ID NO: 2724932 - DNA, 20 bp, Homo sapiens
ctgtgggggaagagcacagc

SEQ ID NO: 2724933 - DNA, 23 bp, Homo sapiens
ctgtgggggaagagcacagccct

SEQ ID NO: 2724934 - DNA, 19 bp, Homo sapiens
ctgtggtcacttatcctga

SEQ ID NO: 2724935 - DNA, 13 bp, Homo sapiens
ctgtggtcccacc

SEQ ID NO: 2724936 - DNA, 14 bp, Homo sapiens
ctgtggtcccaccc

SEQ ID NO: 2724937 - DNA, 20 bp, Homo sapiens
ctgtggtgggaacattcgag

SEQ ID NO: 2724938 - DNA, 15 bp, Homo sapiens
ctgtgtcactggctg

SEQ ID NO: 2724939 - DNA, 13 bp, Homo sapiens
ctgtgtgcaccca

SEQ ID NO: 2724940 - DNA, 13 bp, Homo sapiens
ctcagtctcagga

SEQ ID NO: 2724941 - DNA, 15 bp, Homo sapiens
ctcagtctcaggagc

SEQ ID NO: 2724942 - DNA, 18 bp, Homo sapiens
ctcagtgtcagcactcag

SEQ ID NO: 2724943 - DNA, 20 bp, Homo sapiens
ctcagtgtcagcactcaggt

SEQ ID NO: 2724944 - DNA, 15 bp, Homo sapiens
ctcatcagaactgaa

SEQ ID NO: 2724945 - DNA, 13 bp, Homo sapiens
ctcatcctcctcc

SEQ ID NO: 2724946 - DNA, 15 bp, Homo sapiens
ctcatcctcctcctc

SEQ ID NO: 2724947 - DNA, 16 bp, Homo sapiens
ctcatcctcctcctca

SEQ ID NO: 2724948 - DNA, 16 bp, Homo sapiens
ctcatgccccaggcct

SEQ ID NO: 2724949 - DNA, 15 bp, Homo sapiens
ctcatgtcatttctc

SEQ ID NO: 2724950 - DNA, 17 bp, Homo sapiens
ctcatgtcatttctcat

SEQ ID NO: 2724951 - DNA, 14 bp, Homo sapiens
ctcattccccgggg

SEQ ID NO: 2724952 - DNA, 20 bp, Homo sapiens
ctccaaacactgggctctga

SEQ ID NO: 2724953 - DNA, 23 bp, Homo sapiens
ctccaagtccacagtggaaccag

SEQ ID NO: 2724954 - DNA, 21 bp, Homo sapiens
ctccaccctaaagtctcaggt

SEQ ID NO: 2724955 - DNA, 16 bp, Homo sapiens
ctccaccgccatggct

SEQ ID NO: 2724956 - DNA, 20 bp, Homo sapiens
ctccaccgccatggcttcca

SEQ ID NO: 2724957 - DNA, 23 bp, Homo sapiens
ctccacctagtggctgtccagtg

SEQ ID NO: 2724958 - DNA, 15 bp, Homo sapiens
ctccactccacctcc

SEQ ID NO: 2724959 - DNA, 19 bp, Homo sapiens
ctccagaatgtgctgcctt

SEQ ID NO: 2724960 - DNA, 22 bp, Homo sapiens
ctccagaattacccttcctcat

SEQ ID NO: 2724961 - DNA, 17 bp, Homo sapiens
ctccagactgcggagca

SEQ ID NO: 2724962 - DNA, 22 bp, Homo sapiens
ctccagactgcggagcagcctc

SEQ ID NO: 2724963 - DNA, 15 bp, Homo sapiens
ctccagcctcacaga

SEQ ID NO: 2724964 - DNA, 13 bp, Homo sapiens
ctccagcctgagc

SEQ ID NO: 2724965 - DNA, 14 bp, Homo sapiens
ctccagcctgagca

SEQ ID NO: 2724966 - DNA, 12 bp, Homo sapiens
ctccagcctggg

SEQ ID NO: 2724967 - DNA, 14 bp, Homo sapiens
ctccagtcctgctg

SEQ ID NO: 2724968 - DNA, 17 bp, Homo sapiens
ctccagtcctgctggcc

SEQ ID NO: 2724969 - DNA, 20 bp, Homo sapiens
ctccagtcctgctggcctgc

SEQ ID NO: 2724970 - DNA, 15 bp, Homo sapiens
ctccagtgctggctg

SEQ ID NO: 2724971 - DNA, 17 bp, Homo sapiens
ctccagtgctggctgct

SEQ ID NO: 2724972 - DNA, 19 bp, Homo sapiens
ctccagtgctggctgctgg

SEQ ID NO: 2724973 - DNA, 20 bp, Homo sapiens
ctccagtgggaggacagagc

SEQ ID NO: 2724974 - DNA, 15 bp, Homo sapiens
ctccatgctggtgtg

SEQ ID NO: 2724975 - DNA, 15 bp, Homo sapiens
ctccattattttatt

SEQ ID NO: 2724976 - DNA, 18 bp, Homo sapiens
ctcccaaagtgctgggat

SEQ ID NO: 2724977 - DNA, 22 bp, Homo sapiens
ctcccaattcacctcgttactc

SEQ ID NO: 2724978 - DNA, 20 bp, Homo sapiens
ctcccaccaggcagctccag

SEQ ID NO: 2724979 - DNA, 18 bp, Homo sapiens
ctcccacggggaccactg

SEQ ID NO: 2724980 - DNA, 17 bp, Homo sapiens
ctcccagctttctgtgt

SEQ ID NO: 2724981 - DNA, 22 bp, Homo sapiens
ctcccagtgagaagggcctgct

SEQ ID NO: 2724982 - DNA, 13 bp, Homo sapiens
ctccccaatccat

SEQ ID NO: 2724983 - DNA, 14 bp, Homo sapiens
ctccccacagtcct

SEQ ID NO: 2724984 - DNA, 12 bp, Homo sapiens
ctccccaccaga

SEQ ID NO: 2724985 - DNA, 22 bp, Homo sapiens
ctccccaccagagctgcctccc

SEQ ID NO: 2724986 - DNA, 12 bp, Homo sapiens
ctccccagccct

SEQ ID NO: 2724987 - DNA, 13 bp, Homo sapiens
ctcccccacgtct

SEQ ID NO: 2724988 - DNA, 17 bp, Homo sapiens
ctcccccacgtctctct

SEQ ID NO: 2724989 - DNA, 23 bp, Homo sapiens
ctcccccacgtctctctgcctgc

SEQ ID NO: 2724990 - DNA, 12 bp, Homo sapiens
ctcccccagagc

SEQ ID NO: 2724991 - DNA, 17 bp, Homo sapiens
ctcccccgggaggggcc

SEQ ID NO: 2724992 - DNA, 18 bp, Homo sapiens
ctcccccgggaggggccc

SEQ ID NO: 2724993 - DNA, 22 bp, Homo sapiens
ctcccccgggaggggcccgctt

SEQ ID NO: 2724994 - DNA, 12 bp, Homo sapiens
ctccccttgccc

SEQ ID NO: 2724995 - DNA, 21 bp, Homo sapiens
ctccccttgcccttcctgacc

SEQ ID NO: 2724996 - DNA, 13 bp, Homo sapiens
ctcccggacctgg

SEQ ID NO: 2724997 - DNA, 20 bp, Homo sapiens
ctcccgggaagcatcctccc

SEQ ID NO: 2724998 - DNA, 13 bp, Homo sapiens
ctccctagatcca

SEQ ID NO: 2724999 - DNA, 20 bp, Homo sapiens
ctccctagatccaggcttct

SEQ ID NO: 2725000 - DNA, 12 bp, Homo sapiens
ctccctcctcac

SEQ ID NO: 2725001 - DNA, 14 bp, Homo sapiens
ctccctcctcacac

SEQ ID NO: 2725002 - DNA, 12 bp, Homo sapiens
ctccctcctgga

SEQ ID NO: 2725003 - DNA, 17 bp, Homo sapiens
ctccctctgacctgcag

SEQ ID NO: 2725004 - DNA, 15 bp, Homo sapiens
ctccctctgcctcat

SEQ ID NO: 2725005 - DNA, 23 bp, Homo sapiens
ctccctctgcctcatcctcctcc

SEQ ID NO: 2725006 - DNA, 18 bp, Homo sapiens
ctccctgaccttctccag

SEQ ID NO: 2725007 - DNA, 19 bp, Homo sapiens
ctccctgaccttctccagg

SEQ ID NO: 2725008 - DNA, 15 bp, Homo sapiens
ctccctggccctcaa

SEQ ID NO: 2725009 - DNA, 19 bp, Homo sapiens
ctccctgttatctgctaga

SEQ ID NO: 2725010 - DNA, 23 bp, Homo sapiens
ctccgctggatggggagtctcat

SEQ ID NO: 2725011 - DNA, 13 bp, Homo sapiens
ctccggtgtgcct

SEQ ID NO: 2725012 - DNA, 18 bp, Homo sapiens
ctccggtgtgcctgcagc

SEQ ID NO: 2725013 - DNA, 15 bp, Homo sapiens
ctccgtgagcccttg

SEQ ID NO: 2725014 - DNA, 18 bp, Homo sapiens
ctccgtttccaaatacat

SEQ ID NO: 2725015 - DNA, 19 bp, Homo sapiens
ctcctacccctcccagctg

SEQ ID NO: 2725016 - DNA, 12 bp, Homo sapiens
ctcctacctcag

SEQ ID NO: 2725017 - DNA, 14 bp, Homo sapiens
ctcctacctcagcc

SEQ ID NO: 2725018 - DNA, 22 bp, Homo sapiens
ctcctattctcttaatttttct

SEQ ID NO: 2725019 - DNA, 15 bp, Homo sapiens
ctcctccaccgccat

SEQ ID NO: 2725020 - DNA, 16 bp, Homo sapiens
ctcctccaccgccatg

SEQ ID NO: 2725021 - DNA, 17 bp, Homo sapiens
ctcctccactccacctc

SEQ ID NO: 2725022 - DNA, 14 bp, Homo sapiens
ctcctcccctgccg

SEQ ID NO: 2725023 - DNA, 15 bp, Homo sapiens
ctcctcccctgccgc

SEQ ID NO: 2725024 - DNA, 11 bp, Homo sapiens
ctcctccctct

SEQ ID NO: 2725025 - DNA, 16 bp, Homo sapiens
ctcctccctctgcctc

SEQ ID NO: 2725026 - DNA, 15 bp, Homo sapiens
ctcctcctgccagct

SEQ ID NO: 2725027 - DNA, 21 bp, Homo sapiens
ctcctcctgccagctctgtca

SEQ ID NO: 2725028 - DNA, 15 bp, Homo sapiens
ctcctctccctgcac

SEQ ID NO: 2725029 - DNA, 15 bp, Homo sapiens
ctcctgacctcgtga

SEQ ID NO: 2725030 - DNA, 11 bp, Homo sapiens
ctcctgagcct

SEQ ID NO: 2725031 - DNA, 16 bp, Homo sapiens
ctcctgagtagctggg

SEQ ID NO: 2725032 - DNA, 23 bp, Homo sapiens
ctcctgcagcctgaccccaggca

SEQ ID NO: 2725033 - DNA, 12 bp, Homo sapiens
ctcctgccagct

SEQ ID NO: 2725034 - DNA, 15 bp, Homo sapiens
ctcctgccagctctg

SEQ ID NO: 2725035 - DNA, 21 bp, Homo sapiens
ctcctgcctcagcctcctgag

SEQ ID NO: 2725036 - DNA, 18 bp, Homo sapiens
ctcctggaaaggctcagt

SEQ ID NO: 2725037 - DNA, 19 bp, Homo sapiens
ctcctggaaaggctcagtc

SEQ ID NO: 2725038 - DNA, 22 bp, Homo sapiens
ctcctggaaaggctcagtctca

SEQ ID NO: 2725039 - DNA, 23 bp, Homo sapiens
ctcctggaaaggctcagtctcag

SEQ ID NO: 2725040 - DNA, 21 bp, Homo sapiens
ctcctggaaccggtcacagga

SEQ ID NO: 2725041 - DNA, 17 bp, Homo sapiens
ctcctggagcatcccag

SEQ ID NO: 2725042 - DNA, 24 bp, Homo sapiens
ctcctggcacaacgctctaccctg

SEQ ID NO: 2725043 - DNA, 14 bp, Homo sapiens
ctcctgtccctacc

SEQ ID NO: 2725044 - DNA, 15 bp, Homo sapiens
ctcctgtccctaccc

SEQ ID NO: 2725045 - DNA, 12 bp, Homo sapiens
ctcctgtgccct

SEQ ID NO: 2725046 - DNA, 17 bp, Homo sapiens
ctccttagaagtggaag

SEQ ID NO: 2725047 - DNA, 20 bp, Homo sapiens
ctccttagaagtggaagtag

SEQ ID NO: 2725048 - DNA, 14 bp, Homo sapiens
ctcgaactcctgac

SEQ ID NO: 2725049 - DNA, 19 bp, Homo sapiens
ctcgaggtggagggtagcc

SEQ ID NO: 2725050 - DNA, 23 bp, Homo sapiens
ctcgcccaccgcatgccccctcg

SEQ ID NO: 2725051 - DNA, 12 bp, Homo sapiens
ctcgccccaccc

SEQ ID NO: 2725052 - DNA, 13 bp, Homo sapiens
ctcgcctctgccc

SEQ ID NO: 2725053 - DNA, 17 bp, Homo sapiens
ctcgctgatgctgggct

SEQ ID NO: 2725054 - DNA, 20 bp, Homo sapiens
ctcgctgatgctgggctggg

SEQ ID NO: 2725055 - DNA, 14 bp, Homo sapiens
ctcggaggctcctc

SEQ ID NO: 2725056 - DNA, 20 bp, Homo sapiens
cccccaggattcccagagag

SEQ ID NO: 2725057 - DNA, 15 bp, Homo sapiens
cccccgggaggggcc

SEQ ID NO: 2725058 - DNA, 20 bp, Homo sapiens
cccccgggaggggcccgctt

SEQ ID NO: 2725059 - DNA, 15 bp, Homo sapiens
cccccggggctgggt

SEQ ID NO: 2725060 - DNA, 22 bp, Homo sapiens
ccccctaccgcatggcagctgg

SEQ ID NO: 2725061 - DNA, 13 bp, Homo sapiens
ccccctcctgctg

SEQ ID NO: 2725062 - DNA, 10 bp, Homo sapiens
ccccctgggc

SEQ ID NO: 2725063 - DNA, 23 bp, Homo sapiens
ccccctggtggacagtcctggga

SEQ ID NO: 2725064 - DNA, 18 bp, Homo sapiens
cccccttgaatctgcagg

SEQ ID NO: 2725065 - DNA, 23 bp, Homo sapiens
cccccttgaatctgcagggagca

SEQ ID NO: 2725066 - DNA, 18 bp, Homo sapiens
ccccgagggatgatgcca

SEQ ID NO: 2725067 - DNA, 17 bp, Homo sapiens
ccccgcccagctgcacc

SEQ ID NO: 2725068 - DNA, 16 bp, Homo sapiens
ccccgggaggggcccg

SEQ ID NO: 2725069 - DNA, 15 bp, Homo sapiens
ccccgggctgaccca

SEQ ID NO: 2725070 - DNA, 21 bp, Homo sapiens
ccccggggcgtttctttgccg

SEQ ID NO: 2725071 - DNA, 15 bp, Homo sapiens
cccctaccgcatggc

SEQ ID NO: 2725072 - DNA, 19 bp, Homo sapiens
cccctaccgcatggcagct

SEQ ID NO: 2725073 - DNA, 14 bp, Homo sapiens
cccctcacagactc

SEQ ID NO: 2725074 - DNA, 15 bp, Homo sapiens
cccctcacagactct

SEQ ID NO: 2725075 - DNA, 19 bp, Homo sapiens
cccctcacagactcttcca

SEQ ID NO: 2725076 - DNA, 21 bp, Homo sapiens
cccctcaggggaagctgctag

SEQ ID NO: 2725077 - DNA, 23 bp, Homo sapiens
cccctcaggggaagctgctaggg

SEQ ID NO: 2725078 - DNA, 14 bp, Homo sapiens
cccctcccagggcc

SEQ ID NO: 2725079 - DNA, 22 bp, Homo sapiens
cccctcccccacgtctctctgc

SEQ ID NO: 2725080 - DNA, 16 bp, Homo sapiens
cccctccccctaccgc

SEQ ID NO: 2725081 - DNA, 12 bp, Homo sapiens
cccctcctgctg

SEQ ID NO: 2725082 - DNA, 13 bp, Homo sapiens
cccctcctgctgc

SEQ ID NO: 2725083 - DNA, 13 bp, Homo sapiens
cccctctgtccag

SEQ ID NO: 2725084 - DNA, 12 bp, Homo sapiens
cccctcttgccc

SEQ ID NO: 2725085 - DNA, 15 bp, Homo sapiens
cccctcttgccccaa

SEQ ID NO: 2725086 - DNA, 22 bp, Homo sapiens
cccctgcccgaccccatctcat

SEQ ID NO: 2725087 - DNA, 16 bp, Homo sapiens
cccctggaacctttcc

SEQ ID NO: 2725088 - DNA, 15 bp, Homo sapiens
cccctggagaaggtc

SEQ ID NO: 2725089 - DNA, 21 bp, Homo sapiens
cccctggctgaacagtgctct

SEQ ID NO: 2725090 - DNA, 22 bp, Homo sapiens
cccctggctgaacagtgctctg

SEQ ID NO: 2725091 - DNA, 17 bp, Homo sapiens
cccctggggctggtgga

SEQ ID NO: 2725092 - DNA, 20 bp, Homo sapiens
cccctggtggacagtcctgg

SEQ ID NO: 2725093 - DNA, 21 bp, Homo sapiens
cccctggtggacagtcctggg

SEQ ID NO: 2725094 - DNA, 17 bp, Homo sapiens
cccctgtcccctggggc

SEQ ID NO: 2725095 - DNA, 18 bp, Homo sapiens
ccccttgaatctgcaggg

SEQ ID NO: 2725096 - DNA, 11 bp, Homo sapiens
ccccttgccct

SEQ ID NO: 2725097 - DNA, 17 bp, Homo sapiens
ccccttgcccttcctga

SEQ ID NO: 2725098 - DNA, 20 bp, Homo sapiens
ccccttgcccttcctgaccc

SEQ ID NO: 2725099 - DNA, 17 bp, Homo sapiens
ccccttttcagcttctg

SEQ ID NO: 2725100 - DNA, 23 bp, Homo sapiens
cccgagctactctcttgccagca

SEQ ID NO: 2725101 - DNA, 22 bp, Homo sapiens
cccgagggatgatgccacacca

SEQ ID NO: 2725102 - DNA, 14 bp, Homo sapiens
cccgcccaggctgg

SEQ ID NO: 2725103 - DNA, 14 bp, Homo sapiens
cccgctcccagtgt

SEQ ID NO: 2725104 - DNA, 22 bp, Homo sapiens
cccgcttattctcctccctgtt

SEQ ID NO: 2725105 - DNA, 22 bp, Homo sapiens
cccgcttgcctcggctcctgct

SEQ ID NO: 2725106 - DNA, 14 bp, Homo sapiens
cccggattctggga

SEQ ID NO: 2725107 - DNA, 19 bp, Homo sapiens
cccggattggccctgcccc

SEQ ID NO: 2725108 - DNA, 22 bp, Homo sapiens
cccggattggccctgcccctcc

SEQ ID NO: 2725109 - DNA, 15 bp, Homo sapiens
cccggcgccctctgt

SEQ ID NO: 2725110 - DNA, 18 bp, Homo sapiens
cccggcgccctctgtcct

SEQ ID NO: 2725111 - DNA, 19 bp, Homo sapiens
cccggcgccctctgtcctg

SEQ ID NO: 2725112 - DNA, 13 bp, Homo sapiens
cccggcttgcctg

SEQ ID NO: 2725113 - DNA, 23 bp, Homo sapiens
cccggcttgcctgtaatcccagc

SEQ ID NO: 2725114 - DNA, 15 bp, Homo sapiens
cccgggaggggcccg

SEQ ID NO: 2725115 - DNA, 18 bp, Homo sapiens
cccgggaggggcccgctt

SEQ ID NO: 2725116 - DNA, 19 bp, Homo sapiens
cccgggctgacccagtgtg

SEQ ID NO: 2725117 - DNA, 14 bp, Homo sapiens
cctccagtgctggc

SEQ ID NO: 2725118 - DNA, 17 bp, Homo sapiens
cctccagtgctggctgc

SEQ ID NO: 2725119 - DNA, 17 bp, Homo sapiens
cctccagtgggaggaca

SEQ ID NO: 2725120 - DNA, 20 bp, Homo sapiens
cctccagtgggaggacagag

SEQ ID NO: 2725121 - DNA, 19 bp, Homo sapiens
cctccagttctgatgaggc

SEQ ID NO: 2725122 - DNA, 17 bp, Homo sapiens
cctcccaaagtgctggg

SEQ ID NO: 2725123 - DNA, 20 bp, Homo sapiens
cctcccaccagtggccccca

SEQ ID NO: 2725124 - DNA, 16 bp, Homo sapiens
cctcccagctgacagt

SEQ ID NO: 2725125 - DNA, 14 bp, Homo sapiens
cctcccagggccag

SEQ ID NO: 2725126 - DNA, 18 bp, Homo sapiens
cctcccagtgagaagggc

SEQ ID NO: 2725127 - DNA, 18 bp, Homo sapiens
cctcccatggccttccct

SEQ ID NO: 2725128 - DNA, 14 bp, Homo sapiens
cctccccaatccat

SEQ ID NO: 2725129 - DNA, 23 bp, Homo sapiens
cctccccacagtcctcacagcct

SEQ ID NO: 2725130 - DNA, 15 bp, Homo sapiens
cctccccaccagagc

SEQ ID NO: 2725131 - DNA, 18 bp, Homo sapiens
cctccccaccagagctgc

SEQ ID NO: 2725132 - DNA, 22 bp, Homo sapiens
cctccccaccagagctgcctcc

SEQ ID NO: 2725133 - DNA, 20 bp, Homo sapiens
cctccccattagagtcagcc

SEQ ID NO: 2725134 - DNA, 15 bp, Homo sapiens
cctcccccagagggg

SEQ ID NO: 2725135 - DNA, 16 bp, Homo sapiens
cctcccctgccgcctc

SEQ ID NO: 2725136 - DNA, 17 bp, Homo sapiens
cctccctagatccaggc

SEQ ID NO: 2725137 - DNA, 14 bp, Homo sapiens
cctccctctgcctc

SEQ ID NO: 2725138 - DNA, 16 bp, Homo sapiens
cctccctctgcctcat

SEQ ID NO: 2725139 - DNA, 17 bp, Homo sapiens
cctccctctgcctcatc

SEQ ID NO: 2725140 - DNA, 20 bp, Homo sapiens
cctccctctgcctcatcctc

SEQ ID NO: 2725141 - DNA, 22 bp, Homo sapiens
cctccctctgcctcatcctcct

SEQ ID NO: 2725142 - DNA, 20 bp, Homo sapiens
cctccctgctgtcccctctt

SEQ ID NO: 2725143 - DNA, 22 bp, Homo sapiens
cctcccttgagtaggccctgct

SEQ ID NO: 2725144 - DNA, 23 bp, Homo sapiens
cctcccttgagtaggccctgctt

SEQ ID NO: 2725145 - DNA, 15 bp, Homo sapiens
cctcctcacactcca

SEQ ID NO: 2725146 - DNA, 15 bp, Homo sapiens
cctcctcattcagac

SEQ ID NO: 2725147 - DNA, 18 bp, Homo sapiens
cctcctcattcagaccaa

SEQ ID NO: 2725148 - DNA, 15 bp, Homo sapiens
cctcctccactccac

SEQ ID NO: 2725149 - DNA, 14 bp, Homo sapiens
cctcctgagcctca

SEQ ID NO: 2725150 - DNA, 17 bp, Homo sapiens
cctcctgagcctcacct

SEQ ID NO: 2725151 - DNA, 16 bp, Homo sapiens
cctcctgagtagctgg

SEQ ID NO: 2725152 - DNA, 15 bp, Homo sapiens
cctcctgccagctct

SEQ ID NO: 2725153 - DNA, 17 bp, Homo sapiens
cctcctgctgcagaggg

SEQ ID NO: 2725154 - DNA, 20 bp, Homo sapiens
cctcctgctgcagaggggca

SEQ ID NO: 2725155 - DNA, 20 bp, Homo sapiens
cctccttttggttcctcaca

SEQ ID NO: 2725156 - DNA, 21 bp, Homo sapiens
cctcgcactgcccagggaagc

SEQ ID NO: 2725157 - DNA, 19 bp, Homo sapiens
cctcgcccaccgcatgccc

SEQ ID NO: 2725158 - DNA, 13 bp, Homo sapiens
cctcgcctggcct

SEQ ID NO: 2725159 - DNA, 14 bp, Homo sapiens
cctcgcctggcctg

SEQ ID NO: 2725160 - DNA, 15 bp, Homo sapiens
cctcgcctggcctga

SEQ ID NO: 2725161 - DNA, 16 bp, Homo sapiens
cctcgcctggcctgag

SEQ ID NO: 2725162 - DNA, 18 bp, Homo sapiens
cctcgcctggcctgaggt

SEQ ID NO: 2725163 - DNA, 13 bp, Homo sapiens
cctcggaggctcc

SEQ ID NO: 2725164 - DNA, 17 bp, Homo sapiens
cctcggaggctcctccc

SEQ ID NO: 2725165 - DNA, 20 bp, Homo sapiens
cctcggaggctcctccctct

SEQ ID NO: 2725166 - DNA, 23 bp, Homo sapiens
cctcggaggctcctccctctgcc

SEQ ID NO: 2725167 - DNA, 21 bp, Homo sapiens
cctcggcccatctgtccatcc

SEQ ID NO: 2725168 - DNA, 12 bp, Homo sapiens
cctcggctcctg

SEQ ID NO: 2725169 - DNA, 13 bp, Homo sapiens
cctcggctcctgc

SEQ ID NO: 2725170 - DNA, 19 bp, Homo sapiens
cctcggctcctgctgcacc

SEQ ID NO: 2725171 - DNA, 20 bp, Homo sapiens
cctcgggatgaaaagccata

SEQ ID NO: 2725172 - DNA, 24 bp, Homo sapiens
cctcgggatgaaaagccatatcta

SEQ ID NO: 2725173 - DNA, 21 bp, Homo sapiens
cctcgtccaaggcagttctgt

SEQ ID NO: 2725174 - DNA, 16 bp, Homo sapiens
cctcgtgatttgcctg

SEQ ID NO: 2725175 - DNA, 20 bp, Homo sapiens
cctcgtgatttgcctgcctg

SEQ ID NO: 2725176 - DNA, 18 bp, Homo sapiens
cctcgttactctcacctc

SEQ ID NO: 2725177 - DNA, 22 bp, Homo sapiens
cctcgttactctcacctcgtga

SEQ ID NO: 2725178 - DNA, 15 bp, Homo sapiens
cctctaactccctcc

SEQ ID NO: 2725179 - DNA, 18 bp, Homo sapiens
cctctaactccctcctca

SEQ ID NO: 2725180 - DNA, 12 bp, Homo sapiens
cctctagaacac

SEQ ID NO: 2725181 - DNA, 21 bp, Homo sapiens
cctctagaacacccactggcc

SEQ ID NO: 2725182 - DNA, 23 bp, Homo sapiens
cctctagaacacccactggccag

SEQ ID NO: 2725183 - DNA, 17 bp, Homo sapiens
cctctatttacctgcga

SEQ ID NO: 2725184 - DNA, 21 bp, Homo sapiens
cctctcagagcctcagcttct

SEQ ID NO: 2725185 - DNA, 22 bp, Homo sapiens
cctctcagagcctcagcttctg

SEQ ID NO: 2725186 - DNA, 17 bp, Homo sapiens
cctctccacctagtggc

SEQ ID NO: 2725187 - DNA, 12 bp, Homo sapiens
cctctccatgca

SEQ ID NO: 2725188 - DNA, 19 bp, Homo sapiens
cctctcgccctggccaggg

SEQ ID NO: 2725189 - DNA, 13 bp, Homo sapiens
cctctgagccgca

SEQ ID NO: 2725190 - DNA, 20 bp, Homo sapiens
cctctgagccgcagggcctg

SEQ ID NO: 2725191 - DNA, 15 bp, Homo sapiens
cctctgcccgcagag

SEQ ID NO: 2725192 - DNA, 16 bp, Homo sapiens
cctctgcccgcagagc

SEQ ID NO: 2725193 - DNA, 18 bp, Homo sapiens
cctctgcccgcagagccc

SEQ ID NO: 2725194 - DNA, 11 bp, Homo sapiens
cctctgcctca

SEQ ID NO: 2725195 - DNA, 21 bp, Homo sapiens
acatttttgtacattatgtta

SEQ ID NO: 2725196 - DNA, 20 bp, Homo sapiens
accaaaaattgcgagccttt

SEQ ID NO: 2725197 - DNA, 17 bp, Homo sapiens
accaaagacatcagtct

SEQ ID NO: 2725198 - DNA, 18 bp, Homo sapiens
accaaagagtctctggct

SEQ ID NO: 2725199 - DNA, 19 bp, Homo sapiens
accaaagagtctctggctc

SEQ ID NO: 2725200 - DNA, 22 bp, Homo sapiens
accaaagagtctctggctcagc

SEQ ID NO: 2725201 - DNA, 24 bp, Homo sapiens
accaaagcatcaatacaaccagcc

SEQ ID NO: 2725202 - DNA, 21 bp, Homo sapiens
accaaatgagcattagctact

SEQ ID NO: 2725203 - DNA, 13 bp, Homo sapiens
accaacccagccg

SEQ ID NO: 2725204 - DNA, 14 bp, Homo sapiens
accaacccagccgc

SEQ ID NO: 2725205 - DNA, 19 bp, Homo sapiens
accaacccagccgctgccc

SEQ ID NO: 2725206 - DNA, 20 bp, Homo sapiens
accaagccaccgcagctgct

SEQ ID NO: 2725207 - DNA, 21 bp, Homo sapiens
accaagccaccgcagctgctg

SEQ ID NO: 2725208 - DNA, 23 bp, Homo sapiens
accaagccaccgcagctgctgcc

SEQ ID NO: 2725209 - DNA, 12 bp, Homo sapiens
accaagctgtgc

SEQ ID NO: 2725210 - DNA, 14 bp, Homo sapiens
accaagctgtgcca

SEQ ID NO: 2725211 - DNA, 20 bp, Homo sapiens
accaagctgtgccaccctgg

SEQ ID NO: 2725212 - DNA, 23 bp, Homo sapiens
accaagctgtgccaccctgggct

SEQ ID NO: 2725213 - DNA, 14 bp, Homo sapiens
accaagtgtggaat

SEQ ID NO: 2725214 - DNA, 15 bp, Homo sapiens
accacaccctgcctg

SEQ ID NO: 2725215 - DNA, 18 bp, Homo sapiens
accacaccctgcctgctg

SEQ ID NO: 2725216 - DNA, 22 bp, Homo sapiens
accacaccctgcctgctgtgga

SEQ ID NO: 2725217 - DNA, 14 bp, Homo sapiens
accacacttcttga

SEQ ID NO: 2725218 - DNA, 19 bp, Homo sapiens
accacagcaaggcacctgc

SEQ ID NO: 2725219 - DNA, 13 bp, Homo sapiens
accacatttctgg

SEQ ID NO: 2725220 - DNA, 17 bp, Homo sapiens
accacgtaccaagccac

SEQ ID NO: 2725221 - DNA, 21 bp, Homo sapiens
accactagggtcctggccctc

SEQ ID NO: 2725222 - DNA, 23 bp, Homo sapiens
accagaattgcttgaacccagga

SEQ ID NO: 2725223 - DNA, 15 bp, Homo sapiens
accagagcaggggct

SEQ ID NO: 2725224 - DNA, 16 bp, Homo sapiens
accagagcaggggctg

SEQ ID NO: 2725225 - DNA, 22 bp, Homo sapiens
accagagcaggggctgctgggg

SEQ ID NO: 2725226 - DNA, 15 bp, Homo sapiens
accagagctgcctcc

SEQ ID NO: 2725227 - DNA, 18 bp, Homo sapiens
accagagctgcctcccca

SEQ ID NO: 2725228 - DNA, 11 bp, Homo sapiens
accagcctggc

SEQ ID NO: 2725229 - DNA, 18 bp, Homo sapiens
accaggcagctccagctg

SEQ ID NO: 2725230 - DNA, 15 bp, Homo sapiens
accaggggcaggcac

SEQ ID NO: 2725231 - DNA, 20 bp, Homo sapiens
accaggggcaggcacagcac

SEQ ID NO: 2725232 - DNA, 21 bp, Homo sapiens
accaggtcttgttcaagcagc

SEQ ID NO: 2725233 - DNA, 17 bp, Homo sapiens
accagtgcctcagtgct

SEQ ID NO: 2725234 - DNA, 16 bp, Homo sapiens
accagtgggcatgtat

SEQ ID NO: 2725235 - DNA, 13 bp, Homo sapiens
accagtgtagcct

SEQ ID NO: 2725236 - DNA, 21 bp, Homo sapiens
accagtgtagccttgcccgga

SEQ ID NO: 2725237 - DNA, 23 bp, Homo sapiens
accatattgctcttaaaaatctt

SEQ ID NO: 2725238 - DNA, 21 bp, Homo sapiens
accatgctggcggcgcagagg

SEQ ID NO: 2725239 - DNA, 18 bp, Homo sapiens
accatgtggtttgctgtt

SEQ ID NO: 2725240 - DNA, 14 bp, Homo sapiens
accattctcctgcc

SEQ ID NO: 2725241 - DNA, 15 bp, Homo sapiens
accattgcatgaatt

SEQ ID NO: 2725242 - DNA, 15 bp, Homo sapiens
accattgtcttccaa

SEQ ID NO: 2725243 - DNA, 18 bp, Homo sapiens
accattgtcttccaaccc

SEQ ID NO: 2725244 - DNA, 20 bp, Homo sapiens
accattgtcttccaacccca

SEQ ID NO: 2725245 - DNA, 21 bp, Homo sapiens
accattgtcttccaaccccag

SEQ ID NO: 2725246 - DNA, 15 bp, Homo sapiens
acccaacctgtcctt

SEQ ID NO: 2725247 - DNA, 22 bp, Homo sapiens
acccaagaaaacctgtttttaa

SEQ ID NO: 2725248 - DNA, 13 bp, Homo sapiens
acccactctttgc

SEQ ID NO: 2725249 - DNA, 14 bp, Homo sapiens
acccactctttgct

SEQ ID NO: 2725250 - DNA, 17 bp, Homo sapiens
acccactctttgctaca

SEQ ID NO: 2725251 - DNA, 12 bp, Homo sapiens
acccactggcca

SEQ ID NO: 2725252 - DNA, 23 bp, Homo sapiens
acccactggccagtcctagagct

SEQ ID NO: 2725253 - DNA, 19 bp, Homo sapiens
acccactgtccgcctctgc

SEQ ID NO: 2725254 - DNA, 18 bp, Homo sapiens
acccagccgctgcccggc

SEQ ID NO: 2725255 - DNA, 18 bp, Homo sapiens
acccaggaagggagggag

SEQ ID NO: 2725256 - DNA, 21 bp, Homo sapiens
acccaggaagggagggagctg

SEQ ID NO: 2725257 - DNA, 22 bp, Homo sapiens
acccaggaagggagggagctga

SEQ ID NO: 2725258 - DNA, 20 bp, Homo sapiens
acccaggctggagtacagtg

SEQ ID NO: 2725259 - DNA, 20 bp, Homo sapiens
acccagggctccctcctgga

SEQ ID NO: 2725260 - DNA, 18 bp, Homo sapiens
  misc_feature (7)..(7): n is a, c, g or t
acccagnagggcgtcgct

SEQ ID NO: 2725261 - DNA, 23 bp, Homo sapiens
acccagtgtgtgctcagcagccc

SEQ ID NO: 2725262 - DNA, 21 bp, Homo sapiens
acccatcttcacgcctgggtg

SEQ ID NO: 2725263 - DNA, 20 bp, Homo sapiens
acccatgaagacaggacagt

SEQ ID NO: 2725264 - DNA, 14 bp, Homo sapiens
accccagcacagct

SEQ ID NO: 2725265 - DNA, 17 bp, Homo sapiens
accccagcacagctcct

SEQ ID NO: 2725266 - DNA, 19 bp, Homo sapiens
accccagcacagctcctcc

SEQ ID NO: 2725267 - DNA, 22 bp, Homo sapiens
accccagcggcagatgggcctg

SEQ ID NO: 2725268 - DNA, 18 bp, Homo sapiens
accccagctagggctgga

SEQ ID NO: 2725269 - DNA, 23 bp, Homo sapiens
accccagctggcctctagaacac

SEQ ID NO: 2725270 - DNA, 15 bp, Homo sapiens
accccatctgcccag

SEQ ID NO: 2725271 - DNA, 15 bp, Homo sapiens
acccccaagccacag

SEQ ID NO: 2725272 - DNA, 13 bp, Homo sapiens
acccccagcaccc

SEQ ID NO: 2725273 - DNA, 18 bp, Homo sapiens
acccccaggattcccaga

SEQ ID NO: 2725274 - DNA, 19 bp, Homo sapiens
acccccaggattcccagag

SEQ ID NO: 2725275 - DNA, 11 bp, Homo sapiens
acccccagtgt

SEQ ID NO: 2725276 - DNA, 20 bp, Homo sapiens
acccccagtgtggctgtctg

SEQ ID NO: 2725277 - DNA, 13 bp, Homo sapiens
accccccacctgc

SEQ ID NO: 2725278 - DNA, 22 bp, Homo sapiens
acccctcccagctgacagtcct

SEQ ID NO: 2725279 - DNA, 11 bp, Homo sapiens
acccctccccc

SEQ ID NO: 2725280 - DNA, 13 bp, Homo sapiens
acccctcccccac

SEQ ID NO: 2725281 - DNA, 20 bp, Homo sapiens
acccctcccccacgtctctc

SEQ ID NO: 2725282 - DNA, 23 bp, Homo sapiens
acccctctgtccagccagctcct

SEQ ID NO: 2725283 - DNA, 11 bp, Homo sapiens
acccctggctg

SEQ ID NO: 2725284 - DNA, 21 bp, Homo sapiens
acccctggctgaacagtgctc

SEQ ID NO: 2725285 - DNA, 24 bp, Homo sapiens
acccctggctgaacagtgctctgc

SEQ ID NO: 2725286 - DNA, 16 bp, Homo sapiens
accccttttcagcttc

SEQ ID NO: 2725287 - DNA, 17 bp, Homo sapiens
accccttttcagcttct

SEQ ID NO: 2725288 - DNA, 22 bp, Homo sapiens
cctgatgaaaaatatgtgcttg

SEQ ID NO: 2725289 - DNA, 22 bp, Homo sapiens
cctgattgtattttttttttaa

SEQ ID NO: 2725290 - DNA, 20 bp, Homo sapiens
cctgcactgtcctgctccac

SEQ ID NO: 2725291 - DNA, 21 bp, Homo sapiens
cctgcactgtcctgctccaca

SEQ ID NO: 2725292 - DNA, 23 bp, Homo sapiens
cctgcactgtcctgctccacagt

SEQ ID NO: 2725293 - DNA, 16 bp, Homo sapiens
cctgcaggttgggcca

SEQ ID NO: 2725294 - DNA, 21 bp, Homo sapiens
cctgcaggttgggccatactg

SEQ ID NO: 2725295 - DNA, 16 bp, Homo sapiens
cctgccagcctggctt

SEQ ID NO: 2725296 - DNA, 17 bp, Homo sapiens
cctgccagcctggcttc

SEQ ID NO: 2725297 - DNA, 23 bp, Homo sapiens
cctgccatttgcaccctccgcct

SEQ ID NO: 2725298 - DNA, 19 bp, Homo sapiens
cctgccccagcctcccagc

SEQ ID NO: 2725299 - DNA, 12 bp, Homo sapiens
cctgccccctgg

SEQ ID NO: 2725300 - DNA, 12 bp, Homo sapiens
cctgcccctccc

SEQ ID NO: 2725301 - DNA, 17 bp, Homo sapiens
cctgcccctccccagcc

SEQ ID NO: 2725302 - DNA, 15 bp, Homo sapiens
cctgccgtccctcct

SEQ ID NO: 2725303 - DNA, 17 bp, Homo sapiens
cctgccgtccctcctgt

SEQ ID NO: 2725304 - DNA, 20 bp, Homo sapiens
cctgcctagctcttgggcct

SEQ ID NO: 2725305 - DNA, 14 bp, Homo sapiens
cctgcctgctgtgg

SEQ ID NO: 2725306 - DNA, 15 bp, Homo sapiens
cctgcctgttctcca

SEQ ID NO: 2725307 - DNA, 16 bp, Homo sapiens
cctgcctgttctccag

SEQ ID NO: 2725308 - DNA, 17 bp, Homo sapiens
cctgcctgttctccaga

SEQ ID NO: 2725309 - DNA, 22 bp, Homo sapiens
cctgcctgttctccagatggag

SEQ ID NO: 2725310 - DNA, 16 bp, Homo sapiens
cctgccttgaagccac

SEQ ID NO: 2725311 - DNA, 21 bp, Homo sapiens
cctgccttgaagccactgaag

SEQ ID NO: 2725312 - DNA, 22 bp, Homo sapiens
cctgccttgaagccactgaagc

SEQ ID NO: 2725313 - DNA, 15 bp, Homo sapiens
cctgcgaacttgtgt

SEQ ID NO: 2725314 - DNA, 23 bp, Homo sapiens
cctgcgagagaccctacagacag

SEQ ID NO: 2725315 - DNA, 14 bp, Homo sapiens
cctgctccacagtg

SEQ ID NO: 2725316 - DNA, 15 bp, Homo sapiens
cctgctccacagtgt

SEQ ID NO: 2725317 - DNA, 17 bp, Homo sapiens
cctgctcttacttcccc

SEQ ID NO: 2725318 - DNA, 21 bp, Homo sapiens
cctgctcttacttcccccacc

SEQ ID NO: 2725319 - DNA, 19 bp, Homo sapiens
cctgctgcaccaacccagc

SEQ ID NO: 2725320 - DNA, 20 bp, Homo sapiens
cctgctgcaccaacccagcc

SEQ ID NO: 2725321 - DNA, 18 bp, Homo sapiens
cctgctgcagaggggcag

SEQ ID NO: 2725322 - DNA, 22 bp, Homo sapiens
cctgctgcagaggggcaggccc

SEQ ID NO: 2725323 - DNA, 15 bp, Homo sapiens
cctgctgcagcatga

SEQ ID NO: 2725324 - DNA, 17 bp, Homo sapiens
cctgctgcgtcagacca

SEQ ID NO: 2725325 - DNA, 18 bp, Homo sapiens
cctgctgcgtcagaccag

SEQ ID NO: 2725326 - DNA, 13 bp, Homo sapiens
cctgctggcctgc

SEQ ID NO: 2725327 - DNA, 14 bp, Homo sapiens
cctgctggcctgct

SEQ ID NO: 2725328 - DNA, 16 bp, Homo sapiens
cctgctggcctgctct

SEQ ID NO: 2725329 - DNA, 19 bp, Homo sapiens
cctgctggcctgctcttac

SEQ ID NO: 2725330 - DNA, 17 bp, Homo sapiens
cctgctggttcactcta

SEQ ID NO: 2725331 - DNA, 15 bp, Homo sapiens
cctgctgtcccctct

SEQ ID NO: 2725332 - DNA, 14 bp, Homo sapiens
cctgctgtggagcc

SEQ ID NO: 2725333 - DNA, 16 bp, Homo sapiens
cctgcttcctggaccg

SEQ ID NO: 2725334 - DNA, 23 bp, Homo sapiens
cctgcttttctcccagaaggctg

SEQ ID NO: 2725335 - DNA, 21 bp, Homo sapiens
cctggaaaggctcagtctcag

SEQ ID NO: 2725336 - DNA, 22 bp, Homo sapiens
cctggaaaggctcagtctcagg

SEQ ID NO: 2725337 - DNA, 21 bp, Homo sapiens
cctggaaccggtcacaggaac

SEQ ID NO: 2725338 - DNA, 15 bp, Homo sapiens
cctggaacctttccc

SEQ ID NO: 2725339 - DNA, 18 bp, Homo sapiens
cctggaacctttcccttg

SEQ ID NO: 2725340 - DNA, 20 bp, Homo sapiens
cctggaacctttcccttgtg

SEQ ID NO: 2725341 - DNA, 21 bp, Homo sapiens
cctggaaggtgtcatttgaca

SEQ ID NO: 2725342 - DNA, 16 bp, Homo sapiens
cctggaccctggccta

SEQ ID NO: 2725343 - DNA, 21 bp, Homo sapiens
cctggaccggggccttggtcc

SEQ ID NO: 2725344 - DNA, 13 bp, Homo sapiens
cctggagctgcca

SEQ ID NO: 2725345 - DNA, 15 bp, Homo sapiens
cctggagctgccagc

SEQ ID NO: 2725346 - DNA, 19 bp, Homo sapiens
cctggcacagtgtctgggc

SEQ ID NO: 2725347 - DNA, 20 bp, Homo sapiens
cctggcacagtgtctgggct

SEQ ID NO: 2725348 - DNA, 17 bp, Homo sapiens
cctggcaggatgaccct

SEQ ID NO: 2725349 - DNA, 12 bp, Homo sapiens
cctggccaccac

SEQ ID NO: 2725350 - DNA, 16 bp, Homo sapiens
cctggccaccacccaa

SEQ ID NO: 2725351 - DNA, 20 bp, Homo sapiens
cctggccaccacccaacctg

SEQ ID NO: 2725352 - DNA, 17 bp, Homo sapiens
cctggccaccagcttcc

SEQ ID NO: 2725353 - DNA, 15 bp, Homo sapiens
cctggcccagctccc

SEQ ID NO: 2725354 - DNA, 16 bp, Homo sapiens
cctggcccagctcccc

SEQ ID NO: 2725355 - DNA, 20 bp, Homo sapiens
cctggcccagctcccccggg

SEQ ID NO: 2725356 - DNA, 23 bp, Homo sapiens
cctggccccttctccagcaagca

SEQ ID NO: 2725357 - DNA, 15 bp, Homo sapiens
cctggccctcttctt

SEQ ID NO: 2725358 - DNA, 20 bp, Homo sapiens
cctggctgaacagtgctctg

SEQ ID NO: 2725359 - DNA, 12 bp, Homo sapiens
cctggctggctg

SEQ ID NO: 2725360 - DNA, 13 bp, Homo sapiens
cctggcttctgga

SEQ ID NO: 2725361 - DNA, 20 bp, Homo sapiens
cctggcttctggagcccttg

SEQ ID NO: 2725362 - DNA, 21 bp, Homo sapiens
cctggcttctggagcccttgg

SEQ ID NO: 2725363 - DNA, 19 bp, Homo sapiens
cctgggcaatgcagtgcag

SEQ ID NO: 2725364 - DNA, 16 bp, Homo sapiens
cctgggcccccagaga

SEQ ID NO: 2725365 - DNA, 22 bp, Homo sapiens
cctgggcctcagcctccaggca

SEQ ID NO: 2725366 - DNA, 12 bp, Homo sapiens
cctgggcctccc

SEQ ID NO: 2725367 - DNA, 14 bp, Homo sapiens
cctgggctctgccc

SEQ ID NO: 2725368 - DNA, 20 bp, Homo sapiens
cctgggctctgccccagctc

SEQ ID NO: 2725369 - DNA, 14 bp, Homo sapiens
cctgggctctgtgg

SEQ ID NO: 2725370 - DNA, 15 bp, Homo sapiens
cctgggctctgtggg

SEQ ID NO: 2725371 - DNA, 19 bp, Homo sapiens
cctgggctctgtgggctgc

SEQ ID NO: 2725372 - DNA, 12 bp, Homo sapiens
cctggggcactc

SEQ ID NO: 2725373 - DNA, 12 bp, Homo sapiens
cctggggctggt

SEQ ID NO: 2725374 - DNA, 21 bp, Homo sapiens
cctgggtgacccccactgccg

SEQ ID NO: 2725375 - DNA, 19 bp, Homo sapiens
cctgggtttggcccctgga

SEQ ID NO: 2725376 - DNA, 15 bp, Homo sapiens
cctggtacagcaggg

SEQ ID NO: 2725377 - DNA, 15 bp, Homo sapiens
cctggtaggaaagca

SEQ ID NO: 2725378 - DNA, 21 bp, Homo sapiens
cgcttgcctcggctcctgctg

SEQ ID NO: 2725379 - DNA, 20 bp, Homo sapiens
cggactcagactcctggctt

SEQ ID NO: 2725380 - DNA, 20 bp, Homo sapiens
cggagcagcctccagtgctg

SEQ ID NO: 2725381 - DNA, 20 bp, Homo sapiens
cggagccatgtcatgtgcca

SEQ ID NO: 2725382 - DNA, 14 bp, Homo sapiens
cggagcgaccctgg

SEQ ID NO: 2725383 - DNA, 16 bp, Homo sapiens
cggagcgaccctggct

SEQ ID NO: 2725384 - DNA, 13 bp, Homo sapiens
cggaggttgcagg

SEQ ID NO: 2725385 - DNA, 14 bp, Homo sapiens
cggattggccctgc

SEQ ID NO: 2725386 - DNA, 21 bp, Homo sapiens
cggattggccctgcccctccc

SEQ ID NO: 2725387 - DNA, 18 bp, Homo sapiens
cggcagatgggcctgtgt

SEQ ID NO: 2725388 - DNA, 14 bp, Homo sapiens
cggcattcctgctt

SEQ ID NO: 2725389 - DNA, 17 bp, Homo sapiens
cggccacgtctgtgctc

SEQ ID NO: 2725390 - DNA, 20 bp, Homo sapiens
cggccacgtctgtgctctgt

SEQ ID NO: 2725391 - DNA, 13 bp, Homo sapiens
cggccaggtgggc

SEQ ID NO: 2725392 - DNA, 19 bp, Homo sapiens
cggcccatctgtccatcct

SEQ ID NO: 2725393 - DNA, 13 bp, Homo sapiens
cggccctgcccct

SEQ ID NO: 2725394 - DNA, 15 bp, Homo sapiens
cggccctgcccctcc

SEQ ID NO: 2725395 - DNA, 14 bp, Homo sapiens
cggcctccagactg

SEQ ID NO: 2725396 - DNA, 17 bp, Homo sapiens
cggcgccctctgtcctg

SEQ ID NO: 2725397 - DNA, 18 bp, Homo sapiens
cggcgccctctgtcctga

SEQ ID NO: 2725398 - DNA, 13 bp, Homo sapiens
cggctcctgctgc

SEQ ID NO: 2725399 - DNA, 17 bp, Homo sapiens
cggctcctgctgcacca

SEQ ID NO: 2725400 - DNA, 15 bp, Homo sapiens
cgggaggggcccgct

SEQ ID NO: 2725401 - DNA, 19 bp, Homo sapiens
cgggaggggcccgcttgcc

SEQ ID NO: 2725402 - DNA, 12 bp, Homo sapiens
cgggcagcacag

SEQ ID NO: 2725403 - DNA, 14 bp, Homo sapiens
cgggctcctgtgcc

SEQ ID NO: 2725404 - DNA, 15 bp, Homo sapiens
cgggctcctgtgccc

SEQ ID NO: 2725405 - DNA, 17 bp, Homo sapiens
cgggctgagggcatctc

SEQ ID NO: 2725406 - DNA, 19 bp, Homo sapiens
cgggctgagggcatctctg

SEQ ID NO: 2725407 - DNA, 20 bp, Homo sapiens
cgggctgagggcatctctga

SEQ ID NO: 2725408 - DNA, 17 bp, Homo sapiens
cggggaccactgggccc

SEQ ID NO: 2725409 - DNA, 19 bp, Homo sapiens
cggggaccactgggcccct

SEQ ID NO: 2725410 - DNA, 20 bp, Homo sapiens
cggggaccactgggcccctc

SEQ ID NO: 2725411 - DNA, 17 bp, Homo sapiens
cggggagagaggaggag

SEQ ID NO: 2725412 - DNA, 19 bp, Homo sapiens
cggggcatgctggggcaag

SEQ ID NO: 2725413 - DNA, 14 bp, Homo sapiens
cggggcgtttcttt

SEQ ID NO: 2725414 - DNA, 19 bp, Homo sapiens
cgggtggggggagggcacc

SEQ ID NO: 2725415 - DNA, 17 bp, Homo sapiens
cggtcctttaggcagcc

SEQ ID NO: 2725416 - DNA, 18 bp, Homo sapiens
cggtcctttaggcagcct

SEQ ID NO: 2725417 - DNA, 19 bp, Homo sapiens
cggtcctttaggcagcctg

SEQ ID NO: 2725418 - DNA, 21 bp, Homo sapiens
cggtcctttaggcagcctgcc

SEQ ID NO: 2725419 - DNA, 16 bp, Homo sapiens
cggtgagactctgagg

SEQ ID NO: 2725420 - DNA, 22 bp, Homo sapiens
cggtgggggggagaaggcctcc

SEQ ID NO: 2725421 - DNA, 23 bp, Homo sapiens
cggtgggggggagaaggcctccc

SEQ ID NO: 2725422 - DNA, 17 bp, Homo sapiens
cggtggtaccaggtctc

SEQ ID NO: 2725423 - DNA, 21 bp, Homo sapiens
cggtggtaccaggtctcctcc

SEQ ID NO: 2725424 - DNA, 19 bp, Homo sapiens
cggtgtctgcagctcctgg

SEQ ID NO: 2725425 - DNA, 15 bp, Homo sapiens
cggtgtgcctgcagc

SEQ ID NO: 2725426 - DNA, 17 bp, Homo sapiens
cggtgtgcctgcagccc

SEQ ID NO: 2725427 - DNA, 20 bp, Homo sapiens
cggtgtgcctgcagccccgc

SEQ ID NO: 2725428 - DNA, 15 bp, Homo sapiens
cggttgtcttgaaac

SEQ ID NO: 2725429 - DNA, 18 bp, Homo sapiens
cggtttccgtggcaaccc

SEQ ID NO: 2725430 - DNA, 23 bp, Homo sapiens
cggttttcagctattagcaactg

SEQ ID NO: 2725431 - DNA, 15 bp, Homo sapiens
cgtaccaagccaccg

SEQ ID NO: 2725432 - DNA, 12 bp, Homo sapiens
cgtagatttttg

SEQ ID NO: 2725433 - DNA, 13 bp, Homo sapiens
cgtatagtcaata

SEQ ID NO: 2725434 - DNA, 22 bp, Homo sapiens
cgtatgtcggcacgtcccatgt

SEQ ID NO: 2725435 - DNA, 17 bp, Homo sapiens
cgtattttgatcagtgt

SEQ ID NO: 2725436 - DNA, 18 bp, Homo sapiens
cgtattttgatcagtgtt

SEQ ID NO: 2725437 - DNA, 16 bp, Homo sapiens
cgtcaccctcctgagc

SEQ ID NO: 2725438 - DNA, 20 bp, Homo sapiens
cgtcaccctcctgagcctca

SEQ ID NO: 2725439 - DNA, 22 bp, Homo sapiens
cgtcaccctcctgagcctcacc

SEQ ID NO: 2725440 - DNA, 16 bp, Homo sapiens
cgtcataactagaact

SEQ ID NO: 2725441 - DNA, 23 bp, Homo sapiens
cgtcattgatggagcctgaaccg

SEQ ID NO: 2725442 - DNA, 21 bp, Homo sapiens
cgtccaaggcagttctgtgtc

SEQ ID NO: 2725443 - DNA, 12 bp, Homo sapiens
cgtccctcctgt

SEQ ID NO: 2725444 - DNA, 13 bp, Homo sapiens
cgtccctcctgtt

SEQ ID NO: 2725445 - DNA, 19 bp, Homo sapiens
cgtcctgcacgccgtggag

SEQ ID NO: 2725446 - DNA, 11 bp, Homo sapiens
cgtcctggaat

SEQ ID NO: 2725447 - DNA, 11 bp, Homo sapiens
cgtctctctgc

SEQ ID NO: 2725448 - DNA, 19 bp, Homo sapiens
cgtctctctgcctgctggg

SEQ ID NO: 2725449 - DNA, 13 bp, Homo sapiens
cgtctctgtcccg

SEQ ID NO: 2725450 - DNA, 22 bp, Homo sapiens
cgtgatatccacaaatgctatt

SEQ ID NO: 2725451 - DNA, 20 bp, Homo sapiens
cgtgatctcggctcactgca

SEQ ID NO: 2725452 - DNA, 15 bp, Homo sapiens
cgtgattctgttcta

SEQ ID NO: 2725453 - DNA, 20 bp, Homo sapiens
cgtgatttggaagagaggca

SEQ ID NO: 2725454 - DNA, 21 bp, Homo sapiens
cgtgccagtcgcgctgcctgt

SEQ ID NO: 2725455 - DNA, 16 bp, Homo sapiens
cgtgccagtgtcccca

SEQ ID NO: 2725456 - DNA, 15 bp, Homo sapiens
cgtggcaaccctcag

SEQ ID NO: 2725457 - DNA, 17 bp, Homo sapiens
cgtggcaaccctcagct

SEQ ID NO: 2725458 - DNA, 21 bp, Homo sapiens
cgtgtagccccgggctgaccc

SEQ ID NO: 2725459 - DNA, 13 bp, Homo sapiens
cgtgtagtttctg

SEQ ID NO: 2725460 - DNA, 15 bp, Homo sapiens
cgtgtccctctcgga

SEQ ID NO: 2725461 - DNA, 22 bp, Homo sapiens
cgtgtgctcctcggcagatgct

SEQ ID NO: 2725462 - DNA, 18 bp, Homo sapiens
cgtgtgttccccagctga

SEQ ID NO: 2725463 - DNA, 19 bp, Homo sapiens
cgtgtgttccccagctgat

SEQ ID NO: 2725464 - DNA, 21 bp, Homo sapiens
cgtgttttgtttggacttcac

SEQ ID NO: 2725465 - DNA, 17 bp, Homo sapiens
cgttagaggagcaacag

SEQ ID NO: 2725466 - DNA, 16 bp, Homo sapiens
cgttcgcttgttttaa

SEQ ID NO: 2725467 - DNA, 11 bp, Homo sapiens
cgtttacagtg

SEQ ID NO: 2725468 - DNA, 14 bp, Homo sapiens
cgtttacagtgtat

SEQ ID NO: 2725469 - DNA, 13 bp, Homo sapiens
ctaaaactctcaa

SEQ ID NO: 2725470 - DNA, 18 bp, Homo sapiens
ctaaacagactatttaac

SEQ ID NO: 2725471 - DNA, 13 bp, Homo sapiens
ctaaagtttacag

SEQ ID NO: 2725472 - DNA, 16 bp, Homo sapiens
ctaaattagtttaaaa

SEQ ID NO: 2725473 - DNA, 19 bp, Homo sapiens
ctaaccaaagagtctctgg

SEQ ID NO: 2725474 - DNA, 20 bp, Homo sapiens
ctaaccaaagagtctctggc

SEQ ID NO: 2725475 - DNA, 17 bp, Homo sapiens
ctaacgaacgttttaaa

SEQ ID NO: 2725476 - DNA, 19 bp, Homo sapiens
ctaactccctcctcacact

SEQ ID NO: 2725477 - DNA, 23 bp, Homo sapiens
ctaagcctgttgctgaagtcatt

SEQ ID NO: 2725478 - DNA, 16 bp, Homo sapiens
ctaagctgcagcttcc

SEQ ID NO: 2725479 - DNA, 11 bp, Homo sapiens
ctaaggatttt

SEQ ID NO: 2725480 - DNA, 20 bp, Homo sapiens
ctaaggatttttcaagagat

SEQ ID NO: 2725481 - DNA, 16 bp, Homo sapiens
ctaagtcatggtcctg

SEQ ID NO: 2725482 - DNA, 17 bp, Homo sapiens
ctacccctcccagctga

SEQ ID NO: 2725483 - DNA, 23 bp, Homo sapiens
ctaccctccctgctgtcccctct

SEQ ID NO: 2725484 - DNA, 13 bp, Homo sapiens
ctaccctgcagct

SEQ ID NO: 2725485 - DNA, 16 bp, Homo sapiens
ctaccgcatggcagct

SEQ ID NO: 2725486 - DNA, 14 bp, Homo sapiens
ctacctcagcctag

SEQ ID NO: 2725487 - DNA, 14 bp, Homo sapiens
ctacctttttttct

SEQ ID NO: 2725488 - DNA, 17 bp, Homo sapiens
ctactcagctctcctgc

SEQ ID NO: 2725489 - DNA, 20 bp, Homo sapiens
ctactcagctctcctgctgc

SEQ ID NO: 2725490 - DNA, 16 bp, Homo sapiens
ctactcattccccggg

SEQ ID NO: 2725491 - DNA, 16 bp, Homo sapiens
ctactcctacctcagc

SEQ ID NO: 2725492 - DNA, 13 bp, Homo sapiens
ctactcctcacag

SEQ ID NO: 2725493 - DNA, 22 bp, Homo sapiens
ctactgcttcctctgaatatta

SEQ ID NO: 2725494 - DNA, 21 bp, Homo sapiens
ctacttgagaaaatgcaggag

SEQ ID NO: 2725495 - DNA, 23 bp, Homo sapiens
ctacttgatatttccttcaccac

SEQ ID NO: 2725496 - DNA, 18 bp, Homo sapiens
ctactttgtctaaaaata

SEQ ID NO: 2725497 - DNA, 20 bp, Homo sapiens
ctagaacacccactggccag

SEQ ID NO: 2725498 - DNA, 15 bp, Homo sapiens
ctagaactgaatttt

SEQ ID NO: 2725499 - DNA, 20 bp, Homo sapiens
ctagaagcagaaccagctct

SEQ ID NO: 2725500 - DNA, 13 bp, Homo sapiens
ctagagctcctgt

SEQ ID NO: 2725501 - DNA, 14 bp, Homo sapiens
ctagagctcctgtc

SEQ ID NO: 2725502 - DNA, 16 bp, Homo sapiens
ctagagctcctgtccc

SEQ ID NO: 2725503 - DNA, 23 bp, Homo sapiens
ctagagctcctgtccctacccac

SEQ ID NO: 2725504 - DNA, 16 bp, Homo sapiens
ctagattctcacctgc

SEQ ID NO: 2725505 - DNA, 19 bp, Homo sapiens
ctagcagagcaggggcagg

SEQ ID NO: 2725506 - DNA, 18 bp, Homo sapiens
ctagcatggcccgggcct

SEQ ID NO: 2725507 - DNA, 19 bp, Homo sapiens
ctagcatggcccgggcctt

SEQ ID NO: 2725508 - DNA, 15 bp, Homo sapiens
ctagcattttcttga

SEQ ID NO: 2725509 - DNA, 17 bp, Homo sapiens
ctagccatatattttct

SEQ ID NO: 2725510 - DNA, 15 bp, Homo sapiens
ctagcccagcagaga

SEQ ID NO: 2725511 - DNA, 21 bp, Homo sapiens
ctagctatttctatgtatgtg

SEQ ID NO: 2725512 - DNA, 13 bp, Homo sapiens
ctagctcttgggc

SEQ ID NO: 2725513 - DNA, 15 bp, Homo sapiens
ctagctcttgggcct

SEQ ID NO: 2725514 - DNA, 22 bp, Homo sapiens
ctagctcttgggcctgacctcc

SEQ ID NO: 2725515 - DNA, 23 bp, Homo sapiens
ctagctcttgggcctgacctcca

SEQ ID NO: 2725516 - DNA, 16 bp, Homo sapiens
ctaggactctgaggct

SEQ ID NO: 2725517 - DNA, 22 bp, Homo sapiens
ctaggactctgaggctctttct

SEQ ID NO: 2725518 - DNA, 11 bp, Homo sapiens
ctagggctgga

SEQ ID NO: 2725519 - DNA, 20 bp, Homo sapiens
ctaggggaaggactggccgt

SEQ ID NO: 2725520 - DNA, 22 bp, Homo sapiens
ctaggggaaggactggccgtgg

SEQ ID NO: 2725521 - DNA, 16 bp, Homo sapiens
ctagtagaacaatgta

SEQ ID NO: 2725522 - DNA, 21 bp, Homo sapiens
ctagtatattagtttgattta

SEQ ID NO: 2725523 - DNA, 14 bp, Homo sapiens
ctagtatctattgt

SEQ ID NO: 2725524 - DNA, 15 bp, Homo sapiens
ctagtctcttctcag

SEQ ID NO: 2725525 - DNA, 14 bp, Homo sapiens
ctagtgacttcctg

SEQ ID NO: 2725526 - DNA, 18 bp, Homo sapiens
ctagtgacttcctggtga

SEQ ID NO: 2725527 - DNA, 21 bp, Homo sapiens
ctagtgcagaagccccaactg

SEQ ID NO: 2725528 - DNA, 23 bp, Homo sapiens
ctagtgccctccacagccgcagc

SEQ ID NO: 2725529 - DNA, 16 bp, Homo sapiens
ctagtggctgtccagt

SEQ ID NO: 2725530 - DNA, 18 bp, Homo sapiens
ctagtggctgtccagtgc

SEQ ID NO: 2725531 - DNA, 19 bp, Homo sapiens
ctagtggctgtccagtgcc

SEQ ID NO: 2725532 - DNA, 20 bp, Homo sapiens
ctagttctcaatcactgctc

SEQ ID NO: 2725533 - DNA, 17 bp, Homo sapiens
ctatcagtgtgcccccc

SEQ ID NO: 2725534 - DNA, 23 bp, Homo sapiens
ctatcagtgtgccccccatcctg

SEQ ID NO: 2725535 - DNA, 19 bp, Homo sapiens
ctatccttggagagcagct

SEQ ID NO: 2725536 - DNA, 20 bp, Homo sapiens
ctatccttggagagcagctg

SEQ ID NO: 2725537 - DNA, 21 bp, Homo sapiens
ctatccttggagagcagctgg

SEQ ID NO: 2725538 - DNA, 14 bp, Homo sapiens
ctatgaaaagcaac

SEQ ID NO: 2725539 - DNA, 15 bp, Homo sapiens
ctatgaagagaagga

SEQ ID NO: 2725540 - DNA, 21 bp, Homo sapiens
ctatgatcccagcactttggg

SEQ ID NO: 2725541 - DNA, 21 bp, Homo sapiens
ctatggcccagccactgcagc

SEQ ID NO: 2725542 - DNA, 14 bp, Homo sapiens
ctatggtgaggtgt

SEQ ID NO: 2725543 - DNA, 14 bp, Homo sapiens
ctattagcaactgt

SEQ ID NO: 2725544 - DNA, 18 bp, Homo sapiens
ctattccaataaagcaga

SEQ ID NO: 2725545 - DNA, 21 bp, Homo sapiens
ctattgtgttggctttacaaa

SEQ ID NO: 2725546 - DNA, 23 bp, Homo sapiens
ctattgtgttggctttacaaata

SEQ ID NO: 2725547 - DNA, 14 bp, Homo sapiens
ctattgtttattct

SEQ ID NO: 2725548 - DNA, 22 bp, Homo sapiens
ctcaaagaaatttccactcagg

SEQ ID NO: 2725549 - DNA, 15 bp, Homo sapiens
ctcaactactcagct

SEQ ID NO: 2725550 - DNA, 16 bp, Homo sapiens
ctcaaggcctcccaca

SEQ ID NO: 2725551 - DNA, 18 bp, Homo sapiens
ctcaaggcctcccacagt

SEQ ID NO: 2725552 - DNA, 19 bp, Homo sapiens
ctcaaggcctcccacagtg

SEQ ID NO: 2725553 - DNA, 13 bp, Homo sapiens
ctcaagtttaaag

SEQ ID NO: 2725554 - DNA, 13 bp, Homo sapiens
ctcaattttgtat

SEQ ID NO: 2725555 - DNA, 22 bp, Homo sapiens
ctcacactacttgagaaaatgc

SEQ ID NO: 2725556 - DNA, 13 bp, Homo sapiens
ctcacactccaga

SEQ ID NO: 2725557 - DNA, 13 bp, Homo sapiens
ctcacactcctcc

SEQ ID NO: 2725558 - DNA, 16 bp, Homo sapiens
ctcacactcctcctgc

SEQ ID NO: 2725559 - DNA, 16 bp, Homo sapiens
ctcacagatgctggcc

SEQ ID NO: 2725560 - DNA, 17 bp, Homo sapiens
ctcacagcctctccctt

SEQ ID NO: 2725561 - DNA, 12 bp, Homo sapiens
ctcacattccca

SEQ ID NO: 2725562 - DNA, 14 bp, Homo sapiens
ctcaccaggggcag

SEQ ID NO: 2725563 - DNA, 15 bp, Homo sapiens
ctcaccaggggcagg

SEQ ID NO: 2725564 - DNA, 20 bp, Homo sapiens
ctcaccaggggcaggcacag

SEQ ID NO: 2725565 - DNA, 17 bp, Homo sapiens
ctcaccttaactcagcc

SEQ ID NO: 2725566 - DNA, 18 bp, Homo sapiens
ctcaccttaactcagcca

SEQ ID NO: 2725567 - DNA, 16 bp, Homo sapiens
ctcaccttttcccggg

SEQ ID NO: 2725568 - DNA, 16 bp, Homo sapiens
ctcacgactcttcctg

SEQ ID NO: 2725569 - DNA, 13 bp, Homo sapiens
ctcacgctctgga

SEQ ID NO: 2725570 - DNA, 15 bp, Homo sapiens
ctcacgtgaccagcc

SEQ ID NO: 2725571 - DNA, 19 bp, Homo sapiens
ctcactgcaagctctgcct

SEQ ID NO: 2725572 - DNA, 13 bp, Homo sapiens
ctcagactcctgg

SEQ ID NO: 2725573 - DNA, 17 bp, Homo sapiens
ctcagactcctggcttc

SEQ ID NO: 2725574 - DNA, 22 bp, Homo sapiens
ctcagactcctggcttcatgtg

SEQ ID NO: 2725575 - DNA, 23 bp, Homo sapiens
ctcagactcctggcttcatgtgg

SEQ ID NO: 2725576 - DNA, 16 bp, Homo sapiens
ctcagagcctcagctt

SEQ ID NO: 2725577 - DNA, 18 bp, Homo sapiens
ctcagagctgcgggctga

SEQ ID NO: 2725578 - DNA, 22 bp, Homo sapiens
ctcagagctgcgggctgagggc

SEQ ID NO: 2725579 - DNA, 22 bp, Homo sapiens
ctcagagctgctgagcaggaac

SEQ ID NO: 2725580 - DNA, 21 bp, Homo sapiens
ctcagagggaggagtttttct

SEQ ID NO: 2725581 - DNA, 15 bp, Homo sapiens
ctcagatcctgggca

SEQ ID NO: 2725582 - DNA, 12 bp, Homo sapiens
ctcagcagccag

SEQ ID NO: 2725583 - DNA, 13 bp, Homo sapiens
ctcagcagcccca

SEQ ID NO: 2725584 - DNA, 19 bp, Homo sapiens
ctcagcagccccaccccac

SEQ ID NO: 2725585 - DNA, 18 bp, Homo sapiens
ctcagcagccccctgccc

SEQ ID NO: 2725586 - DNA, 19 bp, Homo sapiens
ctcagcagccccctgcccg

SEQ ID NO: 2725587 - DNA, 14 bp, Homo sapiens
ctcagccagccctg

SEQ ID NO: 2725588 - DNA, 15 bp, Homo sapiens
ctcagccagccctgg

SEQ ID NO: 2725589 - DNA, 22 bp, Homo sapiens
ctcagccagccctggaggctgg

SEQ ID NO: 2725590 - DNA, 15 bp, Homo sapiens
ctcagcctcctgagt

SEQ ID NO: 2725591 - DNA, 21 bp, Homo sapiens
catgtctttggcttcagaatt

SEQ ID NO: 2725592 - DNA, 17 bp, Homo sapiens
catgtgcacctatggcc

SEQ ID NO: 2725593 - DNA, 15 bp, Homo sapiens
catgtgctgctgtgg

SEQ ID NO: 2725594 - DNA, 21 bp, Homo sapiens
catgtggcattctctctgctc

SEQ ID NO: 2725595 - DNA, 13 bp, Homo sapiens
catgtgtatgaga

SEQ ID NO: 2725596 - DNA, 14 bp, Homo sapiens
catgtttaaaacaa

SEQ ID NO: 2725597 - DNA, 19 bp, Homo sapiens
cattaaaacagaagcaaat

SEQ ID NO: 2725598 - DNA, 15 bp, Homo sapiens
cattaagtggctttt

SEQ ID NO: 2725599 - DNA, 16 bp, Homo sapiens
cattaatattcttttg

SEQ ID NO: 2725600 - DNA, 17 bp, Homo sapiens
cattaatattcttttgt

SEQ ID NO: 2725601 - DNA, 17 bp, Homo sapiens
cattacatggctgtggt

SEQ ID NO: 2725602 - DNA, 12 bp, Homo sapiens
cattactgtatg

SEQ ID NO: 2725603 - DNA, 17 bp, Homo sapiens
cattagattatcaaaaa

SEQ ID NO: 2725604 - DNA, 21 bp, Homo sapiens
cattagattatcaaaaagtat

SEQ ID NO: 2725605 - DNA, 19 bp, Homo sapiens
cattagctacttttcagaa

SEQ ID NO: 2725606 - DNA, 20 bp, Homo sapiens
cattatgttattggaatttt

SEQ ID NO: 2725607 - DNA, 21 bp, Homo sapiens
cattatttgataacattttgt

SEQ ID NO: 2725608 - DNA, 23 bp, Homo sapiens
cattattttacagtctctgttgt

SEQ ID NO: 2725609 - DNA, 21 bp, Homo sapiens
cattatttttgttagcaaaga

SEQ ID NO: 2725610 - DNA, 15 bp, Homo sapiens
cattcacatttcaag

SEQ ID NO: 2725611 - DNA, 19 bp, Homo sapiens
cattcaggtgttctcttct

SEQ ID NO: 2725612 - DNA, 21 bp, Homo sapiens
cattcatgcaacttgattctt

SEQ ID NO: 2725613 - DNA, 23 bp, Homo sapiens
cattccaagggtatgggaagcca

SEQ ID NO: 2725614 - DNA, 14 bp, Homo sapiens
cattccctcgggac

SEQ ID NO: 2725615 - DNA, 23 bp, Homo sapiens
cattcctcaccttttcccgggga

SEQ ID NO: 2725616 - DNA, 12 bp, Homo sapiens
cattctcctgcc

SEQ ID NO: 2725617 - DNA, 15 bp, Homo sapiens
cattctcctgcctca

SEQ ID NO: 2725618 - DNA, 17 bp, Homo sapiens
cattctcctgcctcagc

SEQ ID NO: 2725619 - DNA, 16 bp, Homo sapiens
cattctctctgctcag

SEQ ID NO: 2725620 - DNA, 17 bp, Homo sapiens
cattctctctgctcagt

SEQ ID NO: 2725621 - DNA, 14 bp, Homo sapiens
cattctgtctctgc

SEQ ID NO: 2725622 - DNA, 17 bp, Homo sapiens
cattctgtctctgcttg

SEQ ID NO: 2725623 - DNA, 20 bp, Homo sapiens
cattgaatttagtcattatt

SEQ ID NO: 2725624 - DNA, 19 bp, Homo sapiens
cattgatggagcctgaacc

SEQ ID NO: 2725625 - DNA, 14 bp, Homo sapiens
cattgcaatagaaa

SEQ ID NO: 2725626 - DNA, 13 bp, Homo sapiens
cattggaagccat

SEQ ID NO: 2725627 - DNA, 13 bp, Homo sapiens
cattggaagctcc

SEQ ID NO: 2725628 - DNA, 21 bp, Homo sapiens
cattggcagcaggtgctgcta

SEQ ID NO: 2725629 - DNA, 24 bp, Homo sapiens
cattggcagcaggtgctgctaccc

SEQ ID NO: 2725630 - DNA, 14 bp, Homo sapiens
cattgtcaagtgga

SEQ ID NO: 2725631 - DNA, 15 bp, Homo sapiens
cattgtcttccaacc

SEQ ID NO: 2725632 - DNA, 20 bp, Homo sapiens
cattgtcttccaaccccagc

SEQ ID NO: 2725633 - DNA, 21 bp, Homo sapiens
cattgtcttccaaccccagct

SEQ ID NO: 2725634 - DNA, 18 bp, Homo sapiens
catttcaagatccaaatg

SEQ ID NO: 2725635 - DNA, 16 bp, Homo sapiens
catttcgtgtaatatt

SEQ ID NO: 2725636 - DNA, 22 bp, Homo sapiens
catttctactgtataaacaaat

SEQ ID NO: 2725637 - DNA, 12 bp, Homo sapiens
catttcttattt

SEQ ID NO: 2725638 - DNA, 21 bp, Homo sapiens
catttgaaagtgggtttcaat

SEQ ID NO: 2725639 - DNA, 20 bp, Homo sapiens
catttgatttcgatgtacag

SEQ ID NO: 2725640 - DNA, 15 bp, Homo sapiens
catttgcaccctccg

SEQ ID NO: 2725641 - DNA, 23 bp, Homo sapiens
catttggcagaactgctggggct

SEQ ID NO: 2725642 - DNA, 13 bp, Homo sapiens
cattttaaataaa

SEQ ID NO: 2725643 - DNA, 17 bp, Homo sapiens
cattttagaaaatcaga

SEQ ID NO: 2725644 - DNA, 23 bp, Homo sapiens
cattttcagcatcaaacatgaaa

SEQ ID NO: 2725645 - DNA, 14 bp, Homo sapiens
cattttgaatgtga

SEQ ID NO: 2725646 - DNA, 13 bp, Homo sapiens
cattttgcctttc

SEQ ID NO: 2725647 - DNA, 15 bp, Homo sapiens
catttttaaaggaca

SEQ ID NO: 2725648 - DNA, 17 bp, Homo sapiens
catttttgtacattatg

SEQ ID NO: 2725649 - DNA, 20 bp, Homo sapiens
catttttgtacattatgtta

SEQ ID NO: 2725650 - DNA, 15 bp, Homo sapiens
ccaaagagtctctgg

SEQ ID NO: 2725651 - DNA, 13 bp, Homo sapiens
ccaaatagggcaa

SEQ ID NO: 2725652 - DNA, 16 bp, Homo sapiens
ccaaatccacaagcca

SEQ ID NO: 2725653 - DNA, 13 bp, Homo sapiens
ccaaatgcattca

SEQ ID NO: 2725654 - DNA, 17 bp, Homo sapiens
ccaaattgtctgtctgc

SEQ ID NO: 2725655 - DNA, 21 bp, Homo sapiens
ccaacagtgttaggcctggca

SEQ ID NO: 2725656 - DNA, 21 bp, Homo sapiens
ccaacatgtttctgttttgtt

SEQ ID NO: 2725657 - DNA, 12 bp, Homo sapiens
ccaacccagccg

SEQ ID NO: 2725658 - DNA, 21 bp, Homo sapiens
ccaacccagccgctgcccggc

SEQ ID NO: 2725659 - DNA, 18 bp, Homo sapiens
ccaaccccccacctgcca

SEQ ID NO: 2725660 - DNA, 20 bp, Homo sapiens
ccaacccctcccccacgtct

SEQ ID NO: 2725661 - DNA, 12 bp, Homo sapiens
ccaacctgtcct

SEQ ID NO: 2725662 - DNA, 17 bp, Homo sapiens
ccaacctgtccttactc

SEQ ID NO: 2725663 - DNA, 22 bp, Homo sapiens
ccaacctgtccttactcagagc

SEQ ID NO: 2725664 - DNA, 19 bp, Homo sapiens
ccaagagcagaggcagcga

SEQ ID NO: 2725665 - DNA, 17 bp, Homo sapiens
ccaagccaccgcagctg

SEQ ID NO: 2725666 - DNA, 21 bp, Homo sapiens
ccaagccaccgcagctgctgc

SEQ ID NO: 2725667 - DNA, 22 bp, Homo sapiens
ccaagccaccgcagctgctgcc

SEQ ID NO: 2725668 - DNA, 13 bp, Homo sapiens
ccaagctgtgcca

SEQ ID NO: 2725669 - DNA, 21 bp, Homo sapiens
ccaagctgtgccaccctgggc

SEQ ID NO: 2725670 - DNA, 22 bp, Homo sapiens
ccaagctgtgccaccctgggct

SEQ ID NO: 2725671 - DNA, 17 bp, Homo sapiens
ccaaggcagttctgtgt

SEQ ID NO: 2725672 - DNA, 18 bp, Homo sapiens
ccaaggcagttctgtgtc

SEQ ID NO: 2725673 - DNA, 19 bp, Homo sapiens
ccaaggcagttctgtgtcc

SEQ ID NO: 2725674 - DNA, 20 bp, Homo sapiens
ccaagggtaactcttggcca

SEQ ID NO: 2725675 - DNA, 21 bp, Homo sapiens
ccaaggtctcacactcctcct

SEQ ID NO: 2725676 - DNA, 20 bp, Homo sapiens
ccaaggtgggctgagccctg

SEQ ID NO: 2725677 - DNA, 15 bp, Homo sapiens
ccaaggtggtctgct

SEQ ID NO: 2725678 - DNA, 21 bp, Homo sapiens
ccaaggtttcccagtgagcct

SEQ ID NO: 2725679 - DNA, 19 bp, Homo sapiens
ccaagtcaacactcttctt

SEQ ID NO: 2725680 - DNA, 18 bp, Homo sapiens
ccaagtccaacctgcctg

SEQ ID NO: 2725681 - DNA, 20 bp, Homo sapiens
ccaagtccaacctgcctgtg

SEQ ID NO: 2725682 - DNA, 18 bp, Homo sapiens
ccaagtgtcctggaccct

SEQ ID NO: 2725683 - DNA, 16 bp, Homo sapiens
ccaagtgtctcttgac

SEQ ID NO: 2725684 - DNA, 23 bp, Homo sapiens
ccaagtgtctcttgactggctca

SEQ ID NO: 2725685 - DNA, 18 bp, Homo sapiens
ccaatacgtagatttttg

SEQ ID NO: 2725686 - DNA, 23 bp, Homo sapiens
ccaatccatttggcagaactgct

SEQ ID NO: 2725687 - DNA, 17 bp, Homo sapiens
ccaatgaagcaaacaca

SEQ ID NO: 2725688 - DNA, 21 bp, Homo sapiens
ccacacacactccttcccctt

SEQ ID NO: 2725689 - DNA, 20 bp, Homo sapiens
ccacaccaagctgtgccacc

SEQ ID NO: 2725690 - DNA, 19 bp, Homo sapiens
ccacaccctgcctgctgtg

SEQ ID NO: 2725691 - DNA, 11 bp, Homo sapiens
ccacactgggc

SEQ ID NO: 2725692 - DNA, 12 bp, Homo sapiens
ccacacttcttg

SEQ ID NO: 2725693 - DNA, 21 bp, Homo sapiens
ccacacttcttgaaacagcct

SEQ ID NO: 2725694 - DNA, 17 bp, Homo sapiens
ccacagaaaggccactc

SEQ ID NO: 2725695 - DNA, 21 bp, Homo sapiens
ccacagaaaggccactcagga

SEQ ID NO: 2725696 - DNA, 19 bp, Homo sapiens
ccacagcaaggcacctgca

SEQ ID NO: 2725697 - DNA, 20 bp, Homo sapiens
ccacagcccccaccccagca

SEQ ID NO: 2725698 - DNA, 15 bp, Homo sapiens
ccacagccgcagcct

SEQ ID NO: 2725699 - DNA, 12 bp, Homo sapiens
ccacagctctgc

SEQ ID NO: 2725700 - DNA, 16 bp, Homo sapiens
ccacagctctgctgga

SEQ ID NO: 2725701 - DNA, 22 bp, Homo sapiens
ccacagtgactcgggctcctgt

SEQ ID NO: 2725702 - DNA, 23 bp, Homo sapiens
ccacagtgttggcgagaggaggg

SEQ ID NO: 2725703 - DNA, 17 bp, Homo sapiens
ccaccaaggtctcacac

SEQ ID NO: 2725704 - DNA, 19 bp, Homo sapiens
ccaccaaggtctcacactc

SEQ ID NO: 2725705 - DNA, 23 bp, Homo sapiens
ccaccaaggtctcacactcctcc

SEQ ID NO: 2725706 - DNA, 20 bp, Homo sapiens
ccaccacccaacctgtcctt

SEQ ID NO: 2725707 - DNA, 22 bp, Homo sapiens
ccaccagagcaggggctgctgg

SEQ ID NO: 2725708 - DNA, 19 bp, Homo sapiens
ccaccagagctgcctcccc

SEQ ID NO: 2725709 - DNA, 21 bp, Homo sapiens
ccaccagcggccttgaagagg

SEQ ID NO: 2725710 - DNA, 22 bp, Homo sapiens
ccaccagcttccctctgcctga

SEQ ID NO: 2725711 - DNA, 19 bp, Homo sapiens
ccaccaggcagctccagct

SEQ ID NO: 2725712 - DNA, 22 bp, Homo sapiens
ccaccatattcagtgctgtggc

SEQ ID NO: 2725713 - DNA, 17 bp, Homo sapiens
ccaccatgcccagtcga

SEQ ID NO: 2725714 - DNA, 16 bp, Homo sapiens
ccacccaacctgtcct

SEQ ID NO: 2725715 - DNA, 18 bp, Homo sapiens
ccacccaacctgtcctta

SEQ ID NO: 2725716 - DNA, 23 bp, Homo sapiens
caggctgggttgtcactgagact

SEQ ID NO: 2725717 - DNA, 23 bp, Homo sapiens
caggctgtaagcattctgagctg

SEQ ID NO: 2725718 - DNA, 14 bp, Homo sapiens
caggcttctcccgg

SEQ ID NO: 2725719 - DNA, 15 bp, Homo sapiens
caggcttctcccgga

SEQ ID NO: 2725720 - DNA, 20 bp, Homo sapiens
cagggaagccctcggcctcc

SEQ ID NO: 2725721 - DNA, 15 bp, Homo sapiens
cagggacagaagcag

SEQ ID NO: 2725722 - DNA, 18 bp, Homo sapiens
cagggacagaagcaggag

SEQ ID NO: 2725723 - DNA, 19 bp, Homo sapiens
cagggactcaggccagtca

SEQ ID NO: 2725724 - DNA, 18 bp, Homo sapiens
cagggaggaggtggcagc

SEQ ID NO: 2725725 - DNA, 23 bp, Homo sapiens
cagggaggaggtggcagccctgt

SEQ ID NO: 2725726 - DNA, 23 bp, Homo sapiens
cagggataggaagtgccccaggg

SEQ ID NO: 2725727 - DNA, 19 bp, Homo sapiens
cagggatgctatctcgcta

SEQ ID NO: 2725728 - DNA, 13 bp, Homo sapiens
cagggcacagctg

SEQ ID NO: 2725729 - DNA, 12 bp, Homo sapiens
cagggcagagcc

SEQ ID NO: 2725730 - DNA, 16 bp, Homo sapiens
cagggcagagccggga

SEQ ID NO: 2725731 - DNA, 16 bp, Homo sapiens
cagggccagcaggcag

SEQ ID NO: 2725732 - DNA, 19 bp, Homo sapiens
cagggccagcaggcagcgc

SEQ ID NO: 2725733 - DNA, 22 bp, Homo sapiens
cagggccagcaggcagcgcctg

SEQ ID NO: 2725734 - DNA, 12 bp, Homo sapiens
cagggccagggc

SEQ ID NO: 2725735 - DNA, 18 bp, Homo sapiens
cagggccagggccctgca

SEQ ID NO: 2725736 - DNA, 13 bp, Homo sapiens
cagggcctccagg

SEQ ID NO: 2725737 - DNA, 12 bp, Homo sapiens
cagggcctctgt

SEQ ID NO: 2725738 - DNA, 13 bp, Homo sapiens
cagggcctctgtg

SEQ ID NO: 2725739 - DNA, 21 bp, Homo sapiens
cagggcctggccttgtcccca

SEQ ID NO: 2725740 - DNA, 16 bp, Homo sapiens
cagggctccctcctgg

SEQ ID NO: 2725741 - DNA, 20 bp, Homo sapiens
cagggctccctcctggagca

SEQ ID NO: 2725742 - DNA, 20 bp, Homo sapiens
caggggacctggagctgcca

SEQ ID NO: 2725743 - DNA, 12 bp, Homo sapiens
caggggactggg

SEQ ID NO: 2725744 - DNA, 13 bp, Homo sapiens
caggggactgggc

SEQ ID NO: 2725745 - DNA, 15 bp, Homo sapiens
caggggactgggcca

SEQ ID NO: 2725746 - DNA, 17 bp, Homo sapiens
caggggagggaaaagct

SEQ ID NO: 2725747 - DNA, 12 bp, Homo sapiens
caggggctgccc

SEQ ID NO: 2725748 - DNA, 13 bp, Homo sapiens
caggggctgcccg

SEQ ID NO: 2725749 - DNA, 19 bp, Homo sapiens
caggggctgcccgctccca

SEQ ID NO: 2725750 - DNA, 18 bp, Homo sapiens
caggggctgctgggggct

SEQ ID NO: 2725751 - DNA, 16 bp, Homo sapiens
caggggtaccaggcac

SEQ ID NO: 2725752 - DNA, 22 bp, Homo sapiens
caggtctgattcccagaaatac

SEQ ID NO: 2725753 - DNA, 16 bp, Homo sapiens
caggtcttgcccaaag

SEQ ID NO: 2725754 - DNA, 18 bp, Homo sapiens
caggtcttgttcaagcag

SEQ ID NO: 2725755 - DNA, 18 bp, Homo sapiens
caggtgacggactcagac

SEQ ID NO: 2725756 - DNA, 17 bp, Homo sapiens
caggtggggtgaggcag

SEQ ID NO: 2725757 - DNA, 20 bp, Homo sapiens
caggttgaggggctcctgga

SEQ ID NO: 2725758 - DNA, 21 bp, Homo sapiens
caggttgaggggctcctggaa

SEQ ID NO: 2725759 - DNA, 16 bp, Homo sapiens
caggttggaaaagaaa

SEQ ID NO: 2725760 - DNA, 18 bp, Homo sapiens
caggttggaaaagaaatc

SEQ ID NO: 2725761 - DNA, 22 bp, Homo sapiens
caggttggaaaagaaatcaatt

SEQ ID NO: 2725762 - DNA, 22 bp, Homo sapiens
caggttgggccatactggcctc

SEQ ID NO: 2725763 - DNA, 21 bp, Homo sapiens
caggtttactcagtgaaatca

SEQ ID NO: 2725764 - DNA, 15 bp, Homo sapiens
cagtaaataaattgt

SEQ ID NO: 2725765 - DNA, 19 bp, Homo sapiens
cagtaagtataacaaacta

SEQ ID NO: 2725766 - DNA, 23 bp, Homo sapiens
cagtaagtataacaaactatgta

SEQ ID NO: 2725767 - DNA, 14 bp, Homo sapiens
cagtaagtcttttt

SEQ ID NO: 2725768 - DNA, 16 bp, Homo sapiens
cagtacctgattgtat

SEQ ID NO: 2725769 - DNA, 20 bp, Homo sapiens
cagtacctgattgtattttt

SEQ ID NO: 2725770 - DNA, 16 bp, Homo sapiens
cagtagtcgtcaagtt

SEQ ID NO: 2725771 - DNA, 20 bp, Homo sapiens
cagtcaaagcggatgctggc

SEQ ID NO: 2725772 - DNA, 22 bp, Homo sapiens
cagtcaagttccctcctgcagc

SEQ ID NO: 2725773 - DNA, 18 bp, Homo sapiens
cagtcattatttaaagca

SEQ ID NO: 2725774 - DNA, 19 bp, Homo sapiens
cagtccaaattgtctgtct

SEQ ID NO: 2725775 - DNA, 16 bp, Homo sapiens
cagtcctagagctcct

SEQ ID NO: 2725776 - DNA, 17 bp, Homo sapiens
cagtcctagagctcctg

SEQ ID NO: 2725777 - DNA, 19 bp, Homo sapiens
cagtcctagagctcctgtc

SEQ ID NO: 2725778 - DNA, 20 bp, Homo sapiens
cagtcctagagctcctgtcc

SEQ ID NO: 2725779 - DNA, 21 bp, Homo sapiens
cagtcctagagctcctgtccc

SEQ ID NO: 2725780 - DNA, 19 bp, Homo sapiens
cagtcctcacagcctctcc

SEQ ID NO: 2725781 - DNA, 13 bp, Homo sapiens
cagtcctctccac

SEQ ID NO: 2725782 - DNA, 18 bp, Homo sapiens
cagtcctgctggcctgct

SEQ ID NO: 2725783 - DNA, 17 bp, Homo sapiens
cagtcgcgctgcctgtg

SEQ ID NO: 2725784 - DNA, 20 bp, Homo sapiens
cagtcgcgctgcctgtgtgg

SEQ ID NO: 2725785 - DNA, 19 bp, Homo sapiens
cagtctcaggagcatgggg

SEQ ID NO: 2725786 - DNA, 21 bp, Homo sapiens
cagtctgaatggcatggagac

SEQ ID NO: 2725787 - DNA, 14 bp, Homo sapiens
cagtcttttgctgt

SEQ ID NO: 2725788 - DNA, 16 bp, Homo sapiens
cagtgaaatcatatta

SEQ ID NO: 2725789 - DNA, 19 bp, Homo sapiens
cagtgaaatcatattaatt

SEQ ID NO: 2725790 - DNA, 16 bp, Homo sapiens
cagtgaacagcttcac

SEQ ID NO: 2725791 - DNA, 16 bp, Homo sapiens
cagtgaacagtttgga

SEQ ID NO: 2725792 - DNA, 14 bp, Homo sapiens
cagtgaactgagac

SEQ ID NO: 2725793 - DNA, 15 bp, Homo sapiens
cagtgaactgagact

SEQ ID NO: 2725794 - DNA, 19 bp, Homo sapiens
cagtgacgtgactcagagc

SEQ ID NO: 2725795 - DNA, 16 bp, Homo sapiens
cagtgacgtgcacctg

SEQ ID NO: 2725796 - DNA, 17 bp, Homo sapiens
cagtgacgtgcacctgt

SEQ ID NO: 2725797 - DNA, 16 bp, Homo sapiens
cagtgactcgggctcc

SEQ ID NO: 2725798 - DNA, 22 bp, Homo sapiens
cagtgactcgggctcctgtgcc

SEQ ID NO: 2725799 - DNA, 23 bp, Homo sapiens
cagtgactcgggctcctgtgccc

SEQ ID NO: 2725800 - DNA, 23 bp, Homo sapiens
cagtgagaagggcctgctctgct

SEQ ID NO: 2725801 - DNA, 17 bp, Homo sapiens
cagtgagcctctgcgcc

SEQ ID NO: 2725802 - DNA, 17 bp, Homo sapiens
cagtgccctctggacag

SEQ ID NO: 2725803 - DNA, 21 bp, Homo sapiens
cagtgccctctggacagcttg

SEQ ID NO: 2725804 - DNA, 17 bp, Homo sapiens
cagtgccgccgcctcgc

SEQ ID NO: 2725805 - DNA, 23 bp, Homo sapiens
cagtgctattttgtgcccactgt

SEQ ID NO: 2725806 - DNA, 13 bp, Homo sapiens
cagtgctcctgtg

SEQ ID NO: 2725807 - DNA, 16 bp, Homo sapiens
cagtgctcctgtgcag

SEQ ID NO: 2725808 - DNA, 13 bp, Homo sapiens
cagtgctctgcct

SEQ ID NO: 2725809 - DNA, 14 bp, Homo sapiens
cagtgctctgcctc

SEQ ID NO: 2725810 - DNA, 15 bp, Homo sapiens
cagtgctctgcctct

SEQ ID NO: 2725811 - DNA, 18 bp, Homo sapiens
cagtgctctgcctctaac

SEQ ID NO: 2725812 - DNA, 23 bp, Homo sapiens
cagtgctctgcctctaactccct

SEQ ID NO: 2725813 - DNA, 15 bp, Homo sapiens
cagtgctggctgctg

SEQ ID NO: 2725814 - DNA, 13 bp, Homo sapiens
cagtgctgtggcc

SEQ ID NO: 2725815 - DNA, 17 bp, Homo sapiens
cagtgctgtggcctggg

SEQ ID NO: 2725816 - DNA, 20 bp, Homo sapiens
cagtgctgtggcctgggcaa

SEQ ID NO: 2725817 - DNA, 14 bp, Homo sapiens
cagtgcttcagcct

SEQ ID NO: 2725818 - DNA, 19 bp, Homo sapiens
cagtgcttcagcctgaggc

SEQ ID NO: 2725819 - DNA, 13 bp, Homo sapiens
cagtggcactaaa

SEQ ID NO: 2725820 - DNA, 21 bp, Homo sapiens
cagtggcccccactcacaggg

SEQ ID NO: 2725821 - DNA, 15 bp, Homo sapiens
cagtgggtcccactt

SEQ ID NO: 2725822 - DNA, 14 bp, Homo sapiens
cagtgtacccccgc

SEQ ID NO: 2725823 - DNA, 18 bp, Homo sapiens
cagtgtacccccgcccag

SEQ ID NO: 2725824 - DNA, 19 bp, Homo sapiens
cagtgtacccccgcccagg

SEQ ID NO: 2725825 - DNA, 22 bp, Homo sapiens
cagtgtacccccgcccaggctg

SEQ ID NO: 2725826 - DNA, 23 bp, Homo sapiens
cagtgtacccccgcccaggctgg

SEQ ID NO: 2725827 - DNA, 19 bp, Homo sapiens
cagtgtagccttgcccgga

SEQ ID NO: 2725828 - DNA, 14 bp, Homo sapiens
cagtgtatttaaga

SEQ ID NO: 2725829 - DNA, 15 bp, Homo sapiens
cagtgtcagcactca

SEQ ID NO: 2725830 - DNA, 20 bp, Homo sapiens
cagtgtcgtgtctgctgttg

SEQ ID NO: 2725831 - DNA, 18 bp, Homo sapiens
cagtgtctgggctgactg

SEQ ID NO: 2725832 - DNA, 23 bp, Homo sapiens
cagtgtgtgctcagcagccccac

SEQ ID NO: 2725833 - DNA, 17 bp, Homo sapiens
cagtgttacaagggtat

SEQ ID NO: 2725834 - DNA, 15 bp, Homo sapiens
cagtgtttatgacga

SEQ ID NO: 2725835 - DNA, 11 bp, Homo sapiens
cagtgtttcct

SEQ ID NO: 2725836 - DNA, 12 bp, Homo sapiens
cagtgtttgtat

SEQ ID NO: 2725837 - DNA, 13 bp, Homo sapiens
cagttattattct

SEQ ID NO: 2725838 - DNA, 16 bp, Homo sapiens
cagttcataattcacc

SEQ ID NO: 2725839 - DNA, 18 bp, Homo sapiens
cagttcctctttgcatgg

SEQ ID NO: 2725840 - DNA, 13 bp, Homo sapiens
cagttctagttga

SEQ ID NO: 2725841 - DNA, 13 bp, Homo sapiens
cagttctgatgag

SEQ ID NO: 2725842 - DNA, 17 bp, Homo sapiens
cagttctgtgtcctcgc

SEQ ID NO: 2725843 - DNA, 13 bp, Homo sapiens
cataactagaact

SEQ ID NO: 2725844 - DNA, 22 bp, Homo sapiens
catacaaaaaaaatctttaatg

SEQ ID NO: 2725845 - DNA, 17 bp, Homo sapiens
catactggcctcgcctg

SEQ ID NO: 2725846 - DNA, 18 bp, Homo sapiens
catactggcctcgcctgg

SEQ ID NO: 2725847 - DNA, 22 bp, Homo sapiens
catagagatatttaaaagacaa

SEQ ID NO: 2725848 - DNA, 19 bp, Homo sapiens
catagatgagaaaactgag

SEQ ID NO: 2725849 - DNA, 23 bp, Homo sapiens
catagctggttatttctcccttg

SEQ ID NO: 2725850 - DNA, 19 bp, Homo sapiens
catagtcaatcaaacaggg

SEQ ID NO: 2725851 - DNA, 21 bp, Homo sapiens
catagttgaaaaaagaagttt

SEQ ID NO: 2725852 - DNA, 21 bp, Homo sapiens
catatatgtatatgtatatct

SEQ ID NO: 2725853 - DNA, 17 bp, Homo sapiens
catatccattgtggaaa

SEQ ID NO: 2725854 - DNA, 23 bp, Homo sapiens
catatccattgtggaaactggat

SEQ ID NO: 2725855 - DNA, 19 bp, Homo sapiens
catatctagtcaataactc

SEQ ID NO: 2725856 - DNA, 20 bp, Homo sapiens
catatctctagtccctgtgt

SEQ ID NO: 2725857 - DNA, 24 bp, Homo sapiens
catatctctagtccctgtgttctg

SEQ ID NO: 2725858 - DNA, 11 bp, Homo sapiens
catatgaaaaa

SEQ ID NO: 2725859 - DNA, 16 bp, Homo sapiens
catatgtctgtctttg

SEQ ID NO: 2725860 - DNA, 16 bp, Homo sapiens
catattctaaattcac

SEQ ID NO: 2725861 - DNA, 18 bp, Homo sapiens
catattgctcttaaaaat

SEQ ID NO: 2725862 - DNA, 21 bp, Homo sapiens
catattgctcttaaaaatctt

SEQ ID NO: 2725863 - DNA, 22 bp, Homo sapiens
catattgctcttaaaaatcttg

SEQ ID NO: 2725864 - DNA, 17 bp, Homo sapiens
catcaaataaaccttgt

SEQ ID NO: 2725865 - DNA, 19 bp, Homo sapiens
catcaagaaggtagcttga

SEQ ID NO: 2725866 - DNA, 22 bp, Homo sapiens
catcaagctccaccctcctggc

SEQ ID NO: 2725867 - DNA, 20 bp, Homo sapiens
catcacagggcagagccggg

SEQ ID NO: 2725868 - DNA, 17 bp, Homo sapiens
catcaccgtcattgatg

SEQ ID NO: 2725869 - DNA, 19 bp, Homo sapiens
catcagaagtaactcccac

SEQ ID NO: 2725870 - DNA, 15 bp, Homo sapiens
catcagctttttgta

SEQ ID NO: 2725871 - DNA, 17 bp, Homo sapiens
catcagtctccaacatg

SEQ ID NO: 2725872 - DNA, 21 bp, Homo sapiens
catccaaccccccacctgcca

SEQ ID NO: 2725873 - DNA, 19 bp, Homo sapiens
catccagctctatgtggga

SEQ ID NO: 2725874 - DNA, 15 bp, Homo sapiens
catccatagtgcact

SEQ ID NO: 2725875 - DNA, 20 bp, Homo sapiens
catccatagtgcactagcat

SEQ ID NO: 2725876 - DNA, 15 bp, Homo sapiens
catccatctgtggaa

SEQ ID NO: 2725877 - DNA, 21 bp, Homo sapiens
catcccatctaagctgcagct

SEQ ID NO: 2725878 - DNA, 16 bp, Homo sapiens
catccctttttttaca

SEQ ID NO: 2725879 - DNA, 18 bp, Homo sapiens
catccctttttttacatt

SEQ ID NO: 2725880 - DNA, 14 bp, Homo sapiens
catcctaaatattg

SEQ ID NO: 2725881 - DNA, 15 bp, Homo sapiens
catcctccccaccag

SEQ ID NO: 2725882 - DNA, 20 bp, Homo sapiens
catcctccccaccagagctg

SEQ ID NO: 2725883 - DNA, 22 bp, Homo sapiens
catcctccccaccagagctgcc

SEQ ID NO: 2725884 - DNA, 15 bp, Homo sapiens
catcctcctcctcat

SEQ ID NO: 2725885 - DNA, 13 bp, Homo sapiens
catcctcctctcc

SEQ ID NO: 2725886 - DNA, 15 bp, Homo sapiens
catcctcctctccat

SEQ ID NO: 2725887 - DNA, 17 bp, Homo sapiens
catcctcctctccatgc

SEQ ID NO: 2725888 - DNA, 19 bp, Homo sapiens
catcctcctctccatgcaa

SEQ ID NO: 2725889 - DNA, 21 bp, Homo sapiens
catcctcctctccatgcaagt

SEQ ID NO: 2725890 - DNA, 12 bp, Homo sapiens
catcctggccca

SEQ ID NO: 2725891 - DNA, 13 bp, Homo sapiens
catcctggcccat

SEQ ID NO: 2725892 - DNA, 16 bp, Homo sapiens
catcctggcccatcag

SEQ ID NO: 2725893 - DNA, 19 bp, Homo sapiens
catcctggcccatcagtgt

SEQ ID NO: 2725894 - DNA, 19 bp, Homo sapiens
catccttttctgcagaggg

SEQ ID NO: 2725895 - DNA, 13 bp, Homo sapiens
catcgatatgaaa

SEQ ID NO: 2725896 - DNA, 14 bp, Homo sapiens
catcgatatgaaaa

SEQ ID NO: 2725897 - DNA, 15 bp, Homo sapiens
catctaagctgcagc

SEQ ID NO: 2725898 - DNA, 16 bp, Homo sapiens
catctaagctgcagct

SEQ ID NO: 2725899 - DNA, 17 bp, Homo sapiens
catctaagctgcagctt

SEQ ID NO: 2725900 - DNA, 21 bp, Homo sapiens
catctaagctgcagcttcctg

SEQ ID NO: 2725901 - DNA, 20 bp, Homo sapiens
catctccagtatcctgctgg

SEQ ID NO: 2725902 - DNA, 21 bp, Homo sapiens
catctctctactcctacctca

SEQ ID NO: 2725903 - DNA, 12 bp, Homo sapiens
catctctgagtg

SEQ ID NO: 2725904 - DNA, 18 bp, Homo sapiens
catctctgagtgtctctg

SEQ ID NO: 2725905 - DNA, 22 bp, Homo sapiens
catctctgagtgtctctgcctg

SEQ ID NO: 2725906 - DNA, 14 bp, Homo sapiens
catctgtccatcct

SEQ ID NO: 2725907 - DNA, 17 bp, Homo sapiens
catctgtgcctgtctgt

SEQ ID NO: 2725908 - DNA, 19 bp, Homo sapiens
catctgtgcctgtctgtcc

SEQ ID NO: 2725909 - DNA, 21 bp, Homo sapiens
catctgtgcctgtctgtccaa

SEQ ID NO: 2725910 - DNA, 19 bp, Homo sapiens
catctgtggaaatgacagc

SEQ ID NO: 2725911 - DNA, 15 bp, Homo sapiens
catcttcacgcctgg

SEQ ID NO: 2725912 - DNA, 16 bp, Homo sapiens
catcttccaggtgggg

SEQ ID NO: 2725913 - DNA, 21 bp, Homo sapiens
catcttccaggtggggtgagg

SEQ ID NO: 2725914 - DNA, 23 bp, Homo sapiens
catctttgctgaatgtcattatt

SEQ ID NO: 2725915 - DNA, 19 bp, Homo sapiens
catctttgggagagttcat

SEQ ID NO: 2725916 - DNA, 15 bp, Homo sapiens
catgaaaacattgat

SEQ ID NO: 2725917 - DNA, 18 bp, Homo sapiens
catgaaaacattgatgaa

SEQ ID NO: 2725918 - DNA, 14 bp, Homo sapiens
catgaagaagctgg

SEQ ID NO: 2725919 - DNA, 15 bp, Homo sapiens
catgacctaaaacac

SEQ ID NO: 2725920 - DNA, 20 bp, Homo sapiens
catgaggacatgatggagcg

SEQ ID NO: 2725921 - DNA, 21 bp, Homo sapiens
catgagtggccttaataaata

SEQ ID NO: 2725922 - DNA, 20 bp, Homo sapiens
catgatactttaatttttat

SEQ ID NO: 2725923 - DNA, 15 bp, Homo sapiens
catgatctcggctta

SEQ ID NO: 2725924 - DNA, 17 bp, Homo sapiens
catgatgggccgagcca

SEQ ID NO: 2725925 - DNA, 20 bp, Homo sapiens
catgattctacccttattgc

SEQ ID NO: 2725926 - DNA, 22 bp, Homo sapiens
catgatttagggaagcagggac

SEQ ID NO: 2725927 - DNA, 13 bp, Homo sapiens
catgcaagtgctg

SEQ ID NO: 2725928 - DNA, 15 bp, Homo sapiens
catgcaagtgctgtt

SEQ ID NO: 2725929 - DNA, 20 bp, Homo sapiens
catgcaagtgctgtttgggc

SEQ ID NO: 2725930 - DNA, 20 bp, Homo sapiens
catgcattttaggatattct

SEQ ID NO: 2725931 - DNA, 19 bp, Homo sapiens
catgcccactgccgatgcc

SEQ ID NO: 2725932 - DNA, 15 bp, Homo sapiens
catgccccctcgtgc

SEQ ID NO: 2725933 - DNA, 16 bp, Homo sapiens
catgcctcagccagcc

SEQ ID NO: 2725934 - DNA, 22 bp, Homo sapiens
catgctggcggcgcagagggaa

SEQ ID NO: 2725935 - DNA, 23 bp, Homo sapiens
catgctttcctaaagtctctgct

SEQ ID NO: 2725936 - DNA, 14 bp, Homo sapiens
catgctttctcctt

SEQ ID NO: 2725937 - DNA, 16 bp, Homo sapiens
catggaatttgtaagt

SEQ ID NO: 2725938 - DNA, 19 bp, Homo sapiens
catggacgttcggggcatg

SEQ ID NO: 2725939 - DNA, 13 bp, Homo sapiens
catggagtgtttg

SEQ ID NO: 2725940 - DNA, 14 bp, Homo sapiens
catggagtgtttga

SEQ ID NO: 2725941 - DNA, 15 bp, Homo sapiens
catggagtgtttgac

SEQ ID NO: 2725942 - DNA, 21 bp, Homo sapiens
catggagtgtttgacgaagaa

SEQ ID NO: 2725943 - DNA, 17 bp, Homo sapiens
catggattccaaagcat

SEQ ID NO: 2725944 - DNA, 19 bp, Homo sapiens
catggattccaaagcattt

SEQ ID NO: 2725945 - DNA, 13 bp, Homo sapiens
catggatttggtt

SEQ ID NO: 2725946 - DNA, 15 bp, Homo sapiens
catggcagctgggcc

SEQ ID NO: 2725947 - DNA, 14 bp, Homo sapiens
catggccttccctc

SEQ ID NO: 2725948 - DNA, 19 bp, Homo sapiens
catggcgtgtccctctcgg

SEQ ID NO: 2725949 - DNA, 17 bp, Homo sapiens
catggctgggggaggga

SEQ ID NO: 2725950 - DNA, 15 bp, Homo sapiens
catgggactgtgcct

SEQ ID NO: 2725951 - DNA, 15 bp, Homo sapiens
catgggcactgctgg

SEQ ID NO: 2725952 - DNA, 16 bp, Homo sapiens
catgggcactgctggg

SEQ ID NO: 2725953 - DNA, 15 bp, Homo sapiens
catgggtcctcggcc

SEQ ID NO: 2725954 - DNA, 18 bp, Homo sapiens
catgggtcctcggcccat

SEQ ID NO: 2725955 - DNA, 15 bp, Homo sapiens
catggtagactgtga

SEQ ID NO: 2725956 - DNA, 18 bp, Homo sapiens
catggtcctggctggaag

SEQ ID NO: 2725957 - DNA, 15 bp, Homo sapiens
catggtgtgtgtctc

SEQ ID NO: 2725958 - DNA, 18 bp, Homo sapiens
catggtgtgtgtctctga

SEQ ID NO: 2725959 - DNA, 17 bp, Homo sapiens
catgtaaaatcttcagc

SEQ ID NO: 2725960 - DNA, 22 bp, Homo sapiens
catgtaaaatcttcagctggtg

SEQ ID NO: 2725961 - DNA, 20 bp, Homo sapiens
catgtaaggtcttcttgtgt

SEQ ID NO: 2725962 - DNA, 23 bp, Homo sapiens
catgtagctctatggggggaggg

SEQ ID NO: 2725963 - DNA, 15 bp, Homo sapiens
catgtatagctagct

SEQ ID NO: 2725964 - DNA, 18 bp, Homo sapiens
catgtatcactcactgcc

SEQ ID NO: 2725965 - DNA, 19 bp, Homo sapiens
catgtattagccagtcatt

SEQ ID NO: 2725966 - DNA, 16 bp, Homo sapiens
cacccccaagccacag

SEQ ID NO: 2725967 - DNA, 15 bp, Homo sapiens
caccccctcctgctg

SEQ ID NO: 2725968 - DNA, 12 bp, Homo sapiens
cacccggaaaga

SEQ ID NO: 2725969 - DNA, 17 bp, Homo sapiens
caccctaaagtctcagg

SEQ ID NO: 2725970 - DNA, 19 bp, Homo sapiens
caccctcattccctcggga

SEQ ID NO: 2725971 - DNA, 12 bp, Homo sapiens
caccctcccctc

SEQ ID NO: 2725972 - DNA, 12 bp, Homo sapiens
caccctgcagag

SEQ ID NO: 2725973 - DNA, 19 bp, Homo sapiens
caccctgcagagctatggt

SEQ ID NO: 2725974 - DNA, 18 bp, Homo sapiens
caccctgcctgctgtgga

SEQ ID NO: 2725975 - DNA, 14 bp, Homo sapiens
caccctggccacca

SEQ ID NO: 2725976 - DNA, 16 bp, Homo sapiens
caccctgggctctgtg

SEQ ID NO: 2725977 - DNA, 22 bp, Homo sapiens
caccctgggctctgtgggctgc

SEQ ID NO: 2725978 - DNA, 16 bp, Homo sapiens
cacccttggacttgag

SEQ ID NO: 2725979 - DNA, 19 bp, Homo sapiens
caccgcagctgctgccact

SEQ ID NO: 2725980 - DNA, 20 bp, Homo sapiens
caccgcagctgctgccactc

SEQ ID NO: 2725981 - DNA, 19 bp, Homo sapiens
caccgcatgccccctcgtg

SEQ ID NO: 2725982 - DNA, 23 bp, Homo sapiens
caccgccatggcttccaaggtgg

SEQ ID NO: 2725983 - DNA, 19 bp, Homo sapiens
caccgtattagccaggatg

SEQ ID NO: 2725984 - DNA, 17 bp, Homo sapiens
cacctagtggctgtcca

SEQ ID NO: 2725985 - DNA, 19 bp, Homo sapiens
cacctagtggctgtccagt

SEQ ID NO: 2725986 - DNA, 16 bp, Homo sapiens
cacctatggcccagcc

SEQ ID NO: 2725987 - DNA, 18 bp, Homo sapiens
cacctatggcccagccac

SEQ ID NO: 2725988 - DNA, 21 bp, Homo sapiens
cacctatggcccagccactgc

SEQ ID NO: 2725989 - DNA, 23 bp, Homo sapiens
cacctatggcccagccactgcag

SEQ ID NO: 2725990 - DNA, 14 bp, Homo sapiens
cacctcacgctctg

SEQ ID NO: 2725991 - DNA, 20 bp, Homo sapiens
cacctcggatcccactgatt

SEQ ID NO: 2725992 - DNA, 23 bp, Homo sapiens
cacctcgttactctcacctcgtg

SEQ ID NO: 2725993 - DNA, 18 bp, Homo sapiens
cacctgaggttaggagtt

SEQ ID NO: 2725994 - DNA, 14 bp, Homo sapiens
cacctgccagcctg

SEQ ID NO: 2725995 - DNA, 16 bp, Homo sapiens
cacctgccagcctggc

SEQ ID NO: 2725996 - DNA, 17 bp, Homo sapiens
cacctgccagcctggct

SEQ ID NO: 2725997 - DNA, 22 bp, Homo sapiens
cacctgccagcctggcttctgg

SEQ ID NO: 2725998 - DNA, 13 bp, Homo sapiens
cacctgcctagct

SEQ ID NO: 2725999 - DNA, 18 bp, Homo sapiens
cacctgcctagctcttgg

SEQ ID NO: 2726000 - DNA, 13 bp, Homo sapiens
cacctgctggaaa

SEQ ID NO: 2726001 - DNA, 20 bp, Homo sapiens
cacctggtactgcacatttt

SEQ ID NO: 2726002 - DNA, 15 bp, Homo sapiens
cacctgtactcagga

SEQ ID NO: 2726003 - DNA, 19 bp, Homo sapiens
caccttcaattcctgggcc

SEQ ID NO: 2726004 - DNA, 16 bp, Homo sapiens
caccttgccgagagag

SEQ ID NO: 2726005 - DNA, 16 bp, Homo sapiens
caccttgtcaacctct

SEQ ID NO: 2726006 - DNA, 21 bp, Homo sapiens
cacgaacacgcatgcctcagc

SEQ ID NO: 2726007 - DNA, 17 bp, Homo sapiens
cacgactcttcctgcaa

SEQ ID NO: 2726008 - DNA, 23 bp, Homo sapiens
cacgcatgcctcagccagccctg

SEQ ID NO: 2726009 - DNA, 16 bp, Homo sapiens
cacgccaacagccccc

SEQ ID NO: 2726010 - DNA, 18 bp, Homo sapiens
ataggataaattacatta

SEQ ID NO: 2726011 - DNA, 19 bp, Homo sapiens
ataggataaattacattaa

SEQ ID NO: 2726012 - DNA, 19 bp, Homo sapiens
ataggatgaatgggaaagt

SEQ ID NO: 2726013 - DNA, 12 bp, Homo sapiens
ataggtttccac

SEQ ID NO: 2726014 - DNA, 22 bp, Homo sapiens
atagtcaatatggggcattaat

SEQ ID NO: 2726015 - DNA, 18 bp, Homo sapiens
atagtctcaaatcaaata

SEQ ID NO: 2726016 - DNA, 20 bp, Homo sapiens
atagtctcaaatcaaataca

SEQ ID NO: 2726017 - DNA, 13 bp, Homo sapiens
atagtgcctctgc

SEQ ID NO: 2726018 - DNA, 14 bp, Homo sapiens
atagtgcctctgca

SEQ ID NO: 2726019 - DNA, 17 bp, Homo sapiens
atagtgcttcttgtaat

SEQ ID NO: 2726020 - DNA, 18 bp, Homo sapiens
atagtgcttcttgtaata

SEQ ID NO: 2726021 - DNA, 14 bp, Homo sapiens
atagtgtgtccatg

SEQ ID NO: 2726022 - DNA, 15 bp, Homo sapiens
atagttgtctttctt

SEQ ID NO: 2726023 - DNA, 20 bp, Homo sapiens
atataaaagttaaactactt

SEQ ID NO: 2726024 - DNA, 15 bp, Homo sapiens
atataaagaaaatca

SEQ ID NO: 2726025 - DNA, 17 bp, Homo sapiens
atataaccataaatcaa

SEQ ID NO: 2726026 - DNA, 22 bp, Homo sapiens
atataataaatatatatttatc

SEQ ID NO: 2726027 - DNA, 16 bp, Homo sapiens
atataataatgatgat

SEQ ID NO: 2726028 - DNA, 20 bp, Homo sapiens
atataatttaaagaaacact

SEQ ID NO: 2726029 - DNA, 23 bp, Homo sapiens
atatagctctacacaacatgtat

SEQ ID NO: 2726030 - DNA, 15 bp, Homo sapiens
atatatatttatcat

SEQ ID NO: 2726031 - DNA, 13 bp, Homo sapiens
atatatcataaag

SEQ ID NO: 2726032 - DNA, 16 bp, Homo sapiens
atatatcataaagtat

SEQ ID NO: 2726033 - DNA, 21 bp, Homo sapiens
atatatgattgtttgcacaga

SEQ ID NO: 2726034 - DNA, 14 bp, Homo sapiens
atatatggatattt

SEQ ID NO: 2726035 - DNA, 15 bp, Homo sapiens
atatatgtatatgta

SEQ ID NO: 2726036 - DNA, 20 bp, Homo sapiens
atatatgtatatgtatatct

SEQ ID NO: 2726037 - DNA, 21 bp, Homo sapiens
atatatgtatatgtatatcta

SEQ ID NO: 2726038 - DNA, 19 bp, Homo sapiens
atatattctacacatatat

SEQ ID NO: 2726039 - DNA, 14 bp, Homo sapiens
atatattgctttat

SEQ ID NO: 2726040 - DNA, 16 bp, Homo sapiens
atatccccagggaaac

SEQ ID NO: 2726041 - DNA, 17 bp, Homo sapiens
atatctgagaagtgtat

SEQ ID NO: 2726042 - DNA, 17 bp, Homo sapiens
atatctgtttgcttcta

SEQ ID NO: 2726043 - DNA, 22 bp, Homo sapiens
atatctttatgcaaaaacatat

SEQ ID NO: 2726044 - DNA, 13 bp, Homo sapiens
atatgaaagccac

SEQ ID NO: 2726045 - DNA, 12 bp, Homo sapiens
atatgtatatgt

SEQ ID NO: 2726046 - DNA, 19 bp, Homo sapiens
atattaaacactaaatgca

SEQ ID NO: 2726047 - DNA, 23 bp, Homo sapiens
atattattggtcaagaaaagcat

SEQ ID NO: 2726048 - DNA, 21 bp, Homo sapiens
atattcatcaaataaaccttg

SEQ ID NO: 2726049 - DNA, 21 bp, Homo sapiens
atattcctctaaaactctcaa

SEQ ID NO: 2726050 - DNA, 15 bp, Homo sapiens
atattctctgatgtt

SEQ ID NO: 2726051 - DNA, 14 bp, Homo sapiens
atattgaccatgtg

SEQ ID NO: 2726052 - DNA, 15 bp, Homo sapiens
atattgaccatgtga

SEQ ID NO: 2726053 - DNA, 16 bp, Homo sapiens
atattgaccatgtgat

SEQ ID NO: 2726054 - DNA, 16 bp, Homo sapiens
atattgctaccaaaaa

SEQ ID NO: 2726055 - DNA, 13 bp, Homo sapiens
atattgctcttaa

SEQ ID NO: 2726056 - DNA, 16 bp, Homo sapiens
atattgctcttaaaaa

SEQ ID NO: 2726057 - DNA, 20 bp, Homo sapiens
atattgctcttaaaaatctt

SEQ ID NO: 2726058 - DNA, 23 bp, Homo sapiens
atattgctcttaaaaatcttggt

SEQ ID NO: 2726059 - DNA, 21 bp, Homo sapiens
atattgctgctggtaatttgt

SEQ ID NO: 2726060 - DNA, 15 bp, Homo sapiens
atatttaaaagacaa

SEQ ID NO: 2726061 - DNA, 18 bp, Homo sapiens
atatttatcatatttaat

SEQ ID NO: 2726062 - DNA, 15 bp, Homo sapiens
atatttatttatgta

SEQ ID NO: 2726063 - DNA, 23 bp, Homo sapiens
atatttccttcaccacctcatgt

SEQ ID NO: 2726064 - DNA, 23 bp, Homo sapiens
atatttcttcaagtgagtggcat

SEQ ID NO: 2726065 - DNA, 20 bp, Homo sapiens
atatttgtatttaaatgaaa

SEQ ID NO: 2726066 - DNA, 23 bp, Homo sapiens
atattttcatgacttttccatgt

SEQ ID NO: 2726067 - DNA, 17 bp, Homo sapiens
atcaaaacctgcgcagt

SEQ ID NO: 2726068 - DNA, 13 bp, Homo sapiens
atcaaacatgaaa

SEQ ID NO: 2726069 - DNA, 16 bp, Homo sapiens
atcaaacatgaaaaca

SEQ ID NO: 2726070 - DNA, 17 bp, Homo sapiens
atcaagagtctctccag

SEQ ID NO: 2726071 - DNA, 18 bp, Homo sapiens
atcaagatgtcagactgg

SEQ ID NO: 2726072 - DNA, 13 bp, Homo sapiens
atcaagcccttta

SEQ ID NO: 2726073 - DNA, 13 bp, Homo sapiens
atcaagtctgtga

SEQ ID NO: 2726074 - DNA, 19 bp, Homo sapiens
atcaattttttaaaccact

SEQ ID NO: 2726075 - DNA, 14 bp, Homo sapiens
atcacaaaagctgt

SEQ ID NO: 2726076 - DNA, 15 bp, Homo sapiens
atcacaaaagctgtg

SEQ ID NO: 2726077 - DNA, 12 bp, Homo sapiens
atcacagggcag

SEQ ID NO: 2726078 - DNA, 18 bp, Homo sapiens
atcactggtatacacact

SEQ ID NO: 2726079 - DNA, 20 bp, Homo sapiens
atcagaagtaactcccactc

SEQ ID NO: 2726080 - DNA, 15 bp, Homo sapiens
atcagattcaggagc

SEQ ID NO: 2726081 - DNA, 13 bp, Homo sapiens
atcagtgtgcccc

SEQ ID NO: 2726082 - DNA, 14 bp, Homo sapiens
atcagtgtgccccc

SEQ ID NO: 2726083 - DNA, 13 bp, Homo sapiens
atcatataagcaa

SEQ ID NO: 2726084 - DNA, 14 bp, Homo sapiens
atcatataagcaag

SEQ ID NO: 2726085 - DNA, 13 bp, Homo sapiens
atcatattaatta

SEQ ID NO: 2726086 - DNA, 17 bp, Homo sapiens
atcatattatttttaaa

SEQ ID NO: 2726087 - DNA, 19 bp, Homo sapiens
atcatcaggtttactcagt

SEQ ID NO: 2726088 - DNA, 23 bp, Homo sapiens
atcatcccatctaagctgcagct

SEQ ID NO: 2726089 - DNA, 19 bp, Homo sapiens
atcatctttatctcctggg

SEQ ID NO: 2726090 - DNA, 19 bp, Homo sapiens
atcattggtatctgatatc

SEQ ID NO: 2726091 - DNA, 18 bp, Homo sapiens
atccaaatgctgtgcaaa

SEQ ID NO: 2726092 - DNA, 22 bp, Homo sapiens
atccaaatgctgtgcaaacagt

SEQ ID NO: 2726093 - DNA, 20 bp, Homo sapiens
atccaaccccccacctgcca

SEQ ID NO: 2726094 - DNA, 13 bp, Homo sapiens
atccaactcctct

SEQ ID NO: 2726095 - DNA, 14 bp, Homo sapiens
atccacaagccatt

SEQ ID NO: 2726096 - DNA, 13 bp, Homo sapiens
atccaggcttctc

SEQ ID NO: 2726097 - DNA, 14 bp, Homo sapiens
atccaggcttctcc

SEQ ID NO: 2726098 - DNA, 18 bp, Homo sapiens
atccaggcttctcccgga

SEQ ID NO: 2726099 - DNA, 17 bp, Homo sapiens
atccagtagggaaaata

SEQ ID NO: 2726100 - DNA, 17 bp, Homo sapiens
atccatgtgctgctgtg

SEQ ID NO: 2726101 - DNA, 18 bp, Homo sapiens
atccatttggcagaactg

SEQ ID NO: 2726102 - DNA, 20 bp, Homo sapiens
atccatttggcagaactgct

SEQ ID NO: 2726103 - DNA, 15 bp, Homo sapiens
atcccaagtgccagt

SEQ ID NO: 2726104 - DNA, 14 bp, Homo sapiens
atcccaagtgtctc

SEQ ID NO: 2726105 - DNA, 21 bp, Homo sapiens
atcccaagtgtctcttgactg

SEQ ID NO: 2726106 - DNA, 20 bp, Homo sapiens
atcccatctaagctgcagct

SEQ ID NO: 2726107 - DNA, 14 bp, Homo sapiens
atcccccctcacca

SEQ ID NO: 2726108 - DNA, 22 bp, Homo sapiens
atcccctgtcccctggggctgg

SEQ ID NO: 2726109 - DNA, 16 bp, Homo sapiens
atccctttttttacat

SEQ ID NO: 2726110 - DNA, 18 bp, Homo sapiens
atcctcaggtagtactgg

SEQ ID NO: 2726111 - DNA, 17 bp, Homo sapiens
atcctccccaccagagc

SEQ ID NO: 2726112 - DNA, 22 bp, Homo sapiens
atcctccccaccagagctgcct

SEQ ID NO: 2726113 - DNA, 12 bp, Homo sapiens
atcctcctcctc

SEQ ID NO: 2726114 - DNA, 14 bp, Homo sapiens
atcctcctcctcat

SEQ ID NO: 2726115 - DNA, 16 bp, Homo sapiens
atcctcctcctcattc

SEQ ID NO: 2726116 - DNA, 22 bp, Homo sapiens
atcctcctcctcattcagacca

SEQ ID NO: 2726117 - DNA, 12 bp, Homo sapiens
atcctcctctcc

SEQ ID NO: 2726118 - DNA, 14 bp, Homo sapiens
atcctcctctccat

SEQ ID NO: 2726119 - DNA, 20 bp, Homo sapiens
atcctcctctccatgcaagt

SEQ ID NO: 2726120 - DNA, 13 bp, Homo sapiens
atcctggcccatc

SEQ ID NO: 2726121 - DNA, 14 bp, Homo sapiens
atcctggcccatca

SEQ ID NO: 2726122 - DNA, 16 bp, Homo sapiens
atcctggcccatcagt

SEQ ID NO: 2726123 - DNA, 11 bp, Homo sapiens
atcctggctgg

SEQ ID NO: 2726124 - DNA, 23 bp, Homo sapiens
atcctgggcatgatgggccgagc

SEQ ID NO: 2726125 - DNA, 22 bp, Homo sapiens
gacatttctatcttgaatttca

SEQ ID NO: 2726126 - DNA, 20 bp, Homo sapiens
gaccacagcaaggcacctgc

SEQ ID NO: 2726127 - DNA, 23 bp, Homo sapiens
gaccactgggcccctcaggggaa

SEQ ID NO: 2726128 - DNA, 23 bp, Homo sapiens
gaccagaatcagattcaggagct

SEQ ID NO: 2726129 - DNA, 12 bp, Homo sapiens
gaccagcctggc

SEQ ID NO: 2726130 - DNA, 21 bp, Homo sapiens
gaccagctaattggtccaacc

SEQ ID NO: 2726131 - DNA, 22 bp, Homo sapiens
gaccaggtcttgttcaagcagc

SEQ ID NO: 2726132 - DNA, 17 bp, Homo sapiens
gacccagtgtgtgctca

SEQ ID NO: 2726133 - DNA, 19 bp, Homo sapiens
gacccagtgtgtgctcagc

SEQ ID NO: 2726134 - DNA, 23 bp, Homo sapiens
gacccagtgtgtgctcagcagcc

SEQ ID NO: 2726135 - DNA, 17 bp, Homo sapiens
gacccatttcaggaggt

SEQ ID NO: 2726136 - DNA, 18 bp, Homo sapiens
gaccccatctgcccagga

SEQ ID NO: 2726137 - DNA, 18 bp, Homo sapiens
gacccccactgccgcctc

SEQ ID NO: 2726138 - DNA, 18 bp, Homo sapiens
gaccccttttcagcttct

SEQ ID NO: 2726139 - DNA, 20 bp, Homo sapiens
gaccccttttcagcttctgc

SEQ ID NO: 2726140 - DNA, 18 bp, Homo sapiens
gacccggattggccctgc

SEQ ID NO: 2726141 - DNA, 19 bp, Homo sapiens
gacccggattggccctgcc

SEQ ID NO: 2726142 - DNA, 20 bp, Homo sapiens
gacccggattggccctgccc

SEQ ID NO: 2726143 - DNA, 22 bp, Homo sapiens
gacccggattggccctgcccct

SEQ ID NO: 2726144 - DNA, 14 bp, Homo sapiens
gaccctacagacag

SEQ ID NO: 2726145 - DNA, 20 bp, Homo sapiens
gaccgccgcttccagcttcc

SEQ ID NO: 2726146 - DNA, 23 bp, Homo sapiens
gaccgtgatttggaagagaggca

SEQ ID NO: 2726147 - DNA, 15 bp, Homo sapiens
gacctccagtcctgc

SEQ ID NO: 2726148 - DNA, 19 bp, Homo sapiens
gacctccagtcctgctggc

SEQ ID NO: 2726149 - DNA, 20 bp, Homo sapiens
gacctctgaatgtcccagag

SEQ ID NO: 2726150 - DNA, 21 bp, Homo sapiens
gacctgccccgcccagctgca

SEQ ID NO: 2726151 - DNA, 17 bp, Homo sapiens
gacctggactagggcct

SEQ ID NO: 2726152 - DNA, 18 bp, Homo sapiens
gacctggactagggcctc

SEQ ID NO: 2726153 - DNA, 19 bp, Homo sapiens
gacctggactagggcctcg

SEQ ID NO: 2726154 - DNA, 15 bp, Homo sapiens
gacctggagctgcca

SEQ ID NO: 2726155 - DNA, 14 bp, Homo sapiens
gaccttacaaccac

SEQ ID NO: 2726156 - DNA, 24 bp, Homo sapiens
gaccttctccagggacagaagcag

SEQ ID NO: 2726157 - DNA, 21 bp, Homo sapiens
gacggactcagactcctggct

SEQ ID NO: 2726158 - DNA, 22 bp, Homo sapiens
gacggactcagactcctggctt

SEQ ID NO: 2726159 - DNA, 11 bp, Homo sapiens
gacgtcctgga

SEQ ID NO: 2726160 - DNA, 18 bp, Homo sapiens
gacgtgcacctgtactca

SEQ ID NO: 2726161 - DNA, 17 bp, Homo sapiens
gacgttggttctgcact

SEQ ID NO: 2726162 - DNA, 17 bp, Homo sapiens
gactagattctcacctg

SEQ ID NO: 2726163 - DNA, 16 bp, Homo sapiens
gactatttaagtacta

SEQ ID NO: 2726164 - DNA, 15 bp, Homo sapiens
gactcagactcctgg

SEQ ID NO: 2726165 - DNA, 11 bp, Homo sapiens
gactcattcac

SEQ ID NO: 2726166 - DNA, 15 bp, Homo sapiens
gactccagcacgttt

SEQ ID NO: 2726167 - DNA, 19 bp, Homo sapiens
gactcctggcttcatgtgg

SEQ ID NO: 2726168 - DNA, 15 bp, Homo sapiens
gactcgggctcctgt

SEQ ID NO: 2726169 - DNA, 17 bp, Homo sapiens
gactcgggctcctgtgc

SEQ ID NO: 2726170 - DNA, 14 bp, Homo sapiens
gactctctgcctgc

SEQ ID NO: 2726171 - DNA, 23 bp, Homo sapiens
gactctgcagatagtgcctctgc

SEQ ID NO: 2726172 - DNA, 17 bp, Homo sapiens
gactctgtggggccttg

SEQ ID NO: 2726173 - DNA, 22 bp, Homo sapiens
gactcttcctttatcccctcct

SEQ ID NO: 2726174 - DNA, 23 bp, Homo sapiens
gactcttcctttatcccctcctt

SEQ ID NO: 2726175 - DNA, 18 bp, Homo sapiens
gactgcaagaggctcctg

SEQ ID NO: 2726176 - DNA, 16 bp, Homo sapiens
gactgcggagcagcct

SEQ ID NO: 2726177 - DNA, 23 bp, Homo sapiens
gactgcggagcagcctccagtgc

SEQ ID NO: 2726178 - DNA, 14 bp, Homo sapiens
gactgctgacccac

SEQ ID NO: 2726179 - DNA, 12 bp, Homo sapiens
gactgctgggac

SEQ ID NO: 2726180 - DNA, 13 bp, Homo sapiens
gactggctcaaga

SEQ ID NO: 2726181 - DNA, 15 bp, Homo sapiens
gactgtaagcagatt

SEQ ID NO: 2726182 - DNA, 21 bp, Homo sapiens
gactgtaagcagattacaata

SEQ ID NO: 2726183 - DNA, 14 bp, Homo sapiens
gacttagtttttat

SEQ ID NO: 2726184 - DNA, 17 bp, Homo sapiens
gacttcactgcagcctt

SEQ ID NO: 2726185 - DNA, 24 bp, Homo sapiens
gacttcaggagctgacagagccag

SEQ ID NO: 2726186 - DNA, 18 bp, Homo sapiens
gacttcaggggctgcccg

SEQ ID NO: 2726187 - DNA, 19 bp, Homo sapiens
gacttcaggggctgcccgc

SEQ ID NO: 2726188 - DNA, 18 bp, Homo sapiens
gacttcctcgcctctccc

SEQ ID NO: 2726189 - DNA, 16 bp, Homo sapiens
gacttttctaaagctc

SEQ ID NO: 2726190 - DNA, 14 bp, Homo sapiens
gacttttgaagaac

SEQ ID NO: 2726191 - DNA, 15 bp, Homo sapiens
gagaaaactgagagg

SEQ ID NO: 2726192 - DNA, 19 bp, Homo sapiens
gagaaaagcacaatcaact

SEQ ID NO: 2726193 - DNA, 19 bp, Homo sapiens
gagaacatggtgtgtgtct

SEQ ID NO: 2726194 - DNA, 21 bp, Homo sapiens
gagaaggagggttgtgcccac

SEQ ID NO: 2726195 - DNA, 16 bp, Homo sapiens
gagaaggcctcccctg

SEQ ID NO: 2726196 - DNA, 13 bp, Homo sapiens
gagaccagcctgg

SEQ ID NO: 2726197 - DNA, 14 bp, Homo sapiens
gagaccctacagac

SEQ ID NO: 2726198 - DNA, 16 bp, Homo sapiens
gagaccctacagacag

SEQ ID NO: 2726199 - DNA, 16 bp, Homo sapiens
gagacctttgcccaca

SEQ ID NO: 2726200 - DNA, 19 bp, Homo sapiens
gagactagattctcacctg

SEQ ID NO: 2726201 - DNA, 20 bp, Homo sapiens
gagactatgcgtttttataa

SEQ ID NO: 2726202 - DNA, 14 bp, Homo sapiens
gagactatttaagt

SEQ ID NO: 2726203 - DNA, 18 bp, Homo sapiens
gagagaccctacagacag

SEQ ID NO: 2726204 - DNA, 11 bp, Homo sapiens
gagagcagctg

SEQ ID NO: 2726205 - DNA, 12 bp, Homo sapiens
gagagcagctgg

SEQ ID NO: 2726206 - DNA, 16 bp, Homo sapiens
gagagcagcttctgcc

SEQ ID NO: 2726207 - DNA, 11 bp, Homo sapiens
gagagcccagc

SEQ ID NO: 2726208 - DNA, 13 bp, Homo sapiens
gagagcccagcca

SEQ ID NO: 2726209 - DNA, 16 bp, Homo sapiens
gagaggtagcgagctg

SEQ ID NO: 2726210 - DNA, 18 bp, Homo sapiens
gagaggtagcgagctgct

SEQ ID NO: 2726211 - DNA, 22 bp, Homo sapiens
gagatagacgggttgaaagaca

SEQ ID NO: 2726212 - DNA, 11 bp, Homo sapiens
gagatatttac

SEQ ID NO: 2726213 - DNA, 16 bp, Homo sapiens
gagatcacgccactgc

SEQ ID NO: 2726214 - DNA, 12 bp, Homo sapiens
gagatgaaaacc

SEQ ID NO: 2726215 - DNA, 16 bp, Homo sapiens
gagatgactgagtcct

SEQ ID NO: 2726216 - DNA, 21 bp, Homo sapiens
gagatgactgagtcctcgtag

SEQ ID NO: 2726217 - DNA, 15 bp, Homo sapiens
gagatggaagagtca

SEQ ID NO: 2726218 - DNA, 20 bp, Homo sapiens
gagattctttaaggagatag

SEQ ID NO: 2726219 - DNA, 14 bp, Homo sapiens
gagattgctctggg

SEQ ID NO: 2726220 - DNA, 14 bp, Homo sapiens
gagcaaagtctaaa

SEQ ID NO: 2726221 - DNA, 19 bp, Homo sapiens
gagcaaagtctaaagttta

SEQ ID NO: 2726222 - DNA, 15 bp, Homo sapiens
gagcaactcctgttc

SEQ ID NO: 2726223 - DNA, 15 bp, Homo sapiens
gagcaactctccact

SEQ ID NO: 2726224 - DNA, 15 bp, Homo sapiens
gagcaagagaacatt

SEQ ID NO: 2726225 - DNA, 20 bp, Homo sapiens
gagcaaggacaacctgcccc

SEQ ID NO: 2726226 - DNA, 15 bp, Homo sapiens
gagcacagccctccc

SEQ ID NO: 2726227 - DNA, 18 bp, Homo sapiens
gagcacagccctcccgcc

SEQ ID NO: 2726228 - DNA, 20 bp, Homo sapiens
gagcacagccctcccgcccc

SEQ ID NO: 2726229 - DNA, 11 bp, Homo sapiens
gagcagctggc

SEQ ID NO: 2726230 - DNA, 14 bp, Homo sapiens
gagcagctggctct

SEQ ID NO: 2726231 - DNA, 17 bp, Homo sapiens
gagcagctggctctcca

SEQ ID NO: 2726232 - DNA, 15 bp, Homo sapiens
gagcagcttcagttg

SEQ ID NO: 2726233 - DNA, 16 bp, Homo sapiens
gagcagcttctgccac

SEQ ID NO: 2726234 - DNA, 20 bp, Homo sapiens
gagcagcttctgccacttcc

SEQ ID NO: 2726235 - DNA, 16 bp, Homo sapiens
gagcaggggcagggtg

SEQ ID NO: 2726236 - DNA, 23 bp, Homo sapiens
gccactccccagtgctcctgtgc

SEQ ID NO: 2726237 - DNA, 13 bp, Homo sapiens
gccactctgctgc

SEQ ID NO: 2726238 - DNA, 22 bp, Homo sapiens
gccactctgctgcctgtacaga

SEQ ID NO: 2726239 - DNA, 17 bp, Homo sapiens
gccactgaagctgggat

SEQ ID NO: 2726240 - DNA, 13 bp, Homo sapiens
gccacttcccagg

SEQ ID NO: 2726241 - DNA, 15 bp, Homo sapiens
gccacttcccaggta

SEQ ID NO: 2726242 - DNA, 12 bp, Homo sapiens
gccagcagcaga

SEQ ID NO: 2726243 - DNA, 20 bp, Homo sapiens
gccagcaggcagcgcctgtc

SEQ ID NO: 2726244 - DNA, 15 bp, Homo sapiens
gccagccccacagcc

SEQ ID NO: 2726245 - DNA, 17 bp, Homo sapiens
gccagccccacagccca

SEQ ID NO: 2726246 - DNA, 20 bp, Homo sapiens
gccagccctggaggctggat

SEQ ID NO: 2726247 - DNA, 11 bp, Homo sapiens
gccagcctggc

SEQ ID NO: 2726248 - DNA, 18 bp, Homo sapiens
gccagcctggcttctgga

SEQ ID NO: 2726249 - DNA, 19 bp, Homo sapiens
gccagcctggcttctggag

SEQ ID NO: 2726250 - DNA, 20 bp, Homo sapiens
gccagcctggcttctggagc

SEQ ID NO: 2726251 - DNA, 21 bp, Homo sapiens
gccagcctggcttctggagcc

SEQ ID NO: 2726252 - DNA, 20 bp, Homo sapiens
gccagctctgtcaccctggc

SEQ ID NO: 2726253 - DNA, 21 bp, Homo sapiens
gccagctctgtcaccctggcc

SEQ ID NO: 2726254 - DNA, 22 bp, Homo sapiens
gccagctctgtcaccctggcca

SEQ ID NO: 2726255 - DNA, 23 bp, Homo sapiens
gccagctctgtcaccctggccac

SEQ ID NO: 2726256 - DNA, 17 bp, Homo sapiens
gccagggcacagctgga

SEQ ID NO: 2726257 - DNA, 15 bp, Homo sapiens
gccagggccctgcag

SEQ ID NO: 2726258 - DNA, 15 bp, Homo sapiens
gccaggttggaaaag

SEQ ID NO: 2726259 - DNA, 11 bp, Homo sapiens
gccagtcaccc

SEQ ID NO: 2726260 - DNA, 19 bp, Homo sapiens
gccagtcctagagctcctg

SEQ ID NO: 2726261 - DNA, 22 bp, Homo sapiens
gccagtcctagagctcctgtcc

SEQ ID NO: 2726262 - DNA, 15 bp, Homo sapiens
gccagtcgcgctgcc

SEQ ID NO: 2726263 - DNA, 15 bp, Homo sapiens
gccagtttagagttc

SEQ ID NO: 2726264 - DNA, 13 bp, Homo sapiens
gccatactggcct

SEQ ID NO: 2726265 - DNA, 17 bp, Homo sapiens
gccatactggcctcgcc

SEQ ID NO: 2726266 - DNA, 16 bp, Homo sapiens
gccatattcacacctc

SEQ ID NO: 2726267 - DNA, 19 bp, Homo sapiens
gccatattctaaattcact

SEQ ID NO: 2726268 - DNA, 11 bp, Homo sapiens
gccatctcctc

SEQ ID NO: 2726269 - DNA, 13 bp, Homo sapiens
gccatctcctccc

SEQ ID NO: 2726270 - DNA, 16 bp, Homo sapiens
gccatggcgtgtccct

SEQ ID NO: 2726271 - DNA, 13 bp, Homo sapiens
gccatgggcctgc

SEQ ID NO: 2726272 - DNA, 16 bp, Homo sapiens
gccatgggcctgctgc

SEQ ID NO: 2726273 - DNA, 17 bp, Homo sapiens
gccatgggtcctcggcc

SEQ ID NO: 2726274 - DNA, 22 bp, Homo sapiens
gccatgtgcacctatggcccag

SEQ ID NO: 2726275 - DNA, 16 bp, Homo sapiens
gccatgtgttccaagg

SEQ ID NO: 2726276 - DNA, 23 bp, Homo sapiens
gccatttgcaccctccgccttca

SEQ ID NO: 2726277 - DNA, 17 bp, Homo sapiens
gccattttttgaggaga

SEQ ID NO: 2726278 - DNA, 15 bp, Homo sapiens
gcccaatccaggccc

SEQ ID NO: 2726279 - DNA, 16 bp, Homo sapiens
gcccaatccaggcccg

SEQ ID NO: 2726280 - DNA, 14 bp, Homo sapiens
gcccacacacactc

SEQ ID NO: 2726281 - DNA, 19 bp, Homo sapiens
gcccacacacactccttcc

SEQ ID NO: 2726282 - DNA, 20 bp, Homo sapiens
gcccacacacactccttccc

SEQ ID NO: 2726283 - DNA, 21 bp, Homo sapiens
gcccacacacactccttcccc

SEQ ID NO: 2726284 - DNA, 21 bp, Homo sapiens
gcccacagctctgctggaaga

SEQ ID NO: 2726285 - DNA, 17 bp, Homo sapiens
gcccaccgcatgccccc

SEQ ID NO: 2726286 - DNA, 20 bp, Homo sapiens
gcccaccgcatgccccctcg

SEQ ID NO: 2726287 - DNA, 13 bp, Homo sapiens
gcccacgtcctgt

SEQ ID NO: 2726288 - DNA, 15 bp, Homo sapiens
gcccacgtcctgtca

SEQ ID NO: 2726289 - DNA, 15 bp, Homo sapiens
gcccagagggcccag

SEQ ID NO: 2726290 - DNA, 21 bp, Homo sapiens
gcccagccattaccatggaga

SEQ ID NO: 2726291 - DNA, 23 bp, Homo sapiens
gcccagccattaccatggagaca

SEQ ID NO: 2726292 - DNA, 16 bp, Homo sapiens
gcccagctgaggctgg

SEQ ID NO: 2726293 - DNA, 23 bp, Homo sapiens
gcccagctgcacctgccagcctg

SEQ ID NO: 2726294 - DNA, 24 bp, Homo sapiens
gcccagctgcacctgccagcctgg

SEQ ID NO: 2726295 - DNA, 22 bp, Homo sapiens
gcccaggagtttgaggctgcag

SEQ ID NO: 2726296 - DNA, 19 bp, Homo sapiens
gcccaggccatcttccagg

SEQ ID NO: 2726297 - DNA, 18 bp, Homo sapiens
gcccaggctggccagccc

SEQ ID NO: 2726298 - DNA, 19 bp, Homo sapiens
gcccaggctggccagcccc

SEQ ID NO: 2726299 - DNA, 21 bp, Homo sapiens
gcccatcagtgtacccccgcc

SEQ ID NO: 2726300 - DNA, 17 bp, Homo sapiens
gcccatcccccctcacc

SEQ ID NO: 2726301 - DNA, 18 bp, Homo sapiens
gcccatctgtccatcctc

SEQ ID NO: 2726302 - DNA, 15 bp, Homo sapiens
gcccatgggcactgc

SEQ ID NO: 2726303 - DNA, 16 bp, Homo sapiens
gcccatgggcactgct

SEQ ID NO: 2726304 - DNA, 16 bp, Homo sapiens
gcccattcctcacctt

SEQ ID NO: 2726305 - DNA, 18 bp, Homo sapiens
gccccacagcccacgtcc

SEQ ID NO: 2726306 - DNA, 23 bp, Homo sapiens
gccccacagcccacgtcctgtca

SEQ ID NO: 2726307 - DNA, 10 bp, Homo sapiens
gccccagcct

SEQ ID NO: 2726308 - DNA, 17 bp, Homo sapiens
gccccagcctggcccag

SEQ ID NO: 2726309 - DNA, 21 bp, Homo sapiens
gccccagcctggcccagctcc

SEQ ID NO: 2726310 - DNA, 22 bp, Homo sapiens
gccccagcctggcccagctccc

SEQ ID NO: 2726311 - DNA, 22 bp, Homo sapiens
gcccccagagacctttgcccac

SEQ ID NO: 2726312 - DNA, 23 bp, Homo sapiens
gccccccacctttgggatcagcc

SEQ ID NO: 2726313 - DNA, 15 bp, Homo sapiens
gccccccatcctggc

SEQ ID NO: 2726314 - DNA, 12 bp, Homo sapiens
gccccctcgtgc

SEQ ID NO: 2726315 - DNA, 23 bp, Homo sapiens
gccccctggtggacagtcctggg

SEQ ID NO: 2726316 - DNA, 14 bp, Homo sapiens
gccccgggctgacc

SEQ ID NO: 2726317 - DNA, 23 bp, Homo sapiens
gcccctcaggggaagctgctagg

SEQ ID NO: 2726318 - DNA, 16 bp, Homo sapiens
gcccctccccagccct

SEQ ID NO: 2726319 - DNA, 17 bp, Homo sapiens
gcccctccccctaccgc

SEQ ID NO: 2726320 - DNA, 11 bp, Homo sapiens
gtctgggctga

SEQ ID NO: 2726321 - DNA, 17 bp, Homo sapiens
gtctgtccaacccctcc

SEQ ID NO: 2726322 - DNA, 21 bp, Homo sapiens
gtctgtccaacccctccccca

SEQ ID NO: 2726323 - DNA, 14 bp, Homo sapiens
gtctgtctttgcaa

SEQ ID NO: 2726324 - DNA, 14 bp, Homo sapiens
gtcttccaacccca

SEQ ID NO: 2726325 - DNA, 21 bp, Homo sapiens
gtcttccaaccccagctggcc

SEQ ID NO: 2726326 - DNA, 15 bp, Homo sapiens
gtcttcttgtgtcct

SEQ ID NO: 2726327 - DNA, 16 bp, Homo sapiens
gtcttcttgtgtcctg

SEQ ID NO: 2726328 - DNA, 19 bp, Homo sapiens
gtcttcttgtgtcctgatg

SEQ ID NO: 2726329 - DNA, 16 bp, Homo sapiens
gtctttctttgctgct

SEQ ID NO: 2726330 - DNA, 21 bp, Homo sapiens
gtgaaaaatgagcttgtaaat

SEQ ID NO: 2726331 - DNA, 13 bp, Homo sapiens
gtgaaattatttt

SEQ ID NO: 2726332 - DNA, 14 bp, Homo sapiens
gtgaccatgaaaaa

SEQ ID NO: 2726333 - DNA, 19 bp, Homo sapiens
gtgaccccttttcagcttc

SEQ ID NO: 2726334 - DNA, 20 bp, Homo sapiens
gtgaccccttttcagcttct

SEQ ID NO: 2726335 - DNA, 23 bp, Homo sapiens
gtgacctgccccgcccagctgca

SEQ ID NO: 2726336 - DNA, 21 bp, Homo sapiens
gtgacggtcctttaggcagcc

SEQ ID NO: 2726337 - DNA, 14 bp, Homo sapiens
gtgactctacctgc

SEQ ID NO: 2726338 - DNA, 17 bp, Homo sapiens
gtgacttgcctggggcc

SEQ ID NO: 2726339 - DNA, 14 bp, Homo sapiens
gtgacttttgaaga

SEQ ID NO: 2726340 - DNA, 16 bp, Homo sapiens
gtgagaccctgttcta

SEQ ID NO: 2726341 - DNA, 14 bp, Homo sapiens
gtgagactctgagg

SEQ ID NO: 2726342 - DNA, 14 bp, Homo sapiens
gtgaggcccagcct

SEQ ID NO: 2726343 - DNA, 15 bp, Homo sapiens
gtgaggcccagcctg

SEQ ID NO: 2726344 - DNA, 16 bp, Homo sapiens
gtgaggcccagcctgt

SEQ ID NO: 2726345 - DNA, 17 bp, Homo sapiens
gtgaggtgacttgcctg

SEQ ID NO: 2726346 - DNA, 21 bp, Homo sapiens
gtgatacaactgagtctcgag

SEQ ID NO: 2726347 - DNA, 21 bp, Homo sapiens
gtgatatggtactaaggagaa

SEQ ID NO: 2726348 - DNA, 19 bp, Homo sapiens
gtgatattgaccatgtgat

SEQ ID NO: 2726349 - DNA, 14 bp, Homo sapiens
gtgatctcacttaa

SEQ ID NO: 2726350 - DNA, 20 bp, Homo sapiens
gtgatttggaagagaggcac

SEQ ID NO: 2726351 - DNA, 23 bp, Homo sapiens
gtgatttggaagagaggcacctg

SEQ ID NO: 2726352 - DNA, 22 bp, Homo sapiens
gtgcaatggcacgatctcagct

SEQ ID NO: 2726353 - DNA, 17 bp, Homo sapiens
gtgcaattaactctgga

SEQ ID NO: 2726354 - DNA, 21 bp, Homo sapiens
gtgcacctatggcccagccac

SEQ ID NO: 2726355 - DNA, 20 bp, Homo sapiens
gtgcagaacaggggcaccct

SEQ ID NO: 2726356 - DNA, 15 bp, Homo sapiens
gtgcatcagaaaatg

SEQ ID NO: 2726357 - DNA, 21 bp, Homo sapiens
gtgccaccctgggctctgtgg

SEQ ID NO: 2726358 - DNA, 15 bp, Homo sapiens
gtgccagtcgcgctg

SEQ ID NO: 2726359 - DNA, 18 bp, Homo sapiens
gtgccagtcgcgctgcct

SEQ ID NO: 2726360 - DNA, 20 bp, Homo sapiens
gtgcccatgggcactgctgg

SEQ ID NO: 2726361 - DNA, 17 bp, Homo sapiens
gtgcccattcctcacct

SEQ ID NO: 2726362 - DNA, 20 bp, Homo sapiens
gtgccccccatcctggccca

SEQ ID NO: 2726363 - DNA, 22 bp, Homo sapiens
gtgccccccatcctggcccatc

SEQ ID NO: 2726364 - DNA, 20 bp, Homo sapiens
gtgccctccacagccgcagc

SEQ ID NO: 2726365 - DNA, 17 bp, Homo sapiens
gtgccgccgcctcgccc

SEQ ID NO: 2726366 - DNA, 16 bp, Homo sapiens
gtgcctcagtgctgca

SEQ ID NO: 2726367 - DNA, 19 bp, Homo sapiens
gtgcctgattcggctgtct

SEQ ID NO: 2726368 - DNA, 11 bp, Homo sapiens
gtgcctgcagc

SEQ ID NO: 2726369 - DNA, 15 bp, Homo sapiens
gtgcctgtctgtcca

SEQ ID NO: 2726370 - DNA, 16 bp, Homo sapiens
gtgcctgtctgtccaa

SEQ ID NO: 2726371 - DNA, 18 bp, Homo sapiens
gtgcgaccccatctgccc

SEQ ID NO: 2726372 - DNA, 18 bp, Homo sapiens
gtgctcacgactcttcct

SEQ ID NO: 2726373 - DNA, 16 bp, Homo sapiens
gtgctcagcagcccca

SEQ ID NO: 2726374 - DNA, 16 bp, Homo sapiens
gtgctcccaccaggca

SEQ ID NO: 2726375 - DNA, 23 bp, Homo sapiens
gtgctcccacggggaccactggg

SEQ ID NO: 2726376 - DNA, 19 bp, Homo sapiens
gtgctcgcctctgcccagc

SEQ ID NO: 2726377 - DNA, 18 bp, Homo sapiens
gtgctctgcctctaactc

SEQ ID NO: 2726378 - DNA, 15 bp, Homo sapiens
gtgctgctaccctcc

SEQ ID NO: 2726379 - DNA, 14 bp, Homo sapiens
gtgctggctgctgg

SEQ ID NO: 2726380 - DNA, 11 bp, Homo sapiens
gtgctgtggcc

SEQ ID NO: 2726381 - DNA, 17 bp, Homo sapiens
gtgctgtttgggcagga

SEQ ID NO: 2726382 - DNA, 13 bp, Homo sapiens
gtgcttcttgtaa

SEQ ID NO: 2726383 - DNA, 15 bp, Homo sapiens
gtgcttcttgtaata

SEQ ID NO: 2726384 - DNA, 19 bp, Homo sapiens
gtggaaaggattctaaaca

SEQ ID NO: 2726385 - DNA, 19 bp, Homo sapiens
gtggaagtagtggagcccc

SEQ ID NO: 2726386 - DNA, 14 bp, Homo sapiens
gtggacagtcctgg

SEQ ID NO: 2726387 - DNA, 19 bp, Homo sapiens
gtggactctctgcctgctt

SEQ ID NO: 2726388 - DNA, 24 bp, Homo sapiens
gtggactctctgcctgcttcctgg

SEQ ID NO: 2726389 - DNA, 18 bp, Homo sapiens
gtggcagccgcctccctt

SEQ ID NO: 2726390 - DNA, 14 bp, Homo sapiens
gtggccccagcctg

SEQ ID NO: 2726391 - DNA, 20 bp, Homo sapiens
gtggccccagcctggcccag

SEQ ID NO: 2726392 - DNA, 14 bp, Homo sapiens
gtggcctgggcaag

SEQ ID NO: 2726393 - DNA, 21 bp, Homo sapiens
gtggctgggaagggaaggaag

SEQ ID NO: 2726394 - DNA, 15 bp, Homo sapiens
gtgggagagcccagc

SEQ ID NO: 2726395 - DNA, 12 bp, Homo sapiens
gtgggagatgaa

SEQ ID NO: 2726396 - DNA, 14 bp, Homo sapiens
gtgggcccaacagg

SEQ ID NO: 2726397 - DNA, 18 bp, Homo sapiens
gtgggcgggcagcacagc

SEQ ID NO: 2726398 - DNA, 19 bp, Homo sapiens
gtgggctgcactctgtgcc

SEQ ID NO: 2726399 - DNA, 20 bp, Homo sapiens
gtgggctgcactctgtgccc

SEQ ID NO: 2726400 - DNA, 23 bp, Homo sapiens
gtggggaagcaagacgtcctgga

SEQ ID NO: 2726401 - DNA, 14 bp, Homo sapiens
gtggggcctgatgg

SEQ ID NO: 2726402 - DNA, 19 bp, Homo sapiens
gtgggggaagagcacagcc

SEQ ID NO: 2726403 - DNA, 16 bp, Homo sapiens
gtggggggagggcacc

SEQ ID NO: 2726404 - DNA, 16 bp, Homo sapiens
gtggtcccacccagga

SEQ ID NO: 2726405 - DNA, 20 bp, Homo sapiens
gtggtggggaccagctaatt

SEQ ID NO: 2726406 - DNA, 20 bp, Homo sapiens
gtggtttctacggtgacagt

SEQ ID NO: 2726407 - DNA, 13 bp, Homo sapiens
gtgtaatattctc

SEQ ID NO: 2726408 - DNA, 18 bp, Homo sapiens
gtgtaccacaccctgcct

SEQ ID NO: 2726409 - DNA, 22 bp, Homo sapiens
gtgtaccacaccctgcctgctg

SEQ ID NO: 2726410 - DNA, 17 bp, Homo sapiens
gtgtagccttgcccgga

SEQ ID NO: 2726411 - DNA, 21 bp, Homo sapiens
gtgtatgagaagtactttgtg

SEQ ID NO: 2726412 - DNA, 18 bp, Homo sapiens
gtgtcaactttcatttga

SEQ ID NO: 2726413 - DNA, 15 bp, Homo sapiens
gtgtcaccctgcaga

SEQ ID NO: 2726414 - DNA, 13 bp, Homo sapiens
gtgtcactggctg

SEQ ID NO: 2726415 - DNA, 18 bp, Homo sapiens
gtgttgcgtgtcgtgggt

SEQ ID NO: 2726416 - DNA, 23 bp, Homo sapiens
gtgttgggtcctctgcttcctga

SEQ ID NO: 2726417 - DNA, 22 bp, Homo sapiens
gtgtttgtataccatgatgcat

SEQ ID NO: 2726418 - DNA, 15 bp, Homo sapiens
gttaaagctgccggc

SEQ ID NO: 2726419 - DNA, 22 bp, Homo sapiens
gttaaatgccttggtttgattt

SEQ ID NO: 2726420 - DNA, 19 bp, Homo sapiens
gttaattgattaaaatctg

SEQ ID NO: 2726421 - DNA, 21 bp, Homo sapiens
gttagagaggtagcgagctgc

SEQ ID NO: 2726422 - DNA, 22 bp, Homo sapiens
gttagagaggtagcgagctgct

SEQ ID NO: 2726423 - DNA, 11 bp, Homo sapiens
gttagcaaaga

SEQ ID NO: 2726424 - DNA, 20 bp, Homo sapiens
gttagctcaggaggcttgga

SEQ ID NO: 2726425 - DNA, 16 bp, Homo sapiens
gttaggaagttacctg

SEQ ID NO: 2726426 - DNA, 15 bp, Homo sapiens
gttaggagttcgaga

SEQ ID NO: 2726427 - DNA, 15 bp, Homo sapiens
gttaggcctggcaca

SEQ ID NO: 2726428 - DNA, 19 bp, Homo sapiens
gttataaagccttctaaaa

SEQ ID NO: 2726429 - DNA, 13 bp, Homo sapiens
gttatttgtacag

SEQ ID NO: 2726430 - DNA, 14 bp, Homo sapiens
gttatttgtacagt

SEQ ID NO: 2726431 - DNA, 20 bp, Homo sapiens
gttcacaccattctcctgcc

SEQ ID NO: 2726432 - DNA, 18 bp, Homo sapiens
gttcagaattttggaaaa

SEQ ID NO: 2726433 - DNA, 20 bp, Homo sapiens
gttcagttcctctttgcatg

SEQ ID NO: 2726434 - DNA, 20 bp, Homo sapiens
gttcatagtcaatcaaacag

SEQ ID NO: 2726435 - DNA, 13 bp, Homo sapiens
gttcatataattt

SEQ ID NO: 2726436 - DNA, 14 bp, Homo sapiens
gttcatataattta

SEQ ID NO: 2726437 - DNA, 12 bp, Homo sapiens
gttcatgaatac

SEQ ID NO: 2726438 - DNA, 14 bp, Homo sapiens
gttcccaagcaaag

SEQ ID NO: 2726439 - DNA, 15 bp, Homo sapiens
gttccctcctgcagc

SEQ ID NO: 2726440 - DNA, 14 bp, Homo sapiens
gttcctctttgcat

SEQ ID NO: 2726441 - DNA, 20 bp, Homo sapiens
gttctaactcttagaagtga

SEQ ID NO: 2726442 - DNA, 15 bp, Homo sapiens
gttctacttgatatt

SEQ ID NO: 2726443 - DNA, 21 bp, Homo sapiens
gttctcaccttaactcagcca

SEQ ID NO: 2726444 - DNA, 11 bp, Homo sapiens
gttctccagat

SEQ ID NO: 2726445 - DNA, 12 bp, Homo sapiens
gttctgtgtcct

SEQ ID NO: 2726446 - DNA, 18 bp, Homo sapiens
gttgaggggctcctggaa

SEQ ID NO: 2726447 - DNA, 14 bp, Homo sapiens
gttgagtttgctgt

SEQ ID NO: 2726448 - DNA, 21 bp, Homo sapiens
gttgataaattccactggact

SEQ ID NO: 2726449 - DNA, 15 bp, Homo sapiens
gttgcactgaaaacc

SEQ ID NO: 2726450 - DNA, 22 bp, Homo sapiens
gttgcagatctttttgtgaaat

SEQ ID NO: 2726451 - DNA, 16 bp, Homo sapiens
gttgctgttgctgttg

SEQ ID NO: 2726452 - DNA, 18 bp, Homo sapiens
gttggcgagaggaggggc

SEQ ID NO: 2726453 - DNA, 14 bp, Homo sapiens
gttggctttacaaa

SEQ ID NO: 2726454 - DNA, 19 bp, Homo sapiens
gttggctttacaaataatt

SEQ ID NO: 2726455 - DNA, 18 bp, Homo sapiens
gttggtgcaattaactct

SEQ ID NO: 2726456 - DNA, 21 bp, Homo sapiens
gttgtgaaatcaccacattct

SEQ ID NO: 2726457 - DNA, 14 bp, Homo sapiens
gttgtgtaataaca

SEQ ID NO: 2726458 - DNA, 18 bp, Homo sapiens
gtttaaaaaaagtatata

SEQ ID NO: 2726459 - DNA, 19 bp, Homo sapiens
gtttaaaaaaagtatatat

SEQ ID NO: 2726460 - DNA, 22 bp, Homo sapiens
gtttaaaaaaagtatatattct

SEQ ID NO: 2726461 - DNA, 19 bp, Homo sapiens
gtttaaaatgaagcaattt

SEQ ID NO: 2726462 - DNA, 14 bp, Homo sapiens
gtttacaacaaaca

SEQ ID NO: 2726463 - DNA, 14 bp, Homo sapiens
gtttcatgagccca

SEQ ID NO: 2726464 - DNA, 12 bp, Homo sapiens
gtttcccagtga

SEQ ID NO: 2726465 - DNA, 18 bp, Homo sapiens
gtttcccttttcctctag

SEQ ID NO: 2726466 - DNA, 20 bp, Homo sapiens
gtttctaaccaaagagtctc

SEQ ID NO: 2726467 - DNA, 24 bp, Homo sapiens
gtttctaaccaaagagtctctggc

SEQ ID NO: 2726468 - DNA, 21 bp, Homo sapiens
gtttctcaagtttaaagtcat

SEQ ID NO: 2726469 - DNA, 15 bp, Homo sapiens
gtttctccccctggg

SEQ ID NO: 2726470 - DNA, 17 bp, Homo sapiens
gtttctccccctgggct

SEQ ID NO: 2726471 - DNA, 22 bp, Homo sapiens
gtttctcggcaccagtgcctca

SEQ ID NO: 2726472 - DNA, 16 bp, Homo sapiens
gtttgaggctgcagcg

SEQ ID NO: 2726473 - DNA, 12 bp, Homo sapiens
gtttgatagtgc

SEQ ID NO: 2726474 - DNA, 17 bp, Homo sapiens
gtttgatagtgcttctt

SEQ ID NO: 2726475 - DNA, 21 bp, Homo sapiens
gtttgatagtgcttcttgtaa

SEQ ID NO: 2726476 - DNA, 11 bp, Homo sapiens
gtttgcacaga

SEQ ID NO: 2726477 - DNA, 22 bp, Homo sapiens
gtttgcacagagggcgctcctg

SEQ ID NO: 2726478 - DNA, 19 bp, Homo sapiens
gtttgcactgtatgctgga

SEQ ID NO: 2726479 - DNA, 18 bp, Homo sapiens
gtttgggggcttccctgg

SEQ ID NO: 2726480 - DNA, 16 bp, Homo sapiens
gtttgtcctttaacta

SEQ ID NO: 2726481 - DNA, 20 bp, Homo sapiens
gtttgtttctccccctgggc

SEQ ID NO: 2726482 - DNA, 19 bp, Homo sapiens
gttttaaaaataagtttta

SEQ ID NO: 2726483 - DNA, 18 bp, Homo sapiens
gttttagatttttaaaag

SEQ ID NO: 2726484 - DNA, 15 bp, Homo sapiens
gttttatacataaac

SEQ ID NO: 2726485 - DNA, 17 bp, Homo sapiens
gttttatacataaacag

SEQ ID NO: 2726486 - DNA, 21 bp, Homo sapiens
gttttggagaaaaattacaga

SEQ ID NO: 2726487 - DNA, 14 bp, Homo sapiens
gttttgtaaatttc

SEQ ID NO: 2726488 - DNA, 16 bp, Homo sapiens
gtttttaagtcctgta

SEQ ID NO: 2726489 - DNA, 18 bp, Homo sapiens
gtttttataaaaaatggt

SEQ ID NO: 2726490 - DNA, 19 bp, Homo sapiens
gtttttctacttttaaaga

SEQ ID NO: 2726491 - DNA, 13 bp, Homo sapiens
gtttttgttgagt

SEQ ID NO: 2726492 - DNA, 22 bp, Homo sapiens
gtttttgttgagtctctgaaca

SEQ ID NO: 2726493 - DNA, 18 bp, Homo sapiens
taaaaaaaatagaagcta

SEQ ID NO: 2726494 - DNA, 14 bp, Homo sapiens
taaaaaaagtatat

SEQ ID NO: 2726495 - DNA, 21 bp, Homo sapiens
taaaaaactatctttttgctt

SEQ ID NO: 2726496 - DNA, 15 bp, Homo sapiens
taaaaaatggtgcct

SEQ ID NO: 2726497 - DNA, 21 bp, Homo sapiens
taaaaagaaattgtgaaaaat

SEQ ID NO: 2726498 - DNA, 12 bp, Homo sapiens
taaaaagattat

SEQ ID NO: 2726499 - DNA, 19 bp, Homo sapiens
taaaaagattatatatcat

SEQ ID NO: 2726500 - DNA, 18 bp, Homo sapiens
taaaacgtatagtcaata

SEQ ID NO: 2726501 - DNA, 13 bp, Homo sapiens
taaaactaaacat

SEQ ID NO: 2726502 - DNA, 12 bp, Homo sapiens
taaaagggttca

SEQ ID NO: 2726503 - DNA, 22 bp, Homo sapiens
taaaagttaaactacttgtaaa

SEQ ID NO: 2726504 - DNA, 21 bp, Homo sapiens
taaaatcaaatttttctggga

SEQ ID NO: 2726505 - DNA, 21 bp, Homo sapiens
taaaatctggcaaagttatat

SEQ ID NO: 2726506 - DNA, 20 bp, Homo sapiens
taaaatcttcagctggtgga

SEQ ID NO: 2726507 - DNA, 17 bp, Homo sapiens
taaaatgaagcaattta

SEQ ID NO: 2726508 - DNA, 20 bp, Homo sapiens
taaaatgggaattctgactt

SEQ ID NO: 2726509 - DNA, 21 bp, Homo sapiens
taaaatgtttaattcattaat

SEQ ID NO: 2726510 - DNA, 17 bp, Homo sapiens
taaacacagtgtttcct

SEQ ID NO: 2726511 - DNA, 15 bp, Homo sapiens
taaacagcaaagcca

SEQ ID NO: 2726512 - DNA, 17 bp, Homo sapiens
taaacagcaaagccata

SEQ ID NO: 2726513 - DNA, 21 bp, Homo sapiens
taaacagttttggagaaaaat

SEQ ID NO: 2726514 - DNA, 13 bp, Homo sapiens
taaacatgcagaa

SEQ ID NO: 2726515 - DNA, 16 bp, Homo sapiens
taaaccttgtttcttt

SEQ ID NO: 2726516 - DNA, 21 bp, Homo sapiens
taaatgactttttgaatgtca

SEQ ID NO: 2726517 - DNA, 22 bp, Homo sapiens
taaatgagacacatacaaaaaa

SEQ ID NO: 2726518 - DNA, 15 bp, Homo sapiens
taaatgccttggttt

SEQ ID NO: 2726519 - DNA, 15 bp, Homo sapiens
taaatgtagaaagtg

SEQ ID NO: 2726520 - DNA, 12 bp, Homo sapiens
taaattacatta

SEQ ID NO: 2726521 - DNA, 14 bp, Homo sapiens
taaattacattaaa

SEQ ID NO: 2726522 - DNA, 14 bp, Homo sapiens
taaattagtttaaa

SEQ ID NO: 2726523 - DNA, 17 bp, Homo sapiens
taaattagtttaaaatg

SEQ ID NO: 2726524 - DNA, 14 bp, Homo sapiens
taaattatgaagga

SEQ ID NO: 2726525 - DNA, 11 bp, Homo sapiens
taaattatttt

SEQ ID NO: 2726526 - DNA, 19 bp, Homo sapiens
taaattctctctaacataa

SEQ ID NO: 2726527 - DNA, 18 bp, Homo sapiens
taaatttgttgtcatgtg

SEQ ID NO: 2726528 - DNA, 23 bp, Homo sapiens
taaatttgttgtcatgtgtatga

SEQ ID NO: 2726529 - DNA, 14 bp, Homo sapiens
taacaaattatttt

SEQ ID NO: 2726530 - DNA, 22 bp, Homo sapiens
taacaacctttcccatttcgtg

SEQ ID NO: 2726531 - DNA, 20 bp, Homo sapiens
taacaatatgattgcactaa

SEQ ID NO: 2726532 - DNA, 15 bp, Homo sapiens
taacacgtgacactg

SEQ ID NO: 2726533 - DNA, 20 bp, Homo sapiens
taacagcgtgtcaactttca

SEQ ID NO: 2726534 - DNA, 17 bp, Homo sapiens
taacaggttttcttcta

SEQ ID NO: 2726535 - DNA, 22 bp, Homo sapiens
taacatgaaaaacacggcagct

SEQ ID NO: 2726536 - DNA, 16 bp, Homo sapiens
taacatttaggagaag

SEQ ID NO: 2726537 - DNA, 19 bp, Homo sapiens
taacatttaggagaagttg

SEQ ID NO: 2726538 - DNA, 11 bp, Homo sapiens
taacattttgt

SEQ ID NO: 2726539 - DNA, 22 bp, Homo sapiens
taaccaccctagctttatattt

SEQ ID NO: 2726540 - DNA, 20 bp, Homo sapiens
taacgaacgttttaaagctt

SEQ ID NO: 2726541 - DNA, 22 bp, Homo sapiens
taacgttataaagccttctaaa

SEQ ID NO: 2726542 - DNA, 20 bp, Homo sapiens
taactaccctctcaaatgga

SEQ ID NO: 2726543 - DNA, 20 bp, Homo sapiens
taactagaactgaattttgt

SEQ ID NO: 2726544 - DNA, 15 bp, Homo sapiens
taactcccactccta

SEQ ID NO: 2726545 - DNA, 16 bp, Homo sapiens
taactcccactcctaa

SEQ ID NO: 2726546 - DNA, 12 bp, Homo sapiens
taactccctcct

SEQ ID NO: 2726547 - DNA, 13 bp, Homo sapiens
taactccctcctc

SEQ ID NO: 2726548 - DNA, 21 bp, Homo sapiens
taactccctcctcacactcca

SEQ ID NO: 2726549 - DNA, 16 bp, Homo sapiens
taactccgtttccaaa

SEQ ID NO: 2726550 - DNA, 20 bp, Homo sapiens
taactgcaattttaattgat

SEQ ID NO: 2726551 - DNA, 21 bp, Homo sapiens
taactgttgctcgaagactgt

SEQ ID NO: 2726552 - DNA, 13 bp, Homo sapiens
taacttcataaaa

SEQ ID NO: 2726553 - DNA, 15 bp, Homo sapiens
taacttcttaaagtt

SEQ ID NO: 2726554 - DNA, 16 bp, Homo sapiens
taactttgcttgatta

SEQ ID NO: 2726555 - DNA, 23 bp, Homo sapiens
taactttgcttgattaaacagca

SEQ ID NO: 2726556 - DNA, 20 bp, Homo sapiens
taagaaaaaaagcaaaaaca

SEQ ID NO: 2726557 - DNA, 16 bp, Homo sapiens
taagaaacaatttaaa

SEQ ID NO: 2726558 - DNA, 23 bp, Homo sapiens
taagaaagggaaagctgtgcctt

SEQ ID NO: 2726559 - DNA, 22 bp, Homo sapiens
taagagggtgaacaaagaaaag

SEQ ID NO: 2726560 - DNA, 17 bp, Homo sapiens
taagatgatgttaaatg

SEQ ID NO: 2726561 - DNA, 22 bp, Homo sapiens
taagatggcttatttgtataat

SEQ ID NO: 2726562 - DNA, 15 bp, Homo sapiens
taagcagagttcttt

SEQ ID NO: 2726563 - DNA, 17 bp, Homo sapiens
taagcagattacaataa

SEQ ID NO: 2726564 - DNA, 14 bp, Homo sapiens
taagcatgagtggc

SEQ ID NO: 2726565 - DNA, 13 bp, Homo sapiens
taagcctgatgat

SEQ ID NO: 2726566 - DNA, 13 bp, Homo sapiens
taagcctgttgct

SEQ ID NO: 2726567 - DNA, 12 bp, Homo sapiens
taagctgcagct

SEQ ID NO: 2726568 - DNA, 15 bp, Homo sapiens
taagctgcagcttcc

SEQ ID NO: 2726569 - DNA, 18 bp, Homo sapiens
taagctgcagcttcctgt

SEQ ID NO: 2726570 - DNA, 14 bp, Homo sapiens
taagctttctcctt

SEQ ID NO: 2726571 - DNA, 20 bp, Homo sapiens
taaggaagaggggtctttta

SEQ ID NO: 2726572 - DNA, 17 bp, Homo sapiens
taaggatcttttgtaaa

SEQ ID NO: 2726573 - DNA, 21 bp, Homo sapiens
taaggcttaggtgccaggctg

SEQ ID NO: 2726574 - DNA, 16 bp, Homo sapiens
taagggccgccggacc

SEQ ID NO: 2726575 - DNA, 16 bp, Homo sapiens
taaggtcattaaaaca

SEQ ID NO: 2726576 - DNA, 17 bp, Homo sapiens
taagtaccactcaggcc

SEQ ID NO: 2726577 - DNA, 18 bp, Homo sapiens
taagtaccactcaggcca

SEQ ID NO: 2726578 - DNA, 15 bp, Homo sapiens
taagtactatctttg

SEQ ID NO: 2726579 - DNA, 16 bp, Homo sapiens
taagtactatctttgt

SEQ ID NO: 2726580 - DNA, 18 bp, Homo sapiens
taagtactatctttgtct

SEQ ID NO: 2726581 - DNA, 20 bp, Homo sapiens
taagtactatctttgtctaa

SEQ ID NO: 2726582 - DNA, 19 bp, Homo sapiens
taagtataacaaactatgt

SEQ ID NO: 2726583 - DNA, 13 bp, Homo sapiens
taagtcatggtcc

SEQ ID NO: 2726584 - DNA, 17 bp, Homo sapiens
taagtcatggtcctggc

SEQ ID NO: 2726585 - DNA, 12 bp, Homo sapiens
taagtgtggatg

SEQ ID NO: 2726586 - DNA, 18 bp, Homo sapiens
taagttttatacataaac

SEQ ID NO: 2726587 - DNA, 24 bp, Homo sapiens
taagttttgtttgttcacactcct

SEQ ID NO: 2726588 - DNA, 18 bp, Homo sapiens
taataaacttagaataaa

SEQ ID NO: 2726589 - DNA, 23 bp, Homo sapiens
taataaacttagaataaaattgt

SEQ ID NO: 2726590 - DNA, 21 bp, Homo sapiens
taatagcgtcataactagaac

SEQ ID NO: 2726591 - DNA, 21 bp, Homo sapiens
taatatctgagaagtgtatat

SEQ ID NO: 2726592 - DNA, 21 bp, Homo sapiens
taatattcttttgttattaaa

SEQ ID NO: 2726593 - DNA, 18 bp, Homo sapiens
taatatttcttcaagtga

SEQ ID NO: 2726594 - DNA, 22 bp, Homo sapiens
taatatttcttcaagtgagtgg

SEQ ID NO: 2726595 - DNA, 19 bp, Homo sapiens
taatcaagagtctctccag

SEQ ID NO: 2726596 - DNA, 14 bp, Homo sapiens
taatctgttgtttg

SEQ ID NO: 2726597 - DNA, 18 bp, Homo sapiens
taatgaaccgtttacagt

SEQ ID NO: 2726598 - DNA, 16 bp, Homo sapiens
taatgaagtgtttcct

SEQ ID NO: 2726599 - DNA, 21 bp, Homo sapiens
taatgagctcctgctcattgt

SEQ ID NO: 2726600 - DNA, 16 bp, Homo sapiens
taatgatttttgtgta

SEQ ID NO: 2726601 - DNA, 17 bp, Homo sapiens
taatgatttttgtgtat

SEQ ID NO: 2726602 - DNA, 18 bp, Homo sapiens
taatgatttttgtgtatc

SEQ ID NO: 2726603 - DNA, 20 bp, Homo sapiens
taatgcttatgtgttgcata

SEQ ID NO: 2726604 - DNA, 19 bp, Homo sapiens
taattattttccaaaatct

SEQ ID NO: 2726605 - DNA, 20 bp, Homo sapiens
taattattttccaaaatcta

SEQ ID NO: 2726606 - DNA, 21 bp, Homo sapiens
taattcaccaaaagttcatat

SEQ ID NO: 2726607 - DNA, 22 bp, Homo sapiens
taattcattaatctgtttgttt

SEQ ID NO: 2726608 - DNA, 20 bp, Homo sapiens
taatttaaagaaacactaaa

SEQ ID NO: 2726609 - DNA, 20 bp, Homo sapiens
taatttaccattattttaca

SEQ ID NO: 2726610 - DNA, 21 bp, Homo sapiens
taatttataaaagaataaaat

SEQ ID NO: 2726611 - DNA, 14 bp, Homo sapiens
taatttattttgtc

SEQ ID NO: 2726612 - DNA, 13 bp, Homo sapiens
taatttttaaagc

SEQ ID NO: 2726613 - DNA, 15 bp, Homo sapiens
taatttttataaata

SEQ ID NO: 2726614 - DNA, 22 bp, Homo sapiens
taattttttgcagtcttttgct

SEQ ID NO: 2726615 - DNA, 18 bp, Homo sapiens
taatttttttttgtaaag

SEQ ID NO: 2726616 - DNA, 15 bp, Homo sapiens
tacaaaaaaaatctt

SEQ ID NO: 2726617 - DNA, 14 bp, Homo sapiens
tacaaacaggtgct

SEQ ID NO: 2726618 - DNA, 14 bp, Homo sapiens
tacaaaccaggagc

SEQ ID NO: 2726619 - DNA, 12 bp, Homo sapiens
tacaacaaacac

SEQ ID NO: 2726620 - DNA, 19 bp, Homo sapiens
tacaacaaacactgtgatg

SEQ ID NO: 2726621 - DNA, 23 bp, Homo sapiens
tacaacagaaaccagaaaagcaa

SEQ ID NO: 2726622 - DNA, 19 bp, Homo sapiens
tacaagttaaggtatctgg

SEQ ID NO: 2726623 - DNA, 19 bp, Homo sapiens
aatctggcaaagttatatt

SEQ ID NO: 2726624 - DNA, 12 bp, Homo sapiens
aatcttcagctg

SEQ ID NO: 2726625 - DNA, 17 bp, Homo sapiens
aatcttcagctggtgga

SEQ ID NO: 2726626 - DNA, 23 bp, Homo sapiens
aatcttcagctggtggatggtga

SEQ ID NO: 2726627 - DNA, 17 bp, Homo sapiens
aatctttaatggttaat

SEQ ID NO: 2726628 - DNA, 13 bp, Homo sapiens
aatcttttaaaaa

SEQ ID NO: 2726629 - DNA, 15 bp, Homo sapiens
aatgaaagtttgcac

SEQ ID NO: 2726630 - DNA, 22 bp, Homo sapiens
aatgaaccgtttacagtgtatt

SEQ ID NO: 2726631 - DNA, 17 bp, Homo sapiens
aatgaagcaaacacaca

SEQ ID NO: 2726632 - DNA, 17 bp, Homo sapiens
aatgaagcaatttatat

SEQ ID NO: 2726633 - DNA, 13 bp, Homo sapiens
aatgaagcatgta

SEQ ID NO: 2726634 - DNA, 15 bp, Homo sapiens
aatgaaggatttctt

SEQ ID NO: 2726635 - DNA, 18 bp, Homo sapiens
aatgaaggatttcttatt

SEQ ID NO: 2726636 - DNA, 16 bp, Homo sapiens
aatgaagggtcatttc

SEQ ID NO: 2726637 - DNA, 17 bp, Homo sapiens
aatgaatttgactggtt

SEQ ID NO: 2726638 - DNA, 14 bp, Homo sapiens
aatgagcattagct

SEQ ID NO: 2726639 - DNA, 18 bp, Homo sapiens
aatgaggtccctctagct

SEQ ID NO: 2726640 - DNA, 15 bp, Homo sapiens
aatgatttttgtgta

SEQ ID NO: 2726641 - DNA, 17 bp, Homo sapiens
aatgcagaggaggagaa

SEQ ID NO: 2726642 - DNA, 12 bp, Homo sapiens
aatgcattcatg

SEQ ID NO: 2726643 - DNA, 14 bp, Homo sapiens
aatgcattcatgtt

SEQ ID NO: 2726644 - DNA, 21 bp, Homo sapiens
aatgcttctgcctcagcttcc

SEQ ID NO: 2726645 - DNA, 18 bp, Homo sapiens
aatgcttgccaagaaatc

SEQ ID NO: 2726646 - DNA, 19 bp, Homo sapiens
aatgcttgccaagaaatcg

SEQ ID NO: 2726647 - DNA, 13 bp, Homo sapiens
aatggaagaaacc

SEQ ID NO: 2726648 - DNA, 22 bp, Homo sapiens
aatggataagatgatgttaaat

SEQ ID NO: 2726649 - DNA, 16 bp, Homo sapiens
aatggcacgatctcag

SEQ ID NO: 2726650 - DNA, 19 bp, Homo sapiens
aatggcacgatctcagctc

SEQ ID NO: 2726651 - DNA, 14 bp, Homo sapiens
aatggcctgccttg

SEQ ID NO: 2726652 - DNA, 21 bp, Homo sapiens
aatgggaaagtatttttgaaa

SEQ ID NO: 2726653 - DNA, 12 bp, Homo sapiens
aatgtccagctt

SEQ ID NO: 2726654 - DNA, 13 bp, Homo sapiens
aatgtcccagagg

SEQ ID NO: 2726655 - DNA, 20 bp, Homo sapiens
aatgtcctttctccagtgta

SEQ ID NO: 2726656 - DNA, 19 bp, Homo sapiens
aatgtgtctgcaacatgga

SEQ ID NO: 2726657 - DNA, 23 bp, Homo sapiens
aatgtgtctgcaacatggattcc

SEQ ID NO: 2726658 - DNA, 22 bp, Homo sapiens
aatgtgttgatttgagaaattt

SEQ ID NO: 2726659 - DNA, 16 bp, Homo sapiens
aatgttggtgcaatta

SEQ ID NO: 2726660 - DNA, 17 bp, Homo sapiens
aatgttggtgcaattaa

SEQ ID NO: 2726661 - DNA, 22 bp, Homo sapiens
aatgtttaattcattaatctgt

SEQ ID NO: 2726662 - DNA, 20 bp, Homo sapiens
aatgtttgtcagtaaatact

SEQ ID NO: 2726663 - DNA, 21 bp, Homo sapiens
aatgtttgtcagtaaatactc

SEQ ID NO: 2726664 - DNA, 19 bp, Homo sapiens
aattaactccgtttccaaa

SEQ ID NO: 2726665 - DNA, 15 bp, Homo sapiens
aattaattgtcatta

SEQ ID NO: 2726666 - DNA, 23 bp, Homo sapiens
aattagatcaacacttttctcca

SEQ ID NO: 2726667 - DNA, 15 bp, Homo sapiens
aattagtagtgtgtt

SEQ ID NO: 2726668 - DNA, 23 bp, Homo sapiens
aattattttttgcatcatttaaa

SEQ ID NO: 2726669 - DNA, 17 bp, Homo sapiens
aattcaacctgtgtctt

SEQ ID NO: 2726670 - DNA, 18 bp, Homo sapiens
aattcaacctgtgtctta

SEQ ID NO: 2726671 - DNA, 17 bp, Homo sapiens
aattcaccaaaagttca

SEQ ID NO: 2726672 - DNA, 23 bp, Homo sapiens
aattcactcccacacccaagaag

SEQ ID NO: 2726673 - DNA, 13 bp, Homo sapiens
aattcactgttga

SEQ ID NO: 2726674 - DNA, 14 bp, Homo sapiens
aattcattaatctg

SEQ ID NO: 2726675 - DNA, 18 bp, Homo sapiens
aattcattaatctgtttg

SEQ ID NO: 2726676 - DNA, 14 bp, Homo sapiens
aattccactggact

SEQ ID NO: 2726677 - DNA, 16 bp, Homo sapiens
aattcctggcatgaca

SEQ ID NO: 2726678 - DNA, 17 bp, Homo sapiens
aattgaaggagaaaatg

SEQ ID NO: 2726679 - DNA, 14 bp, Homo sapiens
aattgatcattcat

SEQ ID NO: 2726680 - DNA, 14 bp, Homo sapiens
aattgattattctg

SEQ ID NO: 2726681 - DNA, 18 bp, Homo sapiens
aattgcacttttaaacct

SEQ ID NO: 2726682 - DNA, 16 bp, Homo sapiens
aattggagaaaagcac

SEQ ID NO: 2726683 - DNA, 22 bp, Homo sapiens
aattggatacgacaacttgcac

SEQ ID NO: 2726684 - DNA, 14 bp, Homo sapiens
aattggtcattcct

SEQ ID NO: 2726685 - DNA, 18 bp, Homo sapiens
aattgtaaaattgtatag

SEQ ID NO: 2726686 - DNA, 23 bp, Homo sapiens
aattgtatagagatatgcagaag

SEQ ID NO: 2726687 - DNA, 19 bp, Homo sapiens
aattgtatatcattttgcc

SEQ ID NO: 2726688 - DNA, 19 bp, Homo sapiens
aattgtcattatttttgtt

SEQ ID NO: 2726689 - DNA, 22 bp, Homo sapiens
aattgtttttagaaatttattc

SEQ ID NO: 2726690 - DNA, 16 bp, Homo sapiens
aatttaaagaaacact

SEQ ID NO: 2726691 - DNA, 21 bp, Homo sapiens
aatttaaagaaacactaaatt

SEQ ID NO: 2726692 - DNA, 14 bp, Homo sapiens
aatttaaattgtta

SEQ ID NO: 2726693 - DNA, 20 bp, Homo sapiens
aatttaagcatgagtggcct

SEQ ID NO: 2726694 - DNA, 22 bp, Homo sapiens
aatttactttttaaacagtgtt

SEQ ID NO: 2726695 - DNA, 23 bp, Homo sapiens
aatttactttttaaacagtgttt

SEQ ID NO: 2726696 - DNA, 13 bp, Homo sapiens
aatttagtcatta

SEQ ID NO: 2726697 - DNA, 20 bp, Homo sapiens
aatttataggcagatcttta

SEQ ID NO: 2726698 - DNA, 12 bp, Homo sapiens
aatttatatctt

SEQ ID NO: 2726699 - DNA, 13 bp, Homo sapiens
aatttatatcttt

SEQ ID NO: 2726700 - DNA, 15 bp, Homo sapiens
aatttatatctttat

SEQ ID NO: 2726701 - DNA, 18 bp, Homo sapiens
aatttatatctttatgca

SEQ ID NO: 2726702 - DNA, 12 bp, Homo sapiens
aatttattttgt

SEQ ID NO: 2726703 - DNA, 21 bp, Homo sapiens
aatttattttgtcgaattttt

SEQ ID NO: 2726704 - DNA, 17 bp, Homo sapiens
aatttcaggaatttaat

SEQ ID NO: 2726705 - DNA, 15 bp, Homo sapiens
aatttgtaagtttat

SEQ ID NO: 2726706 - DNA, 17 bp, Homo sapiens
aatttgtatctgaagga

SEQ ID NO: 2726707 - DNA, 18 bp, Homo sapiens
aatttgttgtcatgtgta

SEQ ID NO: 2726708 - DNA, 13 bp, Homo sapiens
aattttattgctg

SEQ ID NO: 2726709 - DNA, 21 bp, Homo sapiens
aattttgaggtcttttacata

SEQ ID NO: 2726710 - DNA, 17 bp, Homo sapiens
aattttggaaaaatgtc

SEQ ID NO: 2726711 - DNA, 10 bp, Homo sapiens
aattttgtaa

SEQ ID NO: 2726712 - DNA, 17 bp, Homo sapiens
aattttgtatttaatga

SEQ ID NO: 2726713 - DNA, 17 bp, Homo sapiens
aattttgtcacagctct

SEQ ID NO: 2726714 - DNA, 12 bp, Homo sapiens
aatttttataaa

SEQ ID NO: 2726715 - DNA, 19 bp, Homo sapiens
aatttttataaatatgtga

SEQ ID NO: 2726716 - DNA, 19 bp, Homo sapiens
aattttttgatgtcagcct

SEQ ID NO: 2726717 - DNA, 18 bp, Homo sapiens
aatttttttccagaattg

SEQ ID NO: 2726718 - DNA, 15 bp, Homo sapiens
acaaaagctgtgtct

SEQ ID NO: 2726719 - DNA, 16 bp, Homo sapiens
acaaaagctgtgtctc

SEQ ID NO: 2726720 - DNA, 14 bp, Homo sapiens
acaaacaaatggct

SEQ ID NO: 2726721 - DNA, 14 bp, Homo sapiens
acaaaccaggagca

SEQ ID NO: 2726722 - DNA, 16 bp, Homo sapiens
acaaactacatgtaat

SEQ ID NO: 2726723 - DNA, 18 bp, Homo sapiens
acaaagttactggctctt

SEQ ID NO: 2726724 - DNA, 15 bp, Homo sapiens
acaaatacactttat

SEQ ID NO: 2726725 - DNA, 22 bp, Homo sapiens
acaaatggaactccccagggcc

SEQ ID NO: 2726726 - DNA, 18 bp, Homo sapiens
acaaatggcttacttaca

SEQ ID NO: 2726727 - DNA, 21 bp, Homo sapiens
acaaatggcttacttacaaaa

SEQ ID NO: 2726728 - DNA, 19 bp, Homo sapiens
acaacagaagttatatttt

SEQ ID NO: 2726729 - DNA, 20 bp, Homo sapiens
acaacatttttgtacattat

SEQ ID NO: 2726730 - DNA, 21 bp, Homo sapiens
acaacatttttgtacattatg

SEQ ID NO: 2726731 - DNA, 15 bp, Homo sapiens
acaaccacatttctg

SEQ ID NO: 2726732 - DNA, 13 bp, Homo sapiens
acaacctatgtaa

SEQ ID NO: 2726733 - DNA, 15 bp, Homo sapiens
acaacctgcccctcc

SEQ ID NO: 2726734 - DNA, 18 bp, Homo sapiens
acaacctgcccctcccca

SEQ ID NO: 2726735 - DNA, 21 bp, Homo sapiens
acaacgctctaccctgcagct

SEQ ID NO: 2726736 - DNA, 16 bp, Homo sapiens
acaactttcatttaac

SEQ ID NO: 2726737 - DNA, 16 bp, Homo sapiens
acaagctccctggtga

SEQ ID NO: 2726738 - DNA, 18 bp, Homo sapiens
acaagctccctggtgagg

SEQ ID NO: 2726739 - DNA, 20 bp, Homo sapiens
acaatatgattgcactaaat

SEQ ID NO: 2726740 - DNA, 21 bp, Homo sapiens
acaatcacaaaagctgtgtct

SEQ ID NO: 2726741 - DNA, 18 bp, Homo sapiens
acaatccaaatgcattca

SEQ ID NO: 2726742 - DNA, 20 bp, Homo sapiens
acaatgcgtggcacatctaa

SEQ ID NO: 2726743 - DNA, 14 bp, Homo sapiens
acaatttaaattgt

SEQ ID NO: 2726744 - DNA, 22 bp, Homo sapiens
acacaatgttgcactgaaaacc

SEQ ID NO: 2726745 - DNA, 18 bp, Homo sapiens
acacacactccttcccct

SEQ ID NO: 2726746 - DNA, 18 bp, Homo sapiens
acacacccccaagccaca

SEQ ID NO: 2726747 - DNA, 21 bp, Homo sapiens
acctagtggctgtccagtgcc

SEQ ID NO: 2726748 - DNA, 23 bp, Homo sapiens
acctagtggctgtccagtgccca

SEQ ID NO: 2726749 - DNA, 15 bp, Homo sapiens
acctatagtcccagc

SEQ ID NO: 2726750 - DNA, 21 bp, Homo sapiens
acctatggcccagccactgca

SEQ ID NO: 2726751 - DNA, 15 bp, Homo sapiens
acctcacgctctgga

SEQ ID NO: 2726752 - DNA, 20 bp, Homo sapiens
acctcactattcaagtatta

SEQ ID NO: 2726753 - DNA, 13 bp, Homo sapiens
acctcaggccagg

SEQ ID NO: 2726754 - DNA, 21 bp, Homo sapiens
acctcaggccaggtgcagtgg

SEQ ID NO: 2726755 - DNA, 19 bp, Homo sapiens
acctcaggcttccttggca

SEQ ID NO: 2726756 - DNA, 15 bp, Homo sapiens
acctcatgtcatttc

SEQ ID NO: 2726757 - DNA, 16 bp, Homo sapiens
acctcatgtcatttct

SEQ ID NO: 2726758 - DNA, 12 bp, Homo sapiens
acctccacccac

SEQ ID NO: 2726759 - DNA, 15 bp, Homo sapiens
acctccacctcctgg

SEQ ID NO: 2726760 - DNA, 18 bp, Homo sapiens
acctccagtcctgctggc

SEQ ID NO: 2726761 - DNA, 21 bp, Homo sapiens
acctccagtcctgctggcctg

SEQ ID NO: 2726762 - DNA, 23 bp, Homo sapiens
acctccagtcctgctggcctgct

SEQ ID NO: 2726763 - DNA, 20 bp, Homo sapiens
acctcctctgtgatttcttt

SEQ ID NO: 2726764 - DNA, 23 bp, Homo sapiens
acctcctgggtttaagcaatgct

SEQ ID NO: 2726765 - DNA, 22 bp, Homo sapiens
acctcgtgatttgcctgcctgg

SEQ ID NO: 2726766 - DNA, 18 bp, Homo sapiens
acctctgaatgtcccaga

SEQ ID NO: 2726767 - DNA, 20 bp, Homo sapiens
acctctgaatgtcccagagg

SEQ ID NO: 2726768 - DNA, 21 bp, Homo sapiens
acctgagatactgaagtgcag

SEQ ID NO: 2726769 - DNA, 22 bp, Homo sapiens
acctgagatactgaagtgcagc

SEQ ID NO: 2726770 - DNA, 15 bp, Homo sapiens
acctgcaggccaaga

SEQ ID NO: 2726771 - DNA, 19 bp, Homo sapiens
acctgcaggccaagagcag

SEQ ID NO: 2726772 - DNA, 16 bp, Homo sapiens
acctgccagcctggct

SEQ ID NO: 2726773 - DNA, 13 bp, Homo sapiens
acctgccccctgg

SEQ ID NO: 2726774 - DNA, 18 bp, Homo sapiens
acctgcctagctcttggg

SEQ ID NO: 2726775 - DNA, 21 bp, Homo sapiens
acctgcctagctcttgggcct

SEQ ID NO: 2726776 - DNA, 13 bp, Homo sapiens
acctggagctgcc

SEQ ID NO: 2726777 - DNA, 17 bp, Homo sapiens
acctggagctgccagca

SEQ ID NO: 2726778 - DNA, 19 bp, Homo sapiens
acctggagctgccagcacc

SEQ ID NO: 2726779 - DNA, 19 bp, Homo sapiens
acctggccccttctccagc

SEQ ID NO: 2726780 - DNA, 20 bp, Homo sapiens
acctggccccttctccagca

SEQ ID NO: 2726781 - DNA, 23 bp, Homo sapiens
acctggccccttctccagcaagc

SEQ ID NO: 2726782 - DNA, 17 bp, Homo sapiens
acctgtccttactcaga

SEQ ID NO: 2726783 - DNA, 19 bp, Homo sapiens
acctgtccttactcagagc

SEQ ID NO: 2726784 - DNA, 16 bp, Homo sapiens
accttcaattcctggg

SEQ ID NO: 2726785 - DNA, 22 bp, Homo sapiens
acctttcctgccgtccctcctg

SEQ ID NO: 2726786 - DNA, 20 bp, Homo sapiens
acctttctactttttctgta

SEQ ID NO: 2726787 - DNA, 16 bp, Homo sapiens
acgactcttcctgcaa

SEQ ID NO: 2726788 - DNA, 13 bp, Homo sapiens
acgatctcagctc

SEQ ID NO: 2726789 - DNA, 15 bp, Homo sapiens
acgatctcagctcac

SEQ ID NO: 2726790 - DNA, 14 bp, Homo sapiens
acgcatgcctcagc

SEQ ID NO: 2726791 - DNA, 14 bp, Homo sapiens
acgccaacagcccc

SEQ ID NO: 2726792 - DNA, 20 bp, Homo sapiens
acgccactgcactccagcct

SEQ ID NO: 2726793 - DNA, 13 bp, Homo sapiens
acgccgtggagca

SEQ ID NO: 2726794 - DNA, 16 bp, Homo sapiens
acgcctatgatcccag

SEQ ID NO: 2726795 - DNA, 21 bp, Homo sapiens
acgctgtgattggcaggaggc

SEQ ID NO: 2726796 - DNA, 16 bp, Homo sapiens
acggactcagactcct

SEQ ID NO: 2726797 - DNA, 21 bp, Homo sapiens
acggactcagactcctggctt

SEQ ID NO: 2726798 - DNA, 11 bp, Homo sapiens
acggcagctgt

SEQ ID NO: 2726799 - DNA, 15 bp, Homo sapiens
acggcccatcttggc

SEQ ID NO: 2726800 - DNA, 18 bp, Homo sapiens
acggggaccactgggccc

SEQ ID NO: 2726801 - DNA, 22 bp, Homo sapiens
acggggaccactgggcccctca

SEQ ID NO: 2726802 - DNA, 18 bp, Homo sapiens
acggggccggccaggtgg

SEQ ID NO: 2726803 - DNA, 15 bp, Homo sapiens
acgggttgaaagaca

SEQ ID NO: 2726804 - DNA, 22 bp, Homo sapiens
acgggttgaaagacatcaatga

SEQ ID NO: 2726805 - DNA, 18 bp, Homo sapiens
acgtaccaagccaccgca

SEQ ID NO: 2726806 - DNA, 23 bp, Homo sapiens
acgtatgtcggcacgtcccatgt

SEQ ID NO: 2726807 - DNA, 15 bp, Homo sapiens
acgtcaccctcctga

SEQ ID NO: 2726808 - DNA, 18 bp, Homo sapiens
acgtcctggaatgaagca

SEQ ID NO: 2726809 - DNA, 22 bp, Homo sapiens
acgtcctggaatgaagcatgta

SEQ ID NO: 2726810 - DNA, 13 bp, Homo sapiens
acgtctctctgcc

SEQ ID NO: 2726811 - DNA, 23 bp, Homo sapiens
acgtctctctgcctgctgggctc

SEQ ID NO: 2726812 - DNA, 19 bp, Homo sapiens
acgtctgtgctctgtcctt

SEQ ID NO: 2726813 - DNA, 21 bp, Homo sapiens
acgtctgtgctctgtccttgt

SEQ ID NO: 2726814 - DNA, 17 bp, Homo sapiens
acgtgaataggctgctt

SEQ ID NO: 2726815 - DNA, 19 bp, Homo sapiens
acgtgaataggctgctttt

SEQ ID NO: 2726816 - DNA, 13 bp, Homo sapiens
acgtgcacagctt

SEQ ID NO: 2726817 - DNA, 23 bp, Homo sapiens
acgtgcacagcttcctgagtcac

SEQ ID NO: 2726818 - DNA, 20 bp, Homo sapiens
acgtgcacctgtactcagga

SEQ ID NO: 2726819 - DNA, 23 bp, Homo sapiens
acgtgcacctgtactcaggaggc

SEQ ID NO: 2726820 - DNA, 21 bp, Homo sapiens
acgtgctcgcctctgcccagc

SEQ ID NO: 2726821 - DNA, 12 bp, Homo sapiens
acgtgtgaggat

SEQ ID NO: 2726822 - DNA, 17 bp, Homo sapiens
actaaaatgtttaattc

SEQ ID NO: 2726823 - DNA, 14 bp, Homo sapiens
actaaattagttta

SEQ ID NO: 2726824 - DNA, 15 bp, Homo sapiens
actaacctgacatca

SEQ ID NO: 2726825 - DNA, 18 bp, Homo sapiens
actaacgaacgttttaaa

SEQ ID NO: 2726826 - DNA, 16 bp, Homo sapiens
actaagctttctcctt

SEQ ID NO: 2726827 - DNA, 21 bp, Homo sapiens
actaaggatttttcaagagat

SEQ ID NO: 2726828 - DNA, 17 bp, Homo sapiens
actaagtcatggtcctg

SEQ ID NO: 2726829 - DNA, 20 bp, Homo sapiens
actaagtcatggtcctggct

SEQ ID NO: 2726830 - DNA, 21 bp, Homo sapiens
actaagtcatggtcctggctg

SEQ ID NO: 2726831 - DNA, 21 bp, Homo sapiens
actacaaacatggggagccat

SEQ ID NO: 2726832 - DNA, 20 bp, Homo sapiens
actacactccagcctgagca

SEQ ID NO: 2726833 - DNA, 19 bp, Homo sapiens
actaccctctcaaatggac

SEQ ID NO: 2726834 - DNA, 19 bp, Homo sapiens
actacctttgtccaggcct

SEQ ID NO: 2726835 - DNA, 20 bp, Homo sapiens
actacctttgtccaggcctg

SEQ ID NO: 2726836 - DNA, 15 bp, Homo sapiens
actacttgagaaaat

SEQ ID NO: 2726837 - DNA, 16 bp, Homo sapiens
actagattctcacctg

SEQ ID NO: 2726838 - DNA, 20 bp, Homo sapiens
actagattctcacctgcctt

SEQ ID NO: 2726839 - DNA, 22 bp, Homo sapiens
actagattctcacctgccttca

SEQ ID NO: 2726840 - DNA, 11 bp, Homo sapiens
actagcaggca

SEQ ID NO: 2726841 - DNA, 17 bp, Homo sapiens
actaggactctgaggct

SEQ ID NO: 2726842 - DNA, 18 bp, Homo sapiens
actatatttatttatgta

SEQ ID NO: 2726843 - DNA, 13 bp, Homo sapiens
actatctttgtct

SEQ ID NO: 2726844 - DNA, 17 bp, Homo sapiens
actatgccgtgtagttt

SEQ ID NO: 2726845 - DNA, 22 bp, Homo sapiens
actatgccgtgtagtttctggt

SEQ ID NO: 2726846 - DNA, 13 bp, Homo sapiens
actattggagggt

SEQ ID NO: 2726847 - DNA, 14 bp, Homo sapiens
actatttaacttga

SEQ ID NO: 2726848 - DNA, 14 bp, Homo sapiens
actatttaagtact

SEQ ID NO: 2726849 - DNA, 16 bp, Homo sapiens
actatttaagtactat

SEQ ID NO: 2726850 - DNA, 17 bp, Homo sapiens
actcaagacttccagag

SEQ ID NO: 2726851 - DNA, 17 bp, Homo sapiens
actcactgccaaaaata

SEQ ID NO: 2726852 - DNA, 17 bp, Homo sapiens
actcagaagcctgaggc

SEQ ID NO: 2726853 - DNA, 15 bp, Homo sapiens
actcagacattccaa

SEQ ID NO: 2726854 - DNA, 11 bp, Homo sapiens
actcagagctg

SEQ ID NO: 2726855 - DNA, 17 bp, Homo sapiens
actcagagctgcgggct

SEQ ID NO: 2726856 - DNA, 20 bp, Homo sapiens
actcagctctcctgctgcag

SEQ ID NO: 2726857 - DNA, 19 bp, Homo sapiens
actcagggactcaggccag

SEQ ID NO: 2726858 - DNA, 17 bp, Homo sapiens
actcattcacatttcaa

SEQ ID NO: 2726859 - DNA, 22 bp, Homo sapiens
actcatttgctgacacatcagt

SEQ ID NO: 2726860 - DNA, 20 bp, Homo sapiens
actccagcctgggcgacaga

SEQ ID NO: 2726861 - DNA, 16 bp, Homo sapiens
actcccactcctaatc

SEQ ID NO: 2726862 - DNA, 17 bp, Homo sapiens
actcccacttccctgac

SEQ ID NO: 2726863 - DNA, 12 bp, Homo sapiens
actcccagcgct

SEQ ID NO: 2726864 - DNA, 12 bp, Homo sapiens
actcccccagga

SEQ ID NO: 2726865 - DNA, 12 bp, Homo sapiens
actccctcctca

SEQ ID NO: 2726866 - DNA, 16 bp, Homo sapiens
actccggtgtgcctgc

SEQ ID NO: 2726867 - DNA, 20 bp, Homo sapiens
actccggtgtgcctgcagcc

SEQ ID NO: 2726868 - DNA, 14 bp, Homo sapiens
actcctacctcagc

SEQ ID NO: 2726869 - DNA, 18 bp, Homo sapiens
actcctcacagcatctct

SEQ ID NO: 2726870 - DNA, 21 bp, Homo sapiens
agccctttacttgacctccta

SEQ ID NO: 2726871 - DNA, 20 bp, Homo sapiens
agccctttgcaggcccagca

SEQ ID NO: 2726872 - DNA, 21 bp, Homo sapiens
agccctttgcaggcccagcag

SEQ ID NO: 2726873 - DNA, 18 bp, Homo sapiens
agccgagatcacgccact

SEQ ID NO: 2726874 - DNA, 18 bp, Homo sapiens
agccgcagcctccctctg

SEQ ID NO: 2726875 - DNA, 14 bp, Homo sapiens
agccgcagggcctg

SEQ ID NO: 2726876 - DNA, 16 bp, Homo sapiens
agccgcagggcctgct

SEQ ID NO: 2726877 - DNA, 12 bp, Homo sapiens
agccgctgcccg

SEQ ID NO: 2726878 - DNA, 17 bp, Homo sapiens
agccgctgcccggcgcc

SEQ ID NO: 2726879 - DNA, 22 bp, Homo sapiens
agcctcacagatgctggcctct

SEQ ID NO: 2726880 - DNA, 16 bp, Homo sapiens
agcctccagtgctggc

SEQ ID NO: 2726881 - DNA, 20 bp, Homo sapiens
agcctccagtgctggctgct

SEQ ID NO: 2726882 - DNA, 14 bp, Homo sapiens
agcctcccacaggt

SEQ ID NO: 2726883 - DNA, 15 bp, Homo sapiens
agcctccctctgacc

SEQ ID NO: 2726884 - DNA, 21 bp, Homo sapiens
agcctccctctgacctgcagg

SEQ ID NO: 2726885 - DNA, 22 bp, Homo sapiens
agcctccctctgacctgcaggc

SEQ ID NO: 2726886 - DNA, 19 bp, Homo sapiens
agcctcctgagtagctggg

SEQ ID NO: 2726887 - DNA, 15 bp, Homo sapiens
agcctcgtccaaggc

SEQ ID NO: 2726888 - DNA, 10 bp, Homo sapiens
agcctctccc

SEQ ID NO: 2726889 - DNA, 14 bp, Homo sapiens
agcctctgtgtcac

SEQ ID NO: 2726890 - DNA, 19 bp, Homo sapiens
agcctctgtgtcactggct

SEQ ID NO: 2726891 - DNA, 23 bp, Homo sapiens
agcctctgtgtcactggctgcct

SEQ ID NO: 2726892 - DNA, 12 bp, Homo sapiens
agcctggccacc

SEQ ID NO: 2726893 - DNA, 12 bp, Homo sapiens
agcctggcccag

SEQ ID NO: 2726894 - DNA, 13 bp, Homo sapiens
agcctggcccagc

SEQ ID NO: 2726895 - DNA, 15 bp, Homo sapiens
agcctggcttctgga

SEQ ID NO: 2726896 - DNA, 18 bp, Homo sapiens
agcctggcttctggagcc

SEQ ID NO: 2726897 - DNA, 22 bp, Homo sapiens
agcctgtcctggtacagcaggg

SEQ ID NO: 2726898 - DNA, 15 bp, Homo sapiens
agccttcacatgaaa

SEQ ID NO: 2726899 - DNA, 13 bp, Homo sapiens
agcgaccctggct

SEQ ID NO: 2726900 - DNA, 14 bp, Homo sapiens
agcgaccctggctc

SEQ ID NO: 2726901 - DNA, 17 bp, Homo sapiens
agcgaccctggctctgc

SEQ ID NO: 2726902 - DNA, 19 bp, Homo sapiens
agcgagaaccaggctgctg

SEQ ID NO: 2726903 - DNA, 16 bp, Homo sapiens
agcgagctgctctgct

SEQ ID NO: 2726904 - DNA, 21 bp, Homo sapiens
agcgagttgtggaaagcctct

SEQ ID NO: 2726905 - DNA, 21 bp, Homo sapiens
agcgcacctgccccctggtgg

SEQ ID NO: 2726906 - DNA, 11 bp, Homo sapiens
agcgcctcctg

SEQ ID NO: 2726907 - DNA, 14 bp, Homo sapiens
agcgcctgtcccct

SEQ ID NO: 2726908 - DNA, 20 bp, Homo sapiens
agcgtgctgcctctcttctg

SEQ ID NO: 2726909 - DNA, 15 bp, Homo sapiens
agctaagcctgatga

SEQ ID NO: 2726910 - DNA, 16 bp, Homo sapiens
agctaaggtctataaa

SEQ ID NO: 2726911 - DNA, 23 bp, Homo sapiens
agctaaggtctataaacatgaag

SEQ ID NO: 2726912 - DNA, 15 bp, Homo sapiens
agctactcagaagcc

SEQ ID NO: 2726913 - DNA, 19 bp, Homo sapiens
agctactcagaagcctgag

SEQ ID NO: 2726914 - DNA, 21 bp, Homo sapiens
agctactcagaagcctgaggc

SEQ ID NO: 2726915 - DNA, 14 bp, Homo sapiens
agctactctcttgc

SEQ ID NO: 2726916 - DNA, 19 bp, Homo sapiens
agctactctcttgccagca

SEQ ID NO: 2726917 - DNA, 14 bp, Homo sapiens
agctagaaatcaca

SEQ ID NO: 2726918 - DNA, 15 bp, Homo sapiens
agctagctatttcta

SEQ ID NO: 2726919 - DNA, 22 bp, Homo sapiens
agctatcaatcaccttgcattt

SEQ ID NO: 2726920 - DNA, 16 bp, Homo sapiens
agctcaggtcctgctg

SEQ ID NO: 2726921 - DNA, 20 bp, Homo sapiens
agctcaggtcctgctgcctc

SEQ ID NO: 2726922 - DNA, 13 bp, Homo sapiens
agctcagtggcaa

SEQ ID NO: 2726923 - DNA, 22 bp, Homo sapiens
agctcctcccctgccgcctccc

SEQ ID NO: 2726924 - DNA, 18 bp, Homo sapiens
agctcctgctcattgtgg

SEQ ID NO: 2726925 - DNA, 16 bp, Homo sapiens
agctcctgtccctacc

SEQ ID NO: 2726926 - DNA, 17 bp, Homo sapiens
agctcctgtccctaccc

SEQ ID NO: 2726927 - DNA, 20 bp, Homo sapiens
agctcgagcatgccctgagc

SEQ ID NO: 2726928 - DNA, 18 bp, Homo sapiens
agctctacacaacatgta

SEQ ID NO: 2726929 - DNA, 20 bp, Homo sapiens
agctctattaagatttccaa

SEQ ID NO: 2726930 - DNA, 22 bp, Homo sapiens
agctctattaagatttccaagt

SEQ ID NO: 2726931 - DNA, 15 bp, Homo sapiens
agctctgcagcaata

SEQ ID NO: 2726932 - DNA, 21 bp, Homo sapiens
agctctgcagcaatattctga

SEQ ID NO: 2726933 - DNA, 12 bp, Homo sapiens
agctctgcatta

SEQ ID NO: 2726934 - DNA, 14 bp, Homo sapiens
agctctgctggaag

SEQ ID NO: 2726935 - DNA, 17 bp, Homo sapiens
agctctgctggaagaac

SEQ ID NO: 2726936 - DNA, 14 bp, Homo sapiens
agctgacagtcctc

SEQ ID NO: 2726937 - DNA, 13 bp, Homo sapiens
agctgagctggcc

SEQ ID NO: 2726938 - DNA, 20 bp, Homo sapiens
agctgatgaggatcagagcg

SEQ ID NO: 2726939 - DNA, 16 bp, Homo sapiens
agctgcacctgccagc

SEQ ID NO: 2726940 - DNA, 18 bp, Homo sapiens
agctgcacctgccagcct

SEQ ID NO: 2726941 - DNA, 22 bp, Homo sapiens
agctgcacctgccagcctggct

SEQ ID NO: 2726942 - DNA, 13 bp, Homo sapiens
agctgcagcttcc

SEQ ID NO: 2726943 - DNA, 15 bp, Homo sapiens
agctgcagcttcctg

SEQ ID NO: 2726944 - DNA, 17 bp, Homo sapiens
agctgcagcttcctgtc

SEQ ID NO: 2726945 - DNA, 13 bp, Homo sapiens
agctgccagcacc

SEQ ID NO: 2726946 - DNA, 14 bp, Homo sapiens
agctgccagcacca

SEQ ID NO: 2726947 - DNA, 14 bp, Homo sapiens
agctgcctccccaa

SEQ ID NO: 2726948 - DNA, 16 bp, Homo sapiens
agctgcctccccaatc

SEQ ID NO: 2726949 - DNA, 18 bp, Homo sapiens
agctgcctccccaatcca

SEQ ID NO: 2726950 - DNA, 14 bp, Homo sapiens
agctgcgggctgag

SEQ ID NO: 2726951 - DNA, 23 bp, Homo sapiens
agctgcgggctgagggcatctct

SEQ ID NO: 2726952 - DNA, 20 bp, Homo sapiens
agctgctaggggaaggactg

SEQ ID NO: 2726953 - DNA, 11 bp, Homo sapiens
agctgctctgc

SEQ ID NO: 2726954 - DNA, 15 bp, Homo sapiens
agctgctgccactct

SEQ ID NO: 2726955 - DNA, 18 bp, Homo sapiens
agctgctgccactctgct

SEQ ID NO: 2726956 - DNA, 21 bp, Homo sapiens
agctgctgccactctgctgcc

SEQ ID NO: 2726957 - DNA, 23 bp, Homo sapiens
agctgctgccactctgctgcctg

SEQ ID NO: 2726958 - DNA, 15 bp, Homo sapiens
agctggaaagcagcc

SEQ ID NO: 2726959 - DNA, 14 bp, Homo sapiens
agctggaggaacat

SEQ ID NO: 2726960 - DNA, 21 bp, Homo sapiens
agctggcaatgccctacctgc

SEQ ID NO: 2726961 - DNA, 16 bp, Homo sapiens
agctggcagcctccag

SEQ ID NO: 2726962 - DNA, 13 bp, Homo sapiens
agctgggcccaca

SEQ ID NO: 2726963 - DNA, 21 bp, Homo sapiens
agctgggcccacagcccccac

SEQ ID NO: 2726964 - DNA, 15 bp, Homo sapiens
agctgtaaaaagaga

SEQ ID NO: 2726965 - DNA, 16 bp, Homo sapiens
agctgtagaactctgc

SEQ ID NO: 2726966 - DNA, 19 bp, Homo sapiens
agctgtagaactctgcagg

SEQ ID NO: 2726967 - DNA, 21 bp, Homo sapiens
agctgtagaactctgcaggca

SEQ ID NO: 2726968 - DNA, 17 bp, Homo sapiens
agctgtagctcccgagc

SEQ ID NO: 2726969 - DNA, 16 bp, Homo sapiens
agctgtagctggagaa

SEQ ID NO: 2726970 - DNA, 17 bp, Homo sapiens
agctgtcccctggagaa

SEQ ID NO: 2726971 - DNA, 17 bp, Homo sapiens
agctgtgaacatggact

SEQ ID NO: 2726972 - DNA, 18 bp, Homo sapiens
agctgtgccaccctgggc

SEQ ID NO: 2726973 - DNA, 21 bp, Homo sapiens
agctgtgccaccctgggctct

SEQ ID NO: 2726974 - DNA, 15 bp, Homo sapiens
agctgtggtcccacc

SEQ ID NO: 2726975 - DNA, 16 bp, Homo sapiens
agctgtggtcccaccc

SEQ ID NO: 2726976 - DNA, 14 bp, Homo sapiens
agctgtgtctctgt

SEQ ID NO: 2726977 - DNA, 15 bp, Homo sapiens
agcttacccttggtt

SEQ ID NO: 2726978 - DNA, 14 bp, Homo sapiens
agcttcatatctaa

SEQ ID NO: 2726979 - DNA, 17 bp, Homo sapiens
agcttcccccaaggctg

SEQ ID NO: 2726980 - DNA, 11 bp, Homo sapiens
agcttcctgag

SEQ ID NO: 2726981 - DNA, 13 bp, Homo sapiens
agcttctgccact

SEQ ID NO: 2726982 - DNA, 14 bp, Homo sapiens
agcttctgctgggc

SEQ ID NO: 2726983 - DNA, 17 bp, Homo sapiens
agcttctgctgggctgg

SEQ ID NO: 2726984 - DNA, 15 bp, Homo sapiens
agctttagctggagg

SEQ ID NO: 2726985 - DNA, 20 bp, Homo sapiens
agctttgggaaagctgcctc

SEQ ID NO: 2726986 - DNA, 15 bp, Homo sapiens
aggaaaggattttac

SEQ ID NO: 2726987 - DNA, 16 bp, Homo sapiens
aggaaatcagagctgg

SEQ ID NO: 2726988 - DNA, 19 bp, Homo sapiens
aggaacacccggaaagact

SEQ ID NO: 2726989 - DNA, 20 bp, Homo sapiens
aggaacacccggaaagactg

SEQ ID NO: 2726990 - DNA, 16 bp, Homo sapiens
aggaagacacagccca

SEQ ID NO: 2726991 - DNA, 19 bp, Homo sapiens
aggaagaggggtcttttat

SEQ ID NO: 2726992 - DNA, 15 bp, Homo sapiens
aggaagcagcaatta

SEQ ID NO: 2726993 - DNA, 15 bp, Homo sapiens
aggaagggagggagc

SEQ ID NO: 2726994 - DNA, 18 bp, Homo sapiens
aggaagggagggagctga

SEQ ID NO: 2726995 - DNA, 21 bp, Homo sapiens
agtctcaattttgtatttaat

SEQ ID NO: 2726996 - DNA, 20 bp, Homo sapiens
agtctcacatgtccctgtcc

SEQ ID NO: 2726997 - DNA, 14 bp, Homo sapiens
agtctcgctctgct

SEQ ID NO: 2726998 - DNA, 18 bp, Homo sapiens
agtctctccagcctcaca

SEQ ID NO: 2726999 - DNA, 21 bp, Homo sapiens
agtctctccagcctcacagat

SEQ ID NO: 2727000 - DNA, 12 bp, Homo sapiens
agtctctgaaca

SEQ ID NO: 2727001 - DNA, 20 bp, Homo sapiens
agtctctggctcagctgtgg

SEQ ID NO: 2727002 - DNA, 22 bp, Homo sapiens
agtctctgggtttacaacaaac

SEQ ID NO: 2727003 - DNA, 15 bp, Homo sapiens
agtctctgttgtaaa

SEQ ID NO: 2727004 - DNA, 17 bp, Homo sapiens
agtctgaatggcatgga

SEQ ID NO: 2727005 - DNA, 18 bp, Homo sapiens
agtctgaggcacctgcat

SEQ ID NO: 2727006 - DNA, 20 bp, Homo sapiens
agtctgaggccccaggccct

SEQ ID NO: 2727007 - DNA, 16 bp, Homo sapiens
agtctgagtaaaatct

SEQ ID NO: 2727008 - DNA, 16 bp, Homo sapiens
agtctgctatattttc

SEQ ID NO: 2727009 - DNA, 17 bp, Homo sapiens
agtcttcactgctctgc

SEQ ID NO: 2727010 - DNA, 15 bp, Homo sapiens
agtcttgcattgaat

SEQ ID NO: 2727011 - DNA, 16 bp, Homo sapiens
agtcttttgctgtgct

SEQ ID NO: 2727012 - DNA, 18 bp, Homo sapiens
agtgaacagtttggatgt

SEQ ID NO: 2727013 - DNA, 18 bp, Homo sapiens
agtgaataaacttcagca

SEQ ID NO: 2727014 - DNA, 17 bp, Homo sapiens
agtgaattacactcaag

SEQ ID NO: 2727015 - DNA, 14 bp, Homo sapiens
agtgaattttgcac

SEQ ID NO: 2727016 - DNA, 20 bp, Homo sapiens
agtgactcgggctcctgtgc

SEQ ID NO: 2727017 - DNA, 22 bp, Homo sapiens
agtgactcgggctcctgtgccc

SEQ ID NO: 2727018 - DNA, 13 bp, Homo sapiens
agtgacttcctgg

SEQ ID NO: 2727019 - DNA, 15 bp, Homo sapiens
agtgacttcctggtg

SEQ ID NO: 2727020 - DNA, 14 bp, Homo sapiens
agtgagaaattttt

SEQ ID NO: 2727021 - DNA, 21 bp, Homo sapiens
agtgagaaatttttttccaga

SEQ ID NO: 2727022 - DNA, 18 bp, Homo sapiens
agtgagaagggcctgctc

SEQ ID NO: 2727023 - DNA, 23 bp, Homo sapiens
agtgagaagggcctgctctgctt

SEQ ID NO: 2727024 - DNA, 20 bp, Homo sapiens
agtgagactgggaacttgat

SEQ ID NO: 2727025 - DNA, 12 bp, Homo sapiens
agtgagcctctg

SEQ ID NO: 2727026 - DNA, 13 bp, Homo sapiens
agtgagcctctgc

SEQ ID NO: 2727027 - DNA, 18 bp, Homo sapiens
agtgagcctctgcgcctc

SEQ ID NO: 2727028 - DNA, 19 bp, Homo sapiens
agtgatacaactgagtctc

SEQ ID NO: 2727029 - DNA, 23 bp, Homo sapiens
agtgatatggtactaaggagaat

SEQ ID NO: 2727030 - DNA, 22 bp, Homo sapiens
agtgatgaaaatttgcctttgc

SEQ ID NO: 2727031 - DNA, 17 bp, Homo sapiens
agtgcaccaccctttga

SEQ ID NO: 2727032 - DNA, 17 bp, Homo sapiens
agtgcagctcaggagac

SEQ ID NO: 2727033 - DNA, 13 bp, Homo sapiens
agtgcccattcct

SEQ ID NO: 2727034 - DNA, 17 bp, Homo sapiens
agtgccgccgcctcgcc

SEQ ID NO: 2727035 - DNA, 14 bp, Homo sapiens
agtgctggctgctg

SEQ ID NO: 2727036 - DNA, 16 bp, Homo sapiens
agtgctgtggcctggg

SEQ ID NO: 2727037 - DNA, 18 bp, Homo sapiens
agtgctgtggcctgggca

SEQ ID NO: 2727038 - DNA, 20 bp, Homo sapiens
agtgctgtttgggcaggagt

SEQ ID NO: 2727039 - DNA, 14 bp, Homo sapiens
agtgcttcagcctg

SEQ ID NO: 2727040 - DNA, 16 bp, Homo sapiens
agtgcttcagcctgag

SEQ ID NO: 2727041 - DNA, 17 bp, Homo sapiens
agtgcttcagcctgagg

SEQ ID NO: 2727042 - DNA, 19 bp, Homo sapiens
agtgcttcagcctgaggct

SEQ ID NO: 2727043 - DNA, 20 bp, Homo sapiens
agtgcttcagcctgaggctg

SEQ ID NO: 2727044 - DNA, 22 bp, Homo sapiens
agtggaaacatgctgaaatcta

SEQ ID NO: 2727045 - DNA, 17 bp, Homo sapiens
agtggaagtagtggagc

SEQ ID NO: 2727046 - DNA, 20 bp, Homo sapiens
agtggcactaaaatgtttaa

SEQ ID NO: 2727047 - DNA, 16 bp, Homo sapiens
agtggcattggcagca

SEQ ID NO: 2727048 - DNA, 14 bp, Homo sapiens
agtggctcacgcct

SEQ ID NO: 2727049 - DNA, 13 bp, Homo sapiens
agtgggaggacag

SEQ ID NO: 2727050 - DNA, 15 bp, Homo sapiens
agtgggcatgtatta

SEQ ID NO: 2727051 - DNA, 22 bp, Homo sapiens
agtggtttgatggtgacttcct

SEQ ID NO: 2727052 - DNA, 23 bp, Homo sapiens
agtgtacccccgcccaggctggc

SEQ ID NO: 2727053 - DNA, 13 bp, Homo sapiens
agtgtagccttgc

SEQ ID NO: 2727054 - DNA, 15 bp, Homo sapiens
agtgtcctgtctgct

SEQ ID NO: 2727055 - DNA, 20 bp, Homo sapiens
agtgtcctgtctgctgggct

SEQ ID NO: 2727056 - DNA, 13 bp, Homo sapiens
agtgtctctgcct

SEQ ID NO: 2727057 - DNA, 16 bp, Homo sapiens
agtgtctctgcctgga

SEQ ID NO: 2727058 - DNA, 19 bp, Homo sapiens
agtgtctgggctgactggg

SEQ ID NO: 2727059 - DNA, 16 bp, Homo sapiens
agtgtcttcctgtggg

SEQ ID NO: 2727060 - DNA, 23 bp, Homo sapiens
agtgtgccccccatcctggccca

SEQ ID NO: 2727061 - DNA, 14 bp, Homo sapiens
agtgtgtgctcagc

SEQ ID NO: 2727062 - DNA, 19 bp, Homo sapiens
agtgttaggcctggcacag

SEQ ID NO: 2727063 - DNA, 19 bp, Homo sapiens
agttatatttactttaaaa

SEQ ID NO: 2727064 - DNA, 19 bp, Homo sapiens
agttattttaattatcttt

SEQ ID NO: 2727065 - DNA, 20 bp, Homo sapiens
agttcaagaccagcctggcc

SEQ ID NO: 2727066 - DNA, 15 bp, Homo sapiens
agttcagacttagtt

SEQ ID NO: 2727067 - DNA, 21 bp, Homo sapiens
agttcataaatttgttgtcat

SEQ ID NO: 2727068 - DNA, 16 bp, Homo sapiens
agttcatataatttaa

SEQ ID NO: 2727069 - DNA, 18 bp, Homo sapiens
agttcatataatttaaag

SEQ ID NO: 2727070 - DNA, 18 bp, Homo sapiens
agttccagttttgttttg

SEQ ID NO: 2727071 - DNA, 18 bp, Homo sapiens
agttcctctagtgccctc

SEQ ID NO: 2727072 - DNA, 16 bp, Homo sapiens
agttcctctttgcatg

SEQ ID NO: 2727073 - DNA, 19 bp, Homo sapiens
agttcgagaccagcctggc

SEQ ID NO: 2727074 - DNA, 17 bp, Homo sapiens
agttctgtgtcctcgca

SEQ ID NO: 2727075 - DNA, 23 bp, Homo sapiens
agttctgtgtcctcgcactgccc

SEQ ID NO: 2727076 - DNA, 18 bp, Homo sapiens
agttgaaaaaagaagttt

SEQ ID NO: 2727077 - DNA, 20 bp, Homo sapiens
agttgaatggcctgccttga

SEQ ID NO: 2727078 - DNA, 15 bp, Homo sapiens
agttgacccctcctg

SEQ ID NO: 2727079 - DNA, 23 bp, Homo sapiens
agttgactttttttttgcccaga

SEQ ID NO: 2727080 - DNA, 13 bp, Homo sapiens
agttgatgctaca

SEQ ID NO: 2727081 - DNA, 18 bp, Homo sapiens
agttgattgcgagaattt

SEQ ID NO: 2727082 - DNA, 19 bp, Homo sapiens
agttgattgcgagaatttt

SEQ ID NO: 2727083 - DNA, 19 bp, Homo sapiens
agttgcaccattctttctt

SEQ ID NO: 2727084 - DNA, 14 bp, Homo sapiens
agttgctagcaaac

SEQ ID NO: 2727085 - DNA, 21 bp, Homo sapiens
agttggtcttactttgtgcaa

SEQ ID NO: 2727086 - DNA, 22 bp, Homo sapiens
agttggtcttactttgtgcaaa

SEQ ID NO: 2727087 - DNA, 18 bp, Homo sapiens
agttgtggaaagcctctg

SEQ ID NO: 2727088 - DNA, 20 bp, Homo sapiens
agttgtggaaagcctctgct

SEQ ID NO: 2727089 - DNA, 22 bp, Homo sapiens
agtttaaaatgaagcaatttat

SEQ ID NO: 2727090 - DNA, 21 bp, Homo sapiens
agtttatgtctaaagagcttt

SEQ ID NO: 2727091 - DNA, 15 bp, Homo sapiens
agtttctcaagttta

SEQ ID NO: 2727092 - DNA, 19 bp, Homo sapiens
agtttctcaagtttaaagt

SEQ ID NO: 2727093 - DNA, 16 bp, Homo sapiens
agtttcttttattttc

SEQ ID NO: 2727094 - DNA, 14 bp, Homo sapiens
agtttgaggctgca

SEQ ID NO: 2727095 - DNA, 17 bp, Homo sapiens
agtttgaggctgcagcg

SEQ ID NO: 2727096 - DNA, 20 bp, Homo sapiens
agtttgctgtatacaaacag

SEQ ID NO: 2727097 - DNA, 13 bp, Homo sapiens
agtttgtccttta

SEQ ID NO: 2727098 - DNA, 13 bp, Homo sapiens
agttttaaaactc

SEQ ID NO: 2727099 - DNA, 18 bp, Homo sapiens
agttttatacataaacag

SEQ ID NO: 2727100 - DNA, 12 bp, Homo sapiens
ataaaaaatggt

SEQ ID NO: 2727101 - DNA, 18 bp, Homo sapiens
ataaaaaatggtgcctga

SEQ ID NO: 2727102 - DNA, 23 bp, Homo sapiens
ataaaattgtaaaattgtataga

SEQ ID NO: 2727103 - DNA, 14 bp, Homo sapiens
ataaacaatccaaa

SEQ ID NO: 2727104 - DNA, 16 bp, Homo sapiens
ataaacaatccaaatg

SEQ ID NO: 2727105 - DNA, 12 bp, Homo sapiens
ataaacagtttt

SEQ ID NO: 2727106 - DNA, 21 bp, Homo sapiens
ataaaccttgtttctttctga

SEQ ID NO: 2727107 - DNA, 13 bp, Homo sapiens
ataaactactttg

SEQ ID NO: 2727108 - DNA, 15 bp, Homo sapiens
ataaacttagaataa

SEQ ID NO: 2727109 - DNA, 12 bp, Homo sapiens
ataaacttcagc

SEQ ID NO: 2727110 - DNA, 13 bp, Homo sapiens
ataaacttcagca

SEQ ID NO: 2727111 - DNA, 11 bp, Homo sapiens
ataaagagctc

SEQ ID NO: 2727112 - DNA, 13 bp, Homo sapiens
ataaaggtattta

SEQ ID NO: 2727113 - DNA, 14 bp, Homo sapiens
ataaaggtatttag

SEQ ID NO: 2727114 - DNA, 15 bp, Homo sapiens
ataaagtatgccttc

SEQ ID NO: 2727115 - DNA, 16 bp, Homo sapiens
ataaatacacagcatg

SEQ ID NO: 2727116 - DNA, 11 bp, Homo sapiens
ataaatatgtg

SEQ ID NO: 2727117 - DNA, 14 bp, Homo sapiens
ataaatatgtgaaa

SEQ ID NO: 2727118 - DNA, 14 bp, Homo sapiens
ataaatgctgaatg

SEQ ID NO: 2727119 - DNA, 22 bp, Homo sapiens
attatttgttatttgtacagtt

SEQ ID NO: 2727120 - DNA, 13 bp, Homo sapiens
attattttacagt

SEQ ID NO: 2727121 - DNA, 15 bp, Homo sapiens
attattttacagtct

SEQ ID NO: 2727122 - DNA, 11 bp, Homo sapiens
attattttcaa

SEQ ID NO: 2727123 - DNA, 22 bp, Homo sapiens
attattttttgcatcatttaaa

SEQ ID NO: 2727124 - DNA, 15 bp, Homo sapiens
attcaaaatgtccag

SEQ ID NO: 2727125 - DNA, 17 bp, Homo sapiens
attcaaagaaaacccta

SEQ ID NO: 2727126 - DNA, 18 bp, Homo sapiens
attcaacctgtgtcttat

SEQ ID NO: 2727127 - DNA, 14 bp, Homo sapiens
attcacaaacaaat

SEQ ID NO: 2727128 - DNA, 21 bp, Homo sapiens
attcacaaacaaatggctgta

SEQ ID NO: 2727129 - DNA, 13 bp, Homo sapiens
attcactcccaca

SEQ ID NO: 2727130 - DNA, 21 bp, Homo sapiens
attcactcccacacccaagaa

SEQ ID NO: 2727131 - DNA, 21 bp, Homo sapiens
attcagataaggcagaactag

SEQ ID NO: 2727132 - DNA, 20 bp, Homo sapiens
attcagtgctgtggcctggg

SEQ ID NO: 2727133 - DNA, 21 bp, Homo sapiens
attcagtgctgtggcctgggc

SEQ ID NO: 2727134 - DNA, 12 bp, Homo sapiens
attcataaatct

SEQ ID NO: 2727135 - DNA, 17 bp, Homo sapiens
attcatctggaggctgc

SEQ ID NO: 2727136 - DNA, 18 bp, Homo sapiens
attcatgcaacttgattc

SEQ ID NO: 2727137 - DNA, 17 bp, Homo sapiens
attcatgctttctcctt

SEQ ID NO: 2727138 - DNA, 18 bp, Homo sapiens
attcatgctttctccttt

SEQ ID NO: 2727139 - DNA, 19 bp, Homo sapiens
attcatgctttctcctttt

SEQ ID NO: 2727140 - DNA, 14 bp, Homo sapiens
attcattaatctgt

SEQ ID NO: 2727141 - DNA, 11 bp, Homo sapiens
attcattgtgt

SEQ ID NO: 2727142 - DNA, 16 bp, Homo sapiens
attccagtgtattttc

SEQ ID NO: 2727143 - DNA, 19 bp, Homo sapiens
attccagtgtattttctgt

SEQ ID NO: 2727144 - DNA, 21 bp, Homo sapiens
attcccactaagctttctcct

SEQ ID NO: 2727145 - DNA, 22 bp, Homo sapiens
attcccactaagctttctcctt

SEQ ID NO: 2727146 - DNA, 20 bp, Homo sapiens
attcccatggtagactgtga

SEQ ID NO: 2727147 - DNA, 21 bp, Homo sapiens
attcccatggtagactgtgac

SEQ ID NO: 2727148 - DNA, 22 bp, Homo sapiens
attcccttctgatcttggaaag

SEQ ID NO: 2727149 - DNA, 15 bp, Homo sapiens
attcctctaaaactc

SEQ ID NO: 2727150 - DNA, 20 bp, Homo sapiens
attctacacatatatgtata

SEQ ID NO: 2727151 - DNA, 14 bp, Homo sapiens
attctattttgctg

SEQ ID NO: 2727152 - DNA, 16 bp, Homo sapiens
attctctctgctcagt

SEQ ID NO: 2727153 - DNA, 15 bp, Homo sapiens
attctgataatgtat

SEQ ID NO: 2727154 - DNA, 17 bp, Homo sapiens
attctgtggtgggaaca

SEQ ID NO: 2727155 - DNA, 14 bp, Homo sapiens
attcttctgcctca

SEQ ID NO: 2727156 - DNA, 14 bp, Homo sapiens
attctttaaggaga

SEQ ID NO: 2727157 - DNA, 15 bp, Homo sapiens
attctttaaggagat

SEQ ID NO: 2727158 - DNA, 14 bp, Homo sapiens
attcttttccagaa

SEQ ID NO: 2727159 - DNA, 16 bp, Homo sapiens
attcttttgttattaa

SEQ ID NO: 2727160 - DNA, 19 bp, Homo sapiens
attgaaggagaaaatgcat

SEQ ID NO: 2727161 - DNA, 22 bp, Homo sapiens
attgagagatgttttgttgata

SEQ ID NO: 2727162 - DNA, 15 bp, Homo sapiens
attgatcattcataa

SEQ ID NO: 2727163 - DNA, 21 bp, Homo sapiens
attgatgtcattcagcagtca

SEQ ID NO: 2727164 - DNA, 14 bp, Homo sapiens
attgattaaaatct

SEQ ID NO: 2727165 - DNA, 22 bp, Homo sapiens
attgattattctgattccactt

SEQ ID NO: 2727166 - DNA, 17 bp, Homo sapiens
attgcttgaacccagga

SEQ ID NO: 2727167 - DNA, 14 bp, Homo sapiens
attggaagctccca

SEQ ID NO: 2727168 - DNA, 16 bp, Homo sapiens
attggagaaaagcaca

SEQ ID NO: 2727169 - DNA, 16 bp, Homo sapiens
attggccctgcccctc

SEQ ID NO: 2727170 - DNA, 20 bp, Homo sapiens
attgggcagaatcctgggcc

SEQ ID NO: 2727171 - DNA, 22 bp, Homo sapiens
attgggcagaatcctgggcccc

SEQ ID NO: 2727172 - DNA, 20 bp, Homo sapiens
attggtccaacccagcctga

SEQ ID NO: 2727173 - DNA, 15 bp, Homo sapiens
attggttctatttat

SEQ ID NO: 2727174 - DNA, 17 bp, Homo sapiens
attggtttaaaagtcac

SEQ ID NO: 2727175 - DNA, 19 bp, Homo sapiens
attgtaaaggtaggtgcat

SEQ ID NO: 2727176 - DNA, 16 bp, Homo sapiens
attgtatatatggata

SEQ ID NO: 2727177 - DNA, 15 bp, Homo sapiens
attgtctccttgagt

SEQ ID NO: 2727178 - DNA, 14 bp, Homo sapiens
attgtctgtctgct

SEQ ID NO: 2727179 - DNA, 17 bp, Homo sapiens
attgtcttccaacccca

SEQ ID NO: 2727180 - DNA, 20 bp, Homo sapiens
attgtcttccaaccccagct

SEQ ID NO: 2727181 - DNA, 21 bp, Homo sapiens
attgtcttccaaccccagctg

SEQ ID NO: 2727182 - DNA, 23 bp, Homo sapiens
attgtgaaaaatgagcttgtaaa

SEQ ID NO: 2727183 - DNA, 15 bp, Homo sapiens
attgtgattattgtt

SEQ ID NO: 2727184 - DNA, 18 bp, Homo sapiens
attgtgttggctttacaa

SEQ ID NO: 2727185 - DNA, 17 bp, Homo sapiens
attgttatgatctactc

SEQ ID NO: 2727186 - DNA, 20 bp, Homo sapiens
attgttctgggtgatttcta

SEQ ID NO: 2727187 - DNA, 16 bp, Homo sapiens
attgtttgcacagagg

SEQ ID NO: 2727188 - DNA, 16 bp, Homo sapiens
attgtttttagaaatt

SEQ ID NO: 2727189 - DNA, 13 bp, Homo sapiens
atttaaagcacat

SEQ ID NO: 2727190 - DNA, 15 bp, Homo sapiens
atttaactagcactt

SEQ ID NO: 2727191 - DNA, 13 bp, Homo sapiens
atttaactgcctt

SEQ ID NO: 2727192 - DNA, 22 bp, Homo sapiens
atttaacttgagggtaataaac

SEQ ID NO: 2727193 - DNA, 23 bp, Homo sapiens
atttaacttgagggtaataaact

SEQ ID NO: 2727194 - DNA, 12 bp, Homo sapiens
atttaagtacta

SEQ ID NO: 2727195 - DNA, 17 bp, Homo sapiens
atttaagtactatcttt

SEQ ID NO: 2727196 - DNA, 19 bp, Homo sapiens
atttaagtactatctttgt

SEQ ID NO: 2727197 - DNA, 21 bp, Homo sapiens
atttaagtactatctttgtct

SEQ ID NO: 2727198 - DNA, 13 bp, Homo sapiens
atttaatatctga

SEQ ID NO: 2727199 - DNA, 16 bp, Homo sapiens
atttaatatctgagaa

SEQ ID NO: 2727200 - DNA, 22 bp, Homo sapiens
atttaatttataggcagatctt

SEQ ID NO: 2727201 - DNA, 19 bp, Homo sapiens
atttacctgcgaacttgtg

SEQ ID NO: 2727202 - DNA, 13 bp, Homo sapiens
atttagaatatat

SEQ ID NO: 2727203 - DNA, 20 bp, Homo sapiens
atttagaatatattaaatcg

SEQ ID NO: 2727204 - DNA, 15 bp, Homo sapiens
atttaggagaagttg

SEQ ID NO: 2727205 - DNA, 17 bp, Homo sapiens
atttagggaagcaggga

SEQ ID NO: 2727206 - DNA, 23 bp, Homo sapiens
atttagggaagcagggacacccc

SEQ ID NO: 2727207 - DNA, 17 bp, Homo sapiens
atttagtcccttaaaaa

SEQ ID NO: 2727208 - DNA, 20 bp, Homo sapiens
atttagtgatattgtgggta

SEQ ID NO: 2727209 - DNA, 17 bp, Homo sapiens
atttataggcagatctt

SEQ ID NO: 2727210 - DNA, 18 bp, Homo sapiens
atttataggcagatcttt

SEQ ID NO: 2727211 - DNA, 23 bp, Homo sapiens
atttataggcagatctttaaata

SEQ ID NO: 2727212 - DNA, 18 bp, Homo sapiens
atttatatctttatgcaa

SEQ ID NO: 2727213 - DNA, 17 bp, Homo sapiens
atttatcatatttaata

SEQ ID NO: 2727214 - DNA, 15 bp, Homo sapiens
atttattcttatctt

SEQ ID NO: 2727215 - DNA, 13 bp, Homo sapiens
atttattgtatat

SEQ ID NO: 2727216 - DNA, 20 bp, Homo sapiens
atttattgtatatatggata

SEQ ID NO: 2727217 - DNA, 13 bp, Homo sapiens
atttatttattgt

SEQ ID NO: 2727218 - DNA, 20 bp, Homo sapiens
atttcacatcagctttagga

SEQ ID NO: 2727219 - DNA, 17 bp, Homo sapiens
atttcaggaatttaatt

SEQ ID NO: 2727220 - DNA, 12 bp, Homo sapiens
atttcaggaggt

SEQ ID NO: 2727221 - DNA, 22 bp, Homo sapiens
atttcatacaacagaaaccaga

SEQ ID NO: 2727222 - DNA, 17 bp, Homo sapiens
atttccacataaaggta

SEQ ID NO: 2727223 - DNA, 16 bp, Homo sapiens
atttccactcaggtct

SEQ ID NO: 2727224 - DNA, 16 bp, Homo sapiens
atttcccgtggcccca

SEQ ID NO: 2727225 - DNA, 24 bp, Homo sapiens
atttcctcaacgttgctccccatc

SEQ ID NO: 2727226 - DNA, 21 bp, Homo sapiens
atttccttcaccacctcatgt

SEQ ID NO: 2727227 - DNA, 13 bp, Homo sapiens
atttctaaaacat

SEQ ID NO: 2727228 - DNA, 17 bp, Homo sapiens
atttctaaaacattaat

SEQ ID NO: 2727229 - DNA, 14 bp, Homo sapiens
atttctactgtata

SEQ ID NO: 2727230 - DNA, 19 bp, Homo sapiens
atttctagtatctattgtg

SEQ ID NO: 2727231 - DNA, 17 bp, Homo sapiens
atttctggccatttaac

SEQ ID NO: 2727232 - DNA, 19 bp, Homo sapiens
atttcttggtatgatcatt

SEQ ID NO: 2727233 - DNA, 18 bp, Homo sapiens
atttgcctaattcctggc

SEQ ID NO: 2727234 - DNA, 16 bp, Homo sapiens
atttggaagagaggca

SEQ ID NO: 2727235 - DNA, 21 bp, Homo sapiens
atttggaagagaggcacctgc

SEQ ID NO: 2727236 - DNA, 21 bp, Homo sapiens
atttggcagaactgctggggc

SEQ ID NO: 2727237 - DNA, 17 bp, Homo sapiens
atttgggggaggcttca

SEQ ID NO: 2727238 - DNA, 14 bp, Homo sapiens
atttgtaagtttat

SEQ ID NO: 2727239 - DNA, 23 bp, Homo sapiens
atttgtaagtttatgtctaaaga

SEQ ID NO: 2727240 - DNA, 18 bp, Homo sapiens
atttgtacagttcagttc

SEQ ID NO: 2727241 - DNA, 14 bp, Homo sapiens
atttgtatctgaag

SEQ ID NO: 2727242 - DNA, 21 bp, Homo sapiens
atttgtatctgaaggagattt

SEQ ID NO: 2727243 - DNA, 16 bp, Homo sapiens
cagatctttttgtgaa

SEQ ID NO: 2727244 - DNA, 12 bp, Homo sapiens
cagatgagctgt

SEQ ID NO: 2727245 - DNA, 22 bp, Homo sapiens
cagatgcccagagggcccaggc

SEQ ID NO: 2727246 - DNA, 17 bp, Homo sapiens
cagatgggatgggcttt

SEQ ID NO: 2727247 - DNA, 15 bp, Homo sapiens
cagatgggcctgtgt

SEQ ID NO: 2727248 - DNA, 14 bp, Homo sapiens
cagattacaataaa

SEQ ID NO: 2727249 - DNA, 13 bp, Homo sapiens
cagattcaggagc

SEQ ID NO: 2727250 - DNA, 17 bp, Homo sapiens
cagattcaggagctcag

SEQ ID NO: 2727251 - DNA, 18 bp, Homo sapiens
cagattcaggagctcagt

SEQ ID NO: 2727252 - DNA, 12 bp, Homo sapiens
cagattgcccca

SEQ ID NO: 2727253 - DNA, 16 bp, Homo sapiens
cagattttctcctgtg

SEQ ID NO: 2727254 - DNA, 13 bp, Homo sapiens
cagcaaagccata

SEQ ID NO: 2727255 - DNA, 14 bp, Homo sapiens
cagcaaagccatat

SEQ ID NO: 2727256 - DNA, 17 bp, Homo sapiens
cagcaaagccatattct

SEQ ID NO: 2727257 - DNA, 16 bp, Homo sapiens
cagcaaagttttcaga

SEQ ID NO: 2727258 - DNA, 19 bp, Homo sapiens
cagcaaggaggctggctgg

SEQ ID NO: 2727259 - DNA, 16 bp, Homo sapiens
cagcaaggcacctgca

SEQ ID NO: 2727260 - DNA, 11 bp, Homo sapiens
cagcacagctc

SEQ ID NO: 2727261 - DNA, 16 bp, Homo sapiens
cagcacccgggctcag

SEQ ID NO: 2727262 - DNA, 19 bp, Homo sapiens
cagcactttgggaggctga

SEQ ID NO: 2727263 - DNA, 22 bp, Homo sapiens
cagcactttgggaggctgaggc

SEQ ID NO: 2727264 - DNA, 17 bp, Homo sapiens
cagcaggtgctgctacc

SEQ ID NO: 2727265 - DNA, 13 bp, Homo sapiens
cagcatcaaacat

SEQ ID NO: 2727266 - DNA, 17 bp, Homo sapiens
cagcatcaaacatgaaa

SEQ ID NO: 2727267 - DNA, 13 bp, Homo sapiens
cagcatctcagag

SEQ ID NO: 2727268 - DNA, 14 bp, Homo sapiens
cagcatctctatga

SEQ ID NO: 2727269 - DNA, 14 bp, Homo sapiens
cagccactgcagca

SEQ ID NO: 2727270 - DNA, 16 bp, Homo sapiens
cagccactgcagcaca

SEQ ID NO: 2727271 - DNA, 12 bp, Homo sapiens
cagccagccctg

SEQ ID NO: 2727272 - DNA, 16 bp, Homo sapiens
cagccagccctggagg

SEQ ID NO: 2727273 - DNA, 17 bp, Homo sapiens
cagccagccctggaggc

SEQ ID NO: 2727274 - DNA, 22 bp, Homo sapiens
cagccaggactccttagactga

SEQ ID NO: 2727275 - DNA, 16 bp, Homo sapiens
cagccattaccatgga

SEQ ID NO: 2727276 - DNA, 15 bp, Homo sapiens
cagccccacagccca

SEQ ID NO: 2727277 - DNA, 12 bp, Homo sapiens
cagccctggagg

SEQ ID NO: 2727278 - DNA, 21 bp, Homo sapiens
cagccctggaggctggatggc

SEQ ID NO: 2727279 - DNA, 22 bp, Homo sapiens
cagccctggaggctggatggct

SEQ ID NO: 2727280 - DNA, 23 bp, Homo sapiens
cagccctggaggctggatggctc

SEQ ID NO: 2727281 - DNA, 22 bp, Homo sapiens
cagccctttgcaggcccagcag

SEQ ID NO: 2727282 - DNA, 19 bp, Homo sapiens
cagccgcagcctccctctg

SEQ ID NO: 2727283 - DNA, 13 bp, Homo sapiens
cagccgctgcccg

SEQ ID NO: 2727284 - DNA, 15 bp, Homo sapiens
cagccgtattttaca

SEQ ID NO: 2727285 - DNA, 16 bp, Homo sapiens
cagccgtattttacat

SEQ ID NO: 2727286 - DNA, 21 bp, Homo sapiens
cagcctcacagatgctggcct

SEQ ID NO: 2727287 - DNA, 12 bp, Homo sapiens
cagcctccaggc

SEQ ID NO: 2727288 - DNA, 18 bp, Homo sapiens
cagcctccagtgctggct

SEQ ID NO: 2727289 - DNA, 20 bp, Homo sapiens
cagcctccagtgctggctgc

SEQ ID NO: 2727290 - DNA, 21 bp, Homo sapiens
cagcctccagtgctggctgct

SEQ ID NO: 2727291 - DNA, 15 bp, Homo sapiens
cagcctccagtggga

SEQ ID NO: 2727292 - DNA, 18 bp, Homo sapiens
cagcctcccacaggtggt

SEQ ID NO: 2727293 - DNA, 18 bp, Homo sapiens
cagcctcccagctttctg

SEQ ID NO: 2727294 - DNA, 19 bp, Homo sapiens
cagcctcccgagtagctgg

SEQ ID NO: 2727295 - DNA, 10 bp, Homo sapiens
cagcctcctg

SEQ ID NO: 2727296 - DNA, 11 bp, Homo sapiens
cagcctcctga

SEQ ID NO: 2727297 - DNA, 19 bp, Homo sapiens
cagcctgacgcctactggg

SEQ ID NO: 2727298 - DNA, 19 bp, Homo sapiens
cagcctgaggctgagactg

SEQ ID NO: 2727299 - DNA, 22 bp, Homo sapiens
cagcctgccccagcctcccagc

SEQ ID NO: 2727300 - DNA, 20 bp, Homo sapiens
cagcctggccaccagcttcc

SEQ ID NO: 2727301 - DNA, 11 bp, Homo sapiens
cagcctggccc

SEQ ID NO: 2727302 - DNA, 14 bp, Homo sapiens
cagcctggcccagc

SEQ ID NO: 2727303 - DNA, 15 bp, Homo sapiens
cagcctggcccagct

SEQ ID NO: 2727304 - DNA, 19 bp, Homo sapiens
cagcctggcccagctcccc

SEQ ID NO: 2727305 - DNA, 14 bp, Homo sapiens
cagcctggcttctg

SEQ ID NO: 2727306 - DNA, 15 bp, Homo sapiens
cagcctggcttctgg

SEQ ID NO: 2727307 - DNA, 16 bp, Homo sapiens
cagcctggcttctgga

SEQ ID NO: 2727308 - DNA, 20 bp, Homo sapiens
cagcctggcttctggagccc

SEQ ID NO: 2727309 - DNA, 11 bp, Homo sapiens
cagcctgggcg

SEQ ID NO: 2727310 - DNA, 15 bp, Homo sapiens
cagcctgggcgacag

SEQ ID NO: 2727311 - DNA, 17 bp, Homo sapiens
cagcctgggcgacagag

SEQ ID NO: 2727312 - DNA, 17 bp, Homo sapiens
cagcctgtcctggtaca

SEQ ID NO: 2727313 - DNA, 18 bp, Homo sapiens
cagcctgtcgtgtccagc

SEQ ID NO: 2727314 - DNA, 20 bp, Homo sapiens
cagccttaaacagtgtccag

SEQ ID NO: 2727315 - DNA, 21 bp, Homo sapiens
cagccttaaacagtgtccagg

SEQ ID NO: 2727316 - DNA, 14 bp, Homo sapiens
cagccttccccctc

SEQ ID NO: 2727317 - DNA, 20 bp, Homo sapiens
cagccttccccctcccaggg

SEQ ID NO: 2727318 - DNA, 22 bp, Homo sapiens
cagcctttcacaggactctgca

SEQ ID NO: 2727319 - DNA, 19 bp, Homo sapiens
cagcgcctcctggacctga

SEQ ID NO: 2727320 - DNA, 21 bp, Homo sapiens
cagcgcctgtcccctcacaga

SEQ ID NO: 2727321 - DNA, 22 bp, Homo sapiens
cagcggcagatgggcctgtgtg

SEQ ID NO: 2727322 - DNA, 21 bp, Homo sapiens
cagcggccttgaagaggcagg

SEQ ID NO: 2727323 - DNA, 15 bp, Homo sapiens
cagctaagcctgatg

SEQ ID NO: 2727324 - DNA, 19 bp, Homo sapiens
cagctaagcctgatgatgg

SEQ ID NO: 2727325 - DNA, 16 bp, Homo sapiens
cagctactcagaagcc

SEQ ID NO: 2727326 - DNA, 21 bp, Homo sapiens
cagctactcagaagcctgagg

SEQ ID NO: 2727327 - DNA, 17 bp, Homo sapiens
cagctattcccttctga

SEQ ID NO: 2727328 - DNA, 20 bp, Homo sapiens
cagctattcccttctgatct

SEQ ID NO: 2727329 - DNA, 17 bp, Homo sapiens
cagctcctcccctgccg

SEQ ID NO: 2727330 - DNA, 18 bp, Homo sapiens
cagctcctcccctgccgc

SEQ ID NO: 2727331 - DNA, 20 bp, Homo sapiens
cagctcctcccctgccgcct

SEQ ID NO: 2727332 - DNA, 22 bp, Homo sapiens
cagctcctcccctgccgcctcc

SEQ ID NO: 2727333 - DNA, 14 bp, Homo sapiens
cagctctgtcaccc

SEQ ID NO: 2727334 - DNA, 19 bp, Homo sapiens
cagctctgtcaccctggcc

SEQ ID NO: 2727335 - DNA, 14 bp, Homo sapiens
cagctgacagtcct

SEQ ID NO: 2727336 - DNA, 16 bp, Homo sapiens
cagctgacagtcctct

SEQ ID NO: 2727337 - DNA, 16 bp, Homo sapiens
cagctgcacctgccag

SEQ ID NO: 2727338 - DNA, 18 bp, Homo sapiens
cagctgcacctgccagcc

SEQ ID NO: 2727339 - DNA, 13 bp, Homo sapiens
cagctgctgccac

SEQ ID NO: 2727340 - DNA, 16 bp, Homo sapiens
cagctgctgccactct

SEQ ID NO: 2727341 - DNA, 18 bp, Homo sapiens
cagctgctgccactctgc

SEQ ID NO: 2727342 - DNA, 22 bp, Homo sapiens
cagctgctgccactctgctgcc

SEQ ID NO: 2727343 - DNA, 23 bp, Homo sapiens
cagctgctgccactctgctgcct

SEQ ID NO: 2727344 - DNA, 21 bp, Homo sapiens
cagctggacccatttgccagg

SEQ ID NO: 2727345 - DNA, 10 bp, Homo sapiens
cagctggcct

SEQ ID NO: 2727346 - DNA, 20 bp, Homo sapiens
cagctggctctccaccttgt

SEQ ID NO: 2727347 - DNA, 14 bp, Homo sapiens
cagctgggcccaca

SEQ ID NO: 2727348 - DNA, 15 bp, Homo sapiens
cagctgggcccacag

SEQ ID NO: 2727349 - DNA, 17 bp, Homo sapiens
cagctgggcccacagcc

SEQ ID NO: 2727350 - DNA, 11 bp, Homo sapiens
cagctggtgga

SEQ ID NO: 2727351 - DNA, 15 bp, Homo sapiens
cagctggtggatggt

SEQ ID NO: 2727352 - DNA, 18 bp, Homo sapiens
cagctgtagctcccgagc

SEQ ID NO: 2727353 - DNA, 14 bp, Homo sapiens
cagctgtggtccca

SEQ ID NO: 2727354 - DNA, 15 bp, Homo sapiens
cagctgtggtcccac

SEQ ID NO: 2727355 - DNA, 18 bp, Homo sapiens
cagctgtggtcccaccca

SEQ ID NO: 2727356 - DNA, 16 bp, Homo sapiens
cagcttcacttaaaat

SEQ ID NO: 2727357 - DNA, 17 bp, Homo sapiens
cagcttcctctgagccg

SEQ ID NO: 2727358 - DNA, 13 bp, Homo sapiens
cagcttcctgagt

SEQ ID NO: 2727359 - DNA, 12 bp, Homo sapiens
cagcttctgcca

SEQ ID NO: 2727360 - DNA, 14 bp, Homo sapiens
cagcttctgttgga

SEQ ID NO: 2727361 - DNA, 20 bp, Homo sapiens
cagctttccctccccagagt

SEQ ID NO: 2727362 - DNA, 15 bp, Homo sapiens
cagctttgggaaagc

SEQ ID NO: 2727363 - DNA, 15 bp, Homo sapiens
cagcttttgcttcat

SEQ ID NO: 2727364 - DNA, 20 bp, Homo sapiens
cagctttttgtattaacaaa

SEQ ID NO: 2727365 - DNA, 18 bp, Homo sapiens
caggaaaagcctctgtgt

SEQ ID NO: 2727366 - DNA, 16 bp, Homo sapiens
caggaaccggagggtg

SEQ ID NO: 2727367 - DNA, 18 bp, Homo sapiens
caggaagggagggagctg

SEQ ID NO: 2727368 - DNA, 22 bp, Homo sapiens
ccaagcgtgattcctgctgcct

SEQ ID NO: 2727369 - DNA, 17 bp, Homo sapiens
ccaagctgtgccaccct

SEQ ID NO: 2727370 - DNA, 19 bp, Homo sapiens
ccaagggtatgggaagcca

SEQ ID NO: 2727371 - DNA, 20 bp, Homo sapiens
ccaagggtatgggaagccat

SEQ ID NO: 2727372 - DNA, 16 bp, Homo sapiens
ccaaggtctcacactc

SEQ ID NO: 2727373 - DNA, 19 bp, Homo sapiens
ccaaggtctcacactcctc

SEQ ID NO: 2727374 - DNA, 20 bp, Homo sapiens
ccaaggtctcacactcctcc

SEQ ID NO: 2727375 - DNA, 14 bp, Homo sapiens
ccaaggtttcccag

SEQ ID NO: 2727376 - DNA, 20 bp, Homo sapiens
ccaagtcaacactcttcttg

SEQ ID NO: 2727377 - DNA, 21 bp, Homo sapiens
ccaagtcaacactcttcttga

SEQ ID NO: 2727378 - DNA, 23 bp, Homo sapiens
ccaagtcaacactcttcttgagc

SEQ ID NO: 2727379 - DNA, 22 bp, Homo sapiens
ccaagtccaacctgcctgtgca

SEQ ID NO: 2727380 - DNA, 16 bp, Homo sapiens
ccaagtgccagtcttg

SEQ ID NO: 2727381 - DNA, 15 bp, Homo sapiens
ccaataaagcagagt

SEQ ID NO: 2727382 - DNA, 23 bp, Homo sapiens
ccaatccaggcccggtgaggcca

SEQ ID NO: 2727383 - DNA, 17 bp, Homo sapiens
ccaatcccccagcgctt

SEQ ID NO: 2727384 - DNA, 23 bp, Homo sapiens
ccaatcttagtttctaaccaaag

SEQ ID NO: 2727385 - DNA, 20 bp, Homo sapiens
ccacaacctccacctcctgg

SEQ ID NO: 2727386 - DNA, 23 bp, Homo sapiens
ccacaagccattttttgaggaga

SEQ ID NO: 2727387 - DNA, 16 bp, Homo sapiens
ccacacacactccttc

SEQ ID NO: 2727388 - DNA, 17 bp, Homo sapiens
ccacacacactccttcc

SEQ ID NO: 2727389 - DNA, 18 bp, Homo sapiens
ccacaccaagctgtgcca

SEQ ID NO: 2727390 - DNA, 15 bp, Homo sapiens
ccacaccctgcctgc

SEQ ID NO: 2727391 - DNA, 16 bp, Homo sapiens
ccacaccctgcctgct

SEQ ID NO: 2727392 - DNA, 18 bp, Homo sapiens
ccacaccctgcctgctgt

SEQ ID NO: 2727393 - DNA, 13 bp, Homo sapiens
ccacacttcttga

SEQ ID NO: 2727394 - DNA, 22 bp, Homo sapiens
ccacacttcttgaaacagcctg

SEQ ID NO: 2727395 - DNA, 15 bp, Homo sapiens
ccacagcccccaccc

SEQ ID NO: 2727396 - DNA, 11 bp, Homo sapiens
ccacagctctg

SEQ ID NO: 2727397 - DNA, 13 bp, Homo sapiens
ccacagctctgct

SEQ ID NO: 2727398 - DNA, 15 bp, Homo sapiens
ccacagctctgctgg

SEQ ID NO: 2727399 - DNA, 19 bp, Homo sapiens
ccacagctctgctggaaga

SEQ ID NO: 2727400 - DNA, 20 bp, Homo sapiens
ccacagtggaaccagcccag

SEQ ID NO: 2727401 - DNA, 22 bp, Homo sapiens
ccacagtgttggcgagaggagg

SEQ ID NO: 2727402 - DNA, 20 bp, Homo sapiens
ccaccactaggactctgagg

SEQ ID NO: 2727403 - DNA, 23 bp, Homo sapiens
ccaccagagcaggggctgctggg

SEQ ID NO: 2727404 - DNA, 12 bp, Homo sapiens
ccaccagagctg

SEQ ID NO: 2727405 - DNA, 15 bp, Homo sapiens
ccaccagagctgcct

SEQ ID NO: 2727406 - DNA, 21 bp, Homo sapiens
ccaccagcttccctctgcctg

SEQ ID NO: 2727407 - DNA, 23 bp, Homo sapiens
ccaccatattcagtgctgtggcc

SEQ ID NO: 2727408 - DNA, 17 bp, Homo sapiens
ccacccaacctgtcctt

SEQ ID NO: 2727409 - DNA, 22 bp, Homo sapiens
ccacccaggaagggagggagct

SEQ ID NO: 2727410 - DNA, 21 bp, Homo sapiens
ccacccagggctccctcctgg

SEQ ID NO: 2727411 - DNA, 23 bp, Homo sapiens
ccacccagggctccctcctggag

SEQ ID NO: 2727412 - DNA, 13 bp, Homo sapiens
ccaccctgcccct

SEQ ID NO: 2727413 - DNA, 23 bp, Homo sapiens
ccaccctgggcaatgcagtgcag

SEQ ID NO: 2727414 - DNA, 20 bp, Homo sapiens
ccaccctgggctctgtgggc

SEQ ID NO: 2727415 - DNA, 11 bp, Homo sapiens
ccaccctgggt

SEQ ID NO: 2727416 - DNA, 20 bp, Homo sapiens
ccaccctgggtttggcccct

SEQ ID NO: 2727417 - DNA, 13 bp, Homo sapiens
ccaccgcagctgc

SEQ ID NO: 2727418 - DNA, 16 bp, Homo sapiens
ccaccgcagctgctgc

SEQ ID NO: 2727419 - DNA, 17 bp, Homo sapiens
ccaccgcatgccccctc

SEQ ID NO: 2727420 - DNA, 13 bp, Homo sapiens
ccaccgccatggc

SEQ ID NO: 2727421 - DNA, 23 bp, Homo sapiens
ccacctagtggctgtccagtgcc

SEQ ID NO: 2727422 - DNA, 14 bp, Homo sapiens
ccacctcctgggtt

SEQ ID NO: 2727423 - DNA, 19 bp, Homo sapiens
ccacctcggatcccactga

SEQ ID NO: 2727424 - DNA, 20 bp, Homo sapiens
ccaccttcaattcctgggcc

SEQ ID NO: 2727425 - DNA, 21 bp, Homo sapiens
ccacctttgggatcagcctcc

SEQ ID NO: 2727426 - DNA, 16 bp, Homo sapiens
ccacggggaccactgg

SEQ ID NO: 2727427 - DNA, 19 bp, Homo sapiens
ccacggggaccactgggcc

SEQ ID NO: 2727428 - DNA, 20 bp, Homo sapiens
ccacggggaccactgggccc

SEQ ID NO: 2727429 - DNA, 16 bp, Homo sapiens
ccacgtaccaagccac

SEQ ID NO: 2727430 - DNA, 19 bp, Homo sapiens
ccacgtaccaagccaccgc

SEQ ID NO: 2727431 - DNA, 20 bp, Homo sapiens
ccacgtaccaagccaccgca

SEQ ID NO: 2727432 - DNA, 15 bp, Homo sapiens
ccacgtcctgtcagt

SEQ ID NO: 2727433 - DNA, 16 bp, Homo sapiens
ccacgtcctgtcagtg

SEQ ID NO: 2727434 - DNA, 19 bp, Homo sapiens
ccacgtcctgtcagtgccg

SEQ ID NO: 2727435 - DNA, 14 bp, Homo sapiens
ccacgtctctctgc

SEQ ID NO: 2727436 - DNA, 16 bp, Homo sapiens
ccacgtctgtgctctg

SEQ ID NO: 2727437 - DNA, 15 bp, Homo sapiens
ccacgtgcacagctt

SEQ ID NO: 2727438 - DNA, 15 bp, Homo sapiens
ccacgtgctcgcctc

SEQ ID NO: 2727439 - DNA, 23 bp, Homo sapiens
ccacgtgctcgcctctgcccagc

SEQ ID NO: 2727440 - DNA, 18 bp, Homo sapiens
ccactaagctttctcctt

SEQ ID NO: 2727441 - DNA, 14 bp, Homo sapiens
ccactacactccag

SEQ ID NO: 2727442 - DNA, 16 bp, Homo sapiens
ccactaggactctgag

SEQ ID NO: 2727443 - DNA, 18 bp, Homo sapiens
ccactaggactctgaggc

SEQ ID NO: 2727444 - DNA, 11 bp, Homo sapiens
ccactcacagg

SEQ ID NO: 2727445 - DNA, 20 bp, Homo sapiens
ccactcaggccaacaagcca

SEQ ID NO: 2727446 - DNA, 20 bp, Homo sapiens
ccactccacctccacccact

SEQ ID NO: 2727447 - DNA, 16 bp, Homo sapiens
ccactccccaccttca

SEQ ID NO: 2727448 - DNA, 22 bp, Homo sapiens
ccactcctaatcaagagtctct

SEQ ID NO: 2727449 - DNA, 15 bp, Homo sapiens
ccactcctcttattt

SEQ ID NO: 2727450 - DNA, 12 bp, Homo sapiens
ccactctgctgc

SEQ ID NO: 2727451 - DNA, 17 bp, Homo sapiens
ccactctgctgcctgta

SEQ ID NO: 2727452 - DNA, 12 bp, Homo sapiens
ccactctttgct

SEQ ID NO: 2727453 - DNA, 22 bp, Homo sapiens
ccactctttgctacaataaatg

SEQ ID NO: 2727454 - DNA, 23 bp, Homo sapiens
ccactctttgctacaataaatgc

SEQ ID NO: 2727455 - DNA, 16 bp, Homo sapiens
ccactgaagctgggat

SEQ ID NO: 2727456 - DNA, 23 bp, Homo sapiens
ccactgaagtccccctttctcct

SEQ ID NO: 2727457 - DNA, 13 bp, Homo sapiens
ccactgcaccccc

SEQ ID NO: 2727458 - DNA, 18 bp, Homo sapiens
ccactgcaccccctcctg

SEQ ID NO: 2727459 - DNA, 22 bp, Homo sapiens
ccactgcaccccctcctgctgc

SEQ ID NO: 2727460 - DNA, 17 bp, Homo sapiens
ccactgcactccagcct

SEQ ID NO: 2727461 - DNA, 21 bp, Homo sapiens
ccactgcactccagcctgggc

SEQ ID NO: 2727462 - DNA, 21 bp, Homo sapiens
ccactggacttgagcttggca

SEQ ID NO: 2727463 - DNA, 11 bp, Homo sapiens
ccactggccag

SEQ ID NO: 2727464 - DNA, 19 bp, Homo sapiens
ccactggccagtcctagag

SEQ ID NO: 2727465 - DNA, 22 bp, Homo sapiens
ccactgtccgcctctgcccgca

SEQ ID NO: 2727466 - DNA, 17 bp, Homo sapiens
ccactgtttcatgagcc

SEQ ID NO: 2727467 - DNA, 14 bp, Homo sapiens
ccacttcccaggta

SEQ ID NO: 2727468 - DNA, 17 bp, Homo sapiens
ccacttgggtcttccct

SEQ ID NO: 2727469 - DNA, 15 bp, Homo sapiens
ccagaaagaaaatga

SEQ ID NO: 2727470 - DNA, 18 bp, Homo sapiens
ccagaagaactttgcctt

SEQ ID NO: 2727471 - DNA, 21 bp, Homo sapiens
ccagaaggctgggtccagggg

SEQ ID NO: 2727472 - DNA, 18 bp, Homo sapiens
ccagaatcagattcagga

SEQ ID NO: 2727473 - DNA, 20 bp, Homo sapiens
ccagaatcagattcaggagc

SEQ ID NO: 2727474 - DNA, 20 bp, Homo sapiens
ccagaattgcttgaacccag

SEQ ID NO: 2727475 - DNA, 15 bp, Homo sapiens
ccagaccattgtctt

SEQ ID NO: 2727476 - DNA, 19 bp, Homo sapiens
ccagaccattgtcttccaa

SEQ ID NO: 2727477 - DNA, 13 bp, Homo sapiens
ccagaccccacag

SEQ ID NO: 2727478 - DNA, 23 bp, Homo sapiens
ccagactgcggagcagcctccag

SEQ ID NO: 2727479 - DNA, 16 bp, Homo sapiens
ccagagacctttgccc

SEQ ID NO: 2727480 - DNA, 18 bp, Homo sapiens
ccagagacctttgcccac

SEQ ID NO: 2727481 - DNA, 12 bp, Homo sapiens
ccagagcagggg

SEQ ID NO: 2727482 - DNA, 16 bp, Homo sapiens
ccagagcaggggctgc

SEQ ID NO: 2727483 - DNA, 21 bp, Homo sapiens
ccagagcaggggctgctgggg

SEQ ID NO: 2727484 - DNA, 13 bp, Homo sapiens
ccagagccactac

SEQ ID NO: 2727485 - DNA, 16 bp, Homo sapiens
ccagagcgaggaaagg

SEQ ID NO: 2727486 - DNA, 12 bp, Homo sapiens
ccagagctgagt

SEQ ID NO: 2727487 - DNA, 17 bp, Homo sapiens
ccagagctgcctcccca

SEQ ID NO: 2727488 - DNA, 23 bp, Homo sapiens
ccagagctgcctccccaatccat

SEQ ID NO: 2727489 - DNA, 13 bp, Homo sapiens
ccagagggcccag

SEQ ID NO: 2727490 - DNA, 18 bp, Homo sapiens
ccagagggcccaggcagg

SEQ ID NO: 2727491 - DNA, 14 bp, Homo sapiens
ccctccccagccct

SEQ ID NO: 2727492 - DNA, 22 bp, Homo sapiens
ccctcccccacgtctctctgcc

SEQ ID NO: 2727493 - DNA, 14 bp, Homo sapiens
ccctccccctaccg

SEQ ID NO: 2727494 - DNA, 15 bp, Homo sapiens
ccctccctgctgtcc

SEQ ID NO: 2727495 - DNA, 13 bp, Homo sapiens
ccctccgccttca

SEQ ID NO: 2727496 - DNA, 21 bp, Homo sapiens
ccctccgccttcactccggtg

SEQ ID NO: 2727497 - DNA, 22 bp, Homo sapiens
ccctccgccttcactccggtgt

SEQ ID NO: 2727498 - DNA, 15 bp, Homo sapiens
ccctcctacccctcc

SEQ ID NO: 2727499 - DNA, 18 bp, Homo sapiens
ccctcctcacactccaga

SEQ ID NO: 2727500 - DNA, 13 bp, Homo sapiens
ccctcctgagcct

SEQ ID NO: 2727501 - DNA, 17 bp, Homo sapiens
ccctcctggagcatccc

SEQ ID NO: 2727502 - DNA, 13 bp, Homo sapiens
ccctcctgttgtg

SEQ ID NO: 2727503 - DNA, 15 bp, Homo sapiens
ccctcggcctccaga

SEQ ID NO: 2727504 - DNA, 19 bp, Homo sapiens
ccctcggcctccagactgc

SEQ ID NO: 2727505 - DNA, 22 bp, Homo sapiens
ccctcggcctccagactgcgga

SEQ ID NO: 2727506 - DNA, 14 bp, Homo sapiens
ccctcgtgccagtc

SEQ ID NO: 2727507 - DNA, 21 bp, Homo sapiens
ccctctgcctgaccccaggcc

SEQ ID NO: 2727508 - DNA, 13 bp, Homo sapiens
ccctctgctgctt

SEQ ID NO: 2727509 - DNA, 23 bp, Homo sapiens
ccctcttgccccaacccccagca

SEQ ID NO: 2727510 - DNA, 20 bp, Homo sapiens
ccctgacactgcggggcttg

SEQ ID NO: 2727511 - DNA, 19 bp, Homo sapiens
ccctgaccttctccaggga

SEQ ID NO: 2727512 - DNA, 23 bp, Homo sapiens
ccctgaggatcccctgtcccctg

SEQ ID NO: 2727513 - DNA, 22 bp, Homo sapiens
  misc_feature (13)..(13): n is a, c, g or t
ccctgcacctgcnttgtccctg

SEQ ID NO: 2727514 - DNA, 14 bp, Homo sapiens
ccctgcactgtcct

SEQ ID NO: 2727515 - DNA, 15 bp, Homo sapiens
ccctgcactgtcctg

SEQ ID NO: 2727516 - DNA, 16 bp, Homo sapiens
ccctgcactgtcctgc

SEQ ID NO: 2727517 - DNA, 18 bp, Homo sapiens
ccctgcactgtcctgctc

SEQ ID NO: 2727518 - DNA, 19 bp, Homo sapiens
ccctgcactgtcctgctcc

SEQ ID NO: 2727519 - DNA, 21 bp, Homo sapiens
ccctgcactgtcctgctccac

SEQ ID NO: 2727520 - DNA, 23 bp, Homo sapiens
ccctgcactgtcctgctccacag

SEQ ID NO: 2727521 - DNA, 11 bp, Homo sapiens
ccctgcccctc

SEQ ID NO: 2727522 - DNA, 13 bp, Homo sapiens
ccctgcccctccc

SEQ ID NO: 2727523 - DNA, 16 bp, Homo sapiens
ccctgcccctccccct

SEQ ID NO: 2727524 - DNA, 14 bp, Homo sapiens
ccctgcccctccct

SEQ ID NO: 2727525 - DNA, 15 bp, Homo sapiens
ccctgcccctcccta

SEQ ID NO: 2727526 - DNA, 22 bp, Homo sapiens
ccctgccccttgtcctctcaga

SEQ ID NO: 2727527 - DNA, 19 bp, Homo sapiens
ccctgcccgaccccatctc

SEQ ID NO: 2727528 - DNA, 13 bp, Homo sapiens
ccctgcctgctgt

SEQ ID NO: 2727529 - DNA, 18 bp, Homo sapiens
ccctgcctgctgtggagc

SEQ ID NO: 2727530 - DNA, 17 bp, Homo sapiens
ccctgcgaaggggccct

SEQ ID NO: 2727531 - DNA, 19 bp, Homo sapiens
ccctgctgtcccctcttgc

SEQ ID NO: 2727532 - DNA, 22 bp, Homo sapiens
ccctgcttttctcccagaaggc

SEQ ID NO: 2727533 - DNA, 14 bp, Homo sapiens
ccctggaggctgga

SEQ ID NO: 2727534 - DNA, 20 bp, Homo sapiens
ccctggcaggatgaccctgc

SEQ ID NO: 2727535 - DNA, 12 bp, Homo sapiens
ccctggccacca

SEQ ID NO: 2727536 - DNA, 18 bp, Homo sapiens
ccctggctgaacagtgct

SEQ ID NO: 2727537 - DNA, 18 bp, Homo sapiens
ccctgggcctcagcctcc

SEQ ID NO: 2727538 - DNA, 22 bp, Homo sapiens
ccctgggcctcagcctccaggc

SEQ ID NO: 2727539 - DNA, 13 bp, Homo sapiens
ccctgggctctgc

SEQ ID NO: 2727540 - DNA, 16 bp, Homo sapiens
ccctgggctctgcccc

SEQ ID NO: 2727541 - DNA, 20 bp, Homo sapiens
ccctgggctctgtgggctgc

SEQ ID NO: 2727542 - DNA, 13 bp, Homo sapiens
ccctggggctggt

SEQ ID NO: 2727543 - DNA, 19 bp, Homo sapiens
ccctggggctggtggattg

SEQ ID NO: 2727544 - DNA, 20 bp, Homo sapiens
ccctgggtttggcccctgga

SEQ ID NO: 2727545 - DNA, 16 bp, Homo sapiens
ccctggtccttccagg

SEQ ID NO: 2727546 - DNA, 19 bp, Homo sapiens
ccctggtggacagtcctgg

SEQ ID NO: 2727547 - DNA, 23 bp, Homo sapiens
ccctggtggacagtcctgggaga

SEQ ID NO: 2727548 - DNA, 15 bp, Homo sapiens
ccctgtcccctgggg

SEQ ID NO: 2727549 - DNA, 17 bp, Homo sapiens
ccctgtcccctggggct

SEQ ID NO: 2727550 - DNA, 18 bp, Homo sapiens
ccctgtcccctggggctg

SEQ ID NO: 2727551 - DNA, 17 bp, Homo sapiens
ccctgtgttctgcacat

SEQ ID NO: 2727552 - DNA, 17 bp, Homo sapiens
ccctgttatctgctaga

SEQ ID NO: 2727553 - DNA, 14 bp, Homo sapiens
cccttccatttcta

SEQ ID NO: 2727554 - DNA, 14 bp, Homo sapiens
cccttccccgaggg

SEQ ID NO: 2727555 - DNA, 17 bp, Homo sapiens
cccttcctcatctgtgc

SEQ ID NO: 2727556 - DNA, 18 bp, Homo sapiens
cccttcctcatctgtgcc

SEQ ID NO: 2727557 - DNA, 13 bp, Homo sapiens
cccttcctgaccc

SEQ ID NO: 2727558 - DNA, 19 bp, Homo sapiens
cccttgaatctgcagggag

SEQ ID NO: 2727559 - DNA, 17 bp, Homo sapiens
cccttgagtaggccctg

SEQ ID NO: 2727560 - DNA, 14 bp, Homo sapiens
cccttgcccttcct

SEQ ID NO: 2727561 - DNA, 15 bp, Homo sapiens
cccttgcccttcctg

SEQ ID NO: 2727562 - DNA, 19 bp, Homo sapiens
cccttgcccttcctgaccc

SEQ ID NO: 2727563 - DNA, 16 bp, Homo sapiens
cccttggacttgagga

SEQ ID NO: 2727564 - DNA, 15 bp, Homo sapiens
cccttgtccctgggg

SEQ ID NO: 2727565 - DNA, 23 bp, Homo sapiens
cccttttcaagttgagaacaaaa

SEQ ID NO: 2727566 - DNA, 15 bp, Homo sapiens
cccttttcagcttct

SEQ ID NO: 2727567 - DNA, 16 bp, Homo sapiens
cccttttcagcttctg

SEQ ID NO: 2727568 - DNA, 14 bp, Homo sapiens
ccgactagcaggca

SEQ ID NO: 2727569 - DNA, 23 bp, Homo sapiens
ccgacttgaattttcccactgca

SEQ ID NO: 2727570 - DNA, 20 bp, Homo sapiens
ccgagcaaagtctaaagttt

SEQ ID NO: 2727571 - DNA, 14 bp, Homo sapiens
ccgcagctgctgcc

SEQ ID NO: 2727572 - DNA, 15 bp, Homo sapiens
ccgcagctgctgcca

SEQ ID NO: 2727573 - DNA, 19 bp, Homo sapiens
ccgcagctgctgccactct

SEQ ID NO: 2727574 - DNA, 23 bp, Homo sapiens
ccgcagctgctgccactctgctg

SEQ ID NO: 2727575 - DNA, 12 bp, Homo sapiens
ccgcatgccccc

SEQ ID NO: 2727576 - DNA, 18 bp, Homo sapiens
ccgcatgccccctcgtgc

SEQ ID NO: 2727577 - DNA, 19 bp, Homo sapiens
ccgcatgccccctcgtgcc

SEQ ID NO: 2727578 - DNA, 15 bp, Homo sapiens
ccgccaccacacccg

SEQ ID NO: 2727579 - DNA, 15 bp, Homo sapiens
ccgccatggcttcca

SEQ ID NO: 2727580 - DNA, 17 bp, Homo sapiens
ccgcccaggctggccag

SEQ ID NO: 2727581 - DNA, 15 bp, Homo sapiens
ccgcctcgcccaccg

SEQ ID NO: 2727582 - DNA, 18 bp, Homo sapiens
ccgcctcgcccaccgcat

SEQ ID NO: 2727583 - DNA, 21 bp, Homo sapiens
ccgcctcgcccaccgcatgcc

SEQ ID NO: 2727584 - DNA, 17 bp, Homo sapiens
ccgcctctgcccgcaga

SEQ ID NO: 2727585 - DNA, 16 bp, Homo sapiens
ccgcgcctccttcctt

SEQ ID NO: 2727586 - DNA, 21 bp, Homo sapiens
ccgcggggagagaggaggaga

SEQ ID NO: 2727587 - DNA, 20 bp, Homo sapiens
ccgctcccagtgtcttcctg

SEQ ID NO: 2727588 - DNA, 22 bp, Homo sapiens
ccgcttccagcttcctctgagc

SEQ ID NO: 2727589 - DNA, 13 bp, Homo sapiens
ccgcttgcctcgg

SEQ ID NO: 2727590 - DNA, 20 bp, Homo sapiens
ccgcttgcctcggctcctgc

SEQ ID NO: 2727591 - DNA, 21 bp, Homo sapiens
ccgcttgcctcggctcctgct

SEQ ID NO: 2727592 - DNA, 17 bp, Homo sapiens
ccggagcgaccctggct

SEQ ID NO: 2727593 - DNA, 19 bp, Homo sapiens
ccggagcgaccctggctct

SEQ ID NO: 2727594 - DNA, 15 bp, Homo sapiens
ccggattggccctgc

SEQ ID NO: 2727595 - DNA, 16 bp, Homo sapiens
ccggattggccctgcc

SEQ ID NO: 2727596 - DNA, 18 bp, Homo sapiens
ccggattggccctgcccc

SEQ ID NO: 2727597 - DNA, 20 bp, Homo sapiens
ccggattggccctgcccctc

SEQ ID NO: 2727598 - DNA, 19 bp, Homo sapiens
ccggccacgtctgtgctct

SEQ ID NO: 2727599 - DNA, 13 bp, Homo sapiens
ccggccaggtggg

SEQ ID NO: 2727600 - DNA, 12 bp, Homo sapiens
ccggccctgccc

SEQ ID NO: 2727601 - DNA, 14 bp, Homo sapiens
ccggccctgcccct

SEQ ID NO: 2727602 - DNA, 15 bp, Homo sapiens
ccggccctgcccctc

SEQ ID NO: 2727603 - DNA, 19 bp, Homo sapiens
ccggccctgcccctcccta

SEQ ID NO: 2727604 - DNA, 22 bp, Homo sapiens
ccggccctgcccctccctagat

SEQ ID NO: 2727605 - DNA, 14 bp, Homo sapiens
ccggcgccctctgt

SEQ ID NO: 2727606 - DNA, 19 bp, Homo sapiens
ccggcgccctctgtcctga

SEQ ID NO: 2727607 - DNA, 15 bp, Homo sapiens
ccgggaagcatcctc

SEQ ID NO: 2727608 - DNA, 20 bp, Homo sapiens
ccgggaagcatcctccccac

SEQ ID NO: 2727609 - DNA, 22 bp, Homo sapiens
ccgggaagcatcctccccacca

SEQ ID NO: 2727610 - DNA, 15 bp, Homo sapiens
ccgggaggggcccgc

SEQ ID NO: 2727611 - DNA, 22 bp, Homo sapiens
ccgggaggggcccgcttgcctc

SEQ ID NO: 2727612 - DNA, 24 bp, Homo sapiens
ccggggccttggtcccagacagct

SEQ ID NO: 2727613 - DNA, 13 bp, Homo sapiens
ccggggctgggtt

SEQ ID NO: 2727614 - DNA, 15 bp, Homo sapiens
ccggggctgggttgg

SEQ ID NO: 2727615 - DNA, 12 bp, Homo sapiens
cgaccctggctc

SEQ ID NO: 2727616 - DNA, 22 bp, Homo sapiens
cgacttgaattttcccactgca

SEQ ID NO: 2727617 - DNA, 13 bp, Homo sapiens
cgagaccagcctg

SEQ ID NO: 2727618 - DNA, 14 bp, Homo sapiens
cgagaggaggggcc

SEQ ID NO: 2727619 - DNA, 16 bp, Homo sapiens
cgagatcacgccactg

SEQ ID NO: 2727620 - DNA, 20 bp, Homo sapiens
cgagcaaagtctaaagttta

SEQ ID NO: 2727621 - DNA, 16 bp, Homo sapiens
cgaggatgctgtcagg

SEQ ID NO: 2727622 - DNA, 17 bp, Homo sapiens
cgaggatgctgtcagga

SEQ ID NO: 2727623 - DNA, 20 bp, Homo sapiens
cgaggatgctgtcaggagat

SEQ ID NO: 2727624 - DNA, 23 bp, Homo sapiens
cgaggatgctgtcaggagatgga

SEQ ID NO: 2727625 - DNA, 22 bp, Homo sapiens
cgaggtggagggtagccctggg

SEQ ID NO: 2727626 - DNA, 22 bp, Homo sapiens
cgaggtgggcggatcacttgag

SEQ ID NO: 2727627 - DNA, 20 bp, Homo sapiens
cgaggtgtcaccctgcagag

SEQ ID NO: 2727628 - DNA, 23 bp, Homo sapiens
cgaggtgtcaccctgcagagcta

SEQ ID NO: 2727629 - DNA, 18 bp, Homo sapiens
cgatatgaaaaataaata

SEQ ID NO: 2727630 - DNA, 12 bp, Homo sapiens
cgatctcagctc

SEQ ID NO: 2727631 - DNA, 16 bp, Homo sapiens
cgatcttgctggcagg

SEQ ID NO: 2727632 - DNA, 23 bp, Homo sapiens
cgatgaatgtgttgatttgagaa

SEQ ID NO: 2727633 - DNA, 21 bp, Homo sapiens
cgatgaatttggagactctgt

SEQ ID NO: 2727634 - DNA, 13 bp, Homo sapiens
cgcacctccttgg

SEQ ID NO: 2727635 - DNA, 13 bp, Homo sapiens
cgcagcatgtggg

SEQ ID NO: 2727636 - DNA, 23 bp, Homo sapiens
cgcagctgctgccactctgctgc

SEQ ID NO: 2727637 - DNA, 22 bp, Homo sapiens
cgcatgccccctcgtgccagtc

SEQ ID NO: 2727638 - DNA, 12 bp, Homo sapiens
cgcatggcagct

SEQ ID NO: 2727639 - DNA, 18 bp, Homo sapiens
cgcatggcagctgggccc

SEQ ID NO: 2727640 - DNA, 23 bp, Homo sapiens
cgcatggcagctgggcccacagc

SEQ ID NO: 2727641 - DNA, 22 bp, Homo sapiens
cgccactacactccagcctgag

SEQ ID NO: 2727642 - DNA, 16 bp, Homo sapiens
cgcccaccgcatgccc

SEQ ID NO: 2727643 - DNA, 17 bp, Homo sapiens
cgcccaccgcatgcccc

SEQ ID NO: 2727644 - DNA, 15 bp, Homo sapiens
cgcccagctgcacct

SEQ ID NO: 2727645 - DNA, 18 bp, Homo sapiens
cgcccagctgcacctgcc

SEQ ID NO: 2727646 - DNA, 23 bp, Homo sapiens
cgcccagctgcacctgccagcct

SEQ ID NO: 2727647 - DNA, 17 bp, Homo sapiens
cgcccaggctggccagc

SEQ ID NO: 2727648 - DNA, 17 bp, Homo sapiens
cgccctctgtcctgact

SEQ ID NO: 2727649 - DNA, 19 bp, Homo sapiens
cgcctactggggcagggca

SEQ ID NO: 2727650 - DNA, 20 bp, Homo sapiens
cgcctagaggtcccctcacg

SEQ ID NO: 2727651 - DNA, 23 bp, Homo sapiens
cgcctcccttatgcaggacatgt

SEQ ID NO: 2727652 - DNA, 21 bp, Homo sapiens
cgcctccttcttaactctgca

SEQ ID NO: 2727653 - DNA, 15 bp, Homo sapiens
cgcctcgcccaccgc

SEQ ID NO: 2727654 - DNA, 12 bp, Homo sapiens
cgcctctcccac

SEQ ID NO: 2727655 - DNA, 19 bp, Homo sapiens
cgcctctgcccgcagagcc

SEQ ID NO: 2727656 - DNA, 20 bp, Homo sapiens
cgcctctgcccgcagagccc

SEQ ID NO: 2727657 - DNA, 16 bp, Homo sapiens
cgcctgtcccctcaca

SEQ ID NO: 2727658 - DNA, 18 bp, Homo sapiens
cgcctgtcccctcacaga

SEQ ID NO: 2727659 - DNA, 15 bp, Homo sapiens
cgccttatttatatt

SEQ ID NO: 2727660 - DNA, 13 bp, Homo sapiens
cgccttctccccc

SEQ ID NO: 2727661 - DNA, 15 bp, Homo sapiens
cgcgctgcctgtgtg

SEQ ID NO: 2727662 - DNA, 13 bp, Homo sapiens
cgcgtagagagcc

SEQ ID NO: 2727663 - DNA, 14 bp, Homo sapiens
cgcgtctgccccac

SEQ ID NO: 2727664 - DNA, 15 bp, Homo sapiens
cgcgtctgccccacc

SEQ ID NO: 2727665 - DNA, 19 bp, Homo sapiens
cgcgtctgccccaccctca

SEQ ID NO: 2727666 - DNA, 17 bp, Homo sapiens
cgctaaagttatatttg

SEQ ID NO: 2727667 - DNA, 22 bp, Homo sapiens
cgctcccagtgtcttcctgtgg

SEQ ID NO: 2727668 - DNA, 21 bp, Homo sapiens
cgctctaccctgcagcttgga

SEQ ID NO: 2727669 - DNA, 19 bp, Homo sapiens
cgctgcccggcgccctctg

SEQ ID NO: 2727670 - DNA, 17 bp, Homo sapiens
cgctggacaacccagaa

SEQ ID NO: 2727671 - DNA, 22 bp, Homo sapiens
cgctggacaacccagaactgga

SEQ ID NO: 2727672 - DNA, 13 bp, Homo sapiens
cgctggctccagg

SEQ ID NO: 2727673 - DNA, 19 bp, Homo sapiens
cgctgtgattggcaggagg

SEQ ID NO: 2727674 - DNA, 20 bp, Homo sapiens
cgctgtgattggcaggaggc

SEQ ID NO: 2727675 - DNA, 13 bp, Homo sapiens
cgcttagaaacat

SEQ ID NO: 2727676 - DNA, 17 bp, Homo sapiens
cgcttagaaacatgttc

SEQ ID NO: 2727677 - DNA, 22 bp, Homo sapiens
cgcttgcctcggctcctgctgc

SEQ ID NO: 2727678 - DNA, 22 bp, Homo sapiens
cgcttggggcatttgtgggact

SEQ ID NO: 2727679 - DNA, 14 bp, Homo sapiens
cggaaagactgaaa

SEQ ID NO: 2727680 - DNA, 13 bp, Homo sapiens
cggaccgcgtaga

SEQ ID NO: 2727681 - DNA, 18 bp, Homo sapiens
cggaccgcgtagagagcc

SEQ ID NO: 2727682 - DNA, 20 bp, Homo sapiens
cggacctggactagggcctc

SEQ ID NO: 2727683 - DNA, 19 bp, Homo sapiens
cggagcgaccctggctctg

SEQ ID NO: 2727684 - DNA, 22 bp, Homo sapiens
cggagcgaccctggctctgcca

SEQ ID NO: 2727685 - DNA, 14 bp, Homo sapiens
cggaggctcctccc

SEQ ID NO: 2727686 - DNA, 18 bp, Homo sapiens
cggattggccctgcccct

SEQ ID NO: 2727687 - DNA, 23 bp, Homo sapiens
cggattggccctgcccctccccc

SEQ ID NO: 2727688 - DNA, 17 bp, Homo sapiens
cggcaccagtgcctcag

SEQ ID NO: 2727689 - DNA, 15 bp, Homo sapiens
cggcacgtcccatgt

SEQ ID NO: 2727690 - DNA, 16 bp, Homo sapiens
cggcacgtcccatgtg

SEQ ID NO: 2727691 - DNA, 19 bp, Homo sapiens
cggccacgtctgtgctctg

SEQ ID NO: 2727692 - DNA, 17 bp, Homo sapiens
cggccctgcccctccct

SEQ ID NO: 2727693 - DNA, 15 bp, Homo sapiens
cggctcctgctgcac

SEQ ID NO: 2727694 - DNA, 18 bp, Homo sapiens
cgggaagcatcctcccca

SEQ ID NO: 2727695 - DNA, 21 bp, Homo sapiens
cgggaagcatcctccccacca

SEQ ID NO: 2727696 - DNA, 16 bp, Homo sapiens
cgggatggtcctgggg

SEQ ID NO: 2727697 - DNA, 18 bp, Homo sapiens
cgggatggtcctggggct

SEQ ID NO: 2727698 - DNA, 19 bp, Homo sapiens
cgggcacctatagtcccag

SEQ ID NO: 2727699 - DNA, 20 bp, Homo sapiens
cgggctcagggaccacagca

SEQ ID NO: 2727700 - DNA, 17 bp, Homo sapiens
cgggctcctgtgccctt

SEQ ID NO: 2727701 - DNA, 16 bp, Homo sapiens
cggggaccactgggcc

SEQ ID NO: 2727702 - DNA, 16 bp, Homo sapiens
cggggcatgctggggc

SEQ ID NO: 2727703 - DNA, 17 bp, Homo sapiens
cggggcatgctggggca

SEQ ID NO: 2727704 - DNA, 12 bp, Homo sapiens
cggggctgggtt

SEQ ID NO: 2727705 - DNA, 21 bp, Homo sapiens
cggggctgggttggcgcaccc

SEQ ID NO: 2727706 - DNA, 15 bp, Homo sapiens
cggggcttggctgag

SEQ ID NO: 2727707 - DNA, 16 bp, Homo sapiens
cggggtattttaggca

SEQ ID NO: 2727708 - DNA, 17 bp, Homo sapiens
cgggtggggggagggca

SEQ ID NO: 2727709 - DNA, 15 bp, Homo sapiens
cgggttgaaagacat

SEQ ID NO: 2727710 - DNA, 21 bp, Homo sapiens
cgggttgaaagacatcaatga

SEQ ID NO: 2727711 - DNA, 17 bp, Homo sapiens
cggtaccagcctgacta

SEQ ID NO: 2727712 - DNA, 20 bp, Homo sapiens
cggtcctttaggcagcctgc

SEQ ID NO: 2727713 - DNA, 13 bp, Homo sapiens
cggtgagactctg

SEQ ID NO: 2727714 - DNA, 14 bp, Homo sapiens
cggtgtctgcagct

SEQ ID NO: 2727715 - DNA, 16 bp, Homo sapiens
cggtgtgggctgtgtc

SEQ ID NO: 2727716 - DNA, 17 bp, Homo sapiens
cgtaagatggcttattt

SEQ ID NO: 2727717 - DNA, 15 bp, Homo sapiens
cgtaagctctatctg

SEQ ID NO: 2727718 - DNA, 21 bp, Homo sapiens
cgtaccaagccaccgcagctg

SEQ ID NO: 2727719 - DNA, 18 bp, Homo sapiens
cgtcaccctcctgagcct

SEQ ID NO: 2727720 - DNA, 17 bp, Homo sapiens
cgtccaaggcagttctg

SEQ ID NO: 2727721 - DNA, 18 bp, Homo sapiens
cgtcctgaggagtgtcct

SEQ ID NO: 2727722 - DNA, 22 bp, Homo sapiens
cgtcctgaggagtgtcctgtct

SEQ ID NO: 2727723 - DNA, 13 bp, Homo sapiens
cgtcctggaatga

SEQ ID NO: 2727724 - DNA, 14 bp, Homo sapiens
cgtcctggaatgaa

SEQ ID NO: 2727725 - DNA, 21 bp, Homo sapiens
cgtcctggaatgaagcatgta

SEQ ID NO: 2727726 - DNA, 21 bp, Homo sapiens
cgtcgctggacaacccagaac

SEQ ID NO: 2727727 - DNA, 14 bp, Homo sapiens
cgtctctctgcctg

SEQ ID NO: 2727728 - DNA, 16 bp, Homo sapiens
cgtctctctgcctgct

SEQ ID NO: 2727729 - DNA, 20 bp, Homo sapiens
cgtctctctgcctgctgggc

SEQ ID NO: 2727730 - DNA, 21 bp, Homo sapiens
cgtctctctgcctgctgggct

SEQ ID NO: 2727731 - DNA, 14 bp, Homo sapiens
cgtctgtgctctgt

SEQ ID NO: 2727732 - DNA, 16 bp, Homo sapiens
cgtgaaaacactcgtg

SEQ ID NO: 2727733 - DNA, 12 bp, Homo sapiens
cgtgaccagccc

SEQ ID NO: 2727734 - DNA, 18 bp, Homo sapiens
cgtgaccagccccgtgta

SEQ ID NO: 2727735 - DNA, 13 bp, Homo sapiens
cgtgactcagagc

SEQ ID NO: 2727736 - DNA, 15 bp, Homo sapiens
cgtgactcagagctt

SEQ ID NO: 2727737 - DNA, 17 bp, Homo sapiens
cgtgagtgtgacttttt

SEQ ID NO: 2727738 - DNA, 22 bp, Homo sapiens
ctcccagcgctggctccaggct

SEQ ID NO: 2727739 - DNA, 16 bp, Homo sapiens
ctcccagggccagggc

SEQ ID NO: 2727740 - DNA, 21 bp, Homo sapiens
ctcccagtgagaagggcctgc

SEQ ID NO: 2727741 - DNA, 23 bp, Homo sapiens
ctcccagtgagaagggcctgctc

SEQ ID NO: 2727742 - DNA, 12 bp, Homo sapiens
ctcccagtgtct

SEQ ID NO: 2727743 - DNA, 20 bp, Homo sapiens
ctcccagtgtcttcctgtgg

SEQ ID NO: 2727744 - DNA, 21 bp, Homo sapiens
ctcccagtgtcttcctgtggg

SEQ ID NO: 2727745 - DNA, 13 bp, Homo sapiens
ctccccacagtcc

SEQ ID NO: 2727746 - DNA, 21 bp, Homo sapiens
ctccccacagtcctcacagcc

SEQ ID NO: 2727747 - DNA, 22 bp, Homo sapiens
ctccccacagtcctcacagcct

SEQ ID NO: 2727748 - DNA, 15 bp, Homo sapiens
ctccccaccagagct

SEQ ID NO: 2727749 - DNA, 18 bp, Homo sapiens
ctccccaccagagctgcc

SEQ ID NO: 2727750 - DNA, 23 bp, Homo sapiens
ctccccaccttcaattcctgggc

SEQ ID NO: 2727751 - DNA, 19 bp, Homo sapiens
ctccccagggcctccagga

SEQ ID NO: 2727752 - DNA, 18 bp, Homo sapiens
ctccccagtgctcctgtg

SEQ ID NO: 2727753 - DNA, 18 bp, Homo sapiens
ctcccccacgtctctctg

SEQ ID NO: 2727754 - DNA, 19 bp, Homo sapiens
ctcccccacgtctctctgc

SEQ ID NO: 2727755 - DNA, 13 bp, Homo sapiens
ctcccccagagcc

SEQ ID NO: 2727756 - DNA, 15 bp, Homo sapiens
ctcccccccggggct

SEQ ID NO: 2727757 - DNA, 21 bp, Homo sapiens
ctcccccgggaggggcccgct

SEQ ID NO: 2727758 - DNA, 13 bp, Homo sapiens
ctcccctccaagt

SEQ ID NO: 2727759 - DNA, 11 bp, Homo sapiens
ctcccctgagg

SEQ ID NO: 2727760 - DNA, 23 bp, Homo sapiens
ctcccctgaggatcccctgtccc

SEQ ID NO: 2727761 - DNA, 23 bp, Homo sapiens
ctcccctgaggctggcatcctgg

SEQ ID NO: 2727762 - DNA, 15 bp, Homo sapiens
ctcccctgatccaga

SEQ ID NO: 2727763 - DNA, 23 bp, Homo sapiens
ctccctagatccaggcttctccc

SEQ ID NO: 2727764 - DNA, 15 bp, Homo sapiens
ctccctcctggagca

SEQ ID NO: 2727765 - DNA, 19 bp, Homo sapiens
ctccctcctggagcatccc

SEQ ID NO: 2727766 - DNA, 13 bp, Homo sapiens
ctccctctgacct

SEQ ID NO: 2727767 - DNA, 18 bp, Homo sapiens
ctccctctgacctgcagg

SEQ ID NO: 2727768 - DNA, 21 bp, Homo sapiens
ctccctctgacctgcaggcca

SEQ ID NO: 2727769 - DNA, 19 bp, Homo sapiens
ctccctctgcctcatcctc

SEQ ID NO: 2727770 - DNA, 19 bp, Homo sapiens
ctccctgctgtcccctctt

SEQ ID NO: 2727771 - DNA, 20 bp, Homo sapiens
ctccctgctgtcccctcttg

SEQ ID NO: 2727772 - DNA, 12 bp, Homo sapiens
ctccctggccct

SEQ ID NO: 2727773 - DNA, 14 bp, Homo sapiens
ctccctggccctca

SEQ ID NO: 2727774 - DNA, 20 bp, Homo sapiens
ctccctggtgagggagcctc

SEQ ID NO: 2727775 - DNA, 20 bp, Homo sapiens
ctcccttgagtaggccctgc

SEQ ID NO: 2727776 - DNA, 14 bp, Homo sapiens
ctccgccattccaa

SEQ ID NO: 2727777 - DNA, 21 bp, Homo sapiens
ctccgccttcactccggtgtg

SEQ ID NO: 2727778 - DNA, 22 bp, Homo sapiens
ctccgctggatggggagtctca

SEQ ID NO: 2727779 - DNA, 19 bp, Homo sapiens
ctccggtgtgcctgcagcc

SEQ ID NO: 2727780 - DNA, 23 bp, Homo sapiens
ctccggtgtgcctgcagccccgc

SEQ ID NO: 2727781 - DNA, 19 bp, Homo sapiens
ctcctaatcaagagtctct

SEQ ID NO: 2727782 - DNA, 21 bp, Homo sapiens
ctcctaatcaagagtctctcc

SEQ ID NO: 2727783 - DNA, 22 bp, Homo sapiens
ctcctaatcaagagtctctcca

SEQ ID NO: 2727784 - DNA, 23 bp, Homo sapiens
ctcctacccctcccagctgacag

SEQ ID NO: 2727785 - DNA, 13 bp, Homo sapiens
ctcctacctcagc

SEQ ID NO: 2727786 - DNA, 15 bp, Homo sapiens
ctcctacctcagcct

SEQ ID NO: 2727787 - DNA, 20 bp, Homo sapiens
ctcctactgcttcctctgaa

SEQ ID NO: 2727788 - DNA, 13 bp, Homo sapiens
ctcctagcccagc

SEQ ID NO: 2727789 - DNA, 19 bp, Homo sapiens
ctcctagcccagcagagag

SEQ ID NO: 2727790 - DNA, 16 bp, Homo sapiens
ctcctcccatggcctt

SEQ ID NO: 2727791 - DNA, 10 bp, Homo sapiens
ctcctccctc

SEQ ID NO: 2727792 - DNA, 13 bp, Homo sapiens
ctcctccctctgc

SEQ ID NO: 2727793 - DNA, 13 bp, Homo sapiens
ctcctcctccagt

SEQ ID NO: 2727794 - DNA, 14 bp, Homo sapiens
ctcctcctccccca

SEQ ID NO: 2727795 - DNA, 15 bp, Homo sapiens
ctcctcctcccccag

SEQ ID NO: 2727796 - DNA, 17 bp, Homo sapiens
ctcctcctgccagctct

SEQ ID NO: 2727797 - DNA, 14 bp, Homo sapiens
ctcctctccatgca

SEQ ID NO: 2727798 - DNA, 21 bp, Homo sapiens
ctcctctccatgcaagtgctg

SEQ ID NO: 2727799 - DNA, 12 bp, Homo sapiens
ctcctgagcctc

SEQ ID NO: 2727800 - DNA, 14 bp, Homo sapiens
ctcctgagcctcac

SEQ ID NO: 2727801 - DNA, 16 bp, Homo sapiens
ctcctgagcctcacct

SEQ ID NO: 2727802 - DNA, 19 bp, Homo sapiens
ctcctgagtagctgggact

SEQ ID NO: 2727803 - DNA, 20 bp, Homo sapiens
ctcctgcctcagcctcctga

SEQ ID NO: 2727804 - DNA, 13 bp, Homo sapiens
ctcctgctgcacc

SEQ ID NO: 2727805 - DNA, 14 bp, Homo sapiens
ctcctgctgcacca

SEQ ID NO: 2727806 - DNA, 18 bp, Homo sapiens
ctcctgctgcaccaaccc

SEQ ID NO: 2727807 - DNA, 22 bp, Homo sapiens
ctcctgctgcaccaacccagcc

SEQ ID NO: 2727808 - DNA, 12 bp, Homo sapiens
ctcctgctgcag

SEQ ID NO: 2727809 - DNA, 24 bp, Homo sapiens
ctcctggaaaggctcagtctcagg

SEQ ID NO: 2727810 - DNA, 16 bp, Homo sapiens
ctcctggcttcatgtg

SEQ ID NO: 2727811 - DNA, 13 bp, Homo sapiens
ctcctgtgccctt

SEQ ID NO: 2727812 - DNA, 21 bp, Homo sapiens
ctcctgttgtgaaatcaccac

SEQ ID NO: 2727813 - DNA, 20 bp, Homo sapiens
ctccttccccttgtccctgg

SEQ ID NO: 2727814 - DNA, 23 bp, Homo sapiens
ctccttccccttgtccctggggc

SEQ ID NO: 2727815 - DNA, 16 bp, Homo sapiens
ctccttgagttttcct

SEQ ID NO: 2727816 - DNA, 14 bp, Homo sapiens
ctcctttaccccac

SEQ ID NO: 2727817 - DNA, 17 bp, Homo sapiens
ctcctttttctaccttt

SEQ ID NO: 2727818 - DNA, 22 bp, Homo sapiens
ctcgacatcaccgtcattgatg

SEQ ID NO: 2727819 - DNA, 18 bp, Homo sapiens
ctcgcccaccgcatgccc

SEQ ID NO: 2727820 - DNA, 16 bp, Homo sapiens
ctcgccctggccaggg

SEQ ID NO: 2727821 - DNA, 19 bp, Homo sapiens
ctcgcctctgcccagcctg

SEQ ID NO: 2727822 - DNA, 16 bp, Homo sapiens
ctcgcctggcctgagg

SEQ ID NO: 2727823 - DNA, 16 bp, Homo sapiens
ctcgctgatgctgggc

SEQ ID NO: 2727824 - DNA, 20 bp, Homo sapiens
ctcggaaggctggctgggca

SEQ ID NO: 2727825 - DNA, 17 bp, Homo sapiens
ctcggaggctcctccct

SEQ ID NO: 2727826 - DNA, 20 bp, Homo sapiens
ctcggaggctcctccctctg

SEQ ID NO: 2727827 - DNA, 22 bp, Homo sapiens
ctcggaggctcctccctctgcc

SEQ ID NO: 2727828 - DNA, 23 bp, Homo sapiens
ctcggaggctcctccctctgcct

SEQ ID NO: 2727829 - DNA, 16 bp, Homo sapiens
ctcggcccatctgtcc

SEQ ID NO: 2727830 - DNA, 19 bp, Homo sapiens
ctcggcccatctgtccatc

SEQ ID NO: 2727831 - DNA, 21 bp, Homo sapiens
ctcggcccatctgtccatcct

SEQ ID NO: 2727832 - DNA, 16 bp, Homo sapiens
ctcggctcctgctgca

SEQ ID NO: 2727833 - DNA, 18 bp, Homo sapiens
ctcgggatgaaaagccat

SEQ ID NO: 2727834 - DNA, 16 bp, Homo sapiens
ctcgggcccaggccat

SEQ ID NO: 2727835 - DNA, 24 bp, Homo sapiens
ctcgggcccaggccatcttccagg

SEQ ID NO: 2727836 - DNA, 18 bp, Homo sapiens
ctcgtgatctgcccgcct

SEQ ID NO: 2727837 - DNA, 22 bp, Homo sapiens
ctcgtgccagtcgcgctgcctg

SEQ ID NO: 2727838 - DNA, 11 bp, Homo sapiens
ctcgtgtgccc

SEQ ID NO: 2727839 - DNA, 15 bp, Homo sapiens
ctcgtgtgcccacca

SEQ ID NO: 2727840 - DNA, 17 bp, Homo sapiens
ctcgtgtgcccaccagc

SEQ ID NO: 2727841 - DNA, 18 bp, Homo sapiens
ctctaactccctcctcac

SEQ ID NO: 2727842 - DNA, 16 bp, Homo sapiens
ctctaatttattttgt

SEQ ID NO: 2727843 - DNA, 15 bp, Homo sapiens
ctctacacaacatgt

SEQ ID NO: 2727844 - DNA, 23 bp, Homo sapiens
ctctacacaacatgtatgtggat

SEQ ID NO: 2727845 - DNA, 14 bp, Homo sapiens
ctctaccctgcagc

SEQ ID NO: 2727846 - DNA, 14 bp, Homo sapiens
ctctaccctggtag

SEQ ID NO: 2727847 - DNA, 17 bp, Homo sapiens
ctctaccctggtaggaa

SEQ ID NO: 2727848 - DNA, 17 bp, Homo sapiens
ctctagaacacccactg

SEQ ID NO: 2727849 - DNA, 21 bp, Homo sapiens
ctctagaacacccactggcca

SEQ ID NO: 2727850 - DNA, 13 bp, Homo sapiens
ctctagtccctgt

SEQ ID NO: 2727851 - DNA, 19 bp, Homo sapiens
ctctagtgacttcctggtg

SEQ ID NO: 2727852 - DNA, 22 bp, Homo sapiens
ctctagtgacttcctggtgagg

SEQ ID NO: 2727853 - DNA, 13 bp, Homo sapiens
ctctagtgccctc

SEQ ID NO: 2727854 - DNA, 14 bp, Homo sapiens
ctctagtgccctcc

SEQ ID NO: 2727855 - DNA, 22 bp, Homo sapiens
ctctattccaataaagcagagt

SEQ ID NO: 2727856 - DNA, 15 bp, Homo sapiens
ctctatttacctgcg

SEQ ID NO: 2727857 - DNA, 12 bp, Homo sapiens
ctctcacagata

SEQ ID NO: 2727858 - DNA, 14 bp, Homo sapiens
ctctcagagcctca

SEQ ID NO: 2727859 - DNA, 15 bp, Homo sapiens
ctctcagagcctcag

SEQ ID NO: 2727860 - DNA, 14 bp, Homo sapiens
ctctccacctagtg

SEQ ID NO: 2727861 - DNA, 17 bp, Homo sapiens
ctggctgggcatggacg

SEQ ID NO: 2727862 - DNA, 18 bp, Homo sapiens
ctggctggggcctatcag

SEQ ID NO: 2727863 - DNA, 22 bp, Homo sapiens
ctggctggggcctatcagtgtg

SEQ ID NO: 2727864 - DNA, 23 bp, Homo sapiens
ctggctggggcctatcagtgtgc

SEQ ID NO: 2727865 - DNA, 22 bp, Homo sapiens
ctggcttcatgtggcattctct

SEQ ID NO: 2727866 - DNA, 14 bp, Homo sapiens
ctggcttctggagc

SEQ ID NO: 2727867 - DNA, 15 bp, Homo sapiens
ctgggaagggaagga

SEQ ID NO: 2727868 - DNA, 23 bp, Homo sapiens
ctgggaccccagctagggctgga

SEQ ID NO: 2727869 - DNA, 15 bp, Homo sapiens
ctgggactcattcac

SEQ ID NO: 2727870 - DNA, 15 bp, Homo sapiens
ctgggagaacctcag

SEQ ID NO: 2727871 - DNA, 18 bp, Homo sapiens
ctgggagaacctcaggct

SEQ ID NO: 2727872 - DNA, 20 bp, Homo sapiens
ctgggattacaggcatgagc

SEQ ID NO: 2727873 - DNA, 22 bp, Homo sapiens
ctgggcatgatgggccgagcca

SEQ ID NO: 2727874 - DNA, 18 bp, Homo sapiens
ctgggcatttggtgagag

SEQ ID NO: 2727875 - DNA, 11 bp, Homo sapiens
ctgggccatgg

SEQ ID NO: 2727876 - DNA, 17 bp, Homo sapiens
ctgggccatgggtcctc

SEQ ID NO: 2727877 - DNA, 21 bp, Homo sapiens
ctgggcccacagcccccaccc

SEQ ID NO: 2727878 - DNA, 22 bp, Homo sapiens
ctgggcccacagcccccacccc

SEQ ID NO: 2727879 - DNA, 24 bp, Homo sapiens
ctgggccccaaacgggctgccctg

SEQ ID NO: 2727880 - DNA, 14 bp, Homo sapiens
ctgggcctcagcct

SEQ ID NO: 2727881 - DNA, 18 bp, Homo sapiens
ctgggcgacagagcaaga

SEQ ID NO: 2727882 - DNA, 20 bp, Homo sapiens
ctgggctacaaaccaggagc

SEQ ID NO: 2727883 - DNA, 21 bp, Homo sapiens
ctgggctacaaaccaggagca

SEQ ID NO: 2727884 - DNA, 15 bp, Homo sapiens
ctgggctctgaggag

SEQ ID NO: 2727885 - DNA, 13 bp, Homo sapiens
ctgggctctgccc

SEQ ID NO: 2727886 - DNA, 13 bp, Homo sapiens
ctgggctctgtgg

SEQ ID NO: 2727887 - DNA, 16 bp, Homo sapiens
ctgggctctgtgggct

SEQ ID NO: 2727888 - DNA, 21 bp, Homo sapiens
ctgggctctgtgggctgcact

SEQ ID NO: 2727889 - DNA, 20 bp, Homo sapiens
ctgggctcttaactgttgct

SEQ ID NO: 2727890 - DNA, 20 bp, Homo sapiens
ctgggctggggcctgatggg

SEQ ID NO: 2727891 - DNA, 18 bp, Homo sapiens
ctgggctgggtgcgaccc

SEQ ID NO: 2727892 - DNA, 16 bp, Homo sapiens
ctggggcaagtccctg

SEQ ID NO: 2727893 - DNA, 16 bp, Homo sapiens
ctggggcactccccca

SEQ ID NO: 2727894 - DNA, 17 bp, Homo sapiens
ctggggccacatagctc

SEQ ID NO: 2727895 - DNA, 15 bp, Homo sapiens
ctggggcccctcgac

SEQ ID NO: 2727896 - DNA, 14 bp, Homo sapiens
ctggggctctgtgc

SEQ ID NO: 2727897 - DNA, 16 bp, Homo sapiens
ctggggctggtgaggc

SEQ ID NO: 2727898 - DNA, 23 bp, Homo sapiens
ctggggctggtggattgggcaga

SEQ ID NO: 2727899 - DNA, 14 bp, Homo sapiens
ctggggcttgccag

SEQ ID NO: 2727900 - DNA, 18 bp, Homo sapiens
ctgggggcgggggagcca

SEQ ID NO: 2727901 - DNA, 19 bp, Homo sapiens
ctgggggcgggggagccaa

SEQ ID NO: 2727902 - DNA, 12 bp, Homo sapiens
ctgggggctccc

SEQ ID NO: 2727903 - DNA, 15 bp, Homo sapiens
ctgggggctcccctt

SEQ ID NO: 2727904 - DNA, 15 bp, Homo sapiens
ctgggtccaggggag

SEQ ID NO: 2727905 - DNA, 18 bp, Homo sapiens
ctgggtgagagaggaata

SEQ ID NO: 2727906 - DNA, 21 bp, Homo sapiens
ctgggtgcgaccccatctgcc

SEQ ID NO: 2727907 - DNA, 23 bp, Homo sapiens
ctgggtgcgaccccatctgccca

SEQ ID NO: 2727908 - DNA, 20 bp, Homo sapiens
ctgggtggcccatcccccct

SEQ ID NO: 2727909 - DNA, 23 bp, Homo sapiens
ctgggttggcgcaccctcccctc

SEQ ID NO: 2727910 - DNA, 19 bp, Homo sapiens
ctgggttgtcactgagact

SEQ ID NO: 2727911 - DNA, 18 bp, Homo sapiens
ctgggtttggcccctgga

SEQ ID NO: 2727912 - DNA, 18 bp, Homo sapiens
ctggtaatttgtatctga

SEQ ID NO: 2727913 - DNA, 23 bp, Homo sapiens
ctggtacagcagggtcttgctgt

SEQ ID NO: 2727914 - DNA, 20 bp, Homo sapiens
ctggtagcagaatgcacatt

SEQ ID NO: 2727915 - DNA, 14 bp, Homo sapiens
ctggtaggaaagca

SEQ ID NO: 2727916 - DNA, 12 bp, Homo sapiens
ctggtatctgca

SEQ ID NO: 2727917 - DNA, 16 bp, Homo sapiens
ctggtgaggcccagcc

SEQ ID NO: 2727918 - DNA, 12 bp, Homo sapiens
ctggtgaggccg

SEQ ID NO: 2727919 - DNA, 20 bp, Homo sapiens
ctggtgaggccggccctgcc

SEQ ID NO: 2727920 - DNA, 21 bp, Homo sapiens
ctggtgaggccggccctgccc

SEQ ID NO: 2727921 - DNA, 16 bp, Homo sapiens
ctggtgagggagcctc

SEQ ID NO: 2727922 - DNA, 15 bp, Homo sapiens
ctggtgatgggacaa

SEQ ID NO: 2727923 - DNA, 12 bp, Homo sapiens
ctggtggacagt

SEQ ID NO: 2727924 - DNA, 21 bp, Homo sapiens
ctggtggacagtcctgggaga

SEQ ID NO: 2727925 - DNA, 18 bp, Homo sapiens
ctggtggatggtgacttt

SEQ ID NO: 2727926 - DNA, 22 bp, Homo sapiens
ctggtggatggtgacttttgaa

SEQ ID NO: 2727927 - DNA, 17 bp, Homo sapiens
ctggtggattgggcaga

SEQ ID NO: 2727928 - DNA, 22 bp, Homo sapiens
ctggttcactctaattggtcat

SEQ ID NO: 2727929 - DNA, 21 bp, Homo sapiens
ctgtaaaaagagagaaaactt

SEQ ID NO: 2727930 - DNA, 18 bp, Homo sapiens
ctgtaagcagattacaat

SEQ ID NO: 2727931 - DNA, 20 bp, Homo sapiens
ctgtaagcattctgagctgg

SEQ ID NO: 2727932 - DNA, 23 bp, Homo sapiens
ctgtaatatacaagcaagcaaaa

SEQ ID NO: 2727933 - DNA, 16 bp, Homo sapiens
ctgtacattactgtat

SEQ ID NO: 2727934 - DNA, 20 bp, Homo sapiens
ctgtataattaattgtcatt

SEQ ID NO: 2727935 - DNA, 16 bp, Homo sapiens
ctgtatgtataaatta

SEQ ID NO: 2727936 - DNA, 17 bp, Homo sapiens
ctgtatgtataaattat

SEQ ID NO: 2727937 - DNA, 20 bp, Homo sapiens
ctgtcacccaggctggagta

SEQ ID NO: 2727938 - DNA, 14 bp, Homo sapiens
ctgtcaccctggcc

SEQ ID NO: 2727939 - DNA, 20 bp, Homo sapiens
ctgtcaggagatggaagagt

SEQ ID NO: 2727940 - DNA, 18 bp, Homo sapiens
ctgtcagtgccgccgcct

SEQ ID NO: 2727941 - DNA, 22 bp, Homo sapiens
ctgtcagtgccgccgcctcgcc

SEQ ID NO: 2727942 - DNA, 18 bp, Homo sapiens
ctgtccaacccctccccc

SEQ ID NO: 2727943 - DNA, 23 bp, Homo sapiens
ctgtccaacccctcccccacgtc

SEQ ID NO: 2727944 - DNA, 20 bp, Homo sapiens
ctgtccagccagctcctgca

SEQ ID NO: 2727945 - DNA, 23 bp, Homo sapiens
ctgtccataaagtaattttgtga

SEQ ID NO: 2727946 - DNA, 17 bp, Homo sapiens
ctgtccatcctcctctc

SEQ ID NO: 2727947 - DNA, 18 bp, Homo sapiens
ctgtccatcctcctctcc

SEQ ID NO: 2727948 - DNA, 22 bp, Homo sapiens
ctgtccatcctcctctccatgc

SEQ ID NO: 2727949 - DNA, 23 bp, Homo sapiens
ctgtccatcctcctctccatgca

SEQ ID NO: 2727950 - DNA, 19 bp, Homo sapiens
ctgtcccctcacagactct

SEQ ID NO: 2727951 - DNA, 18 bp, Homo sapiens
ctgtcccctcttgcccca

SEQ ID NO: 2727952 - DNA, 20 bp, Homo sapiens
ctgtcccctcttgccccaac

SEQ ID NO: 2727953 - DNA, 16 bp, Homo sapiens
ctgtcccctggggctg

SEQ ID NO: 2727954 - DNA, 22 bp, Homo sapiens
ctgtcccctggggtctctgctg

SEQ ID NO: 2727955 - DNA, 12 bp, Homo sapiens
ctgtccctaccc

SEQ ID NO: 2727956 - DNA, 15 bp, Homo sapiens
ctgtccctacccact

SEQ ID NO: 2727957 - DNA, 19 bp, Homo sapiens
ctgtccctacccactcttt

SEQ ID NO: 2727958 - DNA, 22 bp, Homo sapiens
ctgtccctacccactctttgct

SEQ ID NO: 2727959 - DNA, 16 bp, Homo sapiens
ctgtccgcctctgccc

SEQ ID NO: 2727960 - DNA, 20 bp, Homo sapiens
ctgtccggagcgaccctggc

SEQ ID NO: 2727961 - DNA, 14 bp, Homo sapiens
ctgtcctgctccac

SEQ ID NO: 2727962 - DNA, 15 bp, Homo sapiens
ctgtcctgctccaca

SEQ ID NO: 2727963 - DNA, 17 bp, Homo sapiens
ctgtcctgctccacagt

SEQ ID NO: 2727964 - DNA, 19 bp, Homo sapiens
ctgtcctggtacagcaggg

SEQ ID NO: 2727965 - DNA, 20 bp, Homo sapiens
ctgtcctgtccggagcgacc

SEQ ID NO: 2727966 - DNA, 16 bp, Homo sapiens
ctgtccttactcagag

SEQ ID NO: 2727967 - DNA, 20 bp, Homo sapiens
ctgtccttactcagagctgc

SEQ ID NO: 2727968 - DNA, 15 bp, Homo sapiens
ctgtcgtgtccagcc

SEQ ID NO: 2727969 - DNA, 23 bp, Homo sapiens
ctgtctctgcttggcttcccctc

SEQ ID NO: 2727970 - DNA, 12 bp, Homo sapiens
ctgtctgctggg

SEQ ID NO: 2727971 - DNA, 15 bp, Homo sapiens
ctgtctgtccaaccc

SEQ ID NO: 2727972 - DNA, 23 bp, Homo sapiens
ctgtctgtccaacccctccccca

SEQ ID NO: 2727973 - DNA, 18 bp, Homo sapiens
ctgtgaacatggactctt

SEQ ID NO: 2727974 - DNA, 18 bp, Homo sapiens
ctgtgatgctttgaagta

SEQ ID NO: 2727975 - DNA, 15 bp, Homo sapiens
ctgtgcaaacagtgt

SEQ ID NO: 2727976 - DNA, 16 bp, Homo sapiens
ctgtgcaaacagtgta

SEQ ID NO: 2727977 - DNA, 18 bp, Homo sapiens
ctgtgcaaacagtgtaag

SEQ ID NO: 2727978 - DNA, 13 bp, Homo sapiens
ctgtgcagggagg

SEQ ID NO: 2727979 - DNA, 22 bp, Homo sapiens
ctgtgcagggaggaggtggcag

SEQ ID NO: 2727980 - DNA, 11 bp, Homo sapiens
ctgtgccaccc

SEQ ID NO: 2727981 - DNA, 20 bp, Homo sapiens
ctgtgccaccctgggctctg

SEQ ID NO: 2727982 - DNA, 22 bp, Homo sapiens
ctgtgccaccctgggctctgtg

SEQ ID NO: 2727983 - DNA, 14 bp, Homo sapiens
gacaacctgcccct

SEQ ID NO: 2727984 - DNA, 18 bp, Homo sapiens
gacacaatgttgcactga

SEQ ID NO: 2727985 - DNA, 18 bp, Homo sapiens
gacacagcccagacaaga

SEQ ID NO: 2727986 - DNA, 22 bp, Homo sapiens
gacacccaccccctctttgtgt

SEQ ID NO: 2727987 - DNA, 16 bp, Homo sapiens
gacacctgccttatgc

SEQ ID NO: 2727988 - DNA, 22 bp, Homo sapiens
gacagactgcaagaggctcctg

SEQ ID NO: 2727989 - DNA, 12 bp, Homo sapiens
gacagagccaga

SEQ ID NO: 2727990 - DNA, 19 bp, Homo sapiens
gacagatcctccatttttg

SEQ ID NO: 2727991 - DNA, 13 bp, Homo sapiens
gacagctggaccc

SEQ ID NO: 2727992 - DNA, 23 bp, Homo sapiens
gacaggacagtgcttcagcctga

SEQ ID NO: 2727993 - DNA, 18 bp, Homo sapiens
gacaggcaccagatggga

SEQ ID NO: 2727994 - DNA, 16 bp, Homo sapiens
gacagtcctctccacc

SEQ ID NO: 2727995 - DNA, 13 bp, Homo sapiens
gacagtcctggga

SEQ ID NO: 2727996 - DNA, 23 bp, Homo sapiens
gacagtgacgtgactcagagctt

SEQ ID NO: 2727997 - DNA, 18 bp, Homo sapiens
gacagtgcttcagcctga

SEQ ID NO: 2727998 - DNA, 16 bp, Homo sapiens
gacagtggcactaaaa

SEQ ID NO: 2727999 - DNA, 19 bp, Homo sapiens
gacatcaccgtcattgatg

SEQ ID NO: 2728000 - DNA, 21 bp, Homo sapiens
gacatcagaagtaactcccac

SEQ ID NO: 2728001 - DNA, 16 bp, Homo sapiens
gacatcgatatgaaaa

SEQ ID NO: 2728002 - DNA, 17 bp, Homo sapiens
gacatcgatatgaaaaa

SEQ ID NO: 2728003 - DNA, 21 bp, Homo sapiens
gacatgatttagggaagcagg

SEQ ID NO: 2728004 - DNA, 14 bp, Homo sapiens
gacattgaaagctc

SEQ ID NO: 2728005 - DNA, 22 bp, Homo sapiens
gacattggagaaggagatttta

SEQ ID NO: 2728006 - DNA, 21 bp, Homo sapiens
gaccacagcaaggcacctgca

SEQ ID NO: 2728007 - DNA, 13 bp, Homo sapiens
gaccactgggccc

SEQ ID NO: 2728008 - DNA, 16 bp, Homo sapiens
gaccactgggcccctc

SEQ ID NO: 2728009 - DNA, 11 bp, Homo sapiens
gaccagcctgg

SEQ ID NO: 2728010 - DNA, 13 bp, Homo sapiens
gaccagcctggcc

SEQ ID NO: 2728011 - DNA, 20 bp, Homo sapiens
gaccatgtgattatggacat

SEQ ID NO: 2728012 - DNA, 18 bp, Homo sapiens
gaccattgtcttccaacc

SEQ ID NO: 2728013 - DNA, 16 bp, Homo sapiens
gacccagtgtgtgctc

SEQ ID NO: 2728014 - DNA, 16 bp, Homo sapiens
gaccccagctagggct

SEQ ID NO: 2728015 - DNA, 14 bp, Homo sapiens
gaccccatctcatt

SEQ ID NO: 2728016 - DNA, 15 bp, Homo sapiens
gaccccatctgccca

SEQ ID NO: 2728017 - DNA, 21 bp, Homo sapiens
gacccccactgccgcctcctt

SEQ ID NO: 2728018 - DNA, 10 bp, Homo sapiens
gaccccctca

SEQ ID NO: 2728019 - DNA, 16 bp, Homo sapiens
gacccggattggccct

SEQ ID NO: 2728020 - DNA, 23 bp, Homo sapiens
gaccctcctccactccacctcca

SEQ ID NO: 2728021 - DNA, 17 bp, Homo sapiens
gaccctggctctgccag

SEQ ID NO: 2728022 - DNA, 15 bp, Homo sapiens
gaccgacgatccctc

SEQ ID NO: 2728023 - DNA, 21 bp, Homo sapiens
gaccgtgatttggaagagagg

SEQ ID NO: 2728024 - DNA, 21 bp, Homo sapiens
gacctccagtcctgctggcct

SEQ ID NO: 2728025 - DNA, 23 bp, Homo sapiens
gacctccagtcctgctggcctgc

SEQ ID NO: 2728026 - DNA, 24 bp, Homo sapiens
gacctccagtcctgctggcctgct

SEQ ID NO: 2728027 - DNA, 19 bp, Homo sapiens
gacctcgtgatttgcctgc

SEQ ID NO: 2728028 - DNA, 18 bp, Homo sapiens
gacctctgaatgtcccag

SEQ ID NO: 2728029 - DNA, 23 bp, Homo sapiens
gacctgatcattacatggctgtg

SEQ ID NO: 2728030 - DNA, 20 bp, Homo sapiens
gacctgcaggccaagagcag

SEQ ID NO: 2728031 - DNA, 16 bp, Homo sapiens
gacctggactagggcc

SEQ ID NO: 2728032 - DNA, 18 bp, Homo sapiens
gacctggagctgccagca

SEQ ID NO: 2728033 - DNA, 21 bp, Homo sapiens
gacctggggtgggcacaggga

SEQ ID NO: 2728034 - DNA, 14 bp, Homo sapiens
gacctttgcccaca

SEQ ID NO: 2728035 - DNA, 15 bp, Homo sapiens
gacctttgcccacac

SEQ ID NO: 2728036 - DNA, 22 bp, Homo sapiens
gacgatcttgctggcagggcct

SEQ ID NO: 2728037 - DNA, 20 bp, Homo sapiens
gacgcccagctgaggctggg

SEQ ID NO: 2728038 - DNA, 17 bp, Homo sapiens
gacgggttgaaagacat

SEQ ID NO: 2728039 - DNA, 18 bp, Homo sapiens
gacgggttgaaagacatc

SEQ ID NO: 2728040 - DNA, 14 bp, Homo sapiens
gacggttgtaagca

SEQ ID NO: 2728041 - DNA, 19 bp, Homo sapiens
gacgtgagtgtgacttttt

SEQ ID NO: 2728042 - DNA, 20 bp, Homo sapiens
gactaacgaacgttttaaag

SEQ ID NO: 2728043 - DNA, 16 bp, Homo sapiens
gactagcaggcatgcc

SEQ ID NO: 2728044 - DNA, 23 bp, Homo sapiens
gactagggcctcggaggctcctc

SEQ ID NO: 2728045 - DNA, 16 bp, Homo sapiens
gactatttaacttgag

SEQ ID NO: 2728046 - DNA, 17 bp, Homo sapiens
gactcagactcctggct

SEQ ID NO: 2728047 - DNA, 23 bp, Homo sapiens
gactcagactcctggcttcatgt

SEQ ID NO: 2728048 - DNA, 18 bp, Homo sapiens
gactcctggcttcatgtg

SEQ ID NO: 2728049 - DNA, 15 bp, Homo sapiens
gactctactcccagc

SEQ ID NO: 2728050 - DNA, 18 bp, Homo sapiens
gactctactcccagcgct

SEQ ID NO: 2728051 - DNA, 12 bp, Homo sapiens
gactctctgtga

SEQ ID NO: 2728052 - DNA, 13 bp, Homo sapiens
gactctgaggtgt

SEQ ID NO: 2728053 - DNA, 22 bp, Homo sapiens
gactcttccaccagagcagggg

SEQ ID NO: 2728054 - DNA, 18 bp, Homo sapiens
gactctttttgtacctgg

SEQ ID NO: 2728055 - DNA, 22 bp, Homo sapiens
gactgagtcctcgtagccatct

SEQ ID NO: 2728056 - DNA, 22 bp, Homo sapiens
gactgcggagcagcctccagtg

SEQ ID NO: 2728057 - DNA, 22 bp, Homo sapiens
gactgcgggatggtcctggggc

SEQ ID NO: 2728058 - DNA, 14 bp, Homo sapiens
gactggctcaagaa

SEQ ID NO: 2728059 - DNA, 14 bp, Homo sapiens
gactggctggctgc

SEQ ID NO: 2728060 - DNA, 16 bp, Homo sapiens
gactgggccatgggtc

SEQ ID NO: 2728061 - DNA, 14 bp, Homo sapiens
gactgtaagcagat

SEQ ID NO: 2728062 - DNA, 12 bp, Homo sapiens
gactgtgacatc

SEQ ID NO: 2728063 - DNA, 15 bp, Homo sapiens
gacttcaatattaaa

SEQ ID NO: 2728064 - DNA, 15 bp, Homo sapiens
gacttcactgcagcc

SEQ ID NO: 2728065 - DNA, 17 bp, Homo sapiens
gacttcaggggctgccc

SEQ ID NO: 2728066 - DNA, 21 bp, Homo sapiens
gacttcaggggctgcccgctc

SEQ ID NO: 2728067 - DNA, 19 bp, Homo sapiens
gacttgaattttcccactg

SEQ ID NO: 2728068 - DNA, 15 bp, Homo sapiens
gacttgcctggggcc

SEQ ID NO: 2728069 - DNA, 12 bp, Homo sapiens
gacttgctttaa

SEQ ID NO: 2728070 - DNA, 13 bp, Homo sapiens
gactttatattta

SEQ ID NO: 2728071 - DNA, 17 bp, Homo sapiens
gacttttccatgtatct

SEQ ID NO: 2728072 - DNA, 13 bp, Homo sapiens
gacttttgaagaa

SEQ ID NO: 2728073 - DNA, 22 bp, Homo sapiens
gagaaaacttatttgagtgatt

SEQ ID NO: 2728074 - DNA, 16 bp, Homo sapiens
gagaaaacttcagaga

SEQ ID NO: 2728075 - DNA, 14 bp, Homo sapiens
gagaaacaggctct

SEQ ID NO: 2728076 - DNA, 15 bp, Homo sapiens
gagaaacaggctctg

SEQ ID NO: 2728077 - DNA, 18 bp, Homo sapiens
gagaaacaggctctgaga

SEQ ID NO: 2728078 - DNA, 15 bp, Homo sapiens
gagaagggcctgctc

SEQ ID NO: 2728079 - DNA, 18 bp, Homo sapiens
gagaagtggccagggctt

SEQ ID NO: 2728080 - DNA, 14 bp, Homo sapiens
gagacatgctctcc

SEQ ID NO: 2728081 - DNA, 14 bp, Homo sapiens
gagaccagcctggc

SEQ ID NO: 2728082 - DNA, 18 bp, Homo sapiens
gagacctcagatgtgttg

SEQ ID NO: 2728083 - DNA, 18 bp, Homo sapiens
gagactagattctcacct

SEQ ID NO: 2728084 - DNA, 18 bp, Homo sapiens
gagactatgcgtttttat

SEQ ID NO: 2728085 - DNA, 13 bp, Homo sapiens
gagagaggaggag

SEQ ID NO: 2728086 - DNA, 15 bp, Homo sapiens
gagagatgagtgggt

SEQ ID NO: 2728087 - DNA, 19 bp, Homo sapiens
gagagcagctggctctcca

SEQ ID NO: 2728088 - DNA, 18 bp, Homo sapiens
gagagcagcttctgccac

SEQ ID NO: 2728089 - DNA, 18 bp, Homo sapiens
gagagccctctgctgctt

SEQ ID NO: 2728090 - DNA, 16 bp, Homo sapiens
gagaggcacctgctgg

SEQ ID NO: 2728091 - DNA, 17 bp, Homo sapiens
gagagtaccatgctggc

SEQ ID NO: 2728092 - DNA, 19 bp, Homo sapiens
gagagttgacccctcctga

SEQ ID NO: 2728093 - DNA, 20 bp, Homo sapiens
gagatagacgggttgaaaga

SEQ ID NO: 2728094 - DNA, 21 bp, Homo sapiens
gagatagacgggttgaaagac

SEQ ID NO: 2728095 - DNA, 23 bp, Homo sapiens
gagatagacgggttgaaagacat

SEQ ID NO: 2728096 - DNA, 16 bp, Homo sapiens
gagatatgcagaagga

SEQ ID NO: 2728097 - DNA, 13 bp, Homo sapiens
gagatgactgagt

SEQ ID NO: 2728098 - DNA, 16 bp, Homo sapiens
gagcaaagtctaaagt

SEQ ID NO: 2728099 - DNA, 14 bp, Homo sapiens
gagcaaatgctgga

SEQ ID NO: 2728100 - DNA, 12 bp, Homo sapiens
gagcaagactct

SEQ ID NO: 2728101 - DNA, 19 bp, Homo sapiens
gagcagaggagtccagggc

SEQ ID NO: 2728102 - DNA, 17 bp, Homo sapiens
gagcagcctccagtgct

SEQ ID NO: 2728103 - DNA, 21 bp, Homo sapiens
gagcagcctccagtgctggct

SEQ ID NO: 2728104 - DNA, 22 bp, Homo sapiens
gagcagcctccagtgctggctg

SEQ ID NO: 2728105 - DNA, 16 bp, Homo sapiens
gagcagctggctctcc

SEQ ID NO: 2728106 - DNA, 15 bp, Homo sapiens
gagcaggggctgctg

SEQ ID NO: 2728107 - DNA, 16 bp, Homo sapiens
gtactatctttgtcta

SEQ ID NO: 2728108 - DNA, 23 bp, Homo sapiens
gtactgggaatggaaggctttgc

SEQ ID NO: 2728109 - DNA, 14 bp, Homo sapiens
gtagagagccgggc

SEQ ID NO: 2728110 - DNA, 18 bp, Homo sapiens
gtagccaaggtgggctga

SEQ ID NO: 2728111 - DNA, 23 bp, Homo sapiens
gtagccttgcccggattctggga

SEQ ID NO: 2728112 - DNA, 16 bp, Homo sapiens
gtagggagctaaggaa

SEQ ID NO: 2728113 - DNA, 19 bp, Homo sapiens
gtagttccaggactcaggg

SEQ ID NO: 2728114 - DNA, 20 bp, Homo sapiens
gtataaggatcttttgtaaa

SEQ ID NO: 2728115 - DNA, 18 bp, Homo sapiens
gtataagttgtgtttgat

SEQ ID NO: 2728116 - DNA, 16 bp, Homo sapiens
gtataatttagtccct

SEQ ID NO: 2728117 - DNA, 14 bp, Homo sapiens
gtatacaaacaggt

SEQ ID NO: 2728118 - DNA, 20 bp, Homo sapiens
gtataggataaattacatta

SEQ ID NO: 2728119 - DNA, 14 bp, Homo sapiens
gtatatattctaca

SEQ ID NO: 2728120 - DNA, 21 bp, Homo sapiens
gtatatattctacacatatat

SEQ ID NO: 2728121 - DNA, 16 bp, Homo sapiens
gtatatctatatctct

SEQ ID NO: 2728122 - DNA, 18 bp, Homo sapiens
gtatatgtatatctatat

SEQ ID NO: 2728123 - DNA, 22 bp, Homo sapiens
gtatatttgtatttaaatgaaa

SEQ ID NO: 2728124 - DNA, 18 bp, Homo sapiens
gtatcgttcgcttgtttt

SEQ ID NO: 2728125 - DNA, 14 bp, Homo sapiens
gtatctattgtgtt

SEQ ID NO: 2728126 - DNA, 23 bp, Homo sapiens
gtatctgatatctgtttgcttct

SEQ ID NO: 2728127 - DNA, 21 bp, Homo sapiens
gtatgtataaattatgaagga

SEQ ID NO: 2728128 - DNA, 20 bp, Homo sapiens
gtattagccagtcattgtaa

SEQ ID NO: 2728129 - DNA, 22 bp, Homo sapiens
gtattaggggtaatatattgct

SEQ ID NO: 2728130 - DNA, 15 bp, Homo sapiens
gtattgctccatttt

SEQ ID NO: 2728131 - DNA, 22 bp, Homo sapiens
gtatttaatgatttttgtgtat

SEQ ID NO: 2728132 - DNA, 23 bp, Homo sapiens
gtatttaatgatttttgtgtatc

SEQ ID NO: 2728133 - DNA, 13 bp, Homo sapiens
gtatttttgaaag

SEQ ID NO: 2728134 - DNA, 17 bp, Homo sapiens
gtcaacactcttcttga

SEQ ID NO: 2728135 - DNA, 16 bp, Homo sapiens
gtcaactttcatttga

SEQ ID NO: 2728136 - DNA, 18 bp, Homo sapiens
gtcaactttcatttgaaa

SEQ ID NO: 2728137 - DNA, 12 bp, Homo sapiens
gtcaagaaaagc

SEQ ID NO: 2728138 - DNA, 13 bp, Homo sapiens
gtcaataactctg

SEQ ID NO: 2728139 - DNA, 14 bp, Homo sapiens
gtcaataactctga

SEQ ID NO: 2728140 - DNA, 13 bp, Homo sapiens
gtcaatcaaacag

SEQ ID NO: 2728141 - DNA, 15 bp, Homo sapiens
gtcaatcaaacaggg

SEQ ID NO: 2728142 - DNA, 18 bp, Homo sapiens
gtcaccctcctgagcctc

SEQ ID NO: 2728143 - DNA, 19 bp, Homo sapiens
gtcaccctcctgagcctca

SEQ ID NO: 2728144 - DNA, 20 bp, Homo sapiens
gtcaccctcctgagcctcac

SEQ ID NO: 2728145 - DNA, 13 bp, Homo sapiens
gtcaccctgcaga

SEQ ID NO: 2728146 - DNA, 15 bp, Homo sapiens
gtcaccctgcagagc

SEQ ID NO: 2728147 - DNA, 14 bp, Homo sapiens
gtcaccctggccac

SEQ ID NO: 2728148 - DNA, 15 bp, Homo sapiens
gtcaccctggccacc

SEQ ID NO: 2728149 - DNA, 18 bp, Homo sapiens
gtcaccctggccaccacc

SEQ ID NO: 2728150 - DNA, 19 bp, Homo sapiens
gtcactgaagtgattgaaa

SEQ ID NO: 2728151 - DNA, 12 bp, Homo sapiens
gtcactgagact

SEQ ID NO: 2728152 - DNA, 21 bp, Homo sapiens
gtcactggctgcctccactcc

SEQ ID NO: 2728153 - DNA, 23 bp, Homo sapiens
gtcactggctgcctccactccca

SEQ ID NO: 2728154 - DNA, 22 bp, Homo sapiens
gtcactgtctcaactactcagc

SEQ ID NO: 2728155 - DNA, 14 bp, Homo sapiens
gtcagactggctgg

SEQ ID NO: 2728156 - DNA, 22 bp, Homo sapiens
gtcagtgccgccgcctcgccca

SEQ ID NO: 2728157 - DNA, 13 bp, Homo sapiens
gtcataactagaa

SEQ ID NO: 2728158 - DNA, 15 bp, Homo sapiens
gtcatcagtaagtat

SEQ ID NO: 2728159 - DNA, 14 bp, Homo sapiens
gtcatggtcctggc

SEQ ID NO: 2728160 - DNA, 16 bp, Homo sapiens
gtcatggtcctggctg

SEQ ID NO: 2728161 - DNA, 16 bp, Homo sapiens
gtcattatttaaagca

SEQ ID NO: 2728162 - DNA, 19 bp, Homo sapiens
gtcattatttgataacatt

SEQ ID NO: 2728163 - DNA, 23 bp, Homo sapiens
gtcattatttttgttagcaaaga

SEQ ID NO: 2728164 - DNA, 18 bp, Homo sapiens
gtcattgatggagcctga

SEQ ID NO: 2728165 - DNA, 20 bp, Homo sapiens
gtcatttgacaacacatgtg

SEQ ID NO: 2728166 - DNA, 17 bp, Homo sapiens
gtccaacccctccccca

SEQ ID NO: 2728167 - DNA, 19 bp, Homo sapiens
gtccacagtggaaccagcc

SEQ ID NO: 2728168 - DNA, 21 bp, Homo sapiens
gtccagaccattgtcttccaa

SEQ ID NO: 2728169 - DNA, 12 bp, Homo sapiens
gtccagccagct

SEQ ID NO: 2728170 - DNA, 21 bp, Homo sapiens
gtccagtcctttgttgctgtt

SEQ ID NO: 2728171 - DNA, 16 bp, Homo sapiens
gtccatcctcctctcc

SEQ ID NO: 2728172 - DNA, 21 bp, Homo sapiens
gtccatcctcctctccatgca

SEQ ID NO: 2728173 - DNA, 21 bp, Homo sapiens
gtcccaagtagtagtgtcttc

SEQ ID NO: 2728174 - DNA, 14 bp, Homo sapiens
gtcccacccaggaa

SEQ ID NO: 2728175 - DNA, 15 bp, Homo sapiens
gtcccagacagctgg

SEQ ID NO: 2728176 - DNA, 22 bp, Homo sapiens
gtccccggccacgtctgtgctc

SEQ ID NO: 2728177 - DNA, 17 bp, Homo sapiens
gtcccctggggctggtg

SEQ ID NO: 2728178 - DNA, 15 bp, Homo sapiens
gtccctacccactct

SEQ ID NO: 2728179 - DNA, 17 bp, Homo sapiens
gtccctgactctctgtg

SEQ ID NO: 2728180 - DNA, 20 bp, Homo sapiens
gtccctgactctctgtgacc

SEQ ID NO: 2728181 - DNA, 11 bp, Homo sapiens
gtccctggggc

SEQ ID NO: 2728182 - DNA, 21 bp, Homo sapiens
gtcccttagaagatctgcttc

SEQ ID NO: 2728183 - DNA, 20 bp, Homo sapiens
gtcccttccatttctactgt

SEQ ID NO: 2728184 - DNA, 19 bp, Homo sapiens
gtccctttttgcaggggac

SEQ ID NO: 2728185 - DNA, 21 bp, Homo sapiens
gtccgcctctgcccgcagagc

SEQ ID NO: 2728186 - DNA, 22 bp, Homo sapiens
gtccgcctctgcccgcagagcc

SEQ ID NO: 2728187 - DNA, 15 bp, Homo sapiens
gtccggagcgaccct

SEQ ID NO: 2728188 - DNA, 22 bp, Homo sapiens
gtcctagagctcctgtccctac

SEQ ID NO: 2728189 - DNA, 21 bp, Homo sapiens
gtcctccaacaataaagagct

SEQ ID NO: 2728190 - DNA, 23 bp, Homo sapiens
gtcctccaacaataaagagctca

SEQ ID NO: 2728191 - DNA, 21 bp, Homo sapiens
gtcctcgcactgcccagggaa

SEQ ID NO: 2728192 - DNA, 17 bp, Homo sapiens
gtcctcggcccatctgt

SEQ ID NO: 2728193 - DNA, 13 bp, Homo sapiens
gtcctctccacct

SEQ ID NO: 2728194 - DNA, 12 bp, Homo sapiens
gtcctctccagc

SEQ ID NO: 2728195 - DNA, 23 bp, Homo sapiens
gtcctgaggagtgtcctgtctgc

SEQ ID NO: 2728196 - DNA, 17 bp, Homo sapiens
gtcctgctccacagtgt

SEQ ID NO: 2728197 - DNA, 15 bp, Homo sapiens
gtcctgctggcctgc

SEQ ID NO: 2728198 - DNA, 22 bp, Homo sapiens
gtcctggaatgaagcatgtagc

SEQ ID NO: 2728199 - DNA, 15 bp, Homo sapiens
gtcctggctggaagg

SEQ ID NO: 2728200 - DNA, 16 bp, Homo sapiens
gtcctggggctctgtg

SEQ ID NO: 2728201 - DNA, 15 bp, Homo sapiens
gtcctgtcagtgccg

SEQ ID NO: 2728202 - DNA, 22 bp, Homo sapiens
gtcctgtcagtgccgccgcctc

SEQ ID NO: 2728203 - DNA, 14 bp, Homo sapiens
gtcctgtccggagc

SEQ ID NO: 2728204 - DNA, 23 bp, Homo sapiens
gtcctgtccggagcgaccctggc

SEQ ID NO: 2728205 - DNA, 16 bp, Homo sapiens
gtccttactcagagct

SEQ ID NO: 2728206 - DNA, 18 bp, Homo sapiens
gtccttactcagagctgc

SEQ ID NO: 2728207 - DNA, 19 bp, Homo sapiens
gtcctttaggcagcctgcc

SEQ ID NO: 2728208 - DNA, 12 bp, Homo sapiens
gtcgagtccagt

SEQ ID NO: 2728209 - DNA, 18 bp, Homo sapiens
gtcgcgctgcctgtgtgg

SEQ ID NO: 2728210 - DNA, 18 bp, Homo sapiens
gtcgctggacaacccaga

SEQ ID NO: 2728211 - DNA, 14 bp, Homo sapiens
gtcgtgggtgtgtg

SEQ ID NO: 2728212 - DNA, 15 bp, Homo sapiens
gtctaaagtttacag

SEQ ID NO: 2728213 - DNA, 19 bp, Homo sapiens
gtctcaattttgtatttaa

SEQ ID NO: 2728214 - DNA, 17 bp, Homo sapiens
gtctcacactcctcctg

SEQ ID NO: 2728215 - DNA, 18 bp, Homo sapiens
gtctcacactcctcctgc

SEQ ID NO: 2728216 - DNA, 19 bp, Homo sapiens
gtctcacactcctcctgcc

SEQ ID NO: 2728217 - DNA, 16 bp, Homo sapiens
gtctcaggagcatggg

SEQ ID NO: 2728218 - DNA, 19 bp, Homo sapiens
gtctcccctgatccagaca

SEQ ID NO: 2728219 - DNA, 15 bp, Homo sapiens
gtctcctgtatcatt

SEQ ID NO: 2728220 - DNA, 16 bp, Homo sapiens
gtctcgaactcctgac

SEQ ID NO: 2728221 - DNA, 17 bp, Homo sapiens
gtctcgctgatgctggg

SEQ ID NO: 2728222 - DNA, 18 bp, Homo sapiens
gtctcgctgatgctgggc

SEQ ID NO: 2728223 - DNA, 20 bp, Homo sapiens
gtctcgctgatgctgggctg

SEQ ID NO: 2728224 - DNA, 13 bp, Homo sapiens
gtctctccagcct

SEQ ID NO: 2728225 - DNA, 15 bp, Homo sapiens
gtctctccagcctca

SEQ ID NO: 2728226 - DNA, 16 bp, Homo sapiens
gtctctccagcctcac

SEQ ID NO: 2728227 - DNA, 18 bp, Homo sapiens
gtctctccagcctcacag

SEQ ID NO: 2728228 - DNA, 16 bp, Homo sapiens
gtctctctgcctgctg

SEQ ID NO: 2728229 - DNA, 12 bp, Homo sapiens
gtctctgcctgg

SEQ ID NO: 2728230 - DNA, 17 bp, Homo sapiens
tacacacccccaagcca

SEQ ID NO: 2728231 - DNA, 17 bp, Homo sapiens
tacacatatatgtatat

SEQ ID NO: 2728232 - DNA, 17 bp, Homo sapiens
tacagaaattagccggg

SEQ ID NO: 2728233 - DNA, 18 bp, Homo sapiens
tacagaaattagccgggc

SEQ ID NO: 2728234 - DNA, 20 bp, Homo sapiens
tacagagaaattctgtggtg

SEQ ID NO: 2728235 - DNA, 15 bp, Homo sapiens
tacaggtgtgagcca

SEQ ID NO: 2728236 - DNA, 19 bp, Homo sapiens
tacagtctcaattttgtat

SEQ ID NO: 2728237 - DNA, 17 bp, Homo sapiens
tacagtctctgttgtaa

SEQ ID NO: 2728238 - DNA, 19 bp, Homo sapiens
tacagtctctgttgtaaat

SEQ ID NO: 2728239 - DNA, 12 bp, Homo sapiens
tacataaacagt

SEQ ID NO: 2728240 - DNA, 15 bp, Homo sapiens
tacatacagtgatat

SEQ ID NO: 2728241 - DNA, 18 bp, Homo sapiens
tacatgaattgcatttta

SEQ ID NO: 2728242 - DNA, 12 bp, Homo sapiens
tacatgctgcta

SEQ ID NO: 2728243 - DNA, 21 bp, Homo sapiens
tacatgttgggcatgattcta

SEQ ID NO: 2728244 - DNA, 17 bp, Homo sapiens
tacattcatctggaggc

SEQ ID NO: 2728245 - DNA, 22 bp, Homo sapiens
tacattcatctggaggctgcgt

SEQ ID NO: 2728246 - DNA, 18 bp, Homo sapiens
tacatttcatacaacaga

SEQ ID NO: 2728247 - DNA, 14 bp, Homo sapiens
taccaaatctcagt

SEQ ID NO: 2728248 - DNA, 14 bp, Homo sapiens
taccaagccaccgc

SEQ ID NO: 2728249 - DNA, 23 bp, Homo sapiens
taccaagccaccgcagctgctgc

SEQ ID NO: 2728250 - DNA, 16 bp, Homo sapiens
taccacaccctgcctg

SEQ ID NO: 2728251 - DNA, 13 bp, Homo sapiens
taccacttccctg

SEQ ID NO: 2728252 - DNA, 14 bp, Homo sapiens
taccacttccctgc

SEQ ID NO: 2728253 - DNA, 16 bp, Homo sapiens
taccagaagtgaatta

SEQ ID NO: 2728254 - DNA, 15 bp, Homo sapiens
taccagcctgactag

SEQ ID NO: 2728255 - DNA, 21 bp, Homo sapiens
taccaggcacatggctggggg

SEQ ID NO: 2728256 - DNA, 18 bp, Homo sapiens
taccaggtctcctccacc

SEQ ID NO: 2728257 - DNA, 22 bp, Homo sapiens
taccaggtctcctccaccgcca

SEQ ID NO: 2728258 - DNA, 21 bp, Homo sapiens
taccatcccggtgcatgcagg

SEQ ID NO: 2728259 - DNA, 18 bp, Homo sapiens
taccattattttacagtc

SEQ ID NO: 2728260 - DNA, 22 bp, Homo sapiens
taccattattttacagtctctg

SEQ ID NO: 2728261 - DNA, 21 bp, Homo sapiens
tacccactctttgctacaata

SEQ ID NO: 2728262 - DNA, 22 bp, Homo sapiens
tacccactctttgctacaataa

SEQ ID NO: 2728263 - DNA, 17 bp, Homo sapiens
tacccccgcccaggctg

SEQ ID NO: 2728264 - DNA, 20 bp, Homo sapiens
tacccccgcccaggctggcc

SEQ ID NO: 2728265 - DNA, 16 bp, Homo sapiens
tacccctcccagctga

SEQ ID NO: 2728266 - DNA, 15 bp, Homo sapiens
taccctccctgctgt

SEQ ID NO: 2728267 - DNA, 16 bp, Homo sapiens
taccctctcaaatgga

SEQ ID NO: 2728268 - DNA, 14 bp, Homo sapiens
taccctgcagcttg

SEQ ID NO: 2728269 - DNA, 12 bp, Homo sapiens
tacccttcctca

SEQ ID NO: 2728270 - DNA, 15 bp, Homo sapiens
tacccttcctcatct

SEQ ID NO: 2728271 - DNA, 12 bp, Homo sapiens
taccgcatggca

SEQ ID NO: 2728272 - DNA, 18 bp, Homo sapiens
taccgcatggcagctggg

SEQ ID NO: 2728273 - DNA, 20 bp, Homo sapiens
taccgcatggcagctgggcc

SEQ ID NO: 2728274 - DNA, 12 bp, Homo sapiens
tacctcagccta

SEQ ID NO: 2728275 - DNA, 15 bp, Homo sapiens
tacctgcctgttctc

SEQ ID NO: 2728276 - DNA, 16 bp, Homo sapiens
tacggtgcacagtaat

SEQ ID NO: 2728277 - DNA, 13 bp, Homo sapiens
tactaaggagaat

SEQ ID NO: 2728278 - DNA, 16 bp, Homo sapiens
tactagaaccttctaa

SEQ ID NO: 2728279 - DNA, 22 bp, Homo sapiens
tactagaaccttctaatccatg

SEQ ID NO: 2728280 - DNA, 19 bp, Homo sapiens
tactcaagcaggtttcttg

SEQ ID NO: 2728281 - DNA, 12 bp, Homo sapiens
tactcagagctg

SEQ ID NO: 2728282 - DNA, 16 bp, Homo sapiens
tactcagctctcctgc

SEQ ID NO: 2728283 - DNA, 17 bp, Homo sapiens
tactcctacctcagcct

SEQ ID NO: 2728284 - DNA, 20 bp, Homo sapiens
tactgaagtgcagctcagga

SEQ ID NO: 2728285 - DNA, 15 bp, Homo sapiens
tactgcacattttgt

SEQ ID NO: 2728286 - DNA, 14 bp, Homo sapiens
tactggcctcgcct

SEQ ID NO: 2728287 - DNA, 16 bp, Homo sapiens
tactgtataaacaaat

SEQ ID NO: 2728288 - DNA, 11 bp, Homo sapiens
tactgtcccag

SEQ ID NO: 2728289 - DNA, 15 bp, Homo sapiens
tactgtcccaggagc

SEQ ID NO: 2728290 - DNA, 15 bp, Homo sapiens
tacttcagtcttgga

SEQ ID NO: 2728291 - DNA, 18 bp, Homo sapiens
tacttcccccaccctggg

SEQ ID NO: 2728292 - DNA, 14 bp, Homo sapiens
tacttgacctccta

SEQ ID NO: 2728293 - DNA, 18 bp, Homo sapiens
tacttgatatttccttca

SEQ ID NO: 2728294 - DNA, 21 bp, Homo sapiens
tactttaatttttataaatat

SEQ ID NO: 2728295 - DNA, 17 bp, Homo sapiens
tacttttgcatgaaaat

SEQ ID NO: 2728296 - DNA, 21 bp, Homo sapiens
tactttttctgtactttttgt

SEQ ID NO: 2728297 - DNA, 22 bp, Homo sapiens
tagaaattaccagagttgttct

SEQ ID NO: 2728298 - DNA, 23 bp, Homo sapiens
tagaacaatgtacaaggtatgta

SEQ ID NO: 2728299 - DNA, 17 bp, Homo sapiens
tagaacacccactggcc

SEQ ID NO: 2728300 - DNA, 19 bp, Homo sapiens
tagaacacccactggccag

SEQ ID NO: 2728301 - DNA, 20 bp, Homo sapiens
tagaacacccactggccagt

SEQ ID NO: 2728302 - DNA, 13 bp, Homo sapiens
tagaaccttctaa

SEQ ID NO: 2728303 - DNA, 17 bp, Homo sapiens
tagaactgaattttgtc

SEQ ID NO: 2728304 - DNA, 22 bp, Homo sapiens
tagaactgaattttgtctttat

SEQ ID NO: 2728305 - DNA, 15 bp, Homo sapiens
tagaagatctgcttc

SEQ ID NO: 2728306 - DNA, 23 bp, Homo sapiens
tagaagatctgcttccctggggc

SEQ ID NO: 2728307 - DNA, 19 bp, Homo sapiens
tagaagctataaagaaaag

SEQ ID NO: 2728308 - DNA, 17 bp, Homo sapiens
tagaatcaagtctgtga

SEQ ID NO: 2728309 - DNA, 19 bp, Homo sapiens
tagaatgcatgtaaggtct

SEQ ID NO: 2728310 - DNA, 17 bp, Homo sapiens
tagaattatattttctt

SEQ ID NO: 2728311 - DNA, 13 bp, Homo sapiens
tagacgggttgaa

SEQ ID NO: 2728312 - DNA, 18 bp, Homo sapiens
tagacgggttgaaagaca

SEQ ID NO: 2728313 - DNA, 19 bp, Homo sapiens
tagacgggttgaaagacat

SEQ ID NO: 2728314 - DNA, 20 bp, Homo sapiens
tagagaggtagcgagctgct

SEQ ID NO: 2728315 - DNA, 19 bp, Homo sapiens
tagagatatgcagaaggaa

SEQ ID NO: 2728316 - DNA, 22 bp, Homo sapiens
tagagatatttaaaagacaaac

SEQ ID NO: 2728317 - DNA, 19 bp, Homo sapiens
tagagctcctgtccctacc

SEQ ID NO: 2728318 - DNA, 17 bp, Homo sapiens
tagagctttcaagtaca

SEQ ID NO: 2728319 - DNA, 22 bp, Homo sapiens
tagaggccaaattaatctttta

SEQ ID NO: 2728320 - DNA, 22 bp, Homo sapiens
tagaggggttttagatttttaa

SEQ ID NO: 2728321 - DNA, 15 bp, Homo sapiens
tagattttctgtaaa

SEQ ID NO: 2728322 - DNA, 23 bp, Homo sapiens
tagatttttaaaaggtaggtttt

SEQ ID NO: 2728323 - DNA, 17 bp, Homo sapiens
tagcacatgattttctt

SEQ ID NO: 2728324 - DNA, 19 bp, Homo sapiens
tagcatggcccgggcctta

SEQ ID NO: 2728325 - DNA, 19 bp, Homo sapiens
tagcattttcttgaaccaa

SEQ ID NO: 2728326 - DNA, 15 bp, Homo sapiens
tagccagtcattgta

SEQ ID NO: 2728327 - DNA, 22 bp, Homo sapiens
tagccttgcccggattctggga

SEQ ID NO: 2728328 - DNA, 17 bp, Homo sapiens
tagcgagctgctctgct

SEQ ID NO: 2728329 - DNA, 15 bp, Homo sapiens
tagcgtccatttctt

SEQ ID NO: 2728330 - DNA, 21 bp, Homo sapiens
tagctcataagctgtagaact

SEQ ID NO: 2728331 - DNA, 14 bp, Homo sapiens
tagctctacacaac

SEQ ID NO: 2728332 - DNA, 17 bp, Homo sapiens
tagctctacacaacatg

SEQ ID NO: 2728333 - DNA, 14 bp, Homo sapiens
tagctcttgggcct

SEQ ID NO: 2728334 - DNA, 15 bp, Homo sapiens
tagctcttgggcctg

SEQ ID NO: 2728335 - DNA, 16 bp, Homo sapiens
tagctcttgggcctga

SEQ ID NO: 2728336 - DNA, 20 bp, Homo sapiens
tagctcttgggcctgacctc

SEQ ID NO: 2728337 - DNA, 13 bp, Homo sapiens
tagctgatgagga

SEQ ID NO: 2728338 - DNA, 11 bp, Homo sapiens
taggaaagcac

SEQ ID NO: 2728339 - DNA, 16 bp, Homo sapiens
taggactctgaggctc

SEQ ID NO: 2728340 - DNA, 18 bp, Homo sapiens
taggactctgaggctctt

SEQ ID NO: 2728341 - DNA, 17 bp, Homo sapiens
taggagttcgagaccag

SEQ ID NO: 2728342 - DNA, 18 bp, Homo sapiens
taggatgaatgggaaagt

SEQ ID NO: 2728343 - DNA, 20 bp, Homo sapiens
taggatgaatgggaaagtat

SEQ ID NO: 2728344 - DNA, 13 bp, Homo sapiens
taggcagcctgcc

SEQ ID NO: 2728345 - DNA, 14 bp, Homo sapiens
taggcctggcacag

SEQ ID NO: 2728346 - DNA, 17 bp, Homo sapiens
taggcctggcacagtgt

SEQ ID NO: 2728347 - DNA, 14 bp, Homo sapiens
tagggaagcaggga

SEQ ID NO: 2728348 - DNA, 21 bp, Homo sapiens
tagggaagcagggacaccccc

SEQ ID NO: 2728349 - DNA, 23 bp, Homo sapiens
tagggctggactctggcacccag

SEQ ID NO: 2728350 - DNA, 23 bp, Homo sapiens
taggggtaatatattgctgctgg

SEQ ID NO: 2728351 - DNA, 14 bp, Homo sapiens
tagtagtttgggtg

SEQ ID NO: 2728352 - DNA, 17 bp, Homo sapiens
tagtcaatcaaacaggg

SEQ ID NO: 2728353 - DNA, 17 bp, Homo sapiens
tagtctcgctaaagtta

SEQ ID NO: 2728354 - DNA, 19 bp, Homo sapiens
tcccagtgagcctctgcgc

SEQ ID NO: 2728355 - DNA, 22 bp, Homo sapiens
tcccatctaagctgcagcttcc

SEQ ID NO: 2728356 - DNA, 23 bp, Homo sapiens
tcccatctaagctgcagcttcct

SEQ ID NO: 2728357 - DNA, 20 bp, Homo sapiens
tcccatggtagactgtgaca

SEQ ID NO: 2728358 - DNA, 23 bp, Homo sapiens
tcccatggtagactgtgacacag

SEQ ID NO: 2728359 - DNA, 19 bp, Homo sapiens
tcccattttagaaaatcag

SEQ ID NO: 2728360 - DNA, 14 bp, Homo sapiens
tccccaaaggcatc

SEQ ID NO: 2728361 - DNA, 15 bp, Homo sapiens
tccccaaaggcatcc

SEQ ID NO: 2728362 - DNA, 18 bp, Homo sapiens
tccccacagtcctcacag

SEQ ID NO: 2728363 - DNA, 23 bp, Homo sapiens
tccccacagtcctcacagcctct

SEQ ID NO: 2728364 - DNA, 23 bp, Homo sapiens
tccccaccttcaattcctgggcc

SEQ ID NO: 2728365 - DNA, 22 bp, Homo sapiens
tccccagagttcttgcaccctc

SEQ ID NO: 2728366 - DNA, 15 bp, Homo sapiens
tccccagccctttgc

SEQ ID NO: 2728367 - DNA, 15 bp, Homo sapiens
tcccccaccctgggt

SEQ ID NO: 2728368 - DNA, 21 bp, Homo sapiens
tcccccaccctgggtttggcc

SEQ ID NO: 2728369 - DNA, 20 bp, Homo sapiens
tcccccacgtctctctgcct

SEQ ID NO: 2728370 - DNA, 12 bp, Homo sapiens
tcccccagcctc

SEQ ID NO: 2728371 - DNA, 22 bp, Homo sapiens
tcccccgggaggggcccgcttg

SEQ ID NO: 2728372 - DNA, 19 bp, Homo sapiens
tccccctaccgcatggcag

SEQ ID NO: 2728373 - DNA, 23 bp, Homo sapiens
tccccctaccgcatggcagctgg

SEQ ID NO: 2728374 - DNA, 19 bp, Homo sapiens
tccccctcccagggccagg

SEQ ID NO: 2728375 - DNA, 22 bp, Homo sapiens
tccccgagggatgatgccacac

SEQ ID NO: 2728376 - DNA, 13 bp, Homo sapiens
tcccctcacagac

SEQ ID NO: 2728377 - DNA, 15 bp, Homo sapiens
tcccctcacagactc

SEQ ID NO: 2728378 - DNA, 21 bp, Homo sapiens
tcccctcacagactcttccac

SEQ ID NO: 2728379 - DNA, 23 bp, Homo sapiens
tcccctcacagactcttccacca

SEQ ID NO: 2728380 - DNA, 22 bp, Homo sapiens
tcccctcacgtgaccagccccg

SEQ ID NO: 2728381 - DNA, 14 bp, Homo sapiens
tcccctcctacccc

SEQ ID NO: 2728382 - DNA, 20 bp, Homo sapiens
tcccctcctacccctcccag

SEQ ID NO: 2728383 - DNA, 21 bp, Homo sapiens
tcccctcttgccccaaccccc

SEQ ID NO: 2728384 - DNA, 23 bp, Homo sapiens
tcccctgaggctggcatcctggc

SEQ ID NO: 2728385 - DNA, 14 bp, Homo sapiens
tcccctgatccaga

SEQ ID NO: 2728386 - DNA, 13 bp, Homo sapiens
tcccctgccgcct

SEQ ID NO: 2728387 - DNA, 16 bp, Homo sapiens
tcccctgccgcctccc

SEQ ID NO: 2728388 - DNA, 19 bp, Homo sapiens
tcccctgccgcctcccggg

SEQ ID NO: 2728389 - DNA, 20 bp, Homo sapiens
tcccctgccgcctcccggga

SEQ ID NO: 2728390 - DNA, 13 bp, Homo sapiens
tcccctggggctg

SEQ ID NO: 2728391 - DNA, 14 bp, Homo sapiens
tcccctggggctgg

SEQ ID NO: 2728392 - DNA, 16 bp, Homo sapiens
tcccctgtcccctggg

SEQ ID NO: 2728393 - DNA, 19 bp, Homo sapiens
tcccctgtcccctggggct

SEQ ID NO: 2728394 - DNA, 21 bp, Homo sapiens
tcccctgtcccctggggctgg

SEQ ID NO: 2728395 - DNA, 17 bp, Homo sapiens
tccccttgcccttcctg

SEQ ID NO: 2728396 - DNA, 18 bp, Homo sapiens
tccccttgtccctggggc

SEQ ID NO: 2728397 - DNA, 19 bp, Homo sapiens
tccccttgtccctggggca

SEQ ID NO: 2728398 - DNA, 19 bp, Homo sapiens
tcccgagcaaagtctaaag

SEQ ID NO: 2728399 - DNA, 21 bp, Homo sapiens
tcccgagctactctcttgcca

SEQ ID NO: 2728400 - DNA, 18 bp, Homo sapiens
tcccgaggatgctgtcag

SEQ ID NO: 2728401 - DNA, 21 bp, Homo sapiens
tcccgaggatgctgtcaggag

SEQ ID NO: 2728402 - DNA, 12 bp, Homo sapiens
tcccggaggtgt

SEQ ID NO: 2728403 - DNA, 22 bp, Homo sapiens
tcccgggaagcatcctccccac

SEQ ID NO: 2728404 - DNA, 23 bp, Homo sapiens
tcccgggaagcatcctccccacc

SEQ ID NO: 2728405 - DNA, 16 bp, Homo sapiens
tcccggtgcagaacag

SEQ ID NO: 2728406 - DNA, 21 bp, Homo sapiens
tcccggtgcagaacaggggca

SEQ ID NO: 2728407 - DNA, 17 bp, Homo sapiens
tcccgtctactcattcc

SEQ ID NO: 2728408 - DNA, 13 bp, Homo sapiens
tcccgtggcccca

SEQ ID NO: 2728409 - DNA, 14 bp, Homo sapiens
tcccgtggccccag

SEQ ID NO: 2728410 - DNA, 15 bp, Homo sapiens
tcccgtggccccagc

SEQ ID NO: 2728411 - DNA, 19 bp, Homo sapiens
tcccgtggccccagcctgg

SEQ ID NO: 2728412 - DNA, 21 bp, Homo sapiens
tcccgtggccccagcctggcc

SEQ ID NO: 2728413 - DNA, 24 bp, Homo sapiens
tcccgtggccccagcctggcccag

SEQ ID NO: 2728414 - DNA, 12 bp, Homo sapiens
tccctacccact

SEQ ID NO: 2728415 - DNA, 13 bp, Homo sapiens
tccctacccactc

SEQ ID NO: 2728416 - DNA, 18 bp, Homo sapiens
tccctacccactctttgc

SEQ ID NO: 2728417 - DNA, 13 bp, Homo sapiens
tccctcctcacac

SEQ ID NO: 2728418 - DNA, 19 bp, Homo sapiens
tccctcctcacactccaga

SEQ ID NO: 2728419 - DNA, 21 bp, Homo sapiens
tccctctcgccctggccaggg

SEQ ID NO: 2728420 - DNA, 22 bp, Homo sapiens
tccctctcgccctggccagggc

SEQ ID NO: 2728421 - DNA, 13 bp, Homo sapiens
tccctctgacctg

SEQ ID NO: 2728422 - DNA, 22 bp, Homo sapiens
tccctctgcctgaccccaggcc

SEQ ID NO: 2728423 - DNA, 16 bp, Homo sapiens
tccctgaagtcttgca

SEQ ID NO: 2728424 - DNA, 17 bp, Homo sapiens
tccctgaagtcttgcat

SEQ ID NO: 2728425 - DNA, 23 bp, Homo sapiens
tccctgacactgcggggcttggc

SEQ ID NO: 2728426 - DNA, 16 bp, Homo sapiens
tccctgactctctgtg

SEQ ID NO: 2728427 - DNA, 17 bp, Homo sapiens
tccctgactctctgtga

SEQ ID NO: 2728428 - DNA, 13 bp, Homo sapiens
tccctgctgtccc

SEQ ID NO: 2728429 - DNA, 11 bp, Homo sapiens
tccctgggcct

SEQ ID NO: 2728430 - DNA, 17 bp, Homo sapiens
tccctgggcctcagcct

SEQ ID NO: 2728431 - DNA, 21 bp, Homo sapiens
tccctgggcctcagcctccag

SEQ ID NO: 2728432 - DNA, 13 bp, Homo sapiens
tccctggggcact

SEQ ID NO: 2728433 - DNA, 20 bp, Homo sapiens
tccctggggcactcccccag

SEQ ID NO: 2728434 - DNA, 21 bp, Homo sapiens
tccctggggcactcccccagg

SEQ ID NO: 2728435 - DNA, 21 bp, Homo sapiens
tccctggggccaacggcaaca

SEQ ID NO: 2728436 - DNA, 13 bp, Homo sapiens
tccctggtgcaga

SEQ ID NO: 2728437 - DNA, 14 bp, Homo sapiens
tcccttctgatctt

SEQ ID NO: 2728438 - DNA, 18 bp, Homo sapiens
tcccttgagtaggccctg

SEQ ID NO: 2728439 - DNA, 21 bp, Homo sapiens
tcccttgagtaggccctgctt

SEQ ID NO: 2728440 - DNA, 15 bp, Homo sapiens
tccgccattccaagt

SEQ ID NO: 2728441 - DNA, 16 bp, Homo sapiens
tccgggtgccattccc

SEQ ID NO: 2728442 - DNA, 23 bp, Homo sapiens
tccgtggcaaccctcagctgcct

SEQ ID NO: 2728443 - DNA, 15 bp, Homo sapiens
tcctaaagtctctgc

SEQ ID NO: 2728444 - DNA, 14 bp, Homo sapiens
tcctacaaccaggt

SEQ ID NO: 2728445 - DNA, 17 bp, Homo sapiens
tcctacacccttggact

SEQ ID NO: 2728446 - DNA, 18 bp, Homo sapiens
tcctacacccttggactt

SEQ ID NO: 2728447 - DNA, 12 bp, Homo sapiens
tcctacctcagc

SEQ ID NO: 2728448 - DNA, 17 bp, Homo sapiens
tcctacctcagcctaga

SEQ ID NO: 2728449 - DNA, 19 bp, Homo sapiens
tcctagagctcctgtccct

SEQ ID NO: 2728450 - DNA, 13 bp, Homo sapiens
tcctaggccacac

SEQ ID NO: 2728451 - DNA, 13 bp, Homo sapiens
tcctagtatatta

SEQ ID NO: 2728452 - DNA, 23 bp, Homo sapiens
tcctagtatattagtttgattta

SEQ ID NO: 2728453 - DNA, 19 bp, Homo sapiens
tcctatccttggagagcag

SEQ ID NO: 2728454 - DNA, 18 bp, Homo sapiens
tcctcatctgtgcctgtc

SEQ ID NO: 2728455 - DNA, 21 bp, Homo sapiens
tcctcatctgtgcctgtctgt

SEQ ID NO: 2728456 - DNA, 21 bp, Homo sapiens
tcctccaccgccatggcttcc

SEQ ID NO: 2728457 - DNA, 15 bp, Homo sapiens
tcctccatttttgtt

SEQ ID NO: 2728458 - DNA, 15 bp, Homo sapiens
tcctcccatggcctt

SEQ ID NO: 2728459 - DNA, 17 bp, Homo sapiens
tcctcccattttagaaa

SEQ ID NO: 2728460 - DNA, 22 bp, Homo sapiens
tcctcccattttagaaaatcag

SEQ ID NO: 2728461 - DNA, 13 bp, Homo sapiens
tcctccccaccag

SEQ ID NO: 2728462 - DNA, 18 bp, Homo sapiens
tcctccccaccagagctg

SEQ ID NO: 2728463 - DNA, 22 bp, Homo sapiens
tcctccccattagagtcagcct

SEQ ID NO: 2728464 - DNA, 15 bp, Homo sapiens
tcctcccctgccgcc

SEQ ID NO: 2728465 - DNA, 18 bp, Homo sapiens
tcctcccctgccgcctcc

SEQ ID NO: 2728466 - DNA, 10 bp, Homo sapiens
tcctccctct

SEQ ID NO: 2728467 - DNA, 17 bp, Homo sapiens
tcctcctcattcagacc

SEQ ID NO: 2728468 - DNA, 20 bp, Homo sapiens
tcctcgggatgaaaagccat

SEQ ID NO: 2728469 - DNA, 14 bp, Homo sapiens
tcctctcagagcct

SEQ ID NO: 2728470 - DNA, 17 bp, Homo sapiens
tcctctccacctagtgg

SEQ ID NO: 2728471 - DNA, 19 bp, Homo sapiens
tcctctccacctagtggct

SEQ ID NO: 2728472 - DNA, 13 bp, Homo sapiens
tcctctccatgca

SEQ ID NO: 2728473 - DNA, 16 bp, Homo sapiens
tcctctccatgcaagt

SEQ ID NO: 2728474 - DNA, 18 bp, Homo sapiens
tcctctccatgcaagtgc

SEQ ID NO: 2728475 - DNA, 21 bp, Homo sapiens
tcctctccatgcaagtgctgt

SEQ ID NO: 2728476 - DNA, 22 bp, Homo sapiens
tcctctccatgcaagtgctgtt

SEQ ID NO: 2728477 - DNA, 11 bp, Homo sapiens
tgacttgcctg

SEQ ID NO: 2728478 - DNA, 17 bp, Homo sapiens
tgagaaaatgcaggaga

SEQ ID NO: 2728479 - DNA, 21 bp, Homo sapiens
tgagaaactttgatctctgct

SEQ ID NO: 2728480 - DNA, 20 bp, Homo sapiens
tgagaaatttttttccagaa

SEQ ID NO: 2728481 - DNA, 21 bp, Homo sapiens
tgagaacatggtgtgtgtctc

SEQ ID NO: 2728482 - DNA, 18 bp, Homo sapiens
tgagaatcccaattattt

SEQ ID NO: 2728483 - DNA, 19 bp, Homo sapiens
tgagaatcccaattattta

SEQ ID NO: 2728484 - DNA, 12 bp, Homo sapiens
tgagaccctgtc

SEQ ID NO: 2728485 - DNA, 14 bp, Homo sapiens
tgagaccctgtctc

SEQ ID NO: 2728486 - DNA, 15 bp, Homo sapiens
tgagaccctgtctct

SEQ ID NO: 2728487 - DNA, 22 bp, Homo sapiens
tgagaccctttaaatgcctgcg

SEQ ID NO: 2728488 - DNA, 14 bp, Homo sapiens
tgagactgggaact

SEQ ID NO: 2728489 - DNA, 16 bp, Homo sapiens
tgagaggaaatgttga

SEQ ID NO: 2728490 - DNA, 14 bp, Homo sapiens
tgagagtcaaagct

SEQ ID NO: 2728491 - DNA, 13 bp, Homo sapiens
tgagattctttaa

SEQ ID NO: 2728492 - DNA, 15 bp, Homo sapiens
tgagattctttaagg

SEQ ID NO: 2728493 - DNA, 16 bp, Homo sapiens
tgagattctttaagga

SEQ ID NO: 2728494 - DNA, 17 bp, Homo sapiens
tgagattctttaaggag

SEQ ID NO: 2728495 - DNA, 18 bp, Homo sapiens
tgagattctttaaggaga

SEQ ID NO: 2728496 - DNA, 20 bp, Homo sapiens
tgagattctttaaggagata

SEQ ID NO: 2728497 - DNA, 22 bp, Homo sapiens
tgagcaggaaccggagggtgac

SEQ ID NO: 2728498 - DNA, 22 bp, Homo sapiens
tgagccatagagatatttaaaa

SEQ ID NO: 2728499 - DNA, 18 bp, Homo sapiens
tgagcccaaacaccctcc

SEQ ID NO: 2728500 - DNA, 21 bp, Homo sapiens
tgagcccaaacaccctcctgg

SEQ ID NO: 2728501 - DNA, 15 bp, Homo sapiens
tgagcctctgcgcct

SEQ ID NO: 2728502 - DNA, 15 bp, Homo sapiens
tgagctagaaatcac

SEQ ID NO: 2728503 - DNA, 15 bp, Homo sapiens
tgagctgtcccctgg

SEQ ID NO: 2728504 - DNA, 16 bp, Homo sapiens
tgaggagcagcttcag

SEQ ID NO: 2728505 - DNA, 14 bp, Homo sapiens
tgaggagtgtcctg

SEQ ID NO: 2728506 - DNA, 15 bp, Homo sapiens
tgaggagtgtcctgt

SEQ ID NO: 2728507 - DNA, 18 bp, Homo sapiens
tgaggagtgtcctgtctg

SEQ ID NO: 2728508 - DNA, 20 bp, Homo sapiens
tgaggagtgtcctgtctgct

SEQ ID NO: 2728509 - DNA, 17 bp, Homo sapiens
tgaggatcccctgtccc

SEQ ID NO: 2728510 - DNA, 22 bp, Homo sapiens
tgaggatcccctgtcccctggg

SEQ ID NO: 2728511 - DNA, 21 bp, Homo sapiens
tgaggcagtgggtcccacttc

SEQ ID NO: 2728512 - DNA, 23 bp, Homo sapiens
tgaggcagtgggtcccacttccc

SEQ ID NO: 2728513 - DNA, 12 bp, Homo sapiens
tgaggcccagcc

SEQ ID NO: 2728514 - DNA, 14 bp, Homo sapiens
tgaggcccagcctg

SEQ ID NO: 2728515 - DNA, 16 bp, Homo sapiens
tgaggcccagcctgtc

SEQ ID NO: 2728516 - DNA, 19 bp, Homo sapiens
tgaggcccagcctgtcctg

SEQ ID NO: 2728517 - DNA, 13 bp, Homo sapiens
tgaggccccaggc

SEQ ID NO: 2728518 - DNA, 15 bp, Homo sapiens
tgaggccccaggccc

SEQ ID NO: 2728519 - DNA, 20 bp, Homo sapiens
tgaggccggccctgcccctc

SEQ ID NO: 2728520 - DNA, 22 bp, Homo sapiens
tgaggccggccctgcccctccc

SEQ ID NO: 2728521 - DNA, 13 bp, Homo sapiens
tgaggcctccctt

SEQ ID NO: 2728522 - DNA, 16 bp, Homo sapiens
tgaggctggcatcctg

SEQ ID NO: 2728523 - DNA, 22 bp, Homo sapiens
tgaggctggcatcctggctggc

SEQ ID NO: 2728524 - DNA, 19 bp, Homo sapiens
tgagggcagtggggagcat

SEQ ID NO: 2728525 - DNA, 21 bp, Homo sapiens
tgaggggaggatcactggagc

SEQ ID NO: 2728526 - DNA, 14 bp, Homo sapiens
tgaggtctcgctga

SEQ ID NO: 2728527 - DNA, 23 bp, Homo sapiens
tgaggtctcgctgatgctgggct

SEQ ID NO: 2728528 - DNA, 18 bp, Homo sapiens
tgaggtcttttacataca

SEQ ID NO: 2728529 - DNA, 20 bp, Homo sapiens
tgaggtgacttgcctggggc

SEQ ID NO: 2728530 - DNA, 12 bp, Homo sapiens
tgagtagcatat

SEQ ID NO: 2728531 - DNA, 13 bp, Homo sapiens
tgagtaggccctg

SEQ ID NO: 2728532 - DNA, 15 bp, Homo sapiens
tgagtaggccctgct

SEQ ID NO: 2728533 - DNA, 13 bp, Homo sapiens
tgagtctcgaggg

SEQ ID NO: 2728534 - DNA, 14 bp, Homo sapiens
tgagtctggcaaac

SEQ ID NO: 2728535 - DNA, 18 bp, Homo sapiens
tgagtctggcaaacatgt

SEQ ID NO: 2728536 - DNA, 21 bp, Homo sapiens
tgagtctggcaaacatgtgca

SEQ ID NO: 2728537 - DNA, 15 bp, Homo sapiens
tgagtgtctctgcct

SEQ ID NO: 2728538 - DNA, 14 bp, Homo sapiens
tgagttattttaat

SEQ ID NO: 2728539 - DNA, 18 bp, Homo sapiens
tgataatgtattgcagtg

SEQ ID NO: 2728540 - DNA, 12 bp, Homo sapiens
tgatagtgcttc

SEQ ID NO: 2728541 - DNA, 14 bp, Homo sapiens
tgatagtgcttctt

SEQ ID NO: 2728542 - DNA, 21 bp, Homo sapiens
tgatatccacaaatgctattc

SEQ ID NO: 2728543 - DNA, 15 bp, Homo sapiens
tgatatctgtttgct

SEQ ID NO: 2728544 - DNA, 15 bp, Homo sapiens
tgatcataagtctaa

SEQ ID NO: 2728545 - DNA, 21 bp, Homo sapiens
tgatcataagtctaaataaat

SEQ ID NO: 2728546 - DNA, 18 bp, Homo sapiens
tgatccagacaagtggga

SEQ ID NO: 2728547 - DNA, 23 bp, Homo sapiens
tgatcgccttatttatattcatc

SEQ ID NO: 2728548 - DNA, 21 bp, Homo sapiens
tgatctaatgaagtgtttcct

SEQ ID NO: 2728549 - DNA, 14 bp, Homo sapiens
tgatctcctgagct

SEQ ID NO: 2728550 - DNA, 16 bp, Homo sapiens
tgatctcggctcactg

SEQ ID NO: 2728551 - DNA, 20 bp, Homo sapiens
tgatgaaaactaaggatttt

SEQ ID NO: 2728552 - DNA, 15 bp, Homo sapiens
tgatgatgaaaacta

SEQ ID NO: 2728553 - DNA, 18 bp, Homo sapiens
tgatgccacaccaagctg

SEQ ID NO: 2728554 - DNA, 20 bp, Homo sapiens
tgatgccacaccaagctgtg

SEQ ID NO: 2728555 - DNA, 13 bp, Homo sapiens
tgatgctgggctg

SEQ ID NO: 2728556 - DNA, 20 bp, Homo sapiens
tgatgctgggctgggtgcga

SEQ ID NO: 2728557 - DNA, 15 bp, Homo sapiens
tgatggaagggcctt

SEQ ID NO: 2728558 - DNA, 23 bp, Homo sapiens
tgatggagcctgaaccgtgtgct

SEQ ID NO: 2728559 - DNA, 15 bp, Homo sapiens
tgatggtgacttcct

SEQ ID NO: 2728560 - DNA, 18 bp, Homo sapiens
tgatgtcagccttgcatc

SEQ ID NO: 2728561 - DNA, 20 bp, Homo sapiens
tgattaaacagcaaagccat

SEQ ID NO: 2728562 - DNA, 17 bp, Homo sapiens
tgattcctgctgcctgt

SEQ ID NO: 2728563 - DNA, 22 bp, Homo sapiens
tgattccttgatggagatattt

SEQ ID NO: 2728564 - DNA, 13 bp, Homo sapiens
tgattcttgtgat

SEQ ID NO: 2728565 - DNA, 17 bp, Homo sapiens
tgattgaatttttaagc

SEQ ID NO: 2728566 - DNA, 10 bp, Homo sapiens
tgattgcact

SEQ ID NO: 2728567 - DNA, 18 bp, Homo sapiens
tgattgcactaaataaac

SEQ ID NO: 2728568 - DNA, 18 bp, Homo sapiens
tgattgcgagaattttca

SEQ ID NO: 2728569 - DNA, 18 bp, Homo sapiens
tgattggtttaaaagtca

SEQ ID NO: 2728570 - DNA, 13 bp, Homo sapiens
tgatttaatatct

SEQ ID NO: 2728571 - DNA, 19 bp, Homo sapiens
tgatttagggaagcaggga

SEQ ID NO: 2728572 - DNA, 17 bp, Homo sapiens
tgatttcccgtggcccc

SEQ ID NO: 2728573 - DNA, 20 bp, Homo sapiens
tgatttcccgtggccccagc

SEQ ID NO: 2728574 - DNA, 22 bp, Homo sapiens
tgatttcccgtggccccagcct

SEQ ID NO: 2728575 - DNA, 15 bp, Homo sapiens
tgatttcgatgtaca

SEQ ID NO: 2728576 - DNA, 19 bp, Homo sapiens
tgatttcgatgtacagtct

SEQ ID NO: 2728577 - DNA, 19 bp, Homo sapiens
tgatttctagtatctattg

SEQ ID NO: 2728578 - DNA, 14 bp, Homo sapiens
tgatttgcctgcct

SEQ ID NO: 2728579 - DNA, 22 bp, Homo sapiens
tgatttgggaagttaggcaaat

SEQ ID NO: 2728580 - DNA, 19 bp, Homo sapiens
tgattttgatattttcaca

SEQ ID NO: 2728581 - DNA, 13 bp, Homo sapiens
tgatttttgtgta

SEQ ID NO: 2728582 - DNA, 20 bp, Homo sapiens
tgatttttgtgtatccagta

SEQ ID NO: 2728583 - DNA, 22 bp, Homo sapiens
tgcaaaaaagccaagccctccg

SEQ ID NO: 2728584 - DNA, 22 bp, Homo sapiens
tgcaaagttttctttccaaaat

SEQ ID NO: 2728585 - DNA, 20 bp, Homo sapiens
tgcaaccctggtgtgctggg

SEQ ID NO: 2728586 - DNA, 14 bp, Homo sapiens
tgcaactcttgtat

SEQ ID NO: 2728587 - DNA, 18 bp, Homo sapiens
tgcaactcttgtattgct

SEQ ID NO: 2728588 - DNA, 19 bp, Homo sapiens
tgcaagacttcactgcagc

SEQ ID NO: 2728589 - DNA, 21 bp, Homo sapiens
tgcaaggggaaacctgtgaaa

SEQ ID NO: 2728590 - DNA, 19 bp, Homo sapiens
tgcaagtgggagatgaaaa

SEQ ID NO: 2728591 - DNA, 22 bp, Homo sapiens
tgcaatagtcagagtgtccctt

SEQ ID NO: 2728592 - DNA, 22 bp, Homo sapiens
tgcaatggcacgatctcagctc

SEQ ID NO: 2728593 - DNA, 20 bp, Homo sapiens
tgcaatgtatggcttttctc

SEQ ID NO: 2728594 - DNA, 17 bp, Homo sapiens
tgcaatgtttttgtgta

SEQ ID NO: 2728595 - DNA, 15 bp, Homo sapiens
tgcaattaactctgg

SEQ ID NO: 2728596 - DNA, 21 bp, Homo sapiens
tgcacagacctcagagatggc

SEQ ID NO: 2728597 - DNA, 20 bp, Homo sapiens
tgcacagagggcgctcctgt

SEQ ID NO: 2728598 - DNA, 16 bp, Homo sapiens
tgcacagtaatatgaa

SEQ ID NO: 2728599 - DNA, 21 bp, Homo sapiens
tgcacagtaatatgaaagcca

SEQ ID NO: 2728600 - DNA, 21 bp, Homo sapiens
tgcctctaactccctcctcac

SEQ ID NO: 2728601 - DNA, 19 bp, Homo sapiens
tgcctgattcggctgtctc

SEQ ID NO: 2728602 - DNA, 15 bp, Homo sapiens
tgcctgcagccccgc

SEQ ID NO: 2728603 - DNA, 18 bp, Homo sapiens
tgcctgcctgggcctccc

SEQ ID NO: 2728604 - DNA, 21 bp, Homo sapiens
tgcctgcgagagaccctacag

SEQ ID NO: 2728605 - DNA, 17 bp, Homo sapiens
tgcctgcttcctggacc

SEQ ID NO: 2728606 - DNA, 21 bp, Homo sapiens
tgcctggggtgtaatgagctc

SEQ ID NO: 2728607 - DNA, 23 bp, Homo sapiens
tgcctgtctgtccaacccctccc

SEQ ID NO: 2728608 - DNA, 15 bp, Homo sapiens
tgcctgtgcatgacc

SEQ ID NO: 2728609 - DNA, 23 bp, Homo sapiens
tgcctgtgcatgacctgatcatt

SEQ ID NO: 2728610 - DNA, 14 bp, Homo sapiens
tgcctgttctccag

SEQ ID NO: 2728611 - DNA, 16 bp, Homo sapiens
tgccttcataaattat

SEQ ID NO: 2728612 - DNA, 21 bp, Homo sapiens
tgccttcctgtttaaaaaaag

SEQ ID NO: 2728613 - DNA, 11 bp, Homo sapiens
tgccttggttt

SEQ ID NO: 2728614 - DNA, 19 bp, Homo sapiens
tgccttggtttgatttcta

SEQ ID NO: 2728615 - DNA, 23 bp, Homo sapiens
tgcctttctcgtggtagaagcca

SEQ ID NO: 2728616 - DNA, 18 bp, Homo sapiens
tgccttttttagcttcat

SEQ ID NO: 2728617 - DNA, 21 bp, Homo sapiens
tgcgaaggggccctggtcctt

SEQ ID NO: 2728618 - DNA, 15 bp, Homo sapiens
tgcgaccccatctgc

SEQ ID NO: 2728619 - DNA, 13 bp, Homo sapiens
tgcgagaattttc

SEQ ID NO: 2728620 - DNA, 15 bp, Homo sapiens
tgcgagaattttcaa

SEQ ID NO: 2728621 - DNA, 21 bp, Homo sapiens
tgcgcaaactttaacaggttt

SEQ ID NO: 2728622 - DNA, 20 bp, Homo sapiens
tgcgccacggcactccagcc

SEQ ID NO: 2728623 - DNA, 20 bp, Homo sapiens
tgcgctaacactgtcctgtc

SEQ ID NO: 2728624 - DNA, 18 bp, Homo sapiens
tgcgggatggtcctgggg

SEQ ID NO: 2728625 - DNA, 13 bp, Homo sapiens
tgctacaataaat

SEQ ID NO: 2728626 - DNA, 14 bp, Homo sapiens
tgctacacagtata

SEQ ID NO: 2728627 - DNA, 14 bp, Homo sapiens
tgctaggggaagga

SEQ ID NO: 2728628 - DNA, 18 bp, Homo sapiens
tgctaggggaaggactgg

SEQ ID NO: 2728629 - DNA, 22 bp, Homo sapiens
tgctaggggaaggactggccgt

SEQ ID NO: 2728630 - DNA, 16 bp, Homo sapiens
tgctatattttcatga

SEQ ID NO: 2728631 - DNA, 18 bp, Homo sapiens
tgctcacactacttgaga

SEQ ID NO: 2728632 - DNA, 13 bp, Homo sapiens
tgctcacagtctc

SEQ ID NO: 2728633 - DNA, 20 bp, Homo sapiens
tgctcacgactcttcctgca

SEQ ID NO: 2728634 - DNA, 12 bp, Homo sapiens
tgctcagcagcc

SEQ ID NO: 2728635 - DNA, 14 bp, Homo sapiens
tgctcagcagcccc

SEQ ID NO: 2728636 - DNA, 18 bp, Homo sapiens
tgctcagtgatctcactt

SEQ ID NO: 2728637 - DNA, 17 bp, Homo sapiens
tgctccattttcttgtc

SEQ ID NO: 2728638 - DNA, 17 bp, Homo sapiens
tgctcccacggggacca

SEQ ID NO: 2728639 - DNA, 14 bp, Homo sapiens
tgctcgaagaacaa

SEQ ID NO: 2728640 - DNA, 15 bp, Homo sapiens
tgctcgggcccaggc

SEQ ID NO: 2728641 - DNA, 16 bp, Homo sapiens
tgctcgggcccaggcc

SEQ ID NO: 2728642 - DNA, 22 bp, Homo sapiens
tgctctgcccccaactcccgga

SEQ ID NO: 2728643 - DNA, 20 bp, Homo sapiens
tgctctgcctctaactccct

SEQ ID NO: 2728644 - DNA, 21 bp, Homo sapiens
tgctctgcttttcctgtctgt

SEQ ID NO: 2728645 - DNA, 12 bp, Homo sapiens
tgctgaaatcta

SEQ ID NO: 2728646 - DNA, 16 bp, Homo sapiens
tgctgaatgtcattat

SEQ ID NO: 2728647 - DNA, 23 bp, Homo sapiens
tgctgacccaccaaggtctcaca

SEQ ID NO: 2728648 - DNA, 20 bp, Homo sapiens
tgctgagcaggaaccggagg

SEQ ID NO: 2728649 - DNA, 21 bp, Homo sapiens
tgctgatcgccttatttatat

SEQ ID NO: 2728650 - DNA, 17 bp, Homo sapiens
tgctgcaccaacccagc

SEQ ID NO: 2728651 - DNA, 20 bp, Homo sapiens
tgctgcaccaacccagccgc

SEQ ID NO: 2728652 - DNA, 22 bp, Homo sapiens
tgctgcaccaacccagccgctg

SEQ ID NO: 2728653 - DNA, 23 bp, Homo sapiens
tgctgcagaggggcaggccctgc

SEQ ID NO: 2728654 - DNA, 16 bp, Homo sapiens
tgctgccactctgctg

SEQ ID NO: 2728655 - DNA, 17 bp, Homo sapiens
tgctgccactctgctgc

SEQ ID NO: 2728656 - DNA, 19 bp, Homo sapiens
tgctgccactctgctgcct

SEQ ID NO: 2728657 - DNA, 20 bp, Homo sapiens
tgctgccactctgctgcctg

SEQ ID NO: 2728658 - DNA, 22 bp, Homo sapiens
tgctgccactctgctgcctgta

SEQ ID NO: 2728659 - DNA, 16 bp, Homo sapiens
tgctgcctctcttctg

SEQ ID NO: 2728660 - DNA, 15 bp, Homo sapiens
tgctgcctgtacaga

SEQ ID NO: 2728661 - DNA, 15 bp, Homo sapiens
tgctgcgtcagacca

SEQ ID NO: 2728662 - DNA, 23 bp, Homo sapiens
tgctgctaccctccctgctgtcc

SEQ ID NO: 2728663 - DNA, 13 bp, Homo sapiens
tgctgctgtggca

SEQ ID NO: 2728664 - DNA, 18 bp, Homo sapiens
tgctggagactatttaag

SEQ ID NO: 2728665 - DNA, 14 bp, Homo sapiens
tgctggcccacagc

SEQ ID NO: 2728666 - DNA, 17 bp, Homo sapiens
tgctggcctcttggcac

SEQ ID NO: 2728667 - DNA, 12 bp, Homo sapiens
tgctggcctgct

SEQ ID NO: 2728668 - DNA, 14 bp, Homo sapiens
tgctggcctgctct

SEQ ID NO: 2728669 - DNA, 20 bp, Homo sapiens
tgctggcggcgcagagggaa

SEQ ID NO: 2728670 - DNA, 16 bp, Homo sapiens
tgctggctgctggccc

SEQ ID NO: 2728671 - DNA, 22 bp, Homo sapiens
tgctgggaccccagctagggct

SEQ ID NO: 2728672 - DNA, 15 bp, Homo sapiens
tgctgggactggcca

SEQ ID NO: 2728673 - DNA, 21 bp, Homo sapiens
tgctgggcaggaaaccccagc

SEQ ID NO: 2728674 - DNA, 24 bp, Homo sapiens
tgctgggcgaaaacccttatgact

SEQ ID NO: 2728675 - DNA, 10 bp, Homo sapiens
tgctgggctg

SEQ ID NO: 2728676 - DNA, 15 bp, Homo sapiens
tgctgggctgggtgc

SEQ ID NO: 2728677 - DNA, 18 bp, Homo sapiens
tgctggggcaagtccctg

SEQ ID NO: 2728678 - DNA, 19 bp, Homo sapiens
tgctggggctggtgaggcc

SEQ ID NO: 2728679 - DNA, 17 bp, Homo sapiens
tgctgggggctcccctt

SEQ ID NO: 2728680 - DNA, 15 bp, Homo sapiens
tgctgggtggcccat

SEQ ID NO: 2728681 - DNA, 16 bp, Homo sapiens
tgctgtatacaaacag

SEQ ID NO: 2728682 - DNA, 19 bp, Homo sapiens
tgctgtatacaaacaggtg

SEQ ID NO: 2728683 - DNA, 21 bp, Homo sapiens
tgctgtcccctcttgccccaa

SEQ ID NO: 2728684 - DNA, 23 bp, Homo sapiens
tgctgtcctaggccacaccatct

SEQ ID NO: 2728685 - DNA, 13 bp, Homo sapiens
tgctgtggcatca

SEQ ID NO: 2728686 - DNA, 14 bp, Homo sapiens
tgctgtggcctggg

SEQ ID NO: 2728687 - DNA, 13 bp, Homo sapiens
tgctgttgctgtt

SEQ ID NO: 2728688 - DNA, 22 bp, Homo sapiens
tgcttcctgagctgtcccctgg

SEQ ID NO: 2728689 - DNA, 19 bp, Homo sapiens
tgcttctgcattcacagcg

SEQ ID NO: 2728690 - DNA, 14 bp, Homo sapiens
tgcttctgcctcag

SEQ ID NO: 2728691 - DNA, 17 bp, Homo sapiens
tgcttctgcctcagctt

SEQ ID NO: 2728692 - DNA, 22 bp, Homo sapiens
tgcttctggctttgttcttgtc

SEQ ID NO: 2728693 - DNA, 11 bp, Homo sapiens
tgcttcttgta

SEQ ID NO: 2728694 - DNA, 14 bp, Homo sapiens
tgcttcttgtaata

SEQ ID NO: 2728695 - DNA, 15 bp, Homo sapiens
tgcttcttgtaatat

SEQ ID NO: 2728696 - DNA, 20 bp, Homo sapiens
tgcttcttgtaatatttctt

SEQ ID NO: 2728697 - DNA, 15 bp, Homo sapiens
tgcttggcttcccct

SEQ ID NO: 2728698 - DNA, 23 bp, Homo sapiens
tgcttggcttcccctccacccta

SEQ ID NO: 2728699 - DNA, 21 bp, Homo sapiens
tgcttgtgatttttgaacaat

SEQ ID NO: 2728700 - DNA, 20 bp, Homo sapiens
tgctttatcctcctgtcagc

SEQ ID NO: 2728701 - DNA, 21 bp, Homo sapiens
tgctttcctaaagtctctgct

SEQ ID NO: 2728702 - DNA, 13 bp, Homo sapiens
tgcttttctccca

SEQ ID NO: 2728703 - DNA, 20 bp, Homo sapiens
tggaaaccacacttcttgaa

SEQ ID NO: 2728704 - DNA, 16 bp, Homo sapiens
tggaaagcatcacctc

SEQ ID NO: 2728705 - DNA, 21 bp, Homo sapiens
tggaaagcatcacctcaggcc

SEQ ID NO: 2728706 - DNA, 12 bp, Homo sapiens
tggaaagcctct

SEQ ID NO: 2728707 - DNA, 15 bp, Homo sapiens
tggaaagcctctgct

SEQ ID NO: 2728708 - DNA, 16 bp, Homo sapiens
tggaaagcctctgctg

SEQ ID NO: 2728709 - DNA, 18 bp, Homo sapiens
tggaaaggattctaaaca

SEQ ID NO: 2728710 - DNA, 21 bp, Homo sapiens
tggaaaggattctaaacagat

SEQ ID NO: 2728711 - DNA, 17 bp, Homo sapiens
tggaaaggctcagtctc

SEQ ID NO: 2728712 - DNA, 19 bp, Homo sapiens
tggaactccccagggcctc

SEQ ID NO: 2728713 - DNA, 19 bp, Homo sapiens
tggaagaactgcatgggga

SEQ ID NO: 2728714 - DNA, 16 bp, Homo sapiens
tggaagagaggcacct

SEQ ID NO: 2728715 - DNA, 14 bp, Homo sapiens
tggaaggctttgcc

SEQ ID NO: 2728716 - DNA, 13 bp, Homo sapiens
tggaatgaagcat

SEQ ID NO: 2728717 - DNA, 15 bp, Homo sapiens
tggaatgaagcatgt

SEQ ID NO: 2728718 - DNA, 12 bp, Homo sapiens
tggaattttctt

SEQ ID NO: 2728719 - DNA, 20 bp, Homo sapiens
tggaattttctttcatacat

SEQ ID NO: 2728720 - DNA, 14 bp, Homo sapiens
tggaattttgtaaa

SEQ ID NO: 2728721 - DNA, 20 bp, Homo sapiens
tggaattttgtaaaaagaaa

SEQ ID NO: 2728722 - DNA, 12 bp, Homo sapiens
tggacagtcctg

SEQ ID NO: 2728723 - DNA, 13 bp, Homo sapiens
tggacagtcctgg

SEQ ID NO: 2728724 - DNA, 18 bp, Homo sapiens
ttaaagaaaatgtgtctg

SEQ ID NO: 2728725 - DNA, 15 bp, Homo sapiens
ttaaagaaacactaa

SEQ ID NO: 2728726 - DNA, 19 bp, Homo sapiens
ttaaagaaacactaaatta

SEQ ID NO: 2728727 - DNA, 21 bp, Homo sapiens
ttaaagcacatgccagggaaa

SEQ ID NO: 2728728 - DNA, 15 bp, Homo sapiens
ttaaaggacaaacag

SEQ ID NO: 2728729 - DNA, 21 bp, Homo sapiens
ttaaatgccttggtttgattt

SEQ ID NO: 2728730 - DNA, 15 bp, Homo sapiens
ttaaatgtagaaagt

SEQ ID NO: 2728731 - DNA, 12 bp, Homo sapiens
ttaactcagcca

SEQ ID NO: 2728732 - DNA, 16 bp, Homo sapiens
ttaactccgtttccaa

SEQ ID NO: 2728733 - DNA, 19 bp, Homo sapiens
ttaagaatagtctctgggt

SEQ ID NO: 2728734 - DNA, 14 bp, Homo sapiens
ttaagctcagtggc

SEQ ID NO: 2728735 - DNA, 13 bp, Homo sapiens
ttaagtgaatgtc

SEQ ID NO: 2728736 - DNA, 20 bp, Homo sapiens
ttaatagcgtcataactaga

SEQ ID NO: 2728737 - DNA, 17 bp, Homo sapiens
ttaatatctgagaagtg

SEQ ID NO: 2728738 - DNA, 20 bp, Homo sapiens
ttaatatctgatactgtatc

SEQ ID NO: 2728739 - DNA, 15 bp, Homo sapiens
ttaatattcttttgt

SEQ ID NO: 2728740 - DNA, 13 bp, Homo sapiens
ttaatttgactgt

SEQ ID NO: 2728741 - DNA, 19 bp, Homo sapiens
ttaatttttataaatatgt

SEQ ID NO: 2728742 - DNA, 15 bp, Homo sapiens
ttacaaataattttt

SEQ ID NO: 2728743 - DNA, 13 bp, Homo sapiens
ttacaacaaacac

SEQ ID NO: 2728744 - DNA, 17 bp, Homo sapiens
ttacacattatgttaga

SEQ ID NO: 2728745 - DNA, 20 bp, Homo sapiens
ttacagaacacgctttcaca

SEQ ID NO: 2728746 - DNA, 22 bp, Homo sapiens
ttacagtaaataaattgtttga

SEQ ID NO: 2728747 - DNA, 16 bp, Homo sapiens
ttacatggctgtggtt

SEQ ID NO: 2728748 - DNA, 10 bp, Homo sapiens
ttaccaaagc

SEQ ID NO: 2728749 - DNA, 21 bp, Homo sapiens
ttaccctgttcccaagcaaag

SEQ ID NO: 2728750 - DNA, 21 bp, Homo sapiens
ttacccttcctcatctgtgcc

SEQ ID NO: 2728751 - DNA, 16 bp, Homo sapiens
ttacctggatgccatt

SEQ ID NO: 2728752 - DNA, 19 bp, Homo sapiens
ttactattatttgctatat

SEQ ID NO: 2728753 - DNA, 17 bp, Homo sapiens
ttactcagtgaaatcat

SEQ ID NO: 2728754 - DNA, 16 bp, Homo sapiens
ttacttaaccaggttt

SEQ ID NO: 2728755 - DNA, 16 bp, Homo sapiens
ttacttccatgatact

SEQ ID NO: 2728756 - DNA, 19 bp, Homo sapiens
ttacttccatgatacttta

SEQ ID NO: 2728757 - DNA, 12 bp, Homo sapiens
ttacttccccca

SEQ ID NO: 2728758 - DNA, 15 bp, Homo sapiens
ttacttcccccaccc

SEQ ID NO: 2728759 - DNA, 14 bp, Homo sapiens
ttactttgtgcaaa

SEQ ID NO: 2728760 - DNA, 14 bp, Homo sapiens
ttagaatatattaa

SEQ ID NO: 2728761 - DNA, 13 bp, Homo sapiens
ttagaccctctat

SEQ ID NO: 2728762 - DNA, 21 bp, Homo sapiens
ttagagaggtagcgagctgct

SEQ ID NO: 2728763 - DNA, 19 bp, Homo sapiens
ttagatcaacacttttctc

SEQ ID NO: 2728764 - DNA, 21 bp, Homo sapiens
ttagattttctgtaaatgaag

SEQ ID NO: 2728765 - DNA, 16 bp, Homo sapiens
ttagcttcatatctaa

SEQ ID NO: 2728766 - DNA, 13 bp, Homo sapiens
ttaggagaagttg

SEQ ID NO: 2728767 - DNA, 17 bp, Homo sapiens
ttaggcctggcacagtg

SEQ ID NO: 2728768 - DNA, 18 bp, Homo sapiens
ttaggcctggcacagtgt

SEQ ID NO: 2728769 - DNA, 19 bp, Homo sapiens
ttagtttgatttaatatct

SEQ ID NO: 2728770 - DNA, 17 bp, Homo sapiens
ttataaatatgtgaaaa

SEQ ID NO: 2728771 - DNA, 20 bp, Homo sapiens
ttataaatatgtgaaaatga

SEQ ID NO: 2728772 - DNA, 16 bp, Homo sapiens
ttataccccatttgat

SEQ ID NO: 2728773 - DNA, 20 bp, Homo sapiens
ttatatatcataaagtatgc

SEQ ID NO: 2728774 - DNA, 21 bp, Homo sapiens
ttatcatggagaatacagaaa

SEQ ID NO: 2728775 - DNA, 15 bp, Homo sapiens
ttatgagaacatggt

SEQ ID NO: 2728776 - DNA, 13 bp, Homo sapiens
ttatgatgctatt

SEQ ID NO: 2728777 - DNA, 19 bp, Homo sapiens
ttatgatttttaaagaaaa

SEQ ID NO: 2728778 - DNA, 17 bp, Homo sapiens
ttatgccttgctatttt

SEQ ID NO: 2728779 - DNA, 19 bp, Homo sapiens
ttatggacatcgatatgaa

SEQ ID NO: 2728780 - DNA, 22 bp, Homo sapiens
ttatggacatcgatatgaaaaa

SEQ ID NO: 2728781 - DNA, 13 bp, Homo sapiens
ttatgtctaaaga

SEQ ID NO: 2728782 - DNA, 16 bp, Homo sapiens
ttattaaaaaaacaca

SEQ ID NO: 2728783 - DNA, 17 bp, Homo sapiens
ttattaaaaaaacacaa

SEQ ID NO: 2728784 - DNA, 21 bp, Homo sapiens
ttattcaggaaaagcctctgt

SEQ ID NO: 2728785 - DNA, 13 bp, Homo sapiens
ttattctcctccc

SEQ ID NO: 2728786 - DNA, 15 bp, Homo sapiens
ttattcttttccaga

SEQ ID NO: 2728787 - DNA, 13 bp, Homo sapiens
ttattctttttaa

SEQ ID NO: 2728788 - DNA, 16 bp, Homo sapiens
ttattgtgatttcccg

SEQ ID NO: 2728789 - DNA, 15 bp, Homo sapiens
ttatttaattagaat

SEQ ID NO: 2728790 - DNA, 20 bp, Homo sapiens
ttatttgccctaagaacttt

SEQ ID NO: 2728791 - DNA, 14 bp, Homo sapiens
ttatttgtacagtt

SEQ ID NO: 2728792 - DNA, 15 bp, Homo sapiens
ttatttgtacagttc

SEQ ID NO: 2728793 - DNA, 21 bp, Homo sapiens
ttatttgtcggggaagatgaa

SEQ ID NO: 2728794 - DNA, 13 bp, Homo sapiens
ttattttaatgta

SEQ ID NO: 2728795 - DNA, 15 bp, Homo sapiens
ttatttttgtaccat

SEQ ID NO: 2728796 - DNA, 13 bp, Homo sapiens
ttattttttgcat

SEQ ID NO: 2728797 - DNA, 14 bp, Homo sapiens
ttcaattcctgggc

SEQ ID NO: 2728798 - DNA, 20 bp, Homo sapiens
ttcaatttactttttaaaca

SEQ ID NO: 2728799 - DNA, 18 bp, Homo sapiens
ttcacaccattctcctgc

SEQ ID NO: 2728800 - DNA, 17 bp, Homo sapiens
ttcacacctcacgctct

SEQ ID NO: 2728801 - DNA, 18 bp, Homo sapiens
ttcacacttgttcaacag

SEQ ID NO: 2728802 - DNA, 19 bp, Homo sapiens
ttcacagatggaagaagtt

SEQ ID NO: 2728803 - DNA, 16 bp, Homo sapiens
ttcacagcgcctcctg

SEQ ID NO: 2728804 - DNA, 18 bp, Homo sapiens
ttcacagcgcctcctgga

SEQ ID NO: 2728805 - DNA, 11 bp, Homo sapiens
ttcacatgaaa

SEQ ID NO: 2728806 - DNA, 13 bp, Homo sapiens
ttcaccatgcagg

SEQ ID NO: 2728807 - DNA, 24 bp, Homo sapiens
ttcactccggtgtgcctgcagccc

SEQ ID NO: 2728808 - DNA, 18 bp, Homo sapiens
ttcacttaaaaaaatgcc

SEQ ID NO: 2728809 - DNA, 15 bp, Homo sapiens
ttcacttaaaatcaa

SEQ ID NO: 2728810 - DNA, 23 bp, Homo sapiens
ttcagaattgtttttagaaattt

SEQ ID NO: 2728811 - DNA, 19 bp, Homo sapiens
ttcagcagtcagtccccca

SEQ ID NO: 2728812 - DNA, 11 bp, Homo sapiens
ttcagctggtg

SEQ ID NO: 2728813 - DNA, 21 bp, Homo sapiens
ttcagctggtggatggtgact

SEQ ID NO: 2728814 - DNA, 15 bp, Homo sapiens
ttcagcttctgctgg

SEQ ID NO: 2728815 - DNA, 17 bp, Homo sapiens
ttcagcttctgctgggc

SEQ ID NO: 2728816 - DNA, 20 bp, Homo sapiens
ttcaggaatttaatttatag

SEQ ID NO: 2728817 - DNA, 15 bp, Homo sapiens
ttcaggagctcagtt

SEQ ID NO: 2728818 - DNA, 23 bp, Homo sapiens
ttcaggggctgcccgctcccagt

SEQ ID NO: 2728819 - DNA, 13 bp, Homo sapiens
ttcagtcttggag

SEQ ID NO: 2728820 - DNA, 23 bp, Homo sapiens
ttcagttcctctttgcatggaat

SEQ ID NO: 2728821 - DNA, 19 bp, Homo sapiens
ttcataaatttgttgtcat

SEQ ID NO: 2728822 - DNA, 16 bp, Homo sapiens
ttcatataatttaaag

SEQ ID NO: 2728823 - DNA, 14 bp, Homo sapiens
ttcatatctaattt

SEQ ID NO: 2728824 - DNA, 18 bp, Homo sapiens
ttcatatctaatttacca

SEQ ID NO: 2728825 - DNA, 18 bp, Homo sapiens
ttcatctggaggctgcgt

SEQ ID NO: 2728826 - DNA, 20 bp, Homo sapiens
ttcatgcattctagtgcaga

SEQ ID NO: 2728827 - DNA, 14 bp, Homo sapiens
ttcatgctttctcc

SEQ ID NO: 2728828 - DNA, 21 bp, Homo sapiens
ttcatgtggcattctctctgc

SEQ ID NO: 2728829 - DNA, 21 bp, Homo sapiens
ttcattagggcaaagatctca

SEQ ID NO: 2728830 - DNA, 16 bp, Homo sapiens
ttcattgtgtatgaga

SEQ ID NO: 2728831 - DNA, 23 bp, Homo sapiens
ttcatttctaacataagtaagac

SEQ ID NO: 2728832 - DNA, 15 bp, Homo sapiens
ttccaaagcattttc

SEQ ID NO: 2728833 - DNA, 20 bp, Homo sapiens
ttccaaagcattttcagcat

SEQ ID NO: 2728834 - DNA, 21 bp, Homo sapiens
ttccaaagggcagtaaagttt

SEQ ID NO: 2728835 - DNA, 18 bp, Homo sapiens
ttccaaatacattccagt

SEQ ID NO: 2728836 - DNA, 18 bp, Homo sapiens
ttccaaccccagctggcc

SEQ ID NO: 2728837 - DNA, 20 bp, Homo sapiens
ttccaaccccagctggcctc

SEQ ID NO: 2728838 - DNA, 13 bp, Homo sapiens
ttccacataaagg

SEQ ID NO: 2728839 - DNA, 14 bp, Homo sapiens
ttccaccagagcag

SEQ ID NO: 2728840 - DNA, 18 bp, Homo sapiens
ttccactcaggtctgttt

SEQ ID NO: 2728841 - DNA, 19 bp, Homo sapiens
ttccactgccaaaacaatg

SEQ ID NO: 2728842 - DNA, 22 bp, Homo sapiens
ttccagaaagaaaatgaatttg

SEQ ID NO: 2728843 - DNA, 12 bp, Homo sapiens
ttccagaattga

SEQ ID NO: 2728844 - DNA, 15 bp, Homo sapiens
ttccagaattgagag

SEQ ID NO: 2728845 - DNA, 19 bp, Homo sapiens
ttccagcttcctctgagcc

SEQ ID NO: 2728846 - DNA, 20 bp, Homo sapiens
ttccagcttcctctgagccg

SEQ ID NO: 2728847 - DNA, 18 bp, Homo sapiens
ttccagtctctgcatgta

SEQ ID NO: 2728848 - DNA, 19 bp, Homo sapiens
ttttgaatgtcataaagaa

SEQ ID NO: 2728849 - DNA, 15 bp, Homo sapiens
ttttgctcttctgta

SEQ ID NO: 2728850 - DNA, 20 bp, Homo sapiens
ttttgctcttctgtatgtga

SEQ ID NO: 2728851 - DNA, 18 bp, Homo sapiens
ttttggagaaaaattaca

SEQ ID NO: 2728852 - DNA, 16 bp, Homo sapiens
ttttgtaaaaagaaat

SEQ ID NO: 2728853 - DNA, 17 bp, Homo sapiens
ttttgtaaaaagaaatt

SEQ ID NO: 2728854 - DNA, 15 bp, Homo sapiens
ttttgtcctgttatt

SEQ ID NO: 2728855 - DNA, 16 bp, Homo sapiens
ttttgttagcaaagat

SEQ ID NO: 2728856 - DNA, 21 bp, Homo sapiens
tttttaaagaaaatgtgtctg

SEQ ID NO: 2728857 - DNA, 18 bp, Homo sapiens
tttttaaataaaagcaca

SEQ ID NO: 2728858 - DNA, 18 bp, Homo sapiens
tttttaaataaaatagag

SEQ ID NO: 2728859 - DNA, 14 bp, Homo sapiens
tttttaagctgtaa

SEQ ID NO: 2728860 - DNA, 13 bp, Homo sapiens
tttttacatttca

SEQ ID NO: 2728861 - DNA, 15 bp, Homo sapiens
tttttatttccacat

SEQ ID NO: 2728862 - DNA, 14 bp, Homo sapiens
tttttccagaattg

SEQ ID NO: 2728863 - DNA, 18 bp, Homo sapiens
tttttctacttttaaaga

SEQ ID NO: 2728864 - DNA, 16 bp, Homo sapiens
tttttctgcctgagat

SEQ ID NO: 2728865 - DNA, 23 bp, Homo sapiens
tttttctgcctgagattctttaa

SEQ ID NO: 2728866 - DNA, 13 bp, Homo sapiens
tttttgatgtcag

SEQ ID NO: 2728867 - DNA, 15 bp, Homo sapiens
tttttgttagcaaag

SEQ ID NO: 2728868 - DNA, 18 bp, Homo sapiens
ttttttaaataaaataga

SEQ ID NO: 2728869 - DNA, 16 bp, Homo sapiens
aaagacacctgcctta

SEQ ID NO: 2728870 - DNA, 13 bp, Homo sapiens
aaagacatcaatg

SEQ ID NO: 2728871 - DNA, 22 bp, Homo sapiens
aaagagctttagtcctagagga

SEQ ID NO: 2728872 - DNA, 12 bp, Homo sapiens
aaagattatata

SEQ ID NO: 2728873 - DNA, 11 bp, Homo sapiens
aaagcagcttt

SEQ ID NO: 2728874 - DNA, 16 bp, Homo sapiens
aaagccacactttgaa

SEQ ID NO: 2728875 - DNA, 22 bp, Homo sapiens
aaagccatattctaaattcact

SEQ ID NO: 2728876 - DNA, 16 bp, Homo sapiens
aaagcctctgctgcca

SEQ ID NO: 2728877 - DNA, 18 bp, Homo sapiens
aaagctagaggagattgc

SEQ ID NO: 2728878 - DNA, 15 bp, Homo sapiens
aaagctgtgtctctg

SEQ ID NO: 2728879 - DNA, 21 bp, Homo sapiens
aaagctgtgtctctgtatata

SEQ ID NO: 2728880 - DNA, 23 bp, Homo sapiens
aaagcttacccttggtttgcaca

SEQ ID NO: 2728881 - DNA, 17 bp, Homo sapiens
aaaggaacacccggaaa

SEQ ID NO: 2728882 - DNA, 19 bp, Homo sapiens
aaaggattttaccaaagca

SEQ ID NO: 2728883 - DNA, 14 bp, Homo sapiens
aaaggcttctccac

SEQ ID NO: 2728884 - DNA, 17 bp, Homo sapiens
aaaggttttattttgta

SEQ ID NO: 2728885 - DNA, 18 bp, Homo sapiens
aaaggttttattttgtaa

SEQ ID NO: 2728886 - DNA, 12 bp, Homo sapiens
aaagtatttttg

SEQ ID NO: 2728887 - DNA, 12 bp, Homo sapiens
aaagtcatttaa

SEQ ID NO: 2728888 - DNA, 22 bp, Homo sapiens
aaagtctaaagtttacagtaaa

SEQ ID NO: 2728889 - DNA, 17 bp, Homo sapiens
aaagtctcctgtatcat

SEQ ID NO: 2728890 - DNA, 14 bp, Homo sapiens
aaagtgaataaact

SEQ ID NO: 2728891 - DNA, 15 bp, Homo sapiens
aaagtgaataaactt

SEQ ID NO: 2728892 - DNA, 18 bp, Homo sapiens
aaagtgaataaacttcag

SEQ ID NO: 2728893 - DNA, 23 bp, Homo sapiens
aaagtgagactttgagggtgtat

SEQ ID NO: 2728894 - DNA, 16 bp, Homo sapiens
aaagtgcaatgtcctg

SEQ ID NO: 2728895 - DNA, 16 bp, Homo sapiens
aaagtgggtttcaatt

SEQ ID NO: 2728896 - DNA, 20 bp, Homo sapiens
aaagttaaactacttgtaaa

SEQ ID NO: 2728897 - DNA, 19 bp, Homo sapiens
aaagttactggctctttgt

SEQ ID NO: 2728898 - DNA, 13 bp, Homo sapiens
aaataaaagcaca

SEQ ID NO: 2728899 - DNA, 13 bp, Homo sapiens
aaataaagcaaat

SEQ ID NO: 2728900 - DNA, 17 bp, Homo sapiens
aaataagttttatacat

SEQ ID NO: 2728901 - DNA, 20 bp, Homo sapiens
aaataagttttatacataaa

SEQ ID NO: 2728902 - DNA, 16 bp, Homo sapiens
aaatacaacagaagtt

SEQ ID NO: 2728903 - DNA, 18 bp, Homo sapiens
aaatagaagctataaaga

SEQ ID NO: 2728904 - DNA, 18 bp, Homo sapiens
aaatagggcaaagaatca

SEQ ID NO: 2728905 - DNA, 19 bp, Homo sapiens
aaatagggtccttgaaaca

SEQ ID NO: 2728906 - DNA, 23 bp, Homo sapiens
aaatatagttgtctttctttgct

SEQ ID NO: 2728907 - DNA, 19 bp, Homo sapiens
aaatatccctttttcacat

SEQ ID NO: 2728908 - DNA, 21 bp, Homo sapiens
aaatattactgatcttacctt

SEQ ID NO: 2728909 - DNA, 14 bp, Homo sapiens
aaatcacaaacata

SEQ ID NO: 2728910 - DNA, 22 bp, Homo sapiens
aaatcagagctggcagcctcca

SEQ ID NO: 2728911 - DNA, 15 bp, Homo sapiens
aaatcagattttctc

SEQ ID NO: 2728912 - DNA, 22 bp, Homo sapiens
aaatcccaagtgtctcttgact

SEQ ID NO: 2728913 - DNA, 18 bp, Homo sapiens
aaatcctaggaagttatc

SEQ ID NO: 2728914 - DNA, 12 bp, Homo sapiens
aaatcttcagct

SEQ ID NO: 2728915 - DNA, 18 bp, Homo sapiens
aaatcttggtttggtaca

SEQ ID NO: 2728916 - DNA, 12 bp, Homo sapiens
aaatgaagcaat

SEQ ID NO: 2728917 - DNA, 15 bp, Homo sapiens
aaatgacagcgggga

SEQ ID NO: 2728918 - DNA, 19 bp, Homo sapiens
aaatgagcttgtaaatact

SEQ ID NO: 2728919 - DNA, 21 bp, Homo sapiens
aaatgagcttgtaaatactcc

SEQ ID NO: 2728920 - DNA, 13 bp, Homo sapiens
aaatgcattatgt

SEQ ID NO: 2728921 - DNA, 13 bp, Homo sapiens
aaatgctgaatga

SEQ ID NO: 2728922 - DNA, 17 bp, Homo sapiens
aaatgctgaatgaatcc

SEQ ID NO: 2728923 - DNA, 19 bp, Homo sapiens
aaatgctttaaaaattaat

SEQ ID NO: 2728924 - DNA, 18 bp, Homo sapiens
aaatggcttacttacaaa

SEQ ID NO: 2728925 - DNA, 21 bp, Homo sapiens
aaatgtcactgaagtgattga

SEQ ID NO: 2728926 - DNA, 16 bp, Homo sapiens
aaatgtttaattcatt

SEQ ID NO: 2728927 - DNA, 19 bp, Homo sapiens
aaatgtttaattcattaat

SEQ ID NO: 2728928 - DNA, 17 bp, Homo sapiens
aaattaaattctctcta

SEQ ID NO: 2728929 - DNA, 19 bp, Homo sapiens
aaattaatcttttaaaaat

SEQ ID NO: 2728930 - DNA, 21 bp, Homo sapiens
aaattaatcttttaaaaatga

SEQ ID NO: 2728931 - DNA, 15 bp, Homo sapiens
aaattaatttgtgca

SEQ ID NO: 2728932 - DNA, 19 bp, Homo sapiens
aaattaccagagttgttct

SEQ ID NO: 2728933 - DNA, 17 bp, Homo sapiens
aaattagcaatcatttt

SEQ ID NO: 2728934 - DNA, 17 bp, Homo sapiens
aaattagtttaaaatga

SEQ ID NO: 2728935 - DNA, 16 bp, Homo sapiens
aaattcactgttgaat

SEQ ID NO: 2728936 - DNA, 13 bp, Homo sapiens
aaattccactgga

SEQ ID NO: 2728937 - DNA, 21 bp, Homo sapiens
aaattgtctgtctgctcttat

SEQ ID NO: 2728938 - DNA, 21 bp, Homo sapiens
aaatttattcttatcttagga

SEQ ID NO: 2728939 - DNA, 17 bp, Homo sapiens
aaatttcccaattttct

SEQ ID NO: 2728940 - DNA, 22 bp, Homo sapiens
aaatttgttgtcatgtgtatga

SEQ ID NO: 2728941 - DNA, 19 bp, Homo sapiens
aacaatatgattgcactaa

SEQ ID NO: 2728942 - DNA, 15 bp, Homo sapiens
aacaatcacaaaagc

SEQ ID NO: 2728943 - DNA, 14 bp, Homo sapiens
aacaatccaaatgc

SEQ ID NO: 2728944 - DNA, 18 bp, Homo sapiens
aacaatccaaatgcattc

SEQ ID NO: 2728945 - DNA, 14 bp, Homo sapiens
aacaatgtcagaaa

SEQ ID NO: 2728946 - DNA, 16 bp, Homo sapiens
aacaatgtcagaaact

SEQ ID NO: 2728947 - DNA, 17 bp, Homo sapiens
aacacaaaaaaataata

SEQ ID NO: 2728948 - DNA, 16 bp, Homo sapiens
aacacccggaaagact

SEQ ID NO: 2728949 - DNA, 18 bp, Homo sapiens
aacacggcagctgtagct

SEQ ID NO: 2728950 - DNA, 19 bp, Homo sapiens
aacactaaacagactattt

SEQ ID NO: 2728951 - DNA, 20 bp, Homo sapiens
aacactaaattagtttaaaa

SEQ ID NO: 2728952 - DNA, 19 bp, Homo sapiens
aacagccccccccttgaat

SEQ ID NO: 2728953 - DNA, 19 bp, Homo sapiens
aacagcttaaagagaaaaa

SEQ ID NO: 2728954 - DNA, 14 bp, Homo sapiens
aacaggagagacag

SEQ ID NO: 2728955 - DNA, 15 bp, Homo sapiens
aacaggagagacagg

SEQ ID NO: 2728956 - DNA, 21 bp, Homo sapiens
aacaggttttcttctaatcat

SEQ ID NO: 2728957 - DNA, 16 bp, Homo sapiens
aacagtgctctgcctc

SEQ ID NO: 2728958 - DNA, 19 bp, Homo sapiens
aacagtttggatgtcctca

SEQ ID NO: 2728959 - DNA, 18 bp, Homo sapiens
aacatcgcaatagttttt

SEQ ID NO: 2728960 - DNA, 14 bp, Homo sapiens
aacatgatgtgaga

SEQ ID NO: 2728961 - DNA, 17 bp, Homo sapiens
aacatggattccaaagc

SEQ ID NO: 2728962 - DNA, 12 bp, Homo sapiens
aacatgtatgtg

SEQ ID NO: 2728963 - DNA, 18 bp, Homo sapiens
aacatgtttctgttttgt

SEQ ID NO: 2728964 - DNA, 17 bp, Homo sapiens
aacattaccttgtcttt

SEQ ID NO: 2728965 - DNA, 17 bp, Homo sapiens
aacattgcaatagaaat

SEQ ID NO: 2728966 - DNA, 21 bp, Homo sapiens
aacattttgaaaacccctggc

SEQ ID NO: 2728967 - DNA, 22 bp, Homo sapiens
aaccacactgaaacctcttcgg

SEQ ID NO: 2728968 - DNA, 15 bp, Homo sapiens
aaccacacttcttga

SEQ ID NO: 2728969 - DNA, 20 bp, Homo sapiens
aaccagccgtattttacatg

SEQ ID NO: 2728970 - DNA, 16 bp, Homo sapiens
aaccaggggtaccagg

SEQ ID NO: 2728971 - DNA, 15 bp, Homo sapiens
aaccatcggtccaca

SEQ ID NO: 2728972 - DNA, 14 bp, Homo sapiens
aacccagccgctgc

SEQ ID NO: 2728973 - DNA, 16 bp, Homo sapiens
aacccagcctgagtgc

SEQ ID NO: 2728974 - DNA, 21 bp, Homo sapiens
aacccaggccacaaatgtgtc

SEQ ID NO: 2728975 - DNA, 17 bp, Homo sapiens
aacccatcttccccgga

SEQ ID NO: 2728976 - DNA, 14 bp, Homo sapiens
aaccccagcatcct

SEQ ID NO: 2728977 - DNA, 11 bp, Homo sapiens
aaccccagctg

SEQ ID NO: 2728978 - DNA, 12 bp, Homo sapiens
aaccccagctgg

SEQ ID NO: 2728979 - DNA, 23 bp, Homo sapiens
aaccccagctggcctctagaaca

SEQ ID NO: 2728980 - DNA, 12 bp, Homo sapiens
aaccgacttttc

SEQ ID NO: 2728981 - DNA, 12 bp, Homo sapiens
aaccgtccctga

SEQ ID NO: 2728982 - DNA, 18 bp, Homo sapiens
aaccgtggactcttcctt

SEQ ID NO: 2728983 - DNA, 14 bp, Homo sapiens
aaccgtttacagtg

SEQ ID NO: 2728984 - DNA, 22 bp, Homo sapiens
aacctatgtaatttttaaagca

SEQ ID NO: 2728985 - DNA, 16 bp, Homo sapiens
aacctccacctcctgg

SEQ ID NO: 2728986 - DNA, 15 bp, Homo sapiens
aacctgcatttttaa

SEQ ID NO: 2728987 - DNA, 19 bp, Homo sapiens
aacctgcctgtgcatgacc

SEQ ID NO: 2728988 - DNA, 21 bp, Homo sapiens
aacctggggtgtggttccaga

SEQ ID NO: 2728989 - DNA, 16 bp, Homo sapiens
aacctgtccataaagt

SEQ ID NO: 2728990 - DNA, 17 bp, Homo sapiens
aacctgtccataaagta

SEQ ID NO: 2728991 - DNA, 21 bp, Homo sapiens
aacctgtccataaagtaattt

SEQ ID NO: 2728992 - DNA, 18 bp, Homo sapiens
aacgctctaccctgcagc

SEQ ID NO: 2728993 - DNA, 23 bp, Homo sapiens
acattatgttattggaattttct

SEQ ID NO: 2728994 - DNA, 20 bp, Homo sapiens
acattcatctggaggctgcg

SEQ ID NO: 2728995 - DNA, 22 bp, Homo sapiens
acattcgaggtgtcaccctgca

SEQ ID NO: 2728996 - DNA, 17 bp, Homo sapiens
acattctgtctctgctt

SEQ ID NO: 2728997 - DNA, 16 bp, Homo sapiens
acattggaagctccca

SEQ ID NO: 2728998 - DNA, 16 bp, Homo sapiens
acatttaggagaagtt

SEQ ID NO: 2728999 - DNA, 20 bp, Homo sapiens
acatttctggccatttaact

SEQ ID NO: 2729000 - DNA, 24 bp, Homo sapiens
acatttctggccatttaactagca

SEQ ID NO: 2729001 - DNA, 20 bp, Homo sapiens
acattttgtacaaagatatg

SEQ ID NO: 2729002 - DNA, 11 bp, Homo sapiens
acattttgtat

SEQ ID NO: 2729003 - DNA, 20 bp, Homo sapiens
acatttttgtacattatgtt

SEQ ID NO: 2729004 - DNA, 15 bp, Homo sapiens
accaaaagttcatat

SEQ ID NO: 2729005 - DNA, 20 bp, Homo sapiens
accaaagagtctctggctca

SEQ ID NO: 2729006 - DNA, 23 bp, Homo sapiens
accaaagagtctctggctcagct

SEQ ID NO: 2729007 - DNA, 12 bp, Homo sapiens
accaacccagcc

SEQ ID NO: 2729008 - DNA, 15 bp, Homo sapiens
accaacccagccgct

SEQ ID NO: 2729009 - DNA, 20 bp, Homo sapiens
accaacccagccgctgcccg

SEQ ID NO: 2729010 - DNA, 20 bp, Homo sapiens
accaagcgtgattcctgctg

SEQ ID NO: 2729011 - DNA, 19 bp, Homo sapiens
accaagctgtgccaccctg

SEQ ID NO: 2729012 - DNA, 22 bp, Homo sapiens
accaaggtctcacactcctcct

SEQ ID NO: 2729013 - DNA, 20 bp, Homo sapiens
accacaacctccacctcctg

SEQ ID NO: 2729014 - DNA, 13 bp, Homo sapiens
accacaccctgcc

SEQ ID NO: 2729015 - DNA, 16 bp, Homo sapiens
accacaccctgcctgc

SEQ ID NO: 2729016 - DNA, 19 bp, Homo sapiens
accacaccctgcctgctgt

SEQ ID NO: 2729017 - DNA, 10 bp, Homo sapiens
accacagcaa

SEQ ID NO: 2729018 - DNA, 21 bp, Homo sapiens
accacagcaaggcacctgcag

SEQ ID NO: 2729019 - DNA, 18 bp, Homo sapiens
accacattctgtctctgc

SEQ ID NO: 2729020 - DNA, 12 bp, Homo sapiens
accacctcatgt

SEQ ID NO: 2729021 - DNA, 22 bp, Homo sapiens
accactaatgcttgccaagaaa

SEQ ID NO: 2729022 - DNA, 17 bp, Homo sapiens
accactaggactctgag

SEQ ID NO: 2729023 - DNA, 12 bp, Homo sapiens
accactgggccc

SEQ ID NO: 2729024 - DNA, 13 bp, Homo sapiens
accactgggcccc

SEQ ID NO: 2729025 - DNA, 17 bp, Homo sapiens
accactgggcccctcag

SEQ ID NO: 2729026 - DNA, 13 bp, Homo sapiens
accacttccctgc

SEQ ID NO: 2729027 - DNA, 22 bp, Homo sapiens
accacttccctgcttttctccc

SEQ ID NO: 2729028 - DNA, 14 bp, Homo sapiens
accagaaaagcaat

SEQ ID NO: 2729029 - DNA, 17 bp, Homo sapiens
accagagcaggggctgc

SEQ ID NO: 2729030 - DNA, 21 bp, Homo sapiens
accagagcaggggctgctggg

SEQ ID NO: 2729031 - DNA, 14 bp, Homo sapiens
accagagctgcctc

SEQ ID NO: 2729032 - DNA, 16 bp, Homo sapiens
accagagctgcctccc

SEQ ID NO: 2729033 - DNA, 17 bp, Homo sapiens
accagagctgcctcccc

SEQ ID NO: 2729034 - DNA, 19 bp, Homo sapiens
accagagctgcctccccaa

SEQ ID NO: 2729035 - DNA, 15 bp, Homo sapiens
accagcccagaccct

SEQ ID NO: 2729036 - DNA, 15 bp, Homo sapiens
accagccgtatttta

SEQ ID NO: 2729037 - DNA, 20 bp, Homo sapiens
accagcctggccaacatggt

SEQ ID NO: 2729038 - DNA, 22 bp, Homo sapiens
accaggagcaaccgtgcagcca

SEQ ID NO: 2729039 - DNA, 18 bp, Homo sapiens
accaggcacatggctggg

SEQ ID NO: 2729040 - DNA, 16 bp, Homo sapiens
accaggcagctccagc

SEQ ID NO: 2729041 - DNA, 14 bp, Homo sapiens
accaggctgctgca

SEQ ID NO: 2729042 - DNA, 16 bp, Homo sapiens
accaggggcaggcaca

SEQ ID NO: 2729043 - DNA, 19 bp, Homo sapiens
accaggggcaggcacagca

SEQ ID NO: 2729044 - DNA, 20 bp, Homo sapiens
accaggtctcctccaccgcc

SEQ ID NO: 2729045 - DNA, 19 bp, Homo sapiens
accagtgtcgtgtctgctg

SEQ ID NO: 2729046 - DNA, 20 bp, Homo sapiens
accatattgctcttaaaaat

SEQ ID NO: 2729047 - DNA, 18 bp, Homo sapiens
accatgagcaattctcct

SEQ ID NO: 2729048 - DNA, 20 bp, Homo sapiens
accatgctggcggcgcagag

SEQ ID NO: 2729049 - DNA, 18 bp, Homo sapiens
accattattttacagtct

SEQ ID NO: 2729050 - DNA, 22 bp, Homo sapiens
accattattttacagtctctgt

SEQ ID NO: 2729051 - DNA, 16 bp, Homo sapiens
accattgtcttccaac

SEQ ID NO: 2729052 - DNA, 20 bp, Homo sapiens
acccaacgtgatgctatgca

SEQ ID NO: 2729053 - DNA, 17 bp, Homo sapiens
acccaccccctctttgt

SEQ ID NO: 2729054 - DNA, 21 bp, Homo sapiens
acccaccccctctttgtgtac

SEQ ID NO: 2729055 - DNA, 17 bp, Homo sapiens
acccactggccagtcct

SEQ ID NO: 2729056 - DNA, 15 bp, Homo sapiens
acccagcctgagtgc

SEQ ID NO: 2729057 - DNA, 19 bp, Homo sapiens
acccagggctccctcctgg

SEQ ID NO: 2729058 - DNA, 22 bp, Homo sapiens
acccagggctccctcctggagc

SEQ ID NO: 2729059 - DNA, 14 bp, Homo sapiens
acccagtgtgtgct

SEQ ID NO: 2729060 - DNA, 18 bp, Homo sapiens
acccagtgtgtgctcagc

SEQ ID NO: 2729061 - DNA, 22 bp, Homo sapiens
acccagtgtgtgctcagcagcc

SEQ ID NO: 2729062 - DNA, 16 bp, Homo sapiens
acccatcttccccgga

SEQ ID NO: 2729063 - DNA, 16 bp, Homo sapiens
acccatttgccaggat

SEQ ID NO: 2729064 - DNA, 16 bp, Homo sapiens
accccaccctgcccct

SEQ ID NO: 2729065 - DNA, 15 bp, Homo sapiens
accccagacctctga

SEQ ID NO: 2729066 - DNA, 16 bp, Homo sapiens
accccagacctctgaa

SEQ ID NO: 2729067 - DNA, 18 bp, Homo sapiens
accccagcacagctcctc

SEQ ID NO: 2729068 - DNA, 20 bp, Homo sapiens
accccagcacagctcctccc

SEQ ID NO: 2729069 - DNA, 21 bp, Homo sapiens
accccagcggcagatgggcct

SEQ ID NO: 2729070 - DNA, 13 bp, Homo sapiens
accccatctgccc

SEQ ID NO: 2729071 - DNA, 17 bp, Homo sapiens
accccatctgcccagga

SEQ ID NO: 2729072 - DNA, 19 bp, Homo sapiens
acccccactgccgcctcct

SEQ ID NO: 2729073 - DNA, 20 bp, Homo sapiens
acccccacttcatgcccact

SEQ ID NO: 2729074 - DNA, 18 bp, Homo sapiens
acccccagcacccgggct

SEQ ID NO: 2729075 - DNA, 22 bp, Homo sapiens
acccccagcacccgggctcagg

SEQ ID NO: 2729076 - DNA, 12 bp, Homo sapiens
accccccacctg

SEQ ID NO: 2729077 - DNA, 13 bp, Homo sapiens
acccccgcccagg

SEQ ID NO: 2729078 - DNA, 23 bp, Homo sapiens
acccccgcccaggctggccagcc

SEQ ID NO: 2729079 - DNA, 14 bp, Homo sapiens
accccctcctgctg

SEQ ID NO: 2729080 - DNA, 12 bp, Homo sapiens
acccctcccagc

SEQ ID NO: 2729081 - DNA, 13 bp, Homo sapiens
acccctcccagct

SEQ ID NO: 2729082 - DNA, 21 bp, Homo sapiens
acccctcccccacgtctctct

SEQ ID NO: 2729083 - DNA, 11 bp, Homo sapiens
acccctcctga

SEQ ID NO: 2729084 - DNA, 15 bp, Homo sapiens
acccggattggccct

SEQ ID NO: 2729085 - DNA, 19 bp, Homo sapiens
acccggattggccctgccc

SEQ ID NO: 2729086 - DNA, 23 bp, Homo sapiens
acccgggctcagggaccacagca

SEQ ID NO: 2729087 - DNA, 21 bp, Homo sapiens
accctaagtgtggatgttcag

SEQ ID NO: 2729088 - DNA, 18 bp, Homo sapiens
accctagctttatatttt

SEQ ID NO: 2729089 - DNA, 11 bp, Homo sapiens
accctcagctg

SEQ ID NO: 2729090 - DNA, 20 bp, Homo sapiens
accctcagctgcctcatcgt

SEQ ID NO: 2729091 - DNA, 12 bp, Homo sapiens
accctccctgct

SEQ ID NO: 2729092 - DNA, 13 bp, Homo sapiens
accctcctgagcc

SEQ ID NO: 2729093 - DNA, 13 bp, Homo sapiens
accctgcagcttg

SEQ ID NO: 2729094 - DNA, 22 bp, Homo sapiens
accctgccccttgtcctctcag

SEQ ID NO: 2729095 - DNA, 13 bp, Homo sapiens
accctgcctgctg

SEQ ID NO: 2729096 - DNA, 16 bp, Homo sapiens
accctgcctgctgtgg

SEQ ID NO: 2729097 - DNA, 19 bp, Homo sapiens
accctgcgaaggggccctg

SEQ ID NO: 2729098 - DNA, 17 bp, Homo sapiens
accctggccaccaccca

SEQ ID NO: 2729099 - DNA, 22 bp, Homo sapiens
accctggccaccacccaacctg

SEQ ID NO: 2729100 - DNA, 18 bp, Homo sapiens
accctgggcaatgcagtg

SEQ ID NO: 2729101 - DNA, 21 bp, Homo sapiens
accctgggtttggcccctgga

SEQ ID NO: 2729102 - DNA, 15 bp, Homo sapiens
accctgtgaccgcag

SEQ ID NO: 2729103 - DNA, 21 bp, Homo sapiens
acccttggtttgcacataaaa

SEQ ID NO: 2729104 - DNA, 13 bp, Homo sapiens
accgcagcatgtg

SEQ ID NO: 2729105 - DNA, 22 bp, Homo sapiens
accgcatgccccctcgtgccag

SEQ ID NO: 2729106 - DNA, 16 bp, Homo sapiens
accgcatggcagctgg

SEQ ID NO: 2729107 - DNA, 17 bp, Homo sapiens
accgcatggcagctggg

SEQ ID NO: 2729108 - DNA, 23 bp, Homo sapiens
accgcatggcagctgggcccaca

SEQ ID NO: 2729109 - DNA, 24 bp, Homo sapiens
accgtgcagccacgaacacgcatg

SEQ ID NO: 2729110 - DNA, 23 bp, Homo sapiens
  misc_feature (6)..(6): n is a, c, g or t
  misc_feature (13)..(13): n is a, c, g or t
acctanccccccnacccccagtg

SEQ ID NO: 2729111 - DNA, 22 bp, Homo sapiens
acctatagtcccagctactcag

SEQ ID NO: 2729112 - DNA, 22 bp, Homo sapiens
acctatggcccagccactgcag

SEQ ID NO: 2729113 - DNA, 14 bp, Homo sapiens
acctcacgctctgg

SEQ ID NO: 2729114 - DNA, 10 bp, Homo sapiens
acctcagcct

SEQ ID NO: 2729115 - DNA, 15 bp, Homo sapiens
acctcagcctagacc

SEQ ID NO: 2729116 - DNA, 20 bp, Homo sapiens
agagttgacccctcctgaac

SEQ ID NO: 2729117 - DNA, 16 bp, Homo sapiens
agatactcaagcaggt

SEQ ID NO: 2729118 - DNA, 20 bp, Homo sapiens
agatagacgggttgaaagac

SEQ ID NO: 2729119 - DNA, 22 bp, Homo sapiens
agatattgtcagagttctgctc

SEQ ID NO: 2729120 - DNA, 17 bp, Homo sapiens
agatctttaaatacagt

SEQ ID NO: 2729121 - DNA, 23 bp, Homo sapiens
agatgaaaacctgcatttttaaa

SEQ ID NO: 2729122 - DNA, 14 bp, Homo sapiens
agatgctggcctct

SEQ ID NO: 2729123 - DNA, 18 bp, Homo sapiens
agatgctggcctcttggc

SEQ ID NO: 2729124 - DNA, 20 bp, Homo sapiens
agatggcttatttgtataat

SEQ ID NO: 2729125 - DNA, 13 bp, Homo sapiens
agatggtctgcat

SEQ ID NO: 2729126 - DNA, 20 bp, Homo sapiens
agatggtctgcatcagcttt

SEQ ID NO: 2729127 - DNA, 21 bp, Homo sapiens
agatggtctgcatcagctttt

SEQ ID NO: 2729128 - DNA, 17 bp, Homo sapiens
agatgtaagaagctaaa

SEQ ID NO: 2729129 - DNA, 18 bp, Homo sapiens
agatgtcagactggctgg

SEQ ID NO: 2729130 - DNA, 18 bp, Homo sapiens
agatgtgctcccaccagg

SEQ ID NO: 2729131 - DNA, 18 bp, Homo sapiens
agattaaatgtgtcattg

SEQ ID NO: 2729132 - DNA, 22 bp, Homo sapiens
agattaactttcaaaagcaaac

SEQ ID NO: 2729133 - DNA, 13 bp, Homo sapiens
agattacaataaa

SEQ ID NO: 2729134 - DNA, 15 bp, Homo sapiens
agattactttgtccc

SEQ ID NO: 2729135 - DNA, 16 bp, Homo sapiens
agattactttgtcccg

SEQ ID NO: 2729136 - DNA, 15 bp, Homo sapiens
agattatatatcata

SEQ ID NO: 2729137 - DNA, 16 bp, Homo sapiens
agattcaggagctcag

SEQ ID NO: 2729138 - DNA, 18 bp, Homo sapiens
agattcaggagctcagtt

SEQ ID NO: 2729139 - DNA, 14 bp, Homo sapiens
agattctttaagga

SEQ ID NO: 2729140 - DNA, 18 bp, Homo sapiens
agattctttaaggagata

SEQ ID NO: 2729141 - DNA, 21 bp, Homo sapiens
agattgtaaaggtaggtgcat

SEQ ID NO: 2729142 - DNA, 19 bp, Homo sapiens
agattttctgtaaatgaag

SEQ ID NO: 2729143 - DNA, 12 bp, Homo sapiens
agcaaacacaca

SEQ ID NO: 2729144 - DNA, 23 bp, Homo sapiens
agcaaagattaaatgtgtcattg

SEQ ID NO: 2729145 - DNA, 12 bp, Homo sapiens
agcaaagccata

SEQ ID NO: 2729146 - DNA, 20 bp, Homo sapiens
agcaaagccatattctaaat

SEQ ID NO: 2729147 - DNA, 15 bp, Homo sapiens
agcaaagtctaaagt

SEQ ID NO: 2729148 - DNA, 20 bp, Homo sapiens
agcaaagtctaaagtttaca

SEQ ID NO: 2729149 - DNA, 22 bp, Homo sapiens
agcaaagtctaaagtttacagt

SEQ ID NO: 2729150 - DNA, 22 bp, Homo sapiens
agcaaatgctggatgagcaact

SEQ ID NO: 2729151 - DNA, 22 bp, Homo sapiens
agcaacagagtgagaccctgtc

SEQ ID NO: 2729152 - DNA, 17 bp, Homo sapiens
agcaaccgtgcagccac

SEQ ID NO: 2729153 - DNA, 22 bp, Homo sapiens
agcaagccggcagaaatagcta

SEQ ID NO: 2729154 - DNA, 20 bp, Homo sapiens
agcaaggacaacctgcccct

SEQ ID NO: 2729155 - DNA, 17 bp, Homo sapiens
agcaaggaggctggctg

SEQ ID NO: 2729156 - DNA, 13 bp, Homo sapiens
agcaaggccaggg

SEQ ID NO: 2729157 - DNA, 21 bp, Homo sapiens
agcaatttatatctttatgca

SEQ ID NO: 2729158 - DNA, 23 bp, Homo sapiens
agcaatttatatctttatgcaaa

SEQ ID NO: 2729159 - DNA, 16 bp, Homo sapiens
agcacaagtacttttg

SEQ ID NO: 2729160 - DNA, 10 bp, Homo sapiens
agcacagccc

SEQ ID NO: 2729161 - DNA, 12 bp, Homo sapiens
agcacagccctc

SEQ ID NO: 2729162 - DNA, 21 bp, Homo sapiens
agcacagctcctcccctgccg

SEQ ID NO: 2729163 - DNA, 23 bp, Homo sapiens
agcacatgccagggaaaaagacc

SEQ ID NO: 2729164 - DNA, 15 bp, Homo sapiens
agcacccgggctcag

SEQ ID NO: 2729165 - DNA, 17 bp, Homo sapiens
agcacccgggctcaggg

SEQ ID NO: 2729166 - DNA, 13 bp, Homo sapiens
agcacgttttctg

SEQ ID NO: 2729167 - DNA, 15 bp, Homo sapiens
agcacgttttctggc

SEQ ID NO: 2729168 - DNA, 21 bp, Homo sapiens
agcactcctcggtactcccat

SEQ ID NO: 2729169 - DNA, 17 bp, Homo sapiens
agcactgacttaaaacg

SEQ ID NO: 2729170 - DNA, 12 bp, Homo sapiens
agcactttggga

SEQ ID NO: 2729171 - DNA, 14 bp, Homo sapiens
agcagagcaggggc

SEQ ID NO: 2729172 - DNA, 16 bp, Homo sapiens
agcagagcttcctcag

SEQ ID NO: 2729173 - DNA, 22 bp, Homo sapiens
agcagaggagtccagggcggga

SEQ ID NO: 2729174 - DNA, 13 bp, Homo sapiens
agcagaggcagcg

SEQ ID NO: 2729175 - DNA, 15 bp, Homo sapiens
agcagagttctttgc

SEQ ID NO: 2729176 - DNA, 17 bp, Homo sapiens
agcagattacaataaat

SEQ ID NO: 2729177 - DNA, 19 bp, Homo sapiens
agcagcctccagtgctggc

SEQ ID NO: 2729178 - DNA, 20 bp, Homo sapiens
agcagcctccagtgctggct

SEQ ID NO: 2729179 - DNA, 20 bp, Homo sapiens
agcagcttctgccacttccc

SEQ ID NO: 2729180 - DNA, 16 bp, Homo sapiens
agcaggaggaggtgcc

SEQ ID NO: 2729181 - DNA, 16 bp, Homo sapiens
agcaggggctgctggg

SEQ ID NO: 2729182 - DNA, 17 bp, Homo sapiens
agcaggggctgctgggg

SEQ ID NO: 2729183 - DNA, 18 bp, Homo sapiens
agcaggtgctgctaccct

SEQ ID NO: 2729184 - DNA, 20 bp, Homo sapiens
agcaggttgaggggctcctg

SEQ ID NO: 2729185 - DNA, 21 bp, Homo sapiens
agcaggttgaggggctcctgg

SEQ ID NO: 2729186 - DNA, 21 bp, Homo sapiens
agcagtaaactttctctgcaa

SEQ ID NO: 2729187 - DNA, 15 bp, Homo sapiens
agcagtctgaaggat

SEQ ID NO: 2729188 - DNA, 16 bp, Homo sapiens
agcagtgccctctgga

SEQ ID NO: 2729189 - DNA, 24 bp, Homo sapiens
agcagtgccctctggacagcttga

SEQ ID NO: 2729190 - DNA, 16 bp, Homo sapiens
agcatcacctcaggcc

SEQ ID NO: 2729191 - DNA, 19 bp, Homo sapiens
agcatcacctcaggccagg

SEQ ID NO: 2729192 - DNA, 13 bp, Homo sapiens
agcatcctcccca

SEQ ID NO: 2729193 - DNA, 22 bp, Homo sapiens
agcatcctccccaccagagctg

SEQ ID NO: 2729194 - DNA, 14 bp, Homo sapiens
agcatctcagagtc

SEQ ID NO: 2729195 - DNA, 22 bp, Homo sapiens
agcatgggactgtgcctttggg

SEQ ID NO: 2729196 - DNA, 15 bp, Homo sapiens
agcatgtggggaagc

SEQ ID NO: 2729197 - DNA, 17 bp, Homo sapiens
agcattctgagctgggc

SEQ ID NO: 2729198 - DNA, 21 bp, Homo sapiens
agccaacgacaaagccaaact

SEQ ID NO: 2729199 - DNA, 12 bp, Homo sapiens
agccaactccat

SEQ ID NO: 2729200 - DNA, 20 bp, Homo sapiens
agccaagccctccgcctaga

SEQ ID NO: 2729201 - DNA, 23 bp, Homo sapiens
agccaaggccctgagttggcagt

SEQ ID NO: 2729202 - DNA, 19 bp, Homo sapiens
agccaaggtgggctgagcc

SEQ ID NO: 2729203 - DNA, 19 bp, Homo sapiens
agccaatatttactcatca

SEQ ID NO: 2729204 - DNA, 22 bp, Homo sapiens
agccacagggaagcatgtactg

SEQ ID NO: 2729205 - DNA, 12 bp, Homo sapiens
agccaccgcagc

SEQ ID NO: 2729206 - DNA, 15 bp, Homo sapiens
agccaccgcagctgc

SEQ ID NO: 2729207 - DNA, 22 bp, Homo sapiens
agccaccgcagctgctgccact

SEQ ID NO: 2729208 - DNA, 21 bp, Homo sapiens
agccacctcggatcccactga

SEQ ID NO: 2729209 - DNA, 12 bp, Homo sapiens
agccactgaagc

SEQ ID NO: 2729210 - DNA, 13 bp, Homo sapiens
agccactgcagca

SEQ ID NO: 2729211 - DNA, 14 bp, Homo sapiens
agccactgcagcac

SEQ ID NO: 2729212 - DNA, 13 bp, Homo sapiens
agccagccaggac

SEQ ID NO: 2729213 - DNA, 13 bp, Homo sapiens
agccagctcctgg

SEQ ID NO: 2729214 - DNA, 14 bp, Homo sapiens
agccagctcctggt

SEQ ID NO: 2729215 - DNA, 20 bp, Homo sapiens
agccatatattttctgagta

SEQ ID NO: 2729216 - DNA, 21 bp, Homo sapiens
agccatatctagtcaataact

SEQ ID NO: 2729217 - DNA, 20 bp, Homo sapiens
agccatattctaaattcact

SEQ ID NO: 2729218 - DNA, 18 bp, Homo sapiens
agccattaccatggagac

SEQ ID NO: 2729219 - DNA, 15 bp, Homo sapiens
agcccacgtcctgtc

SEQ ID NO: 2729220 - DNA, 21 bp, Homo sapiens
agcccagccattaccatggag

SEQ ID NO: 2729221 - DNA, 12 bp, Homo sapiens
agccccacagcc

SEQ ID NO: 2729222 - DNA, 18 bp, Homo sapiens
agccccacagcccacgtc

SEQ ID NO: 2729223 - DNA, 17 bp, Homo sapiens
agccccaccccaccctg

SEQ ID NO: 2729224 - DNA, 16 bp, Homo sapiens
agcccccaccccagca

SEQ ID NO: 2729225 - DNA, 20 bp, Homo sapiens
agcccccaccccagcacagc

SEQ ID NO: 2729226 - DNA, 15 bp, Homo sapiens
agccccgcgcctcct

SEQ ID NO: 2729227 - DNA, 18 bp, Homo sapiens
agccccgcgcctccttcc

SEQ ID NO: 2729228 - DNA, 13 bp, Homo sapiens
agccccgggctga

SEQ ID NO: 2729229 - DNA, 12 bp, Homo sapiens
agccctggaggc

SEQ ID NO: 2729230 - DNA, 13 bp, Homo sapiens
agccctggaggct

SEQ ID NO: 2729231 - DNA, 14 bp, Homo sapiens
agccctggaggctg

SEQ ID NO: 2729232 - DNA, 16 bp, Homo sapiens
agccctggaggctgga

SEQ ID NO: 2729233 - DNA, 12 bp, Homo sapiens
agccctggcagg

SEQ ID NO: 2729234 - DNA, 17 bp, Homo sapiens
agccctggcaggatgac

SEQ ID NO: 2729235 - DNA, 21 bp, Homo sapiens
agccctggcaggatgaccctg

SEQ ID NO: 2729236 - DNA, 21 bp, Homo sapiens
agccgcctcccttatgcagga

SEQ ID NO: 2729237 - DNA, 18 bp, Homo sapiens
agccgctgcccggcgccc

SEQ ID NO: 2729238 - DNA, 12 bp, Homo sapiens
agccgggaaagc

SEQ ID NO: 2729239 - DNA, 15 bp, Homo sapiens
agccgtattttacat

SEQ ID NO: 2729240 - DNA, 15 bp, Homo sapiens
agtgaattacactca

SEQ ID NO: 2729241 - DNA, 18 bp, Homo sapiens
agtgaccatgaaaaataa

SEQ ID NO: 2729242 - DNA, 21 bp, Homo sapiens
agtgagaagggcctgctctgc

SEQ ID NO: 2729243 - DNA, 16 bp, Homo sapiens
agtgagaatgccgggc

SEQ ID NO: 2729244 - DNA, 17 bp, Homo sapiens
agtgagaccctgtctct

SEQ ID NO: 2729245 - DNA, 14 bp, Homo sapiens
agtgagcctctgcg

SEQ ID NO: 2729246 - DNA, 19 bp, Homo sapiens
agtgagcctctgcgcctct

SEQ ID NO: 2729247 - DNA, 22 bp, Homo sapiens
agtgagcctctgcgcctctcca

SEQ ID NO: 2729248 - DNA, 14 bp, Homo sapiens
agtgagtggcatgt

SEQ ID NO: 2729249 - DNA, 18 bp, Homo sapiens
agtgagtggcatgtgggt

SEQ ID NO: 2729250 - DNA, 23 bp, Homo sapiens
agtgattgttatgccttgctatt

SEQ ID NO: 2729251 - DNA, 14 bp, Homo sapiens
agtgcagctcagga

SEQ ID NO: 2729252 - DNA, 20 bp, Homo sapiens
agtgccagtcttgtgtctgc

SEQ ID NO: 2729253 - DNA, 16 bp, Homo sapiens
agtgccctccacagcc

SEQ ID NO: 2729254 - DNA, 21 bp, Homo sapiens
agtgccctccacagccgcagc

SEQ ID NO: 2729255 - DNA, 23 bp, Homo sapiens
agtgccgtagtcctttttgtaac

SEQ ID NO: 2729256 - DNA, 17 bp, Homo sapiens
agtgcctggcaaggcct

SEQ ID NO: 2729257 - DNA, 20 bp, Homo sapiens
agtgctaggattacaggcat

SEQ ID NO: 2729258 - DNA, 12 bp, Homo sapiens
agtgctcctgtg

SEQ ID NO: 2729259 - DNA, 16 bp, Homo sapiens
agtgctcctgtgcagg

SEQ ID NO: 2729260 - DNA, 13 bp, Homo sapiens
agtgctctgcctc

SEQ ID NO: 2729261 - DNA, 14 bp, Homo sapiens
agtgctgcagcttt

SEQ ID NO: 2729262 - DNA, 22 bp, Homo sapiens
agtgctgcagctttgggaaagc

SEQ ID NO: 2729263 - DNA, 12 bp, Homo sapiens
agtgctggctgc

SEQ ID NO: 2729264 - DNA, 15 bp, Homo sapiens
agtgctggctgctgg

SEQ ID NO: 2729265 - DNA, 22 bp, Homo sapiens
agtgctgggattacaggcatga

SEQ ID NO: 2729266 - DNA, 17 bp, Homo sapiens
agtgctgtggcctgggc

SEQ ID NO: 2729267 - DNA, 20 bp, Homo sapiens
agtgctgtggcctgggcaag

SEQ ID NO: 2729268 - DNA, 18 bp, Homo sapiens
agtgcttcagcctgaggc

SEQ ID NO: 2729269 - DNA, 18 bp, Homo sapiens
agtgcttcttgtaatatt

SEQ ID NO: 2729270 - DNA, 18 bp, Homo sapiens
agtggcattggcagcagg

SEQ ID NO: 2729271 - DNA, 20 bp, Homo sapiens
agtggcattggcagcaggtg

SEQ ID NO: 2729272 - DNA, 13 bp, Homo sapiens
agtggccagggct

SEQ ID NO: 2729273 - DNA, 19 bp, Homo sapiens
agtggctgtccagtgccca

SEQ ID NO: 2729274 - DNA, 23 bp, Homo sapiens
agtggctgtccagtgcccattcc

SEQ ID NO: 2729275 - DNA, 15 bp, Homo sapiens
agtgggagatgaaaa

SEQ ID NO: 2729276 - DNA, 16 bp, Homo sapiens
agtgggtcccacttcc

SEQ ID NO: 2729277 - DNA, 17 bp, Homo sapiens
agtgggtcccacttccc

SEQ ID NO: 2729278 - DNA, 21 bp, Homo sapiens
agtggtgttggcagtgtttgt

SEQ ID NO: 2729279 - DNA, 15 bp, Homo sapiens
agtgtagccttgccc

SEQ ID NO: 2729280 - DNA, 23 bp, Homo sapiens
agtgtatttaagaaagggaaagc

SEQ ID NO: 2729281 - DNA, 14 bp, Homo sapiens
agtgtcagagtcat

SEQ ID NO: 2729282 - DNA, 21 bp, Homo sapiens
agtgtccagaccattgtcttc

SEQ ID NO: 2729283 - DNA, 20 bp, Homo sapiens
agtgtcctggaccctggcct

SEQ ID NO: 2729284 - DNA, 18 bp, Homo sapiens
agtgtcctgtctgctggg

SEQ ID NO: 2729285 - DNA, 19 bp, Homo sapiens
agtgtcttcctagtatatt

SEQ ID NO: 2729286 - DNA, 17 bp, Homo sapiens
agtgtgccccccatcct

SEQ ID NO: 2729287 - DNA, 22 bp, Homo sapiens
agtgtgccccccatcctggccc

SEQ ID NO: 2729288 - DNA, 15 bp, Homo sapiens
agtgttaggcctggc

SEQ ID NO: 2729289 - DNA, 16 bp, Homo sapiens
agtgttaggcctggca

SEQ ID NO: 2729290 - DNA, 22 bp, Homo sapiens
agtgtttcctgagtagcagtga

SEQ ID NO: 2729291 - DNA, 15 bp, Homo sapiens
agttaagtgaatgtc

SEQ ID NO: 2729292 - DNA, 14 bp, Homo sapiens
agttagctcaggag

SEQ ID NO: 2729293 - DNA, 16 bp, Homo sapiens
agttagctcaggaggc

SEQ ID NO: 2729294 - DNA, 22 bp, Homo sapiens
agttagctcaggaggcttggaa

SEQ ID NO: 2729295 - DNA, 14 bp, Homo sapiens
agttatatgtgtgt

SEQ ID NO: 2729296 - DNA, 18 bp, Homo sapiens
agttcagacttagttttt

SEQ ID NO: 2729297 - DNA, 23 bp, Homo sapiens
agttcagacttagtttttataaa

SEQ ID NO: 2729298 - DNA, 23 bp, Homo sapiens
agttcagttcctctttgcatgga

SEQ ID NO: 2729299 - DNA, 19 bp, Homo sapiens
agttcatataatttaaaga

SEQ ID NO: 2729300 - DNA, 16 bp, Homo sapiens
agttccctcctgcagc

SEQ ID NO: 2729301 - DNA, 15 bp, Homo sapiens
agttcctctttgcat

SEQ ID NO: 2729302 - DNA, 18 bp, Homo sapiens
agttcgagaccagcctgg

SEQ ID NO: 2729303 - DNA, 17 bp, Homo sapiens
agttctcaatcactgct

SEQ ID NO: 2729304 - DNA, 12 bp, Homo sapiens
agttctctgttc

SEQ ID NO: 2729305 - DNA, 12 bp, Homo sapiens
agttctgtgtcc

SEQ ID NO: 2729306 - DNA, 16 bp, Homo sapiens
agttgacccctcctga

SEQ ID NO: 2729307 - DNA, 20 bp, Homo sapiens
agttgattgcgagaattttc

SEQ ID NO: 2729308 - DNA, 18 bp, Homo sapiens
agttggtcttactttgtg

SEQ ID NO: 2729309 - DNA, 17 bp, Homo sapiens
agttgtctttctttgct

SEQ ID NO: 2729310 - DNA, 18 bp, Homo sapiens
agttgtctttctttgctg

SEQ ID NO: 2729311 - DNA, 21 bp, Homo sapiens
agttgtggaaagcctctgctg

SEQ ID NO: 2729312 - DNA, 14 bp, Homo sapiens
agtttacagtaaat

SEQ ID NO: 2729313 - DNA, 18 bp, Homo sapiens
agtttacagtaaataaat

SEQ ID NO: 2729314 - DNA, 20 bp, Homo sapiens
agtttacagtaaataaattg

SEQ ID NO: 2729315 - DNA, 22 bp, Homo sapiens
agtttacagtaaataaattgtt

SEQ ID NO: 2729316 - DNA, 19 bp, Homo sapiens
agtttccagctaagcctga

SEQ ID NO: 2729317 - DNA, 13 bp, Homo sapiens
agtttctcaagtt

SEQ ID NO: 2729318 - DNA, 21 bp, Homo sapiens
agtttctcaagtttaaagtca

SEQ ID NO: 2729319 - DNA, 17 bp, Homo sapiens
agtttgtggtaaaaaga

SEQ ID NO: 2729320 - DNA, 16 bp, Homo sapiens
agttttatacataaac

SEQ ID NO: 2729321 - DNA, 22 bp, Homo sapiens
agttttatacataaacagtttt

SEQ ID NO: 2729322 - DNA, 20 bp, Homo sapiens
agttttattgactcattcct

SEQ ID NO: 2729323 - DNA, 17 bp, Homo sapiens
agttttgacagagttgg

SEQ ID NO: 2729324 - DNA, 12 bp, Homo sapiens
agttttgtaaat

SEQ ID NO: 2729325 - DNA, 15 bp, Homo sapiens
agttttgtaaatttc

SEQ ID NO: 2729326 - DNA, 19 bp, Homo sapiens
ataaaaaaatatatacaga

SEQ ID NO: 2729327 - DNA, 11 bp, Homo sapiens
ataaaaaatgg

SEQ ID NO: 2729328 - DNA, 16 bp, Homo sapiens
ataaaataattttatt

SEQ ID NO: 2729329 - DNA, 21 bp, Homo sapiens
ataaaattgtaaaattgtata

SEQ ID NO: 2729330 - DNA, 18 bp, Homo sapiens
ataaacaaattagcaatc

SEQ ID NO: 2729331 - DNA, 19 bp, Homo sapiens
ataaacagttttggagaaa

SEQ ID NO: 2729332 - DNA, 18 bp, Homo sapiens
ataaacctctaatttatt

SEQ ID NO: 2729333 - DNA, 20 bp, Homo sapiens
ataaacctctaatttatttt

SEQ ID NO: 2729334 - DNA, 20 bp, Homo sapiens
ataaaccttgtttctttctg

SEQ ID NO: 2729335 - DNA, 15 bp, Homo sapiens
ataaacttcagcacc

SEQ ID NO: 2729336 - DNA, 16 bp, Homo sapiens
ataaacttcagcacca

SEQ ID NO: 2729337 - DNA, 18 bp, Homo sapiens
ataaagaaaatcaatgaa

SEQ ID NO: 2729338 - DNA, 14 bp, Homo sapiens
ataaagaaataata

SEQ ID NO: 2729339 - DNA, 17 bp, Homo sapiens
ataaagatggctattat

SEQ ID NO: 2729340 - DNA, 20 bp, Homo sapiens
ataaagggaacatgcagctc

SEQ ID NO: 2729341 - DNA, 21 bp, Homo sapiens
ataaaggtatttagaatatat

SEQ ID NO: 2729342 - DNA, 17 bp, Homo sapiens
ataaatatagttgtctt

SEQ ID NO: 2729343 - DNA, 12 bp, Homo sapiens
ataaatgctgaa

SEQ ID NO: 2729344 - DNA, 22 bp, Homo sapiens
ataaattaatgagttttatcca

SEQ ID NO: 2729345 - DNA, 14 bp, Homo sapiens
ataaattacattaa

SEQ ID NO: 2729346 - DNA, 15 bp, Homo sapiens
ataaattacattaaa

SEQ ID NO: 2729347 - DNA, 14 bp, Homo sapiens
ataaattatttcta

SEQ ID NO: 2729348 - DNA, 19 bp, Homo sapiens
ataaattatttctaaaaca

SEQ ID NO: 2729349 - DNA, 15 bp, Homo sapiens
ataaattccactgga

SEQ ID NO: 2729350 - DNA, 15 bp, Homo sapiens
ataaattgtttgacc

SEQ ID NO: 2729351 - DNA, 22 bp, Homo sapiens
ataaatttgttgtcatgtgtat

SEQ ID NO: 2729352 - DNA, 20 bp, Homo sapiens
ataacatgtatcactcactg

SEQ ID NO: 2729353 - DNA, 17 bp, Homo sapiens
ataacattttgtttatg

SEQ ID NO: 2729354 - DNA, 16 bp, Homo sapiens
ataactctgattttga

SEQ ID NO: 2729355 - DNA, 12 bp, Homo sapiens
ataacttcataa

SEQ ID NO: 2729356 - DNA, 19 bp, Homo sapiens
ataagctgtagaactctgc

SEQ ID NO: 2729357 - DNA, 18 bp, Homo sapiens
ataagtaagacttgattg

SEQ ID NO: 2729358 - DNA, 14 bp, Homo sapiens
ataagtctaaataa

SEQ ID NO: 2729359 - DNA, 15 bp, Homo sapiens
ataatcatcaggttt

SEQ ID NO: 2729360 - DNA, 19 bp, Homo sapiens
ataatggtgttactaaagt

SEQ ID NO: 2729361 - DNA, 16 bp, Homo sapiens
ataattaattgtcatt

SEQ ID NO: 2729362 - DNA, 19 bp, Homo sapiens
ataattcaccaaaagttca

SEQ ID NO: 2729363 - DNA, 18 bp, Homo sapiens
ataatttaaagaaacact

SEQ ID NO: 2729364 - DNA, 14 bp, Homo sapiens
attcccttctgatc

SEQ ID NO: 2729365 - DNA, 17 bp, Homo sapiens
attcctagctgtaaata

SEQ ID NO: 2729366 - DNA, 21 bp, Homo sapiens
attcctggcatgacactctag

SEQ ID NO: 2729367 - DNA, 17 bp, Homo sapiens
attcgctggggaagggg

SEQ ID NO: 2729368 - DNA, 20 bp, Homo sapiens
attctaaacagatgtccctg

SEQ ID NO: 2729369 - DNA, 14 bp, Homo sapiens
attctaaattcact

SEQ ID NO: 2729370 - DNA, 15 bp, Homo sapiens
attctacacatatat

SEQ ID NO: 2729371 - DNA, 15 bp, Homo sapiens
attctcacctgcctt

SEQ ID NO: 2729372 - DNA, 13 bp, Homo sapiens
attctcctgcctc

SEQ ID NO: 2729373 - DNA, 23 bp, Homo sapiens
attctcctgcctcagcctcctga

SEQ ID NO: 2729374 - DNA, 16 bp, Homo sapiens
attctgacttacttaa

SEQ ID NO: 2729375 - DNA, 13 bp, Homo sapiens
attctgtctctgc

SEQ ID NO: 2729376 - DNA, 15 bp, Homo sapiens
attctgtctctgctt

SEQ ID NO: 2729377 - DNA, 11 bp, Homo sapiens
attctttctca

SEQ ID NO: 2729378 - DNA, 20 bp, Homo sapiens
attcttttccagaaagaaaa

SEQ ID NO: 2729379 - DNA, 21 bp, Homo sapiens
attcttttccagaaagaaaat

SEQ ID NO: 2729380 - DNA, 14 bp, Homo sapiens
attcttttgttatt

SEQ ID NO: 2729381 - DNA, 23 bp, Homo sapiens
attcttttgttattaaaaaaaca

SEQ ID NO: 2729382 - DNA, 14 bp, Homo sapiens
attctttttaaagt

SEQ ID NO: 2729383 - DNA, 17 bp, Homo sapiens
attgaaggagaaaatgc

SEQ ID NO: 2729384 - DNA, 13 bp, Homo sapiens
attgaatgctgcc

SEQ ID NO: 2729385 - DNA, 11 bp, Homo sapiens
attgaatttag

SEQ ID NO: 2729386 - DNA, 17 bp, Homo sapiens
attgaccatgtgattat

SEQ ID NO: 2729387 - DNA, 23 bp, Homo sapiens
attgatcggagcctcctctctca

SEQ ID NO: 2729388 - DNA, 12 bp, Homo sapiens
attgcaatagaa

SEQ ID NO: 2729389 - DNA, 13 bp, Homo sapiens
attgcactaaata

SEQ ID NO: 2729390 - DNA, 17 bp, Homo sapiens
attgccttaaggccaca

SEQ ID NO: 2729391 - DNA, 15 bp, Homo sapiens
attgcgagaattttc

SEQ ID NO: 2729392 - DNA, 15 bp, Homo sapiens
attggaagctcccac

SEQ ID NO: 2729393 - DNA, 12 bp, Homo sapiens
attggaattttc

SEQ ID NO: 2729394 - DNA, 17 bp, Homo sapiens
attggaattttctttca

SEQ ID NO: 2729395 - DNA, 21 bp, Homo sapiens
attggcacaagctccctggtg

SEQ ID NO: 2729396 - DNA, 16 bp, Homo sapiens
attggcaggaggcagg

SEQ ID NO: 2729397 - DNA, 12 bp, Homo sapiens
attggccctgcc

SEQ ID NO: 2729398 - DNA, 18 bp, Homo sapiens
attggccctgcccctccc

SEQ ID NO: 2729399 - DNA, 17 bp, Homo sapiens
attgggccaacaaggac

SEQ ID NO: 2729400 - DNA, 19 bp, Homo sapiens
attgtcagagttctgctct

SEQ ID NO: 2729401 - DNA, 19 bp, Homo sapiens
attgtctgtctgctcttat

SEQ ID NO: 2729402 - DNA, 22 bp, Homo sapiens
attgtcttccaaccccagctgg

SEQ ID NO: 2729403 - DNA, 19 bp, Homo sapiens
attgtgaacatacacattt

SEQ ID NO: 2729404 - DNA, 18 bp, Homo sapiens
attgtgggtaacgtgaga

SEQ ID NO: 2729405 - DNA, 19 bp, Homo sapiens
attgtgtatgagactgtgt

SEQ ID NO: 2729406 - DNA, 17 bp, Homo sapiens
attgttctgggtgattt

SEQ ID NO: 2729407 - DNA, 18 bp, Homo sapiens
attgttctgggtgatttc

SEQ ID NO: 2729408 - DNA, 15 bp, Homo sapiens
atttaaaagacaaac

SEQ ID NO: 2729409 - DNA, 17 bp, Homo sapiens
atttaaaagacaaacac

SEQ ID NO: 2729410 - DNA, 19 bp, Homo sapiens
atttaaaagacaaacacct

SEQ ID NO: 2729411 - DNA, 19 bp, Homo sapiens
atttaaagaaacactaaat

SEQ ID NO: 2729412 - DNA, 12 bp, Homo sapiens
atttaaagcaca

SEQ ID NO: 2729413 - DNA, 20 bp, Homo sapiens
atttaacttgagggtaataa

SEQ ID NO: 2729414 - DNA, 21 bp, Homo sapiens
atttaagaaagggaaagctgt

SEQ ID NO: 2729415 - DNA, 12 bp, Homo sapiens
atttaagcatga

SEQ ID NO: 2729416 - DNA, 17 bp, Homo sapiens
atttaagcatgagtggc

SEQ ID NO: 2729417 - DNA, 16 bp, Homo sapiens
atttaagtactatctt

SEQ ID NO: 2729418 - DNA, 19 bp, Homo sapiens
atttaatttataggcagat

SEQ ID NO: 2729419 - DNA, 23 bp, Homo sapiens
atttaatttataggcagatcttt

SEQ ID NO: 2729420 - DNA, 18 bp, Homo sapiens
atttacatgaattgcatt

SEQ ID NO: 2729421 - DNA, 21 bp, Homo sapiens
atttacatgaattgcatttta

SEQ ID NO: 2729422 - DNA, 18 bp, Homo sapiens
atttaccattattttaca

SEQ ID NO: 2729423 - DNA, 19 bp, Homo sapiens
atttaccattattttacag

SEQ ID NO: 2729424 - DNA, 17 bp, Homo sapiens
atttactttttaaacag

SEQ ID NO: 2729425 - DNA, 14 bp, Homo sapiens
atttagcacatttt

SEQ ID NO: 2729426 - DNA, 12 bp, Homo sapiens
atttaggagaag

SEQ ID NO: 2729427 - DNA, 16 bp, Homo sapiens
atttatatctttatgc

SEQ ID NO: 2729428 - DNA, 19 bp, Homo sapiens
atttatatctttatgcaaa

SEQ ID NO: 2729429 - DNA, 21 bp, Homo sapiens
atttatatctttatgcaaaaa

SEQ ID NO: 2729430 - DNA, 20 bp, Homo sapiens
atttatgatataataaatat

SEQ ID NO: 2729431 - DNA, 16 bp, Homo sapiens
atttattgtatatatg

SEQ ID NO: 2729432 - DNA, 19 bp, Homo sapiens
atttcaagatccaaatgct

SEQ ID NO: 2729433 - DNA, 14 bp, Homo sapiens
atttcagaaacatc

SEQ ID NO: 2729434 - DNA, 13 bp, Homo sapiens
atttcaggaattt

SEQ ID NO: 2729435 - DNA, 19 bp, Homo sapiens
atttcccgtggccccagcc

SEQ ID NO: 2729436 - DNA, 22 bp, Homo sapiens
atttcccgtggccccagcctgg

SEQ ID NO: 2729437 - DNA, 17 bp, Homo sapiens
atttcctcccccagtta

SEQ ID NO: 2729438 - DNA, 17 bp, Homo sapiens
atttcgtgtaatattct

SEQ ID NO: 2729439 - DNA, 15 bp, Homo sapiens
atttctactgtataa

SEQ ID NO: 2729440 - DNA, 18 bp, Homo sapiens
atttctactgtataaaca

SEQ ID NO: 2729441 - DNA, 20 bp, Homo sapiens
atttctactgtataaacaaa

SEQ ID NO: 2729442 - DNA, 17 bp, Homo sapiens
atttctagtatctattg

SEQ ID NO: 2729443 - DNA, 22 bp, Homo sapiens
atttctatcttgaatttcatgc

SEQ ID NO: 2729444 - DNA, 20 bp, Homo sapiens
atttctatgtatgtgccaat

SEQ ID NO: 2729445 - DNA, 15 bp, Homo sapiens
atttcttatttaatt

SEQ ID NO: 2729446 - DNA, 14 bp, Homo sapiens
atttcttattttct

SEQ ID NO: 2729447 - DNA, 11 bp, Homo sapiens
atttctttaat

SEQ ID NO: 2729448 - DNA, 22 bp, Homo sapiens
atttctttaatctgttgtttga

SEQ ID NO: 2729449 - DNA, 21 bp, Homo sapiens
atttctttctttgcaccaaag

SEQ ID NO: 2729450 - DNA, 22 bp, Homo sapiens
atttctttctttgcaccaaaga

SEQ ID NO: 2729451 - DNA, 14 bp, Homo sapiens
atttgacaacacat

SEQ ID NO: 2729452 - DNA, 22 bp, Homo sapiens
atttgaggagcagcttcagttg

SEQ ID NO: 2729453 - DNA, 15 bp, Homo sapiens
atttgataacatttt

SEQ ID NO: 2729454 - DNA, 16 bp, Homo sapiens
atttgatttcgatgta

SEQ ID NO: 2729455 - DNA, 17 bp, Homo sapiens
atttgcctaattcctgg

SEQ ID NO: 2729456 - DNA, 12 bp, Homo sapiens
atttgcctgcct

SEQ ID NO: 2729457 - DNA, 13 bp, Homo sapiens
atttgcctgcctg

SEQ ID NO: 2729458 - DNA, 23 bp, Homo sapiens
atttgcctgcctgggcctcccaa

SEQ ID NO: 2729459 - DNA, 11 bp, Homo sapiens
atttggagact

SEQ ID NO: 2729460 - DNA, 15 bp, Homo sapiens
atttgtacagttcag

SEQ ID NO: 2729461 - DNA, 17 bp, Homo sapiens
atttgtatctgaaggag

SEQ ID NO: 2729462 - DNA, 17 bp, Homo sapiens
atttgttatttgtacag

SEQ ID NO: 2729463 - DNA, 18 bp, Homo sapiens
atttgttatttgtacagt

SEQ ID NO: 2729464 - DNA, 19 bp, Homo sapiens
atttgttatttgtacagtt

SEQ ID NO: 2729465 - DNA, 17 bp, Homo sapiens
atttgttgtcatgtgta

SEQ ID NO: 2729466 - DNA, 13 bp, Homo sapiens
atttgttttcccg

SEQ ID NO: 2729467 - DNA, 19 bp, Homo sapiens
atttgttttcccgccaagc

SEQ ID NO: 2729468 - DNA, 16 bp, Homo sapiens
attttaaggatatgat

SEQ ID NO: 2729469 - DNA, 23 bp, Homo sapiens
attttacagtctctgttgtaaat

SEQ ID NO: 2729470 - DNA, 13 bp, Homo sapiens
attttaccaaagc

SEQ ID NO: 2729471 - DNA, 14 bp, Homo sapiens
attttaccaaagca

SEQ ID NO: 2729472 - DNA, 19 bp, Homo sapiens
attttactgacagaaatgc

SEQ ID NO: 2729473 - DNA, 22 bp, Homo sapiens
attttatataaagaaaatcaat

SEQ ID NO: 2729474 - DNA, 16 bp, Homo sapiens
attttatatctggatt

SEQ ID NO: 2729475 - DNA, 20 bp, Homo sapiens
attttcatgacttttccatg

SEQ ID NO: 2729476 - DNA, 14 bp, Homo sapiens
attttcccactgca

SEQ ID NO: 2729477 - DNA, 22 bp, Homo sapiens
attttctattgtggaattttat

SEQ ID NO: 2729478 - DNA, 13 bp, Homo sapiens
attttctcctgtg

SEQ ID NO: 2729479 - DNA, 17 bp, Homo sapiens
attttctgagtagcata

SEQ ID NO: 2729480 - DNA, 18 bp, Homo sapiens
attttctgtgttgttcat

SEQ ID NO: 2729481 - DNA, 15 bp, Homo sapiens
attttcttggaattt

SEQ ID NO: 2729482 - DNA, 21 bp, Homo sapiens
attttcttggaattttgtaaa

SEQ ID NO: 2729483 - DNA, 17 bp, Homo sapiens
attttctttcatacatt

SEQ ID NO: 2729484 - DNA, 18 bp, Homo sapiens
attttctttcatacatta

SEQ ID NO: 2729485 - DNA, 20 bp, Homo sapiens
attttctttcatacattata

SEQ ID NO: 2729486 - DNA, 16 bp, Homo sapiens
attttgaaaacccctg

SEQ ID NO: 2729487 - DNA, 14 bp, Homo sapiens
attttgaatgtgat

SEQ ID NO: 2729488 - DNA, 14 bp, Homo sapiens
cactctctctctgt

SEQ ID NO: 2729489 - DNA, 17 bp, Homo sapiens
cactctgctgcctgtac

SEQ ID NO: 2729490 - DNA, 13 bp, Homo sapiens
cactctgtgccca

SEQ ID NO: 2729491 - DNA, 16 bp, Homo sapiens
cactcttcttgagcag

SEQ ID NO: 2729492 - DNA, 20 bp, Homo sapiens
cactcttcttgagcagaccg

SEQ ID NO: 2729493 - DNA, 17 bp, Homo sapiens
cactgaagctgggattc

SEQ ID NO: 2729494 - DNA, 23 bp, Homo sapiens
cactgaccgccgcttccagcttc

SEQ ID NO: 2729495 - DNA, 22 bp, Homo sapiens
cactgcaccccctcctgctgca

SEQ ID NO: 2729496 - DNA, 19 bp, Homo sapiens
cactgcactccagcctggg

SEQ ID NO: 2729497 - DNA, 13 bp, Homo sapiens
cactgcagccttt

SEQ ID NO: 2729498 - DNA, 14 bp, Homo sapiens
cactgcagcctttc

SEQ ID NO: 2729499 - DNA, 14 bp, Homo sapiens
cactgccgcctcct

SEQ ID NO: 2729500 - DNA, 15 bp, Homo sapiens
cactgccgcctcctt

SEQ ID NO: 2729501 - DNA, 19 bp, Homo sapiens
cactgcctcctacaaccag

SEQ ID NO: 2729502 - DNA, 19 bp, Homo sapiens
cactgcggggcttggctga

SEQ ID NO: 2729503 - DNA, 16 bp, Homo sapiens
cactgcggtgtctgca

SEQ ID NO: 2729504 - DNA, 19 bp, Homo sapiens
cactgcggtgtctgcagct

SEQ ID NO: 2729505 - DNA, 13 bp, Homo sapiens
cactgctgggtgg

SEQ ID NO: 2729506 - DNA, 17 bp, Homo sapiens
cactgctgggtggccca

SEQ ID NO: 2729507 - DNA, 19 bp, Homo sapiens
cactgctgggtggcccatc

SEQ ID NO: 2729508 - DNA, 14 bp, Homo sapiens
cactggagcccagg

SEQ ID NO: 2729509 - DNA, 15 bp, Homo sapiens
cactggagcccagga

SEQ ID NO: 2729510 - DNA, 17 bp, Homo sapiens
cactggcatctccctga

SEQ ID NO: 2729511 - DNA, 20 bp, Homo sapiens
cactggcatctccctgacct

SEQ ID NO: 2729512 - DNA, 14 bp, Homo sapiens
cactggccagtcct

SEQ ID NO: 2729513 - DNA, 15 bp, Homo sapiens
cactggccagtccta

SEQ ID NO: 2729514 - DNA, 21 bp, Homo sapiens
cactggccagtcctagagctc

SEQ ID NO: 2729515 - DNA, 23 bp, Homo sapiens
cactggcgcatcatatgcagtga

SEQ ID NO: 2729516 - DNA, 18 bp, Homo sapiens
cactggctgcctccactc

SEQ ID NO: 2729517 - DNA, 11 bp, Homo sapiens
cactgggcccc

SEQ ID NO: 2729518 - DNA, 13 bp, Homo sapiens
cactgggcccctc

SEQ ID NO: 2729519 - DNA, 16 bp, Homo sapiens
cactgtatgctggacg

SEQ ID NO: 2729520 - DNA, 13 bp, Homo sapiens
cactgtccaccac

SEQ ID NO: 2729521 - DNA, 12 bp, Homo sapiens
cactgtccgcct

SEQ ID NO: 2729522 - DNA, 16 bp, Homo sapiens
cactgtccgcctctgc

SEQ ID NO: 2729523 - DNA, 12 bp, Homo sapiens
cactgtcctgct

SEQ ID NO: 2729524 - DNA, 22 bp, Homo sapiens
cactgtctcaactactcagctc

SEQ ID NO: 2729525 - DNA, 15 bp, Homo sapiens
cactgtgatgttggg

SEQ ID NO: 2729526 - DNA, 22 bp, Homo sapiens
cactgtgggtctgactttctct

SEQ ID NO: 2729527 - DNA, 18 bp, Homo sapiens
cacttatggaatttttaa

SEQ ID NO: 2729528 - DNA, 13 bp, Homo sapiens
cacttatttccat

SEQ ID NO: 2729529 - DNA, 21 bp, Homo sapiens
cacttcaagtgaccaccagga

SEQ ID NO: 2729530 - DNA, 15 bp, Homo sapiens
cacttcatgcccact

SEQ ID NO: 2729531 - DNA, 16 bp, Homo sapiens
cacttcatgcccactg

SEQ ID NO: 2729532 - DNA, 18 bp, Homo sapiens
cacttcatgcccactgcc

SEQ ID NO: 2729533 - DNA, 20 bp, Homo sapiens
cacttcttgaaacagcctgg

SEQ ID NO: 2729534 - DNA, 16 bp, Homo sapiens
cacttgggtctctgga

SEQ ID NO: 2729535 - DNA, 20 bp, Homo sapiens
cacttgttcaacagtttctc

SEQ ID NO: 2729536 - DNA, 22 bp, Homo sapiens
cacttgttcaacagtttctcaa

SEQ ID NO: 2729537 - DNA, 22 bp, Homo sapiens
cactttgaaggtaataaataca

SEQ ID NO: 2729538 - DNA, 20 bp, Homo sapiens
cactttggtacatggccagt

SEQ ID NO: 2729539 - DNA, 20 bp, Homo sapiens
cactttttttttttctgcct

SEQ ID NO: 2729540 - DNA, 22 bp, Homo sapiens
cactttttttttttctgcctga

SEQ ID NO: 2729541 - DNA, 13 bp, Homo sapiens
cagaacaggggca

SEQ ID NO: 2729542 - DNA, 14 bp, Homo sapiens
cagaactgctgggg

SEQ ID NO: 2729543 - DNA, 15 bp, Homo sapiens
cagaactgctggggc

SEQ ID NO: 2729544 - DNA, 20 bp, Homo sapiens
cagaagacttcaatattaaa

SEQ ID NO: 2729545 - DNA, 20 bp, Homo sapiens
cagaagccccaactgtgatc

SEQ ID NO: 2729546 - DNA, 21 bp, Homo sapiens
cagaaggaagggcatccttct

SEQ ID NO: 2729547 - DNA, 14 bp, Homo sapiens
cagaaggctgggtc

SEQ ID NO: 2729548 - DNA, 14 bp, Homo sapiens
cagaatcctgggcc

SEQ ID NO: 2729549 - DNA, 17 bp, Homo sapiens
cagaattacccttcctc

SEQ ID NO: 2729550 - DNA, 22 bp, Homo sapiens
cagaattgcttgaacccaggag

SEQ ID NO: 2729551 - DNA, 20 bp, Homo sapiens
cagaattttggaaaaatgtc

SEQ ID NO: 2729552 - DNA, 19 bp, Homo sapiens
cagacaagtgggagagccc

SEQ ID NO: 2729553 - DNA, 22 bp, Homo sapiens
cagacatcatgttacttaaaaa

SEQ ID NO: 2729554 - DNA, 16 bp, Homo sapiens
cagaccattgtcttcc

SEQ ID NO: 2729555 - DNA, 23 bp, Homo sapiens
cagaccattgtcttccaacccca

SEQ ID NO: 2729556 - DNA, 15 bp, Homo sapiens
cagacctcagagatg

SEQ ID NO: 2729557 - DNA, 20 bp, Homo sapiens
cagacctctgaatgtcccag

SEQ ID NO: 2729558 - DNA, 17 bp, Homo sapiens
cagacgtgagtgtgact

SEQ ID NO: 2729559 - DNA, 18 bp, Homo sapiens
cagactatttaacttgag

SEQ ID NO: 2729560 - DNA, 13 bp, Homo sapiens
cagactcctggct

SEQ ID NO: 2729561 - DNA, 14 bp, Homo sapiens
cagactcctggctt

SEQ ID NO: 2729562 - DNA, 16 bp, Homo sapiens
cagactcctggcttca

SEQ ID NO: 2729563 - DNA, 22 bp, Homo sapiens
cagactctgtgagattctaaat

SEQ ID NO: 2729564 - DNA, 16 bp, Homo sapiens
cagactcttccaccag

SEQ ID NO: 2729565 - DNA, 21 bp, Homo sapiens
cagactcttccaccagagcag

SEQ ID NO: 2729566 - DNA, 23 bp, Homo sapiens
cagactctttttgtacctggtga

SEQ ID NO: 2729567 - DNA, 12 bp, Homo sapiens
cagactgcggag

SEQ ID NO: 2729568 - DNA, 23 bp, Homo sapiens
cagactgctgggactggccaggt

SEQ ID NO: 2729569 - DNA, 18 bp, Homo sapiens
cagacttagtttttataa

SEQ ID NO: 2729570 - DNA, 16 bp, Homo sapiens
cagagaaattctgtgg

SEQ ID NO: 2729571 - DNA, 18 bp, Homo sapiens
cagagacctttgcccaca

SEQ ID NO: 2729572 - DNA, 21 bp, Homo sapiens
cagagacctttgcccacacac

SEQ ID NO: 2729573 - DNA, 19 bp, Homo sapiens
cagagcaagactctgtctc

SEQ ID NO: 2729574 - DNA, 20 bp, Homo sapiens
cagagcaagactctgtctca

SEQ ID NO: 2729575 - DNA, 14 bp, Homo sapiens
cagagcagcactgg

SEQ ID NO: 2729576 - DNA, 15 bp, Homo sapiens
cagagcaggggcagg

SEQ ID NO: 2729577 - DNA, 17 bp, Homo sapiens
cagagcaggggctgctg

SEQ ID NO: 2729578 - DNA, 21 bp, Homo sapiens
cagagcaggggctgctggggg

SEQ ID NO: 2729579 - DNA, 14 bp, Homo sapiens
cagagccagaggca

SEQ ID NO: 2729580 - DNA, 14 bp, Homo sapiens
cagagctgcctccc

SEQ ID NO: 2729581 - DNA, 15 bp, Homo sapiens
cagagctgcctcccc

SEQ ID NO: 2729582 - DNA, 14 bp, Homo sapiens
cagagctgcgggct

SEQ ID NO: 2729583 - DNA, 17 bp, Homo sapiens
cagagctgcgggctgag

SEQ ID NO: 2729584 - DNA, 21 bp, Homo sapiens
cagagcttttcgaactgtgct

SEQ ID NO: 2729585 - DNA, 17 bp, Homo sapiens
cagaggagtccagggcg

SEQ ID NO: 2729586 - DNA, 19 bp, Homo sapiens
cagaggagtccagggcggg

SEQ ID NO: 2729587 - DNA, 20 bp, Homo sapiens
cagaggagtccagggcggga

SEQ ID NO: 2729588 - DNA, 21 bp, Homo sapiens
cagaggagtccagggcgggag

SEQ ID NO: 2729589 - DNA, 23 bp, Homo sapiens
cagaggctagtctcttctcagag

SEQ ID NO: 2729590 - DNA, 13 bp, Homo sapiens
cagagggcccagg

SEQ ID NO: 2729591 - DNA, 15 bp, Homo sapiens
cagagggcccaggca

SEQ ID NO: 2729592 - DNA, 22 bp, Homo sapiens
cagagggcccaggcaggccacc

SEQ ID NO: 2729593 - DNA, 17 bp, Homo sapiens
cagagggcgctcctgtt

SEQ ID NO: 2729594 - DNA, 20 bp, Homo sapiens
cagaggggcaggccctgcac

SEQ ID NO: 2729595 - DNA, 15 bp, Homo sapiens
cagagtgagaccctg

SEQ ID NO: 2729596 - DNA, 20 bp, Homo sapiens
cagagtgagaccctgtctct

SEQ ID NO: 2729597 - DNA, 14 bp, Homo sapiens
cagagtgtcccttt

SEQ ID NO: 2729598 - DNA, 20 bp, Homo sapiens
cagatcctccatttttgttg

SEQ ID NO: 2729599 - DNA, 19 bp, Homo sapiens
cagatgcccagagggccca

SEQ ID NO: 2729600 - DNA, 15 bp, Homo sapiens
cagatgctggcctct

SEQ ID NO: 2729601 - DNA, 19 bp, Homo sapiens
cagatggaagaagttttaa

SEQ ID NO: 2729602 - DNA, 22 bp, Homo sapiens
cagatgtccctgaagtcttgca

SEQ ID NO: 2729603 - DNA, 15 bp, Homo sapiens
cagatgtgggctcag

SEQ ID NO: 2729604 - DNA, 23 bp, Homo sapiens
cagatgtgggctcagatcctggg

SEQ ID NO: 2729605 - DNA, 15 bp, Homo sapiens
cagattacaataaat

SEQ ID NO: 2729606 - DNA, 21 bp, Homo sapiens
cagattcaggagctcagtttc

SEQ ID NO: 2729607 - DNA, 18 bp, Homo sapiens
cagattgtaaaggtaggt

SEQ ID NO: 2729608 - DNA, 16 bp, Homo sapiens
cagatttactgtccca

SEQ ID NO: 2729609 - DNA, 17 bp, Homo sapiens
cagatttactgtcccag

SEQ ID NO: 2729610 - DNA, 18 bp, Homo sapiens
cagatttactgtcccagg

SEQ ID NO: 2729611 - DNA, 16 bp, Homo sapiens
ccaccgcatgccccct

SEQ ID NO: 2729612 - DNA, 19 bp, Homo sapiens
ccacctagtggctgtccag

SEQ ID NO: 2729613 - DNA, 21 bp, Homo sapiens
ccacctagtggctgtccagtg

SEQ ID NO: 2729614 - DNA, 22 bp, Homo sapiens
ccacctagtggctgtccagtgc

SEQ ID NO: 2729615 - DNA, 21 bp, Homo sapiens
ccacctggccccttctccagc

SEQ ID NO: 2729616 - DNA, 22 bp, Homo sapiens
ccacgaacacgcatgcctcagc

SEQ ID NO: 2729617 - DNA, 19 bp, Homo sapiens
ccacgcccgactagcaggc

SEQ ID NO: 2729618 - DNA, 20 bp, Homo sapiens
ccacgcccgactagcaggca

SEQ ID NO: 2729619 - DNA, 14 bp, Homo sapiens
ccacggcactccag

SEQ ID NO: 2729620 - DNA, 21 bp, Homo sapiens
ccacggggaccactgggcccc

SEQ ID NO: 2729621 - DNA, 16 bp, Homo sapiens
ccacggtcttctgcat

SEQ ID NO: 2729622 - DNA, 18 bp, Homo sapiens
ccacgtcctgtcagtgcc

SEQ ID NO: 2729623 - DNA, 18 bp, Homo sapiens
ccacgtctctctgcctgc

SEQ ID NO: 2729624 - DNA, 20 bp, Homo sapiens
ccacgtctctctgcctgctg

SEQ ID NO: 2729625 - DNA, 23 bp, Homo sapiens
ccacgtctctctgcctgctgggc

SEQ ID NO: 2729626 - DNA, 20 bp, Homo sapiens
ccactacactccagcctgag

SEQ ID NO: 2729627 - DNA, 22 bp, Homo sapiens
ccactacactccagcctgagca

SEQ ID NO: 2729628 - DNA, 22 bp, Homo sapiens
ccactacctttgtccaggcctg

SEQ ID NO: 2729629 - DNA, 22 bp, Homo sapiens
ccactagggtcctggccctctt

SEQ ID NO: 2729630 - DNA, 16 bp, Homo sapiens
ccactcaggtctgttt

SEQ ID NO: 2729631 - DNA, 17 bp, Homo sapiens
ccactcccacttccctg

SEQ ID NO: 2729632 - DNA, 22 bp, Homo sapiens
ccactccccagtgctcctgtgc

SEQ ID NO: 2729633 - DNA, 13 bp, Homo sapiens
ccactctgctgcc

SEQ ID NO: 2729634 - DNA, 13 bp, Homo sapiens
ccactctttgcta

SEQ ID NO: 2729635 - DNA, 21 bp, Homo sapiens
ccactctttgctacaataaat

SEQ ID NO: 2729636 - DNA, 14 bp, Homo sapiens
ccactgaagctggg

SEQ ID NO: 2729637 - DNA, 15 bp, Homo sapiens
ccactgaagctggga

SEQ ID NO: 2729638 - DNA, 18 bp, Homo sapiens
ccactgattggccagccg

SEQ ID NO: 2729639 - DNA, 14 bp, Homo sapiens
ccactgcaccccct

SEQ ID NO: 2729640 - DNA, 17 bp, Homo sapiens
ccactgcaccccctcct

SEQ ID NO: 2729641 - DNA, 20 bp, Homo sapiens
ccactgcaccccctcctgct

SEQ ID NO: 2729642 - DNA, 19 bp, Homo sapiens
ccactgcactccagcctgg

SEQ ID NO: 2729643 - DNA, 14 bp, Homo sapiens
ccactgcagcacag

SEQ ID NO: 2729644 - DNA, 16 bp, Homo sapiens
ccactggacttgagct

SEQ ID NO: 2729645 - DNA, 12 bp, Homo sapiens
ccactggccagt

SEQ ID NO: 2729646 - DNA, 14 bp, Homo sapiens
ccactgggcccctc

SEQ ID NO: 2729647 - DNA, 15 bp, Homo sapiens
ccactgggtgagaga

SEQ ID NO: 2729648 - DNA, 17 bp, Homo sapiens
ccactgggtgagagagg

SEQ ID NO: 2729649 - DNA, 16 bp, Homo sapiens
ccactgtttcatgagc

SEQ ID NO: 2729650 - DNA, 18 bp, Homo sapiens
ccactgtttcatgagccc

SEQ ID NO: 2729651 - DNA, 20 bp, Homo sapiens
ccactgtttcatgagcccaa

SEQ ID NO: 2729652 - DNA, 14 bp, Homo sapiens
ccacttatttccat

SEQ ID NO: 2729653 - DNA, 17 bp, Homo sapiens
ccacttatttccatgga

SEQ ID NO: 2729654 - DNA, 22 bp, Homo sapiens
ccacttcatgcccactgccgat

SEQ ID NO: 2729655 - DNA, 15 bp, Homo sapiens
ccagaaaaccccagc

SEQ ID NO: 2729656 - DNA, 16 bp, Homo sapiens
ccagaaaaccccagca

SEQ ID NO: 2729657 - DNA, 20 bp, Homo sapiens
ccagaaggctgggtccaggg

SEQ ID NO: 2729658 - DNA, 21 bp, Homo sapiens
ccagaatcagattcaggagct

SEQ ID NO: 2729659 - DNA, 14 bp, Homo sapiens
ccagaatgtgctgc

SEQ ID NO: 2729660 - DNA, 19 bp, Homo sapiens
ccagaattacccttcctca

SEQ ID NO: 2729661 - DNA, 13 bp, Homo sapiens
ccagacagctgga

SEQ ID NO: 2729662 - DNA, 22 bp, Homo sapiens
ccagacctctgaatgtcccaga

SEQ ID NO: 2729663 - DNA, 15 bp, Homo sapiens
ccagagcaggggctg

SEQ ID NO: 2729664 - DNA, 20 bp, Homo sapiens
ccagagcaggggctgctggg

SEQ ID NO: 2729665 - DNA, 20 bp, Homo sapiens
ccagagccactacctttgtc

SEQ ID NO: 2729666 - DNA, 12 bp, Homo sapiens
ccagagctgcct

SEQ ID NO: 2729667 - DNA, 18 bp, Homo sapiens
ccagagctgcctccccaa

SEQ ID NO: 2729668 - DNA, 21 bp, Homo sapiens
ccagagctgcctccccaatcc

SEQ ID NO: 2729669 - DNA, 15 bp, Homo sapiens
ccagagggcccaggc

SEQ ID NO: 2729670 - DNA, 17 bp, Homo sapiens
ccagagggcccaggcag

SEQ ID NO: 2729671 - DNA, 23 bp, Homo sapiens
ccagaggggtgggttcctcttcc

SEQ ID NO: 2729672 - DNA, 14 bp, Homo sapiens
ccagatgctgggca

SEQ ID NO: 2729673 - DNA, 15 bp, Homo sapiens
ccagatgtgggctca

SEQ ID NO: 2729674 - DNA, 17 bp, Homo sapiens
ccagatgtgggctcaga

SEQ ID NO: 2729675 - DNA, 19 bp, Homo sapiens
ccagattgttctgtccagt

SEQ ID NO: 2729676 - DNA, 17 bp, Homo sapiens
ccagcaaagttttcaga

SEQ ID NO: 2729677 - DNA, 14 bp, Homo sapiens
ccagcacagctcct

SEQ ID NO: 2729678 - DNA, 19 bp, Homo sapiens
ccagcacagctcctcccct

SEQ ID NO: 2729679 - DNA, 16 bp, Homo sapiens
ccagcagacttgagtc

SEQ ID NO: 2729680 - DNA, 17 bp, Homo sapiens
ccagcaggcagcgcctg

SEQ ID NO: 2729681 - DNA, 19 bp, Homo sapiens
ccagcatccttttctgcag

SEQ ID NO: 2729682 - DNA, 11 bp, Homo sapiens
ccagccaggac

SEQ ID NO: 2729683 - DNA, 19 bp, Homo sapiens
ccagccattaccatggaga

SEQ ID NO: 2729684 - DNA, 12 bp, Homo sapiens
ccagccctggag

SEQ ID NO: 2729685 - DNA, 14 bp, Homo sapiens
ccagccctggaggc

SEQ ID NO: 2729686 - DNA, 22 bp, Homo sapiens
ccagccctggaggctggatggc

SEQ ID NO: 2729687 - DNA, 18 bp, Homo sapiens
ccagccctttgcaggccc

SEQ ID NO: 2729688 - DNA, 22 bp, Homo sapiens
ccagccctttgcaggcccagca

SEQ ID NO: 2729689 - DNA, 16 bp, Homo sapiens
ccagccgctgcccggc

SEQ ID NO: 2729690 - DNA, 14 bp, Homo sapiens
ccagccgtatttta

SEQ ID NO: 2729691 - DNA, 21 bp, Homo sapiens
ccagcctcacagatgctggcc

SEQ ID NO: 2729692 - DNA, 18 bp, Homo sapiens
ccagcctgacgcctactg

SEQ ID NO: 2729693 - DNA, 12 bp, Homo sapiens
ccagcctgagca

SEQ ID NO: 2729694 - DNA, 23 bp, Homo sapiens
ccagcctgccccagcctcccagc

SEQ ID NO: 2729695 - DNA, 12 bp, Homo sapiens
ccagcctggcca

SEQ ID NO: 2729696 - DNA, 19 bp, Homo sapiens
ccagcctggccaccagctt

SEQ ID NO: 2729697 - DNA, 16 bp, Homo sapiens
ccagcctggcccagct

SEQ ID NO: 2729698 - DNA, 16 bp, Homo sapiens
ccagcgctggctccag

SEQ ID NO: 2729699 - DNA, 17 bp, Homo sapiens
ccagcgctggctccagg

SEQ ID NO: 2729700 - DNA, 22 bp, Homo sapiens
ccagcggcagatgggcctgtgt

SEQ ID NO: 2729701 - DNA, 22 bp, Homo sapiens
ccagcggccttgaagaggcagg

SEQ ID NO: 2729702 - DNA, 14 bp, Homo sapiens
ccagctagggctgg

SEQ ID NO: 2729703 - DNA, 16 bp, Homo sapiens
ccagctagggctggac

SEQ ID NO: 2729704 - DNA, 21 bp, Homo sapiens
ccagctcccccgggaggggcc

SEQ ID NO: 2729705 - DNA, 15 bp, Homo sapiens
ccagctgacagtcct

SEQ ID NO: 2729706 - DNA, 20 bp, Homo sapiens
ccagctgacagtcctctcca

SEQ ID NO: 2729707 - DNA, 19 bp, Homo sapiens
ccagctgatcatgtcagcc

SEQ ID NO: 2729708 - DNA, 19 bp, Homo sapiens
ccagctgcacctgccagcc

SEQ ID NO: 2729709 - DNA, 22 bp, Homo sapiens
ccagctgcacctgccagcctgg

SEQ ID NO: 2729710 - DNA, 17 bp, Homo sapiens
ccagctggcctctagaa

SEQ ID NO: 2729711 - DNA, 20 bp, Homo sapiens
ccagctggcctctagaacac

SEQ ID NO: 2729712 - DNA, 21 bp, Homo sapiens
ccagctttccctccccagagt

SEQ ID NO: 2729713 - DNA, 19 bp, Homo sapiens
ccaggaagggagggagctg

SEQ ID NO: 2729714 - DNA, 21 bp, Homo sapiens
ccaggacggggccggccaggt

SEQ ID NO: 2729715 - DNA, 14 bp, Homo sapiens
ccaggactcaggga

SEQ ID NO: 2729716 - DNA, 15 bp, Homo sapiens
ccaggactcagggac

SEQ ID NO: 2729717 - DNA, 22 bp, Homo sapiens
ccaggactcagggactcaggcc

SEQ ID NO: 2729718 - DNA, 20 bp, Homo sapiens
ccaggagcaaccgtgcagcc

SEQ ID NO: 2729719 - DNA, 20 bp, Homo sapiens
ccaggagtttgaggctgcag

SEQ ID NO: 2729720 - DNA, 23 bp, Homo sapiens
ccaggatggtcttgatctcctga

SEQ ID NO: 2729721 - DNA, 16 bp, Homo sapiens
ccaggcagctccagct

SEQ ID NO: 2729722 - DNA, 18 bp, Homo sapiens
ccaggcccggtgaggcca

SEQ ID NO: 2729723 - DNA, 21 bp, Homo sapiens
ccaggccctaggattcctccc

SEQ ID NO: 2729724 - DNA, 22 bp, Homo sapiens
ccaggccggtgtgggctgtgtc

SEQ ID NO: 2729725 - DNA, 16 bp, Homo sapiens
ccaggctagagtgcag

SEQ ID NO: 2729726 - DNA, 17 bp, Homo sapiens
ccaggctagagtgcagt

SEQ ID NO: 2729727 - DNA, 21 bp, Homo sapiens
ccaggctgctgcatggcactg

SEQ ID NO: 2729728 - DNA, 16 bp, Homo sapiens
ccaggctggagtgcaa

SEQ ID NO: 2729729 - DNA, 18 bp, Homo sapiens
ccaggctggccagcccca

SEQ ID NO: 2729730 - DNA, 20 bp, Homo sapiens
ccaggctggccagccccaca

SEQ ID NO: 2729731 - DNA, 19 bp, Homo sapiens
ccaggcttctcccggacct

SEQ ID NO: 2729732 - DNA, 21 bp, Homo sapiens
ccaggcttctcccggacctgg

SEQ ID NO: 2729733 - DNA, 14 bp, Homo sapiens
ccagggaaaaagac

SEQ ID NO: 2729734 - DNA, 13 bp, Homo sapiens
ccgcagcatgtgg

SEQ ID NO: 2729735 - DNA, 14 bp, Homo sapiens
ccgcagcctccctc

SEQ ID NO: 2729736 - DNA, 12 bp, Homo sapiens
ccgcagctgctg

SEQ ID NO: 2729737 - DNA, 13 bp, Homo sapiens
ccgcagctgctgc

SEQ ID NO: 2729738 - DNA, 17 bp, Homo sapiens
ccgcagctgctgccact

SEQ ID NO: 2729739 - DNA, 16 bp, Homo sapiens
ccgcagggcctgctac

SEQ ID NO: 2729740 - DNA, 13 bp, Homo sapiens
ccgcatgccccct

SEQ ID NO: 2729741 - DNA, 21 bp, Homo sapiens
ccgcatgccccctcgtgccag

SEQ ID NO: 2729742 - DNA, 22 bp, Homo sapiens
ccgcatgccccctcgtgccagt

SEQ ID NO: 2729743 - DNA, 23 bp, Homo sapiens
ccgcatgccccctcgtgccagtc

SEQ ID NO: 2729744 - DNA, 13 bp, Homo sapiens
ccgcatggcagct

SEQ ID NO: 2729745 - DNA, 19 bp, Homo sapiens
ccgcatggcagctgggccc

SEQ ID NO: 2729746 - DNA, 22 bp, Homo sapiens
ccgcccagctgcacctgccagc

SEQ ID NO: 2729747 - DNA, 14 bp, Homo sapiens
ccgcccaggctggc

SEQ ID NO: 2729748 - DNA, 20 bp, Homo sapiens
ccgcccaggctggccagccc

SEQ ID NO: 2729749 - DNA, 17 bp, Homo sapiens
ccgccccttccccgagg

SEQ ID NO: 2729750 - DNA, 17 bp, Homo sapiens
ccgccgcctcgcccacc

SEQ ID NO: 2729751 - DNA, 18 bp, Homo sapiens
ccgcctcccgggaagcat

SEQ ID NO: 2729752 - DNA, 19 bp, Homo sapiens
ccgcctcccttatgcagga

SEQ ID NO: 2729753 - DNA, 14 bp, Homo sapiens
ccgcctctgcccgc

SEQ ID NO: 2729754 - DNA, 16 bp, Homo sapiens
ccgcctctgcccgcag

SEQ ID NO: 2729755 - DNA, 13 bp, Homo sapiens
ccgcgtagagagc

SEQ ID NO: 2729756 - DNA, 15 bp, Homo sapiens
ccgctcccagtgtct

SEQ ID NO: 2729757 - DNA, 22 bp, Homo sapiens
ccgctgcccggcgccctctgtc

SEQ ID NO: 2729758 - DNA, 18 bp, Homo sapiens
ccgcttccagcttcctct

SEQ ID NO: 2729759 - DNA, 20 bp, Homo sapiens
ccgcttccagcttcctctga

SEQ ID NO: 2729760 - DNA, 16 bp, Homo sapiens
ccggacctggactagg

SEQ ID NO: 2729761 - DNA, 19 bp, Homo sapiens
ccggacctggactagggcc

SEQ ID NO: 2729762 - DNA, 18 bp, Homo sapiens
ccggagcgaccctggctc

SEQ ID NO: 2729763 - DNA, 12 bp, Homo sapiens
ccggattggccc

SEQ ID NO: 2729764 - DNA, 11 bp, Homo sapiens
ccggccctgcc

SEQ ID NO: 2729765 - DNA, 13 bp, Homo sapiens
ccggccctgcccc

SEQ ID NO: 2729766 - DNA, 17 bp, Homo sapiens
ccggccctgcccctccc

SEQ ID NO: 2729767 - DNA, 18 bp, Homo sapiens
ccggccctgcccctccct

SEQ ID NO: 2729768 - DNA, 15 bp, Homo sapiens
ccggcgccctctgtc

SEQ ID NO: 2729769 - DNA, 17 bp, Homo sapiens
ccggcgccctctgtcct

SEQ ID NO: 2729770 - DNA, 21 bp, Homo sapiens
ccggcgccctctgtcctgact

SEQ ID NO: 2729771 - DNA, 16 bp, Homo sapiens
ccgggaagcatcctcc

SEQ ID NO: 2729772 - DNA, 22 bp, Homo sapiens
ccgggctcagggaccacagcaa

SEQ ID NO: 2729773 - DNA, 18 bp, Homo sapiens
ccgggtggggggagggca

SEQ ID NO: 2729774 - DNA, 11 bp, Homo sapiens
ccggtgcagaa

SEQ ID NO: 2729775 - DNA, 17 bp, Homo sapiens
ccggtgtgcctgcagcc

SEQ ID NO: 2729776 - DNA, 18 bp, Homo sapiens
ccgtcattgatggagcct

SEQ ID NO: 2729777 - DNA, 13 bp, Homo sapiens
ccgtggccccagc

SEQ ID NO: 2729778 - DNA, 14 bp, Homo sapiens
ccgtggccccagcc

SEQ ID NO: 2729779 - DNA, 20 bp, Homo sapiens
ccgtggccccagcctggccc

SEQ ID NO: 2729780 - DNA, 21 bp, Homo sapiens
ccgtggccccagcctggccca

SEQ ID NO: 2729781 - DNA, 22 bp, Homo sapiens
ccgtggccccagcctggcccag

SEQ ID NO: 2729782 - DNA, 14 bp, Homo sapiens
ccgtgtagtttctg

SEQ ID NO: 2729783 - DNA, 15 bp, Homo sapiens
ccgtgtagtttctgg

SEQ ID NO: 2729784 - DNA, 15 bp, Homo sapiens
cctaatcaagagtct

SEQ ID NO: 2729785 - DNA, 22 bp, Homo sapiens
cctaatcaagagtctctccagc

SEQ ID NO: 2729786 - DNA, 20 bp, Homo sapiens
cctacacccttggacttgag

SEQ ID NO: 2729787 - DNA, 15 bp, Homo sapiens
cctacccctcccagc

SEQ ID NO: 2729788 - DNA, 16 bp, Homo sapiens
cctaccgcatggcagc

SEQ ID NO: 2729789 - DNA, 18 bp, Homo sapiens
cctaccgcatggcagctg

SEQ ID NO: 2729790 - DNA, 23 bp, Homo sapiens
cctaccgcatggcagctgggccc

SEQ ID NO: 2729791 - DNA, 12 bp, Homo sapiens
cctacctcagcc

SEQ ID NO: 2729792 - DNA, 14 bp, Homo sapiens
cctacctcagccta

SEQ ID NO: 2729793 - DNA, 21 bp, Homo sapiens
cctacctcagcctagaccctc

SEQ ID NO: 2729794 - DNA, 16 bp, Homo sapiens
cctacctgcctgttct

SEQ ID NO: 2729795 - DNA, 15 bp, Homo sapiens
cctagagctcctgtc

SEQ ID NO: 2729796 - DNA, 16 bp, Homo sapiens
cctagagctcctgtcc

SEQ ID NO: 2729797 - DNA, 15 bp, Homo sapiens
cctagaggtcccctc

SEQ ID NO: 2729798 - DNA, 13 bp, Homo sapiens
cctagatccaggc

SEQ ID NO: 2729799 - DNA, 14 bp, Homo sapiens
cctagatccaggct

SEQ ID NO: 2729800 - DNA, 20 bp, Homo sapiens
cctagatccaggcttctccc

SEQ ID NO: 2729801 - DNA, 17 bp, Homo sapiens
cctagctcttgggcctg

SEQ ID NO: 2729802 - DNA, 21 bp, Homo sapiens
cctagctcttgggcctgacct

SEQ ID NO: 2729803 - DNA, 17 bp, Homo sapiens
cctaggattcctccccc

SEQ ID NO: 2729804 - DNA, 15 bp, Homo sapiens
cctagtggctgtcca

SEQ ID NO: 2729805 - DNA, 13 bp, Homo sapiens
cctatagtcccag

SEQ ID NO: 2729806 - DNA, 16 bp, Homo sapiens
cctatcagtgtgcccc

SEQ ID NO: 2729807 - DNA, 18 bp, Homo sapiens
cctatcagtgtgcccccc

SEQ ID NO: 2729808 - DNA, 16 bp, Homo sapiens
cctatccttggagagc

SEQ ID NO: 2729809 - DNA, 22 bp, Homo sapiens
cctatccttggagagcagctgg

SEQ ID NO: 2729810 - DNA, 23 bp, Homo sapiens
cctatccttggagagcagctggc

SEQ ID NO: 2729811 - DNA, 14 bp, Homo sapiens
cctatgatcccagc

SEQ ID NO: 2729812 - DNA, 14 bp, Homo sapiens
cctcaaatgagaaa

SEQ ID NO: 2729813 - DNA, 13 bp, Homo sapiens
cctcacactccag

SEQ ID NO: 2729814 - DNA, 12 bp, Homo sapiens
cctcacagactc

SEQ ID NO: 2729815 - DNA, 16 bp, Homo sapiens
cctcacagatgctggc

SEQ ID NO: 2729816 - DNA, 18 bp, Homo sapiens
cctcacagatgctggcct

SEQ ID NO: 2729817 - DNA, 19 bp, Homo sapiens
cctcacagatgctggcctc

SEQ ID NO: 2729818 - DNA, 20 bp, Homo sapiens
cctcacagatgctggcctct

SEQ ID NO: 2729819 - DNA, 23 bp, Homo sapiens
cctcacagatgctggcctcttgg

SEQ ID NO: 2729820 - DNA, 15 bp, Homo sapiens
cctcacagcctctcc

SEQ ID NO: 2729821 - DNA, 19 bp, Homo sapiens
cctcaccaggggcaggcac

SEQ ID NO: 2729822 - DNA, 14 bp, Homo sapiens
cctcacgctctgga

SEQ ID NO: 2729823 - DNA, 16 bp, Homo sapiens
cctcacgctctggaca

SEQ ID NO: 2729824 - DNA, 19 bp, Homo sapiens
cctcacgtgaccagccccg

SEQ ID NO: 2729825 - DNA, 20 bp, Homo sapiens
cctcagccagccctggaggc

SEQ ID NO: 2729826 - DNA, 14 bp, Homo sapiens
cctcagcctagacc

SEQ ID NO: 2729827 - DNA, 16 bp, Homo sapiens
cctcagcctagaccct

SEQ ID NO: 2729828 - DNA, 13 bp, Homo sapiens
cctcagcctccag

SEQ ID NO: 2729829 - DNA, 13 bp, Homo sapiens
cctcagcctcctg

SEQ ID NO: 2729830 - DNA, 21 bp, Homo sapiens
cctcagcttctgggggagaca

SEQ ID NO: 2729831 - DNA, 23 bp, Homo sapiens
cctcagggctgtcggtgtgctgt

SEQ ID NO: 2729832 - DNA, 18 bp, Homo sapiens
cctcaggggaagctgcta

SEQ ID NO: 2729833 - DNA, 19 bp, Homo sapiens
cctcaggggaagctgctag

SEQ ID NO: 2729834 - DNA, 20 bp, Homo sapiens
cctcaggggaagctgctagg

SEQ ID NO: 2729835 - DNA, 15 bp, Homo sapiens
cctcagtgctgcaat

SEQ ID NO: 2729836 - DNA, 15 bp, Homo sapiens
cctcatcctcctcct

SEQ ID NO: 2729837 - DNA, 17 bp, Homo sapiens
cctcatcctcctcctca

SEQ ID NO: 2729838 - DNA, 19 bp, Homo sapiens
cctcatctccagtatcctg

SEQ ID NO: 2729839 - DNA, 16 bp, Homo sapiens
cctccacagccgcagc

SEQ ID NO: 2729840 - DNA, 21 bp, Homo sapiens
cctccacattaagtggctttt

SEQ ID NO: 2729841 - DNA, 11 bp, Homo sapiens
cctccacccta

SEQ ID NO: 2729842 - DNA, 22 bp, Homo sapiens
cctccaccctaaagtctcaggt

SEQ ID NO: 2729843 - DNA, 17 bp, Homo sapiens
cctccaccgccatggct

SEQ ID NO: 2729844 - DNA, 13 bp, Homo sapiens
cctccacctcctg

SEQ ID NO: 2729845 - DNA, 12 bp, Homo sapiens
cctccactccca

SEQ ID NO: 2729846 - DNA, 18 bp, Homo sapiens
cctccactcccacttccc

SEQ ID NO: 2729847 - DNA, 20 bp, Homo sapiens
cctccactcccacttccctg

SEQ ID NO: 2729848 - DNA, 13 bp, Homo sapiens
cctccagactgcg

SEQ ID NO: 2729849 - DNA, 23 bp, Homo sapiens
cctccagactgcggagcagcctc

SEQ ID NO: 2729850 - DNA, 20 bp, Homo sapiens
cctccagccacttatttcca

SEQ ID NO: 2729851 - DNA, 18 bp, Homo sapiens
cctccagtcctgctggcc

SEQ ID NO: 2729852 - DNA, 20 bp, Homo sapiens
cctccagtcctgctggcctg

SEQ ID NO: 2729853 - DNA, 23 bp, Homo sapiens
cctccagtcctgctggcctgctc

SEQ ID NO: 2729854 - DNA, 19 bp, Homo sapiens
cctccagtgggaggacaga

SEQ ID NO: 2729855 - DNA, 16 bp, Homo sapiens
cctccagttctgatga

SEQ ID NO: 2729856 - DNA, 15 bp, Homo sapiens
cctccatttttgttg

SEQ ID NO: 2729857 - DNA, 12 bp, Homo sapiens
cctcccacagtg

SEQ ID NO: 2729858 - DNA, 19 bp, Homo sapiens
cctcccagctgacagtcct

SEQ ID NO: 2729859 - DNA, 23 bp, Homo sapiens
cgatgaatttggagactctgtgg

SEQ ID NO: 2729860 - DNA, 17 bp, Homo sapiens
cgcaatagttttttact

SEQ ID NO: 2729861 - DNA, 12 bp, Homo sapiens
cgcagctgctgc

SEQ ID NO: 2729862 - DNA, 13 bp, Homo sapiens
cgcagctgctgcc

SEQ ID NO: 2729863 - DNA, 15 bp, Homo sapiens
cgcagctgctgccac

SEQ ID NO: 2729864 - DNA, 21 bp, Homo sapiens
cgcagctgctgccactctgct

SEQ ID NO: 2729865 - DNA, 22 bp, Homo sapiens
cgcagctgctgccactctgctg

SEQ ID NO: 2729866 - DNA, 24 bp, Homo sapiens
cgcagctgctgccactctgctgcc

SEQ ID NO: 2729867 - DNA, 20 bp, Homo sapiens
cgcatgccccctcgtgccag

SEQ ID NO: 2729868 - DNA, 13 bp, Homo sapiens
cgcatgcctcagc

SEQ ID NO: 2729869 - DNA, 21 bp, Homo sapiens
cgcatgcctcagccagccctg

SEQ ID NO: 2729870 - DNA, 14 bp, Homo sapiens
cgcatggcagctgg

SEQ ID NO: 2729871 - DNA, 16 bp, Homo sapiens
cgcatggcagctgggc

SEQ ID NO: 2729872 - DNA, 19 bp, Homo sapiens
cgcatggcagctgggccca

SEQ ID NO: 2729873 - DNA, 22 bp, Homo sapiens
cgcatggcagctgggcccacag

SEQ ID NO: 2729874 - DNA, 22 bp, Homo sapiens
cgccactgcactccagcctggg

SEQ ID NO: 2729875 - DNA, 21 bp, Homo sapiens
cgcccaccgcatgccccctcg

SEQ ID NO: 2729876 - DNA, 23 bp, Homo sapiens
cgcccaccgcatgccccctcgtg

SEQ ID NO: 2729877 - DNA, 16 bp, Homo sapiens
cgcccaggctggccag

SEQ ID NO: 2729878 - DNA, 20 bp, Homo sapiens
cgcccaggctggccagcccc

SEQ ID NO: 2729879 - DNA, 22 bp, Homo sapiens
cgcccaggctggccagccccac

SEQ ID NO: 2729880 - DNA, 17 bp, Homo sapiens
cgcccgactagcaggca

SEQ ID NO: 2729881 - DNA, 19 bp, Homo sapiens
cgcccgactagcaggcatg

SEQ ID NO: 2729882 - DNA, 14 bp, Homo sapiens
cgccctctgtcctg

SEQ ID NO: 2729883 - DNA, 16 bp, Homo sapiens
cgccctctgtcctgac

SEQ ID NO: 2729884 - DNA, 13 bp, Homo sapiens
cgccctggccagg

SEQ ID NO: 2729885 - DNA, 22 bp, Homo sapiens
cgccctggccagggcctctgtg

SEQ ID NO: 2729886 - DNA, 22 bp, Homo sapiens
cgccgcttccagcttcctctga

SEQ ID NO: 2729887 - DNA, 13 bp, Homo sapiens
cgccgtggagcat

SEQ ID NO: 2729888 - DNA, 16 bp, Homo sapiens
cgcctcgcccaccgca

SEQ ID NO: 2729889 - DNA, 14 bp, Homo sapiens
cgcctcggcctccc

SEQ ID NO: 2729890 - DNA, 14 bp, Homo sapiens
cgcctctgcccagc

SEQ ID NO: 2729891 - DNA, 19 bp, Homo sapiens
cgcctgtcccctcacagac

SEQ ID NO: 2729892 - DNA, 20 bp, Homo sapiens
cgcctgtcccctcacagact

SEQ ID NO: 2729893 - DNA, 19 bp, Homo sapiens
cgccttctcccccccgggg

SEQ ID NO: 2729894 - DNA, 19 bp, Homo sapiens
cgcgccttctcccccccgg

SEQ ID NO: 2729895 - DNA, 12 bp, Homo sapiens
cgcgtagagagc

SEQ ID NO: 2729896 - DNA, 13 bp, Homo sapiens
cgcgtctgcccca

SEQ ID NO: 2729897 - DNA, 22 bp, Homo sapiens
cgctcagcaatagggtgcagtt

SEQ ID NO: 2729898 - DNA, 14 bp, Homo sapiens
cgctcccagtgtct

SEQ ID NO: 2729899 - DNA, 22 bp, Homo sapiens
cgctcgtccacggtcttctgca

SEQ ID NO: 2729900 - DNA, 12 bp, Homo sapiens
cgctgatgctgg

SEQ ID NO: 2729901 - DNA, 16 bp, Homo sapiens
cgctgatgctgggctg

SEQ ID NO: 2729902 - DNA, 21 bp, Homo sapiens
cgctgatgctgggctgggtgc

SEQ ID NO: 2729903 - DNA, 20 bp, Homo sapiens
cgctgcccggcgccctctgt

SEQ ID NO: 2729904 - DNA, 13 bp, Homo sapiens
cgctgcctgtgtg

SEQ ID NO: 2729905 - DNA, 16 bp, Homo sapiens
cgctggacaacccaga

SEQ ID NO: 2729906 - DNA, 23 bp, Homo sapiens
cgctgggacggcccatcttggca

SEQ ID NO: 2729907 - DNA, 19 bp, Homo sapiens
cgcttattgcccaggctgg

SEQ ID NO: 2729908 - DNA, 23 bp, Homo sapiens
cgcttccagcttcctctgagccg

SEQ ID NO: 2729909 - DNA, 14 bp, Homo sapiens
cgcttgcctcggct

SEQ ID NO: 2729910 - DNA, 15 bp, Homo sapiens
cgcttgcctcggctc

SEQ ID NO: 2729911 - DNA, 14 bp, Homo sapiens
cgcttgttttaaaa

SEQ ID NO: 2729912 - DNA, 20 bp, Homo sapiens
cggaaaaggttttattttgt

SEQ ID NO: 2729913 - DNA, 18 bp, Homo sapiens
cggaaggctggctgggca

SEQ ID NO: 2729914 - DNA, 17 bp, Homo sapiens
cggaccgcgtagagagc

SEQ ID NO: 2729915 - DNA, 14 bp, Homo sapiens
cggacctttcagct

SEQ ID NO: 2729916 - DNA, 17 bp, Homo sapiens
cggactcagactcctgg

SEQ ID NO: 2729917 - DNA, 23 bp, Homo sapiens
cggagcagcctccagtgctggct

SEQ ID NO: 2729918 - DNA, 17 bp, Homo sapiens
cggagcgaccctggctc

SEQ ID NO: 2729919 - DNA, 18 bp, Homo sapiens
cggagcgaccctggctct

SEQ ID NO: 2729920 - DNA, 12 bp, Homo sapiens
cggaggctcctc

SEQ ID NO: 2729921 - DNA, 15 bp, Homo sapiens
cggaggctcctccct

SEQ ID NO: 2729922 - DNA, 16 bp, Homo sapiens
cggaggctcctccctc

SEQ ID NO: 2729923 - DNA, 20 bp, Homo sapiens
cggaggctcctccctctgcc

SEQ ID NO: 2729924 - DNA, 23 bp, Homo sapiens
cggaggctcctccctctgcctca

SEQ ID NO: 2729925 - DNA, 12 bp, Homo sapiens
cggattggccct

SEQ ID NO: 2729926 - DNA, 15 bp, Homo sapiens
cggattggccctgcc

SEQ ID NO: 2729927 - DNA, 16 bp, Homo sapiens
cggattggccctgccc

SEQ ID NO: 2729928 - DNA, 19 bp, Homo sapiens
cggattggccctgcccctc

SEQ ID NO: 2729929 - DNA, 18 bp, Homo sapiens
cggcaccagtgcctcagt

SEQ ID NO: 2729930 - DNA, 13 bp, Homo sapiens
cggcactccagcc

SEQ ID NO: 2729931 - DNA, 16 bp, Homo sapiens
cggcactccagcctgg

SEQ ID NO: 2729932 - DNA, 17 bp, Homo sapiens
cggcactccagcctggg

SEQ ID NO: 2729933 - DNA, 22 bp, Homo sapiens
cggcccatctgtccatcctcct

SEQ ID NO: 2729934 - DNA, 12 bp, Homo sapiens
cggctcctgctg

SEQ ID NO: 2729935 - DNA, 14 bp, Homo sapiens
cggctcctgctgca

SEQ ID NO: 2729936 - DNA, 14 bp, Homo sapiens
cggcttcaccaggg

SEQ ID NO: 2729937 - DNA, 19 bp, Homo sapiens
cgggaagcatcctccccac

SEQ ID NO: 2729938 - DNA, 22 bp, Homo sapiens
cgggaagcatcctccccaccag

SEQ ID NO: 2729939 - DNA, 12 bp, Homo sapiens
cgggaagcggag

SEQ ID NO: 2729940 - DNA, 16 bp, Homo sapiens
cgggatcccagcatct

SEQ ID NO: 2729941 - DNA, 21 bp, Homo sapiens
cgggcacctatagtcccagct

SEQ ID NO: 2729942 - DNA, 14 bp, Homo sapiens
cgggcagcacagca

SEQ ID NO: 2729943 - DNA, 15 bp, Homo sapiens
cgggcagcacagcaa

SEQ ID NO: 2729944 - DNA, 15 bp, Homo sapiens
cgggcccaggccatc

SEQ ID NO: 2729945 - DNA, 16 bp, Homo sapiens
cgggctcctgtgccct

SEQ ID NO: 2729946 - DNA, 15 bp, Homo sapiens
cgggctgagggcatc

SEQ ID NO: 2729947 - DNA, 22 bp, Homo sapiens
cggggaggagagagcagcttct

SEQ ID NO: 2729948 - DNA, 19 bp, Homo sapiens
cggggccttggtcccagac

SEQ ID NO: 2729949 - DNA, 23 bp, Homo sapiens
cggggccttggtcccagacagct

SEQ ID NO: 2729950 - DNA, 10 bp, Homo sapiens
cggggctggg

SEQ ID NO: 2729951 - DNA, 14 bp, Homo sapiens
cgggttgaaagaca

SEQ ID NO: 2729952 - DNA, 18 bp, Homo sapiens
cgggttgaaagacatcaa

SEQ ID NO: 2729953 - DNA, 16 bp, Homo sapiens
cggtaccagcctgact

SEQ ID NO: 2729954 - DNA, 20 bp, Homo sapiens
cggtggctcacgcctgtaat

SEQ ID NO: 2729955 - DNA, 20 bp, Homo sapiens
cgtaccaagccaccgcagct

SEQ ID NO: 2729956 - DNA, 22 bp, Homo sapiens
cgtaccaagccaccgcagctgc

SEQ ID NO: 2729957 - DNA, 23 bp, Homo sapiens
cgtaccaagccaccgcagctgct

SEQ ID NO: 2729958 - DNA, 23 bp, Homo sapiens
cgtcaagttgcagatctttttgt

SEQ ID NO: 2729959 - DNA, 13 bp, Homo sapiens
cgtcaccctcctg

SEQ ID NO: 2729960 - DNA, 14 bp, Homo sapiens
cgtcaccctcctga

SEQ ID NO: 2729961 - DNA, 14 bp, Homo sapiens
cgtcataactagaa

SEQ ID NO: 2729962 - DNA, 17 bp, Homo sapiens
cgtcataactagaactg

SEQ ID NO: 2729963 - DNA, 19 bp, Homo sapiens
cgtccatttcttatttaat

SEQ ID NO: 2729964 - DNA, 22 bp, Homo sapiens
cgtccccggccacgtctgtgct

SEQ ID NO: 2729965 - DNA, 18 bp, Homo sapiens
cgtcctggaatgaagcat

SEQ ID NO: 2729966 - DNA, 16 bp, Homo sapiens
cgtcctgtcagtgccg

SEQ ID NO: 2729967 - DNA, 16 bp, Homo sapiens
cgtgaaagcagatgag

SEQ ID NO: 2729968 - DNA, 18 bp, Homo sapiens
cgtgaactgcgtgccagt

SEQ ID NO: 2729969 - DNA, 14 bp, Homo sapiens
cgtgaccagccccg

SEQ ID NO: 2729970 - DNA, 15 bp, Homo sapiens
cgtgagtgtgacttt

SEQ ID NO: 2729971 - DNA, 19 bp, Homo sapiens
cgtgattcctgctgcctgt

SEQ ID NO: 2729972 - DNA, 13 bp, Homo sapiens
cgtgattctgttc

SEQ ID NO: 2729973 - DNA, 14 bp, Homo sapiens
cgtgcacagcttcc

SEQ ID NO: 2729974 - DNA, 19 bp, Homo sapiens
cgtgctcgcctctgcccag

SEQ ID NO: 2729975 - DNA, 18 bp, Homo sapiens
cgtggcaaccctcagctg

SEQ ID NO: 2729976 - DNA, 13 bp, Homo sapiens
cgtggccccagcc

SEQ ID NO: 2729977 - DNA, 21 bp, Homo sapiens
cgtggccccagcctggcccag

SEQ ID NO: 2729978 - DNA, 22 bp, Homo sapiens
cgtggccccagcctggcccagc

SEQ ID NO: 2729979 - DNA, 23 bp, Homo sapiens
cgtggccccagcctggcccagct

SEQ ID NO: 2729980 - DNA, 22 bp, Homo sapiens
cgtggctccagaatgtgctgcc

SEQ ID NO: 2729981 - DNA, 23 bp, Homo sapiens
cgtggctccagaatgtgctgcct

SEQ ID NO: 2729982 - DNA, 14 bp, Homo sapiens
ctctgatgtttggg

SEQ ID NO: 2729983 - DNA, 13 bp, Homo sapiens
ctctgcaactgaa

SEQ ID NO: 2729984 - DNA, 14 bp, Homo sapiens
ctctgcaactgaat

SEQ ID NO: 2729985 - DNA, 21 bp, Homo sapiens
ctctgcagatagtgcctctgc

SEQ ID NO: 2729986 - DNA, 21 bp, Homo sapiens
ctctgcaggaaatcagagctg

SEQ ID NO: 2729987 - DNA, 13 bp, Homo sapiens
ctctgcaggcaga

SEQ ID NO: 2729988 - DNA, 21 bp, Homo sapiens
ctctgccagcgtccccggcca

SEQ ID NO: 2729989 - DNA, 23 bp, Homo sapiens
ctctgcccagcctgccccagcct

SEQ ID NO: 2729990 - DNA, 12 bp, Homo sapiens
ctctgccccagc

SEQ ID NO: 2729991 - DNA, 17 bp, Homo sapiens
ctctgccccagctctgg

SEQ ID NO: 2729992 - DNA, 20 bp, Homo sapiens
ctctgcccccaactcccgga

SEQ ID NO: 2729993 - DNA, 14 bp, Homo sapiens
ctctgcctcatcct

SEQ ID NO: 2729994 - DNA, 15 bp, Homo sapiens
ctctgcctcatcctc

SEQ ID NO: 2729995 - DNA, 16 bp, Homo sapiens
ctctgcctgaccccag

SEQ ID NO: 2729996 - DNA, 15 bp, Homo sapiens
ctctgcctgctgggc

SEQ ID NO: 2729997 - DNA, 18 bp, Homo sapiens
ctctgcctgcttcctgga

SEQ ID NO: 2729998 - DNA, 21 bp, Homo sapiens
ctctgcctgcttcctggaccg

SEQ ID NO: 2729999 - DNA, 13 bp, Homo sapiens
ctctgcctggagc

SEQ ID NO: 2730000 - DNA, 23 bp, Homo sapiens
ctctgctatatgccttaagccaa

SEQ ID NO: 2730001 - DNA, 12 bp, Homo sapiens
ctctgctcagtg

SEQ ID NO: 2730002 - DNA, 14 bp, Homo sapiens
ctctgctgcccagg

SEQ ID NO: 2730003 - DNA, 15 bp, Homo sapiens
ctctgctgcctgtac

SEQ ID NO: 2730004 - DNA, 16 bp, Homo sapiens
ctctgctgcctgtaca

SEQ ID NO: 2730005 - DNA, 17 bp, Homo sapiens
ctctgctgcctgtacag

SEQ ID NO: 2730006 - DNA, 18 bp, Homo sapiens
ctctgctggaagaactgc

SEQ ID NO: 2730007 - DNA, 23 bp, Homo sapiens
ctctgctggaagaactgcatggg

SEQ ID NO: 2730008 - DNA, 13 bp, Homo sapiens
ctctgcttcctga

SEQ ID NO: 2730009 - DNA, 15 bp, Homo sapiens
ctctgcttggcttcc

SEQ ID NO: 2730010 - DNA, 17 bp, Homo sapiens
ctctgcttttcctgtct

SEQ ID NO: 2730011 - DNA, 15 bp, Homo sapiens
ctctggacagcttga

SEQ ID NO: 2730012 - DNA, 17 bp, Homo sapiens
ctctggattcctgtcat

SEQ ID NO: 2730013 - DNA, 18 bp, Homo sapiens
ctctggctcagctgtggt

SEQ ID NO: 2730014 - DNA, 19 bp, Homo sapiens
ctctggctcagctgtggtc

SEQ ID NO: 2730015 - DNA, 15 bp, Homo sapiens
ctctgtcaccctggc

SEQ ID NO: 2730016 - DNA, 17 bp, Homo sapiens
ctctgtcaccctggcca

SEQ ID NO: 2730017 - DNA, 16 bp, Homo sapiens
ctctgtccagccagct

SEQ ID NO: 2730018 - DNA, 22 bp, Homo sapiens
ctctgtcccggttcaccttgcc

SEQ ID NO: 2730019 - DNA, 15 bp, Homo sapiens
ctctgtgacctgccc

SEQ ID NO: 2730020 - DNA, 14 bp, Homo sapiens
ctctgtgcccatgg

SEQ ID NO: 2730021 - DNA, 13 bp, Homo sapiens
ctctgtgggctgc

SEQ ID NO: 2730022 - DNA, 20 bp, Homo sapiens
ctctgtgtcactggctgcct

SEQ ID NO: 2730023 - DNA, 20 bp, Homo sapiens
ctctgtgttgtgaatgtcat

SEQ ID NO: 2730024 - DNA, 19 bp, Homo sapiens
ctctgttaaagatcagcta

SEQ ID NO: 2730025 - DNA, 15 bp, Homo sapiens
ctctgttctagagtg

SEQ ID NO: 2730026 - DNA, 13 bp, Homo sapiens
ctcttacttcccc

SEQ ID NO: 2730027 - DNA, 22 bp, Homo sapiens
ctcttacttcccccaccctggg

SEQ ID NO: 2730028 - DNA, 12 bp, Homo sapiens
ctcttatttgct

SEQ ID NO: 2730029 - DNA, 14 bp, Homo sapiens
ctcttatttttgta

SEQ ID NO: 2730030 - DNA, 19 bp, Homo sapiens
ctcttatttttgtaccata

SEQ ID NO: 2730031 - DNA, 13 bp, Homo sapiens
ctcttctctgtta

SEQ ID NO: 2730032 - DNA, 14 bp, Homo sapiens
ctcttgactggctc

SEQ ID NO: 2730033 - DNA, 15 bp, Homo sapiens
ctcttgactggctca

SEQ ID NO: 2730034 - DNA, 12 bp, Homo sapiens
ctcttgccccaa

SEQ ID NO: 2730035 - DNA, 19 bp, Homo sapiens
ctcttgccccaaatcacaa

SEQ ID NO: 2730036 - DNA, 14 bp, Homo sapiens
ctcttggcacctgc

SEQ ID NO: 2730037 - DNA, 18 bp, Homo sapiens
ctcttggcacctgcctag

SEQ ID NO: 2730038 - DNA, 21 bp, Homo sapiens
ctcttggcacctgcctagctc

SEQ ID NO: 2730039 - DNA, 23 bp, Homo sapiens
ctcttggcacctgcctagctctt

SEQ ID NO: 2730040 - DNA, 23 bp, Homo sapiens
ctcttgggcctgacctccagtcc

SEQ ID NO: 2730041 - DNA, 22 bp, Homo sapiens
ctcttgtattgctccattttct

SEQ ID NO: 2730042 - DNA, 15 bp, Homo sapiens
ctctttgctacaata

SEQ ID NO: 2730043 - DNA, 18 bp, Homo sapiens
ctctttgctacaataaat

SEQ ID NO: 2730044 - DNA, 21 bp, Homo sapiens
ctctttgctacaataaatgct

SEQ ID NO: 2730045 - DNA, 17 bp, Homo sapiens
ctgaacaatattttctc

SEQ ID NO: 2730046 - DNA, 13 bp, Homo sapiens
ctgaacagtgctc

SEQ ID NO: 2730047 - DNA, 18 bp, Homo sapiens
ctgaacagtgctctgcct

SEQ ID NO: 2730048 - DNA, 16 bp, Homo sapiens
ctgaagacctccacat

SEQ ID NO: 2730049 - DNA, 12 bp, Homo sapiens
ctgaaggagatt

SEQ ID NO: 2730050 - DNA, 16 bp, Homo sapiens
ctgaaggagattttcc

SEQ ID NO: 2730051 - DNA, 15 bp, Homo sapiens
ctgaaggcttctgca

SEQ ID NO: 2730052 - DNA, 18 bp, Homo sapiens
ctgaaggcttctgcagct

SEQ ID NO: 2730053 - DNA, 14 bp, Homo sapiens
ctgaataaagggaa

SEQ ID NO: 2730054 - DNA, 15 bp, Homo sapiens
ctgaatattaagaaa

SEQ ID NO: 2730055 - DNA, 20 bp, Homo sapiens
ctgaatgtcattatttgata

SEQ ID NO: 2730056 - DNA, 16 bp, Homo sapiens
ctgaatgtcccagagg

SEQ ID NO: 2730057 - DNA, 16 bp, Homo sapiens
ctgacagagccagagg

SEQ ID NO: 2730058 - DNA, 18 bp, Homo sapiens
ctgacagagccagaggca

SEQ ID NO: 2730059 - DNA, 22 bp, Homo sapiens
ctgacatcaccaagtgtggaat

SEQ ID NO: 2730060 - DNA, 22 bp, Homo sapiens
ctgacccaccaaggtctcacac

SEQ ID NO: 2730061 - DNA, 24 bp, Homo sapiens
ctgacccaccaaggtctcacactc

SEQ ID NO: 2730062 - DNA, 18 bp, Homo sapiens
ctgacccggattggccct

SEQ ID NO: 2730063 - DNA, 20 bp, Homo sapiens
ctgacccggattggccctgc

SEQ ID NO: 2730064 - DNA, 22 bp, Homo sapiens
ctgaccctcctccactccacct

SEQ ID NO: 2730065 - DNA, 21 bp, Homo sapiens
ctgaccgggtctgcttctgca

SEQ ID NO: 2730066 - DNA, 16 bp, Homo sapiens
ctgacctccagtcctg

SEQ ID NO: 2730067 - DNA, 18 bp, Homo sapiens
ctgacctccagtcctgct

SEQ ID NO: 2730068 - DNA, 20 bp, Homo sapiens
ctgacctccagtcctgctgg

SEQ ID NO: 2730069 - DNA, 24 bp, Homo sapiens
ctgacctcgtgatttgcctgcctg

SEQ ID NO: 2730070 - DNA, 12 bp, Homo sapiens
ctgacctgcagg

SEQ ID NO: 2730071 - DNA, 18 bp, Homo sapiens
ctgaccttctccagggac

SEQ ID NO: 2730072 - DNA, 19 bp, Homo sapiens
ctgaccttctccagggaca

SEQ ID NO: 2730073 - DNA, 14 bp, Homo sapiens
ctgactctctgtga

SEQ ID NO: 2730074 - DNA, 20 bp, Homo sapiens
ctgagactagattctcacct

SEQ ID NO: 2730075 - DNA, 21 bp, Homo sapiens
ctgagactttcagtgcactgt

SEQ ID NO: 2730076 - DNA, 14 bp, Homo sapiens
ctgagagagtggca

SEQ ID NO: 2730077 - DNA, 13 bp, Homo sapiens
ctgagaggtgagg

SEQ ID NO: 2730078 - DNA, 20 bp, Homo sapiens
ctgagatactgaagtgcagc

SEQ ID NO: 2730079 - DNA, 23 bp, Homo sapiens
ctgagatactgaagtgcagctca

SEQ ID NO: 2730080 - DNA, 17 bp, Homo sapiens
ctgagattctttaagga

SEQ ID NO: 2730081 - DNA, 16 bp, Homo sapiens
ctgagcaacagagtga

SEQ ID NO: 2730082 - DNA, 14 bp, Homo sapiens
ctgagccgcagggc

SEQ ID NO: 2730083 - DNA, 13 bp, Homo sapiens
ctgagctctctga

SEQ ID NO: 2730084 - DNA, 16 bp, Homo sapiens
ctgagctgtcccctgg

SEQ ID NO: 2730085 - DNA, 21 bp, Homo sapiens
ctgaggagtgtcctgtctgct

SEQ ID NO: 2730086 - DNA, 22 bp, Homo sapiens
ctgaggagtgtcctgtctgctg

SEQ ID NO: 2730087 - DNA, 18 bp, Homo sapiens
ctgaggatcccctgtccc

SEQ ID NO: 2730088 - DNA, 19 bp, Homo sapiens
ctgaggatcccctgtcccc

SEQ ID NO: 2730089 - DNA, 12 bp, Homo sapiens
ctgaggcctccc

SEQ ID NO: 2730090 - DNA, 14 bp, Homo sapiens
ctgaggcctccctt

SEQ ID NO: 2730091 - DNA, 17 bp, Homo sapiens
ctgaggcctcccttgag

SEQ ID NO: 2730092 - DNA, 16 bp, Homo sapiens
ctgaggctctttctgg

SEQ ID NO: 2730093 - DNA, 20 bp, Homo sapiens
ctgaggctctttctgggcca

SEQ ID NO: 2730094 - DNA, 15 bp, Homo sapiens
ctgaggctgagactg

SEQ ID NO: 2730095 - DNA, 12 bp, Homo sapiens
ctgaggctggca

SEQ ID NO: 2730096 - DNA, 16 bp, Homo sapiens
ctgaggctggcatcct

SEQ ID NO: 2730097 - DNA, 15 bp, Homo sapiens
ctgagggcatctctg

SEQ ID NO: 2730098 - DNA, 16 bp, Homo sapiens
ctgagggcatctctga

SEQ ID NO: 2730099 - DNA, 13 bp, Homo sapiens
ctgagtagctggg

SEQ ID NO: 2730100 - DNA, 19 bp, Homo sapiens
ctgagtagctgggactaca

SEQ ID NO: 2730101 - DNA, 20 bp, Homo sapiens
ctgagtagctgggactacag

SEQ ID NO: 2730102 - DNA, 17 bp, Homo sapiens
ctgagtctgctatattt

SEQ ID NO: 2730103 - DNA, 15 bp, Homo sapiens
ctgagtctggcaaac

SEQ ID NO: 2730104 - DNA, 14 bp, Homo sapiens
ctgagtgtctctgc

SEQ ID NO: 2730105 - DNA, 16 bp, Homo sapiens
ctgagtgtctctgcct

SEQ ID NO: 2730106 - DNA, 15 bp, Homo sapiens
ctgtgtctctgtata

SEQ ID NO: 2730107 - DNA, 23 bp, Homo sapiens
ctgtgtctctgtatatagctcta

SEQ ID NO: 2730108 - DNA, 23 bp, Homo sapiens
ctgtgtttctagttgcattttca

SEQ ID NO: 2730109 - DNA, 18 bp, Homo sapiens
ctgttaccaaatctcagt

SEQ ID NO: 2730110 - DNA, 17 bp, Homo sapiens
ctgttctaactcttaga

SEQ ID NO: 2730111 - DNA, 14 bp, Homo sapiens
ctgttctacttgat

SEQ ID NO: 2730112 - DNA, 21 bp, Homo sapiens
ctgtttaaaaaaagtatatat

SEQ ID NO: 2730113 - DNA, 23 bp, Homo sapiens
ctgtttaaaaaaagtatatattc

SEQ ID NO: 2730114 - DNA, 13 bp, Homo sapiens
ctgtttgcttcta

SEQ ID NO: 2730115 - DNA, 17 bp, Homo sapiens
ctgtttgtttggcactg

SEQ ID NO: 2730116 - DNA, 11 bp, Homo sapiens
ctgtttttccg

SEQ ID NO: 2730117 - DNA, 17 bp, Homo sapiens
cttaaaaatcttggttt

SEQ ID NO: 2730118 - DNA, 18 bp, Homo sapiens
cttaaagttgacatttaa

SEQ ID NO: 2730119 - DNA, 17 bp, Homo sapiens
cttaactctgcaggaaa

SEQ ID NO: 2730120 - DNA, 21 bp, Homo sapiens
cttaaggatggagccagctct

SEQ ID NO: 2730121 - DNA, 16 bp, Homo sapiens
cttaaggccacactgg

SEQ ID NO: 2730122 - DNA, 21 bp, Homo sapiens
cttaaggtactctggactttc

SEQ ID NO: 2730123 - DNA, 18 bp, Homo sapiens
cttacaaaagcagctttt

SEQ ID NO: 2730124 - DNA, 23 bp, Homo sapiens
cttacagtaggagtgagaaattt

SEQ ID NO: 2730125 - DNA, 13 bp, Homo sapiens
cttacataatttg

SEQ ID NO: 2730126 - DNA, 14 bp, Homo sapiens
cttactcagagctg

SEQ ID NO: 2730127 - DNA, 15 bp, Homo sapiens
cttactcagagctgc

SEQ ID NO: 2730128 - DNA, 16 bp, Homo sapiens
cttacttaaccaggtt

SEQ ID NO: 2730129 - DNA, 13 bp, Homo sapiens
cttactttgtgca

SEQ ID NO: 2730130 - DNA, 15 bp, Homo sapiens
cttatgagaacatgg

SEQ ID NO: 2730131 - DNA, 21 bp, Homo sapiens
cttattcatgctttctccttt

SEQ ID NO: 2730132 - DNA, 23 bp, Homo sapiens
cttattcatgctttctccttttt

SEQ ID NO: 2730133 - DNA, 15 bp, Homo sapiens
cttattctcctccct

SEQ ID NO: 2730134 - DNA, 19 bp, Homo sapiens
cttattgtattcctcatgt

SEQ ID NO: 2730135 - DNA, 21 bp, Homo sapiens
cttatttatattcatcaaata

SEQ ID NO: 2730136 - DNA, 11 bp, Homo sapiens
cttatttgagt

SEQ ID NO: 2730137 - DNA, 23 bp, Homo sapiens
cttatttgtcggggaagatgaaa

SEQ ID NO: 2730138 - DNA, 14 bp, Homo sapiens
cttatttttgtacc

SEQ ID NO: 2730139 - DNA, 22 bp, Homo sapiens
cttatttttgtaccatattgct

SEQ ID NO: 2730140 - DNA, 16 bp, Homo sapiens
cttcaagttagctcag

SEQ ID NO: 2730141 - DNA, 19 bp, Homo sapiens
cttcaccacctcatgtcat

SEQ ID NO: 2730142 - DNA, 22 bp, Homo sapiens
cttcactccggtgtgcctgcag

SEQ ID NO: 2730143 - DNA, 22 bp, Homo sapiens
cttcactgcagcctttcacagg

SEQ ID NO: 2730144 - DNA, 15 bp, Homo sapiens
cttcactgctctgcc

SEQ ID NO: 2730145 - DNA, 19 bp, Homo sapiens
cttcactgctctgccccca

SEQ ID NO: 2730146 - DNA, 16 bp, Homo sapiens
cttcagcctgaggctg

SEQ ID NO: 2730147 - DNA, 22 bp, Homo sapiens
cttcagcctgaggctgagactg

SEQ ID NO: 2730148 - DNA, 13 bp, Homo sapiens
cttcagctggtgg

SEQ ID NO: 2730149 - DNA, 19 bp, Homo sapiens
cttcagctggtggatggtg

SEQ ID NO: 2730150 - DNA, 14 bp, Homo sapiens
cttcaggggctgcc

SEQ ID NO: 2730151 - DNA, 17 bp, Homo sapiens
cttcaggggctgcccgc

SEQ ID NO: 2730152 - DNA, 23 bp, Homo sapiens
cttcaggggctgcccgctcccag

SEQ ID NO: 2730153 - DNA, 14 bp, Homo sapiens
cttcagtcttggag

SEQ ID NO: 2730154 - DNA, 17 bp, Homo sapiens
cttcagttgttttcccg

SEQ ID NO: 2730155 - DNA, 20 bp, Homo sapiens
cttcatagatgagaaaactg

SEQ ID NO: 2730156 - DNA, 14 bp, Homo sapiens
cttcatatctaatt

SEQ ID NO: 2730157 - DNA, 17 bp, Homo sapiens
cttcatgcccactgccg

SEQ ID NO: 2730158 - DNA, 16 bp, Homo sapiens
cttccaaccccagctg

SEQ ID NO: 2730159 - DNA, 19 bp, Homo sapiens
cttccaaccccagctggcc

SEQ ID NO: 2730160 - DNA, 20 bp, Homo sapiens
cttccaaccccagctggcct

SEQ ID NO: 2730161 - DNA, 22 bp, Homo sapiens
cttccaaccccagctggcctct

SEQ ID NO: 2730162 - DNA, 15 bp, Homo sapiens
cttccaaggtggtct

SEQ ID NO: 2730163 - DNA, 13 bp, Homo sapiens
cttccaccagagc

SEQ ID NO: 2730164 - DNA, 14 bp, Homo sapiens
cttccaccagagca

SEQ ID NO: 2730165 - DNA, 18 bp, Homo sapiens
cttccaccagagcagggg

SEQ ID NO: 2730166 - DNA, 20 bp, Homo sapiens
cttccagcttcctctgagcc

SEQ ID NO: 2730167 - DNA, 19 bp, Homo sapiens
cttccaggcccccaccact

SEQ ID NO: 2730168 - DNA, 16 bp, Homo sapiens
cttccatgatacttta

SEQ ID NO: 2730169 - DNA, 18 bp, Homo sapiens
cttccatgatactttaat

SEQ ID NO: 2730170 - DNA, 21 bp, Homo sapiens
cttcccaggtaagcaggagga

SEQ ID NO: 2730171 - DNA, 16 bp, Homo sapiens
cttcccccaaggctga

SEQ ID NO: 2730172 - DNA, 22 bp, Homo sapiens
cttccccgagggatgatgccac

SEQ ID NO: 2730173 - DNA, 23 bp, Homo sapiens
cttcccctcctacccctcccagc

SEQ ID NO: 2730174 - DNA, 12 bp, Homo sapiens
cttccccttgtc

SEQ ID NO: 2730175 - DNA, 14 bp, Homo sapiens
cttccccttgtccc

SEQ ID NO: 2730176 - DNA, 21 bp, Homo sapiens
cttccctgcttttctcccaga

SEQ ID NO: 2730177 - DNA, 22 bp, Homo sapiens
cttccctgtatgattccttgat

SEQ ID NO: 2730178 - DNA, 16 bp, Homo sapiens
cttcctcatctgtgcc

SEQ ID NO: 2730179 - DNA, 18 bp, Homo sapiens
cttcctcatctgtgcctg

SEQ ID NO: 2730180 - DNA, 22 bp, Homo sapiens
cttcctcatctgtgcctgtctg

SEQ ID NO: 2730181 - DNA, 16 bp, Homo sapiens
cttcctctgagccgca

SEQ ID NO: 2730182 - DNA, 23 bp, Homo sapiens
cttcctgacccggattggccctg

SEQ ID NO: 2730183 - DNA, 22 bp, Homo sapiens
cttcctggaccggggccttggt

SEQ ID NO: 2730184 - DNA, 19 bp, Homo sapiens
cttccttaattcactccca

SEQ ID NO: 2730185 - DNA, 18 bp, Homo sapiens
cttcctttatcccctcct

SEQ ID NO: 2730186 - DNA, 20 bp, Homo sapiens
cttctaatccatgtgctgct

SEQ ID NO: 2730187 - DNA, 17 bp, Homo sapiens
cttctaccttaaaatgt

SEQ ID NO: 2730188 - DNA, 23 bp, Homo sapiens
cttctcagagcagcactggggtt

SEQ ID NO: 2730189 - DNA, 13 bp, Homo sapiens
cttctccagggac

SEQ ID NO: 2730190 - DNA, 18 bp, Homo sapiens
cttctcccggacctggac

SEQ ID NO: 2730191 - DNA, 13 bp, Homo sapiens
cttctgatcttgg

SEQ ID NO: 2730192 - DNA, 15 bp, Homo sapiens
cttctgcatcactgg

SEQ ID NO: 2730193 - DNA, 15 bp, Homo sapiens
cttctgcattcacag

SEQ ID NO: 2730194 - DNA, 11 bp, Homo sapiens
cttctgccact

SEQ ID NO: 2730195 - DNA, 12 bp, Homo sapiens
cttctgccactt

SEQ ID NO: 2730196 - DNA, 14 bp, Homo sapiens
cttctgccacttcc

SEQ ID NO: 2730197 - DNA, 13 bp, Homo sapiens
cttctgccttttt

SEQ ID NO: 2730198 - DNA, 13 bp, Homo sapiens
cttctgctgggct

SEQ ID NO: 2730199 - DNA, 16 bp, Homo sapiens
cttctgctgggctggg

SEQ ID NO: 2730200 - DNA, 17 bp, Homo sapiens
cttctgctgggctgggg

SEQ ID NO: 2730201 - DNA, 19 bp, Homo sapiens
cttctgctgggctggggcc

SEQ ID NO: 2730202 - DNA, 21 bp, Homo sapiens
cttctgtgtcgttttgttgcc

SEQ ID NO: 2730203 - DNA, 23 bp, Homo sapiens
cttcttattcatgctttctcctt

SEQ ID NO: 2730204 - DNA, 13 bp, Homo sapiens
cttcttgtaatat

SEQ ID NO: 2730205 - DNA, 16 bp, Homo sapiens
cttgaaacagcctggg

SEQ ID NO: 2730206 - DNA, 17 bp, Homo sapiens
cttgaaacctttctact

SEQ ID NO: 2730207 - DNA, 17 bp, Homo sapiens
cttgaagccactgaagc

SEQ ID NO: 2730208 - DNA, 18 bp, Homo sapiens
cttgaagccactgaagct

SEQ ID NO: 2730209 - DNA, 17 bp, Homo sapiens
cttgaagtaggaagtag

SEQ ID NO: 2730210 - DNA, 17 bp, Homo sapiens
cttgaattttcccactg

SEQ ID NO: 2730211 - DNA, 18 bp, Homo sapiens
cttgaattttcccactgc

SEQ ID NO: 2730212 - DNA, 21 bp, Homo sapiens
cttgaattttcccactgcacc

SEQ ID NO: 2730213 - DNA, 12 bp, Homo sapiens
cttgacctccta

SEQ ID NO: 2730214 - DNA, 15 bp, Homo sapiens
cttgacctgaactct

SEQ ID NO: 2730215 - DNA, 19 bp, Homo sapiens
cttgacctgaactctgcaa

SEQ ID NO: 2730216 - DNA, 16 bp, Homo sapiens
cttgactctactccca

SEQ ID NO: 2730217 - DNA, 21 bp, Homo sapiens
cttgagaaaatgcaggagagc

SEQ ID NO: 2730218 - DNA, 21 bp, Homo sapiens
cttgagcttggcagctgaact

SEQ ID NO: 2730219 - DNA, 15 bp, Homo sapiens
cttgagtaggccctg

SEQ ID NO: 2730220 - DNA, 17 bp, Homo sapiens
cttgagtaggccctgct

SEQ ID NO: 2730221 - DNA, 19 bp, Homo sapiens
cttgagtaggccctgcttt

SEQ ID NO: 2730222 - DNA, 14 bp, Homo sapiens
cttgatctcctgag

SEQ ID NO: 2730223 - DNA, 12 bp, Homo sapiens
cttgattaaaca

SEQ ID NO: 2730224 - DNA, 13 bp, Homo sapiens
cttgccccaaccc

SEQ ID NO: 2730225 - DNA, 13 bp, Homo sapiens
cttgccgagagag

SEQ ID NO: 2730226 - DNA, 15 bp, Homo sapiens
cttgccgagagaggc

SEQ ID NO: 2730227 - DNA, 16 bp, Homo sapiens
cttgccgagagaggcg

SEQ ID NO: 2730228 - DNA, 22 bp, Homo sapiens
cttgcctcggctcctgctgcac

SEQ ID NO: 2730229 - DNA, 16 bp, Homo sapiens
cttgctggcagggcct

SEQ ID NO: 2730230 - DNA, 16 bp, Homo sapiens
gaaagcatcacctcag

SEQ ID NO: 2730231 - DNA, 19 bp, Homo sapiens
gaaagcatcacctcaggcc

SEQ ID NO: 2730232 - DNA, 14 bp, Homo sapiens
gaaagctgcactca

SEQ ID NO: 2730233 - DNA, 13 bp, Homo sapiens
gaaaggattttac

SEQ ID NO: 2730234 - DNA, 20 bp, Homo sapiens
gaaaggattttaccaaagca

SEQ ID NO: 2730235 - DNA, 18 bp, Homo sapiens
gaaaggctcagtctcagg

SEQ ID NO: 2730236 - DNA, 21 bp, Homo sapiens
gaaaggctcagtctcaggagc

SEQ ID NO: 2730237 - DNA, 22 bp, Homo sapiens
gaaaggctcagtctcaggagca

SEQ ID NO: 2730238 - DNA, 14 bp, Homo sapiens
gaaagtatttttga

SEQ ID NO: 2730239 - DNA, 15 bp, Homo sapiens
gaaagtatttttgaa

SEQ ID NO: 2730240 - DNA, 20 bp, Homo sapiens
gaaagtcagatgcccagagg

SEQ ID NO: 2730241 - DNA, 21 bp, Homo sapiens
gaaagtgaataaacttcagca

SEQ ID NO: 2730242 - DNA, 20 bp, Homo sapiens
gaaataaggtataaggatct

SEQ ID NO: 2730243 - DNA, 11 bp, Homo sapiens
gaaatccagta

SEQ ID NO: 2730244 - DNA, 19 bp, Homo sapiens
gaaatcctggtttgtaatg

SEQ ID NO: 2730245 - DNA, 17 bp, Homo sapiens
gaaatcgccttatgaga

SEQ ID NO: 2730246 - DNA, 19 bp, Homo sapiens
gaaatcgccttatgagaac

SEQ ID NO: 2730247 - DNA, 20 bp, Homo sapiens
gaaattgtctagcagagcag

SEQ ID NO: 2730248 - DNA, 19 bp, Homo sapiens
gaaatttccactcaggtct

SEQ ID NO: 2730249 - DNA, 18 bp, Homo sapiens
gaaattttactgacagaa

SEQ ID NO: 2730250 - DNA, 16 bp, Homo sapiens
gaaatttttttccaga

SEQ ID NO: 2730251 - DNA, 17 bp, Homo sapiens
gaacaaaaattgggttt

SEQ ID NO: 2730252 - DNA, 19 bp, Homo sapiens
gaacaatcacaaaagctgt

SEQ ID NO: 2730253 - DNA, 23 bp, Homo sapiens
gaacaatcacaaaagctgtgtct

SEQ ID NO: 2730254 - DNA, 15 bp, Homo sapiens
gaacaatgtcagaaa

SEQ ID NO: 2730255 - DNA, 17 bp, Homo sapiens
gaacacccactggccag

SEQ ID NO: 2730256 - DNA, 14 bp, Homo sapiens
gaacagtgctctgc

SEQ ID NO: 2730257 - DNA, 19 bp, Homo sapiens
gaacattcgaggtgtcacc

SEQ ID NO: 2730258 - DNA, 23 bp, Homo sapiens
gaacattcgaggtgtcaccctgc

SEQ ID NO: 2730259 - DNA, 17 bp, Homo sapiens
gaacattgggaaggaag

SEQ ID NO: 2730260 - DNA, 22 bp, Homo sapiens
gaaccaggctgctgcatggcac

SEQ ID NO: 2730261 - DNA, 18 bp, Homo sapiens
gaaccccagacctctgaa

SEQ ID NO: 2730262 - DNA, 22 bp, Homo sapiens
gaaccgacttttctaaagctct

SEQ ID NO: 2730263 - DNA, 14 bp, Homo sapiens
gaaccgtttacagt

SEQ ID NO: 2730264 - DNA, 21 bp, Homo sapiens
gaactaggagtcttcactgct

SEQ ID NO: 2730265 - DNA, 12 bp, Homo sapiens
gaactgagactg

SEQ ID NO: 2730266 - DNA, 15 bp, Homo sapiens
gaactgcatggggag

SEQ ID NO: 2730267 - DNA, 16 bp, Homo sapiens
gaactgcatggggagt

SEQ ID NO: 2730268 - DNA, 11 bp, Homo sapiens
gaactgctggg

SEQ ID NO: 2730269 - DNA, 13 bp, Homo sapiens
gaactgctggggc

SEQ ID NO: 2730270 - DNA, 16 bp, Homo sapiens
gaactggacgcccagc

SEQ ID NO: 2730271 - DNA, 12 bp, Homo sapiens
gaactggccact

SEQ ID NO: 2730272 - DNA, 20 bp, Homo sapiens
gaactggtcaccatgaaact

SEQ ID NO: 2730273 - DNA, 15 bp, Homo sapiens
gaagaacaaaaggct

SEQ ID NO: 2730274 - DNA, 19 bp, Homo sapiens
gaagacacagcccagacaa

SEQ ID NO: 2730275 - DNA, 21 bp, Homo sapiens
gaagacacagcccagacaaga

SEQ ID NO: 2730276 - DNA, 15 bp, Homo sapiens
gaagacaggacagtg

SEQ ID NO: 2730277 - DNA, 23 bp, Homo sapiens
gaagaccaatctcttgaatccca

SEQ ID NO: 2730278 - DNA, 15 bp, Homo sapiens
gaagacttcaatatt

SEQ ID NO: 2730279 - DNA, 15 bp, Homo sapiens
gaagagtcatgtggg

SEQ ID NO: 2730280 - DNA, 19 bp, Homo sapiens
gaagatctgcttccctggg

SEQ ID NO: 2730281 - DNA, 19 bp, Homo sapiens
gaagatgaaaccgtccctg

SEQ ID NO: 2730282 - DNA, 14 bp, Homo sapiens
gaagcaagccggca

SEQ ID NO: 2730283 - DNA, 22 bp, Homo sapiens
gaagcaggttgaggggctcctg

SEQ ID NO: 2730284 - DNA, 15 bp, Homo sapiens
gaagcatcctcccca

SEQ ID NO: 2730285 - DNA, 16 bp, Homo sapiens
gaagcatcctccccac

SEQ ID NO: 2730286 - DNA, 18 bp, Homo sapiens
gaagcatcctccccacca

SEQ ID NO: 2730287 - DNA, 20 bp, Homo sapiens
gaagcatcctccccaccaga

SEQ ID NO: 2730288 - DNA, 23 bp, Homo sapiens
gaagcatcctccccaccagagct

SEQ ID NO: 2730289 - DNA, 17 bp, Homo sapiens
gaagctataaagaaaag

SEQ ID NO: 2730290 - DNA, 19 bp, Homo sapiens
gaagctgggactcattcac

SEQ ID NO: 2730291 - DNA, 22 bp, Homo sapiens
gaagctgggactcattcacatt

SEQ ID NO: 2730292 - DNA, 18 bp, Homo sapiens
gaaggaagcaagccggca

SEQ ID NO: 2730293 - DNA, 15 bp, Homo sapiens
gaaggacccaagaaa

SEQ ID NO: 2730294 - DNA, 17 bp, Homo sapiens
gaaggactggccgtggc

SEQ ID NO: 2730295 - DNA, 16 bp, Homo sapiens
gaaggagattttaagg

SEQ ID NO: 2730296 - DNA, 23 bp, Homo sapiens
gaaggagccagccaggactcctt

SEQ ID NO: 2730297 - DNA, 22 bp, Homo sapiens
gaaggatggttgtctcactgtt

SEQ ID NO: 2730298 - DNA, 13 bp, Homo sapiens
gaaggcctcccct

SEQ ID NO: 2730299 - DNA, 16 bp, Homo sapiens
gaaggctggctgggca

SEQ ID NO: 2730300 - DNA, 23 bp, Homo sapiens
gaaggctttgccatgggcctgct

SEQ ID NO: 2730301 - DNA, 15 bp, Homo sapiens
gaagggagggagctg

SEQ ID NO: 2730302 - DNA, 19 bp, Homo sapiens
gaagggcatccttctgcct

SEQ ID NO: 2730303 - DNA, 15 bp, Homo sapiens
gaagggcctgctctg

SEQ ID NO: 2730304 - DNA, 23 bp, Homo sapiens
gaaggggccctggtccttccagg

SEQ ID NO: 2730305 - DNA, 15 bp, Homo sapiens
gaagggtcatttctc

SEQ ID NO: 2730306 - DNA, 15 bp, Homo sapiens
gaaggtgtcatttga

SEQ ID NO: 2730307 - DNA, 18 bp, Homo sapiens
gaagtaactcccactcct

SEQ ID NO: 2730308 - DNA, 22 bp, Homo sapiens
gaagtaagcagagttctttgca

SEQ ID NO: 2730309 - DNA, 14 bp, Homo sapiens
gaagtactttgtgc

SEQ ID NO: 2730310 - DNA, 21 bp, Homo sapiens
gaagtcattgtcgctcagcaa

SEQ ID NO: 2730311 - DNA, 18 bp, Homo sapiens
gaagtgcagctcaggaga

SEQ ID NO: 2730312 - DNA, 13 bp, Homo sapiens
gaagtggccaggg

SEQ ID NO: 2730313 - DNA, 15 bp, Homo sapiens
gaagtggccagggct

SEQ ID NO: 2730314 - DNA, 18 bp, Homo sapiens
gaagtgtcgagtccagtc

SEQ ID NO: 2730315 - DNA, 22 bp, Homo sapiens
gaagttggtcttactttgtgca

SEQ ID NO: 2730316 - DNA, 16 bp, Homo sapiens
gaataaacttcagcac

SEQ ID NO: 2730317 - DNA, 17 bp, Homo sapiens
gaataaacttcagcacc

SEQ ID NO: 2730318 - DNA, 18 bp, Homo sapiens
gaataaacttcagcacca

SEQ ID NO: 2730319 - DNA, 17 bp, Homo sapiens
gaatattaatggaaaca

SEQ ID NO: 2730320 - DNA, 12 bp, Homo sapiens
gaatatttaaag

SEQ ID NO: 2730321 - DNA, 19 bp, Homo sapiens
gaatcaacagtgaacagct

SEQ ID NO: 2730322 - DNA, 13 bp, Homo sapiens
gaatcctgggccc

SEQ ID NO: 2730323 - DNA, 14 bp, Homo sapiens
gaatcctgggcccc

SEQ ID NO: 2730324 - DNA, 16 bp, Homo sapiens
gaatcctgggccccca

SEQ ID NO: 2730325 - DNA, 19 bp, Homo sapiens
gaatcctgggcccccagag

SEQ ID NO: 2730326 - DNA, 12 bp, Homo sapiens
gaatctgcaggg

SEQ ID NO: 2730327 - DNA, 17 bp, Homo sapiens
gaatctgcagggagcaa

SEQ ID NO: 2730328 - DNA, 13 bp, Homo sapiens
gaatgaagcatgt

SEQ ID NO: 2730329 - DNA, 14 bp, Homo sapiens
gaatgaagcatgta

SEQ ID NO: 2730330 - DNA, 16 bp, Homo sapiens
gaatgaggaacaatca

SEQ ID NO: 2730331 - DNA, 21 bp, Homo sapiens
gaatgcacattggaagctccc

SEQ ID NO: 2730332 - DNA, 14 bp, Homo sapiens
gaatgcatgtaagg

SEQ ID NO: 2730333 - DNA, 23 bp, Homo sapiens
gaatgctgcccagggtcagtgta

SEQ ID NO: 2730334 - DNA, 22 bp, Homo sapiens
gaatggataagatgatgttaaa

SEQ ID NO: 2730335 - DNA, 21 bp, Homo sapiens
gaatggcctgccttgaagcca

SEQ ID NO: 2730336 - DNA, 19 bp, Homo sapiens
gaatgtgatcatctttgct

SEQ ID NO: 2730337 - DNA, 21 bp, Homo sapiens
gaatgtgatcatctttgctga

SEQ ID NO: 2730338 - DNA, 14 bp, Homo sapiens
gaatgtgattttaa

SEQ ID NO: 2730339 - DNA, 19 bp, Homo sapiens
gaatgtgattttaaagagt

SEQ ID NO: 2730340 - DNA, 23 bp, Homo sapiens
gaattatccctgctggctttctt

SEQ ID NO: 2730341 - DNA, 15 bp, Homo sapiens
gaattcacaaacaaa

SEQ ID NO: 2730342 - DNA, 12 bp, Homo sapiens
gaattctgactt

SEQ ID NO: 2730343 - DNA, 19 bp, Homo sapiens
gaattgaaggagaaaatgc

SEQ ID NO: 2730344 - DNA, 20 bp, Homo sapiens
gaattgaaggagaaaatgca

SEQ ID NO: 2730345 - DNA, 22 bp, Homo sapiens
gaattgcttgaacccaggaggt

SEQ ID NO: 2730346 - DNA, 20 bp, Homo sapiens
gaattggagaaaagcacaat

SEQ ID NO: 2730347 - DNA, 13 bp, Homo sapiens
gaatttaagcatg

SEQ ID NO: 2730348 - DNA, 22 bp, Homo sapiens
gaatttaagcatgagtggcctt

SEQ ID NO: 2730349 - DNA, 14 bp, Homo sapiens
gaatttagtcatta

SEQ ID NO: 2730350 - DNA, 14 bp, Homo sapiens
gaatttgtaagttt

SEQ ID NO: 2730351 - DNA, 22 bp, Homo sapiens
gaatttgtaagtttatgtctaa

SEQ ID NO: 2730352 - DNA, 16 bp, Homo sapiens
gaattttctttcatac

SEQ ID NO: 2730353 - DNA, 19 bp, Homo sapiens
gcaaacacacagactctgt

SEQ ID NO: 2730354 - DNA, 22 bp, Homo sapiens
gcaaactttaacaggttttctt

SEQ ID NO: 2730355 - DNA, 15 bp, Homo sapiens
gcaaagaactgcccc

SEQ ID NO: 2730356 - DNA, 16 bp, Homo sapiens
gcaaagaactgcccca

SEQ ID NO: 2730357 - DNA, 17 bp, Homo sapiens
gcaaagaactgccccat

SEQ ID NO: 2730358 - DNA, 14 bp, Homo sapiens
gcaaagaatcaaca

SEQ ID NO: 2730359 - DNA, 16 bp, Homo sapiens
gcaaagccatattcta

SEQ ID NO: 2730360 - DNA, 22 bp, Homo sapiens
gcaaagtctaaagtttacagta

SEQ ID NO: 2730361 - DNA, 20 bp, Homo sapiens
gcaacaaagacttgctttaa

SEQ ID NO: 2730362 - DNA, 11 bp, Homo sapiens
gcaacaaggtg

SEQ ID NO: 2730363 - DNA, 22 bp, Homo sapiens
gcaacaatacatgctgctaatt

SEQ ID NO: 2730364 - DNA, 15 bp, Homo sapiens
gcaacatggattcca

SEQ ID NO: 2730365 - DNA, 21 bp, Homo sapiens
gcaacatggattccaaagcat

SEQ ID NO: 2730366 - DNA, 18 bp, Homo sapiens
gcaacattaccttgtctt

SEQ ID NO: 2730367 - DNA, 14 bp, Homo sapiens
gcaaccctcagctg

SEQ ID NO: 2730368 - DNA, 17 bp, Homo sapiens
gcaagacagtggcacta

SEQ ID NO: 2730369 - DNA, 21 bp, Homo sapiens
gcaagacagtggcactaaaat

SEQ ID NO: 2730370 - DNA, 16 bp, Homo sapiens
gcaagacgtcctggaa

SEQ ID NO: 2730371 - DNA, 17 bp, Homo sapiens
gcaagacgtcctggaat

SEQ ID NO: 2730372 - DNA, 18 bp, Homo sapiens
gcaagacgtcctggaatg

SEQ ID NO: 2730373 - DNA, 19 bp, Homo sapiens
gcaagacttcactgcagcc

SEQ ID NO: 2730374 - DNA, 22 bp, Homo sapiens
gcaagacttcactgcagccttt

SEQ ID NO: 2730375 - DNA, 15 bp, Homo sapiens
gcaagcgtgctgcct

SEQ ID NO: 2730376 - DNA, 12 bp, Homo sapiens
gcaagctctgcc

SEQ ID NO: 2730377 - DNA, 17 bp, Homo sapiens
gcaagctctgcctcccg

SEQ ID NO: 2730378 - DNA, 16 bp, Homo sapiens
gcaaggaggctggctg

SEQ ID NO: 2730379 - DNA, 19 bp, Homo sapiens
gcaaggaggctggctgggg

SEQ ID NO: 2730380 - DNA, 20 bp, Homo sapiens
gcaaggaggctggctggggc

SEQ ID NO: 2730381 - DNA, 20 bp, Homo sapiens
gcaagtgttagaattgcctt

SEQ ID NO: 2730382 - DNA, 21 bp, Homo sapiens
gcaataaagtgtagcaccctg

SEQ ID NO: 2730383 - DNA, 13 bp, Homo sapiens
gcaatcattttat

SEQ ID NO: 2730384 - DNA, 22 bp, Homo sapiens
gcaatcattttatataaagaaa

SEQ ID NO: 2730385 - DNA, 23 bp, Homo sapiens
gcacaacgctctaccctgcagct

SEQ ID NO: 2730386 - DNA, 15 bp, Homo sapiens
gcacaagctccctgg

SEQ ID NO: 2730387 - DNA, 17 bp, Homo sapiens
gcacaatcaacttttct

SEQ ID NO: 2730388 - DNA, 16 bp, Homo sapiens
gcacagacctcagaga

SEQ ID NO: 2730389 - DNA, 18 bp, Homo sapiens
gcacagacctcagagatg

SEQ ID NO: 2730390 - DNA, 12 bp, Homo sapiens
gcacagccctcc

SEQ ID NO: 2730391 - DNA, 13 bp, Homo sapiens
gcacagccctccc

SEQ ID NO: 2730392 - DNA, 15 bp, Homo sapiens
gcacaggaggctccg

SEQ ID NO: 2730393 - DNA, 15 bp, Homo sapiens
gcacagtgtctgggc

SEQ ID NO: 2730394 - DNA, 19 bp, Homo sapiens
gcacatctaaattgatcat

SEQ ID NO: 2730395 - DNA, 18 bp, Homo sapiens
gcacatgattttcttttg

SEQ ID NO: 2730396 - DNA, 19 bp, Homo sapiens
gcacatgattttcttttgt

SEQ ID NO: 2730397 - DNA, 16 bp, Homo sapiens
gcacatgccagggaaa

SEQ ID NO: 2730398 - DNA, 13 bp, Homo sapiens
gcacatggctggg

SEQ ID NO: 2730399 - DNA, 13 bp, Homo sapiens
gcaccaaagacat

SEQ ID NO: 2730400 - DNA, 14 bp, Homo sapiens
gcaccaacccagcc

SEQ ID NO: 2730401 - DNA, 15 bp, Homo sapiens
gcaccaacccagccg

SEQ ID NO: 2730402 - DNA, 16 bp, Homo sapiens
gcaccaacccagccgc

SEQ ID NO: 2730403 - DNA, 18 bp, Homo sapiens
gcaccactgtgtatttaa

SEQ ID NO: 2730404 - DNA, 22 bp, Homo sapiens
gcaccattctttcttggtgcat

SEQ ID NO: 2730405 - DNA, 17 bp, Homo sapiens
gcacccagggtcccagc

SEQ ID NO: 2730406 - DNA, 15 bp, Homo sapiens
gcaccccctcctgct

SEQ ID NO: 2730407 - DNA, 19 bp, Homo sapiens
gcaccccctcctgctgcag

SEQ ID NO: 2730408 - DNA, 21 bp, Homo sapiens
gcacccgggctcagggaccac

SEQ ID NO: 2730409 - DNA, 13 bp, Homo sapiens
gcaccctcccctc

SEQ ID NO: 2730410 - DNA, 16 bp, Homo sapiens
gcaccctccgccttca

SEQ ID NO: 2730411 - DNA, 15 bp, Homo sapiens
gcaccgcagcatgtg

SEQ ID NO: 2730412 - DNA, 17 bp, Homo sapiens
gcaccgcagcatgtggg

SEQ ID NO: 2730413 - DNA, 21 bp, Homo sapiens
gcacctatagtcccagctact

SEQ ID NO: 2730414 - DNA, 20 bp, Homo sapiens
gcacctatggcccagccact

SEQ ID NO: 2730415 - DNA, 23 bp, Homo sapiens
gcacctatggcccagccactgca

SEQ ID NO: 2730416 - DNA, 23 bp, Homo sapiens
gcacctcccagtttgctgggttt

SEQ ID NO: 2730417 - DNA, 16 bp, Homo sapiens
gcacctgccccctggt

SEQ ID NO: 2730418 - DNA, 18 bp, Homo sapiens
gcacctgccccctggtgg

SEQ ID NO: 2730419 - DNA, 15 bp, Homo sapiens
gcacgcctgccttct

SEQ ID NO: 2730420 - DNA, 14 bp, Homo sapiens
gcacgtattttaat

SEQ ID NO: 2730421 - DNA, 17 bp, Homo sapiens
gcactaaaatgtttaat

SEQ ID NO: 2730422 - DNA, 23 bp, Homo sapiens
gcactaagtcatggtcctggctg

SEQ ID NO: 2730423 - DNA, 20 bp, Homo sapiens
gcactagcattttcttgaac

SEQ ID NO: 2730424 - DNA, 14 bp, Homo sapiens
gcactccagcctgg

SEQ ID NO: 2730425 - DNA, 21 bp, Homo sapiens
gcactccagcctgggcgacag

SEQ ID NO: 2730426 - DNA, 20 bp, Homo sapiens
gcactcctcggtactcccat

SEQ ID NO: 2730427 - DNA, 21 bp, Homo sapiens
gcactctctctctgttaaaga

SEQ ID NO: 2730428 - DNA, 20 bp, Homo sapiens
gcactctgtgcccatgggca

SEQ ID NO: 2730429 - DNA, 15 bp, Homo sapiens
gcactgctgggtggc

SEQ ID NO: 2730430 - DNA, 15 bp, Homo sapiens
gcactgtatgctgga

SEQ ID NO: 2730431 - DNA, 14 bp, Homo sapiens
gcactgtcctgctc

SEQ ID NO: 2730432 - DNA, 17 bp, Homo sapiens
gcactgtcctgctccac

SEQ ID NO: 2730433 - DNA, 22 bp, Homo sapiens
gcactgtcctgctccacagtgt

SEQ ID NO: 2730434 - DNA, 15 bp, Homo sapiens
gcagaaccagctcta

SEQ ID NO: 2730435 - DNA, 20 bp, Homo sapiens
gcagaatcctgggcccccag

SEQ ID NO: 2730436 - DNA, 22 bp, Homo sapiens
gcagaatcctgggcccccagag

SEQ ID NO: 2730437 - DNA, 17 bp, Homo sapiens
gcagaccgtgatttgga

SEQ ID NO: 2730438 - DNA, 16 bp, Homo sapiens
gcagagaatgtgaaca

SEQ ID NO: 2730439 - DNA, 18 bp, Homo sapiens
gcagaggagtccagggcg

SEQ ID NO: 2730440 - DNA, 17 bp, Homo sapiens
gcagaggggcaggccct

SEQ ID NO: 2730441 - DNA, 19 bp, Homo sapiens
gcagaggggcaggccctgc

SEQ ID NO: 2730442 - DNA, 18 bp, Homo sapiens
gcagaggggctttctgga

SEQ ID NO: 2730443 - DNA, 15 bp, Homo sapiens
gcagaggtgagcaga

SEQ ID NO: 2730444 - DNA, 19 bp, Homo sapiens
gcagaggtgagcagaggag

SEQ ID NO: 2730445 - DNA, 14 bp, Homo sapiens
gcagagttctttgc

SEQ ID NO: 2730446 - DNA, 16 bp, Homo sapiens
gcagatagtgcctctg

SEQ ID NO: 2730447 - DNA, 18 bp, Homo sapiens
gcagatagtgcctctgca

SEQ ID NO: 2730448 - DNA, 23 bp, Homo sapiens
gcagatctttttgtgaaattcaa

SEQ ID NO: 2730449 - DNA, 19 bp, Homo sapiens
gcagatttactgtcccagg

SEQ ID NO: 2730450 - DNA, 22 bp, Homo sapiens
gcagatttactgtcccaggagc

SEQ ID NO: 2730451 - DNA, 12 bp, Homo sapiens
gcagcacagcaa

SEQ ID NO: 2730452 - DNA, 15 bp, Homo sapiens
gcagcaggtgctgct

SEQ ID NO: 2730453 - DNA, 16 bp, Homo sapiens
gcagcaggtgctgcta

SEQ ID NO: 2730454 - DNA, 20 bp, Homo sapiens
gcagcaggtgctgctaccct

SEQ ID NO: 2730455 - DNA, 21 bp, Homo sapiens
gcagcatgtggggaagcaaga

SEQ ID NO: 2730456 - DNA, 23 bp, Homo sapiens
gcagccccgcgcctccttccttg

SEQ ID NO: 2730457 - DNA, 19 bp, Homo sapiens
gcagccgcctcccttatgc

SEQ ID NO: 2730458 - DNA, 22 bp, Homo sapiens
gcagcctccagtgctggctgct

SEQ ID NO: 2730459 - DNA, 23 bp, Homo sapiens
gcagcctccagtgctggctgctg

SEQ ID NO: 2730460 - DNA, 23 bp, Homo sapiens
gcagcctccctctgacctgcagg

SEQ ID NO: 2730461 - DNA, 18 bp, Homo sapiens
gcagcctgaccccaggca

SEQ ID NO: 2730462 - DNA, 16 bp, Homo sapiens
gcagcctttcacagga

SEQ ID NO: 2730463 - DNA, 20 bp, Homo sapiens
gcagcgcctgtcccctcaca

SEQ ID NO: 2730464 - DNA, 20 bp, Homo sapiens
gcagctgctgccactctgct

SEQ ID NO: 2730465 - DNA, 12 bp, Homo sapiens
gcagctgggccc

SEQ ID NO: 2730466 - DNA, 14 bp, Homo sapiens
gcagctgggcccac

SEQ ID NO: 2730467 - DNA, 15 bp, Homo sapiens
gcagctgggcccaca

SEQ ID NO: 2730468 - DNA, 17 bp, Homo sapiens
gcagctgggcccacagc

SEQ ID NO: 2730469 - DNA, 19 bp, Homo sapiens
gcagctgggcccacagccc

SEQ ID NO: 2730470 - DNA, 18 bp, Homo sapiens
gcagctgtagctcccgag

SEQ ID NO: 2730471 - DNA, 13 bp, Homo sapiens
gcagcttcctgtc

SEQ ID NO: 2730472 - DNA, 20 bp, Homo sapiens
gcagcttctgccacttccca

SEQ ID NO: 2730473 - DNA, 16 bp, Homo sapiens
gcagctttgggaaagc

SEQ ID NO: 2730474 - DNA, 20 bp, Homo sapiens
gcagcttttagttcagactt

SEQ ID NO: 2730475 - DNA, 13 bp, Homo sapiens
gcaggaggaggtg

SEQ ID NO: 2730476 - DNA, 16 bp, Homo sapiens
gctagtctcttctcag

SEQ ID NO: 2730477 - DNA, 14 bp, Homo sapiens
gctatattttcatg

SEQ ID NO: 2730478 - DNA, 14 bp, Homo sapiens
gctattaagaaact

SEQ ID NO: 2730479 - DNA, 20 bp, Homo sapiens
gctattagaagggctgaata

SEQ ID NO: 2730480 - DNA, 17 bp, Homo sapiens
gctattcagataaggca

SEQ ID NO: 2730481 - DNA, 16 bp, Homo sapiens
gctattcccttctgat

SEQ ID NO: 2730482 - DNA, 22 bp, Homo sapiens
gctattcccttctgatcttgga

SEQ ID NO: 2730483 - DNA, 18 bp, Homo sapiens
gctatttctatgtatgtg

SEQ ID NO: 2730484 - DNA, 22 bp, Homo sapiens
gctatttctatgtatgtgccaa

SEQ ID NO: 2730485 - DNA, 15 bp, Homo sapiens
gctattttaataaag

SEQ ID NO: 2730486 - DNA, 15 bp, Homo sapiens
gctcacattcccaag

SEQ ID NO: 2730487 - DNA, 16 bp, Homo sapiens
gctcacgactcttcct

SEQ ID NO: 2730488 - DNA, 19 bp, Homo sapiens
gctcacgactcttcctgca

SEQ ID NO: 2730489 - DNA, 14 bp, Homo sapiens
gctcagcagcccca

SEQ ID NO: 2730490 - DNA, 23 bp, Homo sapiens
gctcagcagccccaccccaccct

SEQ ID NO: 2730491 - DNA, 21 bp, Homo sapiens
gctcagctgtggtcccaccca

SEQ ID NO: 2730492 - DNA, 13 bp, Homo sapiens
gctcaggaggctt

SEQ ID NO: 2730493 - DNA, 15 bp, Homo sapiens
gctcaggaggcttgg

SEQ ID NO: 2730494 - DNA, 17 bp, Homo sapiens
gctcaggaggcttggaa

SEQ ID NO: 2730495 - DNA, 18 bp, Homo sapiens
gctcagggaccacagcaa

SEQ ID NO: 2730496 - DNA, 20 bp, Homo sapiens
gctcagggaccacagcaagg

SEQ ID NO: 2730497 - DNA, 16 bp, Homo sapiens
gctcaggtcctgctgc

SEQ ID NO: 2730498 - DNA, 14 bp, Homo sapiens
gctcagtctcagga

SEQ ID NO: 2730499 - DNA, 20 bp, Homo sapiens
gctcagtctcaggagcatgg

SEQ ID NO: 2730500 - DNA, 19 bp, Homo sapiens
gctcataagctgtagaact

SEQ ID NO: 2730501 - DNA, 16 bp, Homo sapiens
gctcatcagaactgaa

SEQ ID NO: 2730502 - DNA, 21 bp, Homo sapiens
gctccagaatgtgctgccttt

SEQ ID NO: 2730503 - DNA, 12 bp, Homo sapiens
gctccatgctgg

SEQ ID NO: 2730504 - DNA, 22 bp, Homo sapiens
gctccatgctggtgtggccaag

SEQ ID NO: 2730505 - DNA, 13 bp, Homo sapiens
gctcccaccaggc

SEQ ID NO: 2730506 - DNA, 23 bp, Homo sapiens
gctcccaccaggcagctccagct

SEQ ID NO: 2730507 - DNA, 20 bp, Homo sapiens
gctcccacggggaccactgg

SEQ ID NO: 2730508 - DNA, 23 bp, Homo sapiens
gctcccacggggaccactgggcc

SEQ ID NO: 2730509 - DNA, 19 bp, Homo sapiens
gctcccagtgtcttcctgt

SEQ ID NO: 2730510 - DNA, 17 bp, Homo sapiens
gctcccccgggaggggc

SEQ ID NO: 2730511 - DNA, 23 bp, Homo sapiens
gctcccctgaggctggcatcctg

SEQ ID NO: 2730512 - DNA, 13 bp, Homo sapiens
gctccctcctgga

SEQ ID NO: 2730513 - DNA, 16 bp, Homo sapiens
gctccctcctggagca

SEQ ID NO: 2730514 - DNA, 19 bp, Homo sapiens
gctccctcctggagcatcc

SEQ ID NO: 2730515 - DNA, 17 bp, Homo sapiens
gctcctagcccagcaga

SEQ ID NO: 2730516 - DNA, 18 bp, Homo sapiens
gctcctagcccagcagag

SEQ ID NO: 2730517 - DNA, 11 bp, Homo sapiens
gctcctcccct

SEQ ID NO: 2730518 - DNA, 14 bp, Homo sapiens
gctcctcccctgcc

SEQ ID NO: 2730519 - DNA, 12 bp, Homo sapiens
gctcctccctct

SEQ ID NO: 2730520 - DNA, 14 bp, Homo sapiens
gctcctccctctgc

SEQ ID NO: 2730521 - DNA, 17 bp, Homo sapiens
gctcctccctctgcctc

SEQ ID NO: 2730522 - DNA, 23 bp, Homo sapiens
gctcctccctctgcctcatcctc

SEQ ID NO: 2730523 - DNA, 15 bp, Homo sapiens
gctcctgctgcacca

SEQ ID NO: 2730524 - DNA, 18 bp, Homo sapiens
gctcctgctgcaccaacc

SEQ ID NO: 2730525 - DNA, 22 bp, Homo sapiens
gctcctgctgcaccaacccagc

SEQ ID NO: 2730526 - DNA, 18 bp, Homo sapiens
gctcctggaaaggctcag

SEQ ID NO: 2730527 - DNA, 22 bp, Homo sapiens
gctcctggaaaggctcagtctc

SEQ ID NO: 2730528 - DNA, 23 bp, Homo sapiens
gctcctggaaaggctcagtctca

SEQ ID NO: 2730529 - DNA, 13 bp, Homo sapiens
gctcctgtcccta

SEQ ID NO: 2730530 - DNA, 17 bp, Homo sapiens
gctcctgtccctaccca

SEQ ID NO: 2730531 - DNA, 18 bp, Homo sapiens
gctcctgtccctacccac

SEQ ID NO: 2730532 - DNA, 13 bp, Homo sapiens
gctcgccccaccc

SEQ ID NO: 2730533 - DNA, 15 bp, Homo sapiens
gctcgccccacccag

SEQ ID NO: 2730534 - DNA, 18 bp, Homo sapiens
gctcgcctctgcccagcc

SEQ ID NO: 2730535 - DNA, 15 bp, Homo sapiens
gctcgggcccaggcc

SEQ ID NO: 2730536 - DNA, 21 bp, Homo sapiens
gctcgtccacggtcttctgca

SEQ ID NO: 2730537 - DNA, 16 bp, Homo sapiens
gctctaccctgcagct

SEQ ID NO: 2730538 - DNA, 12 bp, Homo sapiens
gctctatctgca

SEQ ID NO: 2730539 - DNA, 23 bp, Homo sapiens
gctctatgtgggaaaaaagaaat

SEQ ID NO: 2730540 - DNA, 14 bp, Homo sapiens
gctctcctgctgca

SEQ ID NO: 2730541 - DNA, 16 bp, Homo sapiens
gctctgcctcccgtgt

SEQ ID NO: 2730542 - DNA, 14 bp, Homo sapiens
gctctgctggaaga

SEQ ID NO: 2730543 - DNA, 14 bp, Homo sapiens
gctctgcttttcct

SEQ ID NO: 2730544 - DNA, 17 bp, Homo sapiens
gctctgtcaccctggcc

SEQ ID NO: 2730545 - DNA, 12 bp, Homo sapiens
gctctgtgggct

SEQ ID NO: 2730546 - DNA, 21 bp, Homo sapiens
gctcttacttcccccaccctg

SEQ ID NO: 2730547 - DNA, 14 bp, Homo sapiens
gctcttatttttgt

SEQ ID NO: 2730548 - DNA, 13 bp, Homo sapiens
gctctttctgggc

SEQ ID NO: 2730549 - DNA, 14 bp, Homo sapiens
gctctttctgggcc

SEQ ID NO: 2730550 - DNA, 20 bp, Homo sapiens
gctgaacagtgctctgcctc

SEQ ID NO: 2730551 - DNA, 21 bp, Homo sapiens
gctgaacagtgctctgcctct

SEQ ID NO: 2730552 - DNA, 22 bp, Homo sapiens
gctgaattgagctagaaatcac

SEQ ID NO: 2730553 - DNA, 15 bp, Homo sapiens
gctgacagagccaga

SEQ ID NO: 2730554 - DNA, 21 bp, Homo sapiens
gctgacccagtgtgtgctcag

SEQ ID NO: 2730555 - DNA, 12 bp, Homo sapiens
gctgagccctgg

SEQ ID NO: 2730556 - DNA, 13 bp, Homo sapiens
gctgagccctggc

SEQ ID NO: 2730557 - DNA, 15 bp, Homo sapiens
gctgagccctggcag

SEQ ID NO: 2730558 - DNA, 12 bp, Homo sapiens
gctgaggcctcc

SEQ ID NO: 2730559 - DNA, 15 bp, Homo sapiens
gctgatgaggatcag

SEQ ID NO: 2730560 - DNA, 21 bp, Homo sapiens
gctgatgcattcccggtgcag

SEQ ID NO: 2730561 - DNA, 19 bp, Homo sapiens
gctgatgctgggctgggtg

SEQ ID NO: 2730562 - DNA, 14 bp, Homo sapiens
gctgattttttaaa

SEQ ID NO: 2730563 - DNA, 17 bp, Homo sapiens
gctgcaccaacccagcc

SEQ ID NO: 2730564 - DNA, 18 bp, Homo sapiens
gctgcacctgccagcctg

SEQ ID NO: 2730565 - DNA, 20 bp, Homo sapiens
gctgcacctgccagcctggc

SEQ ID NO: 2730566 - DNA, 16 bp, Homo sapiens
gctgcacgtcaccctc

SEQ ID NO: 2730567 - DNA, 23 bp, Homo sapiens
gctgcacgtcaccctcctgagcc

SEQ ID NO: 2730568 - DNA, 23 bp, Homo sapiens
gctgcactctgtgcccatgggca

SEQ ID NO: 2730569 - DNA, 12 bp, Homo sapiens
gctgcagagggg

SEQ ID NO: 2730570 - DNA, 19 bp, Homo sapiens
gctgcagaggggcaggccc

SEQ ID NO: 2730571 - DNA, 20 bp, Homo sapiens
gctgcagaggggcaggccct

SEQ ID NO: 2730572 - DNA, 23 bp, Homo sapiens
gctgcagaggggcaggccctgca

SEQ ID NO: 2730573 - DNA, 12 bp, Homo sapiens
gctgcagcttcc

SEQ ID NO: 2730574 - DNA, 14 bp, Homo sapiens
gctgcagcttcctg

SEQ ID NO: 2730575 - DNA, 20 bp, Homo sapiens
gctgcagtgacgtgcacctg

SEQ ID NO: 2730576 - DNA, 18 bp, Homo sapiens
gctgccactctgctgcct

SEQ ID NO: 2730577 - DNA, 19 bp, Homo sapiens
gctgccactctgctgcctg

SEQ ID NO: 2730578 - DNA, 22 bp, Homo sapiens
gctgccactctgctgcctgtac

SEQ ID NO: 2730579 - DNA, 12 bp, Homo sapiens
gctgcccgctcc

SEQ ID NO: 2730580 - DNA, 19 bp, Homo sapiens
gctgcccgctcccagtgtc

SEQ ID NO: 2730581 - DNA, 18 bp, Homo sapiens
gctgcccggcgccctctg

SEQ ID NO: 2730582 - DNA, 15 bp, Homo sapiens
gctgccctgccactt

SEQ ID NO: 2730583 - DNA, 15 bp, Homo sapiens
gctgcctccccaatc

SEQ ID NO: 2730584 - DNA, 17 bp, Homo sapiens
gctgcctctcttctgtg

SEQ ID NO: 2730585 - DNA, 15 bp, Homo sapiens
gctgcctgaaaacca

SEQ ID NO: 2730586 - DNA, 17 bp, Homo sapiens
gctgcgggctgagggca

SEQ ID NO: 2730587 - DNA, 14 bp, Homo sapiens
gctgctaccctccc

SEQ ID NO: 2730588 - DNA, 16 bp, Homo sapiens
gctgctaccctccctg

SEQ ID NO: 2730589 - DNA, 18 bp, Homo sapiens
gctgctaccctccctgct

SEQ ID NO: 2730590 - DNA, 20 bp, Homo sapiens
gctgctaccctccctgctgt

SEQ ID NO: 2730591 - DNA, 21 bp, Homo sapiens
gctgctaccctccctgctgtc

SEQ ID NO: 2730592 - DNA, 22 bp, Homo sapiens
gctgctaccctccctgctgtcc

SEQ ID NO: 2730593 - DNA, 23 bp, Homo sapiens
gctgctaccctccctgctgtccc

SEQ ID NO: 2730594 - DNA, 12 bp, Homo sapiens
gctgctctgcta

SEQ ID NO: 2730595 - DNA, 16 bp, Homo sapiens
gctgctgagcaggaac

SEQ ID NO: 2730596 - DNA, 13 bp, Homo sapiens
gctgctgccactc

SEQ ID NO: 2730597 - DNA, 19 bp, Homo sapiens
gctgctgccactctgctgc

SEQ ID NO: 2730598 - DNA, 21 bp, Homo sapiens
gctgctggcccacagctctgc

SEQ ID NO: 2730599 - DNA, 17 bp, Homo sapiens
gctgctgggggctcccc

SEQ ID NO: 2730600 - DNA, 22 bp, Homo sapiens
gggctgggtgcgaccccatctg

SEQ ID NO: 2730601 - DNA, 21 bp, Homo sapiens
gggctggtgaggccggccctg

SEQ ID NO: 2730602 - DNA, 23 bp, Homo sapiens
gggctggtgaggccggccctgcc

SEQ ID NO: 2730603 - DNA, 24 bp, Homo sapiens
gggcttgttgtttttaagtcctgt

SEQ ID NO: 2730604 - DNA, 23 bp, Homo sapiens
ggggaagatgaaaccgtccctga

SEQ ID NO: 2730605 - DNA, 22 bp, Homo sapiens
ggggaagcaagacgtcctggaa

SEQ ID NO: 2730606 - DNA, 13 bp, Homo sapiens
ggggaagctgcta

SEQ ID NO: 2730607 - DNA, 16 bp, Homo sapiens
ggggaccactgggccc

SEQ ID NO: 2730608 - DNA, 21 bp, Homo sapiens
ggggaccactgggcccctcag

SEQ ID NO: 2730609 - DNA, 12 bp, Homo sapiens
ggggactgggcc

SEQ ID NO: 2730610 - DNA, 13 bp, Homo sapiens
ggggactgggcca

SEQ ID NO: 2730611 - DNA, 15 bp, Homo sapiens
ggggagaaggcctcc

SEQ ID NO: 2730612 - DNA, 17 bp, Homo sapiens
ggggagccaacagcagc

SEQ ID NO: 2730613 - DNA, 17 bp, Homo sapiens
ggggcactcccccagga

SEQ ID NO: 2730614 - DNA, 14 bp, Homo sapiens
ggggcaggcacagc

SEQ ID NO: 2730615 - DNA, 21 bp, Homo sapiens
ggggcaggccctgcactgtcc

SEQ ID NO: 2730616 - DNA, 22 bp, Homo sapiens
ggggcaggccctgcactgtcct

SEQ ID NO: 2730617 - DNA, 23 bp, Homo sapiens
ggggcccgcttgcctcggctcct

SEQ ID NO: 2730618 - DNA, 19 bp, Homo sapiens
ggggcctatcagtgtgccc

SEQ ID NO: 2730619 - DNA, 23 bp, Homo sapiens
ggggcctatcagtgtgcccccca

SEQ ID NO: 2730620 - DNA, 12 bp, Homo sapiens
ggggcctccctg

SEQ ID NO: 2730621 - DNA, 11 bp, Homo sapiens
ggggctcctgg

SEQ ID NO: 2730622 - DNA, 13 bp, Homo sapiens
ggggctcctggaa

SEQ ID NO: 2730623 - DNA, 15 bp, Homo sapiens
ggggctgcccgctcc

SEQ ID NO: 2730624 - DNA, 13 bp, Homo sapiens
ggggctgctgggg

SEQ ID NO: 2730625 - DNA, 23 bp, Homo sapiens
ggggctgggttggcgcaccctcc

SEQ ID NO: 2730626 - DNA, 17 bp, Homo sapiens
gggggaagagcacagcc

SEQ ID NO: 2730627 - DNA, 19 bp, Homo sapiens
gggggaagagcacagccct

SEQ ID NO: 2730628 - DNA, 17 bp, Homo sapiens
gggggagccaacagcag

SEQ ID NO: 2730629 - DNA, 18 bp, Homo sapiens
gggggagccaacagcagc

SEQ ID NO: 2730630 - DNA, 12 bp, Homo sapiens
ggggggagggca

SEQ ID NO: 2730631 - DNA, 22 bp, Homo sapiens
gggtaactcttggccagagctg

SEQ ID NO: 2730632 - DNA, 21 bp, Homo sapiens
gggtccaggggagggaaaagc

SEQ ID NO: 2730633 - DNA, 17 bp, Homo sapiens
gggtcccacttcccctc

SEQ ID NO: 2730634 - DNA, 12 bp, Homo sapiens
gggtcctcggcc

SEQ ID NO: 2730635 - DNA, 20 bp, Homo sapiens
gggtcctctgcttcctgagc

SEQ ID NO: 2730636 - DNA, 17 bp, Homo sapiens
gggtctctggattcctg

SEQ ID NO: 2730637 - DNA, 11 bp, Homo sapiens
gggtctgcttc

SEQ ID NO: 2730638 - DNA, 19 bp, Homo sapiens
gggtgagaacgtgcccagc

SEQ ID NO: 2730639 - DNA, 12 bp, Homo sapiens
gggtgagagagg

SEQ ID NO: 2730640 - DNA, 19 bp, Homo sapiens
gggtggcccatcccccctc

SEQ ID NO: 2730641 - DNA, 14 bp, Homo sapiens
gggtgggagagccc

SEQ ID NO: 2730642 - DNA, 13 bp, Homo sapiens
gggttgaaagaca

SEQ ID NO: 2730643 - DNA, 20 bp, Homo sapiens
gggttggcgcaccctcccct

SEQ ID NO: 2730644 - DNA, 17 bp, Homo sapiens
gggttttccaccctgga

SEQ ID NO: 2730645 - DNA, 16 bp, Homo sapiens
ggtaactcgaggtgga

SEQ ID NO: 2730646 - DNA, 19 bp, Homo sapiens
ggtaactcgaggtggaggg

SEQ ID NO: 2730647 - DNA, 20 bp, Homo sapiens
ggtaatttttttttgtaaag

SEQ ID NO: 2730648 - DNA, 17 bp, Homo sapiens
ggtacaggcaagcttgt

SEQ ID NO: 2730649 - DNA, 20 bp, Homo sapiens
ggtaccaggtctcctccacc

SEQ ID NO: 2730650 - DNA, 16 bp, Homo sapiens
ggtactgaaggcttct

SEQ ID NO: 2730651 - DNA, 12 bp, Homo sapiens
ggtagaagccag

SEQ ID NO: 2730652 - DNA, 13 bp, Homo sapiens
ggtagtactggga

SEQ ID NO: 2730653 - DNA, 14 bp, Homo sapiens
ggtcaccatgaaac

SEQ ID NO: 2730654 - DNA, 19 bp, Homo sapiens
ggtccaacccagcctgagt

SEQ ID NO: 2730655 - DNA, 16 bp, Homo sapiens
ggtcccagacagctgg

SEQ ID NO: 2730656 - DNA, 17 bp, Homo sapiens
ggtcccagacagctgga

SEQ ID NO: 2730657 - DNA, 20 bp, Homo sapiens
ggtcccagacagctggaccc

SEQ ID NO: 2730658 - DNA, 17 bp, Homo sapiens
ggtcccagcctggccac

SEQ ID NO: 2730659 - DNA, 11 bp, Homo sapiens
ggtcctggctg

SEQ ID NO: 2730660 - DNA, 16 bp, Homo sapiens
ggtcctggctggaagg

SEQ ID NO: 2730661 - DNA, 15 bp, Homo sapiens
ggtcctggggctctg

SEQ ID NO: 2730662 - DNA, 16 bp, Homo sapiens
ggtcctttaggcagcc

SEQ ID NO: 2730663 - DNA, 15 bp, Homo sapiens
ggtctcacactcctc

SEQ ID NO: 2730664 - DNA, 20 bp, Homo sapiens
ggtctcgctgatgctgggct

SEQ ID NO: 2730665 - DNA, 17 bp, Homo sapiens
ggtctgctcgggcccag

SEQ ID NO: 2730666 - DNA, 12 bp, Homo sapiens
ggtcttctgcat

SEQ ID NO: 2730667 - DNA, 16 bp, Homo sapiens
ggtcttcttgtgtcct

SEQ ID NO: 2730668 - DNA, 18 bp, Homo sapiens
ggtcttgatctcctgagc

SEQ ID NO: 2730669 - DNA, 22 bp, Homo sapiens
ggtgacccatttcaggaggtgc

SEQ ID NO: 2730670 - DNA, 21 bp, Homo sapiens
ggtgaccccttttcagcttct

SEQ ID NO: 2730671 - DNA, 21 bp, Homo sapiens
ggtgacggtcctttaggcagc

SEQ ID NO: 2730672 - DNA, 23 bp, Homo sapiens
ggtgacggtcctttaggcagcct

SEQ ID NO: 2730673 - DNA, 17 bp, Homo sapiens
ggtgagaacgtgcccag

SEQ ID NO: 2730674 - DNA, 13 bp, Homo sapiens
ggtgagactctga

SEQ ID NO: 2730675 - DNA, 13 bp, Homo sapiens
ggtgaggcccagc

SEQ ID NO: 2730676 - DNA, 18 bp, Homo sapiens
ggtgaggccggccctgcc

SEQ ID NO: 2730677 - DNA, 19 bp, Homo sapiens
ggtgaggccggccctgccc

SEQ ID NO: 2730678 - DNA, 21 bp, Homo sapiens
ggtgaggccggccctgcccct

SEQ ID NO: 2730679 - DNA, 14 bp, Homo sapiens
ggtgagggagcctc

SEQ ID NO: 2730680 - DNA, 17 bp, Homo sapiens
ggtgcagaacaggggca

SEQ ID NO: 2730681 - DNA, 18 bp, Homo sapiens
ggtgcagaggtgagcaga

SEQ ID NO: 2730682 - DNA, 22 bp, Homo sapiens
ggtgcagaggtgagcagaggag

SEQ ID NO: 2730683 - DNA, 21 bp, Homo sapiens
ggtgcccagactcaaggcctc

SEQ ID NO: 2730684 - DNA, 19 bp, Homo sapiens
ggtgcgaccccatctgccc

SEQ ID NO: 2730685 - DNA, 22 bp, Homo sapiens
ggtgctcacgactcttcctgca

SEQ ID NO: 2730686 - DNA, 14 bp, Homo sapiens
ggtggacagtcctg

SEQ ID NO: 2730687 - DNA, 18 bp, Homo sapiens
ggtggacagtcctgggag

SEQ ID NO: 2730688 - DNA, 16 bp, Homo sapiens
ggtggatcacctgagg

SEQ ID NO: 2730689 - DNA, 15 bp, Homo sapiens
ggtggatggtgactt

SEQ ID NO: 2730690 - DNA, 18 bp, Homo sapiens
ggtggcagccctgtaggg

SEQ ID NO: 2730691 - DNA, 13 bp, Homo sapiens
ggtgggctgagcc

SEQ ID NO: 2730692 - DNA, 15 bp, Homo sapiens
ggtggggggagggca

SEQ ID NO: 2730693 - DNA, 18 bp, Homo sapiens
ggtggggggagggcaccc

SEQ ID NO: 2730694 - DNA, 14 bp, Homo sapiens
ggtggtctgctcgg

SEQ ID NO: 2730695 - DNA, 20 bp, Homo sapiens
ggtggtctgctcgggcccag

SEQ ID NO: 2730696 - DNA, 17 bp, Homo sapiens
ggtgtcaccctgcagag

SEQ ID NO: 2730697 - DNA, 19 bp, Homo sapiens
ggtgtcaccctgcagagct

SEQ ID NO: 2730698 - DNA, 17 bp, Homo sapiens
ggtgtcgcgccttctcc

SEQ ID NO: 2730699 - DNA, 20 bp, Homo sapiens
ggtgtcgcgccttctccccc

SEQ ID NO: 2730700 - DNA, 20 bp, Homo sapiens
ggtgtgaaagtcagatgccc

SEQ ID NO: 2730701 - DNA, 17 bp, Homo sapiens
ggtgtggataaggctta

SEQ ID NO: 2730702 - DNA, 18 bp, Homo sapiens
ggtgtggttccagaaatg

SEQ ID NO: 2730703 - DNA, 16 bp, Homo sapiens
ggtgttcataatttca

SEQ ID NO: 2730704 - DNA, 12 bp, Homo sapiens
ggttgaaagaca

SEQ ID NO: 2730705 - DNA, 20 bp, Homo sapiens
ggttggcgcaccctcccctc

SEQ ID NO: 2730706 - DNA, 20 bp, Homo sapiens
ggtttaagcaatgcttctgc

SEQ ID NO: 2730707 - DNA, 18 bp, Homo sapiens
ggtttcccagtgagcctc

SEQ ID NO: 2730708 - DNA, 19 bp, Homo sapiens
ggtttcccagtgagcctct

SEQ ID NO: 2730709 - DNA, 16 bp, Homo sapiens
ggtttgggatggagat

SEQ ID NO: 2730710 - DNA, 22 bp, Homo sapiens
ggtttgttattcttttccagaa

SEQ ID NO: 2730711 - DNA, 20 bp, Homo sapiens
gtaaaaagattatatatcat

SEQ ID NO: 2730712 - DNA, 18 bp, Homo sapiens
gtaaaatcttcagctggt

SEQ ID NO: 2730713 - DNA, 19 bp, Homo sapiens
gtaaaatcttcagctggtg

SEQ ID NO: 2730714 - DNA, 18 bp, Homo sapiens
gtaaataaattgtttgac

SEQ ID NO: 2730715 - DNA, 19 bp, Homo sapiens
gtaaatgagacacatacaa

SEQ ID NO: 2730716 - DNA, 18 bp, Homo sapiens
gtaaattttgtatgaaaa

SEQ ID NO: 2730717 - DNA, 22 bp, Homo sapiens
gtaactaccctctcaaatggac

SEQ ID NO: 2730718 - DNA, 18 bp, Homo sapiens
gtaactcccactcctaat

SEQ ID NO: 2730719 - DNA, 18 bp, Homo sapiens
gtaactcttggccagagc

SEQ ID NO: 2730720 - DNA, 19 bp, Homo sapiens
gtaactcttggccagagct

SEQ ID NO: 2730721 - DNA, 23 bp, Homo sapiens
gtaactttgcttgattaaacagc

SEQ ID NO: 2730722 - DNA, 19 bp, Homo sapiens
gtaagatggcttatttgta

SEQ ID NO: 2730723 - DNA, 16 bp, Homo sapiens
gtggatggtgactttt

SEQ ID NO: 2730724 - DNA, 22 bp, Homo sapiens
gtggattgggcagaatcctggg

SEQ ID NO: 2730725 - DNA, 12 bp, Homo sapiens
gtggcactaaaa

SEQ ID NO: 2730726 - DNA, 18 bp, Homo sapiens
gtggcattctctctgctc

SEQ ID NO: 2730727 - DNA, 19 bp, Homo sapiens
gtggcattctctctgctca

SEQ ID NO: 2730728 - DNA, 22 bp, Homo sapiens
gtggcattctctctgctcagtg

SEQ ID NO: 2730729 - DNA, 16 bp, Homo sapiens
gtggcattggcagcag

SEQ ID NO: 2730730 - DNA, 22 bp, Homo sapiens
gtggcattggcagcaggtgctg

SEQ ID NO: 2730731 - DNA, 12 bp, Homo sapiens
gtggccagggct

SEQ ID NO: 2730732 - DNA, 17 bp, Homo sapiens
gtggcccatcccccctc

SEQ ID NO: 2730733 - DNA, 13 bp, Homo sapiens
gtggccccagcct

SEQ ID NO: 2730734 - DNA, 17 bp, Homo sapiens
gtggccccagcctggcc

SEQ ID NO: 2730735 - DNA, 18 bp, Homo sapiens
gtggccccagcctggccc

SEQ ID NO: 2730736 - DNA, 19 bp, Homo sapiens
gtggccccagcctggccca

SEQ ID NO: 2730737 - DNA, 21 bp, Homo sapiens
gtggccccagcctggcccagc

SEQ ID NO: 2730738 - DNA, 23 bp, Homo sapiens
gtggcgtgatctcggctcactgc

SEQ ID NO: 2730739 - DNA, 23 bp, Homo sapiens
gtggctccagaatgtgctgcctt

SEQ ID NO: 2730740 - DNA, 18 bp, Homo sapiens
gtggctgtccagtgccca

SEQ ID NO: 2730741 - DNA, 13 bp, Homo sapiens
gtgggaggacaga

SEQ ID NO: 2730742 - DNA, 18 bp, Homo sapiens
gtgggaggacagagccgg

SEQ ID NO: 2730743 - DNA, 19 bp, Homo sapiens
gtgggcgggcagcacagca

SEQ ID NO: 2730744 - DNA, 17 bp, Homo sapiens
gtgggctcagatcctgg

SEQ ID NO: 2730745 - DNA, 13 bp, Homo sapiens
gtgggctgagccc

SEQ ID NO: 2730746 - DNA, 14 bp, Homo sapiens
gtgggctgagccct

SEQ ID NO: 2730747 - DNA, 18 bp, Homo sapiens
gtgggctgagccctggca

SEQ ID NO: 2730748 - DNA, 21 bp, Homo sapiens
gtgggctgcactctgtgccca

SEQ ID NO: 2730749 - DNA, 21 bp, Homo sapiens
gtgggggaagagcacagccct

SEQ ID NO: 2730750 - DNA, 17 bp, Homo sapiens
gtgggggctgtgccgtg

SEQ ID NO: 2730751 - DNA, 21 bp, Homo sapiens
gtgggggggagaaggcctccc

SEQ ID NO: 2730752 - DNA, 14 bp, Homo sapiens
gtggtcccacccag

SEQ ID NO: 2730753 - DNA, 18 bp, Homo sapiens
gtggtcccacccaggaag

SEQ ID NO: 2730754 - DNA, 19 bp, Homo sapiens
gtggtctgctcgggcccag

SEQ ID NO: 2730755 - DNA, 21 bp, Homo sapiens
gtggtttgatggtgacttcct

SEQ ID NO: 2730756 - DNA, 17 bp, Homo sapiens
gtgtaccacaccctgcc

SEQ ID NO: 2730757 - DNA, 19 bp, Homo sapiens
gtgtacccccgcccaggct

SEQ ID NO: 2730758 - DNA, 20 bp, Homo sapiens
gtgtagccccgggctgaccc

SEQ ID NO: 2730759 - DNA, 15 bp, Homo sapiens
gtgtatctaattccc

SEQ ID NO: 2730760 - DNA, 14 bp, Homo sapiens
gtgtatgttaatat

SEQ ID NO: 2730761 - DNA, 15 bp, Homo sapiens
gtgtcaactttcatt

SEQ ID NO: 2730762 - DNA, 13 bp, Homo sapiens
gtgtcccagtgaa

SEQ ID NO: 2730763 - DNA, 15 bp, Homo sapiens
gtgtcctctccagct

SEQ ID NO: 2730764 - DNA, 15 bp, Homo sapiens
gtgtcctgtctgctg

SEQ ID NO: 2730765 - DNA, 16 bp, Homo sapiens
gtgtcctgtctgctgg

SEQ ID NO: 2730766 - DNA, 20 bp, Homo sapiens
gtgtcctgtctgctgggcta

SEQ ID NO: 2730767 - DNA, 17 bp, Homo sapiens
gtgtcgagtccagtcct

SEQ ID NO: 2730768 - DNA, 15 bp, Homo sapiens
gtgtctctgcctgga

SEQ ID NO: 2730769 - DNA, 13 bp, Homo sapiens
gtgtctctgtata

SEQ ID NO: 2730770 - DNA, 12 bp, Homo sapiens
gtgtctgcagct

SEQ ID NO: 2730771 - DNA, 19 bp, Homo sapiens
gtgtgatcccaagtgccag

SEQ ID NO: 2730772 - DNA, 16 bp, Homo sapiens
gtgtgcccaccagcgg

SEQ ID NO: 2730773 - DNA, 18 bp, Homo sapiens
gtgtgccccccatcctgg

SEQ ID NO: 2730774 - DNA, 15 bp, Homo sapiens
gtgtggatgttcaga

SEQ ID NO: 2730775 - DNA, 20 bp, Homo sapiens
gtgtggccaaggctgagagc

SEQ ID NO: 2730776 - DNA, 14 bp, Homo sapiens
gtgtgggctgtgtc

SEQ ID NO: 2730777 - DNA, 13 bp, Homo sapiens
gtgtgtgctcagc

SEQ ID NO: 2730778 - DNA, 16 bp, Homo sapiens
gtgttactaaagtcac

SEQ ID NO: 2730779 - DNA, 18 bp, Homo sapiens
gtgttgatttgagaaatt

SEQ ID NO: 2730780 - DNA, 23 bp, Homo sapiens
gttaacagcgtgtcaactttcat

SEQ ID NO: 2730781 - DNA, 19 bp, Homo sapiens
gttaagatactcaagcagg

SEQ ID NO: 2730782 - DNA, 18 bp, Homo sapiens
gttaatatctgatactgt

SEQ ID NO: 2730783 - DNA, 12 bp, Homo sapiens
gttacttaaaca

SEQ ID NO: 2730784 - DNA, 20 bp, Homo sapiens
gttacttaaacatcattgga

SEQ ID NO: 2730785 - DNA, 21 bp, Homo sapiens
gttagaattgccttaaggcca

SEQ ID NO: 2730786 - DNA, 20 bp, Homo sapiens
gttagagaggtagcgagctg

SEQ ID NO: 2730787 - DNA, 17 bp, Homo sapiens
gttagcgtccatttctt

SEQ ID NO: 2730788 - DNA, 21 bp, Homo sapiens
gttagcgtccatttcttattt

SEQ ID NO: 2730789 - DNA, 19 bp, Homo sapiens
gttaggattaggtttagaa

SEQ ID NO: 2730790 - DNA, 17 bp, Homo sapiens
gttataacttcataaaa

SEQ ID NO: 2730791 - DNA, 21 bp, Homo sapiens
gttatatagtttagttctaag

SEQ ID NO: 2730792 - DNA, 17 bp, Homo sapiens
gttatgatggaaaggaa

SEQ ID NO: 2730793 - DNA, 17 bp, Homo sapiens
gttattaaaaaaacaca

SEQ ID NO: 2730794 - DNA, 20 bp, Homo sapiens
gttatttgtacagttcagtt

SEQ ID NO: 2730795 - DNA, 15 bp, Homo sapiens
gttcaagaccagcct

SEQ ID NO: 2730796 - DNA, 21 bp, Homo sapiens
gttcattcaaaatgtccagct

SEQ ID NO: 2730797 - DNA, 17 bp, Homo sapiens
gttcgagaccagcctgg

SEQ ID NO: 2730798 - DNA, 18 bp, Homo sapiens
gttcgagaccagcctggc

SEQ ID NO: 2730799 - DNA, 18 bp, Homo sapiens
gttctacttgatatttcc

SEQ ID NO: 2730800 - DNA, 20 bp, Homo sapiens
gttctgaccgggtctgcttc

SEQ ID NO: 2730801 - DNA, 22 bp, Homo sapiens
gttctgaccgggtctgcttctg

SEQ ID NO: 2730802 - DNA, 16 bp, Homo sapiens
gttctgctatatttgt

SEQ ID NO: 2730803 - DNA, 16 bp, Homo sapiens
gttctttgcaagctta

SEQ ID NO: 2730804 - DNA, 13 bp, Homo sapiens
gttgaaaaaagaa

SEQ ID NO: 2730805 - DNA, 16 bp, Homo sapiens
gttgaaagacatcaat

SEQ ID NO: 2730806 - DNA, 23 bp, Homo sapiens
gttgagaacaaaaattgggtttt

SEQ ID NO: 2730807 - DNA, 18 bp, Homo sapiens
gttgataaattccactgg

SEQ ID NO: 2730808 - DNA, 23 bp, Homo sapiens
gttgatattggttctatttattt

SEQ ID NO: 2730809 - DNA, 18 bp, Homo sapiens
gttgattgcgagaatttt

SEQ ID NO: 2730810 - DNA, 14 bp, Homo sapiens
gttgcaccattctt

SEQ ID NO: 2730811 - DNA, 17 bp, Homo sapiens
gttgcagtgaactgaga

SEQ ID NO: 2730812 - DNA, 21 bp, Homo sapiens
gttgcataaacaatccaaatg

SEQ ID NO: 2730813 - DNA, 22 bp, Homo sapiens
gttgctagcaaacaaatggctt

SEQ ID NO: 2730814 - DNA, 15 bp, Homo sapiens
gttgctcgaagactg

SEQ ID NO: 2730815 - DNA, 18 bp, Homo sapiens
gttgctgttgctgttgct

SEQ ID NO: 2730816 - DNA, 19 bp, Homo sapiens
gttggcgcaccctcccctc

SEQ ID NO: 2730817 - DNA, 21 bp, Homo sapiens
gttggcgcaccctcccctccc

SEQ ID NO: 2730818 - DNA, 18 bp, Homo sapiens
gttgggccatactggcct

SEQ ID NO: 2730819 - DNA, 19 bp, Homo sapiens
gttgggccatactggcctc

SEQ ID NO: 2730820 - DNA, 15 bp, Homo sapiens
gttggttctgcacta

SEQ ID NO: 2730821 - DNA, 13 bp, Homo sapiens
gttgtcactgaga

SEQ ID NO: 2730822 - DNA, 15 bp, Homo sapiens
gttgtctccctggcc

SEQ ID NO: 2730823 - DNA, 16 bp, Homo sapiens
gttgtctccctggccc

SEQ ID NO: 2730824 - DNA, 17 bp, Homo sapiens
gttgtctccctggccct

SEQ ID NO: 2730825 - DNA, 22 bp, Homo sapiens
gttgtctttctttgctgctgtg

SEQ ID NO: 2730826 - DNA, 13 bp, Homo sapiens
gttgtgtaataac

SEQ ID NO: 2730827 - DNA, 23 bp, Homo sapiens
gttgttaacacgtgacactgtgg

SEQ ID NO: 2730828 - DNA, 20 bp, Homo sapiens
gtttaaaaaaagtatatatt

SEQ ID NO: 2730829 - DNA, 19 bp, Homo sapiens
gtttaaaagtcacataaaa

SEQ ID NO: 2730830 - DNA, 21 bp, Homo sapiens
gtttaattcattaatctgttt

SEQ ID NO: 2730831 - DNA, 13 bp, Homo sapiens
gtttacagtaaat

SEQ ID NO: 2730832 - DNA, 19 bp, Homo sapiens
gtttacagtgtatttaaga

SEQ ID NO: 2730833 - DNA, 16 bp, Homo sapiens
gtttactcagtgaaat

SEQ ID NO: 2730834 - DNA, 21 bp, Homo sapiens
gtttagaatcaagtctgtgaa

SEQ ID NO: 2730835 - DNA, 14 bp, Homo sapiens
gtttcaatttactt

SEQ ID NO: 2730836 - DNA, 22 bp, Homo sapiens
gtttcaatttactttttaaaca

SEQ ID NO: 2730837 - DNA, 13 bp, Homo sapiens
gtttcatgagccc

SEQ ID NO: 2730838 - DNA, 17 bp, Homo sapiens
gtttcccagtgagcctc

SEQ ID NO: 2730839 - DNA, 21 bp, Homo sapiens
gtttccgtggcaaccctcagc

SEQ ID NO: 2730840 - DNA, 18 bp, Homo sapiens
gtttctcaaagaaatttc

SEQ ID NO: 2730841 - DNA, 14 bp, Homo sapiens
gtttctcaagttta

SEQ ID NO: 2730842 - DNA, 15 bp, Homo sapiens
gtttctcaagtttaa

SEQ ID NO: 2730843 - DNA, 18 bp, Homo sapiens
gtttgaaagtgaataaac

SEQ ID NO: 2730844 - DNA, 19 bp, Homo sapiens
gtttgaagaaccgcatttt

SEQ ID NO: 2730845 - DNA, 16 bp, Homo sapiens
gtttgacgaagaaaca

SEQ ID NO: 2730846 - DNA, 11 bp, Homo sapiens
tagaagcagaa

SEQ ID NO: 2730847 - DNA, 10 bp, Homo sapiens
tagaagccag

SEQ ID NO: 2730848 - DNA, 15 bp, Homo sapiens
tagaataaaattgta

SEQ ID NO: 2730849 - DNA, 16 bp, Homo sapiens
tagacgggttgaaaga

SEQ ID NO: 2730850 - DNA, 20 bp, Homo sapiens
tagacgggttgaaagacatc

SEQ ID NO: 2730851 - DNA, 23 bp, Homo sapiens
tagagaagtaagcagagttcttt

SEQ ID NO: 2730852 - DNA, 17 bp, Homo sapiens
tagagaggtagcgagct

SEQ ID NO: 2730853 - DNA, 18 bp, Homo sapiens
tagagaggtagcgagctg

SEQ ID NO: 2730854 - DNA, 17 bp, Homo sapiens
tagagatgactgagtcc

SEQ ID NO: 2730855 - DNA, 18 bp, Homo sapiens
tagagctcctgtccctac

SEQ ID NO: 2730856 - DNA, 23 bp, Homo sapiens
tagagctcctgtccctacccact

SEQ ID NO: 2730857 - DNA, 20 bp, Homo sapiens
tagaggccaaattaatcttt

SEQ ID NO: 2730858 - DNA, 14 bp, Homo sapiens
tagaggggttttag

SEQ ID NO: 2730859 - DNA, 18 bp, Homo sapiens
tagaggggttttagattt

SEQ ID NO: 2730860 - DNA, 14 bp, Homo sapiens
tagagtcagccttc

SEQ ID NO: 2730861 - DNA, 22 bp, Homo sapiens
tagagtgacaggcaccagatgg

SEQ ID NO: 2730862 - DNA, 18 bp, Homo sapiens
tagatcaacacttttctc

SEQ ID NO: 2730863 - DNA, 20 bp, Homo sapiens
tagatttcagctatgcagaa

SEQ ID NO: 2730864 - DNA, 12 bp, Homo sapiens
tagatttttaaa

SEQ ID NO: 2730865 - DNA, 11 bp, Homo sapiens
tagcaaagatt

SEQ ID NO: 2730866 - DNA, 22 bp, Homo sapiens
tagcaaggccagggcacagctg

SEQ ID NO: 2730867 - DNA, 12 bp, Homo sapiens
tagcactttata

SEQ ID NO: 2730868 - DNA, 18 bp, Homo sapiens
tagcatatataattttat

SEQ ID NO: 2730869 - DNA, 16 bp, Homo sapiens
tagcattttcttgaac

SEQ ID NO: 2730870 - DNA, 21 bp, Homo sapiens
tagccaaggtgggctgagccc

SEQ ID NO: 2730871 - DNA, 23 bp, Homo sapiens
tagccaaggtgggctgagccctg

SEQ ID NO: 2730872 - DNA, 18 bp, Homo sapiens
tagccccgggctgaccca

SEQ ID NO: 2730873 - DNA, 14 bp, Homo sapiens
tagcgagctgctct

SEQ ID NO: 2730874 - DNA, 18 bp, Homo sapiens
tagcgagctgctctgcta

SEQ ID NO: 2730875 - DNA, 17 bp, Homo sapiens
tagctaaaaccaaagga

SEQ ID NO: 2730876 - DNA, 19 bp, Homo sapiens
tagctggaactacaggctc

SEQ ID NO: 2730877 - DNA, 17 bp, Homo sapiens
tagcttcatatctaatt

SEQ ID NO: 2730878 - DNA, 22 bp, Homo sapiens
taggaaagcaccgcagcatgtg

SEQ ID NO: 2730879 - DNA, 13 bp, Homo sapiens
taggaagtgcccc

SEQ ID NO: 2730880 - DNA, 18 bp, Homo sapiens
taggactgacatttctat

SEQ ID NO: 2730881 - DNA, 17 bp, Homo sapiens
taggataaattacatta

SEQ ID NO: 2730882 - DNA, 16 bp, Homo sapiens
taggcagatctttaaa

SEQ ID NO: 2730883 - DNA, 18 bp, Homo sapiens
taggcagatctttaaata

SEQ ID NO: 2730884 - DNA, 14 bp, Homo sapiens
taggcagcctgccg

SEQ ID NO: 2730885 - DNA, 19 bp, Homo sapiens
taggcagggatttgaggag

SEQ ID NO: 2730886 - DNA, 19 bp, Homo sapiens
tagggaaaatagggtcctt

SEQ ID NO: 2730887 - DNA, 22 bp, Homo sapiens
tagggaaggtatatcaggaggg

SEQ ID NO: 2730888 - DNA, 19 bp, Homo sapiens
tagggcctcggaggctcct

SEQ ID NO: 2730889 - DNA, 20 bp, Homo sapiens
tagggcctcggaggctcctc

SEQ ID NO: 2730890 - DNA, 16 bp, Homo sapiens
taggggtaatatattg

SEQ ID NO: 2730891 - DNA, 17 bp, Homo sapiens
tagggtcctggccctct

SEQ ID NO: 2730892 - DNA, 20 bp, Homo sapiens
tagggtccttgaaacagaaa

SEQ ID NO: 2730893 - DNA, 21 bp, Homo sapiens
taggtttagaatcaagtctgt

SEQ ID NO: 2730894 - DNA, 23 bp, Homo sapiens
taggtttagaatcaagtctgtga

SEQ ID NO: 2730895 - DNA, 13 bp, Homo sapiens
tagtagtgtcttc

SEQ ID NO: 2730896 - DNA, 14 bp, Homo sapiens
tagtccctgtgttc

SEQ ID NO: 2730897 - DNA, 18 bp, Homo sapiens
tagtctctgggtttacaa

SEQ ID NO: 2730898 - DNA, 20 bp, Homo sapiens
tagtctcttctcagagcagc

SEQ ID NO: 2730899 - DNA, 17 bp, Homo sapiens
tagttcagacttagttt

SEQ ID NO: 2730900 - DNA, 16 bp, Homo sapiens
tagttgaaaaaagaag

SEQ ID NO: 2730901 - DNA, 21 bp, Homo sapiens
tagttgattgcgagaattttc

SEQ ID NO: 2730902 - DNA, 22 bp, Homo sapiens
tagttgattgcgagaattttca

SEQ ID NO: 2730903 - DNA, 13 bp, Homo sapiens
tagttgtctttct

SEQ ID NO: 2730904 - DNA, 17 bp, Homo sapiens
tataaaataaagcaaat

SEQ ID NO: 2730905 - DNA, 12 bp, Homo sapiens
tataaatatgtg

SEQ ID NO: 2730906 - DNA, 17 bp, Homo sapiens
tataacaaactatgtaa

SEQ ID NO: 2730907 - DNA, 15 bp, Homo sapiens
tataagccaatgaag

SEQ ID NO: 2730908 - DNA, 16 bp, Homo sapiens
tataaggatcttttgt

SEQ ID NO: 2730909 - DNA, 18 bp, Homo sapiens
tataaggatcttttgtaa

SEQ ID NO: 2730910 - DNA, 22 bp, Homo sapiens
tataatttaaagaaacactaaa

SEQ ID NO: 2730911 - DNA, 17 bp, Homo sapiens
tatacaaacaggtgcta

SEQ ID NO: 2730912 - DNA, 16 bp, Homo sapiens
tatacaaagccttggt

SEQ ID NO: 2730913 - DNA, 17 bp, Homo sapiens
tatacaagcaagcaaaa

SEQ ID NO: 2730914 - DNA, 17 bp, Homo sapiens
tatacataaacagtttt

SEQ ID NO: 2730915 - DNA, 20 bp, Homo sapiens
tatacataaacagttttgga

SEQ ID NO: 2730916 - DNA, 18 bp, Homo sapiens
tatacatgtttagtatta

SEQ ID NO: 2730917 - DNA, 17 bp, Homo sapiens
tatagagatatgcagaa

SEQ ID NO: 2730918 - DNA, 19 bp, Homo sapiens
tataggataaattacatta

SEQ ID NO: 2730919 - DNA, 22 bp, Homo sapiens
tataggataaattacattaaaa

SEQ ID NO: 2730920 - DNA, 15 bp, Homo sapiens
tataggcagatcttt

SEQ ID NO: 2730921 - DNA, 20 bp, Homo sapiens
tatagtcccagctactcaga

SEQ ID NO: 2730922 - DNA, 16 bp, Homo sapiens
tatagttgtctttctt

SEQ ID NO: 2730923 - DNA, 21 bp, Homo sapiens
tatagttgtctttctttgctg

SEQ ID NO: 2730924 - DNA, 13 bp, Homo sapiens
tatataacttatt

SEQ ID NO: 2730925 - DNA, 15 bp, Homo sapiens
tatatatcataaagt

SEQ ID NO: 2730926 - DNA, 17 bp, Homo sapiens
tatatctatatctctaa

SEQ ID NO: 2730927 - DNA, 21 bp, Homo sapiens
tatatctggatttttacaaat

SEQ ID NO: 2730928 - DNA, 14 bp, Homo sapiens
tatattcatcaaat

SEQ ID NO: 2730929 - DNA, 23 bp, Homo sapiens
tatattcatcaaataaaccttgt

SEQ ID NO: 2730930 - DNA, 22 bp, Homo sapiens
tatattccgggtgccattccca

SEQ ID NO: 2730931 - DNA, 13 bp, Homo sapiens
tatatttatcata

SEQ ID NO: 2730932 - DNA, 24 bp, Homo sapiens
tatattttcatgacttttccatgt

SEQ ID NO: 2730933 - DNA, 12 bp, Homo sapiens
tatcactcactg

SEQ ID NO: 2730934 - DNA, 13 bp, Homo sapiens
tatcagtgtgccc

SEQ ID NO: 2730935 - DNA, 17 bp, Homo sapiens
tatccacaaatgctatt

SEQ ID NO: 2730936 - DNA, 16 bp, Homo sapiens
tatccttggagagcag

SEQ ID NO: 2730937 - DNA, 19 bp, Homo sapiens
tatccttggagagcagctg

SEQ ID NO: 2730938 - DNA, 12 bp, Homo sapiens
tatctattgtgt

SEQ ID NO: 2730939 - DNA, 20 bp, Homo sapiens
tatctcgctagccatatatt

SEQ ID NO: 2730940 - DNA, 19 bp, Homo sapiens
tatctgagaagtgtatata

SEQ ID NO: 2730941 - DNA, 15 bp, Homo sapiens
tatctgatatctgtt

SEQ ID NO: 2730942 - DNA, 16 bp, Homo sapiens
tatctggccacactgg

SEQ ID NO: 2730943 - DNA, 14 bp, Homo sapiens
tatcttgaatttca

SEQ ID NO: 2730944 - DNA, 14 bp, Homo sapiens
tatctttatgcaaa

SEQ ID NO: 2730945 - DNA, 22 bp, Homo sapiens
tatctttggggaaactaacaat

SEQ ID NO: 2730946 - DNA, 16 bp, Homo sapiens
tatctttgtctaaaca

SEQ ID NO: 2730947 - DNA, 13 bp, Homo sapiens
tatgaaaagcaac

SEQ ID NO: 2730948 - DNA, 20 bp, Homo sapiens
tatgagaacatggtgtgtgt

SEQ ID NO: 2730949 - DNA, 19 bp, Homo sapiens
tatgagactgtgtttctag

SEQ ID NO: 2730950 - DNA, 13 bp, Homo sapiens
tatgatctactca

SEQ ID NO: 2730951 - DNA, 17 bp, Homo sapiens
tatgattgtttgcacag

SEQ ID NO: 2730952 - DNA, 21 bp, Homo sapiens
tatgattgtttgcacagaggg

SEQ ID NO: 2730953 - DNA, 15 bp, Homo sapiens
tatgcaaaaacatat

SEQ ID NO: 2730954 - DNA, 16 bp, Homo sapiens
tatggaatttttaagt

SEQ ID NO: 2730955 - DNA, 19 bp, Homo sapiens
tatggacatcgatatgaaa

SEQ ID NO: 2730956 - DNA, 20 bp, Homo sapiens
tatgtaatgcttatgtgttg

SEQ ID NO: 2730957 - DNA, 22 bp, Homo sapiens
tatgtaatttttaaagcaaata

SEQ ID NO: 2730958 - DNA, 18 bp, Homo sapiens
tatgtacagttcataaat

SEQ ID NO: 2730959 - DNA, 16 bp, Homo sapiens
tatgtaggatctgtca

SEQ ID NO: 2730960 - DNA, 16 bp, Homo sapiens
tatgtatatgtatatc

SEQ ID NO: 2730961 - DNA, 17 bp, Homo sapiens
tatgtatatgtatatct

SEQ ID NO: 2730962 - DNA, 19 bp, Homo sapiens
tatgtatatgtatatctat

SEQ ID NO: 2730963 - DNA, 12 bp, Homo sapiens
tatgtatctttg

SEQ ID NO: 2730964 - DNA, 20 bp, Homo sapiens
tatgtatgtgccaattttgt

SEQ ID NO: 2730965 - DNA, 12 bp, Homo sapiens
tatgtctaaaga

SEQ ID NO: 2730966 - DNA, 20 bp, Homo sapiens
tatgtctgtctttgcaaagg

SEQ ID NO: 2730967 - DNA, 17 bp, Homo sapiens
tatgtgccaattttgtc

SEQ ID NO: 2730968 - DNA, 19 bp, Homo sapiens
tatgtgccaattttgtcac

SEQ ID NO: 2730969 - DNA, 15 bp, Homo sapiens
tatgtgcctttttgt

SEQ ID NO: 2730970 - DNA, 21 bp, Homo sapiens
tccgcctagaggtcccctcac

SEQ ID NO: 2730971 - DNA, 18 bp, Homo sapiens
tccggagcgaccctggct

SEQ ID NO: 2730972 - DNA, 19 bp, Homo sapiens
tccggagcgaccctggctc

SEQ ID NO: 2730973 - DNA, 23 bp, Homo sapiens
tccggagcgaccctggctctgcc

SEQ ID NO: 2730974 - DNA, 14 bp, Homo sapiens
tccgggtgccattc

SEQ ID NO: 2730975 - DNA, 15 bp, Homo sapiens
tccggtgtgcctgca

SEQ ID NO: 2730976 - DNA, 18 bp, Homo sapiens
tccggtgtgcctgcagcc

SEQ ID NO: 2730977 - DNA, 11 bp, Homo sapiens
tccgtgagccc

SEQ ID NO: 2730978 - DNA, 12 bp, Homo sapiens
tccgtgagccct

SEQ ID NO: 2730979 - DNA, 13 bp, Homo sapiens
tcctaagcctgtt

SEQ ID NO: 2730980 - DNA, 22 bp, Homo sapiens
tcctaatcaagagtctctccag

SEQ ID NO: 2730981 - DNA, 13 bp, Homo sapiens
tcctaatgcatta

SEQ ID NO: 2730982 - DNA, 17 bp, Homo sapiens
tcctacaaccaggtctt

SEQ ID NO: 2730983 - DNA, 20 bp, Homo sapiens
tcctacacccttggacttga

SEQ ID NO: 2730984 - DNA, 16 bp, Homo sapiens
tcctacctcagcctag

SEQ ID NO: 2730985 - DNA, 18 bp, Homo sapiens
tcctagagctcctgtccc

SEQ ID NO: 2730986 - DNA, 12 bp, Homo sapiens
tcctcacactcc

SEQ ID NO: 2730987 - DNA, 15 bp, Homo sapiens
tcctcacactccaga

SEQ ID NO: 2730988 - DNA, 13 bp, Homo sapiens
tcctcatctgtgc

SEQ ID NO: 2730989 - DNA, 14 bp, Homo sapiens
tcctcatctgtgcc

SEQ ID NO: 2730990 - DNA, 15 bp, Homo sapiens
tcctcatctgtgcct

SEQ ID NO: 2730991 - DNA, 19 bp, Homo sapiens
tcctcatctgtgcctgtct

SEQ ID NO: 2730992 - DNA, 17 bp, Homo sapiens
tcctccactccacctcc

SEQ ID NO: 2730993 - DNA, 13 bp, Homo sapiens
tcctcccatggcc

SEQ ID NO: 2730994 - DNA, 20 bp, Homo sapiens
tcctcccatggccttccctc

SEQ ID NO: 2730995 - DNA, 22 bp, Homo sapiens
tcctccccaccagagctgcctc

SEQ ID NO: 2730996 - DNA, 13 bp, Homo sapiens
tcctcccctgccg

SEQ ID NO: 2730997 - DNA, 16 bp, Homo sapiens
tcctcccctgccgcct

SEQ ID NO: 2730998 - DNA, 14 bp, Homo sapiens
tcctccctctgcct

SEQ ID NO: 2730999 - DNA, 15 bp, Homo sapiens
tcctcctcccccaga

SEQ ID NO: 2731000 - DNA, 14 bp, Homo sapiens
tcctcctctccatg

SEQ ID NO: 2731001 - DNA, 12 bp, Homo sapiens
tcctcctgccag

SEQ ID NO: 2731002 - DNA, 21 bp, Homo sapiens
tcctcgggatgaaaagccata

SEQ ID NO: 2731003 - DNA, 15 bp, Homo sapiens
tcctcggtactccca

SEQ ID NO: 2731004 - DNA, 17 bp, Homo sapiens
tcctcggtactcccata

SEQ ID NO: 2731005 - DNA, 15 bp, Homo sapiens
tcctctatttcttta

SEQ ID NO: 2731006 - DNA, 16 bp, Homo sapiens
tcctctcagagcctca

SEQ ID NO: 2731007 - DNA, 19 bp, Homo sapiens
tcctctcagagcctcagct

SEQ ID NO: 2731008 - DNA, 23 bp, Homo sapiens
tcctctcagagcctcagcttctg

SEQ ID NO: 2731009 - DNA, 13 bp, Homo sapiens
tcctctgagccgc

SEQ ID NO: 2731010 - DNA, 17 bp, Homo sapiens
tcctctttgcatggaat

SEQ ID NO: 2731011 - DNA, 19 bp, Homo sapiens
tcctgaacaatattttctc

SEQ ID NO: 2731012 - DNA, 23 bp, Homo sapiens
tcctgacccggattggccctgcc

SEQ ID NO: 2731013 - DNA, 14 bp, Homo sapiens
tcctgacctcgtga

SEQ ID NO: 2731014 - DNA, 19 bp, Homo sapiens
tcctgacttcaggggctgc

SEQ ID NO: 2731015 - DNA, 13 bp, Homo sapiens
tcctgagcctcac

SEQ ID NO: 2731016 - DNA, 21 bp, Homo sapiens
tcctgaggctggtagcagaat

SEQ ID NO: 2731017 - DNA, 20 bp, Homo sapiens
tcctgcacgccgtggagcat

SEQ ID NO: 2731018 - DNA, 15 bp, Homo sapiens
tcctgccagctctgt

SEQ ID NO: 2731019 - DNA, 19 bp, Homo sapiens
tcctgccgtccctcctgtt

SEQ ID NO: 2731020 - DNA, 14 bp, Homo sapiens
tcctgcctcagcct

SEQ ID NO: 2731021 - DNA, 13 bp, Homo sapiens
tcctgctccacag

SEQ ID NO: 2731022 - DNA, 18 bp, Homo sapiens
tcctgctccacagtgttg

SEQ ID NO: 2731023 - DNA, 17 bp, Homo sapiens
tcctgctgcaccaaccc

SEQ ID NO: 2731024 - DNA, 21 bp, Homo sapiens
tcctgctgcagaggggcaggc

SEQ ID NO: 2731025 - DNA, 21 bp, Homo sapiens
tcctgctgcctgtattctcta

SEQ ID NO: 2731026 - DNA, 17 bp, Homo sapiens
tcctgctggcctgctct

SEQ ID NO: 2731027 - DNA, 19 bp, Homo sapiens
tcctggaaaggctcagtct

SEQ ID NO: 2731028 - DNA, 19 bp, Homo sapiens
tcctggaatgaagcatgta

SEQ ID NO: 2731029 - DNA, 19 bp, Homo sapiens
tcctggagcatcccaggcg

SEQ ID NO: 2731030 - DNA, 18 bp, Homo sapiens
tcctgggagaacctcagg

SEQ ID NO: 2731031 - DNA, 19 bp, Homo sapiens
tcctgggcccccagagacc

SEQ ID NO: 2731032 - DNA, 16 bp, Homo sapiens
tcctggggctctgtgc

SEQ ID NO: 2731033 - DNA, 19 bp, Homo sapiens
tcctggggctctgtgcagg

SEQ ID NO: 2731034 - DNA, 17 bp, Homo sapiens
tcctggtacagcagggt

SEQ ID NO: 2731035 - DNA, 16 bp, Homo sapiens
tcctggtgaggcccag

SEQ ID NO: 2731036 - DNA, 22 bp, Homo sapiens
tcctggtgaggcccagcctgtc

SEQ ID NO: 2731037 - DNA, 13 bp, Homo sapiens
tcctgtcagtgcc

SEQ ID NO: 2731038 - DNA, 15 bp, Homo sapiens
tcctgtccctaccca

SEQ ID NO: 2731039 - DNA, 17 bp, Homo sapiens
tcctgtccctacccact

SEQ ID NO: 2731040 - DNA, 15 bp, Homo sapiens
tcctgtccggagcga

SEQ ID NO: 2731041 - DNA, 22 bp, Homo sapiens
tcctgttgtgtaataacagaac

SEQ ID NO: 2731042 - DNA, 15 bp, Homo sapiens
tccttactcagagct

SEQ ID NO: 2731043 - DNA, 14 bp, Homo sapiens
tccttagaagtgga

SEQ ID NO: 2731044 - DNA, 18 bp, Homo sapiens
tccttcaagttagctcag

SEQ ID NO: 2731045 - DNA, 16 bp, Homo sapiens
tccttccaggccccca

SEQ ID NO: 2731046 - DNA, 18 bp, Homo sapiens
tccttccccttgtccctg

SEQ ID NO: 2731047 - DNA, 19 bp, Homo sapiens
tccttccccttgtccctgg

SEQ ID NO: 2731048 - DNA, 24 bp, Homo sapiens
tccttccccttgtccctggggcac

SEQ ID NO: 2731049 - DNA, 12 bp, Homo sapiens
tccttctgcctt

SEQ ID NO: 2731050 - DNA, 12 bp, Homo sapiens
tccttgaaacag

SEQ ID NO: 2731051 - DNA, 17 bp, Homo sapiens
tccttgctgtcctaggc

SEQ ID NO: 2731052 - DNA, 18 bp, Homo sapiens
tccttggagagcagctgg

SEQ ID NO: 2731053 - DNA, 19 bp, Homo sapiens
tccttggagagcagctggc

SEQ ID NO: 2731054 - DNA, 20 bp, Homo sapiens
tccttggagtgctgcagctt

SEQ ID NO: 2731055 - DNA, 21 bp, Homo sapiens
tccttggagtgctgcagcttt

SEQ ID NO: 2731056 - DNA, 17 bp, Homo sapiens
tcctttaggcagcctgc

SEQ ID NO: 2731057 - DNA, 21 bp, Homo sapiens
tcctttaggcagcctgccgcc

SEQ ID NO: 2731058 - DNA, 14 bp, Homo sapiens
tcctttgagggcag

SEQ ID NO: 2731059 - DNA, 14 bp, Homo sapiens
tcctttgttgctgt

SEQ ID NO: 2731060 - DNA, 21 bp, Homo sapiens
tccttttgcaacaagacaaag

SEQ ID NO: 2731061 - DNA, 14 bp, Homo sapiens
tcctttttgtaact

SEQ ID NO: 2731062 - DNA, 20 bp, Homo sapiens
tcgaaacctgtccataaagt

SEQ ID NO: 2731063 - DNA, 15 bp, Homo sapiens
tcgaactgtgctccc

SEQ ID NO: 2731064 - DNA, 17 bp, Homo sapiens
tcgaactgtgctcccac

SEQ ID NO: 2731065 - DNA, 18 bp, Homo sapiens
tcgaactgtgctcccacg

SEQ ID NO: 2731066 - DNA, 23 bp, Homo sapiens
tcgaagaacaatgtcagaaactc

SEQ ID NO: 2731067 - DNA, 15 bp, Homo sapiens
tcgagaccagcctgg

SEQ ID NO: 2731068 - DNA, 16 bp, Homo sapiens
tcgcccaccgcatgcc

SEQ ID NO: 2731069 - DNA, 14 bp, Homo sapiens
tcgccctggccagg

SEQ ID NO: 2731070 - DNA, 15 bp, Homo sapiens
tcgccctggccaggg

SEQ ID NO: 2731071 - DNA, 12 bp, Homo sapiens
tcgcgctgcctg

SEQ ID NO: 2731072 - DNA, 15 bp, Homo sapiens
tcgcgctgcctgtgt

SEQ ID NO: 2731073 - DNA, 14 bp, Homo sapiens
tcgcttgttttaaa

SEQ ID NO: 2731074 - DNA, 19 bp, Homo sapiens
tcggaaggctggctgggca

SEQ ID NO: 2731075 - DNA, 17 bp, Homo sapiens
tcggacctttcagctgt

SEQ ID NO: 2731076 - DNA, 13 bp, Homo sapiens
tcggaggctcctc

SEQ ID NO: 2731077 - DNA, 16 bp, Homo sapiens
tcggaggctcctccct

SEQ ID NO: 2731078 - DNA, 20 bp, Homo sapiens
tcggaggctcctccctctgc

SEQ ID NO: 2731079 - DNA, 19 bp, Homo sapiens
tcggcaccagtgcctcagt

SEQ ID NO: 2731080 - DNA, 17 bp, Homo sapiens
tcggcccatctgtccat

SEQ ID NO: 2731081 - DNA, 13 bp, Homo sapiens
tcggcctccagac

SEQ ID NO: 2731082 - DNA, 19 bp, Homo sapiens
tcggcctccagactgcgga

SEQ ID NO: 2731083 - DNA, 13 bp, Homo sapiens
tcggctcctgctg

SEQ ID NO: 2731084 - DNA, 19 bp, Homo sapiens
tcgggatgaaaagccatat

SEQ ID NO: 2731085 - DNA, 17 bp, Homo sapiens
tcggggcatgctggggc

SEQ ID NO: 2731086 - DNA, 21 bp, Homo sapiens
tcgtcatgttggccaggctgg

SEQ ID NO: 2731087 - DNA, 22 bp, Homo sapiens
tcgtccaaggcagttctgtgtc

SEQ ID NO: 2731088 - DNA, 19 bp, Homo sapiens
tcgtgccagtcgcgctgcc

SEQ ID NO: 2731089 - DNA, 22 bp, Homo sapiens
tcgtgccagtcgcgctgcctgt

SEQ ID NO: 2731090 - DNA, 14 bp, Homo sapiens
tcgtgtctgctgtt

SEQ ID NO: 2731091 - DNA, 15 bp, Homo sapiens
tcgtgtctgctgttg

SEQ ID NO: 2731092 - DNA, 20 bp, Homo sapiens
tcgttactctcacctcgtga

SEQ ID NO: 2731093 - DNA, 18 bp, Homo sapiens
tcgttagaggagcaacag

SEQ ID NO: 2731094 - DNA, 19 bp, Homo sapiens
tcgttagcgtccatttctt

SEQ ID NO: 2731095 - DNA, 15 bp, Homo sapiens
tctggcttctgcttc

SEQ ID NO: 2731096 - DNA, 23 bp, Homo sapiens
tctgggccaagttcctctagtgc

SEQ ID NO: 2731097 - DNA, 16 bp, Homo sapiens
tctgtatatagctcta

SEQ ID NO: 2731098 - DNA, 18 bp, Homo sapiens
tctgtcaccctggccacc

SEQ ID NO: 2731099 - DNA, 16 bp, Homo sapiens
tctgtccatcctcctc

SEQ ID NO: 2731100 - DNA, 17 bp, Homo sapiens
tctgtccatcctcctct

SEQ ID NO: 2731101 - DNA, 21 bp, Homo sapiens
tctgtccatcctcctctccat

SEQ ID NO: 2731102 - DNA, 13 bp, Homo sapiens
tctgtccttgtgt

SEQ ID NO: 2731103 - DNA, 13 bp, Homo sapiens
tctgtctttgcaa

SEQ ID NO: 2731104 - DNA, 21 bp, Homo sapiens
tctgtgaaagtctcctgtatc

SEQ ID NO: 2731105 - DNA, 22 bp, Homo sapiens
tctgtgaaagtctcctgtatca

SEQ ID NO: 2731106 - DNA, 15 bp, Homo sapiens
tctgtgcccatgggc

SEQ ID NO: 2731107 - DNA, 16 bp, Homo sapiens
tctgtggaaatgacag

SEQ ID NO: 2731108 - DNA, 11 bp, Homo sapiens
tctgtggtggg

SEQ ID NO: 2731109 - DNA, 23 bp, Homo sapiens
tctgtgtcactggctgcctccac

SEQ ID NO: 2731110 - DNA, 14 bp, Homo sapiens
tctgtgtcctcgca

SEQ ID NO: 2731111 - DNA, 14 bp, Homo sapiens
tctgttctacttga

SEQ ID NO: 2731112 - DNA, 17 bp, Homo sapiens
tctgttctacttgatat

SEQ ID NO: 2731113 - DNA, 14 bp, Homo sapiens
tctgttgtaaataa

SEQ ID NO: 2731114 - DNA, 13 bp, Homo sapiens
tctgttgtttgaa

SEQ ID NO: 2731115 - DNA, 20 bp, Homo sapiens
tcttaatattcagagaaaac

SEQ ID NO: 2731116 - DNA, 18 bp, Homo sapiens
tcttacataatttgcaat

SEQ ID NO: 2731117 - DNA, 22 bp, Homo sapiens
tcttacttcccccaccctgggt

SEQ ID NO: 2731118 - DNA, 23 bp, Homo sapiens
tcttactttgtgcaaaagcaggc

SEQ ID NO: 2731119 - DNA, 17 bp, Homo sapiens
tcttataggtttccact

SEQ ID NO: 2731120 - DNA, 12 bp, Homo sapiens
tcttatttaatt

SEQ ID NO: 2731121 - DNA, 16 bp, Homo sapiens
tcttcaagtgagtggc

SEQ ID NO: 2731122 - DNA, 14 bp, Homo sapiens
tcttcagctggtgg

SEQ ID NO: 2731123 - DNA, 12 bp, Homo sapiens
tcttccaacccc

SEQ ID NO: 2731124 - DNA, 16 bp, Homo sapiens
tcttccaaccccagct

SEQ ID NO: 2731125 - DNA, 15 bp, Homo sapiens
tcttccaccagagca

SEQ ID NO: 2731126 - DNA, 14 bp, Homo sapiens
tcttccccactccc

SEQ ID NO: 2731127 - DNA, 19 bp, Homo sapiens
tcttccccactccccacct

SEQ ID NO: 2731128 - DNA, 12 bp, Homo sapiens
tcttcctgtggg

SEQ ID NO: 2731129 - DNA, 15 bp, Homo sapiens
tcttctaatcataac

SEQ ID NO: 2731130 - DNA, 20 bp, Homo sapiens
tcttctaatcataacatagt

SEQ ID NO: 2731131 - DNA, 24 bp, Homo sapiens
tcttctaatcataacatagttgaa

SEQ ID NO: 2731132 - DNA, 17 bp, Homo sapiens
tcttctcgacttcagga

SEQ ID NO: 2731133 - DNA, 16 bp, Homo sapiens
tcttctttccagaccc

SEQ ID NO: 2731134 - DNA, 17 bp, Homo sapiens
tcttctttccagacccc

SEQ ID NO: 2731135 - DNA, 16 bp, Homo sapiens
tcttgaaacagcctgg

SEQ ID NO: 2731136 - DNA, 13 bp, Homo sapiens
tcttgaatcccat

SEQ ID NO: 2731137 - DNA, 21 bp, Homo sapiens
tcttgccagcattttcacatt

SEQ ID NO: 2731138 - DNA, 18 bp, Homo sapiens
tcttgccccaacccccag

SEQ ID NO: 2731139 - DNA, 23 bp, Homo sapiens
tcttgccccaacccccagcaccc

SEQ ID NO: 2731140 - DNA, 20 bp, Homo sapiens
tcttggaaagaggttctgca

SEQ ID NO: 2731141 - DNA, 21 bp, Homo sapiens
tcttggaaagaggttctgcac

SEQ ID NO: 2731142 - DNA, 16 bp, Homo sapiens
tcttggcacctgccta

SEQ ID NO: 2731143 - DNA, 14 bp, Homo sapiens
tcttggccagagct

SEQ ID NO: 2731144 - DNA, 18 bp, Homo sapiens
tcttgggcctgacctcca

SEQ ID NO: 2731145 - DNA, 16 bp, Homo sapiens
tcttgtattgctccat

SEQ ID NO: 2731146 - DNA, 13 bp, Homo sapiens
tctttaaggagat

SEQ ID NO: 2731147 - DNA, 13 bp, Homo sapiens
tctttaatctgtt

SEQ ID NO: 2731148 - DNA, 19 bp, Homo sapiens
tctttatgcaaaaacatat

SEQ ID NO: 2731149 - DNA, 21 bp, Homo sapiens
tctttatgcaaaaacatatgt

SEQ ID NO: 2731150 - DNA, 17 bp, Homo sapiens
tctttattaaatgtaga

SEQ ID NO: 2731151 - DNA, 15 bp, Homo sapiens
tctttcatacattat

SEQ ID NO: 2731152 - DNA, 16 bp, Homo sapiens
tctttcatacattata

SEQ ID NO: 2731153 - DNA, 17 bp, Homo sapiens
tctttcatacattatat

SEQ ID NO: 2731154 - DNA, 19 bp, Homo sapiens
tctttcatacattatattc

SEQ ID NO: 2731155 - DNA, 18 bp, Homo sapiens
tctttctttgcaccaaag

SEQ ID NO: 2731156 - DNA, 13 bp, Homo sapiens
tctttctttgctg

SEQ ID NO: 2731157 - DNA, 15 bp, Homo sapiens
tctttctttgctgct

SEQ ID NO: 2731158 - DNA, 15 bp, Homo sapiens
tctttgcaccaaaga

SEQ ID NO: 2731159 - DNA, 18 bp, Homo sapiens
tctttgcaccaaagacat

SEQ ID NO: 2731160 - DNA, 12 bp, Homo sapiens
tctttgcatgga

SEQ ID NO: 2731161 - DNA, 18 bp, Homo sapiens
tctttgctacaataaatg

SEQ ID NO: 2731162 - DNA, 20 bp, Homo sapiens
tctttgctacaataaatgct

SEQ ID NO: 2731163 - DNA, 23 bp, Homo sapiens
tctttgctacaataaatgctgaa

SEQ ID NO: 2731164 - DNA, 21 bp, Homo sapiens
tctttgctgaatgtcattatt

SEQ ID NO: 2731165 - DNA, 22 bp, Homo sapiens
tctttggtgaacattgcaatag

SEQ ID NO: 2731166 - DNA, 16 bp, Homo sapiens
tctttgtctaaacaag

SEQ ID NO: 2731167 - DNA, 15 bp, Homo sapiens
tcttttccagaaaga

SEQ ID NO: 2731168 - DNA, 17 bp, Homo sapiens
tcttttgttttcttcat

SEQ ID NO: 2731169 - DNA, 17 bp, Homo sapiens
tgaaaaacacggcagct

SEQ ID NO: 2731170 - DNA, 13 bp, Homo sapiens
tgaaaaatgagct

SEQ ID NO: 2731171 - DNA, 14 bp, Homo sapiens
tgaaagaattctat

SEQ ID NO: 2731172 - DNA, 12 bp, Homo sapiens
tgaaagacatca

SEQ ID NO: 2731173 - DNA, 18 bp, Homo sapiens
tgaaagacatcaatgaaa

SEQ ID NO: 2731174 - DNA, 21 bp, Homo sapiens
tgaaagtgaataaacttcagc

SEQ ID NO: 2731175 - DNA, 17 bp, Homo sapiens
tgaaagtttgcactgta

SEQ ID NO: 2731176 - DNA, 23 bp, Homo sapiens
tgaaattagtagtgtgttgataa

SEQ ID NO: 2731177 - DNA, 17 bp, Homo sapiens
tgaaattcaacctgtgt

SEQ ID NO: 2731178 - DNA, 16 bp, Homo sapiens
tgaacagtgctctgcc

SEQ ID NO: 2731179 - DNA, 19 bp, Homo sapiens
tgaacagtgctctgcctct

SEQ ID NO: 2731180 - DNA, 15 bp, Homo sapiens
tgaacattgcaatag

SEQ ID NO: 2731181 - DNA, 17 bp, Homo sapiens
tgaacccaggaggtgga

SEQ ID NO: 2731182 - DNA, 22 bp, Homo sapiens
tgaaccgacttttctaaagctc

SEQ ID NO: 2731183 - DNA, 21 bp, Homo sapiens
tgaaccgtgtgctcctcggca

SEQ ID NO: 2731184 - DNA, 16 bp, Homo sapiens
tgaactgcgtgccagt

SEQ ID NO: 2731185 - DNA, 21 bp, Homo sapiens
tgaacttatttacacatagtt

SEQ ID NO: 2731186 - DNA, 18 bp, Homo sapiens
tgaagaaccgcattttga

SEQ ID NO: 2731187 - DNA, 16 bp, Homo sapiens
tgaagaggtgagagta

SEQ ID NO: 2731188 - DNA, 13 bp, Homo sapiens
tgaagcaaacaca

SEQ ID NO: 2731189 - DNA, 22 bp, Homo sapiens
tgaagcaaacacacagactctg

SEQ ID NO: 2731190 - DNA, 23 bp, Homo sapiens
tgaagcaaacacacagactctgt

SEQ ID NO: 2731191 - DNA, 19 bp, Homo sapiens
tgaagccactgaagctggg

SEQ ID NO: 2731192 - DNA, 21 bp, Homo sapiens
tgaaggatttcttattttctt

SEQ ID NO: 2731193 - DNA, 16 bp, Homo sapiens
tgaagggaaaattagc

SEQ ID NO: 2731194 - DNA, 21 bp, Homo sapiens
tgaagtcattgtcgctcagca

SEQ ID NO: 2731195 - DNA, 19 bp, Homo sapiens
tgaagtgtcgagtccagtc

SEQ ID NO: 2731196 - DNA, 20 bp, Homo sapiens
tgaagtgtcgagtccagtcc

SEQ ID NO: 2731197 - DNA, 21 bp, Homo sapiens
tgaataaagggaacatgcagc

SEQ ID NO: 2731198 - DNA, 15 bp, Homo sapiens
tgaatacttgaagta

SEQ ID NO: 2731199 - DNA, 19 bp, Homo sapiens
tgaatagaggccaaattaa

SEQ ID NO: 2731200 - DNA, 23 bp, Homo sapiens
tgaatagaggccaaattaatctt

SEQ ID NO: 2731201 - DNA, 20 bp, Homo sapiens
tgaatctgcagggagcaact

SEQ ID NO: 2731202 - DNA, 21 bp, Homo sapiens
tgaatgaggaacaatcacaaa

SEQ ID NO: 2731203 - DNA, 12 bp, Homo sapiens
tgaatggcctgc

SEQ ID NO: 2731204 - DNA, 13 bp, Homo sapiens
tgaatgggaaagt

SEQ ID NO: 2731205 - DNA, 20 bp, Homo sapiens
tgaatgggaaagtatttttg

SEQ ID NO: 2731206 - DNA, 17 bp, Homo sapiens
tgaatgtcataaagaag

SEQ ID NO: 2731207 - DNA, 18 bp, Homo sapiens
tgaatgtcattatttgat

SEQ ID NO: 2731208 - DNA, 20 bp, Homo sapiens
tgaatgtctaaggtcacaca

SEQ ID NO: 2731209 - DNA, 21 bp, Homo sapiens
tgaattatccctgctggcttt

SEQ ID NO: 2731210 - DNA, 14 bp, Homo sapiens
tgaatttaagcatg

SEQ ID NO: 2731211 - DNA, 16 bp, Homo sapiens
tgaattttcccactgc

SEQ ID NO: 2731212 - DNA, 12 bp, Homo sapiens
tgacaacacatg

SEQ ID NO: 2731213 - DNA, 23 bp, Homo sapiens
tgacactgcggggcttggctgag

SEQ ID NO: 2731214 - DNA, 14 bp, Homo sapiens
tgacagaaatgcaa

SEQ ID NO: 2731215 - DNA, 14 bp, Homo sapiens
tgacagactctcgt

SEQ ID NO: 2731216 - DNA, 13 bp, Homo sapiens
tgacagagccaga

SEQ ID NO: 2731217 - DNA, 19 bp, Homo sapiens
tgacagagttggtgttcat

SEQ ID NO: 2731218 - DNA, 16 bp, Homo sapiens
tgacagtcctctccac

SEQ ID NO: 2731219 - DNA, 23 bp, Homo sapiens
tggaaaggctcagtctcaggagc

SEQ ID NO: 2731220 - DNA, 15 bp, Homo sapiens
tggaactccccaggg

SEQ ID NO: 2731221 - DNA, 18 bp, Homo sapiens
tggaactctaccctggta

SEQ ID NO: 2731222 - DNA, 15 bp, Homo sapiens
tggaagagaggcacc

SEQ ID NO: 2731223 - DNA, 19 bp, Homo sapiens
tggaaggagccagccagga

SEQ ID NO: 2731224 - DNA, 18 bp, Homo sapiens
tggaagggccttctccac

SEQ ID NO: 2731225 - DNA, 14 bp, Homo sapiens
tggaagtagtggag

SEQ ID NO: 2731226 - DNA, 17 bp, Homo sapiens
tggaagtagtggagccc

SEQ ID NO: 2731227 - DNA, 15 bp, Homo sapiens
tggaattggagaaaa

SEQ ID NO: 2731228 - DNA, 11 bp, Homo sapiens
tggaattttct

SEQ ID NO: 2731229 - DNA, 21 bp, Homo sapiens
tggaattttctttcatacatt

SEQ ID NO: 2731230 - DNA, 22 bp, Homo sapiens
tggaattttctttcatacatta

SEQ ID NO: 2731231 - DNA, 21 bp, Homo sapiens
tggaattttgtaaaaagaaat

SEQ ID NO: 2731232 - DNA, 22 bp, Homo sapiens
tggacagtacctgattgtattt

SEQ ID NO: 2731233 - DNA, 14 bp, Homo sapiens
tggacagtcctggg

SEQ ID NO: 2731234 - DNA, 16 bp, Homo sapiens
tggacagtcctgggag

SEQ ID NO: 2731235 - DNA, 18 bp, Homo sapiens
tggacatcgatatgaaaa

SEQ ID NO: 2731236 - DNA, 18 bp, Homo sapiens
tggacccatgactctgta

SEQ ID NO: 2731237 - DNA, 20 bp, Homo sapiens
tggaccggggccttggtccc

SEQ ID NO: 2731238 - DNA, 15 bp, Homo sapiens
tggacctctcttgtg

SEQ ID NO: 2731239 - DNA, 15 bp, Homo sapiens
tggacgcccagctga

SEQ ID NO: 2731240 - DNA, 18 bp, Homo sapiens
tggacttgaggattttga

SEQ ID NO: 2731241 - DNA, 14 bp, Homo sapiens
tggactttgttcac

SEQ ID NO: 2731242 - DNA, 21 bp, Homo sapiens
tggagaaaaattacagatcat

SEQ ID NO: 2731243 - DNA, 21 bp, Homo sapiens
tggagaaacaggctctgagat

SEQ ID NO: 2731244 - DNA, 20 bp, Homo sapiens
tggagaactccgctggatgg

SEQ ID NO: 2731245 - DNA, 16 bp, Homo sapiens
tggagactatttaagt

SEQ ID NO: 2731246 - DNA, 19 bp, Homo sapiens
tggagactctgtggggcct

SEQ ID NO: 2731247 - DNA, 13 bp, Homo sapiens
tggagagcagctg

SEQ ID NO: 2731248 - DNA, 20 bp, Homo sapiens
tggagagcagctggctctcc

SEQ ID NO: 2731249 - DNA, 21 bp, Homo sapiens
tggagcctgaaccgtgtgctc

SEQ ID NO: 2731250 - DNA, 19 bp, Homo sapiens
tggaggctgcgtcctgagg

SEQ ID NO: 2731251 - DNA, 13 bp, Homo sapiens
tggaggctggatg

SEQ ID NO: 2731252 - DNA, 20 bp, Homo sapiens
tggagggtgggagagcccag

SEQ ID NO: 2731253 - DNA, 13 bp, Homo sapiens
tggagtctcgctc

SEQ ID NO: 2731254 - DNA, 12 bp, Homo sapiens
tggagtgagcag

SEQ ID NO: 2731255 - DNA, 16 bp, Homo sapiens
tggagtgctgcagctt

SEQ ID NO: 2731256 - DNA, 12 bp, Homo sapiens
tggagtgtttga

SEQ ID NO: 2731257 - DNA, 21 bp, Homo sapiens
tggataaatttgaactccatg

SEQ ID NO: 2731258 - DNA, 19 bp, Homo sapiens
tggataagatgatgttaaa

SEQ ID NO: 2731259 - DNA, 19 bp, Homo sapiens
tggatacgacaacttgcac

SEQ ID NO: 2731260 - DNA, 23 bp, Homo sapiens
tggatgtcctcaaagaagtggtt

SEQ ID NO: 2731261 - DNA, 12 bp, Homo sapiens
tggatgttcaga

SEQ ID NO: 2731262 - DNA, 21 bp, Homo sapiens
tggatttttacaaataaagat

SEQ ID NO: 2731263 - DNA, 22 bp, Homo sapiens
tggatttttacaaataaagatg

SEQ ID NO: 2731264 - DNA, 16 bp, Homo sapiens
tggcaaggttcagtct

SEQ ID NO: 2731265 - DNA, 22 bp, Homo sapiens
tggcacaagctccctggtgagg

SEQ ID NO: 2731266 - DNA, 20 bp, Homo sapiens
tggcacagtgtctgggctga

SEQ ID NO: 2731267 - DNA, 21 bp, Homo sapiens
tggcaccactagggtcctggc

SEQ ID NO: 2731268 - DNA, 13 bp, Homo sapiens
tggcacctgccta

SEQ ID NO: 2731269 - DNA, 20 bp, Homo sapiens
tggcacgatctcagctcacc

SEQ ID NO: 2731270 - DNA, 12 bp, Homo sapiens
tggcactaaaat

SEQ ID NO: 2731271 - DNA, 17 bp, Homo sapiens
tggcactaaaatgttta

SEQ ID NO: 2731272 - DNA, 20 bp, Homo sapiens
tggcagaactgctggggctg

SEQ ID NO: 2731273 - DNA, 23 bp, Homo sapiens
tggcagaactgctggggctggtg

SEQ ID NO: 2731274 - DNA, 13 bp, Homo sapiens
tggcagcaggtgc

SEQ ID NO: 2731275 - DNA, 15 bp, Homo sapiens
tggcagcaggtgctg

SEQ ID NO: 2731276 - DNA, 16 bp, Homo sapiens
tggcagcaggtgctgc

SEQ ID NO: 2731277 - DNA, 17 bp, Homo sapiens
tggcagcaggtgctgct

SEQ ID NO: 2731278 - DNA, 21 bp, Homo sapiens
tggcagcaggtgctgctaccc

SEQ ID NO: 2731279 - DNA, 14 bp, Homo sapiens
tggcagccctgtag

SEQ ID NO: 2731280 - DNA, 18 bp, Homo sapiens
tggcagccgcctccctta

SEQ ID NO: 2731281 - DNA, 15 bp, Homo sapiens
tggcagctgggccca

SEQ ID NO: 2731282 - DNA, 16 bp, Homo sapiens
tggcagctgggcccac

SEQ ID NO: 2731283 - DNA, 20 bp, Homo sapiens
tggcagctgggcccacagcc

SEQ ID NO: 2731284 - DNA, 20 bp, Homo sapiens
tggcatatccattgtggaaa

SEQ ID NO: 2731285 - DNA, 15 bp, Homo sapiens
tggcatcacagggca

SEQ ID NO: 2731286 - DNA, 20 bp, Homo sapiens
tggcatcacagggcagagcc

SEQ ID NO: 2731287 - DNA, 17 bp, Homo sapiens
tggcatcctggctggct

SEQ ID NO: 2731288 - DNA, 23 bp, Homo sapiens
tggcatcctggctggctgtgtcc

SEQ ID NO: 2731289 - DNA, 14 bp, Homo sapiens
tggcattctctctg

SEQ ID NO: 2731290 - DNA, 19 bp, Homo sapiens
tggcattctctctgctcag

SEQ ID NO: 2731291 - DNA, 13 bp, Homo sapiens
tggcattggcagc

SEQ ID NO: 2731292 - DNA, 20 bp, Homo sapiens
tggcattggcagcaggtgct

SEQ ID NO: 2731293 - DNA, 21 bp, Homo sapiens
tggcattggcagcaggtgctg

SEQ ID NO: 2731294 - DNA, 15 bp, Homo sapiens
tggccacagaaaggc

SEQ ID NO: 2731295 - DNA, 12 bp, Homo sapiens
tggccaccaccc

SEQ ID NO: 2731296 - DNA, 13 bp, Homo sapiens
tggccagccccac

SEQ ID NO: 2731297 - DNA, 20 bp, Homo sapiens
tggccagccccacagcccac

SEQ ID NO: 2731298 - DNA, 11 bp, Homo sapiens
tggccagggct

SEQ ID NO: 2731299 - DNA, 16 bp, Homo sapiens
tggccagtcctagagc

SEQ ID NO: 2731300 - DNA, 20 bp, Homo sapiens
tggccagtcctagagctcct

SEQ ID NO: 2731301 - DNA, 16 bp, Homo sapiens
tggccagtgtgatccc

SEQ ID NO: 2731302 - DNA, 17 bp, Homo sapiens
tggcccacagctctgct

SEQ ID NO: 2731303 - DNA, 17 bp, Homo sapiens
tggcccagccactgcag

SEQ ID NO: 2731304 - DNA, 12 bp, Homo sapiens
tggcccagctcc

SEQ ID NO: 2731305 - DNA, 13 bp, Homo sapiens
tggcccagctccc

SEQ ID NO: 2731306 - DNA, 22 bp, Homo sapiens
tggcccatcagtgtacccccgc

SEQ ID NO: 2731307 - DNA, 22 bp, Homo sapiens
tggcccatcccccctcaccagg

SEQ ID NO: 2731308 - DNA, 19 bp, Homo sapiens
tggcccccactcacaggga

SEQ ID NO: 2731309 - DNA, 13 bp, Homo sapiens
tggcccctggaac

SEQ ID NO: 2731310 - DNA, 15 bp, Homo sapiens
tggcccctggaacct

SEQ ID NO: 2731311 - DNA, 19 bp, Homo sapiens
tggcccctggaacctttcc

SEQ ID NO: 2731312 - DNA, 16 bp, Homo sapiens
tggccccttctccagc

SEQ ID NO: 2731313 - DNA, 22 bp, Homo sapiens
tggccctcaaggcctcccacag

SEQ ID NO: 2731314 - DNA, 15 bp, Homo sapiens
tggccgtggctccag

SEQ ID NO: 2731315 - DNA, 16 bp, Homo sapiens
tggccgtggctccaga

SEQ ID NO: 2731316 - DNA, 20 bp, Homo sapiens
tggcctctagaacacccact

SEQ ID NO: 2731317 - DNA, 19 bp, Homo sapiens
tggcctcttggcacctgcc

SEQ ID NO: 2731318 - DNA, 20 bp, Homo sapiens
tggcctcttggcacctgcct

SEQ ID NO: 2731319 - DNA, 11 bp, Homo sapiens
tggccttccct

SEQ ID NO: 2731320 - DNA, 18 bp, Homo sapiens
tggccttccctccccaca

SEQ ID NO: 2731321 - DNA, 19 bp, Homo sapiens
tggcctttgaggcaaaggc

SEQ ID NO: 2731322 - DNA, 15 bp, Homo sapiens
tggcgcaccctcccc

SEQ ID NO: 2731323 - DNA, 18 bp, Homo sapiens
tggcgcaccctcccctcc

SEQ ID NO: 2731324 - DNA, 18 bp, Homo sapiens
tggcgtgtccctctcgga

SEQ ID NO: 2731325 - DNA, 16 bp, Homo sapiens
tggctcagctgtggtc

SEQ ID NO: 2731326 - DNA, 18 bp, Homo sapiens
tggctcagctgtggtccc

SEQ ID NO: 2731327 - DNA, 23 bp, Homo sapiens
tggctcagctgtggtcccaccca

SEQ ID NO: 2731328 - DNA, 19 bp, Homo sapiens
tggctccagaatgtgctgc

SEQ ID NO: 2731329 - DNA, 21 bp, Homo sapiens
tggctccagaatgtgctgcct

SEQ ID NO: 2731330 - DNA, 22 bp, Homo sapiens
tggctccagaatgtgctgcctt

SEQ ID NO: 2731331 - DNA, 23 bp, Homo sapiens
tggctctttgtgtgtctccaggt

SEQ ID NO: 2731332 - DNA, 20 bp, Homo sapiens
tggctgagagagtggcattg

SEQ ID NO: 2731333 - DNA, 16 bp, Homo sapiens
tggctgcctccactcc

SEQ ID NO: 2731334 - DNA, 17 bp, Homo sapiens
tggctgcctccactccc

SEQ ID NO: 2731335 - DNA, 18 bp, Homo sapiens
tggctgcctccactccca

SEQ ID NO: 2731336 - DNA, 11 bp, Homo sapiens
tggctgctggc

SEQ ID NO: 2731337 - DNA, 12 bp, Homo sapiens
tggctgctggcc

SEQ ID NO: 2731338 - DNA, 13 bp, Homo sapiens
tggctgctggccc

SEQ ID NO: 2731339 - DNA, 14 bp, Homo sapiens
tggctgctggccca

SEQ ID NO: 2731340 - DNA, 23 bp, Homo sapiens
tggctgctggcccacagctctgc

SEQ ID NO: 2731341 - DNA, 15 bp, Homo sapiens
tggctggctgtgtcc

SEQ ID NO: 2731342 - DNA, 21 bp, Homo sapiens
tggctggggcctatcagtgtg

SEQ ID NO: 2731343 - DNA, 18 bp, Homo sapiens
ttactgacagaaatgcaa

SEQ ID NO: 2731344 - DNA, 14 bp, Homo sapiens
ttacttcccccacc

SEQ ID NO: 2731345 - DNA, 17 bp, Homo sapiens
ttacttcccccaccctg

SEQ ID NO: 2731346 - DNA, 14 bp, Homo sapiens
ttacttgacctcct

SEQ ID NO: 2731347 - DNA, 11 bp, Homo sapiens
ttagaaacatg

SEQ ID NO: 2731348 - DNA, 14 bp, Homo sapiens
ttagaataaaattg

SEQ ID NO: 2731349 - DNA, 12 bp, Homo sapiens
ttagaatatatt

SEQ ID NO: 2731350 - DNA, 20 bp, Homo sapiens
ttagagaggtagcgagctgc

SEQ ID NO: 2731351 - DNA, 14 bp, Homo sapiens
ttagatcaacactt

SEQ ID NO: 2731352 - DNA, 22 bp, Homo sapiens
ttagcttttagttttaaaactc

SEQ ID NO: 2731353 - DNA, 15 bp, Homo sapiens
ttaggaagttacctg

SEQ ID NO: 2731354 - DNA, 13 bp, Homo sapiens
ttaggcagcctgc

SEQ ID NO: 2731355 - DNA, 15 bp, Homo sapiens
ttaggcctggcacag

SEQ ID NO: 2731356 - DNA, 23 bp, Homo sapiens
ttagggcaaagatctcagcagcc

SEQ ID NO: 2731357 - DNA, 21 bp, Homo sapiens
ttagtctcgctaaagttatat

SEQ ID NO: 2731358 - DNA, 12 bp, Homo sapiens
ttagtttaaaat

SEQ ID NO: 2731359 - DNA, 19 bp, Homo sapiens
ttataaaaaatggtgcctg

SEQ ID NO: 2731360 - DNA, 20 bp, Homo sapiens
ttataaaaaatggtgcctga

SEQ ID NO: 2731361 - DNA, 23 bp, Homo sapiens
ttataaaagaataaaattgcact

SEQ ID NO: 2731362 - DNA, 16 bp, Homo sapiens
ttataaacctctaatt

SEQ ID NO: 2731363 - DNA, 17 bp, Homo sapiens
ttataaacctctaattt

SEQ ID NO: 2731364 - DNA, 17 bp, Homo sapiens
ttatagtctcaaatcaa

SEQ ID NO: 2731365 - DNA, 16 bp, Homo sapiens
ttatatatcataaagt

SEQ ID NO: 2731366 - DNA, 12 bp, Homo sapiens
ttatatctttat

SEQ ID NO: 2731367 - DNA, 22 bp, Homo sapiens
ttatatctttatgcaaaaacat

SEQ ID NO: 2731368 - DNA, 12 bp, Homo sapiens
ttatattttctt

SEQ ID NO: 2731369 - DNA, 15 bp, Homo sapiens
ttatatttttaaagg

SEQ ID NO: 2731370 - DNA, 19 bp, Homo sapiens
ttatccacagaaacatttt

SEQ ID NO: 2731371 - DNA, 14 bp, Homo sapiens
ttatctacccagtc

SEQ ID NO: 2731372 - DNA, 12 bp, Homo sapiens
ttatctcctggg

SEQ ID NO: 2731373 - DNA, 23 bp, Homo sapiens
ttatgaaggacctgaaataaggt

SEQ ID NO: 2731374 - DNA, 21 bp, Homo sapiens
ttatgactccccccttccaaa

SEQ ID NO: 2731375 - DNA, 13 bp, Homo sapiens
ttatgagaacatg

SEQ ID NO: 2731376 - DNA, 22 bp, Homo sapiens
ttatgagaacatggtgtgtgtc

SEQ ID NO: 2731377 - DNA, 13 bp, Homo sapiens
ttatgcaaaaaca

SEQ ID NO: 2731378 - DNA, 15 bp, Homo sapiens
ttatgcaaaaacata

SEQ ID NO: 2731379 - DNA, 16 bp, Homo sapiens
ttatgttattggaatt

SEQ ID NO: 2731380 - DNA, 20 bp, Homo sapiens
ttattaaaaaaacacaaaaa

SEQ ID NO: 2731381 - DNA, 14 bp, Homo sapiens
ttattactttttaa

SEQ ID NO: 2731382 - DNA, 23 bp, Homo sapiens
ttattcaggaaaagcctctgtgt

SEQ ID NO: 2731383 - DNA, 21 bp, Homo sapiens
ttattcatgctttctcctttt

SEQ ID NO: 2731384 - DNA, 12 bp, Homo sapiens
ttattcttttcc

SEQ ID NO: 2731385 - DNA, 16 bp, Homo sapiens
ttattctttttaaagt

SEQ ID NO: 2731386 - DNA, 14 bp, Homo sapiens
ttattggaattttc

SEQ ID NO: 2731387 - DNA, 13 bp, Homo sapiens
ttatttaaagcac

SEQ ID NO: 2731388 - DNA, 19 bp, Homo sapiens
ttatttaaagcacatgcca

SEQ ID NO: 2731389 - DNA, 16 bp, Homo sapiens
ttatttgataacattt

SEQ ID NO: 2731390 - DNA, 12 bp, Homo sapiens
ttattttacagt

SEQ ID NO: 2731391 - DNA, 13 bp, Homo sapiens
ttattttgtaatt

SEQ ID NO: 2731392 - DNA, 21 bp, Homo sapiens
ttcaaaatggtaactttacaa

SEQ ID NO: 2731393 - DNA, 15 bp, Homo sapiens
ttcaaaatgtccagc

SEQ ID NO: 2731394 - DNA, 17 bp, Homo sapiens
ttcaaagaaaaccctaa

SEQ ID NO: 2731395 - DNA, 13 bp, Homo sapiens
ttcaaatatttgt

SEQ ID NO: 2731396 - DNA, 21 bp, Homo sapiens
ttcaagaccagcctggccaac

SEQ ID NO: 2731397 - DNA, 16 bp, Homo sapiens
ttcaagttagctcagg

SEQ ID NO: 2731398 - DNA, 13 bp, Homo sapiens
ttcaattcctggg

SEQ ID NO: 2731399 - DNA, 19 bp, Homo sapiens
ttcacaggactctgcagat

SEQ ID NO: 2731400 - DNA, 21 bp, Homo sapiens
ttcactccggtgtgcctgcag

SEQ ID NO: 2731401 - DNA, 23 bp, Homo sapiens
ttcactccggtgtgcctgcagcc

SEQ ID NO: 2731402 - DNA, 19 bp, Homo sapiens
ttcagctggtggatggtga

SEQ ID NO: 2731403 - DNA, 20 bp, Homo sapiens
ttcagctggtggatggtgac

SEQ ID NO: 2731404 - DNA, 22 bp, Homo sapiens
ttcagctggtggatggtgactt

SEQ ID NO: 2731405 - DNA, 20 bp, Homo sapiens
ttcagctgtgaacatggact

SEQ ID NO: 2731406 - DNA, 23 bp, Homo sapiens
ttcagctgtgaacatggactctt

SEQ ID NO: 2731407 - DNA, 22 bp, Homo sapiens
ttcagcttctgctgggctgggg

SEQ ID NO: 2731408 - DNA, 14 bp, Homo sapiens
ttcaggaatttaat

SEQ ID NO: 2731409 - DNA, 15 bp, Homo sapiens
ttcaggaatttaatt

SEQ ID NO: 2731410 - DNA, 16 bp, Homo sapiens
ttcaggaggctgaggc

SEQ ID NO: 2731411 - DNA, 22 bp, Homo sapiens
ttcagggaatttcaggaactag

SEQ ID NO: 2731412 - DNA, 21 bp, Homo sapiens
ttcaggggactgttctcacct

SEQ ID NO: 2731413 - DNA, 21 bp, Homo sapiens
ttcagtgctgtggcctgggca

SEQ ID NO: 2731414 - DNA, 17 bp, Homo sapiens
ttcagttcctctttgca

SEQ ID NO: 2731415 - DNA, 22 bp, Homo sapiens
ttcataaatttgttgtcatgtg

SEQ ID NO: 2731416 - DNA, 12 bp, Homo sapiens
ttcataatttca

SEQ ID NO: 2731417 - DNA, 12 bp, Homo sapiens
ttcatacattat

SEQ ID NO: 2731418 - DNA, 17 bp, Homo sapiens
ttcatataatttaaaga

SEQ ID NO: 2731419 - DNA, 15 bp, Homo sapiens
ttcatatctaattta

SEQ ID NO: 2731420 - DNA, 20 bp, Homo sapiens
ttcatcaaataaaccttgtt

SEQ ID NO: 2731421 - DNA, 20 bp, Homo sapiens
ttcatctggaggctgcgtcc

SEQ ID NO: 2731422 - DNA, 12 bp, Homo sapiens
ttcatgagccca

SEQ ID NO: 2731423 - DNA, 14 bp, Homo sapiens
ttcatgcccactgc

SEQ ID NO: 2731424 - DNA, 15 bp, Homo sapiens
ttcatttctaacata

SEQ ID NO: 2731425 - DNA, 14 bp, Homo sapiens
ttccaaatcaggct

SEQ ID NO: 2731426 - DNA, 17 bp, Homo sapiens
ttccaaatcaggctggg

SEQ ID NO: 2731427 - DNA, 14 bp, Homo sapiens
ttccaaccccagct

SEQ ID NO: 2731428 - DNA, 22 bp, Homo sapiens
ttccaccagagcaggggctgct

SEQ ID NO: 2731429 - DNA, 13 bp, Homo sapiens
ttccaccctggaa

SEQ ID NO: 2731430 - DNA, 14 bp, Homo sapiens
ttccacgtgtatgc

SEQ ID NO: 2731431 - DNA, 17 bp, Homo sapiens
ttccagaaaaccccagc

SEQ ID NO: 2731432 - DNA, 13 bp, Homo sapiens
ttccagagcctca

SEQ ID NO: 2731433 - DNA, 19 bp, Homo sapiens
ttccagctaagcctgatga

SEQ ID NO: 2731434 - DNA, 15 bp, Homo sapiens
ttccatgcactctct

SEQ ID NO: 2731435 - DNA, 16 bp, Homo sapiens
ttccatttctactgta

SEQ ID NO: 2731436 - DNA, 20 bp, Homo sapiens
ttcccactaagctttctcct

SEQ ID NO: 2731437 - DNA, 13 bp, Homo sapiens
ttcccactgcacc

SEQ ID NO: 2731438 - DNA, 21 bp, Homo sapiens
ttcccagcaaagttttcagat

SEQ ID NO: 2731439 - DNA, 21 bp, Homo sapiens
ttcccatgacctaaaacactg

SEQ ID NO: 2731440 - DNA, 22 bp, Homo sapiens
ttcccatttcgtgtaatattct

SEQ ID NO: 2731441 - DNA, 21 bp, Homo sapiens
ttcccccaaggctgatgcatt

SEQ ID NO: 2731442 - DNA, 17 bp, Homo sapiens
ttcccctcctacccctc

SEQ ID NO: 2731443 - DNA, 19 bp, Homo sapiens
ttcccctcctacccctccc

SEQ ID NO: 2731444 - DNA, 18 bp, Homo sapiens
ttcccggtgcagaacagg

SEQ ID NO: 2731445 - DNA, 16 bp, Homo sapiens
ttcccgtggccccagc

SEQ ID NO: 2731446 - DNA, 19 bp, Homo sapiens
ttcccgtggccccagcctg

SEQ ID NO: 2731447 - DNA, 14 bp, Homo sapiens
ttccctcctgcagc

SEQ ID NO: 2731448 - DNA, 18 bp, Homo sapiens
ttccctgcttttctccca

SEQ ID NO: 2731449 - DNA, 15 bp, Homo sapiens
ttccctggggcccca

SEQ ID NO: 2731450 - DNA, 20 bp, Homo sapiens
ttcctaaagtctctgctgct

SEQ ID NO: 2731451 - DNA, 20 bp, Homo sapiens
ttcctaagcctgttgctgaa

SEQ ID NO: 2731452 - DNA, 15 bp, Homo sapiens
ttcctagctgtaaat

SEQ ID NO: 2731453 - DNA, 16 bp, Homo sapiens
ttcctcatctgtgcct

SEQ ID NO: 2731454 - DNA, 18 bp, Homo sapiens
ttcctcatctgtgcctgt

SEQ ID NO: 2731455 - DNA, 14 bp, Homo sapiens
ttcctcatgaatta

SEQ ID NO: 2731456 - DNA, 23 bp, Homo sapiens
ttcctccccattagagtcagcct

SEQ ID NO: 2731457 - DNA, 16 bp, Homo sapiens
ttcctcccccagagcc

SEQ ID NO: 2731458 - DNA, 23 bp, Homo sapiens
ttcctctagtgccctccacagcc

SEQ ID NO: 2731459 - DNA, 21 bp, Homo sapiens
ttcctctgaatattaagaaac

SEQ ID NO: 2731460 - DNA, 16 bp, Homo sapiens
ttcctctgagccgcag

SEQ ID NO: 2731461 - DNA, 15 bp, Homo sapiens
ttcctctttgcatgg

SEQ ID NO: 2731462 - DNA, 17 bp, Homo sapiens
ttcctctttgcatggaa

SEQ ID NO: 2731463 - DNA, 18 bp, Homo sapiens
ttccttgctgtcctaggc

SEQ ID NO: 2731464 - DNA, 21 bp, Homo sapiens
ttcgaaacctgtccataaagt

SEQ ID NO: 2731465 - DNA, 19 bp, Homo sapiens
ttcgaactgtgctcccacg

SEQ ID NO: 2731466 - DNA, 17 bp, Homo sapiens
ttcgagaccagcctggc

SEQ ID NO: 2731467 - DNA, 11 bp, Homo sapiens
aaaaaaatata

SEQ ID NO: 2731468 - DNA, 12 bp, Homo sapiens
aaaaaagaaatc

SEQ ID NO: 2731469 - DNA, 15 bp, Homo sapiens
aaaaaagaagtttgg

SEQ ID NO: 2731470 - DNA, 16 bp, Homo sapiens
aaaaacacggcagctg

SEQ ID NO: 2731471 - DNA, 24 bp, Homo sapiens
aaaaacatatgtctgtctttgcaa

SEQ ID NO: 2731472 - DNA, 18 bp, Homo sapiens
aaaaactagacattattt

SEQ ID NO: 2731473 - DNA, 13 bp, Homo sapiens
aaaaagtatatat

SEQ ID NO: 2731474 - DNA, 19 bp, Homo sapiens
aaaaataagttttatacat

SEQ ID NO: 2731475 - DNA, 23 bp, Homo sapiens
aaaaatggaaacatttattcctt

SEQ ID NO: 2731476 - DNA, 15 bp, Homo sapiens
aaaaatggtgcctga

SEQ ID NO: 2731477 - DNA, 20 bp, Homo sapiens
aaaacaattgttctgggtga

SEQ ID NO: 2731478 - DNA, 15 bp, Homo sapiens
aaaacagaagcaaat

SEQ ID NO: 2731479 - DNA, 21 bp, Homo sapiens
aaaacagcttaaagagaaaaa

SEQ ID NO: 2731480 - DNA, 11 bp, Homo sapiens
aaaacatttct

SEQ ID NO: 2731481 - DNA, 9 bp, Homo sapiens
aaaagaaat

SEQ ID NO: 2731482 - DNA, 13 bp, Homo sapiens
aaaagacaaacac

SEQ ID NO: 2731483 - DNA, 17 bp, Homo sapiens
aaaagaccaaattttga

SEQ ID NO: 2731484 - DNA, 17 bp, Homo sapiens
aaaagattatatatcat

SEQ ID NO: 2731485 - DNA, 22 bp, Homo sapiens
aaaagattatatatcataaagt

SEQ ID NO: 2731486 - DNA, 23 bp, Homo sapiens
aaaagattatatatcataaagta

SEQ ID NO: 2731487 - DNA, 19 bp, Homo sapiens
aaaagcacaagtacttttg

SEQ ID NO: 2731488 - DNA, 10 bp, Homo sapiens
aaaagccata

SEQ ID NO: 2731489 - DNA, 15 bp, Homo sapiens
aaaagccatatctag

SEQ ID NO: 2731490 - DNA, 16 bp, Homo sapiens
aaaagccatatctagt

SEQ ID NO: 2731491 - DNA, 14 bp, Homo sapiens
aaaagcctctgtgt

SEQ ID NO: 2731492 - DNA, 19 bp, Homo sapiens
aaaaggttttattttgtaa

SEQ ID NO: 2731493 - DNA, 12 bp, Homo sapiens
aaaataagtttt

SEQ ID NO: 2731494 - DNA, 18 bp, Homo sapiens
aaaatatccctttttcac

SEQ ID NO: 2731495 - DNA, 13 bp, Homo sapiens
aaaatcttcagct

SEQ ID NO: 2731496 - DNA, 13 bp, Homo sapiens
aaaatgtcactga

SEQ ID NO: 2731497 - DNA, 15 bp, Homo sapiens
aaaatgtcactgaag

SEQ ID NO: 2731498 - DNA, 18 bp, Homo sapiens
aaaatgttggtgcaatta

SEQ ID NO: 2731499 - DNA, 17 bp, Homo sapiens
aaaattccatgcactct

SEQ ID NO: 2731500 - DNA, 15 bp, Homo sapiens
aaaattgtatagaga

SEQ ID NO: 2731501 - DNA, 21 bp, Homo sapiens
aaaattgtatagagatatgca

SEQ ID NO: 2731502 - DNA, 20 bp, Homo sapiens
aaaatttcaacaagtagcta

SEQ ID NO: 2731503 - DNA, 16 bp, Homo sapiens
aaacactcgtgtgccc

SEQ ID NO: 2731504 - DNA, 17 bp, Homo sapiens
aaacactgggctctgag

SEQ ID NO: 2731505 - DNA, 14 bp, Homo sapiens
aaacagaagcaaat

SEQ ID NO: 2731506 - DNA, 13 bp, Homo sapiens
aaacagactattt

SEQ ID NO: 2731507 - DNA, 21 bp, Homo sapiens
aaacagcaaagccatattcta

SEQ ID NO: 2731508 - DNA, 11 bp, Homo sapiens
aaacagcctgg

SEQ ID NO: 2731509 - DNA, 18 bp, Homo sapiens
aaacaggtgctaacactg

SEQ ID NO: 2731510 - DNA, 18 bp, Homo sapiens
aaacagtgaatttaagca

SEQ ID NO: 2731511 - DNA, 22 bp, Homo sapiens
aaacatatgtctgtctttgcaa

SEQ ID NO: 2731512 - DNA, 23 bp, Homo sapiens
aaacatatgtctgtctttgcaaa

SEQ ID NO: 2731513 - DNA, 12 bp, Homo sapiens
aaacatgaaaac

SEQ ID NO: 2731514 - DNA, 16 bp, Homo sapiens
aaaccacacttcttga

SEQ ID NO: 2731515 - DNA, 19 bp, Homo sapiens
aaaccatccatctgtggaa

SEQ ID NO: 2731516 - DNA, 20 bp, Homo sapiens
aaacctctaatttattttgt

SEQ ID NO: 2731517 - DNA, 20 bp, Homo sapiens
aaacctgcatttttaaagga

SEQ ID NO: 2731518 - DNA, 20 bp, Homo sapiens
aaacctgtttttaacatgtg

SEQ ID NO: 2731519 - DNA, 21 bp, Homo sapiens
aaacctgtttttaacatgtga

SEQ ID NO: 2731520 - DNA, 12 bp, Homo sapiens
aaaccttgtttc

SEQ ID NO: 2731521 - DNA, 22 bp, Homo sapiens
aaaccttttttatgatgctatt

SEQ ID NO: 2731522 - DNA, 16 bp, Homo sapiens
aaactcctactgcttc

SEQ ID NO: 2731523 - DNA, 23 bp, Homo sapiens
aaactcctactgcttcctctgaa

SEQ ID NO: 2731524 - DNA, 19 bp, Homo sapiens
aaactgatgtttaaaagtc

SEQ ID NO: 2731525 - DNA, 18 bp, Homo sapiens
aaactgcgtaggagagaa

SEQ ID NO: 2731526 - DNA, 12 bp, Homo sapiens
aaactgctttat

SEQ ID NO: 2731527 - DNA, 22 bp, Homo sapiens
aaacttagaataaaattgtaaa

SEQ ID NO: 2731528 - DNA, 10 bp, Homo sapiens
aaacttattt

SEQ ID NO: 2731529 - DNA, 12 bp, Homo sapiens
aaacttatttga

SEQ ID NO: 2731530 - DNA, 14 bp, Homo sapiens
aaagaaatcaattt

SEQ ID NO: 2731531 - DNA, 22 bp, Homo sapiens
aaagaagcttaacagtaagaaa

SEQ ID NO: 2731532 - DNA, 13 bp, Homo sapiens
aaagaattctatt

SEQ ID NO: 2731533 - DNA, 14 bp, Homo sapiens
aaagaattctattt

SEQ ID NO: 2731534 - DNA, 15 bp, Homo sapiens
aaagaattctatttt

SEQ ID NO: 2731535 - DNA, 16 bp, Homo sapiens
aaagaattctattttg

SEQ ID NO: 2731536 - DNA, 16 bp, Homo sapiens
aaagacatcaatgaaa

SEQ ID NO: 2731537 - DNA, 16 bp, Homo sapiens
aaagacattgaaagct

SEQ ID NO: 2731538 - DNA, 15 bp, Homo sapiens
aaagacttgctttaa

SEQ ID NO: 2731539 - DNA, 13 bp, Homo sapiens
aaagagagaaaac

SEQ ID NO: 2731540 - DNA, 22 bp, Homo sapiens
aaagagagaaaacttatttgag

SEQ ID NO: 2731541 - DNA, 15 bp, Homo sapiens
aaagagggagagatg

SEQ ID NO: 2731542 - DNA, 18 bp, Homo sapiens
aaagaggttctgcactcc

SEQ ID NO: 2731543 - DNA, 17 bp, Homo sapiens
aaagagtctctggctca

SEQ ID NO: 2731544 - DNA, 19 bp, Homo sapiens
aaagattaaatgtgtcatt

SEQ ID NO: 2731545 - DNA, 18 bp, Homo sapiens
aaagcaccgcagcatgtg

SEQ ID NO: 2731546 - DNA, 13 bp, Homo sapiens
aaagccacatttt

SEQ ID NO: 2731547 - DNA, 17 bp, Homo sapiens
aaagccatattctaaat

SEQ ID NO: 2731548 - DNA, 21 bp, Homo sapiens
aaagcctctgtgtcactggct

SEQ ID NO: 2731549 - DNA, 24 bp, Homo sapiens
aaagcctctgtgtcactggctgcc

SEQ ID NO: 2731550 - DNA, 18 bp, Homo sapiens
aaagctctgaacaaaagc

SEQ ID NO: 2731551 - DNA, 16 bp, Homo sapiens
aaagctgtgtctctgt

SEQ ID NO: 2731552 - DNA, 18 bp, Homo sapiens
aaagctgtgtctctgtat

SEQ ID NO: 2731553 - DNA, 19 bp, Homo sapiens
aaagcttacccttggtttg

SEQ ID NO: 2731554 - DNA, 15 bp, Homo sapiens
aaaggacaaacagtg

SEQ ID NO: 2731555 - DNA, 15 bp, Homo sapiens
aaaggactgtaagca

SEQ ID NO: 2731556 - DNA, 14 bp, Homo sapiens
aaaggattttacca

SEQ ID NO: 2731557 - DNA, 16 bp, Homo sapiens
aaaggattttaccaaa

SEQ ID NO: 2731558 - DNA, 18 bp, Homo sapiens
aaaggattttaccaaagc

SEQ ID NO: 2731559 - DNA, 19 bp, Homo sapiens
aaaggctcagtctcaggag

SEQ ID NO: 2731560 - DNA, 22 bp, Homo sapiens
aaaggctttggcaacagaaaac

SEQ ID NO: 2731561 - DNA, 15 bp, Homo sapiens
aaaggtaggttttaa

SEQ ID NO: 2731562 - DNA, 13 bp, Homo sapiens
aaaggtatttaga

SEQ ID NO: 2731563 - DNA, 22 bp, Homo sapiens
aaaggtttcactgttcatgaat

SEQ ID NO: 2731564 - DNA, 19 bp, Homo sapiens
aaagtaagtaccactcagg

SEQ ID NO: 2731565 - DNA, 20 bp, Homo sapiens
aaagtataaattcgctgtga

SEQ ID NO: 2731566 - DNA, 21 bp, Homo sapiens
aaagtatgccttcctgtttaa

SEQ ID NO: 2731567 - DNA, 16 bp, Homo sapiens
aaagtatttttgaaag

SEQ ID NO: 2731568 - DNA, 12 bp, Homo sapiens
aaagtcagattt

SEQ ID NO: 2731569 - DNA, 13 bp, Homo sapiens
aaagtcatttaaa

SEQ ID NO: 2731570 - DNA, 17 bp, Homo sapiens
aaagtgggtttcaattt

SEQ ID NO: 2731571 - DNA, 13 bp, Homo sapiens
aaagttccagttt

SEQ ID NO: 2731572 - DNA, 16 bp, Homo sapiens
aaagttccagttttgt

SEQ ID NO: 2731573 - DNA, 15 bp, Homo sapiens
aaagtttacagtaaa

SEQ ID NO: 2731574 - DNA, 21 bp, Homo sapiens
aaagtttacagtaaataaatt

SEQ ID NO: 2731575 - DNA, 14 bp, Homo sapiens
aaagtttgtccttt

SEQ ID NO: 2731576 - DNA, 22 bp, Homo sapiens
aaagttttcagattgtaaaggt

SEQ ID NO: 2731577 - DNA, 12 bp, Homo sapiens
aaataaaataat

SEQ ID NO: 2731578 - DNA, 12 bp, Homo sapiens
aaataaattgtt

SEQ ID NO: 2731579 - DNA, 13 bp, Homo sapiens
aaataaattgttt

SEQ ID NO: 2731580 - DNA, 19 bp, Homo sapiens
aaataagttttatacataa

SEQ ID NO: 2731581 - DNA, 22 bp, Homo sapiens
aaataagttttatacataaaca

SEQ ID NO: 2731582 - DNA, 15 bp, Homo sapiens
aaataattttttgca

SEQ ID NO: 2731583 - DNA, 13 bp, Homo sapiens
aaatacattccag

SEQ ID NO: 2731584 - DNA, 15 bp, Homo sapiens
aaatacattccagtg

SEQ ID NO: 2731585 - DNA, 16 bp, Homo sapiens
aaatactccattattt

SEQ ID NO: 2731586 - DNA, 23 bp, Homo sapiens
aaatagatttcagctatgcagaa

SEQ ID NO: 2731587 - DNA, 17 bp, Homo sapiens
aaatagcaaggccaggg

SEQ ID NO: 2731588 - DNA, 15 bp, Homo sapiens
aaatataaattttgt

SEQ ID NO: 2731589 - DNA, 22 bp, Homo sapiens
aaatatagttgtctttctttgc

SEQ ID NO: 2731590 - DNA, 17 bp, Homo sapiens
aaatattaaaatttatt

SEQ ID NO: 2731591 - DNA, 13 bp, Homo sapiens
aaatattactgat

SEQ ID NO: 2731592 - DNA, 13 bp, Homo sapiens
aaatcaaatacat

SEQ ID NO: 2731593 - DNA, 15 bp, Homo sapiens
aaatcaaatttttct

SEQ ID NO: 2731594 - DNA, 17 bp, Homo sapiens
aaatcaaatttttctgg

SEQ ID NO: 2731595 - DNA, 12 bp, Homo sapiens
aaatcacaaaca

SEQ ID NO: 2731596 - DNA, 22 bp, Homo sapiens
aaatcatattaattattttcca

SEQ ID NO: 2731597 - DNA, 16 bp, Homo sapiens
aaatcgccttatgaga

SEQ ID NO: 2731598 - DNA, 17 bp, Homo sapiens
aaatcgccttatgagaa

SEQ ID NO: 2731599 - DNA, 22 bp, Homo sapiens
aaatctggcaaagttatattta

SEQ ID NO: 2731600 - DNA, 21 bp, Homo sapiens
aaatcttcagctggtggatgg

SEQ ID NO: 2731601 - DNA, 22 bp, Homo sapiens
aaatgagaaaggatttcctttc

SEQ ID NO: 2731602 - DNA, 15 bp, Homo sapiens
aaatgagcattagct

SEQ ID NO: 2731603 - DNA, 12 bp, Homo sapiens
aaatgaggaaac

SEQ ID NO: 2731604 - DNA, 14 bp, Homo sapiens
aaatgaggaaacat

SEQ ID NO: 2731605 - DNA, 13 bp, Homo sapiens
aaatgctattcag

SEQ ID NO: 2731606 - DNA, 24 bp, Homo sapiens
aaatgctggatgagcaactcctgt

SEQ ID NO: 2731607 - DNA, 22 bp, Homo sapiens
aaatggaactccccagggcctc

SEQ ID NO: 2731608 - DNA, 23 bp, Homo sapiens
aaatgtttaattcattaatctgt

SEQ ID NO: 2731609 - DNA, 21 bp, Homo sapiens
aaattaaattctctctaacat

SEQ ID NO: 2731610 - DNA, 23 bp, Homo sapiens
aaattaatcttttaaaaatgatg

SEQ ID NO: 2731611 - DNA, 16 bp, Homo sapiens
aaattagtttaaaatg

SEQ ID NO: 2731612 - DNA, 21 bp, Homo sapiens
aaattatttctaaaacattaa

SEQ ID NO: 2731613 - DNA, 19 bp, Homo sapiens
aaattcaacctgtgtctta

SEQ ID NO: 2731614 - DNA, 21 bp, Homo sapiens
aaattcactgttgaatgcctg

SEQ ID NO: 2731615 - DNA, 19 bp, Homo sapiens
aaattgatcattcataatt

SEQ ID NO: 2731616 - DNA, 18 bp, Homo sapiens
aaattgtctgtctgctct

SEQ ID NO: 2731617 - DNA, 19 bp, Homo sapiens
aaattgtctgtctgctctt

SEQ ID NO: 2731618 - DNA, 22 bp, Homo sapiens
aaatttccactcaggtctgttt

SEQ ID NO: 2731619 - DNA, 17 bp, Homo sapiens
aaattttgaggtctttt

SEQ ID NO: 2731620 - DNA, 20 bp, Homo sapiens
aaatttttctgggaagaaaa

SEQ ID NO: 2731621 - DNA, 19 bp, Homo sapiens
aaattttttgatgtcagcc

SEQ ID NO: 2731622 - DNA, 20 bp, Homo sapiens
aaattttttgatgtcagcct

SEQ ID NO: 2731623 - DNA, 16 bp, Homo sapiens
aaatttttttccagaa

SEQ ID NO: 2731624 - DNA, 18 bp, Homo sapiens
aacaaagttactggctct

SEQ ID NO: 2731625 - DNA, 22 bp, Homo sapiens
aacaaagttactggctctttgt

SEQ ID NO: 2731626 - DNA, 19 bp, Homo sapiens
aacaaatgtatcagtgatg

SEQ ID NO: 2731627 - DNA, 15 bp, Homo sapiens
aacaataaagagctc

SEQ ID NO: 2731628 - DNA, 15 bp, Homo sapiens
aacaatatgattgca

SEQ ID NO: 2731629 - DNA, 20 bp, Homo sapiens
aacaatatgattgcactaaa

SEQ ID NO: 2731630 - DNA, 11 bp, Homo sapiens
aacaatcacaa

SEQ ID NO: 2731631 - DNA, 23 bp, Homo sapiens
aacaatcacaaaagctgtgtctc

SEQ ID NO: 2731632 - DNA, 10 bp, Homo sapiens
aacacaaaaa

SEQ ID NO: 2731633 - DNA, 22 bp, Homo sapiens
aacacagtgcctggcaaggcct

SEQ ID NO: 2731634 - DNA, 12 bp, Homo sapiens
aacacccactgg

SEQ ID NO: 2731635 - DNA, 15 bp, Homo sapiens
aacacccactggcca

SEQ ID NO: 2731636 - DNA, 20 bp, Homo sapiens
aacacccagtctgttcccca

SEQ ID NO: 2731637 - DNA, 21 bp, Homo sapiens
aacacgcatgcctcagccagc

SEQ ID NO: 2731638 - DNA, 21 bp, Homo sapiens
aacacgtccagaatttttcat

SEQ ID NO: 2731639 - DNA, 20 bp, Homo sapiens
aacactcttcttgagcagac

SEQ ID NO: 2731640 - DNA, 21 bp, Homo sapiens
aacacttttctccagggttca

SEQ ID NO: 2731641 - DNA, 20 bp, Homo sapiens
aacagactatttaacttgag

SEQ ID NO: 2731642 - DNA, 15 bp, Homo sapiens
aacagcaaagccata

SEQ ID NO: 2731643 - DNA, 23 bp, Homo sapiens
aacaggcccttggtagagctggt

SEQ ID NO: 2731644 - DNA, 13 bp, Homo sapiens
aacaggctctgag

SEQ ID NO: 2731645 - DNA, 15 bp, Homo sapiens
aacagtgctctgcct

SEQ ID NO: 2731646 - DNA, 20 bp, Homo sapiens
aacagtgttaggcctggcac

SEQ ID NO: 2731647 - DNA, 24 bp, Homo sapiens
aacatagttgaaaaaagaagtttg

SEQ ID NO: 2731648 - DNA, 17 bp, Homo sapiens
aacatatgtatctttgg

SEQ ID NO: 2731649 - DNA, 18 bp, Homo sapiens
aacatcttcatgttttag

SEQ ID NO: 2731650 - DNA, 21 bp, Homo sapiens
aacatgaaaaacacggcagct

SEQ ID NO: 2731651 - DNA, 15 bp, Homo sapiens
aacatgaaaacattg

SEQ ID NO: 2731652 - DNA, 21 bp, Homo sapiens
aacatgaaaacattgatgaat

SEQ ID NO: 2731653 - DNA, 18 bp, Homo sapiens
aacatggattccaaagca

SEQ ID NO: 2731654 - DNA, 17 bp, Homo sapiens
aacatggtgtgtgtctc

SEQ ID NO: 2731655 - DNA, 21 bp, Homo sapiens
aacatggtgtgtgtctctgac

SEQ ID NO: 2731656 - DNA, 18 bp, Homo sapiens
aacatgtatcactcactg

SEQ ID NO: 2731657 - DNA, 14 bp, Homo sapiens
aacatgtatgtgga

SEQ ID NO: 2731658 - DNA, 22 bp, Homo sapiens
aacatgtgcaactcttgtattg

SEQ ID NO: 2731659 - DNA, 14 bp, Homo sapiens
aacatgtttctgtt

SEQ ID NO: 2731660 - DNA, 20 bp, Homo sapiens
aacattaccttgtctttcaa

SEQ ID NO: 2731661 - DNA, 18 bp, Homo sapiens
aacattgatgaatgagga

SEQ ID NO: 2731662 - DNA, 14 bp, Homo sapiens
aacattgcaataga

SEQ ID NO: 2731663 - DNA, 18 bp, Homo sapiens
aacatttaggagaagttg

SEQ ID NO: 2731664 - DNA, 18 bp, Homo sapiens
aacatttttgtacattat

SEQ ID NO: 2731665 - DNA, 19 bp, Homo sapiens
aaccaaagagtctctggct

SEQ ID NO: 2731666 - DNA, 13 bp, Homo sapiens
aaccaacccatgt

SEQ ID NO: 2731667 - DNA, 12 bp, Homo sapiens
actcccactcct

SEQ ID NO: 2731668 - DNA, 20 bp, Homo sapiens
actcccacttccctgacact

SEQ ID NO: 2731669 - DNA, 14 bp, Homo sapiens
actccccagggcct

SEQ ID NO: 2731670 - DNA, 20 bp, Homo sapiens
actccccagtgctcctgtgc

SEQ ID NO: 2731671 - DNA, 13 bp, Homo sapiens
actccctcctcac

SEQ ID NO: 2731672 - DNA, 15 bp, Homo sapiens
actccctcctcacac

SEQ ID NO: 2731673 - DNA, 20 bp, Homo sapiens
actccctcctcacactccag

SEQ ID NO: 2731674 - DNA, 22 bp, Homo sapiens
actcctaatcaagagtctctcc

SEQ ID NO: 2731675 - DNA, 24 bp, Homo sapiens
actcctaatcaagagtctctccag

SEQ ID NO: 2731676 - DNA, 12 bp, Homo sapiens
actcctcctgcc

SEQ ID NO: 2731677 - DNA, 14 bp, Homo sapiens
actcctcctgccag

SEQ ID NO: 2731678 - DNA, 17 bp, Homo sapiens
actcctctagtcagcac

SEQ ID NO: 2731679 - DNA, 20 bp, Homo sapiens
actcctgttctttgggctca

SEQ ID NO: 2731680 - DNA, 15 bp, Homo sapiens
actcgatgaatgtgt

SEQ ID NO: 2731681 - DNA, 15 bp, Homo sapiens
actcgggctcctgtg

SEQ ID NO: 2731682 - DNA, 23 bp, Homo sapiens
actctaccctggtaggaaagcac

SEQ ID NO: 2731683 - DNA, 23 bp, Homo sapiens
actctagtgacttcctggtgagg

SEQ ID NO: 2731684 - DNA, 16 bp, Homo sapiens
actctctctctgttaa

SEQ ID NO: 2731685 - DNA, 13 bp, Homo sapiens
actctctgcctgc

SEQ ID NO: 2731686 - DNA, 15 bp, Homo sapiens
actctctgcctgctt

SEQ ID NO: 2731687 - DNA, 22 bp, Homo sapiens
actctctgcctgcttcctggac

SEQ ID NO: 2731688 - DNA, 22 bp, Homo sapiens
actctgcagatagtgcctctgc

SEQ ID NO: 2731689 - DNA, 13 bp, Homo sapiens
actctgcaggcag

SEQ ID NO: 2731690 - DNA, 16 bp, Homo sapiens
actctgccagccacat

SEQ ID NO: 2731691 - DNA, 12 bp, Homo sapiens
actctgctgcct

SEQ ID NO: 2731692 - DNA, 14 bp, Homo sapiens
actctggactttct

SEQ ID NO: 2731693 - DNA, 16 bp, Homo sapiens
actctgtggggccttg

SEQ ID NO: 2731694 - DNA, 17 bp, Homo sapiens
actctgtggggccttgg

SEQ ID NO: 2731695 - DNA, 17 bp, Homo sapiens
actcttagaagtgacat

SEQ ID NO: 2731696 - DNA, 19 bp, Homo sapiens
actcttccaccagagcagg

SEQ ID NO: 2731697 - DNA, 21 bp, Homo sapiens
actcttccaccagagcagggg

SEQ ID NO: 2731698 - DNA, 11 bp, Homo sapiens
actcttcctgc

SEQ ID NO: 2731699 - DNA, 19 bp, Homo sapiens
actcttgtattgctccatt

SEQ ID NO: 2731700 - DNA, 24 bp, Homo sapiens
actctttgctacaataaatgctga

SEQ ID NO: 2731701 - DNA, 13 bp, Homo sapiens
actctttttgtac

SEQ ID NO: 2731702 - DNA, 13 bp, Homo sapiens
actgaaagtggtt

SEQ ID NO: 2731703 - DNA, 21 bp, Homo sapiens
actgaaccgacttttctaaag

SEQ ID NO: 2731704 - DNA, 13 bp, Homo sapiens
actgaagtgcagc

SEQ ID NO: 2731705 - DNA, 16 bp, Homo sapiens
actgaagtgcagctca

SEQ ID NO: 2731706 - DNA, 14 bp, Homo sapiens
actgaatacttgaa

SEQ ID NO: 2731707 - DNA, 21 bp, Homo sapiens
actgaatacttgaagtaggaa

SEQ ID NO: 2731708 - DNA, 19 bp, Homo sapiens
actgaccgccgcttccagc

SEQ ID NO: 2731709 - DNA, 22 bp, Homo sapiens
actgaggccaaaagaggcctga

SEQ ID NO: 2731710 - DNA, 17 bp, Homo sapiens
actgagtacaattgtta

SEQ ID NO: 2731711 - DNA, 19 bp, Homo sapiens
actgatgcaatgtatggct

SEQ ID NO: 2731712 - DNA, 18 bp, Homo sapiens
actgcaagctctgcctcc

SEQ ID NO: 2731713 - DNA, 18 bp, Homo sapiens
actgcaccccctcctgct

SEQ ID NO: 2731714 - DNA, 19 bp, Homo sapiens
actgcaccccctcctgctg

SEQ ID NO: 2731715 - DNA, 15 bp, Homo sapiens
actgcactccagcct

SEQ ID NO: 2731716 - DNA, 19 bp, Homo sapiens
actgcactccagcctgggc

SEQ ID NO: 2731717 - DNA, 20 bp, Homo sapiens
actgcactccagcctgggcg

SEQ ID NO: 2731718 - DNA, 17 bp, Homo sapiens
actgccaaaaatagaaa

SEQ ID NO: 2731719 - DNA, 15 bp, Homo sapiens
actgccccatctcct

SEQ ID NO: 2731720 - DNA, 15 bp, Homo sapiens
actgcggagcagcct

SEQ ID NO: 2731721 - DNA, 20 bp, Homo sapiens
actgcgggatggtcctgggg

SEQ ID NO: 2731722 - DNA, 22 bp, Homo sapiens
actgcgggatggtcctggggct

SEQ ID NO: 2731723 - DNA, 15 bp, Homo sapiens
actgctgacccacca

SEQ ID NO: 2731724 - DNA, 18 bp, Homo sapiens
actgctgacccaccaagg

SEQ ID NO: 2731725 - DNA, 19 bp, Homo sapiens
actgctgggactggccagg

SEQ ID NO: 2731726 - DNA, 15 bp, Homo sapiens
actgctggggctggt

SEQ ID NO: 2731727 - DNA, 16 bp, Homo sapiens
actgctggggctggtg

SEQ ID NO: 2731728 - DNA, 22 bp, Homo sapiens
actgctggggctggtgaggccg

SEQ ID NO: 2731729 - DNA, 19 bp, Homo sapiens
actgctgggtggcccatcc

SEQ ID NO: 2731730 - DNA, 19 bp, Homo sapiens
actgcttcctctgaatatt

SEQ ID NO: 2731731 - DNA, 22 bp, Homo sapiens
actggacttgagcttggcagct

SEQ ID NO: 2731732 - DNA, 15 bp, Homo sapiens
actggccactcccca

SEQ ID NO: 2731733 - DNA, 20 bp, Homo sapiens
actggccagtcctagagctc

SEQ ID NO: 2731734 - DNA, 21 bp, Homo sapiens
actggccagtcctagagctcc

SEQ ID NO: 2731735 - DNA, 17 bp, Homo sapiens
actggccgtggctccag

SEQ ID NO: 2731736 - DNA, 19 bp, Homo sapiens
actggcctcgcctggcctg

SEQ ID NO: 2731737 - DNA, 19 bp, Homo sapiens
actggctctttgtgtgtct

SEQ ID NO: 2731738 - DNA, 19 bp, Homo sapiens
actggctgcctccactccc

SEQ ID NO: 2731739 - DNA, 17 bp, Homo sapiens
actggctggctgcagtg

SEQ ID NO: 2731740 - DNA, 22 bp, Homo sapiens
actggtttatccacccacaaca

SEQ ID NO: 2731741 - DNA, 23 bp, Homo sapiens
actgtaagcagattacaataaat

SEQ ID NO: 2731742 - DNA, 14 bp, Homo sapiens
actgtacttcccaa

SEQ ID NO: 2731743 - DNA, 14 bp, Homo sapiens
actgtcccaggagc

SEQ ID NO: 2731744 - DNA, 20 bp, Homo sapiens
actgtccgcctctgcccgca

SEQ ID NO: 2731745 - DNA, 22 bp, Homo sapiens
actgtccgcctctgcccgcaga

SEQ ID NO: 2731746 - DNA, 10 bp, Homo sapiens
actgtcctgc

SEQ ID NO: 2731747 - DNA, 17 bp, Homo sapiens
actgtcctgctccacag

SEQ ID NO: 2731748 - DNA, 20 bp, Homo sapiens
actgtgacacagctgagctg

SEQ ID NO: 2731749 - DNA, 12 bp, Homo sapiens
actgtgtttcta

SEQ ID NO: 2731750 - DNA, 16 bp, Homo sapiens
acttagaataaaattg

SEQ ID NO: 2731751 - DNA, 13 bp, Homo sapiens
acttatcctgaca

SEQ ID NO: 2731752 - DNA, 13 bp, Homo sapiens
acttatttccatg

SEQ ID NO: 2731753 - DNA, 11 bp, Homo sapiens
acttatttgag

SEQ ID NO: 2731754 - DNA, 16 bp, Homo sapiens
acttcactaccaaatg

SEQ ID NO: 2731755 - DNA, 16 bp, Homo sapiens
acttcactgcagcctt

SEQ ID NO: 2731756 - DNA, 17 bp, Homo sapiens
acttcactgcagccttt

SEQ ID NO: 2731757 - DNA, 19 bp, Homo sapiens
acttcaggagctgacagag

SEQ ID NO: 2731758 - DNA, 17 bp, Homo sapiens
acttcaggggctgcccg

SEQ ID NO: 2731759 - DNA, 22 bp, Homo sapiens
acttcaggggctgcccgctccc

SEQ ID NO: 2731760 - DNA, 20 bp, Homo sapiens
acttcatagatgagaaaact

SEQ ID NO: 2731761 - DNA, 14 bp, Homo sapiens
acttcatgcccact

SEQ ID NO: 2731762 - DNA, 17 bp, Homo sapiens
acttcatgcccactgcc

SEQ ID NO: 2731763 - DNA, 17 bp, Homo sapiens
acttccatgatacttta

SEQ ID NO: 2731764 - DNA, 18 bp, Homo sapiens
acttccatgatactttaa

SEQ ID NO: 2731765 - DNA, 18 bp, Homo sapiens
acttcccaattgccacat

SEQ ID NO: 2731766 - DNA, 23 bp, Homo sapiens
acttccctgcttttctcccagaa

SEQ ID NO: 2731767 - DNA, 17 bp, Homo sapiens
acttcctcgcctctccc

SEQ ID NO: 2731768 - DNA, 14 bp, Homo sapiens
acttctatatcatt

SEQ ID NO: 2731769 - DNA, 18 bp, Homo sapiens
acttcttgaaacagcctg

SEQ ID NO: 2731770 - DNA, 19 bp, Homo sapiens
acttgattggtttaaaagt

SEQ ID NO: 2731771 - DNA, 17 bp, Homo sapiens
acttgcctggggccaca

SEQ ID NO: 2731772 - DNA, 16 bp, Homo sapiens
acttgggtacatcttg

SEQ ID NO: 2731773 - DNA, 15 bp, Homo sapiens
acttgggtcttccct

SEQ ID NO: 2731774 - DNA, 21 bp, Homo sapiens
acttgttcaacagtttctcaa

SEQ ID NO: 2731775 - DNA, 13 bp, Homo sapiens
actttaattttta

SEQ ID NO: 2731776 - DNA, 21 bp, Homo sapiens
actttaatttttataaatatg

SEQ ID NO: 2731777 - DNA, 22 bp, Homo sapiens
actttaatttttataaatatgt

SEQ ID NO: 2731778 - DNA, 15 bp, Homo sapiens
actttatctgaaaat

SEQ ID NO: 2731779 - DNA, 16 bp, Homo sapiens
actttgatctctgctt

SEQ ID NO: 2731780 - DNA, 18 bp, Homo sapiens
actttgatctctgcttac

SEQ ID NO: 2731781 - DNA, 16 bp, Homo sapiens
acttttaaaactatat

SEQ ID NO: 2731782 - DNA, 21 bp, Homo sapiens
acttttcagaattgaaggaga

SEQ ID NO: 2731783 - DNA, 22 bp, Homo sapiens
acttttctaaagctctgaacaa

SEQ ID NO: 2731784 - DNA, 14 bp, Homo sapiens
acttttctccaggg

SEQ ID NO: 2731785 - DNA, 17 bp, Homo sapiens
actttttaaacagtgtt

SEQ ID NO: 2731786 - DNA, 12 bp, Homo sapiens
actttttctgta

SEQ ID NO: 2731787 - DNA, 16 bp, Homo sapiens
agaaaaatggcctgca

SEQ ID NO: 2731788 - DNA, 23 bp, Homo sapiens
agaaaacttcagagaaattatgt

SEQ ID NO: 2731789 - DNA, 13 bp, Homo sapiens
agaaaacttccaa

SEQ ID NO: 2731790 - DNA, 17 bp, Homo sapiens
agaaaagagggagagat

SEQ ID NO: 2731791 - DNA, 21 bp, Homo sapiens
agaaaatcagattttctcctg

SEQ ID NO: 2731792 - DNA, 15 bp, Homo sapiens
agaaaatgaatttga

SEQ ID NO: 2731793 - DNA, 19 bp, Homo sapiens
agaaaatgcaggagagctt

SEQ ID NO: 2731794 - DNA, 20 bp, Homo sapiens
aaccacgtaccaagccaccg

SEQ ID NO: 2731795 - DNA, 19 bp, Homo sapiens
aaccaggggtaccaggcac

SEQ ID NO: 2731796 - DNA, 18 bp, Homo sapiens
aacccagaactggacgcc

SEQ ID NO: 2731797 - DNA, 16 bp, Homo sapiens
aacccagccgctgccc

SEQ ID NO: 2731798 - DNA, 22 bp, Homo sapiens
aacctcgaggtttctcaaagaa

SEQ ID NO: 2731799 - DNA, 19 bp, Homo sapiens
aacctctaatttattttgt

SEQ ID NO: 2731800 - DNA, 20 bp, Homo sapiens
aacctctaatttattttgtc

SEQ ID NO: 2731801 - DNA, 23 bp, Homo sapiens
aacctgcatttttaaaggacaaa

SEQ ID NO: 2731802 - DNA, 14 bp, Homo sapiens
aacctgcctgtgca

SEQ ID NO: 2731803 - DNA, 15 bp, Homo sapiens
aacctgtccttactc

SEQ ID NO: 2731804 - DNA, 20 bp, Homo sapiens
aacctgtttttaacatgtga

SEQ ID NO: 2731805 - DNA, 17 bp, Homo sapiens
aaccttgtttctttctg

SEQ ID NO: 2731806 - DNA, 14 bp, Homo sapiens
aacctttcccattt

SEQ ID NO: 2731807 - DNA, 18 bp, Homo sapiens
aacctttctactttttct

SEQ ID NO: 2731808 - DNA, 14 bp, Homo sapiens
aacgaacgttttaa

SEQ ID NO: 2731809 - DNA, 15 bp, Homo sapiens
aacggggtccttcaa

SEQ ID NO: 2731810 - DNA, 14 bp, Homo sapiens
aacgtatagtcaat

SEQ ID NO: 2731811 - DNA, 23 bp, Homo sapiens
aactacacacccccaagccacag

SEQ ID NO: 2731812 - DNA, 19 bp, Homo sapiens
aactaccagtgggcatgta

SEQ ID NO: 2731813 - DNA, 20 bp, Homo sapiens
aactaccagtgggcatgtat

SEQ ID NO: 2731814 - DNA, 19 bp, Homo sapiens
aactaccctctcaaatgga

SEQ ID NO: 2731815 - DNA, 13 bp, Homo sapiens
aactactttgaat

SEQ ID NO: 2731816 - DNA, 17 bp, Homo sapiens
aactagaactgaatttt

SEQ ID NO: 2731817 - DNA, 18 bp, Homo sapiens
aactagacattattttgt

SEQ ID NO: 2731818 - DNA, 14 bp, Homo sapiens
aactagcctcatct

SEQ ID NO: 2731819 - DNA, 22 bp, Homo sapiens
aactatgccgtgtagtttctgg

SEQ ID NO: 2731820 - DNA, 16 bp, Homo sapiens
aactcagacattccaa

SEQ ID NO: 2731821 - DNA, 14 bp, Homo sapiens
aactcagagcctcc

SEQ ID NO: 2731822 - DNA, 23 bp, Homo sapiens
aactccatgggattttatctgtg

SEQ ID NO: 2731823 - DNA, 17 bp, Homo sapiens
aactcctactgcttcct

SEQ ID NO: 2731824 - DNA, 17 bp, Homo sapiens
aactcctgacctcgtga

SEQ ID NO: 2731825 - DNA, 23 bp, Homo sapiens
aactcgatgaatgtgttgatttg

SEQ ID NO: 2731826 - DNA, 14 bp, Homo sapiens
aactctgcaggaaa

SEQ ID NO: 2731827 - DNA, 17 bp, Homo sapiens
aactcttggccagagct

SEQ ID NO: 2731828 - DNA, 21 bp, Homo sapiens
aactcttgtattgctccattt

SEQ ID NO: 2731829 - DNA, 20 bp, Homo sapiens
aactgagtacaattgttatg

SEQ ID NO: 2731830 - DNA, 17 bp, Homo sapiens
aactggacgcccagctg

SEQ ID NO: 2731831 - DNA, 19 bp, Homo sapiens
aactggtcaccatgaaact

SEQ ID NO: 2731832 - DNA, 13 bp, Homo sapiens
aactgttgctcga

SEQ ID NO: 2731833 - DNA, 20 bp, Homo sapiens
aactgttgctcgaagactgt

SEQ ID NO: 2731834 - DNA, 16 bp, Homo sapiens
aacttagaataaaatt

SEQ ID NO: 2731835 - DNA, 17 bp, Homo sapiens
aacttagaataaaattg

SEQ ID NO: 2731836 - DNA, 19 bp, Homo sapiens
aacttagaataaaattgta

SEQ ID NO: 2731837 - DNA, 21 bp, Homo sapiens
aacttagaataaaattgtaaa

SEQ ID NO: 2731838 - DNA, 23 bp, Homo sapiens
aacttattgtattcctcatgtca

SEQ ID NO: 2731839 - DNA, 16 bp, Homo sapiens
aacttgagggtaataa

SEQ ID NO: 2731840 - DNA, 18 bp, Homo sapiens
aagaaaaccctaagtgtg

SEQ ID NO: 2731841 - DNA, 16 bp, Homo sapiens
aagaaaagttttgtaa

SEQ ID NO: 2731842 - DNA, 22 bp, Homo sapiens
aagaaaagttttgtaaatttct

SEQ ID NO: 2731843 - DNA, 14 bp, Homo sapiens
aagaaaatcaatga

SEQ ID NO: 2731844 - DNA, 19 bp, Homo sapiens
aagaaaatgaatttgactg

SEQ ID NO: 2731845 - DNA, 22 bp, Homo sapiens
aagaaaatgaatttgactggtt

SEQ ID NO: 2731846 - DNA, 13 bp, Homo sapiens
aagaaacactaaa

SEQ ID NO: 2731847 - DNA, 14 bp, Homo sapiens
aagaaacactaaat

SEQ ID NO: 2731848 - DNA, 21 bp, Homo sapiens
aagaaacccttccacgtgtat

SEQ ID NO: 2731849 - DNA, 14 bp, Homo sapiens
aagaaatcaatttt

SEQ ID NO: 2731850 - DNA, 19 bp, Homo sapiens
aagaaatcgccttatgaga

SEQ ID NO: 2731851 - DNA, 20 bp, Homo sapiens
aagaaatcgccttatgagaa

SEQ ID NO: 2731852 - DNA, 21 bp, Homo sapiens
aagaaatcgccttatgagaac

SEQ ID NO: 2731853 - DNA, 21 bp, Homo sapiens
aagaaatttccactcaggtct

SEQ ID NO: 2731854 - DNA, 23 bp, Homo sapiens
aagaactgccccatctcctccca

SEQ ID NO: 2731855 - DNA, 13 bp, Homo sapiens
aagaatcccaccc

SEQ ID NO: 2731856 - DNA, 19 bp, Homo sapiens
aagaattctattttgctgg

SEQ ID NO: 2731857 - DNA, 20 bp, Homo sapiens
aagaattctattttgctgga

SEQ ID NO: 2731858 - DNA, 22 bp, Homo sapiens
aagacagtggcactaaaatgtt

SEQ ID NO: 2731859 - DNA, 13 bp, Homo sapiens
aagacatcaatga

SEQ ID NO: 2731860 - DNA, 14 bp, Homo sapiens
aagacatcaatgaa

SEQ ID NO: 2731861 - DNA, 16 bp, Homo sapiens
aagacatcagtctcca

SEQ ID NO: 2731862 - DNA, 22 bp, Homo sapiens
aagacgtcctggaatgaagcat

SEQ ID NO: 2731863 - DNA, 22 bp, Homo sapiens
aagactctgtctcaataaataa

SEQ ID NO: 2731864 - DNA, 13 bp, Homo sapiens
aagactgaaagaa

SEQ ID NO: 2731865 - DNA, 22 bp, Homo sapiens
aagactgcctcaaaaaaaaaac

SEQ ID NO: 2731866 - DNA, 18 bp, Homo sapiens
aagagagaaaacttattt

SEQ ID NO: 2731867 - DNA, 13 bp, Homo sapiens
aagagcacagccc

SEQ ID NO: 2731868 - DNA, 16 bp, Homo sapiens
aagagccttcacatga

SEQ ID NO: 2731869 - DNA, 17 bp, Homo sapiens
aagagccttcacatgaa

SEQ ID NO: 2731870 - DNA, 15 bp, Homo sapiens
aagagtctctggctc

SEQ ID NO: 2731871 - DNA, 19 bp, Homo sapiens
aagagtctctggctcagct

SEQ ID NO: 2731872 - DNA, 21 bp, Homo sapiens
aagatccaaatgctgtgcaaa

SEQ ID NO: 2731873 - DNA, 23 bp, Homo sapiens
aagatccaaatgctgtgcaaaca

SEQ ID NO: 2731874 - DNA, 19 bp, Homo sapiens
aagatgaaaccgtccctga

SEQ ID NO: 2731875 - DNA, 19 bp, Homo sapiens
aagatggctattataatgg

SEQ ID NO: 2731876 - DNA, 22 bp, Homo sapiens
aagatggctggaaggagccagc

SEQ ID NO: 2731877 - DNA, 15 bp, Homo sapiens
aagattatatatcat

SEQ ID NO: 2731878 - DNA, 23 bp, Homo sapiens
aagattatatatcataaagtatg

SEQ ID NO: 2731879 - DNA, 23 bp, Homo sapiens
aagcaaacacacagactctgtga

SEQ ID NO: 2731880 - DNA, 14 bp, Homo sapiens
aagcaatactgttt

SEQ ID NO: 2731881 - DNA, 17 bp, Homo sapiens
aagcaatactgtttcca

SEQ ID NO: 2731882 - DNA, 12 bp, Homo sapiens
aagcaatttata

SEQ ID NO: 2731883 - DNA, 18 bp, Homo sapiens
aagcaatttatatcttta

SEQ ID NO: 2731884 - DNA, 17 bp, Homo sapiens
aagcacaagtacttttg

SEQ ID NO: 2731885 - DNA, 17 bp, Homo sapiens
aagcaccgcagcatgtg

SEQ ID NO: 2731886 - DNA, 19 bp, Homo sapiens
aagcaccgcctccaaatgc

SEQ ID NO: 2731887 - DNA, 22 bp, Homo sapiens
aagcagacgtgagtgtgacttt

SEQ ID NO: 2731888 - DNA, 17 bp, Homo sapiens
aagcagattacaataaa

SEQ ID NO: 2731889 - DNA, 18 bp, Homo sapiens
aagcagattacaataaat

SEQ ID NO: 2731890 - DNA, 14 bp, Homo sapiens
aagcagcaattaat

SEQ ID NO: 2731891 - DNA, 22 bp, Homo sapiens
aagcaggagtaagtttctcatc

SEQ ID NO: 2731892 - DNA, 18 bp, Homo sapiens
aagcatcacctcaggcca

SEQ ID NO: 2731893 - DNA, 15 bp, Homo sapiens
aagcatgagtggcct

SEQ ID NO: 2731894 - DNA, 19 bp, Homo sapiens
aagcatgagtggccttaat

SEQ ID NO: 2731895 - DNA, 18 bp, Homo sapiens
aagcatgtttaaaacaaa

SEQ ID NO: 2731896 - DNA, 16 bp, Homo sapiens
aagcattttcagcatc

SEQ ID NO: 2731897 - DNA, 20 bp, Homo sapiens
aagccaaactctgccagcca

SEQ ID NO: 2731898 - DNA, 16 bp, Homo sapiens
aagccaacgacaaagc

SEQ ID NO: 2731899 - DNA, 20 bp, Homo sapiens
aagccaccgcagctgctgcc

SEQ ID NO: 2731900 - DNA, 23 bp, Homo sapiens
aagccaccgcagctgctgccact

SEQ ID NO: 2731901 - DNA, 17 bp, Homo sapiens
aagccactgaagctggg

SEQ ID NO: 2731902 - DNA, 18 bp, Homo sapiens
aagccggcagaaatagct

SEQ ID NO: 2731903 - DNA, 14 bp, Homo sapiens
aagcctctgctgcc

SEQ ID NO: 2731904 - DNA, 21 bp, Homo sapiens
aagcctctgtgtcactggctg

SEQ ID NO: 2731905 - DNA, 23 bp, Homo sapiens
aagcggaaaaggttttattttgt

SEQ ID NO: 2731906 - DNA, 17 bp, Homo sapiens
aagctaaaatgaaaaat

SEQ ID NO: 2731907 - DNA, 14 bp, Homo sapiens
aagctcagtggcaa

SEQ ID NO: 2731908 - DNA, 16 bp, Homo sapiens
aagctccaccctcctg

SEQ ID NO: 2731909 - DNA, 13 bp, Homo sapiens
aagctccctggtg

SEQ ID NO: 2731910 - DNA, 22 bp, Homo sapiens
aagctccctggtgagggagcct

SEQ ID NO: 2731911 - DNA, 18 bp, Homo sapiens
aagcttagattttctgta

SEQ ID NO: 2731912 - DNA, 18 bp, Homo sapiens
aaggaaaaactgatgttt

SEQ ID NO: 2731913 - DNA, 18 bp, Homo sapiens
aaggaacacccggaaaga

SEQ ID NO: 2731914 - DNA, 12 bp, Homo sapiens
aaggacaaacag

SEQ ID NO: 2731915 - DNA, 17 bp, Homo sapiens
aaggacaacctgcccct

SEQ ID NO: 2731916 - DNA, 21 bp, Homo sapiens
aaggactaacgaacgttttaa

SEQ ID NO: 2731917 - DNA, 21 bp, Homo sapiens
aaggactggccgtggctccag

SEQ ID NO: 2731918 - DNA, 12 bp, Homo sapiens
aaggatcttttg

SEQ ID NO: 2731919 - DNA, 13 bp, Homo sapiens
aaggattttacca

SEQ ID NO: 2731920 - DNA, 14 bp, Homo sapiens
aaggattttaccaa

SEQ ID NO: 2731921 - DNA, 17 bp, Homo sapiens
aaggattttaccaaagc

SEQ ID NO: 2731922 - DNA, 17 bp, Homo sapiens
aaggcagttctgtgtcc

SEQ ID NO: 2731923 - DNA, 15 bp, Homo sapiens
aaggcatctgagtgt

SEQ ID NO: 2731924 - DNA, 14 bp, Homo sapiens
aaggccactcagga

SEQ ID NO: 2731925 - DNA, 12 bp, Homo sapiens
aaggccagggca

SEQ ID NO: 2731926 - DNA, 13 bp, Homo sapiens
aaggccagggcac

SEQ ID NO: 2731927 - DNA, 14 bp, Homo sapiens
aaggcctcccacag

SEQ ID NO: 2731928 - DNA, 15 bp, Homo sapiens
aaggcctcccacagt

SEQ ID NO: 2731929 - DNA, 17 bp, Homo sapiens
aaggcctcccacagtga

SEQ ID NO: 2731930 - DNA, 13 bp, Homo sapiens
aaggcctcccctg

SEQ ID NO: 2731931 - DNA, 14 bp, Homo sapiens
aaggctgatgcatt

SEQ ID NO: 2731932 - DNA, 17 bp, Homo sapiens
aaggctgggtccagggg

SEQ ID NO: 2731933 - DNA, 13 bp, Homo sapiens
aaggcttctccac

SEQ ID NO: 2731934 - DNA, 13 bp, Homo sapiens
aagggaaagctgt

SEQ ID NO: 2731935 - DNA, 15 bp, Homo sapiens
aagggacatgtcttt

SEQ ID NO: 2731936 - DNA, 18 bp, Homo sapiens
aagggagggagctgaggc

SEQ ID NO: 2731937 - DNA, 19 bp, Homo sapiens
aagggagggagctgaggcc

SEQ ID NO: 2731938 - DNA, 16 bp, Homo sapiens
aagggcagtaaagttt

SEQ ID NO: 2731939 - DNA, 14 bp, Homo sapiens
aagggcatccttct

SEQ ID NO: 2731940 - DNA, 14 bp, Homo sapiens
aagggccttctcca

SEQ ID NO: 2731941 - DNA, 13 bp, Homo sapiens
aaggggccctggt

SEQ ID NO: 2731942 - DNA, 18 bp, Homo sapiens
aagggtatgggaagccat

SEQ ID NO: 2731943 - DNA, 21 bp, Homo sapiens
aaggtacggtgagactctgag

SEQ ID NO: 2731944 - DNA, 17 bp, Homo sapiens
aaggtatatcaggaggg

SEQ ID NO: 2731945 - DNA, 13 bp, Homo sapiens
aaggtatctggta

SEQ ID NO: 2731946 - DNA, 18 bp, Homo sapiens
aaggtcgcacctccttgg

SEQ ID NO: 2731947 - DNA, 20 bp, Homo sapiens
aaggtctcacactcctcctg

SEQ ID NO: 2731948 - DNA, 19 bp, Homo sapiens
aaggtgagaggaaatgttg

SEQ ID NO: 2731949 - DNA, 21 bp, Homo sapiens
aaggtgccgatttcatgcatt

SEQ ID NO: 2731950 - DNA, 16 bp, Homo sapiens
aaggtgggctgagccc

SEQ ID NO: 2731951 - DNA, 16 bp, Homo sapiens
aaggtttcactgttca

SEQ ID NO: 2731952 - DNA, 17 bp, Homo sapiens
aaggtttcactgttcat

SEQ ID NO: 2731953 - DNA, 15 bp, Homo sapiens
aaggttttattttgt

SEQ ID NO: 2731954 - DNA, 17 bp, Homo sapiens
aagtaccactcaggcca

SEQ ID NO: 2731955 - DNA, 15 bp, Homo sapiens
aagtactatctttgt

SEQ ID NO: 2731956 - DNA, 18 bp, Homo sapiens
aagtactatctttgtcta

SEQ ID NO: 2731957 - DNA, 19 bp, Homo sapiens
aagtactatctttgtctaa

SEQ ID NO: 2731958 - DNA, 12 bp, Homo sapiens
aagtagctgaga

SEQ ID NO: 2731959 - DNA, 12 bp, Homo sapiens
aagtataacaaa

SEQ ID NO: 2731960 - DNA, 21 bp, Homo sapiens
aagtataggataaattacatt

SEQ ID NO: 2731961 - DNA, 22 bp, Homo sapiens
aagtattaggggtaatatattg

SEQ ID NO: 2731962 - DNA, 16 bp, Homo sapiens
aagtcagactgctggg

SEQ ID NO: 2731963 - DNA, 17 bp, Homo sapiens
aagtcagactgctggga

SEQ ID NO: 2731964 - DNA, 16 bp, Homo sapiens
aagtccaacctgcctg

SEQ ID NO: 2731965 - DNA, 19 bp, Homo sapiens
aagtccaacctgcctgtgc

SEQ ID NO: 2731966 - DNA, 21 bp, Homo sapiens
aagtccttaaccgtggactct

SEQ ID NO: 2731967 - DNA, 14 bp, Homo sapiens
aagtctaaagttta

SEQ ID NO: 2731968 - DNA, 21 bp, Homo sapiens
aagtctaaagtttacagtaaa

SEQ ID NO: 2731969 - DNA, 22 bp, Homo sapiens
aagtctgaggcacctgcatatc

SEQ ID NO: 2731970 - DNA, 13 bp, Homo sapiens
aagtgaataaact

SEQ ID NO: 2731971 - DNA, 14 bp, Homo sapiens
aagtgaataaactt

SEQ ID NO: 2731972 - DNA, 16 bp, Homo sapiens
aagtgaataaacttca

SEQ ID NO: 2731973 - DNA, 20 bp, Homo sapiens
aagtgaataaacttcagcac

SEQ ID NO: 2731974 - DNA, 13 bp, Homo sapiens
aagtgattgaaag

SEQ ID NO: 2731975 - DNA, 17 bp, Homo sapiens
aagtgggtttcaattta

SEQ ID NO: 2731976 - DNA, 13 bp, Homo sapiens
aagtgtcctggac

SEQ ID NO: 2731977 - DNA, 16 bp, Homo sapiens
aagtgtggatgttcag

SEQ ID NO: 2731978 - DNA, 18 bp, Homo sapiens
aagttaaggtatctggta

SEQ ID NO: 2731979 - DNA, 20 bp, Homo sapiens
aagttcatataatttaaaga

SEQ ID NO: 2731980 - DNA, 18 bp, Homo sapiens
aagtttacagtaaataaa

SEQ ID NO: 2731981 - DNA, 19 bp, Homo sapiens
aagtttacagtaaataaat

SEQ ID NO: 2731982 - DNA, 21 bp, Homo sapiens
aagtttgcactgtatgctgga

SEQ ID NO: 2731983 - DNA, 19 bp, Homo sapiens
aagtttgggctaacattta

SEQ ID NO: 2731984 - DNA, 15 bp, Homo sapiens
aagttttatacataa

SEQ ID NO: 2731985 - DNA, 13 bp, Homo sapiens
aagttttcagatt

SEQ ID NO: 2731986 - DNA, 14 bp, Homo sapiens
aagttttctttcca

SEQ ID NO: 2731987 - DNA, 15 bp, Homo sapiens
aataaaattgcactt

SEQ ID NO: 2731988 - DNA, 14 bp, Homo sapiens
aataaaccttgttt

SEQ ID NO: 2731989 - DNA, 21 bp, Homo sapiens
aataaaccttgtttctttctg

SEQ ID NO: 2731990 - DNA, 22 bp, Homo sapiens
aataaacttagaataaaattgt

SEQ ID NO: 2731991 - DNA, 14 bp, Homo sapiens
aataaacttcagca

SEQ ID NO: 2731992 - DNA, 14 bp, Homo sapiens
aataaatatagttg

SEQ ID NO: 2731993 - DNA, 21 bp, Homo sapiens
aataaatatagttgtctttct

SEQ ID NO: 2731994 - DNA, 13 bp, Homo sapiens
aataaatgctgaa

SEQ ID NO: 2731995 - DNA, 13 bp, Homo sapiens
aataaattgtttg

SEQ ID NO: 2731996 - DNA, 16 bp, Homo sapiens
aataactctgattttg

SEQ ID NO: 2731997 - DNA, 22 bp, Homo sapiens
aataaggtataaggatcttttg

SEQ ID NO: 2731998 - DNA, 20 bp, Homo sapiens
aataattttttgcagtcttt

SEQ ID NO: 2731999 - DNA, 18 bp, Homo sapiens
aatacaacagaagttata

SEQ ID NO: 2732000 - DNA, 13 bp, Homo sapiens
aatacaaccagcc

SEQ ID NO: 2732001 - DNA, 19 bp, Homo sapiens
aatacagaaattagccggg

SEQ ID NO: 2732002 - DNA, 19 bp, Homo sapiens
aatacatacaacctatgta

SEQ ID NO: 2732003 - DNA, 23 bp, Homo sapiens
aatagatttcagctatgcagaaa

SEQ ID NO: 2732004 - DNA, 16 bp, Homo sapiens
aatagcaaggccaggg

SEQ ID NO: 2732005 - DNA, 17 bp, Homo sapiens
aatagcaaggccagggc

SEQ ID NO: 2732006 - DNA, 18 bp, Homo sapiens
aatagcgtcataactaga

SEQ ID NO: 2732007 - DNA, 13 bp, Homo sapiens
aatatagttgtct

SEQ ID NO: 2732008 - DNA, 21 bp, Homo sapiens
aatatagttgtctttctttgc

SEQ ID NO: 2732009 - DNA, 14 bp, Homo sapiens
aatatataatgcaa

SEQ ID NO: 2732010 - DNA, 14 bp, Homo sapiens
aatatatatttatc

SEQ ID NO: 2732011 - DNA, 22 bp, Homo sapiens
aatatatatttatcatatttaa

SEQ ID NO: 2732012 - DNA, 23 bp, Homo sapiens
aatatctttcacatgcattttag

SEQ ID NO: 2732013 - DNA, 22 bp, Homo sapiens
aatatggggcattaatattctt

SEQ ID NO: 2732014 - DNA, 14 bp, Homo sapiens
aatattaagaaaca

SEQ ID NO: 2732015 - DNA, 19 bp, Homo sapiens
aatattaagaaacaattta

SEQ ID NO: 2732016 - DNA, 21 bp, Homo sapiens
aatattactgatcttaccttt

SEQ ID NO: 2732017 - DNA, 17 bp, Homo sapiens
aatattctctgatgttt

SEQ ID NO: 2732018 - DNA, 18 bp, Homo sapiens
aatcaagagtctctccag

SEQ ID NO: 2732019 - DNA, 21 bp, Homo sapiens
aatcaagagtctctccagcct

SEQ ID NO: 2732020 - DNA, 14 bp, Homo sapiens
aatcaatgtgagtt

SEQ ID NO: 2732021 - DNA, 17 bp, Homo sapiens
aatcacagggcatttaa

SEQ ID NO: 2732022 - DNA, 20 bp, Homo sapiens
aatcagagctggcagcctcc

SEQ ID NO: 2732023 - DNA, 14 bp, Homo sapiens
aatcaggctttgtc

SEQ ID NO: 2732024 - DNA, 16 bp, Homo sapiens
aatctggcaaagttat

SEQ ID NO: 2732025 - DNA, 15 bp, Homo sapiens
aatcttcagctggtg

SEQ ID NO: 2732026 - DNA, 22 bp, Homo sapiens
aatcttggtttggtacagttca

SEQ ID NO: 2732027 - DNA, 14 bp, Homo sapiens
aatgaagcaaacac

SEQ ID NO: 2732028 - DNA, 22 bp, Homo sapiens
aatgaaggatttcttattttct

SEQ ID NO: 2732029 - DNA, 18 bp, Homo sapiens
aatgaagggtcatttctc

SEQ ID NO: 2732030 - DNA, 16 bp, Homo sapiens
aatgaagtatttctca

SEQ ID NO: 2732031 - DNA, 16 bp, Homo sapiens
aatgaatttgactggt

SEQ ID NO: 2732032 - DNA, 16 bp, Homo sapiens
aatgactttttgaatg

SEQ ID NO: 2732033 - DNA, 16 bp, Homo sapiens
aatgagcttgtaaata

SEQ ID NO: 2732034 - DNA, 16 bp, Homo sapiens
aatgatcataagtcta

SEQ ID NO: 2732035 - DNA, 16 bp, Homo sapiens
aatgatttttgtgtat

SEQ ID NO: 2732036 - DNA, 21 bp, Homo sapiens
aatgcatgtaaggtcttcttg

SEQ ID NO: 2732037 - DNA, 18 bp, Homo sapiens
aatgccttggtttgattt

SEQ ID NO: 2732038 - DNA, 22 bp, Homo sapiens
aatgccttggtttgatttctag

SEQ ID NO: 2732039 - DNA, 24 bp, Homo sapiens
aatgccttggtttgatttctagta

SEQ ID NO: 2732040 - DNA, 15 bp, Homo sapiens
aatgcttatgtgttg

SEQ ID NO: 2732041 - DNA, 20 bp, Homo sapiens
aatgcttatgtgttgcataa

SEQ ID NO: 2732042 - DNA, 18 bp, Homo sapiens
aatgcttctgcctcagct

SEQ ID NO: 2732043 - DNA, 22 bp, Homo sapiens
aatggcctgccttgaagccact

SEQ ID NO: 2732044 - DNA, 17 bp, Homo sapiens
aatgggaattctgactt

SEQ ID NO: 2732045 - DNA, 10 bp, Homo sapiens
aatggtgcct

SEQ ID NO: 2732046 - DNA, 16 bp, Homo sapiens
aatgtcactgaagtga

SEQ ID NO: 2732047 - DNA, 14 bp, Homo sapiens
aatgtcagaaactc

SEQ ID NO: 2732048 - DNA, 23 bp, Homo sapiens
aatgtcagaaactcgatgaatgt

SEQ ID NO: 2732049 - DNA, 20 bp, Homo sapiens
aatgtcattatttgataaca

SEQ ID NO: 2732050 - DNA, 12 bp, Homo sapiens
aatgtcccagag

SEQ ID NO: 2732051 - DNA, 15 bp, Homo sapiens
aatgtgatcatcttt

SEQ ID NO: 2732052 - DNA, 10 bp, Homo sapiens
aatgtgtctg

SEQ ID NO: 2732053 - DNA, 17 bp, Homo sapiens
aatgtgtctgcaacatg

SEQ ID NO: 2732054 - DNA, 18 bp, Homo sapiens
aatgtgtctgcaacatgg

SEQ ID NO: 2732055 - DNA, 21 bp, Homo sapiens
aatgtgtctgcaacatggatt

SEQ ID NO: 2732056 - DNA, 18 bp, Homo sapiens
aatgtgtgtatgttaata

SEQ ID NO: 2732057 - DNA, 17 bp, Homo sapiens
aatgtgttgatttgaga

SEQ ID NO: 2732058 - DNA, 15 bp, Homo sapiens
aatgttggtgcaatt

SEQ ID NO: 2732059 - DNA, 22 bp, Homo sapiens
aatgtttttggcaacaggagag

SEQ ID NO: 2732060 - DNA, 14 bp, Homo sapiens
aatgtttttgtgta

SEQ ID NO: 2732061 - DNA, 23 bp, Homo sapiens
aattaaaccagactctgttgcaa

SEQ ID NO: 2732062 - DNA, 13 bp, Homo sapiens
aattaaactccta

SEQ ID NO: 2732063 - DNA, 19 bp, Homo sapiens
aattaacaaagaatttcag

SEQ ID NO: 2732064 - DNA, 13 bp, Homo sapiens
aattaatctttta

SEQ ID NO: 2732065 - DNA, 20 bp, Homo sapiens
aattaatcttttaaaaatga

SEQ ID NO: 2732066 - DNA, 15 bp, Homo sapiens
aattaattaaaataa

SEQ ID NO: 2732067 - DNA, 15 bp, Homo sapiens
aattacccttcctca

SEQ ID NO: 2732068 - DNA, 15 bp, Homo sapiens
aattactaattctag

SEQ ID NO: 2732069 - DNA, 21 bp, Homo sapiens
aattagaatggataagatgat

SEQ ID NO: 2732070 - DNA, 14 bp, Homo sapiens
aattagccgggcgt

SEQ ID NO: 2732071 - DNA, 20 bp, Homo sapiens
aattagcttttagttttaaa

SEQ ID NO: 2732072 - DNA, 21 bp, Homo sapiens
aattagtttaaaatgaagcaa

SEQ ID NO: 2732073 - DNA, 20 bp, Homo sapiens
aattatttctaaaacattaa

SEQ ID NO: 2732074 - DNA, 15 bp, Homo sapiens
aattattttttgcat

SEQ ID NO: 2732075 - DNA, 11 bp, Homo sapiens
aattcaaagaa

SEQ ID NO: 2732076 - DNA, 14 bp, Homo sapiens
aattcacaaacaaa

SEQ ID NO: 2732077 - DNA, 13 bp, Homo sapiens
aattcactcccac

SEQ ID NO: 2732078 - DNA, 21 bp, Homo sapiens
aattccactggacttgagctt

SEQ ID NO: 2732079 - DNA, 18 bp, Homo sapiens
aattcctagctgtaaata

SEQ ID NO: 2732080 - DNA, 21 bp, Homo sapiens
aattcctagctgtaaatataa

SEQ ID NO: 2732081 - DNA, 21 bp, Homo sapiens
aattcctggcatgacactcta

SEQ ID NO: 2732082 - DNA, 14 bp, Homo sapiens
aattctattttgct

SEQ ID NO: 2732083 - DNA, 16 bp, Homo sapiens
aattctattttgctgg

SEQ ID NO: 2732084 - DNA, 17 bp, Homo sapiens
aattgaggcttacagta

SEQ ID NO: 2732085 - DNA, 13 bp, Homo sapiens
aattgatcattca

SEQ ID NO: 2732086 - DNA, 22 bp, Homo sapiens
aattgattattctgattccact

SEQ ID NO: 2732087 - DNA, 23 bp, Homo sapiens
aattgattattctgattccactt

SEQ ID NO: 2732088 - DNA, 20 bp, Homo sapiens
aattgcttgaacccaggagg

SEQ ID NO: 2732089 - DNA, 13 bp, Homo sapiens
aattggtcattcc

SEQ ID NO: 2732090 - DNA, 12 bp, Homo sapiens
aatttaatttat

SEQ ID NO: 2732091 - DNA, 22 bp, Homo sapiens
aatttagtcccttaaaaattaa

SEQ ID NO: 2732092 - DNA, 23 bp, Homo sapiens
aatttataggcagatctttaaat

SEQ ID NO: 2732093 - DNA, 22 bp, Homo sapiens
aatttatatctttatgcaaaaa

SEQ ID NO: 2732094 - DNA, 13 bp, Homo sapiens
aatttattcttat

SEQ ID NO: 2732095 - DNA, 17 bp, Homo sapiens
aatttattttgtcgaat

SEQ ID NO: 2732096 - DNA, 17 bp, Homo sapiens
aatttcagttctagttg

SEQ ID NO: 2732097 - DNA, 16 bp, Homo sapiens
aatttctctactgtct

SEQ ID NO: 2732098 - DNA, 14 bp, Homo sapiens
aatttgtaagttta

SEQ ID NO: 2732099 - DNA, 12 bp, Homo sapiens
aattttaaattg

SEQ ID NO: 2732100 - DNA, 19 bp, Homo sapiens
aattttactgacagaaatg

SEQ ID NO: 2732101 - DNA, 21 bp, Homo sapiens
aattttactgacagaaatgca

SEQ ID NO: 2732102 - DNA, 23 bp, Homo sapiens
aattttatctacccagtcatgta

SEQ ID NO: 2732103 - DNA, 15 bp, Homo sapiens
aattttgaggtcttt

SEQ ID NO: 2732104 - DNA, 12 bp, Homo sapiens
aattttggaaaa

SEQ ID NO: 2732105 - DNA, 18 bp, Homo sapiens
aattttggaaaaatgtca

SEQ ID NO: 2732106 - DNA, 16 bp, Homo sapiens
aatttttattatttgt

SEQ ID NO: 2732107 - DNA, 16 bp, Homo sapiens
aattttttaaaccact

SEQ ID NO: 2732108 - DNA, 21 bp, Homo sapiens
aattttttgatgtcagccttg

SEQ ID NO: 2732109 - DNA, 21 bp, Homo sapiens
acaaaaatgtaatgatcataa

SEQ ID NO: 2732110 - DNA, 15 bp, Homo sapiens
acaaaagcagctttt

SEQ ID NO: 2732111 - DNA, 16 bp, Homo sapiens
acaaaagcagctttta

SEQ ID NO: 2732112 - DNA, 18 bp, Homo sapiens
acaaaagcagcttttagt

SEQ ID NO: 2732113 - DNA, 12 bp, Homo sapiens
acaaaaggcttt

SEQ ID NO: 2732114 - DNA, 12 bp, Homo sapiens
acaaacagtgaa

SEQ ID NO: 2732115 - DNA, 19 bp, Homo sapiens
acaaagccaaactctgcca

SEQ ID NO: 2732116 - DNA, 14 bp, Homo sapiens
acaaataaagatgg

SEQ ID NO: 2732117 - DNA, 23 bp, Homo sapiens
acaaataattttttgcagtcttt

SEQ ID NO: 2732118 - DNA, 19 bp, Homo sapiens
acaaattgtttcattttgt

SEQ ID NO: 2732119 - DNA, 11 bp, Homo sapiens
acaacaaacac

SEQ ID NO: 2732120 - DNA, 14 bp, Homo sapiens
acaacaaacactgt

SEQ ID NO: 2732121 - DNA, 18 bp, Homo sapiens
acaacatttttgtacatt

SEQ ID NO: 2732122 - DNA, 23 bp, Homo sapiens
acaacatttttgtacattatgtt

SEQ ID NO: 2732123 - DNA, 21 bp, Homo sapiens
acaaccacatttctggccatt

SEQ ID NO: 2732124 - DNA, 14 bp, Homo sapiens
acaaccaggtcttg

SEQ ID NO: 2732125 - DNA, 22 bp, Homo sapiens
acaacctttcccatttcgtgta

SEQ ID NO: 2732126 - DNA, 20 bp, Homo sapiens
acaacgctctaccctgcagc

SEQ ID NO: 2732127 - DNA, 23 bp, Homo sapiens
acaacgctctaccctgcagcttg

SEQ ID NO: 2732128 - DNA, 22 bp, Homo sapiens
acaactagcctcatctccagta

SEQ ID NO: 2732129 - DNA, 12 bp, Homo sapiens
acatgaaaacat

SEQ ID NO: 2732130 - DNA, 13 bp, Homo sapiens
acatgaaaacatt

SEQ ID NO: 2732131 - DNA, 14 bp, Homo sapiens
acatgaaaacattg

SEQ ID NO: 2732132 - DNA, 21 bp, Homo sapiens
acatgatttagggaagcaggg

SEQ ID NO: 2732133 - DNA, 22 bp, Homo sapiens
acatgattttcttttgttttct

SEQ ID NO: 2732134 - DNA, 22 bp, Homo sapiens
acatgctcatcccaaaagctag

SEQ ID NO: 2732135 - DNA, 14 bp, Homo sapiens
acatgtatgtggat

SEQ ID NO: 2732136 - DNA, 15 bp, Homo sapiens
acatgtatgtggata

SEQ ID NO: 2732137 - DNA, 23 bp, Homo sapiens
acatgtctttggcttcagaattg

SEQ ID NO: 2732138 - DNA, 22 bp, Homo sapiens
acatgtttctgttttgttgttt

SEQ ID NO: 2732139 - DNA, 15 bp, Homo sapiens
acattactgtatgta

SEQ ID NO: 2732140 - DNA, 13 bp, Homo sapiens
acattatgttatt

SEQ ID NO: 2732141 - DNA, 20 bp, Homo sapiens
acattatgttattggaattt

SEQ ID NO: 2732142 - DNA, 17 bp, Homo sapiens
acattattttgtatgga

SEQ ID NO: 2732143 - DNA, 17 bp, Homo sapiens
acattcatctggaggct

SEQ ID NO: 2732144 - DNA, 18 bp, Homo sapiens
acattcatctggaggctg

SEQ ID NO: 2732145 - DNA, 15 bp, Homo sapiens
acattcctctgcagc

SEQ ID NO: 2732146 - DNA, 23 bp, Homo sapiens
acattcgaggtgtcaccctgcag

SEQ ID NO: 2732147 - DNA, 15 bp, Homo sapiens
acattgcaatagaaa

SEQ ID NO: 2732148 - DNA, 18 bp, Homo sapiens
acattgggaaggaagccc

SEQ ID NO: 2732149 - DNA, 21 bp, Homo sapiens
acattgtaaacgtattttgat

SEQ ID NO: 2732150 - DNA, 14 bp, Homo sapiens
acatttaggagaag

SEQ ID NO: 2732151 - DNA, 17 bp, Homo sapiens
acatttaggagaagttg

SEQ ID NO: 2732152 - DNA, 15 bp, Homo sapiens
acatttctggacagt

SEQ ID NO: 2732153 - DNA, 18 bp, Homo sapiens
acattttataaagttatg

SEQ ID NO: 2732154 - DNA, 13 bp, Homo sapiens
acattttgccttt

SEQ ID NO: 2732155 - DNA, 18 bp, Homo sapiens
acatttttgtacattatg

SEQ ID NO: 2732156 - DNA, 23 bp, Homo sapiens
accccttttcagcttctgctggg

SEQ ID NO: 2732157 - DNA, 19 bp, Homo sapiens
acccgccttttataaacct

SEQ ID NO: 2732158 - DNA, 16 bp, Homo sapiens
acccggattggccctg

SEQ ID NO: 2732159 - DNA, 17 bp, Homo sapiens
acccggattggccctgc

SEQ ID NO: 2732160 - DNA, 21 bp, Homo sapiens
acccggattggccctgcccct

SEQ ID NO: 2732161 - DNA, 16 bp, Homo sapiens
accctaagtgtggatg

SEQ ID NO: 2732162 - DNA, 12 bp, Homo sapiens
accctcccctcc

SEQ ID NO: 2732163 - DNA, 13 bp, Homo sapiens
accctcccctccc

SEQ ID NO: 2732164 - DNA, 14 bp, Homo sapiens
accctcctccactc

SEQ ID NO: 2732165 - DNA, 20 bp, Homo sapiens
accctcctctatttctttaa

SEQ ID NO: 2732166 - DNA, 14 bp, Homo sapiens
accctcctgagcct

SEQ ID NO: 2732167 - DNA, 13 bp, Homo sapiens
accctctatttac

SEQ ID NO: 2732168 - DNA, 13 bp, Homo sapiens
accctgcagagct

SEQ ID NO: 2732169 - DNA, 11 bp, Homo sapiens
accctgcagct

SEQ ID NO: 2732170 - DNA, 12 bp, Homo sapiens
accctgcctgct

SEQ ID NO: 2732171 - DNA, 14 bp, Homo sapiens
accctgcctgctgt

SEQ ID NO: 2732172 - DNA, 17 bp, Homo sapiens
accctgcctgctgtgga

SEQ ID NO: 2732173 - DNA, 18 bp, Homo sapiens
accctgcgaaggggccct

SEQ ID NO: 2732174 - DNA, 15 bp, Homo sapiens
accctggctctgcca

SEQ ID NO: 2732175 - DNA, 17 bp, Homo sapiens
accctgggctctgtggg

SEQ ID NO: 2732176 - DNA, 18 bp, Homo sapiens
accctgggctctgtgggc

SEQ ID NO: 2732177 - DNA, 19 bp, Homo sapiens
accctggtaggaaagcacc

SEQ ID NO: 2732178 - DNA, 14 bp, Homo sapiens
acccttcctcatct

SEQ ID NO: 2732179 - DNA, 19 bp, Homo sapiens
acccttcctcatctgtgcc

SEQ ID NO: 2732180 - DNA, 21 bp, Homo sapiens
acccttcctcatctgtgcctg

SEQ ID NO: 2732181 - DNA, 24 bp, Homo sapiens
acccttcctcatctgtgcctgtct

SEQ ID NO: 2732182 - DNA, 15 bp, Homo sapiens
acccttggacttgag

SEQ ID NO: 2732183 - DNA, 20 bp, Homo sapiens
acccttggtttgcacataaa

SEQ ID NO: 2732184 - DNA, 13 bp, Homo sapiens
accgacgatccct

SEQ ID NO: 2732185 - DNA, 12 bp, Homo sapiens
accgcagctgct

SEQ ID NO: 2732186 - DNA, 13 bp, Homo sapiens
accgcatggcagc

SEQ ID NO: 2732187 - DNA, 14 bp, Homo sapiens
accgcatggcagct

SEQ ID NO: 2732188 - DNA, 18 bp, Homo sapiens
accgcatggcagctgggc

SEQ ID NO: 2732189 - DNA, 20 bp, Homo sapiens
accgcatggcagctgggccc

SEQ ID NO: 2732190 - DNA, 12 bp, Homo sapiens
cctagctcttgg

SEQ ID NO: 2732191 - DNA, 18 bp, Homo sapiens
cctagctcttgggcctga

SEQ ID NO: 2732192 - DNA, 23 bp, Homo sapiens
cctaggccacaccatctcctttc

SEQ ID NO: 2732193 - DNA, 18 bp, Homo sapiens
cctatagtcccagctact

SEQ ID NO: 2732194 - DNA, 17 bp, Homo sapiens
cctatcagtgtgccccc

SEQ ID NO: 2732195 - DNA, 20 bp, Homo sapiens
cctatcagtgtgccccccat

SEQ ID NO: 2732196 - DNA, 24 bp, Homo sapiens
cctatcagtgtgccccccatcctg

SEQ ID NO: 2732197 - DNA, 15 bp, Homo sapiens
cctatcatcagttag

SEQ ID NO: 2732198 - DNA, 14 bp, Homo sapiens
cctatggcccagcc

SEQ ID NO: 2732199 - DNA, 15 bp, Homo sapiens
cctatggcccagcca

SEQ ID NO: 2732200 - DNA, 23 bp, Homo sapiens
cctatggcccagccactgcagca

SEQ ID NO: 2732201 - DNA, 12 bp, Homo sapiens
cctatgtaattt

SEQ ID NO: 2732202 - DNA, 20 bp, Homo sapiens
cctattttggacgtgtgagg

SEQ ID NO: 2732203 - DNA, 19 bp, Homo sapiens
cctcacagactcttccacc

SEQ ID NO: 2732204 - DNA, 21 bp, Homo sapiens
cctcacagactcttccaccag

SEQ ID NO: 2732205 - DNA, 24 bp, Homo sapiens
cctcacagactcttccaccagagc

SEQ ID NO: 2732206 - DNA, 14 bp, Homo sapiens
cctcacagatgctg

SEQ ID NO: 2732207 - DNA, 19 bp, Homo sapiens
cctcacagcctctccctta

SEQ ID NO: 2732208 - DNA, 14 bp, Homo sapiens
cctcaccaggggca

SEQ ID NO: 2732209 - DNA, 19 bp, Homo sapiens
cctcaccttttcccgggga

SEQ ID NO: 2732210 - DNA, 18 bp, Homo sapiens
cctcacgtgaccagcccc

SEQ ID NO: 2732211 - DNA, 21 bp, Homo sapiens
cctcagagatggcttccttgt

SEQ ID NO: 2732212 - DNA, 15 bp, Homo sapiens
cctcagatgtgttga

SEQ ID NO: 2732213 - DNA, 20 bp, Homo sapiens
cctcagcctagaccctcctc

SEQ ID NO: 2732214 - DNA, 16 bp, Homo sapiens
cctcagcctccaggca

SEQ ID NO: 2732215 - DNA, 12 bp, Homo sapiens
cctcagcctcct

SEQ ID NO: 2732216 - DNA, 14 bp, Homo sapiens
cctcagcctcctga

SEQ ID NO: 2732217 - DNA, 12 bp, Homo sapiens
cctcagcttccc

SEQ ID NO: 2732218 - DNA, 21 bp, Homo sapiens
cctcaggccaggtgcagtggc

SEQ ID NO: 2732219 - DNA, 16 bp, Homo sapiens
cctcaggcttccttgg

SEQ ID NO: 2732220 - DNA, 17 bp, Homo sapiens
cctcaggggaagctgct

SEQ ID NO: 2732221 - DNA, 21 bp, Homo sapiens
cctcaggggaagctgctaggg

SEQ ID NO: 2732222 - DNA, 13 bp, Homo sapiens
cctcagtgctgca

SEQ ID NO: 2732223 - DNA, 14 bp, Homo sapiens
cctcatctgtgcct

SEQ ID NO: 2732224 - DNA, 16 bp, Homo sapiens
cctcatgaggccatgc

SEQ ID NO: 2732225 - DNA, 17 bp, Homo sapiens
cctcatgaggccatgca

SEQ ID NO: 2732226 - DNA, 16 bp, Homo sapiens
cctcatgccccaggcc

SEQ ID NO: 2732227 - DNA, 16 bp, Homo sapiens
cctcatgtcatttctc

SEQ ID NO: 2732228 - DNA, 17 bp, Homo sapiens
cctcatgtcatttctca

SEQ ID NO: 2732229 - DNA, 18 bp, Homo sapiens
cctcattcagaccaatct

SEQ ID NO: 2732230 - DNA, 15 bp, Homo sapiens
cctccaaacactggg

SEQ ID NO: 2732231 - DNA, 18 bp, Homo sapiens
cctccaacaataaagagc

SEQ ID NO: 2732232 - DNA, 21 bp, Homo sapiens
cctccaccgccatggcttcca

SEQ ID NO: 2732233 - DNA, 14 bp, Homo sapiens
cctccactccacct

SEQ ID NO: 2732234 - DNA, 16 bp, Homo sapiens
cctccactccacctcc

SEQ ID NO: 2732235 - DNA, 15 bp, Homo sapiens
cctccagactgcgga

SEQ ID NO: 2732236 - DNA, 14 bp, Homo sapiens
cctccagtcctgct

SEQ ID NO: 2732237 - DNA, 15 bp, Homo sapiens
cctccagtcctgctg

SEQ ID NO: 2732238 - DNA, 21 bp, Homo sapiens
cctccagtcctgctggcctgc

SEQ ID NO: 2732239 - DNA, 23 bp, Homo sapiens
cttgcctcggctcctgctgcacc

SEQ ID NO: 2732240 - DNA, 13 bp, Homo sapiens
cttgccttcctgc

SEQ ID NO: 2732241 - DNA, 15 bp, Homo sapiens
cttgccttcctgcct

SEQ ID NO: 2732242 - DNA, 19 bp, Homo sapiens
cttgctgtaactcagacat

SEQ ID NO: 2732243 - DNA, 17 bp, Homo sapiens
cttgctgtcctaggcca

SEQ ID NO: 2732244 - DNA, 20 bp, Homo sapiens
cttggaaagcatcacctcag

SEQ ID NO: 2732245 - DNA, 22 bp, Homo sapiens
cttggaaagcatcacctcaggc

SEQ ID NO: 2732246 - DNA, 23 bp, Homo sapiens
cttggaaagcatcacctcaggcc

SEQ ID NO: 2732247 - DNA, 16 bp, Homo sapiens
cttggaaccacagtca

SEQ ID NO: 2732248 - DNA, 16 bp, Homo sapiens
cttggaattttgtaaa

SEQ ID NO: 2732249 - DNA, 23 bp, Homo sapiens
cttggaattttgtaaaaagaaat

SEQ ID NO: 2732250 - DNA, 13 bp, Homo sapiens
cttggagagcagc

SEQ ID NO: 2732251 - DNA, 22 bp, Homo sapiens
cttggagagcagctggctctcc

SEQ ID NO: 2732252 - DNA, 17 bp, Homo sapiens
cttggagtgctgcagct

SEQ ID NO: 2732253 - DNA, 18 bp, Homo sapiens
cttggcacctgcctagct

SEQ ID NO: 2732254 - DNA, 14 bp, Homo sapiens
cttggccagagctg

SEQ ID NO: 2732255 - DNA, 16 bp, Homo sapiens
cttggccagagctgag

SEQ ID NO: 2732256 - DNA, 22 bp, Homo sapiens
cttgggcctgacctccagtcct

SEQ ID NO: 2732257 - DNA, 22 bp, Homo sapiens
cttggtcccagacagctggacc

SEQ ID NO: 2732258 - DNA, 14 bp, Homo sapiens
cttgtaatatttct

SEQ ID NO: 2732259 - DNA, 18 bp, Homo sapiens
cttgtattgctccatttt

SEQ ID NO: 2732260 - DNA, 20 bp, Homo sapiens
cttgtcaaatagcaaggcca

SEQ ID NO: 2732261 - DNA, 13 bp, Homo sapiens
cttgtccctgggg

SEQ ID NO: 2732262 - DNA, 18 bp, Homo sapiens
cttgtccctggggcactc

SEQ ID NO: 2732263 - DNA, 22 bp, Homo sapiens
cttgtcctctcagagcctcagc

SEQ ID NO: 2732264 - DNA, 21 bp, Homo sapiens
cttgtggactctctgcctgct

SEQ ID NO: 2732265 - DNA, 13 bp, Homo sapiens
cttgtgtctgcgt

SEQ ID NO: 2732266 - DNA, 15 bp, Homo sapiens
cttgtgtgtaccaca

SEQ ID NO: 2732267 - DNA, 22 bp, Homo sapiens
cttgtgtgtaccacaccctgcc

SEQ ID NO: 2732268 - DNA, 18 bp, Homo sapiens
cttgttgtttttaagtcc

SEQ ID NO: 2732269 - DNA, 22 bp, Homo sapiens
cttgttgtttttaagtcctgta

SEQ ID NO: 2732270 - DNA, 16 bp, Homo sapiens
cttgtttctttctgaa

SEQ ID NO: 2732271 - DNA, 20 bp, Homo sapiens
ctttaaatacagtcaactta

SEQ ID NO: 2732272 - DNA, 15 bp, Homo sapiens
ctttaaggagataga

SEQ ID NO: 2732273 - DNA, 23 bp, Homo sapiens
ctttaatttttataaatatgtga

SEQ ID NO: 2732274 - DNA, 12 bp, Homo sapiens
ctttagatttca

SEQ ID NO: 2732275 - DNA, 14 bp, Homo sapiens
ctttaggcagcctg

SEQ ID NO: 2732276 - DNA, 16 bp, Homo sapiens
ctttaggcagcctgcc

SEQ ID NO: 2732277 - DNA, 17 bp, Homo sapiens
ctttatattttgttgtt

SEQ ID NO: 2732278 - DNA, 13 bp, Homo sapiens
ctttatcccctcc

SEQ ID NO: 2732279 - DNA, 20 bp, Homo sapiens
ctttatgcaaaaacatatgt

SEQ ID NO: 2732280 - DNA, 17 bp, Homo sapiens
ctttattaaatgtagaa

SEQ ID NO: 2732281 - DNA, 15 bp, Homo sapiens
ctttcaaaagcaaac

SEQ ID NO: 2732282 - DNA, 14 bp, Homo sapiens
ctttcacaggactc

SEQ ID NO: 2732283 - DNA, 14 bp, Homo sapiens
ctttcagctgtgaa

SEQ ID NO: 2732284 - DNA, 15 bp, Homo sapiens
ctttcatacattata

SEQ ID NO: 2732285 - DNA, 22 bp, Homo sapiens
ctttcatacattatattcctct

SEQ ID NO: 2732286 - DNA, 20 bp, Homo sapiens
ctttctcgtggtagaagcca

SEQ ID NO: 2732287 - DNA, 16 bp, Homo sapiens
ctttctcttggacatt

SEQ ID NO: 2732288 - DNA, 20 bp, Homo sapiens
ctttctcttggacattgtaa

SEQ ID NO: 2732289 - DNA, 21 bp, Homo sapiens
ctttctttgctgctgtggaaa

SEQ ID NO: 2732290 - DNA, 15 bp, Homo sapiens
ctttgaatcaaaata

SEQ ID NO: 2732291 - DNA, 15 bp, Homo sapiens
ctttgagcaggttta

SEQ ID NO: 2732292 - DNA, 15 bp, Homo sapiens
ctttgatctctgctt

SEQ ID NO: 2732293 - DNA, 15 bp, Homo sapiens
ctttgcaccaaagac

SEQ ID NO: 2732294 - DNA, 16 bp, Homo sapiens
ctttgcaccaaagaca

SEQ ID NO: 2732295 - DNA, 22 bp, Homo sapiens
ctttgcagaccgcatagtcact

SEQ ID NO: 2732296 - DNA, 20 bp, Homo sapiens
ctttgcccacacacactcct

SEQ ID NO: 2732297 - DNA, 19 bp, Homo sapiens
ctttgccttaagtttccct

SEQ ID NO: 2732298 - DNA, 13 bp, Homo sapiens
ctttgctacaata

SEQ ID NO: 2732299 - DNA, 17 bp, Homo sapiens
ctttgctacaataaatg

SEQ ID NO: 2732300 - DNA, 19 bp, Homo sapiens
ctttgctgaatgtcattat

SEQ ID NO: 2732301 - DNA, 15 bp, Homo sapiens
ctttgggaaagctgc

SEQ ID NO: 2732302 - DNA, 19 bp, Homo sapiens
ctttggggaaactaacaat

SEQ ID NO: 2732303 - DNA, 14 bp, Homo sapiens
ctttgtctaaacaa

SEQ ID NO: 2732304 - DNA, 11 bp, Homo sapiens
ctttgtgctga

SEQ ID NO: 2732305 - DNA, 23 bp, Homo sapiens
ctttgtgtccattgatgtcattc

SEQ ID NO: 2732306 - DNA, 14 bp, Homo sapiens
ctttgttgctgttg

SEQ ID NO: 2732307 - DNA, 16 bp, Homo sapiens
ctttgttgctgttgct

SEQ ID NO: 2732308 - DNA, 14 bp, Homo sapiens
cttttaaaaatgat

SEQ ID NO: 2732309 - DNA, 15 bp, Homo sapiens
cttttacatacagtg

SEQ ID NO: 2732310 - DNA, 14 bp, Homo sapiens
cttttataaacctc

SEQ ID NO: 2732311 - DNA, 21 bp, Homo sapiens
cttttcaagttgagaacaaaa

SEQ ID NO: 2732312 - DNA, 23 bp, Homo sapiens
cttttcagcttctgctgggctgg

SEQ ID NO: 2732313 - DNA, 17 bp, Homo sapiens
cttttcctcccatttta

SEQ ID NO: 2732314 - DNA, 19 bp, Homo sapiens
cttttcctcccattttaga

SEQ ID NO: 2732315 - DNA, 13 bp, Homo sapiens
cttttctcccaga

SEQ ID NO: 2732316 - DNA, 21 bp, Homo sapiens
cttttgaagaacaaaaggctt

SEQ ID NO: 2732317 - DNA, 17 bp, Homo sapiens
cttttgttattaaaaaa

SEQ ID NO: 2732318 - DNA, 22 bp, Homo sapiens
cttttgttattaaaaaaacaca

SEQ ID NO: 2732319 - DNA, 14 bp, Homo sapiens
ctttttaaacagtg

SEQ ID NO: 2732320 - DNA, 15 bp, Homo sapiens
ctttttaaacagtgt

SEQ ID NO: 2732321 - DNA, 17 bp, Homo sapiens
ctttttgtattaacaaa

SEQ ID NO: 2732322 - DNA, 22 bp, Homo sapiens
ctttttgtgaaattcaacctgt

SEQ ID NO: 2732323 - DNA, 15 bp, Homo sapiens
cttttttagcttcat

SEQ ID NO: 2732324 - DNA, 14 bp, Homo sapiens
ctttttttctctcc

SEQ ID NO: 2732325 - DNA, 22 bp, Homo sapiens
ctttttttttttctgcctgaga

SEQ ID NO: 2732326 - DNA, 16 bp, Homo sapiens
gaaaaaaaaattccat

SEQ ID NO: 2732327 - DNA, 17 bp, Homo sapiens
gaaaaacacggcagctg

SEQ ID NO: 2732328 - DNA, 23 bp, Homo sapiens
gaaaaacacggcagctgtagctc

SEQ ID NO: 2732329 - DNA, 21 bp, Homo sapiens
gaaaaatcataaccaccctag

SEQ ID NO: 2732330 - DNA, 18 bp, Homo sapiens
gaaaaatgagcttgtaaa

SEQ ID NO: 2732331 - DNA, 22 bp, Homo sapiens
gaaaaatgtcactgaagtgatt

SEQ ID NO: 2732332 - DNA, 17 bp, Homo sapiens
gaaaacattgatgaatg

SEQ ID NO: 2732333 - DNA, 18 bp, Homo sapiens
gaaaacattgatgaatga

SEQ ID NO: 2732334 - DNA, 11 bp, Homo sapiens
gaaaaccctaa

SEQ ID NO: 2732335 - DNA, 18 bp, Homo sapiens
gaaaaccctaagtgtgga

SEQ ID NO: 2732336 - DNA, 20 bp, Homo sapiens
gaaaaccctaagtgtggatg

SEQ ID NO: 2732337 - DNA, 22 bp, Homo sapiens
gaaaacctgtttttaacatgtg

SEQ ID NO: 2732338 - DNA, 18 bp, Homo sapiens
gaaaactaaggatttttc

SEQ ID NO: 2732339 - DNA, 14 bp, Homo sapiens
gaaaacttatttga

SEQ ID NO: 2732340 - DNA, 23 bp, Homo sapiens
gaaaacttcagagaaattatgtt

SEQ ID NO: 2732341 - DNA, 19 bp, Homo sapiens
gaaaagacattgaaagctc

SEQ ID NO: 2732342 - DNA, 14 bp, Homo sapiens
gaaaagatgtgctc

SEQ ID NO: 2732343 - DNA, 10 bp, Homo sapiens
gaaaagcaac

SEQ ID NO: 2732344 - DNA, 11 bp, Homo sapiens
gaaaagccata

SEQ ID NO: 2732345 - DNA, 15 bp, Homo sapiens
gaaaagccatatcta

SEQ ID NO: 2732346 - DNA, 14 bp, Homo sapiens
gaaaagcctctgtg

SEQ ID NO: 2732347 - DNA, 15 bp, Homo sapiens
gaaaagcctctgtgt

SEQ ID NO: 2732348 - DNA, 17 bp, Homo sapiens
gaaaaggttttattttg

SEQ ID NO: 2732349 - DNA, 18 bp, Homo sapiens
gaaaaggttttattttgt

SEQ ID NO: 2732350 - DNA, 19 bp, Homo sapiens
gaaaagttttgtaaatttc

SEQ ID NO: 2732351 - DNA, 21 bp, Homo sapiens
gaaaatagggtccttgaaaca

SEQ ID NO: 2732352 - DNA, 19 bp, Homo sapiens
gaaaatgcagccttaaaca

SEQ ID NO: 2732353 - DNA, 16 bp, Homo sapiens
gaaaatgcaggagagc

SEQ ID NO: 2732354 - DNA, 22 bp, Homo sapiens
gaaaatgcaggagagcttcccc

SEQ ID NO: 2732355 - DNA, 12 bp, Homo sapiens
gaaaatgtgtct

SEQ ID NO: 2732356 - DNA, 21 bp, Homo sapiens
gaaaatgtgtctgcaacatgg

SEQ ID NO: 2732357 - DNA, 21 bp, Homo sapiens
gaaaattcctattgattttct

SEQ ID NO: 2732358 - DNA, 21 bp, Homo sapiens
gaaacaaaaaacaccaaaaat

SEQ ID NO: 2732359 - DNA, 13 bp, Homo sapiens
gaaacactaaatt

SEQ ID NO: 2732360 - DNA, 18 bp, Homo sapiens
gaaacctgtccataaagt

SEQ ID NO: 2732361 - DNA, 19 bp, Homo sapiens
gaaactttgatctctgctt

SEQ ID NO: 2732362 - DNA, 13 bp, Homo sapiens
gaaagaaaatgaa

SEQ ID NO: 2732363 - DNA, 16 bp, Homo sapiens
gaaagacatcaatgaa

SEQ ID NO: 2732364 - DNA, 17 bp, Homo sapiens
gaaagcatcacctcagg

SEQ ID NO: 2732365 - DNA, 18 bp, Homo sapiens
gaaagcatcacctcaggc

SEQ ID NO: 2732366 - DNA, 16 bp, Homo sapiens
ctgggagaacctcagg

SEQ ID NO: 2732367 - DNA, 15 bp, Homo sapiens
ctgggaggaagcagg

SEQ ID NO: 2732368 - DNA, 21 bp, Homo sapiens
ctgggaggaagcaggttgagg

SEQ ID NO: 2732369 - DNA, 21 bp, Homo sapiens
ctgggcatgatgggccgagcc

SEQ ID NO: 2732370 - DNA, 12 bp, Homo sapiens
ctgggcattttc

SEQ ID NO: 2732371 - DNA, 15 bp, Homo sapiens
ctgggccaagttcct

SEQ ID NO: 2732372 - DNA, 18 bp, Homo sapiens
ctgggccaagttcctcta

SEQ ID NO: 2732373 - DNA, 20 bp, Homo sapiens
ctgggccaagttcctctagt

SEQ ID NO: 2732374 - DNA, 14 bp, Homo sapiens
ctgggccagatgct

SEQ ID NO: 2732375 - DNA, 18 bp, Homo sapiens
ctgggccagatgctgggc

SEQ ID NO: 2732376 - DNA, 13 bp, Homo sapiens
ctgggccatgggt

SEQ ID NO: 2732377 - DNA, 16 bp, Homo sapiens
ctgggccatgggtcct

SEQ ID NO: 2732378 - DNA, 14 bp, Homo sapiens
ctgggcccacagcc

SEQ ID NO: 2732379 - DNA, 17 bp, Homo sapiens
ctgggcccacagccccc

SEQ ID NO: 2732380 - DNA, 20 bp, Homo sapiens
ctgggcccacagcccccacc

SEQ ID NO: 2732381 - DNA, 12 bp, Homo sapiens
ctgggcccccag

SEQ ID NO: 2732382 - DNA, 13 bp, Homo sapiens
ctgggcccccaga

SEQ ID NO: 2732383 - DNA, 15 bp, Homo sapiens
ctgggcccccagaga

SEQ ID NO: 2732384 - DNA, 13 bp, Homo sapiens
ctgggcccctcag

SEQ ID NO: 2732385 - DNA, 23 bp, Homo sapiens
ctgggcccctcaggggaagctgc

SEQ ID NO: 2732386 - DNA, 17 bp, Homo sapiens
ctgggcctcagcctcca

SEQ ID NO: 2732387 - DNA, 18 bp, Homo sapiens
ctgggcctcagcctccag

SEQ ID NO: 2732388 - DNA, 19 bp, Homo sapiens
ctgggctacaaaccaggag

SEQ ID NO: 2732389 - DNA, 20 bp, Homo sapiens
ctgggctctgtgggctgcac

SEQ ID NO: 2732390 - DNA, 21 bp, Homo sapiens
ctggggcaagtccctgactct

SEQ ID NO: 2732391 - DNA, 12 bp, Homo sapiens
ctggggcactcc

SEQ ID NO: 2732392 - DNA, 13 bp, Homo sapiens
ctggggcactccc

SEQ ID NO: 2732393 - DNA, 19 bp, Homo sapiens
ctggggcactcccccagga

SEQ ID NO: 2732394 - DNA, 17 bp, Homo sapiens
ctggggcctatcagtgt

SEQ ID NO: 2732395 - DNA, 19 bp, Homo sapiens
ctggggctctgtgcaggga

SEQ ID NO: 2732396 - DNA, 13 bp, Homo sapiens
ctggggcttgcta

SEQ ID NO: 2732397 - DNA, 16 bp, Homo sapiens
ctgggggagggactgc

SEQ ID NO: 2732398 - DNA, 24 bp, Homo sapiens
ctgggggagggactgctgacccac

SEQ ID NO: 2732399 - DNA, 23 bp, Homo sapiens
ctgggggctccccttgcccttcc

SEQ ID NO: 2732400 - DNA, 13 bp, Homo sapiens
ctgggtgatttct

SEQ ID NO: 2732401 - DNA, 19 bp, Homo sapiens
ctgggtgcgaccccatctg

SEQ ID NO: 2732402 - DNA, 22 bp, Homo sapiens
ctgggtgcgaccccatctgccc

SEQ ID NO: 2732403 - DNA, 15 bp, Homo sapiens
ctgggtggcccatcc

SEQ ID NO: 2732404 - DNA, 16 bp, Homo sapiens
ctgggtggcccatccc

SEQ ID NO: 2732405 - DNA, 16 bp, Homo sapiens
ctgggttggcgcaccc

SEQ ID NO: 2732406 - DNA, 18 bp, Homo sapiens
ctgggttggcgcaccctc

SEQ ID NO: 2732407 - DNA, 20 bp, Homo sapiens
ctgggttggcgcaccctccc

SEQ ID NO: 2732408 - DNA, 18 bp, Homo sapiens
ctgggttgtcactgagac

SEQ ID NO: 2732409 - DNA, 16 bp, Homo sapiens
ctgggtttacaacaaa

SEQ ID NO: 2732410 - DNA, 22 bp, Homo sapiens
ctgggtttacaacaaacactgt

SEQ ID NO: 2732411 - DNA, 17 bp, Homo sapiens
ctgggtttggcccctgg

SEQ ID NO: 2732412 - DNA, 15 bp, Homo sapiens
ctggtacagcagggt

SEQ ID NO: 2732413 - DNA, 13 bp, Homo sapiens
ctggtagcagaat

SEQ ID NO: 2732414 - DNA, 23 bp, Homo sapiens
ctggtatctgcatgtaaaatctt

SEQ ID NO: 2732415 - DNA, 16 bp, Homo sapiens
ctggtccttccaggcc

SEQ ID NO: 2732416 - DNA, 17 bp, Homo sapiens
ctggtccttccaggccc

SEQ ID NO: 2732417 - DNA, 17 bp, Homo sapiens
ctggtgaggcccagcct

SEQ ID NO: 2732418 - DNA, 20 bp, Homo sapiens
ctggtgaggcccagcctgtc

SEQ ID NO: 2732419 - DNA, 19 bp, Homo sapiens
ctggtgaggccggccctgc

SEQ ID NO: 2732420 - DNA, 22 bp, Homo sapiens
ctggtgaggccggccctgcccc

SEQ ID NO: 2732421 - DNA, 19 bp, Homo sapiens
ctggtgcagaggtgagcag

SEQ ID NO: 2732422 - DNA, 20 bp, Homo sapiens
ctggtgcagaggtgagcaga

SEQ ID NO: 2732423 - DNA, 23 bp, Homo sapiens
ctggtgccagatgtgggctcaga

SEQ ID NO: 2732424 - DNA, 17 bp, Homo sapiens
ctggtggacagtcctgg

SEQ ID NO: 2732425 - DNA, 17 bp, Homo sapiens
ctggtggatggtgactt

SEQ ID NO: 2732426 - DNA, 16 bp, Homo sapiens
ctggtgtggccaaggc

SEQ ID NO: 2732427 - DNA, 18 bp, Homo sapiens
ctgtaaaactaaacatac

SEQ ID NO: 2732428 - DNA, 21 bp, Homo sapiens
ctgtaagcagattacaataaa

SEQ ID NO: 2732429 - DNA, 22 bp, Homo sapiens
ctgtaagcattctgagctgggc

SEQ ID NO: 2732430 - DNA, 13 bp, Homo sapiens
ctgtactcaggag

SEQ ID NO: 2732431 - DNA, 22 bp, Homo sapiens
ctgtacttcccaattgccacat

SEQ ID NO: 2732432 - DNA, 13 bp, Homo sapiens
ctgtactttttgt

SEQ ID NO: 2732433 - DNA, 19 bp, Homo sapiens
ctgtagaactctgcaggca

SEQ ID NO: 2732434 - DNA, 22 bp, Homo sapiens
ctgtagaactctgcaggcagat

SEQ ID NO: 2732435 - DNA, 16 bp, Homo sapiens
ctgtatacaaacaggt

SEQ ID NO: 2732436 - DNA, 15 bp, Homo sapiens
ctgtcaccctggcca

SEQ ID NO: 2732437 - DNA, 17 bp, Homo sapiens
cctggtgagggagcctc

SEQ ID NO: 2732438 - DNA, 15 bp, Homo sapiens
cctggtgcagaggtg

SEQ ID NO: 2732439 - DNA, 17 bp, Homo sapiens
cctggtggacagtcctg

SEQ ID NO: 2732440 - DNA, 18 bp, Homo sapiens
cctggtggacagtcctgg

SEQ ID NO: 2732441 - DNA, 20 bp, Homo sapiens
cctggtggacagtcctggga

SEQ ID NO: 2732442 - DNA, 13 bp, Homo sapiens
cctggtttgtaat

SEQ ID NO: 2732443 - DNA, 21 bp, Homo sapiens
cctgtactcaggaggctgagg

SEQ ID NO: 2732444 - DNA, 22 bp, Homo sapiens
cctgtactcaggaggctgaggg

SEQ ID NO: 2732445 - DNA, 15 bp, Homo sapiens
cctgtcagtgccgcc

SEQ ID NO: 2732446 - DNA, 13 bp, Homo sapiens
cctgtcccctcac

SEQ ID NO: 2732447 - DNA, 14 bp, Homo sapiens
cctgtcccctcaca

SEQ ID NO: 2732448 - DNA, 20 bp, Homo sapiens
cctgtcccctcacagactct

SEQ ID NO: 2732449 - DNA, 23 bp, Homo sapiens
cctgtcccctcacagactcttcc

SEQ ID NO: 2732450 - DNA, 13 bp, Homo sapiens
cctgtcccctggg

SEQ ID NO: 2732451 - DNA, 16 bp, Homo sapiens
cctgtcccctggggct

SEQ ID NO: 2732452 - DNA, 17 bp, Homo sapiens
cctgtccctacccactc

SEQ ID NO: 2732453 - DNA, 22 bp, Homo sapiens
cctgtccggagcgaccctggct

SEQ ID NO: 2732454 - DNA, 21 bp, Homo sapiens
cctgtcctggtacagcagggt

SEQ ID NO: 2732455 - DNA, 18 bp, Homo sapiens
cctgtccttactcagagc

SEQ ID NO: 2732456 - DNA, 17 bp, Homo sapiens
cctgtcgtgtccagcct

SEQ ID NO: 2732457 - DNA, 15 bp, Homo sapiens
cctgtgactatggct

SEQ ID NO: 2732458 - DNA, 15 bp, Homo sapiens
cctgtgcccttattc

SEQ ID NO: 2732459 - DNA, 14 bp, Homo sapiens
cctgtggggcctga

SEQ ID NO: 2732460 - DNA, 21 bp, Homo sapiens
cctgtgggggaagagcacagc

SEQ ID NO: 2732461 - DNA, 20 bp, Homo sapiens
cctgttgtgtaataacagaa

SEQ ID NO: 2732462 - DNA, 17 bp, Homo sapiens
ccttaaggccacactgg

SEQ ID NO: 2732463 - DNA, 13 bp, Homo sapiens
ccttactcagagc

SEQ ID NO: 2732464 - DNA, 17 bp, Homo sapiens
ccttcaaagaagggcca

SEQ ID NO: 2732465 - DNA, 19 bp, Homo sapiens
ccttcaagttagctcagga

SEQ ID NO: 2732466 - DNA, 14 bp, Homo sapiens
ccttcaattcctgg

SEQ ID NO: 2732467 - DNA, 17 bp, Homo sapiens
cgccctggccagggcct

SEQ ID NO: 2732468 - DNA, 16 bp, Homo sapiens
cgccgcctcgcccacc

SEQ ID NO: 2732469 - DNA, 18 bp, Homo sapiens
cgccgcctcgcccaccgc

SEQ ID NO: 2732470 - DNA, 17 bp, Homo sapiens
cgcctagaggtcccctc

SEQ ID NO: 2732471 - DNA, 18 bp, Homo sapiens
cgcctagaggtcccctca

SEQ ID NO: 2732472 - DNA, 22 bp, Homo sapiens
cgcctcgcccaccgcatgcccc

SEQ ID NO: 2732473 - DNA, 15 bp, Homo sapiens
cgcctgtcccctcac

SEQ ID NO: 2732474 - DNA, 22 bp, Homo sapiens
cgcctgtcccctcacagactct

SEQ ID NO: 2732475 - DNA, 22 bp, Homo sapiens
cgccttcactccggtgtgcctg

SEQ ID NO: 2732476 - DNA, 21 bp, Homo sapiens
cgccttctcccccccggggct

SEQ ID NO: 2732477 - DNA, 22 bp, Homo sapiens
cgcgccactacactccagcctg

SEQ ID NO: 2732478 - DNA, 23 bp, Homo sapiens
cgcgccttctcccccccggggct

SEQ ID NO: 2732479 - DNA, 16 bp, Homo sapiens
cgctctaccctgcagc

SEQ ID NO: 2732480 - DNA, 16 bp, Homo sapiens
cgctctgctgcccagg

SEQ ID NO: 2732481 - DNA, 14 bp, Homo sapiens
cgctgatgctgggc

SEQ ID NO: 2732482 - DNA, 17 bp, Homo sapiens
cgctgatgctgggctgg

SEQ ID NO: 2732483 - DNA, 19 bp, Homo sapiens
cgctgatgctgggctgggt

SEQ ID NO: 2732484 - DNA, 21 bp, Homo sapiens
cgctgcccggcgccctctgtc

SEQ ID NO: 2732485 - DNA, 22 bp, Homo sapiens
cgctgcccggcgccctctgtcc

SEQ ID NO: 2732486 - DNA, 15 bp, Homo sapiens
cgctggacaacccag

SEQ ID NO: 2732487 - DNA, 15 bp, Homo sapiens
cgcttattgcccagg

SEQ ID NO: 2732488 - DNA, 18 bp, Homo sapiens
cgcttgcctcggctcctg

SEQ ID NO: 2732489 - DNA, 20 bp, Homo sapiens
cgcttgcctcggctcctgct

SEQ ID NO: 2732490 - DNA, 15 bp, Homo sapiens
ctgcctgttctccag

SEQ ID NO: 2732491 - DNA, 19 bp, Homo sapiens
ctgccttctcccctccaag

SEQ ID NO: 2732492 - DNA, 16 bp, Homo sapiens
ctgccttgaagccact

SEQ ID NO: 2732493 - DNA, 22 bp, Homo sapiens
ctgccttgaagccactgaagct

SEQ ID NO: 2732494 - DNA, 21 bp, Homo sapiens
ctgccttgggcctcatctgct

SEQ ID NO: 2732495 - DNA, 19 bp, Homo sapiens
ctgcgaaggggccctggtc

SEQ ID NO: 2732496 - DNA, 20 bp, Homo sapiens
ctgcgagagaccctacagac

SEQ ID NO: 2732497 - DNA, 18 bp, Homo sapiens
ctgcggagcagcctccag

SEQ ID NO: 2732498 - DNA, 17 bp, Homo sapiens
ctgcgggatggtcctgg

SEQ ID NO: 2732499 - DNA, 13 bp, Homo sapiens
ctgcgggctgagg

SEQ ID NO: 2732500 - DNA, 15 bp, Homo sapiens
ctgcgggctgagggc

SEQ ID NO: 2732501 - DNA, 15 bp, Homo sapiens
ctgcggtgtctgcag

SEQ ID NO: 2732502 - DNA, 18 bp, Homo sapiens
ctgcggtgtctgcagctc

SEQ ID NO: 2732503 - DNA, 20 bp, Homo sapiens
ctgcgtcagaccagtactgg

SEQ ID NO: 2732504 - DNA, 17 bp, Homo sapiens
ctgctaccctccctgct

SEQ ID NO: 2732505 - DNA, 18 bp, Homo sapiens
ctgctaccctccctgctg

SEQ ID NO: 2732506 - DNA, 19 bp, Homo sapiens
ctgctaccctccctgctgt

SEQ ID NO: 2732507 - DNA, 23 bp, Homo sapiens
ctgctatattttcatgacttttc

SEQ ID NO: 2732508 - DNA, 13 bp, Homo sapiens
ctgctcattgtgg

SEQ ID NO: 2732509 - DNA, 17 bp, Homo sapiens
ctgctcctagcccagca

SEQ ID NO: 2732510 - DNA, 13 bp, Homo sapiens
ctgctcgggccca

SEQ ID NO: 2732511 - DNA, 22 bp, Homo sapiens
ctgctcgggcccaggccatctt

SEQ ID NO: 2732512 - DNA, 21 bp, Homo sapiens
ctgctcttacttcccccaccc

SEQ ID NO: 2732513 - DNA, 20 bp, Homo sapiens
ctgctgcaccaacccagccg

SEQ ID NO: 2732514 - DNA, 23 bp, Homo sapiens
ctgctgcaccaacccagccgctg

SEQ ID NO: 2732515 - DNA, 16 bp, Homo sapiens
ctgctgcagaggggca

SEQ ID NO: 2732516 - DNA, 21 bp, Homo sapiens
ctgctgcagaggggcaggccc

SEQ ID NO: 2732517 - DNA, 18 bp, Homo sapiens
ctgctgcagcatgaaggc

SEQ ID NO: 2732518 - DNA, 14 bp, Homo sapiens
ctgctgccactctg

SEQ ID NO: 2732519 - DNA, 22 bp, Homo sapiens
ctgctgccactctgctgcctgt

SEQ ID NO: 2732520 - DNA, 15 bp, Homo sapiens
ctgctgcctgtacag

SEQ ID NO: 2732521 - DNA, 13 bp, Homo sapiens
ctgctgctaaggc

SEQ ID NO: 2732522 - DNA, 23 bp, Homo sapiens
ctgctgctaaggctctatttcct

SEQ ID NO: 2732523 - DNA, 14 bp, Homo sapiens
ctgctggcccacag

SEQ ID NO: 2732524 - DNA, 16 bp, Homo sapiens
ctgctggcccacagct

SEQ ID NO: 2732525 - DNA, 21 bp, Homo sapiens
ctgctggcccacagctctgct

SEQ ID NO: 2732526 - DNA, 13 bp, Homo sapiens
ctgctggcctgct

SEQ ID NO: 2732527 - DNA, 14 bp, Homo sapiens
ctgctggcctgctc

SEQ ID NO: 2732528 - DNA, 16 bp, Homo sapiens
ctgctggcctgctctt

SEQ ID NO: 2732529 - DNA, 23 bp, Homo sapiens
ctgctggcctgctcttacttccc

SEQ ID NO: 2732530 - DNA, 19 bp, Homo sapiens
ctgctgggaccccagctag

SEQ ID NO: 2732531 - DNA, 23 bp, Homo sapiens
ctgctgggaccccagctagggct

SEQ ID NO: 2732532 - DNA, 13 bp, Homo sapiens
ctgctgggctggg

SEQ ID NO: 2732533 - DNA, 14 bp, Homo sapiens
ctgctgggctgggg

SEQ ID NO: 2732534 - DNA, 18 bp, Homo sapiens
ctgctgggctggggcctg

SEQ ID NO: 2732535 - DNA, 19 bp, Homo sapiens
ctgctgggctggggcctga

SEQ ID NO: 2732536 - DNA, 10 bp, Homo sapiens
ctgctggggg

SEQ ID NO: 2732537 - DNA, 18 bp, Homo sapiens
ctgctgggtggcccatcc

SEQ ID NO: 2732538 - DNA, 20 bp, Homo sapiens
ctgctgtcccctcttgcccc

SEQ ID NO: 2732539 - DNA, 16 bp, Homo sapiens
ctgctgttgtgggacc

SEQ ID NO: 2732540 - DNA, 14 bp, Homo sapiens
ctgcttcctgagct

SEQ ID NO: 2732541 - DNA, 14 bp, Homo sapiens
ctgcttcctggacc

SEQ ID NO: 2732542 - DNA, 15 bp, Homo sapiens
ctgcttcctggaccg

SEQ ID NO: 2732543 - DNA, 16 bp, Homo sapiens
ctgcttcctggaccgg

SEQ ID NO: 2732544 - DNA, 13 bp, Homo sapiens
ctgcttggcttcc

SEQ ID NO: 2732545 - DNA, 15 bp, Homo sapiens
ctgcttttctcccag

SEQ ID NO: 2732546 - DNA, 16 bp, Homo sapiens
ctgcttttctcccaga

SEQ ID NO: 2732547 - DNA, 20 bp, Homo sapiens
ctgcttttctcccagaaggc

SEQ ID NO: 2732548 - DNA, 13 bp, Homo sapiens
ctggaaaggctca

SEQ ID NO: 2732549 - DNA, 15 bp, Homo sapiens
ctggaaaggctcagt

SEQ ID NO: 2732550 - DNA, 22 bp, Homo sapiens
ctggaaaggctcagtctcagga

SEQ ID NO: 2732551 - DNA, 23 bp, Homo sapiens
ctggaatcaagatgtcagactgg

SEQ ID NO: 2732552 - DNA, 16 bp, Homo sapiens
ctggacaacccagaac

SEQ ID NO: 2732553 - DNA, 18 bp, Homo sapiens
ctggacagtacctgattg

SEQ ID NO: 2732554 - DNA, 14 bp, Homo sapiens
ctggaccctggcct

SEQ ID NO: 2732555 - DNA, 19 bp, Homo sapiens
ctggacgcccagctgaggc

SEQ ID NO: 2732556 - DNA, 19 bp, Homo sapiens
ctggacggcattcctgctt

SEQ ID NO: 2732557 - DNA, 16 bp, Homo sapiens
ctggactagggcctcg

SEQ ID NO: 2732558 - DNA, 22 bp, Homo sapiens
ctggactagggcctcggaggct

SEQ ID NO: 2732559 - DNA, 15 bp, Homo sapiens
ctggacttgagcttg

SEQ ID NO: 2732560 - DNA, 17 bp, Homo sapiens
ctggagactatttaagt

SEQ ID NO: 2732561 - DNA, 23 bp, Homo sapiens
ctggagaggagggatgctgcctg

SEQ ID NO: 2732562 - DNA, 12 bp, Homo sapiens
ctggagcccagg

SEQ ID NO: 2732563 - DNA, 12 bp, Homo sapiens
ctggagctgcca

SEQ ID NO: 2732564 - DNA, 12 bp, Homo sapiens
ctggaggctgga

SEQ ID NO: 2732565 - DNA, 15 bp, Homo sapiens
ctggaggctggatgg

SEQ ID NO: 2732566 - DNA, 12 bp, Homo sapiens
ctggagggagat

SEQ ID NO: 2732567 - DNA, 18 bp, Homo sapiens
ctggatgagcaactcctg

SEQ ID NO: 2732568 - DNA, 15 bp, Homo sapiens
ctggcacagtgtctg

SEQ ID NO: 2732569 - DNA, 15 bp, Homo sapiens
ctggcagggcctggc

SEQ ID NO: 2732570 - DNA, 21 bp, Homo sapiens
ctggcatgacactctagtgac

SEQ ID NO: 2732571 - DNA, 13 bp, Homo sapiens
ctggccaccaccc

SEQ ID NO: 2732572 - DNA, 21 bp, Homo sapiens
ctggccagccccacagcccac

SEQ ID NO: 2732573 - DNA, 16 bp, Homo sapiens
ctggccagtcctagag

SEQ ID NO: 2732574 - DNA, 22 bp, Homo sapiens
ctggccagtcctagagctcctg

SEQ ID NO: 2732575 - DNA, 13 bp, Homo sapiens
ctggcccacagct

SEQ ID NO: 2732576 - DNA, 16 bp, Homo sapiens
ctggcccacagctctg

SEQ ID NO: 2732577 - DNA, 17 bp, Homo sapiens
ctggcccacagctctgc

SEQ ID NO: 2732578 - DNA, 18 bp, Homo sapiens
ctggcccacagctctgct

SEQ ID NO: 2732579 - DNA, 14 bp, Homo sapiens
ctggcccagctccc

SEQ ID NO: 2732580 - DNA, 15 bp, Homo sapiens
ctggcccagctcccc

SEQ ID NO: 2732581 - DNA, 18 bp, Homo sapiens
ctggccccttctccagca

SEQ ID NO: 2732582 - DNA, 13 bp, Homo sapiens
ctggcctcataca

SEQ ID NO: 2732583 - DNA, 19 bp, Homo sapiens
ctggcctcgcctggcctga

SEQ ID NO: 2732584 - DNA, 20 bp, Homo sapiens
ctggcctctagaacacccac

SEQ ID NO: 2732585 - DNA, 13 bp, Homo sapiens
ctggcctcttggc

SEQ ID NO: 2732586 - DNA, 18 bp, Homo sapiens
ctggcctcttggcacctg

SEQ ID NO: 2732587 - DNA, 21 bp, Homo sapiens
ctggcctcttggcacctgcct

SEQ ID NO: 2732588 - DNA, 23 bp, Homo sapiens
ctggcctcttggcacctgcctag

SEQ ID NO: 2732589 - DNA, 12 bp, Homo sapiens
cccgggtgcagg

SEQ ID NO: 2732590 - DNA, 17 bp, Homo sapiens
cccggttcaccttgccg

SEQ ID NO: 2732591 - DNA, 14 bp, Homo sapiens
cccgtggccccagc

SEQ ID NO: 2732592 - DNA, 17 bp, Homo sapiens
cccgtggccccagcctg

SEQ ID NO: 2732593 - DNA, 20 bp, Homo sapiens
cccgtggccccagcctggcc

SEQ ID NO: 2732594 - DNA, 16 bp, Homo sapiens
cccgttgtctccctgg

SEQ ID NO: 2732595 - DNA, 19 bp, Homo sapiens
ccctaagtgtggatgttca

SEQ ID NO: 2732596 - DNA, 20 bp, Homo sapiens
ccctaagtgtggatgttcag

SEQ ID NO: 2732597 - DNA, 12 bp, Homo sapiens
ccctacagacag

SEQ ID NO: 2732598 - DNA, 12 bp, Homo sapiens
ccctacccactc

SEQ ID NO: 2732599 - DNA, 18 bp, Homo sapiens
ccctacccactctttgct

SEQ ID NO: 2732600 - DNA, 19 bp, Homo sapiens
ccctaccgcatggcagctg

SEQ ID NO: 2732601 - DNA, 22 bp, Homo sapiens
ccctaccgcatggcagctgggc

SEQ ID NO: 2732602 - DNA, 23 bp, Homo sapiens
ccctaccgcatggcagctgggcc

SEQ ID NO: 2732603 - DNA, 20 bp, Homo sapiens
ccctagatccaggcttctcc

SEQ ID NO: 2732604 - DNA, 22 bp, Homo sapiens
ccctagatccaggcttctcccg

SEQ ID NO: 2732605 - DNA, 16 bp, Homo sapiens
ccctcaaggcctccca

SEQ ID NO: 2732606 - DNA, 17 bp, Homo sapiens
ccctcaaggcctcccac

SEQ ID NO: 2732607 - DNA, 19 bp, Homo sapiens
ccctcaaggcctcccacag

SEQ ID NO: 2732608 - DNA, 20 bp, Homo sapiens
ccctcaaggcctcccacagt

SEQ ID NO: 2732609 - DNA, 14 bp, Homo sapiens
ccctcacagactct

SEQ ID NO: 2732610 - DNA, 14 bp, Homo sapiens
ccctcaccaggggc

SEQ ID NO: 2732611 - DNA, 22 bp, Homo sapiens
ccctcaggattgtttctcggca

SEQ ID NO: 2732612 - DNA, 17 bp, Homo sapiens
ccctcaggggaagctgc

SEQ ID NO: 2732613 - DNA, 13 bp, Homo sapiens
ccctcatcctttt

SEQ ID NO: 2732614 - DNA, 18 bp, Homo sapiens
ccctcattccctcgggac

SEQ ID NO: 2732615 - DNA, 16 bp, Homo sapiens
ccctccccacagtcct

SEQ ID NO: 2732616 - DNA, 14 bp, Homo sapiens
ccctcccgcccctt

SEQ ID NO: 2732617 - DNA, 12 bp, Homo sapiens
ccctccctgctg

SEQ ID NO: 2732618 - DNA, 19 bp, Homo sapiens
ccctccctgctgtcccctc

SEQ ID NO: 2732619 - DNA, 13 bp, Homo sapiens
ccctccgcctaga

SEQ ID NO: 2732620 - DNA, 22 bp, Homo sapiens
ccctcctacccctcccagctga

SEQ ID NO: 2732621 - DNA, 12 bp, Homo sapiens
ccctcctcacac

SEQ ID NO: 2732622 - DNA, 16 bp, Homo sapiens
ccctcctcacactcca

SEQ ID NO: 2732623 - DNA, 16 bp, Homo sapiens
ccctcctccactccac

SEQ ID NO: 2732624 - DNA, 14 bp, Homo sapiens
ccctcctgagcctc

SEQ ID NO: 2732625 - DNA, 15 bp, Homo sapiens
ccctcctgagcctca

SEQ ID NO: 2732626 - DNA, 18 bp, Homo sapiens
ccctcctgagcctcacct

SEQ ID NO: 2732627 - DNA, 24 bp, Homo sapiens
ccctcctgagcctcacctttcctg

SEQ ID NO: 2732628 - DNA, 12 bp, Homo sapiens
ccctcctgctgc

SEQ ID NO: 2732629 - DNA, 13 bp, Homo sapiens
ccctcctgctgca

SEQ ID NO: 2732630 - DNA, 14 bp, Homo sapiens
ccctcctggcacaa

SEQ ID NO: 2732631 - DNA, 16 bp, Homo sapiens
ccctcctttaccccac

SEQ ID NO: 2732632 - DNA, 14 bp, Homo sapiens
ccctcggcctccag

SEQ ID NO: 2732633 - DNA, 18 bp, Homo sapiens
ccctcgggaccctcccag

SEQ ID NO: 2732634 - DNA, 15 bp, Homo sapiens
ccctcgtttgatagt

SEQ ID NO: 2732635 - DNA, 17 bp, Homo sapiens
ccctctgcctcatcctc

SEQ ID NO: 2732636 - DNA, 19 bp, Homo sapiens
ccctctgcctcatcctcct

SEQ ID NO: 2732637 - DNA, 14 bp, Homo sapiens
ccctctgctgcttt

SEQ ID NO: 2732638 - DNA, 15 bp, Homo sapiens
ccctctggacagctt

SEQ ID NO: 2732639 - DNA, 21 bp, Homo sapiens
ccctctgtccagccagctcct

SEQ ID NO: 2732640 - DNA, 15 bp, Homo sapiens
ccctctgtcctgact

SEQ ID NO: 2732641 - DNA, 18 bp, Homo sapiens
ccctctgttgccaggcta

SEQ ID NO: 2732642 - DNA, 13 bp, Homo sapiens
ccctcttgcccca

SEQ ID NO: 2732643 - DNA, 18 bp, Homo sapiens
ccctcttgccccaacccc

SEQ ID NO: 2732644 - DNA, 15 bp, Homo sapiens
ccctgaagtcttgca

SEQ ID NO: 2732645 - DNA, 13 bp, Homo sapiens
ccctgaccttctc

SEQ ID NO: 2732646 - DNA, 17 bp, Homo sapiens
ccctgaccttctccagg

SEQ ID NO: 2732647 - DNA, 17 bp, Homo sapiens
ccctgactctctgtgac

SEQ ID NO: 2732648 - DNA, 21 bp, Homo sapiens
ccctgaggatcccctgtcccc

SEQ ID NO: 2732649 - DNA, 22 bp, Homo sapiens
ccctgaggctggcatcctggct

SEQ ID NO: 2732650 - DNA, 23 bp, Homo sapiens
ccctgcaacaaagacttgcttta

SEQ ID NO: 2732651 - DNA, 10 bp, Homo sapiens
ccctgcactg

SEQ ID NO: 2732652 - DNA, 17 bp, Homo sapiens
ccctgcactgtcctgct

SEQ ID NO: 2732653 - DNA, 20 bp, Homo sapiens
ccctgcactgtcctgctcca

SEQ ID NO: 2732654 - DNA, 22 bp, Homo sapiens
ccctgcactgtcctgctccaca

SEQ ID NO: 2732655 - DNA, 14 bp, Homo sapiens
cccaccgcatgccc

SEQ ID NO: 2732656 - DNA, 22 bp, Homo sapiens
cccaccgcatgccccctcgtgc

SEQ ID NO: 2732657 - DNA, 22 bp, Homo sapiens
cccacctttgggatcagcctcc

SEQ ID NO: 2732658 - DNA, 17 bp, Homo sapiens
cccacggggaccactgg

SEQ ID NO: 2732659 - DNA, 17 bp, Homo sapiens
cccacgtcctgtcagtg

SEQ ID NO: 2732660 - DNA, 22 bp, Homo sapiens
cccacgtcctgtcagtgccgcc

SEQ ID NO: 2732661 - DNA, 16 bp, Homo sapiens
cccacgtctctctgcc

SEQ ID NO: 2732662 - DNA, 18 bp, Homo sapiens
cccacgtctctctgcctg

SEQ ID NO: 2732663 - DNA, 19 bp, Homo sapiens
cccacgtctctctgcctgc

SEQ ID NO: 2732664 - DNA, 22 bp, Homo sapiens
cccacgtctctctgcctgctgg

SEQ ID NO: 2732665 - DNA, 22 bp, Homo sapiens
cccactaagctttctcctttga

SEQ ID NO: 2732666 - DNA, 23 bp, Homo sapiens
cccactctttgctacaataaatg

SEQ ID NO: 2732667 - DNA, 17 bp, Homo sapiens
cccactgcaccccctcc

SEQ ID NO: 2732668 - DNA, 18 bp, Homo sapiens
cccactgcaccccctcct

SEQ ID NO: 2732669 - DNA, 19 bp, Homo sapiens
cccactgcaccccctcctg

SEQ ID NO: 2732670 - DNA, 22 bp, Homo sapiens
cccactgcaccccctcctgctg

SEQ ID NO: 2732671 - DNA, 17 bp, Homo sapiens
cccactgccgcctcctt

SEQ ID NO: 2732672 - DNA, 14 bp, Homo sapiens
cccactggccagtc

SEQ ID NO: 2732673 - DNA, 15 bp, Homo sapiens
cccacttcatgccca

SEQ ID NO: 2732674 - DNA, 21 bp, Homo sapiens
cccacttcatgcccactgccg

SEQ ID NO: 2732675 - DNA, 22 bp, Homo sapiens
cccactttttttttttctgcct

SEQ ID NO: 2732676 - DNA, 23 bp, Homo sapiens
cccactttttttttttctgcctg

SEQ ID NO: 2732677 - DNA, 13 bp, Homo sapiens
cccagaaggctgg

SEQ ID NO: 2732678 - DNA, 14 bp, Homo sapiens
cccagacagctgga

SEQ ID NO: 2732679 - DNA, 17 bp, Homo sapiens
cccagacagctggaccc

SEQ ID NO: 2732680 - DNA, 14 bp, Homo sapiens
cccagacctctgaa

SEQ ID NO: 2732681 - DNA, 19 bp, Homo sapiens
cccagagacctttgcccac

SEQ ID NO: 2732682 - DNA, 21 bp, Homo sapiens
cccagagacctttgcccacac

SEQ ID NO: 2732683 - DNA, 18 bp, Homo sapiens
cccagagccactaccttt

SEQ ID NO: 2732684 - DNA, 20 bp, Homo sapiens
cccagagcgaggaaaggatt

SEQ ID NO: 2732685 - DNA, 13 bp, Homo sapiens
cccagagggccca

SEQ ID NO: 2732686 - DNA, 22 bp, Homo sapiens
cccagagggcccaggcaggcca

SEQ ID NO: 2732687 - DNA, 19 bp, Homo sapiens
cccagagttcttgcaccct

SEQ ID NO: 2732688 - DNA, 13 bp, Homo sapiens
cccagcacagctc

SEQ ID NO: 2732689 - DNA, 16 bp, Homo sapiens
cccagcacagctcctc

SEQ ID NO: 2732690 - DNA, 20 bp, Homo sapiens
cccagcacagctcctcccct

SEQ ID NO: 2732691 - DNA, 21 bp, Homo sapiens
cccagcacagctcctcccctg

SEQ ID NO: 2732692 - DNA, 12 bp, Homo sapiens
cccagcacccgg

SEQ ID NO: 2732693 - DNA, 15 bp, Homo sapiens
cccagcatctcagag

SEQ ID NO: 2732694 - DNA, 16 bp, Homo sapiens
cccagcatctcagagt

SEQ ID NO: 2732695 - DNA, 20 bp, Homo sapiens
cccagcctgccccagcctcc

SEQ ID NO: 2732696 - DNA, 22 bp, Homo sapiens
cccagcctgccccagcctccca

SEQ ID NO: 2732697 - DNA, 14 bp, Homo sapiens
cccagcctggccca

SEQ ID NO: 2732698 - DNA, 16 bp, Homo sapiens
cccagcctggcccagc

SEQ ID NO: 2732699 - DNA, 19 bp, Homo sapiens
cccagcctggcccagctcc

SEQ ID NO: 2732700 - DNA, 20 bp, Homo sapiens
cccagcctggcccagctccc

SEQ ID NO: 2732701 - DNA, 22 bp, Homo sapiens
cccagcctggcccagctccccc

SEQ ID NO: 2732702 - DNA, 15 bp, Homo sapiens
cccagctagggctgg

SEQ ID NO: 2732703 - DNA, 17 bp, Homo sapiens
cccagctagggctggac

SEQ ID NO: 2732704 - DNA, 19 bp, Homo sapiens
cccagctcccccgggaggg

SEQ ID NO: 2732705 - DNA, 13 bp, Homo sapiens
cccagctgaggct

SEQ ID NO: 2732706 - DNA, 18 bp, Homo sapiens
cccagctgcacctgccag

SEQ ID NO: 2732707 - DNA, 22 bp, Homo sapiens
cccagctgcacctgccagcctg

SEQ ID NO: 2732708 - DNA, 23 bp, Homo sapiens
cccagctgcacctgccagcctgg

SEQ ID NO: 2732709 - DNA, 11 bp, Homo sapiens
cccagctggcc

SEQ ID NO: 2732710 - DNA, 14 bp, Homo sapiens
cccagctggcctct

SEQ ID NO: 2732711 - DNA, 18 bp, Homo sapiens
cccaggaagggagggagc

SEQ ID NO: 2732712 - DNA, 21 bp, Homo sapiens
cccaggaagggagggagctga

SEQ ID NO: 2732713 - DNA, 19 bp, Homo sapiens
cccaggacggggccggcca

SEQ ID NO: 2732714 - DNA, 22 bp, Homo sapiens
cccaggacggggccggccaggt

SEQ ID NO: 2732715 - DNA, 23 bp, Homo sapiens
cccaggaggtggaggttgcagtg

SEQ ID NO: 2732716 - DNA, 23 bp, Homo sapiens
cccaggagtttgaggctgcagcg

SEQ ID NO: 2732717 - DNA, 16 bp, Homo sapiens
cccaggattcccagag

SEQ ID NO: 2732718 - DNA, 23 bp, Homo sapiens
cccaggattgtgcaatagtcaga

SEQ ID NO: 2732719 - DNA, 14 bp, Homo sapiens
cccaggcaggccac

SEQ ID NO: 2732720 - DNA, 18 bp, Homo sapiens
cccaggctagagtgcagt

SEQ ID NO: 2732721 - DNA, 18 bp, Homo sapiens
cccaggctggagtgcaat

SEQ ID NO: 2732722 - DNA, 16 bp, Homo sapiens
cccaggctggccagcc

SEQ ID NO: 2732723 - DNA, 17 bp, Homo sapiens
cccaggctggccagccc

SEQ ID NO: 2732724 - DNA, 22 bp, Homo sapiens
cccaggctggccagccccacag

SEQ ID NO: 2732725 - DNA, 21 bp, Homo sapiens
cccagggccagggccctgcag

SEQ ID NO: 2732726 - DNA, 22 bp, Homo sapiens
cccagggccagggccctgcaga

SEQ ID NO: 2732727 - DNA, 15 bp, Homo sapiens
cccagggcctccagg

SEQ ID NO: 2732728 - DNA, 22 bp, Homo sapiens
cccagggctccctcctggagca

SEQ ID NO: 2732729 - DNA, 14 bp, Homo sapiens
cccaggtaagcagg

SEQ ID NO: 2732730 - DNA, 17 bp, Homo sapiens
cccaggtaagcaggagg

SEQ ID NO: 2732731 - DNA, 19 bp, Homo sapiens
cccaggtaagcaggaggag

SEQ ID NO: 2732732 - DNA, 14 bp, Homo sapiens
cccagtgagcctct

SEQ ID NO: 2732733 - DNA, 18 bp, Homo sapiens
cccagtgtcttcctgtgg

SEQ ID NO: 2732734 - DNA, 14 bp, Homo sapiens
cccagtgtgtgctc

SEQ ID NO: 2732735 - DNA, 17 bp, Homo sapiens
cccagtgtgtgctcagc

SEQ ID NO: 2732736 - DNA, 23 bp, Homo sapiens
cccatcagtgtacccccgcccag

SEQ ID NO: 2732737 - DNA, 12 bp, Homo sapiens
cccatcccccct

SEQ ID NO: 2732738 - DNA, 15 bp, Homo sapiens
cccatcccccctcac

SEQ ID NO: 2732739 - DNA, 16 bp, Homo sapiens
cccatcccccctcacc

SEQ ID NO: 2732740 - DNA, 22 bp, Homo sapiens
cccatcccccctcaccaggggc

SEQ ID NO: 2732741 - DNA, 14 bp, Homo sapiens
cccatcctggccca

SEQ ID NO: 2732742 - DNA, 12 bp, Homo sapiens
cccatctgccca

SEQ ID NO: 2732743 - DNA, 17 bp, Homo sapiens
cccatctgtccatcctc

SEQ ID NO: 2732744 - DNA, 21 bp, Homo sapiens
cccatctgtccatcctcctct

SEQ ID NO: 2732745 - DNA, 16 bp, Homo sapiens
cccatgggcactgctg

SEQ ID NO: 2732746 - DNA, 23 bp, Homo sapiens
cccatgtgcatggaaatgtcctc

SEQ ID NO: 2732747 - DNA, 23 bp, Homo sapiens
ccccaacccccagcacccgggct

SEQ ID NO: 2732748 - DNA, 22 bp, Homo sapiens
ccccaatccatttggcagaact

SEQ ID NO: 2732749 - DNA, 11 bp, Homo sapiens
ccccacagccc

SEQ ID NO: 2732750 - DNA, 13 bp, Homo sapiens
ccccacagcccac

SEQ ID NO: 2732751 - DNA, 22 bp, Homo sapiens
ccccaccagagctgcctcccca

SEQ ID NO: 2732752 - DNA, 18 bp, Homo sapiens
ccccaccccagcacagct

SEQ ID NO: 2732753 - DNA, 22 bp, Homo sapiens
ccccaccctcaaaccctgtggg

SEQ ID NO: 2732754 - DNA, 12 bp, Homo sapiens
ccccacctgcca

SEQ ID NO: 2732755 - DNA, 18 bp, Homo sapiens
ccccacgtctctctgcct

SEQ ID NO: 2732756 - DNA, 23 bp, Homo sapiens
ccccacgtctctctgcctgctgg

SEQ ID NO: 2732757 - DNA, 15 bp, Homo sapiens
ccccactcacaggga

SEQ ID NO: 2732758 - DNA, 15 bp, Homo sapiens
ccccagagccactac

SEQ ID NO: 2732759 - DNA, 22 bp, Homo sapiens
ccccagagccactacctttgtc

SEQ ID NO: 2732760 - DNA, 19 bp, Homo sapiens
ccccagcacagctcctccc

SEQ ID NO: 2732761 - DNA, 13 bp, Homo sapiens
ccccagcacccgg

SEQ ID NO: 2732762 - DNA, 15 bp, Homo sapiens
ccccagcctggccca

SEQ ID NO: 2732763 - DNA, 19 bp, Homo sapiens
ccccagcctggcccagctc

SEQ ID NO: 2732764 - DNA, 21 bp, Homo sapiens
ccccagcctggcccagctccc

SEQ ID NO: 2732765 - DNA, 22 bp, Homo sapiens
ccccagcctggcccagctcccc

SEQ ID NO: 2732766 - DNA, 21 bp, Homo sapiens
ccccagcggcagatgggcctg

SEQ ID NO: 2732767 - DNA, 11 bp, Homo sapiens
ccccagctggc

SEQ ID NO: 2732768 - DNA, 15 bp, Homo sapiens
ccccagctggcctct

SEQ ID NO: 2732769 - DNA, 23 bp, Homo sapiens
ccccagctggcctctagaacacc

SEQ ID NO: 2732770 - DNA, 14 bp, Homo sapiens
ccccatctctacta

SEQ ID NO: 2732771 - DNA, 13 bp, Homo sapiens
ccccatctgccca

SEQ ID NO: 2732772 - DNA, 14 bp, Homo sapiens
ccccatctgcccag

SEQ ID NO: 2732773 - DNA, 18 bp, Homo sapiens
ccccatctgcccaggacg

SEQ ID NO: 2732774 - DNA, 17 bp, Homo sapiens
ccccattagagtcagcc

SEQ ID NO: 2732775 - DNA, 17 bp, Homo sapiens
cccccaccccagcacag

SEQ ID NO: 2732776 - DNA, 18 bp, Homo sapiens
cccccacgtctctctgcc

SEQ ID NO: 2732777 - DNA, 23 bp, Homo sapiens
cccccacgtctctctgcctgctg

SEQ ID NO: 2732778 - DNA, 22 bp, Homo sapiens
cccccagagacctttgcccaca

SEQ ID NO: 2732779 - DNA, 23 bp, Homo sapiens
cccccagagacctttgcccacac

SEQ ID NO: 2732780 - DNA, 20 bp, Homo sapiens
cagcctggcccagctccccc

SEQ ID NO: 2732781 - DNA, 19 bp, Homo sapiens
cagcctggcttctggagcc

SEQ ID NO: 2732782 - DNA, 14 bp, Homo sapiens
cagcctgggtgacg

SEQ ID NO: 2732783 - DNA, 13 bp, Homo sapiens
cagcctgtcctgg

SEQ ID NO: 2732784 - DNA, 14 bp, Homo sapiens
cagcctgtcctggt

SEQ ID NO: 2732785 - DNA, 16 bp, Homo sapiens
cagcctgtcctggtac

SEQ ID NO: 2732786 - DNA, 18 bp, Homo sapiens
cagcctgtcctggtacag

SEQ ID NO: 2732787 - DNA, 22 bp, Homo sapiens
cagcctgtcctggtacagcagg

SEQ ID NO: 2732788 - DNA, 20 bp, Homo sapiens
cagcctgtcgtgtccagcct

SEQ ID NO: 2732789 - DNA, 12 bp, Homo sapiens
cagcgcctcctg

SEQ ID NO: 2732790 - DNA, 14 bp, Homo sapiens
cagcgcctgtcccc

SEQ ID NO: 2732791 - DNA, 18 bp, Homo sapiens
cagcgcctgtcccctcac

SEQ ID NO: 2732792 - DNA, 24 bp, Homo sapiens
cagcgcctgtcccctcacagactc

SEQ ID NO: 2732793 - DNA, 15 bp, Homo sapiens
cagcgtgtcaacttt

SEQ ID NO: 2732794 - DNA, 17 bp, Homo sapiens
cagctaagcctgatgat

SEQ ID NO: 2732795 - DNA, 18 bp, Homo sapiens
cagctaagcctgatgatg

SEQ ID NO: 2732796 - DNA, 15 bp, Homo sapiens
cagctactcagaagc

SEQ ID NO: 2732797 - DNA, 23 bp, Homo sapiens
cagctactcagaagcctgaggct

SEQ ID NO: 2732798 - DNA, 16 bp, Homo sapiens
cagctattcaggaggc

SEQ ID NO: 2732799 - DNA, 22 bp, Homo sapiens
cagctattcccttctgatcttg

SEQ ID NO: 2732800 - DNA, 12 bp, Homo sapiens
cagctcaggaga

SEQ ID NO: 2732801 - DNA, 13 bp, Homo sapiens
cagctcctcccct

SEQ ID NO: 2732802 - DNA, 15 bp, Homo sapiens
cagctcctcccctgc

SEQ ID NO: 2732803 - DNA, 21 bp, Homo sapiens
cagctcctcccctgccgcctc

SEQ ID NO: 2732804 - DNA, 22 bp, Homo sapiens
cagctcgagcatgccctgagct

SEQ ID NO: 2732805 - DNA, 23 bp, Homo sapiens
cagctctatgtgggaaaaaagaa

SEQ ID NO: 2732806 - DNA, 19 bp, Homo sapiens
cagctctgcagcaatattc

SEQ ID NO: 2732807 - DNA, 15 bp, Homo sapiens
cagctctgctggaag

SEQ ID NO: 2732808 - DNA, 14 bp, Homo sapiens
cagctctggcttcc

SEQ ID NO: 2732809 - DNA, 22 bp, Homo sapiens
cagctctgtcaccctggccacc

SEQ ID NO: 2732810 - DNA, 13 bp, Homo sapiens
cagctcttgtttg

SEQ ID NO: 2732811 - DNA, 15 bp, Homo sapiens
cagctcttgtttgga

SEQ ID NO: 2732812 - DNA, 12 bp, Homo sapiens
cagctgctgcca

SEQ ID NO: 2732813 - DNA, 21 bp, Homo sapiens
cagctgctgccactctgctgc

SEQ ID NO: 2732814 - DNA, 22 bp, Homo sapiens
cagctggacccatttgccagga

SEQ ID NO: 2732815 - DNA, 14 bp, Homo sapiens
cagctggcctctag

SEQ ID NO: 2732816 - DNA, 15 bp, Homo sapiens
cagctggcctctaga

SEQ ID NO: 2732817 - DNA, 20 bp, Homo sapiens
cagctggcctctagaacacc

SEQ ID NO: 2732818 - DNA, 23 bp, Homo sapiens
cagctggcctctagaacacccac

SEQ ID NO: 2732819 - DNA, 14 bp, Homo sapiens
cagctggctctcca

SEQ ID NO: 2732820 - DNA, 19 bp, Homo sapiens
cagctgggcccacagcccc

SEQ ID NO: 2732821 - DNA, 20 bp, Homo sapiens
cagctgggcccacagccccc

SEQ ID NO: 2732822 - DNA, 23 bp, Homo sapiens
cagctgggcccacagcccccacc

SEQ ID NO: 2732823 - DNA, 19 bp, Homo sapiens
cagctggtggatggtgact

SEQ ID NO: 2732824 - DNA, 22 bp, Homo sapiens
cagctgtggtcccacccaggaa

SEQ ID NO: 2732825 - DNA, 18 bp, Homo sapiens
cagctgttacctgagata

SEQ ID NO: 2732826 - DNA, 13 bp, Homo sapiens
cagcttctcttga

SEQ ID NO: 2732827 - DNA, 15 bp, Homo sapiens
cagcttctgccactt

SEQ ID NO: 2732828 - DNA, 21 bp, Homo sapiens
cagcttgactctactcccagc

SEQ ID NO: 2732829 - DNA, 17 bp, Homo sapiens
cagctttccctccccag

SEQ ID NO: 2732830 - DNA, 14 bp, Homo sapiens
cagctttggctgca

SEQ ID NO: 2732831 - DNA, 16 bp, Homo sapiens
cagctttttgtattaa

SEQ ID NO: 2732832 - DNA, 18 bp, Homo sapiens
cagctttttgtattaaca

SEQ ID NO: 2732833 - DNA, 16 bp, Homo sapiens
caggaaatcagagctg

SEQ ID NO: 2732834 - DNA, 17 bp, Homo sapiens
caggaaatcagagctgg

SEQ ID NO: 2732835 - DNA, 19 bp, Homo sapiens
caggaagggagggagctga

SEQ ID NO: 2732836 - DNA, 21 bp, Homo sapiens
caggaagggagggagctgagg

SEQ ID NO: 2732837 - DNA, 17 bp, Homo sapiens
caggaataggcatttgc

SEQ ID NO: 2732838 - DNA, 20 bp, Homo sapiens
caggacagtgcttcagcctg

SEQ ID NO: 2732839 - DNA, 22 bp, Homo sapiens
caggacagtgcttcagcctgag

SEQ ID NO: 2732840 - DNA, 16 bp, Homo sapiens
caggacggggccggcc

SEQ ID NO: 2732841 - DNA, 23 bp, Homo sapiens
caggactcagggactcaggccag

SEQ ID NO: 2732842 - DNA, 13 bp, Homo sapiens
caggactctgcag

SEQ ID NO: 2732843 - DNA, 22 bp, Homo sapiens
caggactggggcttgccaggct

SEQ ID NO: 2732844 - DNA, 18 bp, Homo sapiens
caggagagcttcccccaa

SEQ ID NO: 2732845 - DNA, 14 bp, Homo sapiens
caggagcaaatgct

SEQ ID NO: 2732846 - DNA, 15 bp, Homo sapiens
caggagcaaatgctg

SEQ ID NO: 2732847 - DNA, 19 bp, Homo sapiens
caggagcaaccgtgcagcc

SEQ ID NO: 2732848 - DNA, 23 bp, Homo sapiens
caggagcaaccgtgcagccacga

SEQ ID NO: 2732849 - DNA, 20 bp, Homo sapiens
caggagctgacagagccaga

SEQ ID NO: 2732850 - DNA, 21 bp, Homo sapiens
caggagctgacagagccagag

SEQ ID NO: 2732851 - DNA, 22 bp, Homo sapiens
caggagctgacagagccagagg

SEQ ID NO: 2732852 - DNA, 23 bp, Homo sapiens
caggagctgacagagccagaggc

SEQ ID NO: 2732853 - DNA, 19 bp, Homo sapiens
caggaggaggtgccaacag

SEQ ID NO: 2732854 - DNA, 13 bp, Homo sapiens
caggaggctgagg

SEQ ID NO: 2732855 - DNA, 15 bp, Homo sapiens
caggaggctgaggca

SEQ ID NO: 2732856 - DNA, 15 bp, Homo sapiens
caggaggggaagagg

SEQ ID NO: 2732857 - DNA, 20 bp, Homo sapiens
caggagtcaccatgcaaggg

SEQ ID NO: 2732858 - DNA, 18 bp, Homo sapiens
caggagtttgaggctgca

SEQ ID NO: 2732859 - DNA, 21 bp, Homo sapiens
caggagtttgaggctgcagcg

SEQ ID NO: 2732860 - DNA, 22 bp, Homo sapiens
caggatggtcttgatctcctga

SEQ ID NO: 2732861 - DNA, 14 bp, Homo sapiens
caggattcccagag

SEQ ID NO: 2732862 - DNA, 17 bp, Homo sapiens
caggattcccagagaga

SEQ ID NO: 2732863 - DNA, 22 bp, Homo sapiens
caggattgggccaacaaggact

SEQ ID NO: 2732864 - DNA, 23 bp, Homo sapiens
caggattgtgcaatagtcagagt

SEQ ID NO: 2732865 - DNA, 23 bp, Homo sapiens
caggcaagcttgtgtgggcccaa

SEQ ID NO: 2732866 - DNA, 23 bp, Homo sapiens
caggcacatggctgggggaggga

SEQ ID NO: 2732867 - DNA, 22 bp, Homo sapiens
caggcacccccaggattcccag

SEQ ID NO: 2732868 - DNA, 22 bp, Homo sapiens
caggcagatttactgtcccagg

SEQ ID NO: 2732869 - DNA, 15 bp, Homo sapiens
caggcagcgcctgtc

SEQ ID NO: 2732870 - DNA, 17 bp, Homo sapiens
caggcagcgcctgtccc

SEQ ID NO: 2732871 - DNA, 22 bp, Homo sapiens
caggcagcgcctgtcccctcac

SEQ ID NO: 2732872 - DNA, 15 bp, Homo sapiens
caggcagctcgagca

SEQ ID NO: 2732873 - DNA, 19 bp, Homo sapiens
caggccaagagcagaggca

SEQ ID NO: 2732874 - DNA, 19 bp, Homo sapiens
caggccacagccagcctgt

SEQ ID NO: 2732875 - DNA, 16 bp, Homo sapiens
caggccaggtgcagtg

SEQ ID NO: 2732876 - DNA, 14 bp, Homo sapiens
caggccatcttcca

SEQ ID NO: 2732877 - DNA, 15 bp, Homo sapiens
caggccatcttccag

SEQ ID NO: 2732878 - DNA, 16 bp, Homo sapiens
caggccatcttccagg

SEQ ID NO: 2732879 - DNA, 11 bp, Homo sapiens
caggccctgca

SEQ ID NO: 2732880 - DNA, 23 bp, Homo sapiens
caggccctgcactgtcctgctcc

SEQ ID NO: 2732881 - DNA, 20 bp, Homo sapiens
caggcccttggtagagctgg

SEQ ID NO: 2732882 - DNA, 22 bp, Homo sapiens
caggccggtgtgggctgtgtcg

SEQ ID NO: 2732883 - DNA, 14 bp, Homo sapiens
caggcgcacaccac

SEQ ID NO: 2732884 - DNA, 16 bp, Homo sapiens
caggctagagtgcagt

SEQ ID NO: 2732885 - DNA, 20 bp, Homo sapiens
caggctctgagatttcacag

SEQ ID NO: 2732886 - DNA, 20 bp, Homo sapiens
caggctgctgcatggcactg

SEQ ID NO: 2732887 - DNA, 17 bp, Homo sapiens
caggctggccagcccca

SEQ ID NO: 2732888 - DNA, 18 bp, Homo sapiens
caggctggccagccccac

SEQ ID NO: 2732889 - DNA, 19 bp, Homo sapiens
caggctggccagccccaca

SEQ ID NO: 2732890 - DNA, 20 bp, Homo sapiens
caggctggccagccccacag

SEQ ID NO: 2732891 - DNA, 23 bp, Homo sapiens
caggctggccagccccacagccc

SEQ ID NO: 2732892 - DNA, 19 bp, Homo sapiens
ccagcggcagatgggcctg

SEQ ID NO: 2732893 - DNA, 12 bp, Homo sapiens
ccagcgtccccg

SEQ ID NO: 2732894 - DNA, 16 bp, Homo sapiens
ccagctactcagaagc

SEQ ID NO: 2732895 - DNA, 14 bp, Homo sapiens
ccagctctggcttc

SEQ ID NO: 2732896 - DNA, 14 bp, Homo sapiens
ccagctgaggctgg

SEQ ID NO: 2732897 - DNA, 15 bp, Homo sapiens
ccagctgaggctggg

SEQ ID NO: 2732898 - DNA, 18 bp, Homo sapiens
ccagctgcacctgccagc

SEQ ID NO: 2732899 - DNA, 13 bp, Homo sapiens
ccagctggcctct

SEQ ID NO: 2732900 - DNA, 16 bp, Homo sapiens
ccagctggcctctaga

SEQ ID NO: 2732901 - DNA, 16 bp, Homo sapiens
ccagctgttacctgag

SEQ ID NO: 2732902 - DNA, 22 bp, Homo sapiens
ccagcttccctctgcctgaccc

SEQ ID NO: 2732903 - DNA, 14 bp, Homo sapiens
ccagcttcctctga

SEQ ID NO: 2732904 - DNA, 15 bp, Homo sapiens
ccagcttcctctgag

SEQ ID NO: 2732905 - DNA, 18 bp, Homo sapiens
ccagctttccctccccag

SEQ ID NO: 2732906 - DNA, 18 bp, Homo sapiens
cccaatccatttggcaga

SEQ ID NO: 2732907 - DNA, 15 bp, Homo sapiens
cccaattgccacatt

SEQ ID NO: 2732908 - DNA, 16 bp, Homo sapiens
cccacacacactcctt

SEQ ID NO: 2732909 - DNA, 19 bp, Homo sapiens
cccacacacactccttccc

SEQ ID NO: 2732910 - DNA, 11 bp, Homo sapiens
cccacagccca

SEQ ID NO: 2732911 - DNA, 18 bp, Homo sapiens
cccacagcccacgtcctg

SEQ ID NO: 2732912 - DNA, 12 bp, Homo sapiens
cccacagctctg

SEQ ID NO: 2732913 - DNA, 13 bp, Homo sapiens
cccacagctctgc

SEQ ID NO: 2732914 - DNA, 21 bp, Homo sapiens
cccacagtcctcacagcctct

SEQ ID NO: 2732915 - DNA, 22 bp, Homo sapiens
cccacagtgactcgggctcctg

SEQ ID NO: 2732916 - DNA, 19 bp, Homo sapiens
cccaccaaggtctcacact

SEQ ID NO: 2732917 - DNA, 22 bp, Homo sapiens
cccaccaaggtctcacactcct

SEQ ID NO: 2732918 - DNA, 23 bp, Homo sapiens
cccaccactaggactctgaggct

SEQ ID NO: 2732919 - DNA, 14 bp, Homo sapiens
cccaccagagctgc

SEQ ID NO: 2732920 - DNA, 17 bp, Homo sapiens
cccaccagagctgcctc

SEQ ID NO: 2732921 - DNA, 22 bp, Homo sapiens
cccaccagagctgcctccccaa

SEQ ID NO: 2732922 - DNA, 23 bp, Homo sapiens
cccaccagagctgcctccccaat

SEQ ID NO: 2732923 - DNA, 14 bp, Homo sapiens
cccaccagcggcct

SEQ ID NO: 2732924 - DNA, 21 bp, Homo sapiens
cccaccccagcacagctcctc

SEQ ID NO: 2732925 - DNA, 21 bp, Homo sapiens
cccaccctcaaaccctgtggg

SEQ ID NO: 2732926 - DNA, 19 bp, Homo sapiens
cccaccctgggtttggccc

SEQ ID NO: 2732927 - DNA, 17 bp, Homo sapiens
cagaattttggaaaaat

SEQ ID NO: 2732928 - DNA, 14 bp, Homo sapiens
cagacctcagagat

SEQ ID NO: 2732929 - DNA, 21 bp, Homo sapiens
cagacctctgaatgtcccaga

SEQ ID NO: 2732930 - DNA, 20 bp, Homo sapiens
cagacgtgagtgtgactttt

SEQ ID NO: 2732931 - DNA, 12 bp, Homo sapiens
cagactcctggc

SEQ ID NO: 2732932 - DNA, 15 bp, Homo sapiens
cagactcctggcttc

SEQ ID NO: 2732933 - DNA, 17 bp, Homo sapiens
cagactcctggcttcat

SEQ ID NO: 2732934 - DNA, 17 bp, Homo sapiens
cagactcttccaccaga

SEQ ID NO: 2732935 - DNA, 13 bp, Homo sapiens
cagactgcggagc

SEQ ID NO: 2732936 - DNA, 18 bp, Homo sapiens
cagactgcggagcagcct

SEQ ID NO: 2732937 - DNA, 22 bp, Homo sapiens
cagactgcggagcagcctccag

SEQ ID NO: 2732938 - DNA, 13 bp, Homo sapiens
cagactgctggga

SEQ ID NO: 2732939 - DNA, 20 bp, Homo sapiens
cagactgctgggactggcca

SEQ ID NO: 2732940 - DNA, 23 bp, Homo sapiens
cagacttagtttttataaaatgg

SEQ ID NO: 2732941 - DNA, 17 bp, Homo sapiens
cagagaaattatgtttt

SEQ ID NO: 2732942 - DNA, 16 bp, Homo sapiens
cagagcaggggctgct

SEQ ID NO: 2732943 - DNA, 19 bp, Homo sapiens
cagagcaggggctgctggg

SEQ ID NO: 2732944 - DNA, 20 bp, Homo sapiens
cagagcaggggctgctgggg

SEQ ID NO: 2732945 - DNA, 22 bp, Homo sapiens
cagagcaggggctgctgggggc

SEQ ID NO: 2732946 - DNA, 11 bp, Homo sapiens
cagagcctcag

SEQ ID NO: 2732947 - DNA, 14 bp, Homo sapiens
cagagcctcagctt

SEQ ID NO: 2732948 - DNA, 18 bp, Homo sapiens
cagagcctcagcttctgg

SEQ ID NO: 2732949 - DNA, 16 bp, Homo sapiens
cagagctatggtgagg

SEQ ID NO: 2732950 - DNA, 11 bp, Homo sapiens
cagagctgagt

SEQ ID NO: 2732951 - DNA, 23 bp, Homo sapiens
cagagctgagtggcagccgcctc

SEQ ID NO: 2732952 - DNA, 17 bp, Homo sapiens
cagagctgcctccccaa

SEQ ID NO: 2732953 - DNA, 20 bp, Homo sapiens
cagagctgcgggctgagggc

SEQ ID NO: 2732954 - DNA, 14 bp, Homo sapiens
cagagctgctgagc

SEQ ID NO: 2732955 - DNA, 15 bp, Homo sapiens
cagagctgctgagca

SEQ ID NO: 2732956 - DNA, 20 bp, Homo sapiens
cagagctgctgagcaggaac

SEQ ID NO: 2732957 - DNA, 22 bp, Homo sapiens
cagagctggcagcctccagtgg

SEQ ID NO: 2732958 - DNA, 22 bp, Homo sapiens
cagagcttttcgaactgtgctc

SEQ ID NO: 2732959 - DNA, 23 bp, Homo sapiens
cagagcttttcgaactgtgctcc

SEQ ID NO: 2732960 - DNA, 18 bp, Homo sapiens
cagagggaaggggcctac

SEQ ID NO: 2732961 - DNA, 15 bp, Homo sapiens
cagagggcgctcctg

SEQ ID NO: 2732962 - DNA, 16 bp, Homo sapiens
cagagggcgctcctgt

SEQ ID NO: 2732963 - DNA, 23 bp, Homo sapiens
cagaggggaaaccagtgtagcct

SEQ ID NO: 2732964 - DNA, 22 bp, Homo sapiens
cagaggggcaggccctgcactg

SEQ ID NO: 2732965 - DNA, 15 bp, Homo sapiens
cagaggtgagcagag

SEQ ID NO: 2732966 - DNA, 22 bp, Homo sapiens
cagagtgtccctttttgcaggg

SEQ ID NO: 2732967 - DNA, 17 bp, Homo sapiens
cagagttcttgcaccct

SEQ ID NO: 2732968 - DNA, 12 bp, Homo sapiens
cagagttctttg

SEQ ID NO: 2732969 - DNA, 13 bp, Homo sapiens
cagagttctttgc

SEQ ID NO: 2732970 - DNA, 14 bp, Homo sapiens
cagagttctttgca

SEQ ID NO: 2732971 - DNA, 14 bp, Homo sapiens
cagatcctccattt

SEQ ID NO: 2732972 - DNA, 18 bp, Homo sapiens
cagatctttaaatacagt

SEQ ID NO: 2732973 - DNA, 13 bp, Homo sapiens
cagatctttttgt

SEQ ID NO: 2732974 - DNA, 15 bp, Homo sapiens
cagatctttttgtga

SEQ ID NO: 2732975 - DNA, 18 bp, Homo sapiens
cagatgctggcctcttgg

SEQ ID NO: 2732976 - DNA, 20 bp, Homo sapiens
cagatgctggcctcttggca

SEQ ID NO: 2732977 - DNA, 12 bp, Homo sapiens
cagatgctgggc

SEQ ID NO: 2732978 - DNA, 21 bp, Homo sapiens
cagatggaagaagttttaact

SEQ ID NO: 2732979 - DNA, 15 bp, Homo sapiens
cagatggagaaacag

SEQ ID NO: 2732980 - DNA, 23 bp, Homo sapiens
cagatggagaaacaggctctgag

SEQ ID NO: 2732981 - DNA, 20 bp, Homo sapiens
cagatgggatgggctttctc

SEQ ID NO: 2732982 - DNA, 12 bp, Homo sapiens
cagatgtccctg

SEQ ID NO: 2732983 - DNA, 13 bp, Homo sapiens
cagatgtccctga

SEQ ID NO: 2732984 - DNA, 14 bp, Homo sapiens
cagatgtccctgaa

SEQ ID NO: 2732985 - DNA, 20 bp, Homo sapiens
cagatgtccctgaagtcttg

SEQ ID NO: 2732986 - DNA, 20 bp, Homo sapiens
cagatgtgggctcagatcct

SEQ ID NO: 2732987 - DNA, 17 bp, Homo sapiens
cagattacaataaatcc

SEQ ID NO: 2732988 - DNA, 22 bp, Homo sapiens
cagatttactgtcccaggagca

SEQ ID NO: 2732989 - DNA, 22 bp, Homo sapiens
cagatttgggggaattaacaaa

SEQ ID NO: 2732990 - DNA, 13 bp, Homo sapiens
cagatttgtataa

SEQ ID NO: 2732991 - DNA, 16 bp, Homo sapiens
cagcaaagccatattc

SEQ ID NO: 2732992 - DNA, 14 bp, Homo sapiens
cagcaagcagtgcc

SEQ ID NO: 2732993 - DNA, 15 bp, Homo sapiens
cagcaatattctgat

SEQ ID NO: 2732994 - DNA, 19 bp, Homo sapiens
cagcacagcaaggaggctg

SEQ ID NO: 2732995 - DNA, 15 bp, Homo sapiens
cagcacagctcctcc

SEQ ID NO: 2732996 - DNA, 18 bp, Homo sapiens
cagcacagctcctcccct

SEQ ID NO: 2732997 - DNA, 18 bp, Homo sapiens
cagcacagggatccgact

SEQ ID NO: 2732998 - DNA, 20 bp, Homo sapiens
cagcactttgggaggctgag

SEQ ID NO: 2732999 - DNA, 16 bp, Homo sapiens
cagcagccagctcctg

SEQ ID NO: 2733000 - DNA, 11 bp, Homo sapiens
cagcagcccca

SEQ ID NO: 2733001 - DNA, 16 bp, Homo sapiens
cagcagccccctgccc

SEQ ID NO: 2733002 - DNA, 17 bp, Homo sapiens
cagcagccccctgcccg

SEQ ID NO: 2733003 - DNA, 15 bp, Homo sapiens
cagcaggcagcgcct

SEQ ID NO: 2733004 - DNA, 15 bp, Homo sapiens
cagcaggtgctgcta

SEQ ID NO: 2733005 - DNA, 19 bp, Homo sapiens
cagcaggtgctgctaccct

SEQ ID NO: 2733006 - DNA, 23 bp, Homo sapiens
cagcaggtgctgctaccctccct

SEQ ID NO: 2733007 - DNA, 19 bp, Homo sapiens
cagcatcaaacatgaaaac

SEQ ID NO: 2733008 - DNA, 23 bp, Homo sapiens
cagcatccttttctgcagagggg

SEQ ID NO: 2733009 - DNA, 15 bp, Homo sapiens
cagcatctcagagtc

SEQ ID NO: 2733010 - DNA, 16 bp, Homo sapiens
cagcatctcagagtcc

SEQ ID NO: 2733011 - DNA, 18 bp, Homo sapiens
cagcatgtggggaagcaa

SEQ ID NO: 2733012 - DNA, 21 bp, Homo sapiens
cagcattttcacattttgcct

SEQ ID NO: 2733013 - DNA, 22 bp, Homo sapiens
cagccacgaacacgcatgcctc

SEQ ID NO: 2733014 - DNA, 13 bp, Homo sapiens
cagccagccctgg

SEQ ID NO: 2733015 - DNA, 20 bp, Homo sapiens
cagccagccctggaggctgg

SEQ ID NO: 2733016 - DNA, 12 bp, Homo sapiens
cagccagctcct

SEQ ID NO: 2733017 - DNA, 15 bp, Homo sapiens
cagccagctcctggt

SEQ ID NO: 2733018 - DNA, 16 bp, Homo sapiens
cagccagctcctggta

SEQ ID NO: 2733019 - DNA, 20 bp, Homo sapiens
cagccattaccatggagaca

SEQ ID NO: 2733020 - DNA, 15 bp, Homo sapiens
cagcccacgtcctgt

SEQ ID NO: 2733021 - DNA, 20 bp, Homo sapiens
cagcccacgtcctgtcagtg

SEQ ID NO: 2733022 - DNA, 12 bp, Homo sapiens
cagccccacagc

SEQ ID NO: 2733023 - DNA, 16 bp, Homo sapiens
cagccccacagcccac

SEQ ID NO: 2733024 - DNA, 23 bp, Homo sapiens
cagccccaccccaccctgcccct

SEQ ID NO: 2733025 - DNA, 18 bp, Homo sapiens
cagccccgcgcctccttc

SEQ ID NO: 2733026 - DNA, 14 bp, Homo sapiens
cagccctggaggct

SEQ ID NO: 2733027 - DNA, 16 bp, Homo sapiens
cagccgcagcctccct

SEQ ID NO: 2733028 - DNA, 23 bp, Homo sapiens
cagccgcctcccttatgcaggac

SEQ ID NO: 2733029 - DNA, 12 bp, Homo sapiens
cagccgctgccc

SEQ ID NO: 2733030 - DNA, 12 bp, Homo sapiens
cagcctcacaga

SEQ ID NO: 2733031 - DNA, 15 bp, Homo sapiens
cagcctcacagatgc

SEQ ID NO: 2733032 - DNA, 17 bp, Homo sapiens
cagcctcacagatgctg

SEQ ID NO: 2733033 - DNA, 20 bp, Homo sapiens
cagcctcacagatgctggcc

SEQ ID NO: 2733034 - DNA, 23 bp, Homo sapiens
cagcctcacagatgctggcctct

SEQ ID NO: 2733035 - DNA, 22 bp, Homo sapiens
cacgccactgcactccagcctg

SEQ ID NO: 2733036 - DNA, 16 bp, Homo sapiens
cacgcccgactagcag

SEQ ID NO: 2733037 - DNA, 21 bp, Homo sapiens
cacgcctatgatcccagcact

SEQ ID NO: 2733038 - DNA, 17 bp, Homo sapiens
cacgcctgggtgacccc

SEQ ID NO: 2733039 - DNA, 19 bp, Homo sapiens
cacggggaccactgggccc

SEQ ID NO: 2733040 - DNA, 22 bp, Homo sapiens
cacggggaccactgggcccctc

SEQ ID NO: 2733041 - DNA, 14 bp, Homo sapiens
cacggtcttctgca

SEQ ID NO: 2733042 - DNA, 17 bp, Homo sapiens
cacgtcaccctcctgag

SEQ ID NO: 2733043 - DNA, 18 bp, Homo sapiens
cacgtcaccctcctgagc

SEQ ID NO: 2733044 - DNA, 12 bp, Homo sapiens
cacgtcccatgt

SEQ ID NO: 2733045 - DNA, 15 bp, Homo sapiens
cacgtctctctgcct

SEQ ID NO: 2733046 - DNA, 18 bp, Homo sapiens
cacgtctctctgcctgct

SEQ ID NO: 2733047 - DNA, 21 bp, Homo sapiens
cacgtctctctgcctgctggg

SEQ ID NO: 2733048 - DNA, 16 bp, Homo sapiens
cacgtctgtgctctgt

SEQ ID NO: 2733049 - DNA, 16 bp, Homo sapiens
cacgtgaccagccccg

SEQ ID NO: 2733050 - DNA, 19 bp, Homo sapiens
cacgtgaccagccccgtgt

SEQ ID NO: 2733051 - DNA, 20 bp, Homo sapiens
cacgttttctggcttctgct

SEQ ID NO: 2733052 - DNA, 15 bp, Homo sapiens
cactaaaatgtttaa

SEQ ID NO: 2733053 - DNA, 17 bp, Homo sapiens
cactaaacagactattt

SEQ ID NO: 2733054 - DNA, 21 bp, Homo sapiens
cactacactccagcctgagca

SEQ ID NO: 2733055 - DNA, 17 bp, Homo sapiens
cactcacagggagctgg

SEQ ID NO: 2733056 - DNA, 18 bp, Homo sapiens
cactcacagggagctggc

SEQ ID NO: 2733057 - DNA, 14 bp, Homo sapiens
cactcagcagcccc

SEQ ID NO: 2733058 - DNA, 15 bp, Homo sapiens
cactcagcagccccc

SEQ ID NO: 2733059 - DNA, 23 bp, Homo sapiens
cactcaggatgtcctttgtgtcc

SEQ ID NO: 2733060 - DNA, 12 bp, Homo sapiens
cactccagcctg

SEQ ID NO: 2733061 - DNA, 14 bp, Homo sapiens
cactccagcctgag

SEQ ID NO: 2733062 - DNA, 21 bp, Homo sapiens
cactccagcctgagcaacaga

SEQ ID NO: 2733063 - DNA, 13 bp, Homo sapiens
cactccagcctgg

SEQ ID NO: 2733064 - DNA, 16 bp, Homo sapiens
cactccagcctgggcg

SEQ ID NO: 2733065 - DNA, 15 bp, Homo sapiens
cactcccacttccct

SEQ ID NO: 2733066 - DNA, 17 bp, Homo sapiens
cactccggtgtgcctgc

SEQ ID NO: 2733067 - DNA, 17 bp, Homo sapiens
cactcctcctgccagct

SEQ ID NO: 2733068 - DNA, 18 bp, Homo sapiens
cactcctcctgccagctc

SEQ ID NO: 2733069 - DNA, 19 bp, Homo sapiens
cactcctcctgccagctct

SEQ ID NO: 2733070 - DNA, 12 bp, Homo sapiens
cactccttcccc

SEQ ID NO: 2733071 - DNA, 17 bp, Homo sapiens
cactcgtgtgcccacca

SEQ ID NO: 2733072 - DNA, 18 bp, Homo sapiens
cactctagtgacttcctg

SEQ ID NO: 2733073 - DNA, 20 bp, Homo sapiens
cactctagtgacttcctggt

SEQ ID NO: 2733074 - DNA, 21 bp, Homo sapiens
cactctagtgacttcctggtg

SEQ ID NO: 2733075 - DNA, 12 bp, Homo sapiens
cactctgctgcc

SEQ ID NO: 2733076 - DNA, 13 bp, Homo sapiens
cactctgctgcct

SEQ ID NO: 2733077 - DNA, 20 bp, Homo sapiens
cactctgctgcctgtacaga

SEQ ID NO: 2733078 - DNA, 12 bp, Homo sapiens
cactctgtgccc

SEQ ID NO: 2733079 - DNA, 18 bp, Homo sapiens
cactcttcttgagcagac

SEQ ID NO: 2733080 - DNA, 16 bp, Homo sapiens
cactctttgctacaat

SEQ ID NO: 2733081 - DNA, 20 bp, Homo sapiens
cactctttgctacaataaat

SEQ ID NO: 2733082 - DNA, 13 bp, Homo sapiens
cactgaagctggg

SEQ ID NO: 2733083 - DNA, 16 bp, Homo sapiens
cactgaagtgattgaa

SEQ ID NO: 2733084 - DNA, 18 bp, Homo sapiens
cactgaagtgattgaaag

SEQ ID NO: 2733085 - DNA, 22 bp, Homo sapiens
cactgagactagattctcacct

SEQ ID NO: 2733086 - DNA, 13 bp, Homo sapiens
cactgcaccccct

SEQ ID NO: 2733087 - DNA, 14 bp, Homo sapiens
cactgcaccccctc

SEQ ID NO: 2733088 - DNA, 18 bp, Homo sapiens
cactgcaccccctcctgc

SEQ ID NO: 2733089 - DNA, 16 bp, Homo sapiens
cactgcactccagcct

SEQ ID NO: 2733090 - DNA, 18 bp, Homo sapiens
cactgcactccagcctgg

SEQ ID NO: 2733091 - DNA, 22 bp, Homo sapiens
cactgccaaaaatagaaagtga

SEQ ID NO: 2733092 - DNA, 18 bp, Homo sapiens
cactgccgcctccttctt

SEQ ID NO: 2733093 - DNA, 20 bp, Homo sapiens
cactgcggggcttggctgag

SEQ ID NO: 2733094 - DNA, 22 bp, Homo sapiens
cactgcggtgtctgcagctcct

SEQ ID NO: 2733095 - DNA, 18 bp, Homo sapiens
cactgctgggtggcccat

SEQ ID NO: 2733096 - DNA, 11 bp, Homo sapiens
cactggagccc

SEQ ID NO: 2733097 - DNA, 12 bp, Homo sapiens
cactggagccca

SEQ ID NO: 2733098 - DNA, 13 bp, Homo sapiens
cactggagcccag

SEQ ID NO: 2733099 - DNA, 23 bp, Homo sapiens
cactggctgcctccactcccact

SEQ ID NO: 2733100 - DNA, 15 bp, Homo sapiens
cactgggcccctcag

SEQ ID NO: 2733101 - DNA, 17 bp, Homo sapiens
cactgggcccctcaggg

SEQ ID NO: 2733102 - DNA, 12 bp, Homo sapiens
cactgggctctg

SEQ ID NO: 2733103 - DNA, 20 bp, Homo sapiens
cactgggctctgaggagtgg

SEQ ID NO: 2733104 - DNA, 13 bp, Homo sapiens
cactgggtgagag

SEQ ID NO: 2733105 - DNA, 15 bp, Homo sapiens
cactgtcctgctcca

SEQ ID NO: 2733106 - DNA, 20 bp, Homo sapiens
cactgtcctgctccacagtg

SEQ ID NO: 2733107 - DNA, 15 bp, Homo sapiens
cactgtgtatttaac

SEQ ID NO: 2733108 - DNA, 23 bp, Homo sapiens
cactgttcccagcaaagttttca

SEQ ID NO: 2733109 - DNA, 17 bp, Homo sapiens
cactgttgaatgcctgt

SEQ ID NO: 2733110 - DNA, 14 bp, Homo sapiens
cacttatcctgaca

SEQ ID NO: 2733111 - DNA, 14 bp, Homo sapiens
cacttatttccatg

SEQ ID NO: 2733112 - DNA, 16 bp, Homo sapiens
cacttcatagatgaga

SEQ ID NO: 2733113 - DNA, 12 bp, Homo sapiens
cacttcccctcc

SEQ ID NO: 2733114 - DNA, 13 bp, Homo sapiens
cacttcccctcct

SEQ ID NO: 2733115 - DNA, 15 bp, Homo sapiens
cacttcccctcctac

SEQ ID NO: 2733116 - DNA, 20 bp, Homo sapiens
cacttccctgacactgcggg

SEQ ID NO: 2733117 - DNA, 14 bp, Homo sapiens
cacttccctgcttt

SEQ ID NO: 2733118 - DNA, 21 bp, Homo sapiens
accgcatggcagctgggccca

SEQ ID NO: 2733119 - DNA, 16 bp, Homo sapiens
accgtattagccagga

SEQ ID NO: 2733120 - DNA, 20 bp, Homo sapiens
accgtgatttggaagagagg

SEQ ID NO: 2733121 - DNA, 23 bp, Homo sapiens
accgtgatttggaagagaggcac

SEQ ID NO: 2733122 - DNA, 12 bp, Homo sapiens
accgtgcagcca

SEQ ID NO: 2733123 - DNA, 19 bp, Homo sapiens
acctagtggctgtccagtg

SEQ ID NO: 2733124 - DNA, 22 bp, Homo sapiens
acctagtggctgtccagtgccc

SEQ ID NO: 2733125 - DNA, 16 bp, Homo sapiens
acctatagtcccagct

SEQ ID NO: 2733126 - DNA, 19 bp, Homo sapiens
acctatggcccagccactg

SEQ ID NO: 2733127 - DNA, 13 bp, Homo sapiens
acctcagcctaga

SEQ ID NO: 2733128 - DNA, 20 bp, Homo sapiens
acctccaatcccccagcgct

SEQ ID NO: 2733129 - DNA, 18 bp, Homo sapiens
acctccacccactgtccg

SEQ ID NO: 2733130 - DNA, 11 bp, Homo sapiens
acctccagtcc

SEQ ID NO: 2733131 - DNA, 14 bp, Homo sapiens
acctccagtcctgc

SEQ ID NO: 2733132 - DNA, 15 bp, Homo sapiens
acctccagtcctgct

SEQ ID NO: 2733133 - DNA, 21 bp, Homo sapiens
acctcctctgtgatttctttc

SEQ ID NO: 2733134 - DNA, 9 bp, Homo sapiens
acctcctgg

SEQ ID NO: 2733135 - DNA, 18 bp, Homo sapiens
acctctaatttattttgt

SEQ ID NO: 2733136 - DNA, 19 bp, Homo sapiens
acctctcttgtgagccata

SEQ ID NO: 2733137 - DNA, 17 bp, Homo sapiens
acctctgaatgtcccag

SEQ ID NO: 2733138 - DNA, 19 bp, Homo sapiens
acctctgaatgtcccagag

SEQ ID NO: 2733139 - DNA, 15 bp, Homo sapiens
acctgaactctgcaa

SEQ ID NO: 2733140 - DNA, 14 bp, Homo sapiens
acctgattgtattt

SEQ ID NO: 2733141 - DNA, 13 bp, Homo sapiens
acctgcaggttgg

SEQ ID NO: 2733142 - DNA, 17 bp, Homo sapiens
acctgcatatctctagt

SEQ ID NO: 2733143 - DNA, 23 bp, Homo sapiens
acctgcatatctctagtccctgt

SEQ ID NO: 2733144 - DNA, 15 bp, Homo sapiens
acctgccagcctggc

SEQ ID NO: 2733145 - DNA, 18 bp, Homo sapiens
acctgccagcctggcttc

SEQ ID NO: 2733146 - DNA, 21 bp, Homo sapiens
acctgccagcctggcttctgg

SEQ ID NO: 2733147 - DNA, 15 bp, Homo sapiens
acctgccatttgcac

SEQ ID NO: 2733148 - DNA, 16 bp, Homo sapiens
acctgccccgcccagc

SEQ ID NO: 2733149 - DNA, 23 bp, Homo sapiens
acctgccccgcccagctgcacct

SEQ ID NO: 2733150 - DNA, 14 bp, Homo sapiens
acctgcccctcccc

SEQ ID NO: 2733151 - DNA, 12 bp, Homo sapiens
acctgcctagct

SEQ ID NO: 2733152 - DNA, 17 bp, Homo sapiens
acctgcctagctcttgg

SEQ ID NO: 2733153 - DNA, 17 bp, Homo sapiens
acctgcctgttctccag

SEQ ID NO: 2733154 - DNA, 23 bp, Homo sapiens
acctgccttgggcctcatctgct

SEQ ID NO: 2733155 - DNA, 19 bp, Homo sapiens
acctgcgaacttgtgttta

SEQ ID NO: 2733156 - DNA, 17 bp, Homo sapiens
acctggactagggcctc

SEQ ID NO: 2733157 - DNA, 14 bp, Homo sapiens
acctggagctgcca

SEQ ID NO: 2733158 - DNA, 15 bp, Homo sapiens
acctggagctgccag

SEQ ID NO: 2733159 - DNA, 15 bp, Homo sapiens
acctgtccataaagt

SEQ ID NO: 2733160 - DNA, 23 bp, Homo sapiens
acctgtccttactcagagctgcg

SEQ ID NO: 2733161 - DNA, 14 bp, Homo sapiens
accttacaaccaca

SEQ ID NO: 2733162 - DNA, 20 bp, Homo sapiens
accttacaaccacatttctg

SEQ ID NO: 2733163 - DNA, 21 bp, Homo sapiens
accttacaaccacatttctgg

SEQ ID NO: 2733164 - DNA, 22 bp, Homo sapiens
accttattgagcgtgattctgt

SEQ ID NO: 2733165 - DNA, 23 bp, Homo sapiens
accttctaatccatgtgctgctg

SEQ ID NO: 2733166 - DNA, 12 bp, Homo sapiens
accttctccagg

SEQ ID NO: 2733167 - DNA, 13 bp, Homo sapiens
accttgcatttca

SEQ ID NO: 2733168 - DNA, 16 bp, Homo sapiens
accttgtctttcaaaa

SEQ ID NO: 2733169 - DNA, 13 bp, Homo sapiens
acctttatgaggt

SEQ ID NO: 2733170 - DNA, 16 bp, Homo sapiens
acctttcagctgtgaa

SEQ ID NO: 2733171 - DNA, 23 bp, Homo sapiens
acctttcctgccgtccctcctgt

SEQ ID NO: 2733172 - DNA, 15 bp, Homo sapiens
acctttgcccacaca

SEQ ID NO: 2733173 - DNA, 18 bp, Homo sapiens
acctttgggatcagcctc

SEQ ID NO: 2733174 - DNA, 19 bp, Homo sapiens
acctttgggatcagcctcc

SEQ ID NO: 2733175 - DNA, 21 bp, Homo sapiens
acctttgggatcagcctccgc

SEQ ID NO: 2733176 - DNA, 17 bp, Homo sapiens
acctttgtccaggcctg

SEQ ID NO: 2733177 - DNA, 17 bp, Homo sapiens
acctttttttctctcct

SEQ ID NO: 2733178 - DNA, 14 bp, Homo sapiens
acgaacgttttaaa

SEQ ID NO: 2733179 - DNA, 22 bp, Homo sapiens
acgacaaagccaaactctgcca

SEQ ID NO: 2733180 - DNA, 15 bp, Homo sapiens
acgcatgcctcagcc

SEQ ID NO: 2733181 - DNA, 19 bp, Homo sapiens
acgcatgcctcagccagcc

SEQ ID NO: 2733182 - DNA, 22 bp, Homo sapiens
acgcatgcctcagccagccctg

SEQ ID NO: 2733183 - DNA, 23 bp, Homo sapiens
acgccactgcactccagcctggg

SEQ ID NO: 2733184 - DNA, 18 bp, Homo sapiens
acgcctatgatcccagca

SEQ ID NO: 2733185 - DNA, 18 bp, Homo sapiens
acgctctaccctgcagct

SEQ ID NO: 2733186 - DNA, 12 bp, Homo sapiens
acgctctggaca

SEQ ID NO: 2733187 - DNA, 19 bp, Homo sapiens
acggactcagactcctggc

SEQ ID NO: 2733188 - DNA, 22 bp, Homo sapiens
acggagccatgtcatgtgccac

SEQ ID NO: 2733189 - DNA, 17 bp, Homo sapiens
acggggaccactgggcc

SEQ ID NO: 2733190 - DNA, 23 bp, Homo sapiens
acggggaccactgggcccctcag

SEQ ID NO: 2733191 - DNA, 15 bp, Homo sapiens
acggggccggccagg

SEQ ID NO: 2733192 - DNA, 14 bp, Homo sapiens
acggggtccttcaa

SEQ ID NO: 2733193 - DNA, 18 bp, Homo sapiens
acgggttgaaagacatca

SEQ ID NO: 2733194 - DNA, 21 bp, Homo sapiens
acgggttgaaagacatcaatg

SEQ ID NO: 2733195 - DNA, 19 bp, Homo sapiens
acggtcctttaggcagcct

SEQ ID NO: 2733196 - DNA, 20 bp, Homo sapiens
acggtcctttaggcagcctg

SEQ ID NO: 2733197 - DNA, 21 bp, Homo sapiens
acggtcctttaggcagcctgc

SEQ ID NO: 2733198 - DNA, 13 bp, Homo sapiens
acggtcttctgca

SEQ ID NO: 2733199 - DNA, 23 bp, Homo sapiens
acggtgacagtgacgtgactcag

SEQ ID NO: 2733200 - DNA, 18 bp, Homo sapiens
acgtcaccctcctgagcc

SEQ ID NO: 2733201 - DNA, 15 bp, Homo sapiens
acgtcctggaatgaa

SEQ ID NO: 2733202 - DNA, 21 bp, Homo sapiens
acgtcctgtcagtgccgccgc

SEQ ID NO: 2733203 - DNA, 18 bp, Homo sapiens
acgtctctctgcctgctg

SEQ ID NO: 2733204 - DNA, 20 bp, Homo sapiens
acgtctctctgcctgctggg

SEQ ID NO: 2733205 - DNA, 15 bp, Homo sapiens
acgtctgtgctctgt

SEQ ID NO: 2733206 - DNA, 15 bp, Homo sapiens
acgtgaccagccccg

SEQ ID NO: 2733207 - DNA, 16 bp, Homo sapiens
acgtgactcagagctt

SEQ ID NO: 2733208 - DNA, 20 bp, Homo sapiens
acgtgcacagcttcctgagt

SEQ ID NO: 2733209 - DNA, 12 bp, Homo sapiens
acgtgcccagcc

SEQ ID NO: 2733210 - DNA, 14 bp, Homo sapiens
acgttcggggcatg

SEQ ID NO: 2733211 - DNA, 22 bp, Homo sapiens
actaaaatgtttaattcattaa

SEQ ID NO: 2733212 - DNA, 16 bp, Homo sapiens
actaaattagtttaaa

SEQ ID NO: 2733213 - DNA, 17 bp, Homo sapiens
actaacgaacgttttaa

SEQ ID NO: 2733214 - DNA, 17 bp, Homo sapiens
actaagctttctccttt

SEQ ID NO: 2733215 - DNA, 12 bp, Homo sapiens
actaaggagaat

SEQ ID NO: 2733216 - DNA, 16 bp, Homo sapiens
actaaggatttttcaa

SEQ ID NO: 2733217 - DNA, 22 bp, Homo sapiens
actaaggtacggtgagactctg

SEQ ID NO: 2733218 - DNA, 22 bp, Homo sapiens
actaattggctacatgttgcaa

SEQ ID NO: 2733219 - DNA, 17 bp, Homo sapiens
actacactccagcctga

SEQ ID NO: 2733220 - DNA, 19 bp, Homo sapiens
actaccagtgggcatgtat

SEQ ID NO: 2733221 - DNA, 22 bp, Homo sapiens
actagacattattttgtatgga

SEQ ID NO: 2733222 - DNA, 21 bp, Homo sapiens
actagccatgataactgcaat

SEQ ID NO: 2733223 - DNA, 22 bp, Homo sapiens
actagggcctcggaggctcctc

SEQ ID NO: 2733224 - DNA, 24 bp, Homo sapiens
actagggcctcggaggctcctccc

SEQ ID NO: 2733225 - DNA, 14 bp, Homo sapiens
actatgcgttttta

SEQ ID NO: 2733226 - DNA, 18 bp, Homo sapiens
actatttaacttgagggt

SEQ ID NO: 2733227 - DNA, 22 bp, Homo sapiens
actatttaagtactatctttgt

SEQ ID NO: 2733228 - DNA, 19 bp, Homo sapiens
actcaagcaggtttcttgc

SEQ ID NO: 2733229 - DNA, 16 bp, Homo sapiens
actcagactcctggct

SEQ ID NO: 2733230 - DNA, 13 bp, Homo sapiens
actcagagctgcg

SEQ ID NO: 2733231 - DNA, 15 bp, Homo sapiens
actcagagctgcggg

SEQ ID NO: 2733232 - DNA, 11 bp, Homo sapiens
actcagagctt

SEQ ID NO: 2733233 - DNA, 12 bp, Homo sapiens
actcagatgagt

SEQ ID NO: 2733234 - DNA, 16 bp, Homo sapiens
actcagtgaaatcata

SEQ ID NO: 2733235 - DNA, 20 bp, Homo sapiens
actcagtgaaatcatattaa

SEQ ID NO: 2733236 - DNA, 21 bp, Homo sapiens
actccagaattacccttcctc

SEQ ID NO: 2733237 - DNA, 17 bp, Homo sapiens
actccagcacgttttct

SEQ ID NO: 2733238 - DNA, 13 bp, Homo sapiens
actccagcctgag

SEQ ID NO: 2733239 - DNA, 14 bp, Homo sapiens
actccagcctgagc

SEQ ID NO: 2733240 - DNA, 14 bp, Homo sapiens
actccagcctgggc

SEQ ID NO: 2733241 - DNA, 15 bp, Homo sapiens
actccagcctgggcg

SEQ ID NO: 2733242 - DNA, 18 bp, Homo sapiens
actccatatttatttaaa

SEQ ID NO: 2733243 - DNA, 14 bp, Homo sapiens
actccattatttta

SEQ ID NO: 2733244 - DNA, 16 bp, Homo sapiens
actcccacacccaaga

SEQ ID NO: 2733245 - DNA, 20 bp, Homo sapiens
attttcttttgttttcttca

SEQ ID NO: 2733246 - DNA, 19 bp, Homo sapiens
attttgaaaacccctggct

SEQ ID NO: 2733247 - DNA, 15 bp, Homo sapiens
attttgatcagtgtt

SEQ ID NO: 2733248 - DNA, 19 bp, Homo sapiens
attttgctggagactattt

SEQ ID NO: 2733249 - DNA, 19 bp, Homo sapiens
attttggaaaaatgtcact

SEQ ID NO: 2733250 - DNA, 14 bp, Homo sapiens
attttgtaaaaaga

SEQ ID NO: 2733251 - DNA, 18 bp, Homo sapiens
attttgtaaaaagaaatt

SEQ ID NO: 2733252 - DNA, 21 bp, Homo sapiens
attttgtaattattgtgattt

SEQ ID NO: 2733253 - DNA, 21 bp, Homo sapiens
attttgtacaaagatatgcta

SEQ ID NO: 2733254 - DNA, 17 bp, Homo sapiens
attttgtcacagctctt

SEQ ID NO: 2733255 - DNA, 20 bp, Homo sapiens
attttgtcacagctcttgtt

SEQ ID NO: 2733256 - DNA, 19 bp, Homo sapiens
attttgtgaaagaaggagc

SEQ ID NO: 2733257 - DNA, 13 bp, Homo sapiens
atttttaaaagcc

SEQ ID NO: 2733258 - DNA, 13 bp, Homo sapiens
atttttaaagaaa

SEQ ID NO: 2733259 - DNA, 20 bp, Homo sapiens
atttttaaaggaaaaatcat

SEQ ID NO: 2733260 - DNA, 20 bp, Homo sapiens
atttttaaaggacaaacagt

SEQ ID NO: 2733261 - DNA, 16 bp, Homo sapiens
atttttataaatatgt

SEQ ID NO: 2733262 - DNA, 17 bp, Homo sapiens
atttttgaatgtgattt

SEQ ID NO: 2733263 - DNA, 13 bp, Homo sapiens
atttttgtaccat

SEQ ID NO: 2733264 - DNA, 23 bp, Homo sapiens
atttttgtaccatattgctctta

SEQ ID NO: 2733265 - DNA, 17 bp, Homo sapiens
atttttgttagcaaaga

SEQ ID NO: 2733266 - DNA, 13 bp, Homo sapiens
attttttaaacca

SEQ ID NO: 2733267 - DNA, 18 bp, Homo sapiens
attttttaaataaaatag

SEQ ID NO: 2733268 - DNA, 19 bp, Homo sapiens
attttttgatgtcagcctt

SEQ ID NO: 2733269 - DNA, 16 bp, Homo sapiens
caaaaaaaatctttaa

SEQ ID NO: 2733270 - DNA, 14 bp, Homo sapiens
caaaaagatttatt

SEQ ID NO: 2733271 - DNA, 20 bp, Homo sapiens
caaaaatctcccagtgacaa

SEQ ID NO: 2733272 - DNA, 21 bp, Homo sapiens
caaaacatttctggacagtac

SEQ ID NO: 2733273 - DNA, 19 bp, Homo sapiens
caaaagcaggcttgtgctt

SEQ ID NO: 2733274 - DNA, 18 bp, Homo sapiens
caaaagctagaggagatt

SEQ ID NO: 2733275 - DNA, 23 bp, Homo sapiens
caaaagctgtgtctctgtatata

SEQ ID NO: 2733276 - DNA, 11 bp, Homo sapiens
caaaagtctga

SEQ ID NO: 2733277 - DNA, 15 bp, Homo sapiens
caaaagtctgaggca

SEQ ID NO: 2733278 - DNA, 21 bp, Homo sapiens
caaacactgggctctgaggag

SEQ ID NO: 2733279 - DNA, 22 bp, Homo sapiens
caaacagggacactacaaacat

SEQ ID NO: 2733280 - DNA, 14 bp, Homo sapiens
caagctccctggtg

SEQ ID NO: 2733281 - DNA, 15 bp, Homo sapiens
caagctccctggtga

SEQ ID NO: 2733282 - DNA, 15 bp, Homo sapiens
caagctgtgccaccc

SEQ ID NO: 2733283 - DNA, 19 bp, Homo sapiens
caagctgtgccaccctggg

SEQ ID NO: 2733284 - DNA, 21 bp, Homo sapiens
caagctgtgccaccctgggct

SEQ ID NO: 2733285 - DNA, 23 bp, Homo sapiens
caagcttatttagcacattttga

SEQ ID NO: 2733286 - DNA, 13 bp, Homo sapiens
caaggaaaagatg

SEQ ID NO: 2733287 - DNA, 17 bp, Homo sapiens
caaggacaacctgcccc

SEQ ID NO: 2733288 - DNA, 18 bp, Homo sapiens
caaggacaacctgcccct

SEQ ID NO: 2733289 - DNA, 23 bp, Homo sapiens
caaggacaacctgcccctcccca

SEQ ID NO: 2733290 - DNA, 21 bp, Homo sapiens
caaggaggctggctggggcct

SEQ ID NO: 2733291 - DNA, 19 bp, Homo sapiens
caaggcacctgcaggttgg

SEQ ID NO: 2733292 - DNA, 14 bp, Homo sapiens
caaggcagttctgt

SEQ ID NO: 2733293 - DNA, 16 bp, Homo sapiens
caaggcctccagccac

SEQ ID NO: 2733294 - DNA, 16 bp, Homo sapiens
caaggcctcccacagt

SEQ ID NO: 2733295 - DNA, 22 bp, Homo sapiens
caagggtaactcttggccagag

SEQ ID NO: 2733296 - DNA, 13 bp, Homo sapiens
caagggtgctgtg

SEQ ID NO: 2733297 - DNA, 21 bp, Homo sapiens
caaggtaatttttttttgtaa

SEQ ID NO: 2733298 - DNA, 16 bp, Homo sapiens
caaggtcggtaagttg

SEQ ID NO: 2733299 - DNA, 20 bp, Homo sapiens
caaggtctcacactcctcct

SEQ ID NO: 2733300 - DNA, 22 bp, Homo sapiens
caaggtgcacagacctcagaga

SEQ ID NO: 2733301 - DNA, 16 bp, Homo sapiens
caaggtgggctgagcc

SEQ ID NO: 2733302 - DNA, 20 bp, Homo sapiens
caaggtggtctgctcgggcc

SEQ ID NO: 2733303 - DNA, 23 bp, Homo sapiens
caaggtggtctgctcgggcccag

SEQ ID NO: 2733304 - DNA, 23 bp, Homo sapiens
caaggtttcccagtgagcctctg

SEQ ID NO: 2733305 - DNA, 20 bp, Homo sapiens
caagtacatggctagctttt

SEQ ID NO: 2733306 - DNA, 13 bp, Homo sapiens
caagtagctgaga

SEQ ID NO: 2733307 - DNA, 17 bp, Homo sapiens
caagtagtagtgtcttc

SEQ ID NO: 2733308 - DNA, 13 bp, Homo sapiens
caagtccaacctg

SEQ ID NO: 2733309 - DNA, 18 bp, Homo sapiens
caagtccaacctgcctgt

SEQ ID NO: 2733310 - DNA, 20 bp, Homo sapiens
caagtccctgactctctgtg

SEQ ID NO: 2733311 - DNA, 23 bp, Homo sapiens
caagtccctgactctctgtgacc

SEQ ID NO: 2733312 - DNA, 13 bp, Homo sapiens
caagtctgtgaaa

SEQ ID NO: 2733313 - DNA, 20 bp, Homo sapiens
caagtgccagtcttgtgtct

SEQ ID NO: 2733314 - DNA, 12 bp, Homo sapiens
caagtttaaagt

SEQ ID NO: 2733315 - DNA, 14 bp, Homo sapiens
caataaagagctca

SEQ ID NO: 2733316 - DNA, 18 bp, Homo sapiens
caataactctgattttga

SEQ ID NO: 2733317 - DNA, 21 bp, Homo sapiens
caataactctgattttgatat

SEQ ID NO: 2733318 - DNA, 17 bp, Homo sapiens
caatatggggcattaat

SEQ ID NO: 2733319 - DNA, 17 bp, Homo sapiens
caatatttactcatcag

SEQ ID NO: 2733320 - DNA, 23 bp, Homo sapiens
caatcacaaaagctgtgtctctg

SEQ ID NO: 2733321 - DNA, 14 bp, Homo sapiens
tgctgcaccaaccc

SEQ ID NO: 2733322 - DNA, 18 bp, Homo sapiens
tgctgcaccaacccagcc

SEQ ID NO: 2733323 - DNA, 12 bp, Homo sapiens
tgctgcagcttt

SEQ ID NO: 2733324 - DNA, 18 bp, Homo sapiens
tgctgccactctgctgcc

SEQ ID NO: 2733325 - DNA, 21 bp, Homo sapiens
tgctgccactctgctgcctgt

SEQ ID NO: 2733326 - DNA, 13 bp, Homo sapiens
tgctgcctctctt

SEQ ID NO: 2733327 - DNA, 20 bp, Homo sapiens
tgctgcgtcagaccagtact

SEQ ID NO: 2733328 - DNA, 14 bp, Homo sapiens
tgctgctaccctcc

SEQ ID NO: 2733329 - DNA, 15 bp, Homo sapiens
tgctgctaccctccc

SEQ ID NO: 2733330 - DNA, 21 bp, Homo sapiens
tgctgctaccctccctgctgt

SEQ ID NO: 2733331 - DNA, 16 bp, Homo sapiens
tgctggaaaccacact

SEQ ID NO: 2733332 - DNA, 18 bp, Homo sapiens
tgctggaagaactgcatg

SEQ ID NO: 2733333 - DNA, 19 bp, Homo sapiens
tgctggaagaactgcatgg

SEQ ID NO: 2733334 - DNA, 20 bp, Homo sapiens
tgctggacggcattcctgct

SEQ ID NO: 2733335 - DNA, 19 bp, Homo sapiens
tgctggagactatttaagt

SEQ ID NO: 2733336 - DNA, 15 bp, Homo sapiens
tgctggcccacagct

SEQ ID NO: 2733337 - DNA, 17 bp, Homo sapiens
tgctggcccacagctct

SEQ ID NO: 2733338 - DNA, 20 bp, Homo sapiens
tgctggcccacagctctgct

SEQ ID NO: 2733339 - DNA, 12 bp, Homo sapiens
tgctggcctctt

SEQ ID NO: 2733340 - DNA, 21 bp, Homo sapiens
tgctggcctcttggcacctgc

SEQ ID NO: 2733341 - DNA, 13 bp, Homo sapiens
tgctggcctgctc

SEQ ID NO: 2733342 - DNA, 18 bp, Homo sapiens
tgctggctgctggcccac

SEQ ID NO: 2733343 - DNA, 20 bp, Homo sapiens
tgctggctgctggcccacag

SEQ ID NO: 2733344 - DNA, 17 bp, Homo sapiens
tgctgggactggccagg

SEQ ID NO: 2733345 - DNA, 22 bp, Homo sapiens
tgctgggctcttaactgttgct

SEQ ID NO: 2733346 - DNA, 13 bp, Homo sapiens
tgctgggctgggg

SEQ ID NO: 2733347 - DNA, 23 bp, Homo sapiens
tgctggggcaagtccctgactct

SEQ ID NO: 2733348 - DNA, 13 bp, Homo sapiens
tgctgggtggccc

SEQ ID NO: 2733349 - DNA, 14 bp, Homo sapiens
tgctgggtggccca

SEQ ID NO: 2733350 - DNA, 20 bp, Homo sapiens
tgctgggtggcccatccccc

SEQ ID NO: 2733351 - DNA, 22 bp, Homo sapiens
tgctgggtggcccatcccccct

SEQ ID NO: 2733352 - DNA, 21 bp, Homo sapiens
tgctgtaactcagacattcca

SEQ ID NO: 2733353 - DNA, 16 bp, Homo sapiens
tgctgtacattactgt

SEQ ID NO: 2733354 - DNA, 22 bp, Homo sapiens
tgctgtatacaaacaggtgcta

SEQ ID NO: 2733355 - DNA, 22 bp, Homo sapiens
tgctgtcaggagatggaagagt

SEQ ID NO: 2733356 - DNA, 10 bp, Homo sapiens
tgctgtcccc

SEQ ID NO: 2733357 - DNA, 15 bp, Homo sapiens
tgctgtcccctcttg

SEQ ID NO: 2733358 - DNA, 20 bp, Homo sapiens
tgctgtcccctcttgcccca

SEQ ID NO: 2733359 - DNA, 14 bp, Homo sapiens
tgctgtcctaggcc

SEQ ID NO: 2733360 - DNA, 17 bp, Homo sapiens
tgctgtgcaaacagtgt

SEQ ID NO: 2733361 - DNA, 18 bp, Homo sapiens
tgctgtgcaaacagtgta

SEQ ID NO: 2733362 - DNA, 16 bp, Homo sapiens
tgctgtgctgtacatt

SEQ ID NO: 2733363 - DNA, 15 bp, Homo sapiens
tgctgtggcctgggc

SEQ ID NO: 2733364 - DNA, 18 bp, Homo sapiens
tgctgttgctgttgctgt

SEQ ID NO: 2733365 - DNA, 18 bp, Homo sapiens
tgcttactaatgtgcccc

SEQ ID NO: 2733366 - DNA, 16 bp, Homo sapiens
tgcttatgtgttgcat

SEQ ID NO: 2733367 - DNA, 22 bp, Homo sapiens
tgcttatgtgttgcataaacaa

SEQ ID NO: 2733368 - DNA, 15 bp, Homo sapiens
tgcttcagcctgagg

SEQ ID NO: 2733369 - DNA, 22 bp, Homo sapiens
tgcttcagcctgaggctgagac

SEQ ID NO: 2733370 - DNA, 16 bp, Homo sapiens
tgcttctggctttgtt

SEQ ID NO: 2733371 - DNA, 17 bp, Homo sapiens
tgcttggcttcccctcc

SEQ ID NO: 2733372 - DNA, 16 bp, Homo sapiens
tgctttccaacacaca

SEQ ID NO: 2733373 - DNA, 22 bp, Homo sapiens
tgctttcctaaagtctctgctg

SEQ ID NO: 2733374 - DNA, 22 bp, Homo sapiens
tgctttcttctttccagacccc

SEQ ID NO: 2733375 - DNA, 16 bp, Homo sapiens
tggaaaaatgtcactg

SEQ ID NO: 2733376 - DNA, 14 bp, Homo sapiens
tggaaaagaaatca

SEQ ID NO: 2733377 - DNA, 16 bp, Homo sapiens
tggaaaagggctcaga

SEQ ID NO: 2733378 - DNA, 20 bp, Homo sapiens
tggaaagaggttctgcactc

SEQ ID NO: 2733379 - DNA, 20 bp, Homo sapiens
tggaaagcatcacctcaggc

SEQ ID NO: 2733380 - DNA, 18 bp, Homo sapiens
tggaaagcctctgctgcc

SEQ ID NO: 2733381 - DNA, 20 bp, Homo sapiens
tggaaaggctcagtctcagg

SEQ ID NO: 2733382 - DNA, 20 bp, Homo sapiens
tggaaatgtcctccaacaat

SEQ ID NO: 2733383 - DNA, 18 bp, Homo sapiens
tggaactccccagggcct

SEQ ID NO: 2733384 - DNA, 16 bp, Homo sapiens
tggaactctaccctgg

SEQ ID NO: 2733385 - DNA, 12 bp, Homo sapiens
tggaagagaggc

SEQ ID NO: 2733386 - DNA, 14 bp, Homo sapiens
tggaagagaggcac

SEQ ID NO: 2733387 - DNA, 21 bp, Homo sapiens
tggaagagaggcacctgctgg

SEQ ID NO: 2733388 - DNA, 23 bp, Homo sapiens
tggaagagaggcacctgctggaa

SEQ ID NO: 2733389 - DNA, 16 bp, Homo sapiens
tggaatgaagcatgta

SEQ ID NO: 2733390 - DNA, 22 bp, Homo sapiens
tggaattggagaaaagcacaat

SEQ ID NO: 2733391 - DNA, 14 bp, Homo sapiens
tggaatttgtaagt

SEQ ID NO: 2733392 - DNA, 13 bp, Homo sapiens
tggacaacccaga

SEQ ID NO: 2733393 - DNA, 19 bp, Homo sapiens
tggacagtacctgattgta

SEQ ID NO: 2733394 - DNA, 17 bp, Homo sapiens
tggacagtcctgggaga

SEQ ID NO: 2733395 - DNA, 15 bp, Homo sapiens
tggacatcgatatga

SEQ ID NO: 2733396 - DNA, 16 bp, Homo sapiens
tggacatcgatatgaa

SEQ ID NO: 2733397 - DNA, 18 bp, Homo sapiens
tggacctctcttgtgagc

SEQ ID NO: 2733398 - DNA, 22 bp, Homo sapiens
tggacgcccagctgaggctggg

SEQ ID NO: 2733399 - DNA, 14 bp, Homo sapiens
tggacgtgtgagga

SEQ ID NO: 2733400 - DNA, 17 bp, Homo sapiens
tggactagggcctcgga

SEQ ID NO: 2733401 - DNA, 18 bp, Homo sapiens
tggactctctgcctgctt

SEQ ID NO: 2733402 - DNA, 14 bp, Homo sapiens
tggagactctgtgg

SEQ ID NO: 2733403 - DNA, 12 bp, Homo sapiens
tggagagcagct

SEQ ID NO: 2733404 - DNA, 16 bp, Homo sapiens
tggagagcagctggct

SEQ ID NO: 2733405 - DNA, 15 bp, Homo sapiens
tggagcccttgggtt

SEQ ID NO: 2733406 - DNA, 18 bp, Homo sapiens
tggagccgggaaagctgt

SEQ ID NO: 2733407 - DNA, 21 bp, Homo sapiens
tggagcgcacctgccccctgg

SEQ ID NO: 2733408 - DNA, 22 bp, Homo sapiens
tggagcgcacctgccccctggt

SEQ ID NO: 2733409 - DNA, 12 bp, Homo sapiens
tggagcggctca

SEQ ID NO: 2733410 - DNA, 22 bp, Homo sapiens
tggagcggctcatcagaactga

SEQ ID NO: 2733411 - DNA, 18 bp, Homo sapiens
tggagtctcgctctgctg

SEQ ID NO: 2733412 - DNA, 16 bp, Homo sapiens
tggagtgaaattattt

SEQ ID NO: 2733413 - DNA, 21 bp, Homo sapiens
tggataagatgatgttaaatg

SEQ ID NO: 2733414 - DNA, 15 bp, Homo sapiens
tggatccacgtgctc

SEQ ID NO: 2733415 - DNA, 18 bp, Homo sapiens
tggatgagcaactcctgt

SEQ ID NO: 2733416 - DNA, 14 bp, Homo sapiens
tggatggtgacttt

SEQ ID NO: 2733417 - DNA, 16 bp, Homo sapiens
tggatgttcagaattt

SEQ ID NO: 2733418 - DNA, 17 bp, Homo sapiens
tggattatccactgcaa

SEQ ID NO: 2733419 - DNA, 14 bp, Homo sapiens
tggattcccctgga

SEQ ID NO: 2733420 - DNA, 12 bp, Homo sapiens
tggattcctgtc

SEQ ID NO: 2733421 - DNA, 14 bp, Homo sapiens
tggatttttacaaa

SEQ ID NO: 2733422 - DNA, 22 bp, Homo sapiens
tggcaaacatgtgcaactcttg

SEQ ID NO: 2733423 - DNA, 21 bp, Homo sapiens
tggcaatgccctacctgcctg

SEQ ID NO: 2733424 - DNA, 22 bp, Homo sapiens
tggcacaacgctctaccctgca

SEQ ID NO: 2733425 - DNA, 12 bp, Homo sapiens
tggcacaagctc

SEQ ID NO: 2733426 - DNA, 21 bp, Homo sapiens
tggcacaagctccctggtgag

SEQ ID NO: 2733427 - DNA, 16 bp, Homo sapiens
tggcacagtgtctggg

SEQ ID NO: 2733428 - DNA, 18 bp, Homo sapiens
tggcacagtgtctgggct

SEQ ID NO: 2733429 - DNA, 19 bp, Homo sapiens
tggcacagtgtctgggctg

SEQ ID NO: 2733430 - DNA, 14 bp, Homo sapiens
tggcacctgcctag

SEQ ID NO: 2733431 - DNA, 13 bp, Homo sapiens
tggcactaaaatg

SEQ ID NO: 2733432 - DNA, 19 bp, Homo sapiens
tggcactaaaatgtttaat

SEQ ID NO: 2733433 - DNA, 24 bp, Homo sapiens
tggcagaactgctggggctggtga

SEQ ID NO: 2733434 - DNA, 11 bp, Homo sapiens
tggcagccctg

SEQ ID NO: 2733435 - DNA, 13 bp, Homo sapiens
tggcagcctccag

SEQ ID NO: 2733436 - DNA, 19 bp, Homo sapiens
tggcagctgggcccacagc

SEQ ID NO: 2733437 - DNA, 14 bp, Homo sapiens
tggcagtgtttgta

SEQ ID NO: 2733438 - DNA, 12 bp, Homo sapiens
tggcatcctggc

SEQ ID NO: 2733439 - DNA, 16 bp, Homo sapiens
tggcatcctggctggc

SEQ ID NO: 2733440 - DNA, 18 bp, Homo sapiens
tggcatcctggctggctg

SEQ ID NO: 2733441 - DNA, 19 bp, Homo sapiens
tggcatgtgggttgtgata

SEQ ID NO: 2733442 - DNA, 23 bp, Homo sapiens
tggcatgtgggttgtgatattga

SEQ ID NO: 2733443 - DNA, 20 bp, Homo sapiens
tggcattctctctgctcagt

SEQ ID NO: 2733444 - DNA, 17 bp, Homo sapiens
tggccaccacccaacct

SEQ ID NO: 2733445 - DNA, 14 bp, Homo sapiens
ttaggcctggcaca

SEQ ID NO: 2733446 - DNA, 13 bp, Homo sapiens
ttagtcattatta

SEQ ID NO: 2733447 - DNA, 23 bp, Homo sapiens
ttagtgaattacactcaaggaaa

SEQ ID NO: 2733448 - DNA, 18 bp, Homo sapiens
ttagtttaaaatgaagca

SEQ ID NO: 2733449 - DNA, 14 bp, Homo sapiens
ttatacataaacag

SEQ ID NO: 2733450 - DNA, 15 bp, Homo sapiens
ttatacataaacagt

SEQ ID NO: 2733451 - DNA, 18 bp, Homo sapiens
ttataggcagatctttaa

SEQ ID NO: 2733452 - DNA, 13 bp, Homo sapiens
ttatataaagaaa

SEQ ID NO: 2733453 - DNA, 15 bp, Homo sapiens
ttatataaagaaaat

SEQ ID NO: 2733454 - DNA, 12 bp, Homo sapiens
ttatatatcata

SEQ ID NO: 2733455 - DNA, 17 bp, Homo sapiens
ttatatatcataaagta

SEQ ID NO: 2733456 - DNA, 18 bp, Homo sapiens
ttatcaaaaagtataaat

SEQ ID NO: 2733457 - DNA, 20 bp, Homo sapiens
ttatctacccagtcatgtac

SEQ ID NO: 2733458 - DNA, 14 bp, Homo sapiens
ttatgagaacatgg

SEQ ID NO: 2733459 - DNA, 19 bp, Homo sapiens
ttatgataaaatgctttaa

SEQ ID NO: 2733460 - DNA, 16 bp, Homo sapiens
ttatgctaactgtaga

SEQ ID NO: 2733461 - DNA, 14 bp, Homo sapiens
ttattattttgcaa

SEQ ID NO: 2733462 - DNA, 22 bp, Homo sapiens
ttattcaggaaaagcctctgtg

SEQ ID NO: 2733463 - DNA, 13 bp, Homo sapiens
ttatttaagcaat

SEQ ID NO: 2733464 - DNA, 15 bp, Homo sapiens
ttatttctaaaacat

SEQ ID NO: 2733465 - DNA, 22 bp, Homo sapiens
ttatttctaaaacattaattga

SEQ ID NO: 2733466 - DNA, 17 bp, Homo sapiens
ttatttgactttttcac

SEQ ID NO: 2733467 - DNA, 13 bp, Homo sapiens
ttatttgtataat

SEQ ID NO: 2733468 - DNA, 23 bp, Homo sapiens
ttattttgccatggatgagagtc

SEQ ID NO: 2733469 - DNA, 14 bp, Homo sapiens
ttattttgtaatta

SEQ ID NO: 2733470 - DNA, 15 bp, Homo sapiens
ttattttgtaattat

SEQ ID NO: 2733471 - DNA, 21 bp, Homo sapiens
ttattttgtaattattgtgat

SEQ ID NO: 2733472 - DNA, 16 bp, Homo sapiens
ttatttttgtaccata

SEQ ID NO: 2733473 - DNA, 20 bp, Homo sapiens
ttatttttttaagctgtaaa

SEQ ID NO: 2733474 - DNA, 22 bp, Homo sapiens
ttcaaagaaaaccctaagtgtg

SEQ ID NO: 2733475 - DNA, 14 bp, Homo sapiens
ttcaacagtttctc

SEQ ID NO: 2733476 - DNA, 14 bp, Homo sapiens
ttcaagatccaaat

SEQ ID NO: 2733477 - DNA, 21 bp, Homo sapiens
ttcaaggactaacgaacgttt

SEQ ID NO: 2733478 - DNA, 21 bp, Homo sapiens
ttcaagtattaggggtaatat

SEQ ID NO: 2733479 - DNA, 17 bp, Homo sapiens
ttcaagttagctcagga

SEQ ID NO: 2733480 - DNA, 21 bp, Homo sapiens
ttcaatttactttttaaacag

SEQ ID NO: 2733481 - DNA, 23 bp, Homo sapiens
ttcaatttactttttaaacagtg

SEQ ID NO: 2733482 - DNA, 19 bp, Homo sapiens
ttcacacctcacgctctgg

SEQ ID NO: 2733483 - DNA, 23 bp, Homo sapiens
ttcacacctcacgctctggacat

SEQ ID NO: 2733484 - DNA, 10 bp, Homo sapiens
ttcacactcc

SEQ ID NO: 2733485 - DNA, 20 bp, Homo sapiens
ttcacacttgttcaacagtt

SEQ ID NO: 2733486 - DNA, 14 bp, Homo sapiens
ttcacagcgcctcc

SEQ ID NO: 2733487 - DNA, 17 bp, Homo sapiens
ttcacagcgcctcctgg

SEQ ID NO: 2733488 - DNA, 17 bp, Homo sapiens
ttcaccatgcaggcaac

SEQ ID NO: 2733489 - DNA, 19 bp, Homo sapiens
ttcaccgtattagccagga

SEQ ID NO: 2733490 - DNA, 14 bp, Homo sapiens
ttcactaccaaatg

SEQ ID NO: 2733491 - DNA, 22 bp, Homo sapiens
ttcactccggtgtgcctgcagc

SEQ ID NO: 2733492 - DNA, 13 bp, Homo sapiens
ttcactctaattg

SEQ ID NO: 2733493 - DNA, 12 bp, Homo sapiens
ttcactgcagcc

SEQ ID NO: 2733494 - DNA, 21 bp, Homo sapiens
ttcactgttgaatgcctgtcc

SEQ ID NO: 2733495 - DNA, 22 bp, Homo sapiens
ttcagaattgaaggagaaaatg

SEQ ID NO: 2733496 - DNA, 19 bp, Homo sapiens
ttcagaattttggaaaaat

SEQ ID NO: 2733497 - DNA, 21 bp, Homo sapiens
ttcagaattttggaaaaatgt

SEQ ID NO: 2733498 - DNA, 15 bp, Homo sapiens
ttcagataaggcaga

SEQ ID NO: 2733499 - DNA, 14 bp, Homo sapiens
ttcagattgtaaag

SEQ ID NO: 2733500 - DNA, 10 bp, Homo sapiens
ttcagcacca

SEQ ID NO: 2733501 - DNA, 16 bp, Homo sapiens
ttcagcatcaaacatg

SEQ ID NO: 2733502 - DNA, 23 bp, Homo sapiens
ttcagctggtggatggtgacttt

SEQ ID NO: 2733503 - DNA, 16 bp, Homo sapiens
ttcagcttctgctggg

SEQ ID NO: 2733504 - DNA, 18 bp, Homo sapiens
ttcagcttctgctgggct

SEQ ID NO: 2733505 - DNA, 14 bp, Homo sapiens
ttcagcttctgttg

SEQ ID NO: 2733506 - DNA, 18 bp, Homo sapiens
ttcaggaaaagcctctgt

SEQ ID NO: 2733507 - DNA, 18 bp, Homo sapiens
ttcagggaatttcaggaa

SEQ ID NO: 2733508 - DNA, 12 bp, Homo sapiens
ttcagtctgaat

SEQ ID NO: 2733509 - DNA, 16 bp, Homo sapiens
ttcagttattttgctt

SEQ ID NO: 2733510 - DNA, 13 bp, Homo sapiens
ttcatacattata

SEQ ID NO: 2733511 - DNA, 16 bp, Homo sapiens
ttcatacattatattc

SEQ ID NO: 2733512 - DNA, 14 bp, Homo sapiens
ttcatataatttaa

SEQ ID NO: 2733513 - DNA, 13 bp, Homo sapiens
ttcatgagcccaa

SEQ ID NO: 2733514 - DNA, 21 bp, Homo sapiens
ttcatgcattctagtgcagaa

SEQ ID NO: 2733515 - DNA, 22 bp, Homo sapiens
ttcatgcattctagtgcagaag

SEQ ID NO: 2733516 - DNA, 16 bp, Homo sapiens
ttcatgctttctcctt

SEQ ID NO: 2733517 - DNA, 22 bp, Homo sapiens
ttcatgtggcattctctctgct

SEQ ID NO: 2733518 - DNA, 17 bp, Homo sapiens
ttcattaatctgtttgt

SEQ ID NO: 2733519 - DNA, 19 bp, Homo sapiens
ttcattcaaaatgtccagc

SEQ ID NO: 2733520 - DNA, 14 bp, Homo sapiens
ttcattggttaaaa

SEQ ID NO: 2733521 - DNA, 14 bp, Homo sapiens
ttcattgtgtatga

SEQ ID NO: 2733522 - DNA, 20 bp, Homo sapiens
ttcatttgagttattttaat

SEQ ID NO: 2733523 - DNA, 13 bp, Homo sapiens
ttccaaccccagc

SEQ ID NO: 2733524 - DNA, 16 bp, Homo sapiens
ttccaaccccagctgg

SEQ ID NO: 2733525 - DNA, 21 bp, Homo sapiens
ttccaaccccagctggcctct

SEQ ID NO: 2733526 - DNA, 23 bp, Homo sapiens
ttccaagggtatgggaagccata

SEQ ID NO: 2733527 - DNA, 19 bp, Homo sapiens
ttccaagtcaacactcttc

SEQ ID NO: 2733528 - DNA, 23 bp, Homo sapiens
ttccaataaagcagagtttgaca

SEQ ID NO: 2733529 - DNA, 16 bp, Homo sapiens
ttccacatataaagct

SEQ ID NO: 2733530 - DNA, 15 bp, Homo sapiens
ttccaccagagcagg

SEQ ID NO: 2733531 - DNA, 11 bp, Homo sapiens
ttccaccctgg

SEQ ID NO: 2733532 - DNA, 18 bp, Homo sapiens
ttccactgccaaaacaat

SEQ ID NO: 2733533 - DNA, 12 bp, Homo sapiens
ttccactggact

SEQ ID NO: 2733534 - DNA, 21 bp, Homo sapiens
ttccagaaaaccccagcatcc

SEQ ID NO: 2733535 - DNA, 22 bp, Homo sapiens
ttccagaaatgtttttggcaac

SEQ ID NO: 2733536 - DNA, 11 bp, Homo sapiens
ttccagaattg

SEQ ID NO: 2733537 - DNA, 14 bp, Homo sapiens
ttccagattgttct

SEQ ID NO: 2733538 - DNA, 21 bp, Homo sapiens
ttccagctaagcctgatgatg

SEQ ID NO: 2733539 - DNA, 15 bp, Homo sapiens
ttccaggtggggtga

SEQ ID NO: 2733540 - DNA, 15 bp, Homo sapiens
ttccagtgtattttc

SEQ ID NO: 2733541 - DNA, 18 bp, Homo sapiens
ttccatttctactgtata

SEQ ID NO: 2733542 - DNA, 11 bp, Homo sapiens
ttcccactgca

SEQ ID NO: 2733543 - DNA, 18 bp, Homo sapiens
ttcccactgcaccccctc

SEQ ID NO: 2733544 - DNA, 20 bp, Homo sapiens
ttcccactgcaccccctcct

SEQ ID NO: 2733545 - DNA, 22 bp, Homo sapiens
ttcccagaaatacaacagaagt

SEQ ID NO: 2733546 - DNA, 17 bp, Homo sapiens
ttcccagtgagcctctg

SEQ ID NO: 2733547 - DNA, 19 bp, Homo sapiens
ttcccagtgagcctctgcg

SEQ ID NO: 2733548 - DNA, 15 bp, Homo sapiens
ttccccctcccaggg

SEQ ID NO: 2733549 - DNA, 23 bp, Homo sapiens
ttccccgagggatgatgccacac

SEQ ID NO: 2733550 - DNA, 16 bp, Homo sapiens
ttcccctcctacccct

SEQ ID NO: 2733551 - DNA, 20 bp, Homo sapiens
ttcccctcctacccctccca

SEQ ID NO: 2733552 - DNA, 21 bp, Homo sapiens
ttcccgagcaaagtctaaagt

SEQ ID NO: 2733553 - DNA, 17 bp, Homo sapiens
ttcccgtggccccagcc

SEQ ID NO: 2733554 - DNA, 20 bp, Homo sapiens
ttccctgcttttctcccaga

SEQ ID NO: 2733555 - DNA, 21 bp, Homo sapiens
ttccctgcttttctcccagaa

SEQ ID NO: 2733556 - DNA, 13 bp, Homo sapiens
ttccctgggcctc

SEQ ID NO: 2733557 - DNA, 14 bp, Homo sapiens
ttccctgggcctca

SEQ ID NO: 2733558 - DNA, 12 bp, Homo sapiens
ttccctggggcc

SEQ ID NO: 2733559 - DNA, 22 bp, Homo sapiens
ttcccttctgatcttggaaaga

SEQ ID NO: 2733560 - DNA, 19 bp, Homo sapiens
ttcctaaagtctctgctgc

SEQ ID NO: 2733561 - DNA, 21 bp, Homo sapiens
ttcctacacccttggacttga

SEQ ID NO: 2733562 - DNA, 17 bp, Homo sapiens
ttcctagctgtaaatat

SEQ ID NO: 2733563 - DNA, 21 bp, Homo sapiens
ttcctagctgtaaatataaat

SEQ ID NO: 2733564 - DNA, 13 bp, Homo sapiens
ttcctcatctgtg

SEQ ID NO: 2733565 - DNA, 19 bp, Homo sapiens
ttcctcccattttagaaaa

SEQ ID NO: 2733566 - DNA, 15 bp, Homo sapiens
ttcctcgcctctccc

SEQ ID NO: 2733567 - DNA, 13 bp, Homo sapiens
ttcctctgagccg

SEQ ID NO: 2733568 - DNA, 21 bp, Homo sapiens
ttcctgacccggattggccct

SEQ ID NO: 2733569 - DNA, 15 bp, Homo sapiens
ttcctgcaaagggaa

SEQ ID NO: 2733570 - DNA, 19 bp, Homo sapiens
ttcctgccgtccctcctgt

SEQ ID NO: 2733571 - DNA, 12 bp, Homo sapiens
ttcctgctgcct

SEQ ID NO: 2733572 - DNA, 11 bp, Homo sapiens
ttcctggaccg

SEQ ID NO: 2733573 - DNA, 19 bp, Homo sapiens
ttcctggtgaggcccagcc

SEQ ID NO: 2733574 - DNA, 23 bp, Homo sapiens
ttccttcaccacctcatgtcatt

SEQ ID NO: 2733575 - DNA, 20 bp, Homo sapiens
ttccttttgcaacaagacaa

SEQ ID NO: 2733576 - DNA, 16 bp, Homo sapiens
ttcgatgtacagtctc

SEQ ID NO: 2733577 - DNA, 23 bp, Homo sapiens
ttcgatgtacagtctcaattttg

SEQ ID NO: 2733578 - DNA, 11 bp, Homo sapiens
ttcgctgggga

SEQ ID NO: 2733579 - DNA, 16 bp, Homo sapiens
ttcgcttgttttaaaa

SEQ ID NO: 2733580 - DNA, 18 bp, Homo sapiens
ttcgcttgttttaaaagg

SEQ ID NO: 2733581 - DNA, 20 bp, Homo sapiens
ttctaaacagatgtccctga

SEQ ID NO: 2733582 - DNA, 12 bp, Homo sapiens
ttctaaattcac

SEQ ID NO: 2733583 - DNA, 13 bp, Homo sapiens
ttctaaattcact

SEQ ID NO: 2733584 - DNA, 22 bp, Homo sapiens
ttctaaccaaagagtctctggc

SEQ ID NO: 2733585 - DNA, 14 bp, Homo sapiens
ttctaactcttaga

SEQ ID NO: 2733586 - DNA, 19 bp, Homo sapiens
ttctaataaatcaatgtga

SEQ ID NO: 2733587 - DNA, 21 bp, Homo sapiens
ttctacctttttttctctcct

SEQ ID NO: 2733588 - DNA, 16 bp, Homo sapiens
ttctacttgatatttc

SEQ ID NO: 2733589 - DNA, 22 bp, Homo sapiens
ttctagttgattgcgagaattt

SEQ ID NO: 2733590 - DNA, 20 bp, Homo sapiens
ttctatcttgaatttcatgc

SEQ ID NO: 2733591 - DNA, 22 bp, Homo sapiens
ttctatgtatgtgccaattttg

SEQ ID NO: 2733592 - DNA, 21 bp, Homo sapiens
ttctattttgctggagactat

SEQ ID NO: 2733593 - DNA, 13 bp, Homo sapiens
ttctcaaagaaat

SEQ ID NO: 2733594 - DNA, 20 bp, Homo sapiens
ttctcaaagaaatttccact

SEQ ID NO: 2733595 - DNA, 18 bp, Homo sapiens
ttctcacctgccttcaaa

SEQ ID NO: 2733596 - DNA, 21 bp, Homo sapiens
ttctcccccccggggctgggt

SEQ ID NO: 2733597 - DNA, 18 bp, Homo sapiens
ttctccccctgggctctg

SEQ ID NO: 2733598 - DNA, 16 bp, Homo sapiens
ttctcccctccaagtg

SEQ ID NO: 2733599 - DNA, 21 bp, Homo sapiens
ttctctatgaaaagcaactga

SEQ ID NO: 2733600 - DNA, 22 bp, Homo sapiens
ttctctcccacgtgcacagctt

SEQ ID NO: 2733601 - DNA, 14 bp, Homo sapiens
ttctctctgctcag

SEQ ID NO: 2733602 - DNA, 23 bp, Homo sapiens
ttctcttgccccaaatcacaaac

SEQ ID NO: 2733603 - DNA, 14 bp, Homo sapiens
ttctgccacttccc

SEQ ID NO: 2733604 - DNA, 19 bp, Homo sapiens
ttctgcccacattggaccc

SEQ ID NO: 2733605 - DNA, 12 bp, Homo sapiens
ttctgcctcagc

SEQ ID NO: 2733606 - DNA, 16 bp, Homo sapiens
ttctgcctgagattct

SEQ ID NO: 2733607 - DNA, 17 bp, Homo sapiens
ttctgcctgagattctt

SEQ ID NO: 2733608 - DNA, 10 bp, Homo sapiens
ttctggagcc

SEQ ID NO: 2733609 - DNA, 16 bp, Homo sapiens
ttctggctttgttctt

SEQ ID NO: 2733610 - DNA, 13 bp, Homo sapiens
ttctgggaagaaa

SEQ ID NO: 2733611 - DNA, 13 bp, Homo sapiens
ttctgggtgattt

SEQ ID NO: 2733612 - DNA, 13 bp, Homo sapiens
ttctgtaaatgaa

SEQ ID NO: 2733613 - DNA, 15 bp, Homo sapiens
ttctgtatgtgacaa

SEQ ID NO: 2733614 - DNA, 16 bp, Homo sapiens
ttctgtccagtttcca

SEQ ID NO: 2733615 - DNA, 14 bp, Homo sapiens
ttctgtgtgcacag

SEQ ID NO: 2733616 - DNA, 13 bp, Homo sapiens
ttcttacagactg

SEQ ID NO: 2733617 - DNA, 22 bp, Homo sapiens
ttcttccttaattcactcccac

SEQ ID NO: 2733618 - DNA, 15 bp, Homo sapiens
ttcttgcaccctcat

SEQ ID NO: 2733619 - DNA, 14 bp, Homo sapiens
ttcttgcttctggc

SEQ ID NO: 2733620 - DNA, 22 bp, Homo sapiens
ttcttgtcatcagtaagtataa

SEQ ID NO: 2733621 - DNA, 12 bp, Homo sapiens
ttctttcttggt

SEQ ID NO: 2733622 - DNA, 14 bp, Homo sapiens
ttctttcttggtgc

SEQ ID NO: 2733623 - DNA, 14 bp, Homo sapiens
ttctttgcaccaaa

SEQ ID NO: 2733624 - DNA, 21 bp, Homo sapiens
ttctttgcaccaaagacatca

SEQ ID NO: 2733625 - DNA, 17 bp, Homo sapiens
ttcttttccagaaagaa

SEQ ID NO: 2733626 - DNA, 20 bp, Homo sapiens
ttcttttgttttcttcattt

SEQ ID NO: 2733627 - DNA, 12 bp, Homo sapiens
ttgaaaaaagaa

SEQ ID NO: 2733628 - DNA, 18 bp, Homo sapiens
ttgaaagaattctatttt

SEQ ID NO: 2733629 - DNA, 21 bp, Homo sapiens
ttgaaagaattctattttgct

SEQ ID NO: 2733630 - DNA, 12 bp, Homo sapiens
ttgaaagacatc

SEQ ID NO: 2733631 - DNA, 15 bp, Homo sapiens
ttgaaagacatcaat

SEQ ID NO: 2733632 - DNA, 19 bp, Homo sapiens
ttgaaagacatcaatgaaa

SEQ ID NO: 2733633 - DNA, 18 bp, Homo sapiens
ttgaaagtgaataaactt

SEQ ID NO: 2733634 - DNA, 22 bp, Homo sapiens
ttgaaagtgaataaacttcagc

SEQ ID NO: 2733635 - DNA, 10 bp, Homo sapiens
ttgaagaggc

SEQ ID NO: 2733636 - DNA, 18 bp, Homo sapiens
ttgaaggagaaaatgcat

SEQ ID NO: 2733637 - DNA, 18 bp, Homo sapiens
ttgaagtggccagatgag

SEQ ID NO: 2733638 - DNA, 22 bp, Homo sapiens
ttgaatagaggccaaattaatc

SEQ ID NO: 2733639 - DNA, 18 bp, Homo sapiens
ttgaatggcctgccttga

SEQ ID NO: 2733640 - DNA, 16 bp, Homo sapiens
ttgaatgtgatcatct

SEQ ID NO: 2733641 - DNA, 18 bp, Homo sapiens
ttgaatgtgatcatcttt

SEQ ID NO: 2733642 - DNA, 23 bp, Homo sapiens
ttgaatgtgatcatctttgctga

SEQ ID NO: 2733643 - DNA, 18 bp, Homo sapiens
ttgaatttttaagcaaat

SEQ ID NO: 2733644 - DNA, 16 bp, Homo sapiens
ttgacaacacatgtgg

SEQ ID NO: 2733645 - DNA, 14 bp, Homo sapiens
ttgacccctcctga

SEQ ID NO: 2733646 - DNA, 21 bp, Homo sapiens
ttgacgaagaaacaaaaaaca

SEQ ID NO: 2733647 - DNA, 16 bp, Homo sapiens
ttgagattatatttcc

SEQ ID NO: 2733648 - DNA, 16 bp, Homo sapiens
ttgaggattttgagta

SEQ ID NO: 2733649 - DNA, 17 bp, Homo sapiens
ttgaggattttgagtat

SEQ ID NO: 2733650 - DNA, 21 bp, Homo sapiens
ttgaggcaaaggccagcagca

SEQ ID NO: 2733651 - DNA, 14 bp, Homo sapiens
ttgaggctgcagcg

SEQ ID NO: 2733652 - DNA, 18 bp, Homo sapiens
ttgagggtaataaactta

SEQ ID NO: 2733653 - DNA, 18 bp, Homo sapiens
ttgaggtcttttacatac

SEQ ID NO: 2733654 - DNA, 15 bp, Homo sapiens
ttgagtttgctgtat

SEQ ID NO: 2733655 - DNA, 23 bp, Homo sapiens
ttgagtttgctgtatacaaacag

SEQ ID NO: 2733656 - DNA, 19 bp, Homo sapiens
ttgataaattccactggac

SEQ ID NO: 2733657 - DNA, 21 bp, Homo sapiens
ttgatcattcataattttatc

SEQ ID NO: 2733658 - DNA, 17 bp, Homo sapiens
ttgatgtcagccttgca

SEQ ID NO: 2733659 - DNA, 13 bp, Homo sapiens
ttgattaaacagc

SEQ ID NO: 2733660 - DNA, 20 bp, Homo sapiens
ttgattattctgattccact

SEQ ID NO: 2733661 - DNA, 17 bp, Homo sapiens
ttgatttcgatgtacag

SEQ ID NO: 2733662 - DNA, 14 bp, Homo sapiens
ttgatttctagtat

SEQ ID NO: 2733663 - DNA, 20 bp, Homo sapiens
ttgcacagagggcgctcctg

SEQ ID NO: 2733664 - DNA, 18 bp, Homo sapiens
ttgcaccattctttcttg

SEQ ID NO: 2733665 - DNA, 23 bp, Homo sapiens
ttgcaccattctttcttggtgca

SEQ ID NO: 2733666 - DNA, 19 bp, Homo sapiens
ttgcacgtattttaatagc

SEQ ID NO: 2733667 - DNA, 18 bp, Homo sapiens
ttgcaggggactgggcca

SEQ ID NO: 2733668 - DNA, 17 bp, Homo sapiens
ttgcagtgaactgagac

SEQ ID NO: 2733669 - DNA, 17 bp, Homo sapiens
ttgcataaacaatccaa

SEQ ID NO: 2733670 - DNA, 12 bp, Homo sapiens
ttgccaggctag

SEQ ID NO: 2733671 - DNA, 15 bp, Homo sapiens
ttgccccaaatcaca

SEQ ID NO: 2733672 - DNA, 14 bp, Homo sapiens
ttgccccaaccccc

SEQ ID NO: 2733673 - DNA, 21 bp, Homo sapiens
ttgccccaacccccagcaccc

SEQ ID NO: 2733674 - DNA, 19 bp, Homo sapiens
ttgcccggattctgggagg

SEQ ID NO: 2733675 - DNA, 12 bp, Homo sapiens
ttgcccttcctg

SEQ ID NO: 2733676 - DNA, 16 bp, Homo sapiens
ttgcccttcctgaccc

SEQ ID NO: 2733677 - DNA, 14 bp, Homo sapiens
ttgccgagagaggc

SEQ ID NO: 2733678 - DNA, 14 bp, Homo sapiens
ttgcctcggctcct

SEQ ID NO: 2733679 - DNA, 23 bp, Homo sapiens
tggccaccacccaacctgtcctt

SEQ ID NO: 2733680 - DNA, 17 bp, Homo sapiens
tggccagccccacagcc

SEQ ID NO: 2733681 - DNA, 18 bp, Homo sapiens
tggccagccccacagccc

SEQ ID NO: 2733682 - DNA, 19 bp, Homo sapiens
tggccagccccacagccca

SEQ ID NO: 2733683 - DNA, 20 bp, Homo sapiens
tggccaggctggtctcgaac

SEQ ID NO: 2733684 - DNA, 12 bp, Homo sapiens
tggccagggcct

SEQ ID NO: 2733685 - DNA, 15 bp, Homo sapiens
tggccagtcctagag

SEQ ID NO: 2733686 - DNA, 22 bp, Homo sapiens
tggccagtcctagagctcctgt

SEQ ID NO: 2733687 - DNA, 12 bp, Homo sapiens
tggcccacagct

SEQ ID NO: 2733688 - DNA, 15 bp, Homo sapiens
tggcccacagctctg

SEQ ID NO: 2733689 - DNA, 14 bp, Homo sapiens
tggcccagccactg

SEQ ID NO: 2733690 - DNA, 16 bp, Homo sapiens
tggcccagccactgca

SEQ ID NO: 2733691 - DNA, 19 bp, Homo sapiens
tggcccagccactgcagca

SEQ ID NO: 2733692 - DNA, 22 bp, Homo sapiens
tggcccagctcccccgggaggg

SEQ ID NO: 2733693 - DNA, 23 bp, Homo sapiens
tggcccatcagtgtacccccgcc

SEQ ID NO: 2733694 - DNA, 15 bp, Homo sapiens
tggcccatcccccct

SEQ ID NO: 2733695 - DNA, 17 bp, Homo sapiens
tggcccatcccccctca

SEQ ID NO: 2733696 - DNA, 20 bp, Homo sapiens
tggcccatcccccctcacca

SEQ ID NO: 2733697 - DNA, 21 bp, Homo sapiens
tggcccatcccccctcaccag

SEQ ID NO: 2733698 - DNA, 13 bp, Homo sapiens
tggccccagcctg

SEQ ID NO: 2733699 - DNA, 18 bp, Homo sapiens
tggccccagcctggccca

SEQ ID NO: 2733700 - DNA, 22 bp, Homo sapiens
tggccccagcctggcccagctc

SEQ ID NO: 2733701 - DNA, 12 bp, Homo sapiens
tggccctgcccc

SEQ ID NO: 2733702 - DNA, 15 bp, Homo sapiens
tggccctgcccctcc

SEQ ID NO: 2733703 - DNA, 19 bp, Homo sapiens
tggccctgtgactatggct

SEQ ID NO: 2733704 - DNA, 22 bp, Homo sapiens
tggcctaaagaatcccaccccc

SEQ ID NO: 2733705 - DNA, 14 bp, Homo sapiens
tggcctcgcctggc

SEQ ID NO: 2733706 - DNA, 17 bp, Homo sapiens
tggcctcgcctggcctg

SEQ ID NO: 2733707 - DNA, 23 bp, Homo sapiens
tggcctctagaacacccactggc

SEQ ID NO: 2733708 - DNA, 24 bp, Homo sapiens
tggcctctagaacacccactggcc

SEQ ID NO: 2733709 - DNA, 17 bp, Homo sapiens
tggcctcttggcacctg

SEQ ID NO: 2733710 - DNA, 22 bp, Homo sapiens
tggcgaaaccccgtctctacta

SEQ ID NO: 2733711 - DNA, 16 bp, Homo sapiens
tggctccagaatgtgc

SEQ ID NO: 2733712 - DNA, 11 bp, Homo sapiens
tggctccaggc

SEQ ID NO: 2733713 - DNA, 22 bp, Homo sapiens
tggctctgccagcgtccccggc

SEQ ID NO: 2733714 - DNA, 21 bp, Homo sapiens
tggctgaacagtgctctgcct

SEQ ID NO: 2733715 - DNA, 21 bp, Homo sapiens
tggctgcacgtcaccctcctg

SEQ ID NO: 2733716 - DNA, 22 bp, Homo sapiens
tggctgcacgtcaccctcctga

SEQ ID NO: 2733717 - DNA, 14 bp, Homo sapiens
tggctgcctccact

SEQ ID NO: 2733718 - DNA, 21 bp, Homo sapiens
tggctgctggcccacagctct

SEQ ID NO: 2733719 - DNA, 14 bp, Homo sapiens
tggctggctgcagt

SEQ ID NO: 2733720 - DNA, 11 bp, Homo sapiens
tggctggggga

SEQ ID NO: 2733721 - DNA, 15 bp, Homo sapiens
tggctgggggaggga

SEQ ID NO: 2733722 - DNA, 22 bp, Homo sapiens
tggctgggggagggactgctga

SEQ ID NO: 2733723 - DNA, 23 bp, Homo sapiens
tggctgtccagtgcccattcctc

SEQ ID NO: 2733724 - DNA, 20 bp, Homo sapiens
tggcttacttacaaaagcag

SEQ ID NO: 2733725 - DNA, 16 bp, Homo sapiens
tggcttatttgtataa

SEQ ID NO: 2733726 - DNA, 15 bp, Homo sapiens
tggcttcccctccac

SEQ ID NO: 2733727 - DNA, 14 bp, Homo sapiens
tggcttctggagcc

SEQ ID NO: 2733728 - DNA, 16 bp, Homo sapiens
tggctttgttcttgtc

SEQ ID NO: 2733729 - DNA, 17 bp, Homo sapiens
tggctttgttcttgtca

SEQ ID NO: 2733730 - DNA, 15 bp, Homo sapiens
tggctttttaacatg

SEQ ID NO: 2733731 - DNA, 22 bp, Homo sapiens
tgggaccccagctagggctgga

SEQ ID NO: 2733732 - DNA, 14 bp, Homo sapiens
tgggagaacctcag

SEQ ID NO: 2733733 - DNA, 15 bp, Homo sapiens
tgggagaacctcagg

SEQ ID NO: 2733734 - DNA, 14 bp, Homo sapiens
tgggagagcccagc

SEQ ID NO: 2733735 - DNA, 18 bp, Homo sapiens
tgggagagcccagccatt

SEQ ID NO: 2733736 - DNA, 14 bp, Homo sapiens
tgggagatgaaaac

SEQ ID NO: 2733737 - DNA, 15 bp, Homo sapiens
tgggaggacagagcc

SEQ ID NO: 2733738 - DNA, 15 bp, Homo sapiens
tgggaggctgaggcg

SEQ ID NO: 2733739 - DNA, 20 bp, Homo sapiens
tgggatataagaggcagcgt

SEQ ID NO: 2733740 - DNA, 16 bp, Homo sapiens
tgggcagaatcctggg

SEQ ID NO: 2733741 - DNA, 18 bp, Homo sapiens
tgggcagaatcctgggcc

SEQ ID NO: 2733742 - DNA, 21 bp, Homo sapiens
tgggcaggagtcaccatgcaa

SEQ ID NO: 2733743 - DNA, 22 bp, Homo sapiens
tgggcaggagtcaccatgcaag

SEQ ID NO: 2733744 - DNA, 15 bp, Homo sapiens
tgggcatttggtgag

SEQ ID NO: 2733745 - DNA, 20 bp, Homo sapiens
tgggccaggttggaaaagaa

SEQ ID NO: 2733746 - DNA, 19 bp, Homo sapiens
tgggccatgggtcctcggc

SEQ ID NO: 2733747 - DNA, 17 bp, Homo sapiens
tgggcccaacaggccct

SEQ ID NO: 2733748 - DNA, 23 bp, Homo sapiens
tgggcccacagcccccaccccag

SEQ ID NO: 2733749 - DNA, 13 bp, Homo sapiens
tgggcccctcagg

SEQ ID NO: 2733750 - DNA, 16 bp, Homo sapiens
tgggcccctcagggga

SEQ ID NO: 2733751 - DNA, 23 bp, Homo sapiens
tgggcccctcaggggaagctgct

SEQ ID NO: 2733752 - DNA, 17 bp, Homo sapiens
tgggcctcagcctccag

SEQ ID NO: 2733753 - DNA, 18 bp, Homo sapiens
tgggcctcagcctccagg

SEQ ID NO: 2733754 - DNA, 23 bp, Homo sapiens
tgggcctgacctccagtcctgct

SEQ ID NO: 2733755 - DNA, 21 bp, Homo sapiens
tgggctaacatttaggagaag

SEQ ID NO: 2733756 - DNA, 19 bp, Homo sapiens
tgggctacaaaccaggagc

SEQ ID NO: 2733757 - DNA, 19 bp, Homo sapiens
tgggctcacattcccaagg

SEQ ID NO: 2733758 - DNA, 16 bp, Homo sapiens
tgggctcagatcctgg

SEQ ID NO: 2733759 - DNA, 18 bp, Homo sapiens
tgggctcagatcctgggc

SEQ ID NO: 2733760 - DNA, 13 bp, Homo sapiens
tgggctctgagga

SEQ ID NO: 2733761 - DNA, 17 bp, Homo sapiens
tgggctctgccccagct

SEQ ID NO: 2733762 - DNA, 20 bp, Homo sapiens
tgggctctgccccagctctg

SEQ ID NO: 2733763 - DNA, 19 bp, Homo sapiens
tgggctcttaactgttgct

SEQ ID NO: 2733764 - DNA, 15 bp, Homo sapiens
tgggctgagccctgg

SEQ ID NO: 2733765 - DNA, 18 bp, Homo sapiens
tgggctggggcctgatgg

SEQ ID NO: 2733766 - DNA, 17 bp, Homo sapiens
tggggaagggggctcca

SEQ ID NO: 2733767 - DNA, 20 bp, Homo sapiens
tggggaccccctcaggattg

SEQ ID NO: 2733768 - DNA, 17 bp, Homo sapiens
tggggataaaggagaag

SEQ ID NO: 2733769 - DNA, 19 bp, Homo sapiens
tggggcaagtccctgactc

SEQ ID NO: 2733770 - DNA, 18 bp, Homo sapiens
tggggctcgccccaccca

SEQ ID NO: 2733771 - DNA, 16 bp, Homo sapiens
tggggctggtgaggcc

SEQ ID NO: 2733772 - DNA, 14 bp, Homo sapiens
tggggcttgccagg

SEQ ID NO: 2733773 - DNA, 14 bp, Homo sapiens
tgggggcttccctg

SEQ ID NO: 2733774 - DNA, 20 bp, Homo sapiens
tgggggggagaaggcctccc

SEQ ID NO: 2733775 - DNA, 21 bp, Homo sapiens
tgggggggagaaggcctcccc

SEQ ID NO: 2733776 - DNA, 22 bp, Homo sapiens
tgggggggagaaggcctcccct

SEQ ID NO: 2733777 - DNA, 13 bp, Homo sapiens
tgggtccagggga

SEQ ID NO: 2733778 - DNA, 17 bp, Homo sapiens
tgggtcccacttcccct

SEQ ID NO: 2733779 - DNA, 20 bp, Homo sapiens
tgggtcccacttcccctcct

SEQ ID NO: 2733780 - DNA, 21 bp, Homo sapiens
tgggtctctggattcctgtca

SEQ ID NO: 2733781 - DNA, 13 bp, Homo sapiens
tgggtgacggtcc

SEQ ID NO: 2733782 - DNA, 16 bp, Homo sapiens
tgggtgatttctagaa

SEQ ID NO: 2733783 - DNA, 13 bp, Homo sapiens
tgggttcctcttc

SEQ ID NO: 2733784 - DNA, 15 bp, Homo sapiens
tgggttggcgcaccc

SEQ ID NO: 2733785 - DNA, 16 bp, Homo sapiens
tgggttgtcactgaga

SEQ ID NO: 2733786 - DNA, 16 bp, Homo sapiens
tgggtttacaacaaac

SEQ ID NO: 2733787 - DNA, 18 bp, Homo sapiens
tgggtttacaacaaacac

SEQ ID NO: 2733788 - DNA, 23 bp, Homo sapiens
tggtaaaaagattatatatcata

SEQ ID NO: 2733789 - DNA, 23 bp, Homo sapiens
tggtacagttcataattcaccaa

SEQ ID NO: 2733790 - DNA, 15 bp, Homo sapiens
tggtactaaggagaa

SEQ ID NO: 2733791 - DNA, 18 bp, Homo sapiens
tggtactgcacattttgt

SEQ ID NO: 2733792 - DNA, 16 bp, Homo sapiens
tggtaggaaagcaccg

SEQ ID NO: 2733793 - DNA, 16 bp, Homo sapiens
tggtcccagacagctg

SEQ ID NO: 2733794 - DNA, 11 bp, Homo sapiens
tggtcctgggg

SEQ ID NO: 2733795 - DNA, 18 bp, Homo sapiens
tggtctcgaactcctgac

SEQ ID NO: 2733796 - DNA, 17 bp, Homo sapiens
tggtctgctcgggccca

SEQ ID NO: 2733797 - DNA, 21 bp, Homo sapiens
tggtctgctcgggcccaggcc

SEQ ID NO: 2733798 - DNA, 20 bp, Homo sapiens
tggtcttactttgtgcaaaa

SEQ ID NO: 2733799 - DNA, 22 bp, Homo sapiens
tggtgaccccttttcagcttct

SEQ ID NO: 2733800 - DNA, 14 bp, Homo sapiens
tggtgacttttgaa

SEQ ID NO: 2733801 - DNA, 17 bp, Homo sapiens
tggtgagagtcaaagct

SEQ ID NO: 2733802 - DNA, 18 bp, Homo sapiens
tggtgagagtcaaagctg

SEQ ID NO: 2733803 - DNA, 19 bp, Homo sapiens
tggtgagagtcaaagctga

SEQ ID NO: 2733804 - DNA, 17 bp, Homo sapiens
tggtgaggcccagcctg

SEQ ID NO: 2733805 - DNA, 17 bp, Homo sapiens
tggtgaggccggccctg

SEQ ID NO: 2733806 - DNA, 19 bp, Homo sapiens
tggtgaggccggccctgcc

SEQ ID NO: 2733807 - DNA, 17 bp, Homo sapiens
tggtgcaattaactctg

SEQ ID NO: 2733808 - DNA, 23 bp, Homo sapiens
tggtgcagaggtgagcagaggag

SEQ ID NO: 2733809 - DNA, 10 bp, Homo sapiens
tggtgcctga

SEQ ID NO: 2733810 - DNA, 17 bp, Homo sapiens
tggtggacagtcctggg

SEQ ID NO: 2733811 - DNA, 12 bp, Homo sapiens
tggtggggacca

SEQ ID NO: 2733812 - DNA, 20 bp, Homo sapiens
tggtggggctgccaggggag

SEQ ID NO: 2733813 - DNA, 16 bp, Homo sapiens
tggtgttactaaagtc

SEQ ID NO: 2733814 - DNA, 20 bp, Homo sapiens
tggtgttcataatttcagtt

SEQ ID NO: 2733815 - DNA, 19 bp, Homo sapiens
tggttagagaagtaagcag

SEQ ID NO: 2733816 - DNA, 15 bp, Homo sapiens
tggttcctcacatat

SEQ ID NO: 2733817 - DNA, 13 bp, Homo sapiens
tggtttgttattc

SEQ ID NO: 2733818 - DNA, 15 bp, Homo sapiens
tgtaaaaaaggaaca

SEQ ID NO: 2733819 - DNA, 19 bp, Homo sapiens
tgtaaaatcttcagctggt

SEQ ID NO: 2733820 - DNA, 14 bp, Homo sapiens
tgtaaaattgtata

SEQ ID NO: 2733821 - DNA, 21 bp, Homo sapiens
tgtaaatgaagggtcatttct

SEQ ID NO: 2733822 - DNA, 17 bp, Homo sapiens
tgtaaatgagacacata

SEQ ID NO: 2733823 - DNA, 20 bp, Homo sapiens
tgtaaattttgtatgaaaaa

SEQ ID NO: 2733824 - DNA, 23 bp, Homo sapiens
tgtaactaccctctcaaatggac

SEQ ID NO: 2733825 - DNA, 13 bp, Homo sapiens
tgtaactcagaca

SEQ ID NO: 2733826 - DNA, 19 bp, Homo sapiens
tgtaagtttatgtctaaag

SEQ ID NO: 2733827 - DNA, 20 bp, Homo sapiens
tgtaatatttcttcaagtga

SEQ ID NO: 2733828 - DNA, 14 bp, Homo sapiens
tgtaatcagtttta

SEQ ID NO: 2733829 - DNA, 18 bp, Homo sapiens
tgtacagtctcaattttg

SEQ ID NO: 2733830 - DNA, 14 bp, Homo sapiens
tgtacagttcagtt

SEQ ID NO: 2733831 - DNA, 20 bp, Homo sapiens
tgtacagttcagttcctctt

SEQ ID NO: 2733832 - DNA, 12 bp, Homo sapiens
tgtacattatgt

SEQ ID NO: 2733833 - DNA, 12 bp, Homo sapiens
tgtaccacaccc

SEQ ID NO: 2733834 - DNA, 16 bp, Homo sapiens
tgtaccatattgctct

SEQ ID NO: 2733835 - DNA, 16 bp, Homo sapiens
tgtacccccgcccagg

SEQ ID NO: 2733836 - DNA, 17 bp, Homo sapiens
tgtacccccgcccaggc

SEQ ID NO: 2733837 - DNA, 22 bp, Homo sapiens
tgtacccccgcccaggctggcc

SEQ ID NO: 2733838 - DNA, 17 bp, Homo sapiens
tgtacctggtgacccct

SEQ ID NO: 2733839 - DNA, 12 bp, Homo sapiens
tgtagccccggg

SEQ ID NO: 2733840 - DNA, 14 bp, Homo sapiens
tgtagccccgggct

SEQ ID NO: 2733841 - DNA, 21 bp, Homo sapiens
tgtagctctatggggggaggg

SEQ ID NO: 2733842 - DNA, 15 bp, Homo sapiens
tgtatacaaacaggt

SEQ ID NO: 2733843 - DNA, 16 bp, Homo sapiens
tgtatacaaacaggtg

SEQ ID NO: 2733844 - DNA, 17 bp, Homo sapiens
tgtatacaaacaggtgc

SEQ ID NO: 2733845 - DNA, 16 bp, Homo sapiens
tgtatatgtatatcta

SEQ ID NO: 2733846 - DNA, 18 bp, Homo sapiens
tgtatctgaaggagattt

SEQ ID NO: 2733847 - DNA, 20 bp, Homo sapiens
tgtatctttggggaaactaa

SEQ ID NO: 2733848 - DNA, 21 bp, Homo sapiens
tgtatgagaagtactttgtgc

SEQ ID NO: 2733849 - DNA, 17 bp, Homo sapiens
tgtatgtgacaacattt

SEQ ID NO: 2733850 - DNA, 21 bp, Homo sapiens
tgtattagccagtcattgtaa

SEQ ID NO: 2733851 - DNA, 22 bp, Homo sapiens
tgtattgctccattttcttgtc

SEQ ID NO: 2733852 - DNA, 16 bp, Homo sapiens
tgtatttaatgatttt

SEQ ID NO: 2733853 - DNA, 14 bp, Homo sapiens
tgtattttctgtgt

SEQ ID NO: 2733854 - DNA, 19 bp, Homo sapiens
tgtcaaatagcaaggccag

SEQ ID NO: 2733855 - DNA, 15 bp, Homo sapiens
tgtcaactttcattt

SEQ ID NO: 2733856 - DNA, 22 bp, Homo sapiens
tgtcaactttcatttgaaagtg

SEQ ID NO: 2733857 - DNA, 12 bp, Homo sapiens
tgtcacagctct

SEQ ID NO: 2733858 - DNA, 14 bp, Homo sapiens
tgtcacagctcttg

SEQ ID NO: 2733859 - DNA, 18 bp, Homo sapiens
tgtcacagctcttgtttg

SEQ ID NO: 2733860 - DNA, 18 bp, Homo sapiens
tgtcaccctggccaccac

SEQ ID NO: 2733861 - DNA, 19 bp, Homo sapiens
tgtcactgaagtgattgaa

SEQ ID NO: 2733862 - DNA, 17 bp, Homo sapiens
tgtcactggctgcctcc

SEQ ID NO: 2733863 - DNA, 19 bp, Homo sapiens
tgtcactggctgcctccac

SEQ ID NO: 2733864 - DNA, 14 bp, Homo sapiens
tgtcagcctcccac

SEQ ID NO: 2733865 - DNA, 12 bp, Homo sapiens
tgtcagccttgc

SEQ ID NO: 2733866 - DNA, 13 bp, Homo sapiens
tgtcagccttgca

SEQ ID NO: 2733867 - DNA, 17 bp, Homo sapiens
tgtcaggagagccctct

SEQ ID NO: 2733868 - DNA, 12 bp, Homo sapiens
tgtcatgtgtat

SEQ ID NO: 2733869 - DNA, 17 bp, Homo sapiens
tgtcatgtgtatgagaa

SEQ ID NO: 2733870 - DNA, 13 bp, Homo sapiens
tgtcattatttga

SEQ ID NO: 2733871 - DNA, 21 bp, Homo sapiens
tgtcattatttgataacattt

SEQ ID NO: 2733872 - DNA, 14 bp, Homo sapiens
tgtcattggaagcc

SEQ ID NO: 2733873 - DNA, 16 bp, Homo sapiens
tgtcatttctcatgga

SEQ ID NO: 2733874 - DNA, 23 bp, Homo sapiens
tgtccataaagtaattttgtgaa

SEQ ID NO: 2733875 - DNA, 14 bp, Homo sapiens
tgtccatcctcctc

SEQ ID NO: 2733876 - DNA, 16 bp, Homo sapiens
tgtccatcctcctctc

SEQ ID NO: 2733877 - DNA, 19 bp, Homo sapiens
tgtccatcctcctctccat

SEQ ID NO: 2733878 - DNA, 14 bp, Homo sapiens
tgtcccctggggct

SEQ ID NO: 2733879 - DNA, 12 bp, Homo sapiens
tgtccctaccca

SEQ ID NO: 2733880 - DNA, 18 bp, Homo sapiens
tgtccctacccactcttt

SEQ ID NO: 2733881 - DNA, 21 bp, Homo sapiens
tgtccctctcggaaggctggc

SEQ ID NO: 2733882 - DNA, 20 bp, Homo sapiens
tgtccctggggcactccccc

SEQ ID NO: 2733883 - DNA, 22 bp, Homo sapiens
tgtccctggggcactcccccag

SEQ ID NO: 2733884 - DNA, 23 bp, Homo sapiens
tgtccgcctctgcccgcagagcc

SEQ ID NO: 2733885 - DNA, 21 bp, Homo sapiens
tgtccggagcgaccctggctc

SEQ ID NO: 2733886 - DNA, 21 bp, Homo sapiens
tgtcctccaacaataaagagc

SEQ ID NO: 2733887 - DNA, 13 bp, Homo sapiens
tgtcctcgcactg

SEQ ID NO: 2733888 - DNA, 18 bp, Homo sapiens
tgtcctctcagagcctca

SEQ ID NO: 2733889 - DNA, 21 bp, Homo sapiens
tgtcctgacttcaggggctgc

SEQ ID NO: 2733890 - DNA, 10 bp, Homo sapiens
tgtcctgcat

SEQ ID NO: 2733891 - DNA, 16 bp, Homo sapiens
tgtcctgcatgcataa

SEQ ID NO: 2733892 - DNA, 21 bp, Homo sapiens
tgtcctgcatgcataatgaac

SEQ ID NO: 2733893 - DNA, 17 bp, Homo sapiens
tgtcctgctccacagtg

SEQ ID NO: 2733894 - DNA, 18 bp, Homo sapiens
tgtcctggtacagcaggg

SEQ ID NO: 2733895 - DNA, 19 bp, Homo sapiens
tgtcctggtacagcagggt

SEQ ID NO: 2733896 - DNA, 16 bp, Homo sapiens
tgtcctgtctgctggg

SEQ ID NO: 2733897 - DNA, 17 bp, Homo sapiens
tgtcctgtctgctgggc

SEQ ID NO: 2733898 - DNA, 23 bp, Homo sapiens
tgtcctgttattttttatttcca

SEQ ID NO: 2733899 - DNA, 18 bp, Homo sapiens
tgtccttactcagagctg

SEQ ID NO: 2733900 - DNA, 19 bp, Homo sapiens
tgtctactcctcacagcat

SEQ ID NO: 2733901 - DNA, 13 bp, Homo sapiens
tgtctcactgttt

SEQ ID NO: 2733902 - DNA, 14 bp, Homo sapiens
tgtctccctggccc

SEQ ID NO: 2733903 - DNA, 16 bp, Homo sapiens
tgtctccctggccctc

SEQ ID NO: 2733904 - DNA, 16 bp, Homo sapiens
tgtctctgcctggagc

SEQ ID NO: 2733905 - DNA, 20 bp, Homo sapiens
tgtctctgcctggagcaggg

SEQ ID NO: 2733906 - DNA, 11 bp, Homo sapiens
tgtctgcagct

SEQ ID NO: 2733907 - DNA, 15 bp, Homo sapiens
tgtctgcagctcctg

SEQ ID NO: 2733908 - DNA, 16 bp, Homo sapiens
tgtctgcagctcctgg

SEQ ID NO: 2733909 - DNA, 17 bp, Homo sapiens
tgtctgcagctcctgga

SEQ ID NO: 2733910 - DNA, 12 bp, Homo sapiens
tgtctgctgttg

SEQ ID NO: 2733911 - DNA, 21 bp, Homo sapiens
tgtctggtatccatgttttat

SEQ ID NO: 2733912 - DNA, 22 bp, Homo sapiens
tgtctgtccaacccctccccca

SEQ ID NO: 2733913 - DNA, 12 bp, Homo sapiens
tgtctgtctgct

SEQ ID NO: 2733914 - DNA, 15 bp, Homo sapiens
tgtctgtctgctctt

SEQ ID NO: 2733915 - DNA, 16 bp, Homo sapiens
tgtctgtctgctctta

SEQ ID NO: 2733916 - DNA, 19 bp, Homo sapiens
tgtcttataggtttccact

SEQ ID NO: 2733917 - DNA, 15 bp, Homo sapiens
tgtcttccaacccca

SEQ ID NO: 2733918 - DNA, 20 bp, Homo sapiens
tgtcttccaaccccagctgg

SEQ ID NO: 2733919 - DNA, 20 bp, Homo sapiens
tgtcttcctagtatattagt

SEQ ID NO: 2733920 - DNA, 14 bp, Homo sapiens
tgtcttgaaacctt

SEQ ID NO: 2733921 - DNA, 12 bp, Homo sapiens
tgtctttcaaaa

SEQ ID NO: 2733922 - DNA, 13 bp, Homo sapiens
tgtctttctttgc

SEQ ID NO: 2733923 - DNA, 14 bp, Homo sapiens
tgtctttctttgct

SEQ ID NO: 2733924 - DNA, 19 bp, Homo sapiens
tgtctttctttgctgctgt

SEQ ID NO: 2733925 - DNA, 21 bp, Homo sapiens
tgtgaaagtcagatgcccaga

SEQ ID NO: 2733926 - DNA, 19 bp, Homo sapiens
tgtgaaattcaacctgtgt

SEQ ID NO: 2733927 - DNA, 18 bp, Homo sapiens
tgtgacaacatttttgta

SEQ ID NO: 2733928 - DNA, 19 bp, Homo sapiens
tgtgaggatgtggatggag

SEQ ID NO: 2733929 - DNA, 23 bp, Homo sapiens
tgtgagtataaaataaagcaaat

SEQ ID NO: 2733930 - DNA, 22 bp, Homo sapiens
tgtgatattgaccatgtgatta

SEQ ID NO: 2733931 - DNA, 17 bp, Homo sapiens
tgtgatcatctttgctg

SEQ ID NO: 2733932 - DNA, 14 bp, Homo sapiens
tgtgattatggaca

SEQ ID NO: 2733933 - DNA, 14 bp, Homo sapiens
tgtgcaaaagcagg

SEQ ID NO: 2733934 - DNA, 18 bp, Homo sapiens
tgtgcaaacagtgtaagc

SEQ ID NO: 2733935 - DNA, 24 bp, Homo sapiens
tgtgcaactcttgtattgctccat

SEQ ID NO: 2733936 - DNA, 15 bp, Homo sapiens
tgtgccaccctgggc

SEQ ID NO: 2733937 - DNA, 14 bp, Homo sapiens
tgtgcccatgggca

SEQ ID NO: 2733938 - DNA, 20 bp, Homo sapiens
tgtgcccatgggcactgctg

SEQ ID NO: 2733939 - DNA, 22 bp, Homo sapiens
tgtgcccatgggcactgctggg

SEQ ID NO: 2733940 - DNA, 16 bp, Homo sapiens
tgtgccccatgtccaa

SEQ ID NO: 2733941 - DNA, 13 bp, Homo sapiens
tgtgccccccatc

SEQ ID NO: 2733942 - DNA, 21 bp, Homo sapiens
tgtgcctgtctgtccaacccc

SEQ ID NO: 2733943 - DNA, 17 bp, Homo sapiens
tgtgctcagcagcccca

SEQ ID NO: 2733944 - DNA, 17 bp, Homo sapiens
tgtgctcccaccaggca

SEQ ID NO: 2733945 - DNA, 20 bp, Homo sapiens
tgtgctctcggcttcaccag

SEQ ID NO: 2733946 - DNA, 17 bp, Homo sapiens
tgtgctgtcagcctccc

SEQ ID NO: 2733947 - DNA, 12 bp, Homo sapiens
tgtggaaagcct

SEQ ID NO: 2733948 - DNA, 14 bp, Homo sapiens
tgtggaaagcctct

SEQ ID NO: 2733949 - DNA, 17 bp, Homo sapiens
tgtggaaagcctctgct

SEQ ID NO: 2733950 - DNA, 21 bp, Homo sapiens
tgtggaaaggattctaaacag

SEQ ID NO: 2733951 - DNA, 16 bp, Homo sapiens
tgtggactttgttcac

SEQ ID NO: 2733952 - DNA, 15 bp, Homo sapiens
tgtggattcagcttc

SEQ ID NO: 2733953 - DNA, 15 bp, Homo sapiens
tgtgggaaaaaagaa

SEQ ID NO: 2733954 - DNA, 16 bp, Homo sapiens
tgtgggaaaaaagaaa

SEQ ID NO: 2733955 - DNA, 16 bp, Homo sapiens
tgtgggctgcactctg

SEQ ID NO: 2733956 - DNA, 23 bp, Homo sapiens
tgtggggaagcaagacgtcctgg

SEQ ID NO: 2733957 - DNA, 19 bp, Homo sapiens
tgtggtcccacccaggaag

SEQ ID NO: 2733958 - DNA, 18 bp, Homo sapiens
tgtggttcctaagcctgt

SEQ ID NO: 2733959 - DNA, 22 bp, Homo sapiens
tgtgtaccacaccctgcctgct

SEQ ID NO: 2733960 - DNA, 22 bp, Homo sapiens
tgtgtcactggctgcctccact

SEQ ID NO: 2733961 - DNA, 15 bp, Homo sapiens
tgtgtctctgtatat

SEQ ID NO: 2733962 - DNA, 18 bp, Homo sapiens
tgtgtgtaccacaccctg

SEQ ID NO: 2733963 - DNA, 24 bp, Homo sapiens
tgtgtgtaccacaccctgcctgct

SEQ ID NO: 2733964 - DNA, 12 bp, Homo sapiens
tgtgtgtctctg

SEQ ID NO: 2733965 - DNA, 13 bp, Homo sapiens
tgtgttggcttta

SEQ ID NO: 2733966 - DNA, 14 bp, Homo sapiens
tgttaaatgaaacc

SEQ ID NO: 2733967 - DNA, 21 bp, Homo sapiens
tgttaatatctgatactgtat

SEQ ID NO: 2733968 - DNA, 14 bp, Homo sapiens
tgttaattgattaa

SEQ ID NO: 2733969 - DNA, 21 bp, Homo sapiens
tgttacttaaacatcattgga

SEQ ID NO: 2733970 - DNA, 16 bp, Homo sapiens
tgttacttccctccaa

SEQ ID NO: 2733971 - DNA, 13 bp, Homo sapiens
tgttagcaaagat

SEQ ID NO: 2733972 - DNA, 17 bp, Homo sapiens
tgttattggaattttct

SEQ ID NO: 2733973 - DNA, 16 bp, Homo sapiens
tgttatttgtacagtt

SEQ ID NO: 2733974 - DNA, 16 bp, Homo sapiens
tgttcaacagtttctc

SEQ ID NO: 2733975 - DNA, 18 bp, Homo sapiens
tgttcagaattttggaaa

SEQ ID NO: 2733976 - DNA, 23 bp, Homo sapiens
tgttcagaattttggaaaaatgt

SEQ ID NO: 2733977 - DNA, 18 bp, Homo sapiens
tgttccccatggccactt

SEQ ID NO: 2733978 - DNA, 20 bp, Homo sapiens
tgttctacttgatatttcct

SEQ ID NO: 2733979 - DNA, 19 bp, Homo sapiens
tgttgataaattccactgg

SEQ ID NO: 2733980 - DNA, 19 bp, Homo sapiens
tgttgcacagttcatttaa

SEQ ID NO: 2733981 - DNA, 11 bp, Homo sapiens
tgttgctgttg

SEQ ID NO: 2733982 - DNA, 15 bp, Homo sapiens
tgttgctgttgctgt

SEQ ID NO: 2733983 - DNA, 18 bp, Homo sapiens
tgttggcagtgtttgtat

SEQ ID NO: 2733984 - DNA, 22 bp, Homo sapiens
tgttgggatgcgggcattttga

SEQ ID NO: 2733985 - DNA, 11 bp, Homo sapiens
tgttggtgcaa

SEQ ID NO: 2733986 - DNA, 15 bp, Homo sapiens
tgtttcatgagccca

SEQ ID NO: 2733987 - DNA, 16 bp, Homo sapiens
tgtttcatgagcccaa

SEQ ID NO: 2733988 - DNA, 15 bp, Homo sapiens
tgtttctccccctgg

SEQ ID NO: 2733989 - DNA, 22 bp, Homo sapiens
tgtttgaagaaccgcattttga

SEQ ID NO: 2733990 - DNA, 14 bp, Homo sapiens
tgtttggacttcac

SEQ ID NO: 2733991 - DNA, 21 bp, Homo sapiens
tgtttgtataccatgatgcat

SEQ ID NO: 2733992 - DNA, 15 bp, Homo sapiens
tgtttgtcagtaaat

SEQ ID NO: 2733993 - DNA, 16 bp, Homo sapiens
tgtttgttcacactcc

SEQ ID NO: 2733994 - DNA, 17 bp, Homo sapiens
tgtttttaagtcctgta

SEQ ID NO: 2733995 - DNA, 17 bp, Homo sapiens
ttaaaaataagttttat

SEQ ID NO: 2733996 - DNA, 17 bp, Homo sapiens
ttaaaacagaagcaaat

SEQ ID NO: 2733997 - DNA, 15 bp, Homo sapiens
ttaaaagacaaacac

SEQ ID NO: 2733998 - DNA, 16 bp, Homo sapiens
ttaaaagtttgtcctt

SEQ ID NO: 2733999 - DNA, 16 bp, Homo sapiens
ttaaaataaaataatt

SEQ ID NO: 2734000 - DNA, 17 bp, Homo sapiens
ttaaaatgaagcaattt

SEQ ID NO: 2734001 - DNA, 18 bp, Homo sapiens
ttaaaatgttggtgcaat

SEQ ID NO: 2734002 - DNA, 18 bp, Homo sapiens
ttaaacagcaaagccata

SEQ ID NO: 2734003 - DNA, 21 bp, Homo sapiens
ttaaacatcattggataaatt

SEQ ID NO: 2734004 - DNA, 17 bp, Homo sapiens
ttaaagaaacactaaat

SEQ ID NO: 2734005 - DNA, 19 bp, Homo sapiens
ttaaataaaagcacaagta

SEQ ID NO: 2734006 - DNA, 17 bp, Homo sapiens
ttaaattctctctaaca

SEQ ID NO: 2734007 - DNA, 16 bp, Homo sapiens
ttaaattttaaggtag

SEQ ID NO: 2734008 - DNA, 20 bp, Homo sapiens
ttaacaggttttcttctaat

SEQ ID NO: 2734009 - DNA, 11 bp, Homo sapiens
ttaacatgtga

SEQ ID NO: 2734010 - DNA, 14 bp, Homo sapiens
ttaactctgcagga

SEQ ID NO: 2734011 - DNA, 19 bp, Homo sapiens
ttaactttcaaaagcaaac

SEQ ID NO: 2734012 - DNA, 17 bp, Homo sapiens
ttaagtactatctttgt

SEQ ID NO: 2734013 - DNA, 22 bp, Homo sapiens
ttaataggatgaatgggaaagt

SEQ ID NO: 2734014 - DNA, 14 bp, Homo sapiens
ttaatatctgagaa

SEQ ID NO: 2734015 - DNA, 22 bp, Homo sapiens
ttaatatctgagaagtgtatat

SEQ ID NO: 2734016 - DNA, 14 bp, Homo sapiens
ttaatattcttttg

SEQ ID NO: 2734017 - DNA, 16 bp, Homo sapiens
ttaatattcttttgtt

SEQ ID NO: 2734018 - DNA, 13 bp, Homo sapiens
ttaatcttttaaa

SEQ ID NO: 2734019 - DNA, 18 bp, Homo sapiens
ttaatgatttttgtgtat

SEQ ID NO: 2734020 - DNA, 17 bp, Homo sapiens
ttaattcattaatctgt

SEQ ID NO: 2734021 - DNA, 14 bp, Homo sapiens
ttacaaataatttt

SEQ ID NO: 2734022 - DNA, 14 bp, Homo sapiens
ttacaacaaacact

SEQ ID NO: 2734023 - DNA, 16 bp, Homo sapiens
ttacaacaaacactgt

SEQ ID NO: 2734024 - DNA, 14 bp, Homo sapiens
ttacaggcatgagc

SEQ ID NO: 2734025 - DNA, 18 bp, Homo sapiens
ttacagtaaataaattgt

SEQ ID NO: 2734026 - DNA, 22 bp, Homo sapiens
ttacagtaggagtgagaaattt

SEQ ID NO: 2734027 - DNA, 17 bp, Homo sapiens
ttacagtctctgttgta

SEQ ID NO: 2734028 - DNA, 15 bp, Homo sapiens
ttacagtgtatttaa

SEQ ID NO: 2734029 - DNA, 22 bp, Homo sapiens
ttacatacagtgatatggtact

SEQ ID NO: 2734030 - DNA, 12 bp, Homo sapiens
ttacatgaagct

SEQ ID NO: 2734031 - DNA, 22 bp, Homo sapiens
ttacattaaaatagcacatgat

SEQ ID NO: 2734032 - DNA, 24 bp, Homo sapiens
ttacattaaaatagcacatgattt

SEQ ID NO: 2734033 - DNA, 18 bp, Homo sapiens
ttaccattattttacagt

SEQ ID NO: 2734034 - DNA, 15 bp, Homo sapiens
ttacccttcctcatc

SEQ ID NO: 2734035 - DNA, 23 bp, Homo sapiens
ttaccttattgagcgtgattctg

SEQ ID NO: 2734036 - DNA, 13 bp, Homo sapiens
ttactcagagctg

SEQ ID NO: 2734037 - DNA, 19 bp, Homo sapiens
ttactcagagctgcgggct

SEQ ID NO: 2734038 - DNA, 20 bp, Homo sapiens
ttactcagagctgcgggctg

SEQ ID NO: 2734039 - DNA, 14 bp, Homo sapiens
ttactcagtgaaat

SEQ ID NO: 2734040 - DNA, 17 bp, Homo sapiens
ttactgacagaaatgca

SEQ ID NO: 2734041 - DNA, 21 bp, Homo sapiens
ttactgatcttacctttatga

SEQ ID NO: 2734042 - DNA, 12 bp, Homo sapiens
ttactgtatgta

SEQ ID NO: 2734043 - DNA, 22 bp, Homo sapiens
ttactgtatgtataaattatga

SEQ ID NO: 2734044 - DNA, 16 bp, Homo sapiens
ttacttaaacatcatt

SEQ ID NO: 2734045 - DNA, 17 bp, Homo sapiens
ttactttttaaacagtg

SEQ ID NO: 2734046 - DNA, 14 bp, Homo sapiens
ttagaaaatcagat

SEQ ID NO: 2734047 - DNA, 12 bp, Homo sapiens
ttagaaacatgt

SEQ ID NO: 2734048 - DNA, 21 bp, Homo sapiens
ttagaaatttattcttatctt

SEQ ID NO: 2734049 - DNA, 20 bp, Homo sapiens
ttagaaccagccgtatttta

SEQ ID NO: 2734050 - DNA, 15 bp, Homo sapiens
ttagaataaaattgt

SEQ ID NO: 2734051 - DNA, 20 bp, Homo sapiens
ttagaatcaagtctgtgaaa

SEQ ID NO: 2734052 - DNA, 15 bp, Homo sapiens
ttagattttctgtaa

SEQ ID NO: 2734053 - DNA, 15 bp, Homo sapiens
ttagccagtcattgt

SEQ ID NO: 2734054 - DNA, 23 bp, Homo sapiens
ttagcgtccatttcttatttaat

SEQ ID NO: 2734055 - DNA, 18 bp, Homo sapiens
ttagcttcatatctaatt

SEQ ID NO: 2734056 - DNA, 18 bp, Homo sapiens
ttaggagaagttggtctt

SEQ ID NO: 2734057 - DNA, 18 bp, Homo sapiens
ttaggcagggatttgagg

SEQ ID NO: 2734058 - DNA, 12 bp, Homo sapiens
ttaggcctggca

SEQ ID NO: 2734059 - DNA, 22 bp, Homo sapiens
tctgtccatcctcctctccatg

SEQ ID NO: 2734060 - DNA, 13 bp, Homo sapiens
tctgtctctgctt

SEQ ID NO: 2734061 - DNA, 14 bp, Homo sapiens
tctgtctgctctta

SEQ ID NO: 2734062 - DNA, 16 bp, Homo sapiens
tctgtgcccatgggca

SEQ ID NO: 2734063 - DNA, 19 bp, Homo sapiens
tctgtgcccatgggcactg

SEQ ID NO: 2734064 - DNA, 15 bp, Homo sapiens
tctgtgcctgtctgt

SEQ ID NO: 2734065 - DNA, 18 bp, Homo sapiens
tctgtgcctgtctgtcca

SEQ ID NO: 2734066 - DNA, 12 bp, Homo sapiens
tctgtgggctgc

SEQ ID NO: 2734067 - DNA, 15 bp, Homo sapiens
tctgtgggctgcact

SEQ ID NO: 2734068 - DNA, 19 bp, Homo sapiens
tctgtgggctgcactctgt

SEQ ID NO: 2734069 - DNA, 21 bp, Homo sapiens
tctgtgggctgcactctgtgc

SEQ ID NO: 2734070 - DNA, 23 bp, Homo sapiens
tctgtgggctgcactctgtgccc

SEQ ID NO: 2734071 - DNA, 14 bp, Homo sapiens
tctgtgtcactggc

SEQ ID NO: 2734072 - DNA, 15 bp, Homo sapiens
tctgtgtcactggct

SEQ ID NO: 2734073 - DNA, 22 bp, Homo sapiens
tctgtgtcactggctgcctcca

SEQ ID NO: 2734074 - DNA, 14 bp, Homo sapiens
tctgttaaagatca

SEQ ID NO: 2734075 - DNA, 20 bp, Homo sapiens
tctgttccccatggccactt

SEQ ID NO: 2734076 - DNA, 22 bp, Homo sapiens
tctgttctacttgatatttcct

SEQ ID NO: 2734077 - DNA, 15 bp, Homo sapiens
tctgttgtttgaaga

SEQ ID NO: 2734078 - DNA, 13 bp, Homo sapiens
tcttaactctgca

SEQ ID NO: 2734079 - DNA, 16 bp, Homo sapiens
tcttaactctgcagga

SEQ ID NO: 2734080 - DNA, 16 bp, Homo sapiens
tcttaatattcagaga

SEQ ID NO: 2734081 - DNA, 22 bp, Homo sapiens
tcttaatattcagagaaaactt

SEQ ID NO: 2734082 - DNA, 17 bp, Homo sapiens
tcttacataatttgcaa

SEQ ID NO: 2734083 - DNA, 15 bp, Homo sapiens
tcttacttcccccac

SEQ ID NO: 2734084 - DNA, 13 bp, Homo sapiens
tcttactttgtgc

SEQ ID NO: 2734085 - DNA, 22 bp, Homo sapiens
tcttattcatgctttctccttt

SEQ ID NO: 2734086 - DNA, 23 bp, Homo sapiens
tcttattcatgctttctcctttt

SEQ ID NO: 2734087 - DNA, 12 bp, Homo sapiens
tcttattttctt

SEQ ID NO: 2734088 - DNA, 19 bp, Homo sapiens
tcttattttcttggaattt

SEQ ID NO: 2734089 - DNA, 14 bp, Homo sapiens
tcttatttttgtac

SEQ ID NO: 2734090 - DNA, 15 bp, Homo sapiens
tcttcacgcctgggt

SEQ ID NO: 2734091 - DNA, 15 bp, Homo sapiens
tcttccaaccccagc

SEQ ID NO: 2734092 - DNA, 22 bp, Homo sapiens
tcttccaaccccagctggcctc

SEQ ID NO: 2734093 - DNA, 17 bp, Homo sapiens
tcttccaccagagcagg

SEQ ID NO: 2734094 - DNA, 19 bp, Homo sapiens
tcttccaggtggggtgagg

SEQ ID NO: 2734095 - DNA, 18 bp, Homo sapiens
tcttcccccactcctctt

SEQ ID NO: 2734096 - DNA, 19 bp, Homo sapiens
tcttcctagtatattagtt

SEQ ID NO: 2734097 - DNA, 19 bp, Homo sapiens
tcttcctgtgggggaagag

SEQ ID NO: 2734098 - DNA, 20 bp, Homo sapiens
tcttcctttatcccctcctt

SEQ ID NO: 2734099 - DNA, 15 bp, Homo sapiens
tcttctcagagcagc

SEQ ID NO: 2734100 - DNA, 23 bp, Homo sapiens
tcttctcagagcagcactggggt

SEQ ID NO: 2734101 - DNA, 21 bp, Homo sapiens
tcttctgtatgtgacaacatt

SEQ ID NO: 2734102 - DNA, 20 bp, Homo sapiens
tcttcttgagcagaccgtga

SEQ ID NO: 2734103 - DNA, 16 bp, Homo sapiens
tcttcttgtgtcctga

SEQ ID NO: 2734104 - DNA, 15 bp, Homo sapiens
tcttgaaacagcctg

SEQ ID NO: 2734105 - DNA, 20 bp, Homo sapiens
tcttgacctgaactctgcaa

SEQ ID NO: 2734106 - DNA, 14 bp, Homo sapiens
tcttgactggctca

SEQ ID NO: 2734107 - DNA, 15 bp, Homo sapiens
tcttgatctcctgag

SEQ ID NO: 2734108 - DNA, 16 bp, Homo sapiens
tcttgatctcctgagc

SEQ ID NO: 2734109 - DNA, 17 bp, Homo sapiens
tcttgatctcctgagct

SEQ ID NO: 2734110 - DNA, 22 bp, Homo sapiens
tcttgcattgaatttagtcatt

SEQ ID NO: 2734111 - DNA, 16 bp, Homo sapiens
tcttgccccaaatcac

SEQ ID NO: 2734112 - DNA, 17 bp, Homo sapiens
tcttgccccaaatcaca

SEQ ID NO: 2734113 - DNA, 19 bp, Homo sapiens
tcttgccccaaatcacaaa

SEQ ID NO: 2734114 - DNA, 22 bp, Homo sapiens
tcttgctgtaactcagacattc

SEQ ID NO: 2734115 - DNA, 12 bp, Homo sapiens
tcttgcttctgg

SEQ ID NO: 2734116 - DNA, 15 bp, Homo sapiens
tcttggcacctgcct

SEQ ID NO: 2734117 - DNA, 12 bp, Homo sapiens
tcttgggcctga

SEQ ID NO: 2734118 - DNA, 19 bp, Homo sapiens
tcttgggcctgacctccag

SEQ ID NO: 2734119 - DNA, 20 bp, Homo sapiens
tcttgggcctgacctccagt

SEQ ID NO: 2734120 - DNA, 16 bp, Homo sapiens
tcttggggctcgcccc

SEQ ID NO: 2734121 - DNA, 13 bp, Homo sapiens
tcttgtgtcctga

SEQ ID NO: 2734122 - DNA, 16 bp, Homo sapiens
tctttaaggagataga

SEQ ID NO: 2734123 - DNA, 15 bp, Homo sapiens
tctttaatctgttgt

SEQ ID NO: 2734124 - DNA, 17 bp, Homo sapiens
tctttatgcaaaaacat

SEQ ID NO: 2734125 - DNA, 12 bp, Homo sapiens
tctttcatacat

SEQ ID NO: 2734126 - DNA, 18 bp, Homo sapiens
tctttccaaaacatttct

SEQ ID NO: 2734127 - DNA, 17 bp, Homo sapiens
tctttcttggtgcattc

SEQ ID NO: 2734128 - DNA, 18 bp, Homo sapiens
tctttcttggtgcattcg

SEQ ID NO: 2734129 - DNA, 18 bp, Homo sapiens
tctttctttccaaaacat

SEQ ID NO: 2734130 - DNA, 19 bp, Homo sapiens
tctttctttgcaccaaaga

SEQ ID NO: 2734131 - DNA, 14 bp, Homo sapiens
tctttctttgctgc

SEQ ID NO: 2734132 - DNA, 16 bp, Homo sapiens
tctttctttgctgctg

SEQ ID NO: 2734133 - DNA, 19 bp, Homo sapiens
tctttctttgctgctgtgg

SEQ ID NO: 2734134 - DNA, 20 bp, Homo sapiens
tctttgcaaaggactgtaag

SEQ ID NO: 2734135 - DNA, 20 bp, Homo sapiens
tgcattcacagcgcctcctg

SEQ ID NO: 2734136 - DNA, 22 bp, Homo sapiens
tgcattcatgttttaaaagttt

SEQ ID NO: 2734137 - DNA, 21 bp, Homo sapiens
tgccaacagtgttaggcctgg

SEQ ID NO: 2734138 - DNA, 13 bp, Homo sapiens
tgccaccctgggc

SEQ ID NO: 2734139 - DNA, 15 bp, Homo sapiens
tgccaccctgggctc

SEQ ID NO: 2734140 - DNA, 12 bp, Homo sapiens
tgccactctgct

SEQ ID NO: 2734141 - DNA, 16 bp, Homo sapiens
tgccactctgctgcct

SEQ ID NO: 2734142 - DNA, 19 bp, Homo sapiens
tgccactctgctgcctgta

SEQ ID NO: 2734143 - DNA, 23 bp, Homo sapiens
tgccactttggtacatggccagt

SEQ ID NO: 2734144 - DNA, 12 bp, Homo sapiens
tgccagcctggc

SEQ ID NO: 2734145 - DNA, 22 bp, Homo sapiens
tgccagcctggcttctggagcc

SEQ ID NO: 2734146 - DNA, 18 bp, Homo sapiens
tgccagctctgtcaccct

SEQ ID NO: 2734147 - DNA, 19 bp, Homo sapiens
tgccaggattggcacaagc

SEQ ID NO: 2734148 - DNA, 21 bp, Homo sapiens
tgccaggattggcacaagctc

SEQ ID NO: 2734149 - DNA, 22 bp, Homo sapiens
tgccaggattggcacaagctcc

SEQ ID NO: 2734150 - DNA, 17 bp, Homo sapiens
tgccagggaaaaagacc

SEQ ID NO: 2734151 - DNA, 16 bp, Homo sapiens
tgccagtcgcgctgcc

SEQ ID NO: 2734152 - DNA, 17 bp, Homo sapiens
tgccagtcgcgctgcct

SEQ ID NO: 2734153 - DNA, 19 bp, Homo sapiens
tgccagtcgcgctgcctgt

SEQ ID NO: 2734154 - DNA, 20 bp, Homo sapiens
tgccagtcgcgctgcctgtg

SEQ ID NO: 2734155 - DNA, 17 bp, Homo sapiens
tgccatggcgtgtccct

SEQ ID NO: 2734156 - DNA, 18 bp, Homo sapiens
tgccattgtatttcttca

SEQ ID NO: 2734157 - DNA, 17 bp, Homo sapiens
tgccatttgcaccctcc

SEQ ID NO: 2734158 - DNA, 18 bp, Homo sapiens
tgcccaactttcattggt

SEQ ID NO: 2734159 - DNA, 16 bp, Homo sapiens
tgcccaatccaggccc

SEQ ID NO: 2734160 - DNA, 17 bp, Homo sapiens
tgcccaatccaggcccg

SEQ ID NO: 2734161 - DNA, 20 bp, Homo sapiens
tgcccacacacactccttcc

SEQ ID NO: 2734162 - DNA, 23 bp, Homo sapiens
tgcccacacacactccttcccct

SEQ ID NO: 2734163 - DNA, 18 bp, Homo sapiens
tgcccagagggcccaggc

SEQ ID NO: 2734164 - DNA, 14 bp, Homo sapiens
tgcccagcctgccc

SEQ ID NO: 2734165 - DNA, 22 bp, Homo sapiens
tgcccaggacggggccggccag

SEQ ID NO: 2734166 - DNA, 19 bp, Homo sapiens
tgcccaggctagagtgcag

SEQ ID NO: 2734167 - DNA, 20 bp, Homo sapiens
tgcccaggctagagtgcagt

SEQ ID NO: 2734168 - DNA, 20 bp, Homo sapiens
tgcccaggctggagtgcaat

SEQ ID NO: 2734169 - DNA, 17 bp, Homo sapiens
tgcccagggaagccctc

SEQ ID NO: 2734170 - DNA, 21 bp, Homo sapiens
tgcccagtcgatatctcactt

SEQ ID NO: 2734171 - DNA, 15 bp, Homo sapiens
tgcccatgggcactg

SEQ ID NO: 2734172 - DNA, 16 bp, Homo sapiens
tgcccatgggcactgc

SEQ ID NO: 2734173 - DNA, 22 bp, Homo sapiens
tgcccatgggcactgctgggtg

SEQ ID NO: 2734174 - DNA, 14 bp, Homo sapiens
tgccccaaatcaca

SEQ ID NO: 2734175 - DNA, 20 bp, Homo sapiens
tgccccaacccccagcaccc

SEQ ID NO: 2734176 - DNA, 21 bp, Homo sapiens
tgccccatctcctcccatggc

SEQ ID NO: 2734177 - DNA, 16 bp, Homo sapiens
tgccccctcgtgccag

SEQ ID NO: 2734178 - DNA, 21 bp, Homo sapiens
tgccccctggtggacagtcct

SEQ ID NO: 2734179 - DNA, 13 bp, Homo sapiens
tgccccgcccagc

SEQ ID NO: 2734180 - DNA, 17 bp, Homo sapiens
tgcccctccccagccct

SEQ ID NO: 2734181 - DNA, 17 bp, Homo sapiens
tgcccctccccctaccg

SEQ ID NO: 2734182 - DNA, 14 bp, Homo sapiens
tgccccttgtcctc

SEQ ID NO: 2734183 - DNA, 19 bp, Homo sapiens
tgccccttgtcctctcaga

SEQ ID NO: 2734184 - DNA, 13 bp, Homo sapiens
tgcccgcagagcc

SEQ ID NO: 2734185 - DNA, 14 bp, Homo sapiens
tgcccgcagagccc

SEQ ID NO: 2734186 - DNA, 18 bp, Homo sapiens
tgcccgcctcggcctccc

SEQ ID NO: 2734187 - DNA, 18 bp, Homo sapiens
tgcccggattctgggagg

SEQ ID NO: 2734188 - DNA, 22 bp, Homo sapiens
tgcccggattctgggaggaagc

SEQ ID NO: 2734189 - DNA, 15 bp, Homo sapiens
tgcccggcgccctct

SEQ ID NO: 2734190 - DNA, 20 bp, Homo sapiens
tgccctacctgcctgttctc

SEQ ID NO: 2734191 - DNA, 22 bp, Homo sapiens
tgccctacctgcctgttctcca

SEQ ID NO: 2734192 - DNA, 13 bp, Homo sapiens
tgccgagagaggc

SEQ ID NO: 2734193 - DNA, 22 bp, Homo sapiens
tgccgagagaggcgcgtctgcc

SEQ ID NO: 2734194 - DNA, 22 bp, Homo sapiens
tgccgatgcccaatccaggccc

SEQ ID NO: 2734195 - DNA, 18 bp, Homo sapiens
tgccgccgcctcgcccac

SEQ ID NO: 2734196 - DNA, 21 bp, Homo sapiens
tgccgccgcctcgcccaccgc

SEQ ID NO: 2734197 - DNA, 14 bp, Homo sapiens
tgccgcctcccggg

SEQ ID NO: 2734198 - DNA, 19 bp, Homo sapiens
tgccgcctcccgggaagca

SEQ ID NO: 2734199 - DNA, 20 bp, Homo sapiens
tgccgggtggggggagggca

SEQ ID NO: 2734200 - DNA, 22 bp, Homo sapiens
tgccgggtggggggagggcacc

SEQ ID NO: 2734201 - DNA, 15 bp, Homo sapiens
tgccggtaccagcct

SEQ ID NO: 2734202 - DNA, 18 bp, Homo sapiens
tgcctaattcctggcatg

SEQ ID NO: 2734203 - DNA, 17 bp, Homo sapiens
tgcctagctcttgggcc

SEQ ID NO: 2734204 - DNA, 20 bp, Homo sapiens
tgcctagctcttgggcctga

SEQ ID NO: 2734205 - DNA, 15 bp, Homo sapiens
tgcctcagcctcctg

SEQ ID NO: 2734206 - DNA, 17 bp, Homo sapiens
tgcctcagcctcctgag

SEQ ID NO: 2734207 - DNA, 19 bp, Homo sapiens
tgcctcatcctcctcctca

SEQ ID NO: 2734208 - DNA, 21 bp, Homo sapiens
tgcctcctacaaccaggtctt

SEQ ID NO: 2734209 - DNA, 16 bp, Homo sapiens
tgcctcggctcctgct

SEQ ID NO: 2734210 - DNA, 17 bp, Homo sapiens
tgcctcggctcctgctg

SEQ ID NO: 2734211 - DNA, 12 bp, Homo sapiens
tgcctgagattc

SEQ ID NO: 2734212 - DNA, 20 bp, Homo sapiens
tgcctgagattctttaagga

SEQ ID NO: 2734213 - DNA, 20 bp, Homo sapiens
tgcctgattcggctgtctca

SEQ ID NO: 2734214 - DNA, 11 bp, Homo sapiens
tgcctgcagcc

SEQ ID NO: 2734215 - DNA, 15 bp, Homo sapiens
tgcctgcctgggcct

SEQ ID NO: 2734216 - DNA, 13 bp, Homo sapiens
tgcctgctgggct

SEQ ID NO: 2734217 - DNA, 15 bp, Homo sapiens
tgcctgctgggctct

SEQ ID NO: 2734218 - DNA, 16 bp, Homo sapiens
tgcctgctgggctctt

SEQ ID NO: 2734219 - DNA, 13 bp, Homo sapiens
tgcctgctgtgga

SEQ ID NO: 2734220 - DNA, 11 bp, Homo sapiens
tgcctgcttcc

SEQ ID NO: 2734221 - DNA, 15 bp, Homo sapiens
tgcctgcttcctgga

SEQ ID NO: 2734222 - DNA, 16 bp, Homo sapiens
tgcctgcttcctggac

SEQ ID NO: 2734223 - DNA, 16 bp, Homo sapiens
tgcctgggcctcccaa

SEQ ID NO: 2734224 - DNA, 17 bp, Homo sapiens
tgcctgggcctcccaaa

SEQ ID NO: 2734225 - DNA, 17 bp, Homo sapiens
tgcctgtaatcccagca

SEQ ID NO: 2734226 - DNA, 14 bp, Homo sapiens
tgcctgtctgtcca

SEQ ID NO: 2734227 - DNA, 20 bp, Homo sapiens
tgcctgtctgtccaacccct

SEQ ID NO: 2734228 - DNA, 21 bp, Homo sapiens
tgcctgtctgtccaacccctc

SEQ ID NO: 2734229 - DNA, 22 bp, Homo sapiens
tgccttaaggccacactggcat

SEQ ID NO: 2734230 - DNA, 21 bp, Homo sapiens
tgccttatgcaaggggaaacc

SEQ ID NO: 2734231 - DNA, 16 bp, Homo sapiens
tgccttcctgtttaaa

SEQ ID NO: 2734232 - DNA, 14 bp, Homo sapiens
tgccttgaagccac

SEQ ID NO: 2734233 - DNA, 15 bp, Homo sapiens
tgccttgaagccact

SEQ ID NO: 2734234 - DNA, 19 bp, Homo sapiens
tgccttgtgtacagttatt

SEQ ID NO: 2734235 - DNA, 18 bp, Homo sapiens
tgcctttttgtttttgta

SEQ ID NO: 2734236 - DNA, 17 bp, Homo sapiens
tgccttttttagcttca

SEQ ID NO: 2734237 - DNA, 16 bp, Homo sapiens
tgcgaaggggccctgg

SEQ ID NO: 2734238 - DNA, 14 bp, Homo sapiens
tgcgaccccatctg

SEQ ID NO: 2734239 - DNA, 20 bp, Homo sapiens
tgcgaccccatctgcccagg

SEQ ID NO: 2734240 - DNA, 16 bp, Homo sapiens
tgcgcctctccactgt

SEQ ID NO: 2734241 - DNA, 19 bp, Homo sapiens
tgcgggatggtcctggggc

SEQ ID NO: 2734242 - DNA, 13 bp, Homo sapiens
tgcgggctgaggg

SEQ ID NO: 2734243 - DNA, 17 bp, Homo sapiens
tgcgtggcacatctaaa

SEQ ID NO: 2734244 - DNA, 12 bp, Homo sapiens
tgctacaataaa

SEQ ID NO: 2734245 - DNA, 16 bp, Homo sapiens
tgctacaataaatgct

SEQ ID NO: 2734246 - DNA, 14 bp, Homo sapiens
tgctaccctccctg

SEQ ID NO: 2734247 - DNA, 19 bp, Homo sapiens
tgctaccctccctgctgtc

SEQ ID NO: 2734248 - DNA, 18 bp, Homo sapiens
tgctatattttcatgact

SEQ ID NO: 2734249 - DNA, 18 bp, Homo sapiens
tgctatgcatgtctgacc

SEQ ID NO: 2734250 - DNA, 18 bp, Homo sapiens
tgctattcagataaggca

SEQ ID NO: 2734251 - DNA, 22 bp, Homo sapiens
tgctattttaataaagattcta

SEQ ID NO: 2734252 - DNA, 18 bp, Homo sapiens
tgctcacgactcttcctg

SEQ ID NO: 2734253 - DNA, 23 bp, Homo sapiens
tgctcacgactcttcctgcaaag

SEQ ID NO: 2734254 - DNA, 16 bp, Homo sapiens
tgctcattgtggccag

SEQ ID NO: 2734255 - DNA, 13 bp, Homo sapiens
tgctccacagtgt

SEQ ID NO: 2734256 - DNA, 16 bp, Homo sapiens
tgctcttaaaaatctt

SEQ ID NO: 2734257 - DNA, 22 bp, Homo sapiens
tgctcttacttcccccaccctg

SEQ ID NO: 2734258 - DNA, 13 bp, Homo sapiens
tgctgaaatctat

SEQ ID NO: 2734259 - DNA, 13 bp, Homo sapiens
tgctgaatgaatc

SEQ ID NO: 2734260 - DNA, 20 bp, Homo sapiens
tgctgaatgtcattatttga

SEQ ID NO: 2734261 - DNA, 13 bp, Homo sapiens
tgctgacccacca

SEQ ID NO: 2734262 - DNA, 13 bp, Homo sapiens
tcctagagctcct

SEQ ID NO: 2734263 - DNA, 14 bp, Homo sapiens
tcctagagctcctg

SEQ ID NO: 2734264 - DNA, 21 bp, Homo sapiens
tcctagagctcctgtccctac

SEQ ID NO: 2734265 - DNA, 22 bp, Homo sapiens
tcctagagctcctgtccctacc

SEQ ID NO: 2734266 - DNA, 15 bp, Homo sapiens
tcctagcccagcaga

SEQ ID NO: 2734267 - DNA, 22 bp, Homo sapiens
tcctatccttggagagcagctg

SEQ ID NO: 2734268 - DNA, 13 bp, Homo sapiens
tcctcacactcca

SEQ ID NO: 2734269 - DNA, 14 bp, Homo sapiens
tcctcacactccag

SEQ ID NO: 2734270 - DNA, 18 bp, Homo sapiens
tcctcacagcctctccct

SEQ ID NO: 2734271 - DNA, 19 bp, Homo sapiens
tcctcacagcctctccctt

SEQ ID NO: 2734272 - DNA, 19 bp, Homo sapiens
tcctcaccttttcccgggg

SEQ ID NO: 2734273 - DNA, 22 bp, Homo sapiens
tcctcaccttttcccggggagg

SEQ ID NO: 2734274 - DNA, 16 bp, Homo sapiens
tcctcatctgtgcctg

SEQ ID NO: 2734275 - DNA, 19 bp, Homo sapiens
tcctccaacaataaagagc

SEQ ID NO: 2734276 - DNA, 22 bp, Homo sapiens
tcctccaccgccatggcttcca

SEQ ID NO: 2734277 - DNA, 23 bp, Homo sapiens
tcctccaccgccatggcttccaa

SEQ ID NO: 2734278 - DNA, 13 bp, Homo sapiens
tcctccactccac

SEQ ID NO: 2734279 - DNA, 16 bp, Homo sapiens
tcctcccaccagtggc

SEQ ID NO: 2734280 - DNA, 21 bp, Homo sapiens
tcctcccaccagtggccccca

SEQ ID NO: 2734281 - DNA, 14 bp, Homo sapiens
tcctcccatggcct

SEQ ID NO: 2734282 - DNA, 14 bp, Homo sapiens
tcctccccaccaga

SEQ ID NO: 2734283 - DNA, 19 bp, Homo sapiens
tcctccccaccagagctgc

SEQ ID NO: 2734284 - DNA, 20 bp, Homo sapiens
tcctccccaccagagctgcc

SEQ ID NO: 2734285 - DNA, 21 bp, Homo sapiens
tcctccccaccagagctgcct

SEQ ID NO: 2734286 - DNA, 23 bp, Homo sapiens
tcctccccaccagagctgcctcc

SEQ ID NO: 2734287 - DNA, 10 bp, Homo sapiens
tcctcccctg

SEQ ID NO: 2734288 - DNA, 17 bp, Homo sapiens
tcctcccctgccgcctc

SEQ ID NO: 2734289 - DNA, 20 bp, Homo sapiens
tcctcccctgccgcctcccg

SEQ ID NO: 2734290 - DNA, 13 bp, Homo sapiens
tcctccctctgcc

SEQ ID NO: 2734291 - DNA, 23 bp, Homo sapiens
tcctccctctgcctcatcctcct

SEQ ID NO: 2734292 - DNA, 20 bp, Homo sapiens
tcctccctgttatctgctag

SEQ ID NO: 2734293 - DNA, 13 bp, Homo sapiens
tcctcctcctcat

SEQ ID NO: 2734294 - DNA, 15 bp, Homo sapiens
tcctcctctccatgc

SEQ ID NO: 2734295 - DNA, 17 bp, Homo sapiens
tcctcctctccatgcaa

SEQ ID NO: 2734296 - DNA, 21 bp, Homo sapiens
tcctcctctccatgcaagtgc

SEQ ID NO: 2734297 - DNA, 16 bp, Homo sapiens
tcctcctgccagctct

SEQ ID NO: 2734298 - DNA, 17 bp, Homo sapiens
tcctcctgccagctctg

SEQ ID NO: 2734299 - DNA, 19 bp, Homo sapiens
tcctcgcactgcccaggga

SEQ ID NO: 2734300 - DNA, 20 bp, Homo sapiens
tcctcggcccatctgtccat

SEQ ID NO: 2734301 - DNA, 23 bp, Homo sapiens
tcctcggcccatctgtccatcct

SEQ ID NO: 2734302 - DNA, 14 bp, Homo sapiens
tcctctatttcttt

SEQ ID NO: 2734303 - DNA, 18 bp, Homo sapiens
tcctctcagagcctcagc

SEQ ID NO: 2734304 - DNA, 15 bp, Homo sapiens
tcctctgaatattaa

SEQ ID NO: 2734305 - DNA, 14 bp, Homo sapiens
tcctctgagccgca

SEQ ID NO: 2734306 - DNA, 15 bp, Homo sapiens
tcctgaactggccac

SEQ ID NO: 2734307 - DNA, 20 bp, Homo sapiens
tcctgaagtgtcgagtccag

SEQ ID NO: 2734308 - DNA, 21 bp, Homo sapiens
tcctgaagtgtcgagtccagt

SEQ ID NO: 2734309 - DNA, 22 bp, Homo sapiens
tcctgaatttattattgttctt

SEQ ID NO: 2734310 - DNA, 17 bp, Homo sapiens
tcctgacacattttcaa

SEQ ID NO: 2734311 - DNA, 20 bp, Homo sapiens
tcctgacccggattggccct

SEQ ID NO: 2734312 - DNA, 22 bp, Homo sapiens
tcctgacccggattggccctgc

SEQ ID NO: 2734313 - DNA, 21 bp, Homo sapiens
tcctgaggagtgtcctgtctg

SEQ ID NO: 2734314 - DNA, 13 bp, Homo sapiens
tcctgaggctgag

SEQ ID NO: 2734315 - DNA, 16 bp, Homo sapiens
tcctgagtagctggga

SEQ ID NO: 2734316 - DNA, 17 bp, Homo sapiens
tcctgcaaagggaactg

SEQ ID NO: 2734317 - DNA, 23 bp, Homo sapiens
tcctgcagcctgaccccaggcag

SEQ ID NO: 2734318 - DNA, 24 bp, Homo sapiens
tcctgcagcctgaccccaggcagc

SEQ ID NO: 2734319 - DNA, 13 bp, Homo sapiens
tcctgccagctct

SEQ ID NO: 2734320 - DNA, 14 bp, Homo sapiens
tcctgccagctctg

SEQ ID NO: 2734321 - DNA, 17 bp, Homo sapiens
tcctgccagctctgtca

SEQ ID NO: 2734322 - DNA, 18 bp, Homo sapiens
tcctgccagctctgtcac

SEQ ID NO: 2734323 - DNA, 18 bp, Homo sapiens
tcctgccgtccctcctgt

SEQ ID NO: 2734324 - DNA, 17 bp, Homo sapiens
tcctgcctcagcctcct

SEQ ID NO: 2734325 - DNA, 19 bp, Homo sapiens
tcctgcctcagcctcctga

SEQ ID NO: 2734326 - DNA, 21 bp, Homo sapiens
tcctgcctcagcctcctgagt

SEQ ID NO: 2734327 - DNA, 15 bp, Homo sapiens
tcctgctccacagtg

SEQ ID NO: 2734328 - DNA, 21 bp, Homo sapiens
tcctgctccatcggggaatga

SEQ ID NO: 2734329 - DNA, 13 bp, Homo sapiens
tcctgctgcacca

SEQ ID NO: 2734330 - DNA, 19 bp, Homo sapiens
tcctgctgcaccaacccag

SEQ ID NO: 2734331 - DNA, 13 bp, Homo sapiens
tcctgctggcctg

SEQ ID NO: 2734332 - DNA, 14 bp, Homo sapiens
tcctgctggcctgc

SEQ ID NO: 2734333 - DNA, 21 bp, Homo sapiens
tcctgctggcctgctcttact

SEQ ID NO: 2734334 - DNA, 16 bp, Homo sapiens
tcctggaaaggctcag

SEQ ID NO: 2734335 - DNA, 22 bp, Homo sapiens
tcctggaaaggctcagtctcag

SEQ ID NO: 2734336 - DNA, 20 bp, Homo sapiens
tcctggaaccggtcacagga

SEQ ID NO: 2734337 - DNA, 14 bp, Homo sapiens
tcctggaccctggc

SEQ ID NO: 2734338 - DNA, 13 bp, Homo sapiens
tcctggacctgaa

SEQ ID NO: 2734339 - DNA, 11 bp, Homo sapiens
tcctggcccat

SEQ ID NO: 2734340 - DNA, 13 bp, Homo sapiens
tcctggcccatca

SEQ ID NO: 2734341 - DNA, 12 bp, Homo sapiens
tcctggccctct

SEQ ID NO: 2734342 - DNA, 18 bp, Homo sapiens
tcctggcctcatacagaa

SEQ ID NO: 2734343 - DNA, 20 bp, Homo sapiens
tcctgggagaacctcaggct

SEQ ID NO: 2734344 - DNA, 14 bp, Homo sapiens
tcctgggcccccag

SEQ ID NO: 2734345 - DNA, 15 bp, Homo sapiens
tcctggtacagcagg

SEQ ID NO: 2734346 - DNA, 17 bp, Homo sapiens
tcctggtgaggcccagc

SEQ ID NO: 2734347 - DNA, 18 bp, Homo sapiens
tcctggtgaggcccagcc

SEQ ID NO: 2734348 - DNA, 19 bp, Homo sapiens
tcctggtgaggcccagcct

SEQ ID NO: 2734349 - DNA, 14 bp, Homo sapiens
tcctggtttgtaat

SEQ ID NO: 2734350 - DNA, 14 bp, Homo sapiens
tcctgtcagtgccg

SEQ ID NO: 2734351 - DNA, 13 bp, Homo sapiens
tcctgtccctacc

SEQ ID NO: 2734352 - DNA, 15 bp, Homo sapiens
tcctgtctgctgggc

SEQ ID NO: 2734353 - DNA, 16 bp, Homo sapiens
tcctgtctgctgggct

SEQ ID NO: 2734354 - DNA, 18 bp, Homo sapiens
tcctgtctgctgggctac

SEQ ID NO: 2734355 - DNA, 20 bp, Homo sapiens
tcctgtctgtatataactta

SEQ ID NO: 2734356 - DNA, 22 bp, Homo sapiens
tcctgtgggggaagagcacagc

SEQ ID NO: 2734357 - DNA, 18 bp, Homo sapiens
tcctgttctttgggctca

SEQ ID NO: 2734358 - DNA, 17 bp, Homo sapiens
tcctgttgtgtaataac

SEQ ID NO: 2734359 - DNA, 19 bp, Homo sapiens
tccttaattcactcccaca

SEQ ID NO: 2734360 - DNA, 18 bp, Homo sapiens
tccttactcagagctgcg

SEQ ID NO: 2734361 - DNA, 19 bp, Homo sapiens
tccttactcagagctgcgg

SEQ ID NO: 2734362 - DNA, 20 bp, Homo sapiens
tccttccccttgtccctggg

SEQ ID NO: 2734363 - DNA, 21 bp, Homo sapiens
tccttcctacacccttggact

SEQ ID NO: 2734364 - DNA, 16 bp, Homo sapiens
tccttgaaacagaaaa

SEQ ID NO: 2734365 - DNA, 20 bp, Homo sapiens
tccttggagagcagctggct

SEQ ID NO: 2734366 - DNA, 22 bp, Homo sapiens
tcctttcagggaatttcaggaa

SEQ ID NO: 2734367 - DNA, 15 bp, Homo sapiens
tcctttgttgctgtt

SEQ ID NO: 2734368 - DNA, 16 bp, Homo sapiens
tcctttgttgctgttg

SEQ ID NO: 2734369 - DNA, 15 bp, Homo sapiens
tcgaatttttattat

SEQ ID NO: 2734370 - DNA, 20 bp, Homo sapiens
tcgaatttttattatttgtt

SEQ ID NO: 2734371 - DNA, 19 bp, Homo sapiens
tcgagaccagcctggccaa

SEQ ID NO: 2734372 - DNA, 14 bp, Homo sapiens
tcgaggtgtcaccc

SEQ ID NO: 2734373 - DNA, 17 bp, Homo sapiens
tcgaggtgtcaccctgc

SEQ ID NO: 2734374 - DNA, 20 bp, Homo sapiens
tcgaggtgtcaccctgcaga

SEQ ID NO: 2734375 - DNA, 16 bp, Homo sapiens
tcgaggtttctcaaag

SEQ ID NO: 2734376 - DNA, 23 bp, Homo sapiens
tcgagtccagtcctttgttgctg

SEQ ID NO: 2734377 - DNA, 23 bp, Homo sapiens
tcgcaatagttttttacttctct

SEQ ID NO: 2734378 - DNA, 21 bp, Homo sapiens
tcgcaccactgtgtatttaac

SEQ ID NO: 2734379 - DNA, 12 bp, Homo sapiens
tcgcacctcctt

SEQ ID NO: 2734380 - DNA, 14 bp, Homo sapiens
tcgcccaccgcatg

SEQ ID NO: 2734381 - DNA, 21 bp, Homo sapiens
tcgcccaccgcatgccccctc

SEQ ID NO: 2734382 - DNA, 14 bp, Homo sapiens
tcgccccacccagg

SEQ ID NO: 2734383 - DNA, 17 bp, Homo sapiens
tcgccctggccagggcc

SEQ ID NO: 2734384 - DNA, 17 bp, Homo sapiens
tcgctctgctgcccagg

SEQ ID NO: 2734385 - DNA, 22 bp, Homo sapiens
tcgctgatgctgggctgggtgc

SEQ ID NO: 2734386 - DNA, 14 bp, Homo sapiens
tcgctggacaaccc

SEQ ID NO: 2734387 - DNA, 17 bp, Homo sapiens
tcgcttgttttaaaagg

SEQ ID NO: 2734388 - DNA, 12 bp, Homo sapiens
ctgttctccaga

SEQ ID NO: 2734389 - DNA, 13 bp, Homo sapiens
ctgttctccagat

SEQ ID NO: 2734390 - DNA, 18 bp, Homo sapiens
ctgttgaatgcctgtccc

SEQ ID NO: 2734391 - DNA, 14 bp, Homo sapiens
ctgttgctgttggc

SEQ ID NO: 2734392 - DNA, 22 bp, Homo sapiens
ctgttgttgttacttccctcca

SEQ ID NO: 2734393 - DNA, 12 bp, Homo sapiens
ctgttgtttgaa

SEQ ID NO: 2734394 - DNA, 22 bp, Homo sapiens
ctgtttaaaaaaagtatatatt

SEQ ID NO: 2734395 - DNA, 16 bp, Homo sapiens
ctgtttcatgagccca

SEQ ID NO: 2734396 - DNA, 16 bp, Homo sapiens
ctgtttgggcaggagt

SEQ ID NO: 2734397 - DNA, 16 bp, Homo sapiens
ctgtttttaacatgtg

SEQ ID NO: 2734398 - DNA, 23 bp, Homo sapiens
cttaaaaatcttggtttggtaca

SEQ ID NO: 2734399 - DNA, 22 bp, Homo sapiens
cttaaaaattaaattctctcta

SEQ ID NO: 2734400 - DNA, 17 bp, Homo sapiens
cttaaggccacactggc

SEQ ID NO: 2734401 - DNA, 22 bp, Homo sapiens
cttaaggccacactggcatctc

SEQ ID NO: 2734402 - DNA, 13 bp, Homo sapiens
cttacaaaagcag

SEQ ID NO: 2734403 - DNA, 17 bp, Homo sapiens
cttacaaaagcagcttt

SEQ ID NO: 2734404 - DNA, 18 bp, Homo sapiens
cttacagttttaaattct

SEQ ID NO: 2734405 - DNA, 21 bp, Homo sapiens
cttacccttggtttgcacata

SEQ ID NO: 2734406 - DNA, 23 bp, Homo sapiens
cttacccttggtttgcacataaa

SEQ ID NO: 2734407 - DNA, 13 bp, Homo sapiens
cttactcagagct

SEQ ID NO: 2734408 - DNA, 16 bp, Homo sapiens
cttactcagagctgcg

SEQ ID NO: 2734409 - DNA, 21 bp, Homo sapiens
cttacttcccccaccctgggt

SEQ ID NO: 2734410 - DNA, 12 bp, Homo sapiens
cttactttgtgc

SEQ ID NO: 2734411 - DNA, 23 bp, Homo sapiens
cttactttgtgcaaaagcaggct

SEQ ID NO: 2734412 - DNA, 13 bp, Homo sapiens
cttagaaacatgt

SEQ ID NO: 2734413 - DNA, 15 bp, Homo sapiens
cttagaaacatgttc

SEQ ID NO: 2734414 - DNA, 11 bp, Homo sapiens
cttagaataaa

SEQ ID NO: 2734415 - DNA, 16 bp, Homo sapiens
cttagaataaaattgt

SEQ ID NO: 2734416 - DNA, 17 bp, Homo sapiens
cttagaataaaattgta

SEQ ID NO: 2734417 - DNA, 16 bp, Homo sapiens
cttaggatttaccaaa

SEQ ID NO: 2734418 - DNA, 18 bp, Homo sapiens
cttaggtgccaggctgta

SEQ ID NO: 2734419 - DNA, 20 bp, Homo sapiens
cttaggtggctctgggaatg

SEQ ID NO: 2734420 - DNA, 14 bp, Homo sapiens
cttataggtttcca

SEQ ID NO: 2734421 - DNA, 20 bp, Homo sapiens
cttattcatgctttctcctt

SEQ ID NO: 2734422 - DNA, 18 bp, Homo sapiens
cttattgagcgtgattct

SEQ ID NO: 2734423 - DNA, 18 bp, Homo sapiens
cttatttatattcatcaa

SEQ ID NO: 2734424 - DNA, 12 bp, Homo sapiens
cttatttgagtg

SEQ ID NO: 2734425 - DNA, 13 bp, Homo sapiens
cttatttgagtga

SEQ ID NO: 2734426 - DNA, 19 bp, Homo sapiens
cttcaagttagctcaggag

SEQ ID NO: 2734427 - DNA, 20 bp, Homo sapiens
cttcaagttagctcaggagg

SEQ ID NO: 2734428 - DNA, 12 bp, Homo sapiens
cttcacatgaaa

SEQ ID NO: 2734429 - DNA, 13 bp, Homo sapiens
cttcacgcctggg

SEQ ID NO: 2734430 - DNA, 14 bp, Homo sapiens
cttcactccggtgt

SEQ ID NO: 2734431 - DNA, 19 bp, Homo sapiens
cttcactccggtgtgcctg

SEQ ID NO: 2734432 - DNA, 14 bp, Homo sapiens
cttcactgcagcct

SEQ ID NO: 2734433 - DNA, 14 bp, Homo sapiens
cttcagcctgaggc

SEQ ID NO: 2734434 - DNA, 11 bp, Homo sapiens
cttcagctggt

SEQ ID NO: 2734435 - DNA, 12 bp, Homo sapiens
cttcagctggtg

SEQ ID NO: 2734436 - DNA, 19 bp, Homo sapiens
cttcaggagctgacagagc

SEQ ID NO: 2734437 - DNA, 22 bp, Homo sapiens
cttcaggggactgttctcacct

SEQ ID NO: 2734438 - DNA, 20 bp, Homo sapiens
cttcaggggctgcccgctcc

SEQ ID NO: 2734439 - DNA, 22 bp, Homo sapiens
cttcatcccttgcttaagaatc

SEQ ID NO: 2734440 - DNA, 18 bp, Homo sapiens
cttccaaatcaggctggg

SEQ ID NO: 2734441 - DNA, 13 bp, Homo sapiens
cttccaaccccag

SEQ ID NO: 2734442 - DNA, 14 bp, Homo sapiens
cttccaaccccagc

SEQ ID NO: 2734443 - DNA, 21 bp, Homo sapiens
cttccaaccccagctggcctc

SEQ ID NO: 2734444 - DNA, 16 bp, Homo sapiens
cttccaccagagcagg

SEQ ID NO: 2734445 - DNA, 23 bp, Homo sapiens
cttccaccagagcaggggctgct

SEQ ID NO: 2734446 - DNA, 24 bp, Homo sapiens
cttccaccagagcaggggctgctg

SEQ ID NO: 2734447 - DNA, 17 bp, Homo sapiens
cttccagcttcctctga

SEQ ID NO: 2734448 - DNA, 21 bp, Homo sapiens
cttccagcttcctctgagccg

SEQ ID NO: 2734449 - DNA, 17 bp, Homo sapiens
cttccatttctactgta

SEQ ID NO: 2734450 - DNA, 18 bp, Homo sapiens
cttcccaagtagctgaga

SEQ ID NO: 2734451 - DNA, 13 bp, Homo sapiens
cttcccccaaggc

SEQ ID NO: 2734452 - DNA, 16 bp, Homo sapiens
cttccccctcccaggg

SEQ ID NO: 2734453 - DNA, 13 bp, Homo sapiens
cttcccctcctac

SEQ ID NO: 2734454 - DNA, 20 bp, Homo sapiens
cttccccttgtccctggggc

SEQ ID NO: 2734455 - DNA, 22 bp, Homo sapiens
cttccccttgtccctggggcac

SEQ ID NO: 2734456 - DNA, 13 bp, Homo sapiens
cttccctgctttt

SEQ ID NO: 2734457 - DNA, 20 bp, Homo sapiens
cttccctgcttttctcccag

SEQ ID NO: 2734458 - DNA, 12 bp, Homo sapiens
cttccctgggcc

SEQ ID NO: 2734459 - DNA, 14 bp, Homo sapiens
cttccctgggcctc

SEQ ID NO: 2734460 - DNA, 21 bp, Homo sapiens
cttccctgggcctcagcctcc

SEQ ID NO: 2734461 - DNA, 12 bp, Homo sapiens
cttccctggggc

SEQ ID NO: 2734462 - DNA, 15 bp, Homo sapiens
cttccctggggcccc

SEQ ID NO: 2734463 - DNA, 11 bp, Homo sapiens
cttcctcatct

SEQ ID NO: 2734464 - DNA, 17 bp, Homo sapiens
cttcctcatctgtgcct

SEQ ID NO: 2734465 - DNA, 20 bp, Homo sapiens
cttcctcatctgtgcctgtc

SEQ ID NO: 2734466 - DNA, 19 bp, Homo sapiens
cttcctgacccggattggc

SEQ ID NO: 2734467 - DNA, 21 bp, Homo sapiens
cttcctgacccggattggccc

SEQ ID NO: 2734468 - DNA, 16 bp, Homo sapiens
cttcctgcctagtctc

SEQ ID NO: 2734469 - DNA, 17 bp, Homo sapiens
cttcctggaccggggcc

SEQ ID NO: 2734470 - DNA, 18 bp, Homo sapiens
cttcctggtgaggcccag

SEQ ID NO: 2734471 - DNA, 23 bp, Homo sapiens
cttcctggtgaggcccagcctgt

SEQ ID NO: 2734472 - DNA, 24 bp, Homo sapiens
cttcctggtgaggcccagcctgtc

SEQ ID NO: 2734473 - DNA, 21 bp, Homo sapiens
cttctaatccatgtgctgctg

SEQ ID NO: 2734474 - DNA, 18 bp, Homo sapiens
cttctattaacaaattat

SEQ ID NO: 2734475 - DNA, 19 bp, Homo sapiens
cttctcagagcagcactgg

SEQ ID NO: 2734476 - DNA, 12 bp, Homo sapiens
cttctccagcaa

SEQ ID NO: 2734477 - DNA, 17 bp, Homo sapiens
cttctccagcaagcagt

SEQ ID NO: 2734478 - DNA, 21 bp, Homo sapiens
cttctccagcaagcagtgccc

SEQ ID NO: 2734479 - DNA, 22 bp, Homo sapiens
cttctcccccccggggctgggt

SEQ ID NO: 2734480 - DNA, 15 bp, Homo sapiens
cttctcccggacctg

SEQ ID NO: 2734481 - DNA, 17 bp, Homo sapiens
cttctctcccacgtgca

SEQ ID NO: 2734482 - DNA, 14 bp, Homo sapiens
cttctgcagctttg

SEQ ID NO: 2734483 - DNA, 16 bp, Homo sapiens
cttctgcagctttggc

SEQ ID NO: 2734484 - DNA, 18 bp, Homo sapiens
cttctgccacttcccagg

SEQ ID NO: 2734485 - DNA, 20 bp, Homo sapiens
cttctgccacttcccaggta

SEQ ID NO: 2734486 - DNA, 13 bp, Homo sapiens
cttctgcctcagc

SEQ ID NO: 2734487 - DNA, 14 bp, Homo sapiens
cttctgctgggctg

SEQ ID NO: 2734488 - DNA, 22 bp, Homo sapiens
cttctggctttgttcttgtcat

SEQ ID NO: 2734489 - DNA, 22 bp, Homo sapiens
cttctgtatgtgacaacatttt

SEQ ID NO: 2734490 - DNA, 18 bp, Homo sapiens
cttcttgtgtcctgatga

SEQ ID NO: 2734491 - DNA, 17 bp, Homo sapiens
cttctttaattgatcta

SEQ ID NO: 2734492 - DNA, 21 bp, Homo sapiens
cttgaaacctttctacttttt

SEQ ID NO: 2734493 - DNA, 18 bp, Homo sapiens
cttgaacatgttttgtat

SEQ ID NO: 2734494 - DNA, 23 bp, Homo sapiens
cttgaagaggcaggtctgggcca

SEQ ID NO: 2734495 - DNA, 19 bp, Homo sapiens
cttgaagccactgaagctg

SEQ ID NO: 2734496 - DNA, 21 bp, Homo sapiens
cttgaagccactgaagctggg

SEQ ID NO: 2734497 - DNA, 19 bp, Homo sapiens
cttgaattttcccactgca

SEQ ID NO: 2734498 - DNA, 20 bp, Homo sapiens
cttgaattttcccactgcac

SEQ ID NO: 2734499 - DNA, 22 bp, Homo sapiens
cttgaattttcccactgcaccc

SEQ ID NO: 2734500 - DNA, 19 bp, Homo sapiens
cttgagaaaatgcaggaga

SEQ ID NO: 2734501 - DNA, 13 bp, Homo sapiens
cttgagcagaccg

SEQ ID NO: 2734502 - DNA, 16 bp, Homo sapiens
cttgaggattttgagt

SEQ ID NO: 2734503 - DNA, 14 bp, Homo sapiens
cttgattaaacagc

SEQ ID NO: 2734504 - DNA, 19 bp, Homo sapiens
cttgcacgtattttaatag

SEQ ID NO: 2734505 - DNA, 14 bp, Homo sapiens
cttgccaagaaatc

SEQ ID NO: 2734506 - DNA, 17 bp, Homo sapiens
cttgccccaacccccag

SEQ ID NO: 2734507 - DNA, 20 bp, Homo sapiens
cttgccccaacccccagcac

SEQ ID NO: 2734508 - DNA, 17 bp, Homo sapiens
cttgcccggattctggg

SEQ ID NO: 2734509 - DNA, 18 bp, Homo sapiens
cttgcctcggctcctgct

SEQ ID NO: 2734510 - DNA, 21 bp, Homo sapiens
gacagcggggaaggtttttat

SEQ ID NO: 2734511 - DNA, 17 bp, Homo sapiens
gacagtcctctccacct

SEQ ID NO: 2734512 - DNA, 15 bp, Homo sapiens
gacagtcctgggaga

SEQ ID NO: 2734513 - DNA, 18 bp, Homo sapiens
gacagtgacgtgactcag

SEQ ID NO: 2734514 - DNA, 21 bp, Homo sapiens
gacagtgacgtgactcagagc

SEQ ID NO: 2734515 - DNA, 13 bp, Homo sapiens
gacagtggcacta

SEQ ID NO: 2734516 - DNA, 15 bp, Homo sapiens
gacagtggcactaaa

SEQ ID NO: 2734517 - DNA, 21 bp, Homo sapiens
gacatatgttaggaatactct

SEQ ID NO: 2734518 - DNA, 13 bp, Homo sapiens
gacatcgatatga

SEQ ID NO: 2734519 - DNA, 18 bp, Homo sapiens
gacatgctctccccacag

SEQ ID NO: 2734520 - DNA, 13 bp, Homo sapiens
tccagaattgaga

SEQ ID NO: 2734521 - DNA, 22 bp, Homo sapiens
tccagaccattgtcttccaacc

SEQ ID NO: 2734522 - DNA, 21 bp, Homo sapiens
tccagactgcggagcagcctc

SEQ ID NO: 2734523 - DNA, 22 bp, Homo sapiens
tccagcctcacagatgctggcc

SEQ ID NO: 2734524 - DNA, 19 bp, Homo sapiens
tccagctaagcctgatgat

SEQ ID NO: 2734525 - DNA, 20 bp, Homo sapiens
tccagcttcctctgagccgc

SEQ ID NO: 2734526 - DNA, 23 bp, Homo sapiens
tccaggctcctcatgaggccatg

SEQ ID NO: 2734527 - DNA, 16 bp, Homo sapiens
tccaggcttctcccgg

SEQ ID NO: 2734528 - DNA, 17 bp, Homo sapiens
tccaggcttctcccgga

SEQ ID NO: 2734529 - DNA, 20 bp, Homo sapiens
tccaggcttctcccggacct

SEQ ID NO: 2734530 - DNA, 22 bp, Homo sapiens
tccaggcttctcccggacctgg

SEQ ID NO: 2734531 - DNA, 17 bp, Homo sapiens
tccagggacagaagcag

SEQ ID NO: 2734532 - DNA, 18 bp, Homo sapiens
tccagggacagaagcagg

SEQ ID NO: 2734533 - DNA, 21 bp, Homo sapiens
tccaggggagggaaaagctaa

SEQ ID NO: 2734534 - DNA, 17 bp, Homo sapiens
tccaggtaactttgctt

SEQ ID NO: 2734535 - DNA, 16 bp, Homo sapiens
tccaggtggggtgagg

SEQ ID NO: 2734536 - DNA, 21 bp, Homo sapiens
tccaggtggggtgaggcagtg

SEQ ID NO: 2734537 - DNA, 23 bp, Homo sapiens
tccagtagggaaaatagggtcct

SEQ ID NO: 2734538 - DNA, 22 bp, Homo sapiens
tccagtcaaagcggatgctggc

SEQ ID NO: 2734539 - DNA, 13 bp, Homo sapiens
tccagtcctgctg

SEQ ID NO: 2734540 - DNA, 18 bp, Homo sapiens
tccagtcctgctggcctg

SEQ ID NO: 2734541 - DNA, 19 bp, Homo sapiens
tccagtcctttgttgctgt

SEQ ID NO: 2734542 - DNA, 13 bp, Homo sapiens
tccagtctgcaga

SEQ ID NO: 2734543 - DNA, 12 bp, Homo sapiens
tccagtgctggc

SEQ ID NO: 2734544 - DNA, 13 bp, Homo sapiens
tccagtgctggct

SEQ ID NO: 2734545 - DNA, 19 bp, Homo sapiens
tccagtgctggctgctggc

SEQ ID NO: 2734546 - DNA, 21 bp, Homo sapiens
tccagtgctggctgctggccc

SEQ ID NO: 2734547 - DNA, 16 bp, Homo sapiens
tccagtgtattttctg

SEQ ID NO: 2734548 - DNA, 14 bp, Homo sapiens
tccagtttccaaag

SEQ ID NO: 2734549 - DNA, 12 bp, Homo sapiens
tccagttttgtt

SEQ ID NO: 2734550 - DNA, 21 bp, Homo sapiens
tccataaagtaattttgtgaa

SEQ ID NO: 2734551 - DNA, 22 bp, Homo sapiens
tccatgatactttaatttttat

SEQ ID NO: 2734552 - DNA, 18 bp, Homo sapiens
tccattccttcacatagt

SEQ ID NO: 2734553 - DNA, 14 bp, Homo sapiens
tccatttctactgt

SEQ ID NO: 2734554 - DNA, 16 bp, Homo sapiens
tccatttcttatttaa

SEQ ID NO: 2734555 - DNA, 14 bp, Homo sapiens
tccattttcttgtc

SEQ ID NO: 2734556 - DNA, 20 bp, Homo sapiens
tcccaaagtgctgggattac

SEQ ID NO: 2734557 - DNA, 12 bp, Homo sapiens
tcccaagcaaag

SEQ ID NO: 2734558 - DNA, 17 bp, Homo sapiens
tcccaagtgccagtctt

SEQ ID NO: 2734559 - DNA, 23 bp, Homo sapiens
tcccacagtgactcgggctcctg

SEQ ID NO: 2734560 - DNA, 20 bp, Homo sapiens
tcccaccaggcagctccagc

SEQ ID NO: 2734561 - DNA, 13 bp, Homo sapiens
tcccacccaggaa

SEQ ID NO: 2734562 - DNA, 21 bp, Homo sapiens
tcccacggggaccactgggcc

SEQ ID NO: 2734563 - DNA, 19 bp, Homo sapiens
tcccacgtgcacagcttcc

SEQ ID NO: 2734564 - DNA, 20 bp, Homo sapiens
tcccactaagctttctcctt

SEQ ID NO: 2734565 - DNA, 20 bp, Homo sapiens
tcccactatgcctgatgtga

SEQ ID NO: 2734566 - DNA, 13 bp, Homo sapiens
tcccactcctaat

SEQ ID NO: 2734567 - DNA, 18 bp, Homo sapiens
tcccactgcaccccctcc

SEQ ID NO: 2734568 - DNA, 20 bp, Homo sapiens
tcccactgcaccccctcctg

SEQ ID NO: 2734569 - DNA, 15 bp, Homo sapiens
tcccacttcccctcc

SEQ ID NO: 2734570 - DNA, 14 bp, Homo sapiens
tcccagacagctgg

SEQ ID NO: 2734571 - DNA, 15 bp, Homo sapiens
tcccagcctggccac

SEQ ID NO: 2734572 - DNA, 16 bp, Homo sapiens
tcccagcctggccacc

SEQ ID NO: 2734573 - DNA, 16 bp, Homo sapiens
tcccagctattcagga

SEQ ID NO: 2734574 - DNA, 23 bp, Homo sapiens
tcccagctattcaggaggctgag

SEQ ID NO: 2734575 - DNA, 17 bp, Homo sapiens
tcccagctgacagtcct

SEQ ID NO: 2734576 - DNA, 18 bp, Homo sapiens
tcccaggagcaaatgctg

SEQ ID NO: 2734577 - DNA, 12 bp, Homo sapiens
tcccagtgacaa

SEQ ID NO: 2734578 - DNA, 14 bp, Homo sapiens
tcccagtgagcctc

SEQ ID NO: 2734579 - DNA, 16 bp, Homo sapiens
tcccagtgagcctctg

SEQ ID NO: 2734580 - DNA, 20 bp, Homo sapiens
tcccagtgtcttcctgtggg

SEQ ID NO: 2734581 - DNA, 18 bp, Homo sapiens
tcccatctaagctgcagc

SEQ ID NO: 2734582 - DNA, 15 bp, Homo sapiens
tcccatggccttccc

SEQ ID NO: 2734583 - DNA, 16 bp, Homo sapiens
tcccatggccttccct

SEQ ID NO: 2734584 - DNA, 13 bp, Homo sapiens
tcccatgtgcatg

SEQ ID NO: 2734585 - DNA, 16 bp, Homo sapiens
tccccaccagagctgc

SEQ ID NO: 2734586 - DNA, 18 bp, Homo sapiens
tccccaccagagctgcct

SEQ ID NO: 2734587 - DNA, 12 bp, Homo sapiens
tccccagctcca

SEQ ID NO: 2734588 - DNA, 21 bp, Homo sapiens
tccccattagagtcagccttc

SEQ ID NO: 2734589 - DNA, 22 bp, Homo sapiens
tcccccactcctcttatttgct

SEQ ID NO: 2734590 - DNA, 15 bp, Homo sapiens
tcccccagagccact

SEQ ID NO: 2734591 - DNA, 17 bp, Homo sapiens
tccccctaccgcatggc

SEQ ID NO: 2734592 - DNA, 22 bp, Homo sapiens
tccccctaccgcatggcagctg

SEQ ID NO: 2734593 - DNA, 17 bp, Homo sapiens
tccccctcccagggcca

SEQ ID NO: 2734594 - DNA, 15 bp, Homo sapiens
tccccctgggctctg

SEQ ID NO: 2734595 - DNA, 20 bp, Homo sapiens
tccccctgggctctgcccca

SEQ ID NO: 2734596 - DNA, 22 bp, Homo sapiens
tccccctgggctctgccccagc

SEQ ID NO: 2734597 - DNA, 21 bp, Homo sapiens
tccccgagggatgatgccaca

SEQ ID NO: 2734598 - DNA, 16 bp, Homo sapiens
tcccctcacagactct

SEQ ID NO: 2734599 - DNA, 20 bp, Homo sapiens
tcccctcacgtgaccagccc

SEQ ID NO: 2734600 - DNA, 21 bp, Homo sapiens
tcccctcacgtgaccagcccc

SEQ ID NO: 2734601 - DNA, 15 bp, Homo sapiens
tcccctggggctggt

SEQ ID NO: 2734602 - DNA, 12 bp, Homo sapiens
tcccctgtcccc

SEQ ID NO: 2734603 - DNA, 18 bp, Homo sapiens
tcccctgtcccctggggc

SEQ ID NO: 2734604 - DNA, 21 bp, Homo sapiens
tccccttgcccttcctgaccc

SEQ ID NO: 2734605 - DNA, 20 bp, Homo sapiens
tcccgagcaaagtctaaagt

SEQ ID NO: 2734606 - DNA, 20 bp, Homo sapiens
tcccgggaagcatcctcccc

SEQ ID NO: 2734607 - DNA, 15 bp, Homo sapiens
tcccggttcaccttg

SEQ ID NO: 2734608 - DNA, 16 bp, Homo sapiens
tcccgtggccccagcc

SEQ ID NO: 2734609 - DNA, 17 bp, Homo sapiens
tcccgtggccccagcct

SEQ ID NO: 2734610 - DNA, 18 bp, Homo sapiens
tcccgtggccccagcctg

SEQ ID NO: 2734611 - DNA, 20 bp, Homo sapiens
tcccgtggccccagcctggc

SEQ ID NO: 2734612 - DNA, 14 bp, Homo sapiens
tccctacccactct

SEQ ID NO: 2734613 - DNA, 12 bp, Homo sapiens
tccctagatcca

SEQ ID NO: 2734614 - DNA, 16 bp, Homo sapiens
tccctagatccaggct

SEQ ID NO: 2734615 - DNA, 21 bp, Homo sapiens
tccctagatccaggcttctcc

SEQ ID NO: 2734616 - DNA, 17 bp, Homo sapiens
tccctccaagaggctgg

SEQ ID NO: 2734617 - DNA, 12 bp, Homo sapiens
tccctccccaga

SEQ ID NO: 2734618 - DNA, 17 bp, Homo sapiens
tccctcctcacactcca

SEQ ID NO: 2734619 - DNA, 16 bp, Homo sapiens
tccctcctggagcatc

SEQ ID NO: 2734620 - DNA, 23 bp, Homo sapiens
tccctcgaccagaatcagattca

SEQ ID NO: 2734621 - DNA, 12 bp, Homo sapiens
tccctctcggaa

SEQ ID NO: 2734622 - DNA, 22 bp, Homo sapiens
tccctctcggaaggctggctgg

SEQ ID NO: 2734623 - DNA, 13 bp, Homo sapiens
tccctctgcctca

SEQ ID NO: 2734624 - DNA, 16 bp, Homo sapiens
tccctctgcctcatcc

SEQ ID NO: 2734625 - DNA, 18 bp, Homo sapiens
tccctctgcctcatcctc

SEQ ID NO: 2734626 - DNA, 17 bp, Homo sapiens
tccctgaccttctccag

SEQ ID NO: 2734627 - DNA, 19 bp, Homo sapiens
tccctgaccttctccaggg

SEQ ID NO: 2734628 - DNA, 18 bp, Homo sapiens
tccctgactctctgtgac

SEQ ID NO: 2734629 - DNA, 14 bp, Homo sapiens
tccctgctgtcccc

SEQ ID NO: 2734630 - DNA, 18 bp, Homo sapiens
tccctgcttttctcccag

SEQ ID NO: 2734631 - DNA, 19 bp, Homo sapiens
tccctgcttttctcccaga

SEQ ID NO: 2734632 - DNA, 23 bp, Homo sapiens
tccctgcttttctcccagaaggc

SEQ ID NO: 2734633 - DNA, 13 bp, Homo sapiens
tccctgggcctca

SEQ ID NO: 2734634 - DNA, 17 bp, Homo sapiens
tccctggggcactcccc

SEQ ID NO: 2734635 - DNA, 14 bp, Homo sapiens
tccctggggcccca

SEQ ID NO: 2734636 - DNA, 14 bp, Homo sapiens
tccctggtcccttg

SEQ ID NO: 2734637 - DNA, 16 bp, Homo sapiens
tccctggtgcagaggt

SEQ ID NO: 2734638 - DNA, 19 bp, Homo sapiens
tcccttgagtaggccctgc

SEQ ID NO: 2734639 - DNA, 13 bp, Homo sapiens
tcccttttcctct

SEQ ID NO: 2734640 - DNA, 17 bp, Homo sapiens
tcccttttcctctagaa

SEQ ID NO: 2734641 - DNA, 19 bp, Homo sapiens
tccctttttttacatttca

SEQ ID NO: 2734642 - DNA, 22 bp, Homo sapiens
tccgacttgaattttcccactg

SEQ ID NO: 2734643 - DNA, 21 bp, Homo sapiens
tccgctggatggggagtctca

SEQ ID NO: 2734644 - DNA, 12 bp, Homo sapiens
tccggtgtgcct

SEQ ID NO: 2734645 - DNA, 17 bp, Homo sapiens
tccggtgtgcctgcagc

SEQ ID NO: 2734646 - DNA, 19 bp, Homo sapiens
tccggtgtgcctgcagccc

SEQ ID NO: 2734647 - DNA, 13 bp, Homo sapiens
tccgtgagccctt

SEQ ID NO: 2734648 - DNA, 14 bp, Homo sapiens
tccgtgagcccttg

SEQ ID NO: 2734649 - DNA, 17 bp, Homo sapiens
tccgtggcaaccctcag

SEQ ID NO: 2734650 - DNA, 19 bp, Homo sapiens
tccgtggcaaccctcagct

SEQ ID NO: 2734651 - DNA, 15 bp, Homo sapiens
tccgtttattaaaga

SEQ ID NO: 2734652 - DNA, 19 bp, Homo sapiens
tcctaatcatataccagag

SEQ ID NO: 2734653 - DNA, 12 bp, Homo sapiens
tcctacccctcc

SEQ ID NO: 2734654 - DNA, 16 bp, Homo sapiens
tcctacccctcccagc

SEQ ID NO: 2734655 - DNA, 17 bp, Homo sapiens
tcctacccctcccagct

SEQ ID NO: 2734656 - DNA, 15 bp, Homo sapiens
tgggtggcccatccc

SEQ ID NO: 2734657 - DNA, 21 bp, Homo sapiens
tgggtggcccatcccccctca

SEQ ID NO: 2734658 - DNA, 22 bp, Homo sapiens
tgggttggcgcaccctcccctc

SEQ ID NO: 2734659 - DNA, 20 bp, Homo sapiens
tgggtttacaacaaacactg

SEQ ID NO: 2734660 - DNA, 20 bp, Homo sapiens
tgggtttggcccctggaacc

SEQ ID NO: 2734661 - DNA, 19 bp, Homo sapiens
tggtaatttgtatctgaag

SEQ ID NO: 2734662 - DNA, 20 bp, Homo sapiens
tggtacagcagggtcttgct

SEQ ID NO: 2734663 - DNA, 16 bp, Homo sapiens
tggtacatggccagtg

SEQ ID NO: 2734664 - DNA, 18 bp, Homo sapiens
tggtaccaggtctcctcc

SEQ ID NO: 2734665 - DNA, 13 bp, Homo sapiens
tggtagaagccag

SEQ ID NO: 2734666 - DNA, 19 bp, Homo sapiens
tggtcattcctaatgcatt

SEQ ID NO: 2734667 - DNA, 23 bp, Homo sapiens
tggtccttccaggcccccaccac

SEQ ID NO: 2734668 - DNA, 18 bp, Homo sapiens
tggtgaggcccagcctgt

SEQ ID NO: 2734669 - DNA, 21 bp, Homo sapiens
tggtgaggcccagcctgtcct

SEQ ID NO: 2734670 - DNA, 23 bp, Homo sapiens
tggtgaggcccagcctgtcctgg

SEQ ID NO: 2734671 - DNA, 22 bp, Homo sapiens
tggtgaggccggccctgcccct

SEQ ID NO: 2734672 - DNA, 14 bp, Homo sapiens
tggtgaggtgtgga

SEQ ID NO: 2734673 - DNA, 18 bp, Homo sapiens
tggtgcagaggtgagcag

SEQ ID NO: 2734674 - DNA, 11 bp, Homo sapiens
tggtgcattcg

SEQ ID NO: 2734675 - DNA, 22 bp, Homo sapiens
tggtgccagatgtgggctcaga

SEQ ID NO: 2734676 - DNA, 16 bp, Homo sapiens
tggtggacagtcctgg

SEQ ID NO: 2734677 - DNA, 18 bp, Homo sapiens
tggtggacagtcctggga

SEQ ID NO: 2734678 - DNA, 21 bp, Homo sapiens
tggttagagaagtaagcagag

SEQ ID NO: 2734679 - DNA, 16 bp, Homo sapiens
tggttcctaagcctgt

SEQ ID NO: 2734680 - DNA, 17 bp, Homo sapiens
tggttcctaagcctgtt

SEQ ID NO: 2734681 - DNA, 18 bp, Homo sapiens
tggtttgatttctagtat

SEQ ID NO: 2734682 - DNA, 14 bp, Homo sapiens
tggtttttgttgag

SEQ ID NO: 2734683 - DNA, 12 bp, Homo sapiens
tgtaaaaagaaa

SEQ ID NO: 2734684 - DNA, 16 bp, Homo sapiens
tgtaaaaagaaattgt

SEQ ID NO: 2734685 - DNA, 22 bp, Homo sapiens
tgtaaaaagagagaaaacttat

SEQ ID NO: 2734686 - DNA, 23 bp, Homo sapiens
tgtaaaacaaaaatgtaatgatc

SEQ ID NO: 2734687 - DNA, 15 bp, Homo sapiens
tgtaaaatcttcagc

SEQ ID NO: 2734688 - DNA, 16 bp, Homo sapiens
tgtaaaatcttcagct

SEQ ID NO: 2734689 - DNA, 18 bp, Homo sapiens
tgtaaaggtaggtgcatg

SEQ ID NO: 2734690 - DNA, 20 bp, Homo sapiens
tgtaaaggtaggtgcatgcc

SEQ ID NO: 2734691 - DNA, 21 bp, Homo sapiens
tgtaaataaccacactgaaac

SEQ ID NO: 2734692 - DNA, 20 bp, Homo sapiens
tgtaacatccagctctatgt

SEQ ID NO: 2734693 - DNA, 20 bp, Homo sapiens
tgtaagcattctgagctggg

SEQ ID NO: 2734694 - DNA, 19 bp, Homo sapiens
tgtaagcttagattttctg

SEQ ID NO: 2734695 - DNA, 23 bp, Homo sapiens
tgtaaggtcttcttgtgtcctga

SEQ ID NO: 2734696 - DNA, 20 bp, Homo sapiens
tgtaatattctctgatgttt

SEQ ID NO: 2734697 - DNA, 15 bp, Homo sapiens
tgtaatatttcttca

SEQ ID NO: 2734698 - DNA, 19 bp, Homo sapiens
tgtaatatttcttcaagtg

SEQ ID NO: 2734699 - DNA, 20 bp, Homo sapiens
tgtaatcccagcactttggg

SEQ ID NO: 2734700 - DNA, 12 bp, Homo sapiens
tgtaattattgt

SEQ ID NO: 2734701 - DNA, 17 bp, Homo sapiens
tgtaatttttaaagcaa

SEQ ID NO: 2734702 - DNA, 18 bp, Homo sapiens
tgtaatttttaaagcaaa

SEQ ID NO: 2734703 - DNA, 22 bp, Homo sapiens
tgtacagtctcaattttgtatt

SEQ ID NO: 2734704 - DNA, 22 bp, Homo sapiens
tgtacattactgtatgtataaa

SEQ ID NO: 2734705 - DNA, 14 bp, Homo sapiens
tgtacccccgccca

SEQ ID NO: 2734706 - DNA, 15 bp, Homo sapiens
tgtacccccgcccag

SEQ ID NO: 2734707 - DNA, 19 bp, Homo sapiens
tgtacccccgcccaggctg

SEQ ID NO: 2734708 - DNA, 18 bp, Homo sapiens
tgtacctggtgacccctt

SEQ ID NO: 2734709 - DNA, 18 bp, Homo sapiens
tgtactcaggaggctgag

SEQ ID NO: 2734710 - DNA, 19 bp, Homo sapiens
tgtactggagagtggcaaa

SEQ ID NO: 2734711 - DNA, 20 bp, Homo sapiens
tgtagagtggcgattgaatg

SEQ ID NO: 2734712 - DNA, 20 bp, Homo sapiens
tgtagccccgggctgaccca

SEQ ID NO: 2734713 - DNA, 23 bp, Homo sapiens
tgtagctcccgagctactctctt

SEQ ID NO: 2734714 - DNA, 18 bp, Homo sapiens
tgtataaacaaattagca

SEQ ID NO: 2734715 - DNA, 20 bp, Homo sapiens
tgtatacaaacaggtgctaa

SEQ ID NO: 2734716 - DNA, 20 bp, Homo sapiens
tgtatcctgaggctgagaga

SEQ ID NO: 2734717 - DNA, 15 bp, Homo sapiens
tgtatctacctcact

SEQ ID NO: 2734718 - DNA, 22 bp, Homo sapiens
tgtatctgaaggagattttcct

SEQ ID NO: 2734719 - DNA, 17 bp, Homo sapiens
tgtatgagaagtacttt

SEQ ID NO: 2734720 - DNA, 19 bp, Homo sapiens
tgtatgtggatacagtcat

SEQ ID NO: 2734721 - DNA, 20 bp, Homo sapiens
tgtatgtggatacagtcatt

SEQ ID NO: 2734722 - DNA, 20 bp, Homo sapiens
tgtattagccagtcattgta

SEQ ID NO: 2734723 - DNA, 15 bp, Homo sapiens
tgtatttaaatgaaa

SEQ ID NO: 2734724 - DNA, 21 bp, Homo sapiens
tgtatttaagaaagggaaagc

SEQ ID NO: 2734725 - DNA, 14 bp, Homo sapiens
tgtatttaatgatt

SEQ ID NO: 2734726 - DNA, 21 bp, Homo sapiens
tgtattttctgtgttgttcat

SEQ ID NO: 2734727 - DNA, 16 bp, Homo sapiens
tgtcacagctcttgtt

SEQ ID NO: 2734728 - DNA, 16 bp, Homo sapiens
tgtcaccctgcagagc

SEQ ID NO: 2734729 - DNA, 15 bp, Homo sapiens
tgtcaccctggccac

SEQ ID NO: 2734730 - DNA, 21 bp, Homo sapiens
tgtcaccctggccaccaccca

SEQ ID NO: 2734731 - DNA, 12 bp, Homo sapiens
tgtcactgaagt

SEQ ID NO: 2734732 - DNA, 15 bp, Homo sapiens
tgtcactgaagtgat

SEQ ID NO: 2734733 - DNA, 16 bp, Homo sapiens
tgtcactgaagtgatt

SEQ ID NO: 2734734 - DNA, 13 bp, Homo sapiens
tgtcactgagact

SEQ ID NO: 2734735 - DNA, 21 bp, Homo sapiens
tgtcactggctgcctccactc

SEQ ID NO: 2734736 - DNA, 22 bp, Homo sapiens
tgtcactggctgcctccactcc

SEQ ID NO: 2734737 - DNA, 16 bp, Homo sapiens
tgtcagagttctgctc

SEQ ID NO: 2734738 - DNA, 11 bp, Homo sapiens
tgtcagccttg

SEQ ID NO: 2734739 - DNA, 17 bp, Homo sapiens
tgtcataaagaagagcc

SEQ ID NO: 2734740 - DNA, 16 bp, Homo sapiens
tgtcatcagtaagtat

SEQ ID NO: 2734741 - DNA, 18 bp, Homo sapiens
tgtcattatttgataaca

SEQ ID NO: 2734742 - DNA, 13 bp, Homo sapiens
tgtcatttctcat

SEQ ID NO: 2734743 - DNA, 16 bp, Homo sapiens
tgtccaaaatatttgt

SEQ ID NO: 2734744 - DNA, 15 bp, Homo sapiens
tgtccaacccctccc

SEQ ID NO: 2734745 - DNA, 20 bp, Homo sapiens
tgtccaacccctcccccacg

SEQ ID NO: 2734746 - DNA, 22 bp, Homo sapiens
tgtccagcttctcttgaaaact

SEQ ID NO: 2734747 - DNA, 16 bp, Homo sapiens
tgtccagtgcccattc

SEQ ID NO: 2734748 - DNA, 17 bp, Homo sapiens
tgtccagtgcccattcc

SEQ ID NO: 2734749 - DNA, 23 bp, Homo sapiens
tgtccagtgcccattcctcacct

SEQ ID NO: 2734750 - DNA, 14 bp, Homo sapiens
tgtccagtttccaa

SEQ ID NO: 2734751 - DNA, 13 bp, Homo sapiens
tgtccataaagta

SEQ ID NO: 2734752 - DNA, 20 bp, Homo sapiens
tgtccatcctcctctccatg

SEQ ID NO: 2734753 - DNA, 22 bp, Homo sapiens
tgtccatcctcctctccatgca

SEQ ID NO: 2734754 - DNA, 23 bp, Homo sapiens
tgtccatcctcctctccatgcaa

SEQ ID NO: 2734755 - DNA, 13 bp, Homo sapiens
tgtcccagtgaac

SEQ ID NO: 2734756 - DNA, 17 bp, Homo sapiens
tgtcccctcacagactc

SEQ ID NO: 2734757 - DNA, 13 bp, Homo sapiens
tgtcccctggggc

SEQ ID NO: 2734758 - DNA, 17 bp, Homo sapiens
tgtcccggttcaccttg

SEQ ID NO: 2734759 - DNA, 14 bp, Homo sapiens
tgtccctacccact

SEQ ID NO: 2734760 - DNA, 15 bp, Homo sapiens
tgtccctacccactc

SEQ ID NO: 2734761 - DNA, 20 bp, Homo sapiens
tgtccctgaagtcttgcatt

SEQ ID NO: 2734762 - DNA, 12 bp, Homo sapiens
tgtccctggggc

SEQ ID NO: 2734763 - DNA, 19 bp, Homo sapiens
tgtccctggggcactcccc

SEQ ID NO: 2734764 - DNA, 14 bp, Homo sapiens
tgtccctggtgcag

SEQ ID NO: 2734765 - DNA, 22 bp, Homo sapiens
tgtcccttccatttctactgta

SEQ ID NO: 2734766 - DNA, 13 bp, Homo sapiens
tgtccgcctctgc

SEQ ID NO: 2734767 - DNA, 22 bp, Homo sapiens
tgtccggagcgaccctggctct

SEQ ID NO: 2734768 - DNA, 13 bp, Homo sapiens
tgtcctcaaagaa

SEQ ID NO: 2734769 - DNA, 14 bp, Homo sapiens
tgtcctcgcactgc

SEQ ID NO: 2734770 - DNA, 21 bp, Homo sapiens
tgtcctcgcactgcccaggga

SEQ ID NO: 2734771 - DNA, 14 bp, Homo sapiens
tgtcctctcagagc

SEQ ID NO: 2734772 - DNA, 22 bp, Homo sapiens
tgtcctgacttcaggggctgcc

SEQ ID NO: 2734773 - DNA, 17 bp, Homo sapiens
tgtcctggaccctggcc

SEQ ID NO: 2734774 - DNA, 15 bp, Homo sapiens
tgtcctggtacagca

SEQ ID NO: 2734775 - DNA, 15 bp, Homo sapiens
tgtcctgtctgctgg

SEQ ID NO: 2734776 - DNA, 17 bp, Homo sapiens
tgtccttactcagagct

SEQ ID NO: 2734777 - DNA, 21 bp, Homo sapiens
tgtcgaatttttattatttgt

SEQ ID NO: 2734778 - DNA, 14 bp, Homo sapiens
tgtcgcgccttctc

SEQ ID NO: 2734779 - DNA, 16 bp, Homo sapiens
tgtcggtgtgctgtca

SEQ ID NO: 2734780 - DNA, 14 bp, Homo sapiens
tgtcgtgtccagcc

SEQ ID NO: 2734781 - DNA, 16 bp, Homo sapiens
tgtcgtgtctgctgtt

SEQ ID NO: 2734782 - DNA, 14 bp, Homo sapiens
tggcatcctggctg

SEQ ID NO: 2734783 - DNA, 15 bp, Homo sapiens
tggcatcctggctgg

SEQ ID NO: 2734784 - DNA, 18 bp, Homo sapiens
tggcatctccctgacctt

SEQ ID NO: 2734785 - DNA, 16 bp, Homo sapiens
tggcatcttgctgcta

SEQ ID NO: 2734786 - DNA, 20 bp, Homo sapiens
tggcatgtgggttgtgatat

SEQ ID NO: 2734787 - DNA, 19 bp, Homo sapiens
tggcattggcagcaggtgc

SEQ ID NO: 2734788 - DNA, 12 bp, Homo sapiens
tggccacactgg

SEQ ID NO: 2734789 - DNA, 16 bp, Homo sapiens
tggccacactgggctc

SEQ ID NO: 2734790 - DNA, 21 bp, Homo sapiens
tggccacttgggtcttccctg

SEQ ID NO: 2734791 - DNA, 14 bp, Homo sapiens
tggccagagctgag

SEQ ID NO: 2734792 - DNA, 15 bp, Homo sapiens
tggccagccccacag

SEQ ID NO: 2734793 - DNA, 16 bp, Homo sapiens
tggccagccccacagc

SEQ ID NO: 2734794 - DNA, 23 bp, Homo sapiens
tggccagccccacagcccacgtc

SEQ ID NO: 2734795 - DNA, 18 bp, Homo sapiens
tggccagtcctagagctc

SEQ ID NO: 2734796 - DNA, 19 bp, Homo sapiens
tggccagtcctagagctcc

SEQ ID NO: 2734797 - DNA, 21 bp, Homo sapiens
tggccagtcctagagctcctg

SEQ ID NO: 2734798 - DNA, 21 bp, Homo sapiens
tggccatggaataaaccattt

SEQ ID NO: 2734799 - DNA, 19 bp, Homo sapiens
tggcccacagctctgctgg

SEQ ID NO: 2734800 - DNA, 22 bp, Homo sapiens
tggcccacagctctgctggaag

SEQ ID NO: 2734801 - DNA, 23 bp, Homo sapiens
tggcccacagctctgctggaaga

SEQ ID NO: 2734802 - DNA, 13 bp, Homo sapiens
tggcccagccact

SEQ ID NO: 2734803 - DNA, 14 bp, Homo sapiens
tggcccagctcccc

SEQ ID NO: 2734804 - DNA, 12 bp, Homo sapiens
tggcccatcccc

SEQ ID NO: 2734805 - DNA, 19 bp, Homo sapiens
tggcccatcccccctcacc

SEQ ID NO: 2734806 - DNA, 12 bp, Homo sapiens
tggccccagcct

SEQ ID NO: 2734807 - DNA, 17 bp, Homo sapiens
tggccccagcctggccc

SEQ ID NO: 2734808 - DNA, 19 bp, Homo sapiens
tggccccagcctggcccag

SEQ ID NO: 2734809 - DNA, 20 bp, Homo sapiens
tggccccagcctggcccagc

SEQ ID NO: 2734810 - DNA, 17 bp, Homo sapiens
tggccccttctccagca

SEQ ID NO: 2734811 - DNA, 19 bp, Homo sapiens
tggccctcaaggcctccca

SEQ ID NO: 2734812 - DNA, 20 bp, Homo sapiens
tggccctcaaggcctcccac

SEQ ID NO: 2734813 - DNA, 21 bp, Homo sapiens
tggccctcaaggcctcccaca

SEQ ID NO: 2734814 - DNA, 11 bp, Homo sapiens
tggccctgccc

SEQ ID NO: 2734815 - DNA, 13 bp, Homo sapiens
tggccctgcccct

SEQ ID NO: 2734816 - DNA, 14 bp, Homo sapiens
tggccgtggctcca

SEQ ID NO: 2734817 - DNA, 17 bp, Homo sapiens
tggcctaaagaatccca

SEQ ID NO: 2734818 - DNA, 13 bp, Homo sapiens
tggcctccaagtc

SEQ ID NO: 2734819 - DNA, 23 bp, Homo sapiens
tggcctccaagtccacagtggaa

SEQ ID NO: 2734820 - DNA, 15 bp, Homo sapiens
tggcctcgcctggcc

SEQ ID NO: 2734821 - DNA, 16 bp, Homo sapiens
tggcctcgcctggcct

SEQ ID NO: 2734822 - DNA, 13 bp, Homo sapiens
tggcctctagaac

SEQ ID NO: 2734823 - DNA, 22 bp, Homo sapiens
tggcctcttggcacctgcctag

SEQ ID NO: 2734824 - DNA, 17 bp, Homo sapiens
tggcgagaggaggggcc

SEQ ID NO: 2734825 - DNA, 13 bp, Homo sapiens
tggcgcaccctcc

SEQ ID NO: 2734826 - DNA, 16 bp, Homo sapiens
tggcgcaccctcccct

SEQ ID NO: 2734827 - DNA, 15 bp, Homo sapiens
tggctcagctgtggt

SEQ ID NO: 2734828 - DNA, 22 bp, Homo sapiens
tggctccaggctcctcatgagg

SEQ ID NO: 2734829 - DNA, 15 bp, Homo sapiens
tggctctgccagcgt

SEQ ID NO: 2734830 - DNA, 16 bp, Homo sapiens
tggctgaacagtgctc

SEQ ID NO: 2734831 - DNA, 20 bp, Homo sapiens
tggctgaacagtgctctgcc

SEQ ID NO: 2734832 - DNA, 22 bp, Homo sapiens
tggctgaacagtgctctgcctc

SEQ ID NO: 2734833 - DNA, 23 bp, Homo sapiens
tggctgaacagtgctctgcctct

SEQ ID NO: 2734834 - DNA, 17 bp, Homo sapiens
tggctgcacgtcaccct

SEQ ID NO: 2734835 - DNA, 20 bp, Homo sapiens
tggctgcacgtcaccctcct

SEQ ID NO: 2734836 - DNA, 23 bp, Homo sapiens
tggctgcacgtcaccctcctgag

SEQ ID NO: 2734837 - DNA, 22 bp, Homo sapiens
tggctgctggcccacagctctg

SEQ ID NO: 2734838 - DNA, 13 bp, Homo sapiens
tggctggctgcag

SEQ ID NO: 2734839 - DNA, 20 bp, Homo sapiens
tggctggggcctatcagtgt

SEQ ID NO: 2734840 - DNA, 18 bp, Homo sapiens
tggctgggggagggactg

SEQ ID NO: 2734841 - DNA, 20 bp, Homo sapiens
tggctgggggagggactgct

SEQ ID NO: 2734842 - DNA, 23 bp, Homo sapiens
tggctgggggagggactgctgac

SEQ ID NO: 2734843 - DNA, 22 bp, Homo sapiens
tggctgtggttcctaagcctgt

SEQ ID NO: 2734844 - DNA, 13 bp, Homo sapiens
tggctttacaaat

SEQ ID NO: 2734845 - DNA, 15 bp, Homo sapiens
tgggaaaaaagaaat

SEQ ID NO: 2734846 - DNA, 16 bp, Homo sapiens
tgggaaaaaagaaatc

SEQ ID NO: 2734847 - DNA, 11 bp, Homo sapiens
tgggaagccat

SEQ ID NO: 2734848 - DNA, 12 bp, Homo sapiens
tgggaatgggag

SEQ ID NO: 2734849 - DNA, 15 bp, Homo sapiens
tgggaatgggagagg

SEQ ID NO: 2734850 - DNA, 21 bp, Homo sapiens
tctctgcctgcttcctggacc

SEQ ID NO: 2734851 - DNA, 18 bp, Homo sapiens
tctctgcctggagcaggg

SEQ ID NO: 2734852 - DNA, 12 bp, Homo sapiens
tctctgctcagt

SEQ ID NO: 2734853 - DNA, 14 bp, Homo sapiens
tctctgcttggctt

SEQ ID NO: 2734854 - DNA, 13 bp, Homo sapiens
tctctggctcagc

SEQ ID NO: 2734855 - DNA, 22 bp, Homo sapiens
tctctgggtttacaacaaacac

SEQ ID NO: 2734856 - DNA, 18 bp, Homo sapiens
tctctgtgacctgccccg

SEQ ID NO: 2734857 - DNA, 15 bp, Homo sapiens
tctctgttgtaaata

SEQ ID NO: 2734858 - DNA, 13 bp, Homo sapiens
tctcttctcagag

SEQ ID NO: 2734859 - DNA, 13 bp, Homo sapiens
tctcttgccagca

SEQ ID NO: 2734860 - DNA, 16 bp, Homo sapiens
tctgaatgtcccagag

SEQ ID NO: 2734861 - DNA, 17 bp, Homo sapiens
tctgaatgtcccagagg

SEQ ID NO: 2734862 - DNA, 14 bp, Homo sapiens
tctgacctgcaggc

SEQ ID NO: 2734863 - DNA, 15 bp, Homo sapiens
tctgacctgcaggcc

SEQ ID NO: 2734864 - DNA, 19 bp, Homo sapiens
tctgacttacttaaccagg

SEQ ID NO: 2734865 - DNA, 13 bp, Homo sapiens
tctgactttctct

SEQ ID NO: 2734866 - DNA, 17 bp, Homo sapiens
tctgactttctcttcta

SEQ ID NO: 2734867 - DNA, 14 bp, Homo sapiens
tctgagaagtgtat

SEQ ID NO: 2734868 - DNA, 16 bp, Homo sapiens
tctgagaagtgtatat

SEQ ID NO: 2734869 - DNA, 20 bp, Homo sapiens
tctgagccgcagggcctgct

SEQ ID NO: 2734870 - DNA, 23 bp, Homo sapiens
tctgaggcacctgcatatctcta

SEQ ID NO: 2734871 - DNA, 21 bp, Homo sapiens
tctgaggctctttctgggcca

SEQ ID NO: 2734872 - DNA, 18 bp, Homo sapiens
tctgagtgtctctgcctg

SEQ ID NO: 2734873 - DNA, 23 bp, Homo sapiens
tctgagtgtctctgcctggagca

SEQ ID NO: 2734874 - DNA, 15 bp, Homo sapiens
tctgataatgtattg

SEQ ID NO: 2734875 - DNA, 17 bp, Homo sapiens
tctgattttgatatttt

SEQ ID NO: 2734876 - DNA, 12 bp, Homo sapiens
tctgcaacatgg

SEQ ID NO: 2734877 - DNA, 19 bp, Homo sapiens
tctgcaacatggattccaa

SEQ ID NO: 2734878 - DNA, 17 bp, Homo sapiens
tctgcactcctggaacc

SEQ ID NO: 2734879 - DNA, 18 bp, Homo sapiens
tctgcagatagtgcctct

SEQ ID NO: 2734880 - DNA, 21 bp, Homo sapiens
tctgcagatagtgcctctgca

SEQ ID NO: 2734881 - DNA, 22 bp, Homo sapiens
tctgcagatagtgcctctgcaa

SEQ ID NO: 2734882 - DNA, 15 bp, Homo sapiens
tctgcagctcctgga

SEQ ID NO: 2734883 - DNA, 12 bp, Homo sapiens
tctgcaggaaat

SEQ ID NO: 2734884 - DNA, 20 bp, Homo sapiens
tctgcatcagctttttgtat

SEQ ID NO: 2734885 - DNA, 23 bp, Homo sapiens
tctgcatgtaaaatcttcagctg

SEQ ID NO: 2734886 - DNA, 23 bp, Homo sapiens
tctgcattcacagcgcctcctgg

SEQ ID NO: 2734887 - DNA, 16 bp, Homo sapiens
tctgccacttcccagg

SEQ ID NO: 2734888 - DNA, 15 bp, Homo sapiens
tctgcccaactttca

SEQ ID NO: 2734889 - DNA, 20 bp, Homo sapiens
tctgcccaactttcattggt

SEQ ID NO: 2734890 - DNA, 13 bp, Homo sapiens
tctgccccaccct

SEQ ID NO: 2734891 - DNA, 21 bp, Homo sapiens
tctgcccgcagagcccacgcc

SEQ ID NO: 2734892 - DNA, 20 bp, Homo sapiens
tctgcccgcctcggcctccc

SEQ ID NO: 2734893 - DNA, 13 bp, Homo sapiens
tctgcctcagctt

SEQ ID NO: 2734894 - DNA, 16 bp, Homo sapiens
tctgcctcagcttccc

SEQ ID NO: 2734895 - DNA, 19 bp, Homo sapiens
tctgcctcagcttcccaag

SEQ ID NO: 2734896 - DNA, 16 bp, Homo sapiens
tctgcctcatcctcct

SEQ ID NO: 2734897 - DNA, 17 bp, Homo sapiens
tctgcctcatcctcctc

SEQ ID NO: 2734898 - DNA, 18 bp, Homo sapiens
tctgcctcatcctcctcc

SEQ ID NO: 2734899 - DNA, 20 bp, Homo sapiens
tctgcctctaactccctcct

SEQ ID NO: 2734900 - DNA, 16 bp, Homo sapiens
tctgcctgaccccagg

SEQ ID NO: 2734901 - DNA, 18 bp, Homo sapiens
tctgcctgaccccaggcc

SEQ ID NO: 2734902 - DNA, 14 bp, Homo sapiens
tctgcctgagattc

SEQ ID NO: 2734903 - DNA, 19 bp, Homo sapiens
tctgcctgagattctttaa

SEQ ID NO: 2734904 - DNA, 17 bp, Homo sapiens
tctgcctgctgggctct

SEQ ID NO: 2734905 - DNA, 14 bp, Homo sapiens
tctgctatatttgt

SEQ ID NO: 2734906 - DNA, 17 bp, Homo sapiens
tctgctatattttcatg

SEQ ID NO: 2734907 - DNA, 14 bp, Homo sapiens
tctgctcagtgatc

SEQ ID NO: 2734908 - DNA, 19 bp, Homo sapiens
tctgctcccaattcacctc

SEQ ID NO: 2734909 - DNA, 18 bp, Homo sapiens
tctgctcgggcccaggcc

SEQ ID NO: 2734910 - DNA, 15 bp, Homo sapiens
tctgctgcctgtaca

SEQ ID NO: 2734911 - DNA, 16 bp, Homo sapiens
tctgctgctttccaac

SEQ ID NO: 2734912 - DNA, 13 bp, Homo sapiens
tctgctgggctgg

SEQ ID NO: 2734913 - DNA, 14 bp, Homo sapiens
tctgctgggctggg

SEQ ID NO: 2734914 - DNA, 22 bp, Homo sapiens
tctgctgggctggggcctgatg

SEQ ID NO: 2734915 - DNA, 24 bp, Homo sapiens
tctgctgggctggggcctgatggg

SEQ ID NO: 2734916 - DNA, 17 bp, Homo sapiens
tctgcttccctggggcc

SEQ ID NO: 2734917 - DNA, 18 bp, Homo sapiens
tctgcttggcttcccctc

SEQ ID NO: 2734918 - DNA, 21 bp, Homo sapiens
tctgcttggcttcccctccac

SEQ ID NO: 2734919 - DNA, 18 bp, Homo sapiens
tctgcttttcctgtctgt

SEQ ID NO: 2734920 - DNA, 12 bp, Homo sapiens
tctggagccctt

SEQ ID NO: 2734921 - DNA, 13 bp, Homo sapiens
tctggaggctgcg

SEQ ID NO: 2734922 - DNA, 16 bp, Homo sapiens
tctggatttttacaaa

SEQ ID NO: 2734923 - DNA, 17 bp, Homo sapiens
tctggcaaacatgtgca

SEQ ID NO: 2734924 - DNA, 18 bp, Homo sapiens
tctggcaaagttatattt

SEQ ID NO: 2734925 - DNA, 20 bp, Homo sapiens
tctgggccagatgctgggca

SEQ ID NO: 2734926 - DNA, 23 bp, Homo sapiens
tctgggctgattttttaaataaa

SEQ ID NO: 2734927 - DNA, 19 bp, Homo sapiens
tctgggggagacatgctct

SEQ ID NO: 2734928 - DNA, 15 bp, Homo sapiens
tctgggtgatttcta

SEQ ID NO: 2734929 - DNA, 17 bp, Homo sapiens
tctgggtgatttctaga

SEQ ID NO: 2734930 - DNA, 16 bp, Homo sapiens
tctgggtttacaacaa

SEQ ID NO: 2734931 - DNA, 20 bp, Homo sapiens
tctgggtttacaacaaacac

SEQ ID NO: 2734932 - DNA, 14 bp, Homo sapiens
tctggtatctgcat

SEQ ID NO: 2734933 - DNA, 19 bp, Homo sapiens
tctgtcaccctggccacca

SEQ ID NO: 2734934 - DNA, 16 bp, Homo sapiens
tctgtccaacccctcc

SEQ ID NO: 2734935 - DNA, 17 bp, Homo sapiens
tctgtccagccagctcc

SEQ ID NO: 2734936 - DNA, 15 bp, Homo sapiens
tctgtccagtttcca

SEQ ID NO: 2734937 - DNA, 14 bp, Homo sapiens
tctgtccatcctcc

SEQ ID NO: 2734938 - DNA, 15 bp, Homo sapiens
tctgtccatcctcct

SEQ ID NO: 2734939 - DNA, 24 bp, Homo sapiens
tctgtccatcctcctctccatgca

SEQ ID NO: 2734940 - DNA, 20 bp, Homo sapiens
tctgtcccggttcaccttgc

SEQ ID NO: 2734941 - DNA, 12 bp, Homo sapiens
tctgtctctgct

SEQ ID NO: 2734942 - DNA, 13 bp, Homo sapiens
tctgtctgctctt

SEQ ID NO: 2734943 - DNA, 14 bp, Homo sapiens
tctgtctttgcaaa

SEQ ID NO: 2734944 - DNA, 21 bp, Homo sapiens
tgacatcagaagtaactccca

SEQ ID NO: 2734945 - DNA, 22 bp, Homo sapiens
tgacatcagaagtaactcccac

SEQ ID NO: 2734946 - DNA, 23 bp, Homo sapiens
tgacatcagaagtaactcccact

SEQ ID NO: 2734947 - DNA, 20 bp, Homo sapiens
tgaccagccccgtgtagccc

SEQ ID NO: 2734948 - DNA, 12 bp, Homo sapiens
tgaccatgtgat

SEQ ID NO: 2734949 - DNA, 21 bp, Homo sapiens
tgaccccttttcagcttctgc

SEQ ID NO: 2734950 - DNA, 21 bp, Homo sapiens
tgacccggattggccctgccc

SEQ ID NO: 2734951 - DNA, 15 bp, Homo sapiens
tgacctccagtcctg

SEQ ID NO: 2734952 - DNA, 18 bp, Homo sapiens
tgacctccagtcctgctg

SEQ ID NO: 2734953 - DNA, 21 bp, Homo sapiens
tgacctccagtcctgctggcc

SEQ ID NO: 2734954 - DNA, 16 bp, Homo sapiens
tgacctgaactctgca

SEQ ID NO: 2734955 - DNA, 11 bp, Homo sapiens
tgacctgcagg

SEQ ID NO: 2734956 - DNA, 19 bp, Homo sapiens
tgacctgccccgcccagct

SEQ ID NO: 2734957 - DNA, 19 bp, Homo sapiens
tgaccttctccagggacag

SEQ ID NO: 2734958 - DNA, 18 bp, Homo sapiens
tgacggactcagactcct

SEQ ID NO: 2734959 - DNA, 16 bp, Homo sapiens
tgacgtgactcagagc

SEQ ID NO: 2734960 - DNA, 19 bp, Homo sapiens
tgacgtgcacctgtactca

SEQ ID NO: 2734961 - DNA, 20 bp, Homo sapiens
tgactatggctctggcacca

SEQ ID NO: 2734962 - DNA, 16 bp, Homo sapiens
tgactcgggctcctgt

SEQ ID NO: 2734963 - DNA, 20 bp, Homo sapiens
tgactcgggctcctgtgccc

SEQ ID NO: 2734964 - DNA, 13 bp, Homo sapiens
tgactctctgtga

SEQ ID NO: 2734965 - DNA, 18 bp, Homo sapiens
tgacttacttaaccaggt

SEQ ID NO: 2734966 - DNA, 18 bp, Homo sapiens
tgacttcaggggctgccc

SEQ ID NO: 2734967 - DNA, 13 bp, Homo sapiens
tgacttttgaaga

SEQ ID NO: 2734968 - DNA, 19 bp, Homo sapiens
tgagaaatttttttccaga

SEQ ID NO: 2734969 - DNA, 16 bp, Homo sapiens
tgagaagggcctgctc

SEQ ID NO: 2734970 - DNA, 22 bp, Homo sapiens
tgagaagggcctgctctgcttt

SEQ ID NO: 2734971 - DNA, 21 bp, Homo sapiens
tgagaagtactttgtgctgat

SEQ ID NO: 2734972 - DNA, 14 bp, Homo sapiens
tgagaagtgtatat

SEQ ID NO: 2734973 - DNA, 17 bp, Homo sapiens
tgagacacatacaaaaa

SEQ ID NO: 2734974 - DNA, 15 bp, Homo sapiens
tgagaccctgttcta

SEQ ID NO: 2734975 - DNA, 19 bp, Homo sapiens
tgagactagattctcacct

SEQ ID NO: 2734976 - DNA, 20 bp, Homo sapiens
tgagactagattctcacctg

SEQ ID NO: 2734977 - DNA, 16 bp, Homo sapiens
tgagagtcaaagctga

SEQ ID NO: 2734978 - DNA, 18 bp, Homo sapiens
tgagatggagtctcactc

SEQ ID NO: 2734979 - DNA, 23 bp, Homo sapiens
tgagatggagtctcgctctgctg

SEQ ID NO: 2734980 - DNA, 21 bp, Homo sapiens
tgagattctttaaggagatag

SEQ ID NO: 2734981 - DNA, 18 bp, Homo sapiens
tgagcaactcctgttctt

SEQ ID NO: 2734982 - DNA, 20 bp, Homo sapiens
tgagcaaggacaacctgccc

SEQ ID NO: 2734983 - DNA, 12 bp, Homo sapiens
tctccatgaaga

SEQ ID NO: 2734984 - DNA, 15 bp, Homo sapiens
tctccatgcaagtgc

SEQ ID NO: 2734985 - DNA, 19 bp, Homo sapiens
tctccatgcaagtgctgtt

SEQ ID NO: 2734986 - DNA, 16 bp, Homo sapiens
tctcccagaaggctgg

SEQ ID NO: 2734987 - DNA, 20 bp, Homo sapiens
tctcccccccggggctgggt

SEQ ID NO: 2734988 - DNA, 18 bp, Homo sapiens
tctcccggacctggacta

SEQ ID NO: 2734989 - DNA, 20 bp, Homo sapiens
tctccctgaccttctccagg

SEQ ID NO: 2734990 - DNA, 13 bp, Homo sapiens
tctccctggccct

SEQ ID NO: 2734991 - DNA, 17 bp, Homo sapiens
tctcctgcctcagcctc

SEQ ID NO: 2734992 - DNA, 15 bp, Homo sapiens
tctcctgtgggaaaa

SEQ ID NO: 2734993 - DNA, 15 bp, Homo sapiens
tctccttagaagtgg

SEQ ID NO: 2734994 - DNA, 14 bp, Homo sapiens
tctcgaactcctga

SEQ ID NO: 2734995 - DNA, 21 bp, Homo sapiens
tctcgctaaagttatatttgt

SEQ ID NO: 2734996 - DNA, 20 bp, Homo sapiens
tctcgctgatgctgggctgg

SEQ ID NO: 2734997 - DNA, 17 bp, Homo sapiens
tctcggcaccagtgcct

SEQ ID NO: 2734998 - DNA, 17 bp, Homo sapiens
tctcgtggtagaagcca

SEQ ID NO: 2734999 - DNA, 19 bp, Homo sapiens
tctcgtggtagaagccagt

SEQ ID NO: 2735000 - DNA, 19 bp, Homo sapiens
tctctactcctacctcagc

SEQ ID NO: 2735001 - DNA, 21 bp, Homo sapiens
tctctactgtctcagtttaca

SEQ ID NO: 2735002 - DNA, 12 bp, Homo sapiens
tctctccagcct

SEQ ID NO: 2735003 - DNA, 13 bp, Homo sapiens
tctctccagcctc

SEQ ID NO: 2735004 - DNA, 22 bp, Homo sapiens
tctctctactcctacctcagcc

SEQ ID NO: 2735005 - DNA, 11 bp, Homo sapiens
tctctctgcct

SEQ ID NO: 2735006 - DNA, 13 bp, Homo sapiens
tctctctgcctgc

SEQ ID NO: 2735007 - DNA, 16 bp, Homo sapiens
tctctctgcctgctgg

SEQ ID NO: 2735008 - DNA, 16 bp, Homo sapiens
tctctctgttaaagat

SEQ ID NO: 2735009 - DNA, 18 bp, Homo sapiens
tctctgagtgtctctgcc

SEQ ID NO: 2735010 - DNA, 20 bp, Homo sapiens
tctctgatgtgatatccact

SEQ ID NO: 2735011 - DNA, 16 bp, Homo sapiens
tctctgcctgcttcct

SEQ ID NO: 2735012 - DNA, 13 bp, Homo sapiens
tcctggctggctg

SEQ ID NO: 2735013 - DNA, 22 bp, Homo sapiens
tcctggctggctgtgtcctctc

SEQ ID NO: 2735014 - DNA, 19 bp, Homo sapiens
tcctgggagaacctcaggc

SEQ ID NO: 2735015 - DNA, 23 bp, Homo sapiens
tcctgggagaacctcaggcttcc

SEQ ID NO: 2735016 - DNA, 11 bp, Homo sapiens
tcctgggcccc

SEQ ID NO: 2735017 - DNA, 15 bp, Homo sapiens
tcctggggctctgtg

SEQ ID NO: 2735018 - DNA, 18 bp, Homo sapiens
tcctggggctctgtgcag

SEQ ID NO: 2735019 - DNA, 18 bp, Homo sapiens
tcctggtacagcagggtc

SEQ ID NO: 2735020 - DNA, 23 bp, Homo sapiens
tcctggtacagcagggtcttgct

SEQ ID NO: 2735021 - DNA, 22 bp, Homo sapiens
tcctgtcagataggattttctc

SEQ ID NO: 2735022 - DNA, 16 bp, Homo sapiens
tcctgtccctacccac

SEQ ID NO: 2735023 - DNA, 18 bp, Homo sapiens
tcctgtccctacccactc

SEQ ID NO: 2735024 - DNA, 23 bp, Homo sapiens
tcctgtccctacccactctttgc

SEQ ID NO: 2735025 - DNA, 19 bp, Homo sapiens
tcctgtccggagcgaccct

SEQ ID NO: 2735026 - DNA, 14 bp, Homo sapiens
tcctgtctgctggg

SEQ ID NO: 2735027 - DNA, 24 bp, Homo sapiens
tcctgttattttttatttccacat

SEQ ID NO: 2735028 - DNA, 17 bp, Homo sapiens
tccttaattcactccca

SEQ ID NO: 2735029 - DNA, 18 bp, Homo sapiens
tccttaattcactcccac

SEQ ID NO: 2735030 - DNA, 14 bp, Homo sapiens
tccttactcagagc

SEQ ID NO: 2735031 - DNA, 23 bp, Homo sapiens
tccttcaagttagctcaggaggc

SEQ ID NO: 2735032 - DNA, 13 bp, Homo sapiens
tccttccaggccc

SEQ ID NO: 2735033 - DNA, 21 bp, Homo sapiens
tccttccaggcccccaccact

SEQ ID NO: 2735034 - DNA, 19 bp, Homo sapiens
tccttccttgctgtcctag

SEQ ID NO: 2735035 - DNA, 23 bp, Homo sapiens
tcatgcaagacttcactgcagcc

SEQ ID NO: 2735036 - DNA, 14 bp, Homo sapiens
tcatgcccactgcc

SEQ ID NO: 2735037 - DNA, 15 bp, Homo sapiens
tcatgcccactgccg

SEQ ID NO: 2735038 - DNA, 15 bp, Homo sapiens
tcatgctttctcctt

SEQ ID NO: 2735039 - DNA, 22 bp, Homo sapiens
tcatggaccaggtcttgttcaa

SEQ ID NO: 2735040 - DNA, 21 bp, Homo sapiens
tcatgtcagaggtttggagcc

SEQ ID NO: 2735041 - DNA, 18 bp, Homo sapiens
tcatgtggcattctctct

SEQ ID NO: 2735042 - DNA, 13 bp, Homo sapiens
tcatgtgtatgag

SEQ ID NO: 2735043 - DNA, 19 bp, Homo sapiens
tcatgtgtatgagaagtac

SEQ ID NO: 2735044 - DNA, 21 bp, Homo sapiens
tcattaagcgggatcccagca

SEQ ID NO: 2735045 - DNA, 22 bp, Homo sapiens
tcattatttgataacattttgt

SEQ ID NO: 2735046 - DNA, 14 bp, Homo sapiens
tcattcacatttca

SEQ ID NO: 2735047 - DNA, 16 bp, Homo sapiens
tcattcaggtgttctc

SEQ ID NO: 2735048 - DNA, 19 bp, Homo sapiens
tcacaccattctcctgcct

SEQ ID NO: 2735049 - DNA, 22 bp, Homo sapiens
tcacactacttgagaaaatgca

SEQ ID NO: 2735050 - DNA, 19 bp, Homo sapiens
tcacactcctcctgccagc

SEQ ID NO: 2735051 - DNA, 21 bp, Homo sapiens
tcacactcctcctgccagctc

SEQ ID NO: 2735052 - DNA, 16 bp, Homo sapiens
tcacagactcttccac

SEQ ID NO: 2735053 - DNA, 20 bp, Homo sapiens
tcacagactcttccaccaga

SEQ ID NO: 2735054 - DNA, 15 bp, Homo sapiens
tcacagatgctggcc

SEQ ID NO: 2735055 - DNA, 17 bp, Homo sapiens
tcacagatgctggcctc

SEQ ID NO: 2735056 - DNA, 22 bp, Homo sapiens
tcacagatgctggcctcttggc

SEQ ID NO: 2735057 - DNA, 15 bp, Homo sapiens
tacccctcccagctg

SEQ ID NO: 2735058 - DNA, 19 bp, Homo sapiens
tacccctcccagctgacag

SEQ ID NO: 2735059 - DNA, 12 bp, Homo sapiens
taccctccctgc

SEQ ID NO: 2735060 - DNA, 18 bp, Homo sapiens
taccctccctgctgtccc

SEQ ID NO: 2735061 - DNA, 23 bp, Homo sapiens
taccctccctgctgtcccctctt

SEQ ID NO: 2735062 - DNA, 12 bp, Homo sapiens
taccctgcagct

SEQ ID NO: 2735063 - DNA, 13 bp, Homo sapiens
taccctgcagctt

SEQ ID NO: 2735064 - DNA, 13 bp, Homo sapiens
tacccttcctcat

SEQ ID NO: 2735065 - DNA, 19 bp, Homo sapiens
tacccttggtttgcacata

SEQ ID NO: 2735066 - DNA, 20 bp, Homo sapiens
tacccttggtttgcacataa

SEQ ID NO: 2735067 - DNA, 14 bp, Homo sapiens
tacctgattgtatt

SEQ ID NO: 2735068 - DNA, 21 bp, Homo sapiens
taccttaatttgactgtcctc

SEQ ID NO: 2735069 - DNA, 16 bp, Homo sapiens
tacggtgagactctga

SEQ ID NO: 2735070 - DNA, 19 bp, Homo sapiens
tactaaggagaattaaact

SEQ ID NO: 2735071 - DNA, 12 bp, Homo sapiens
tactatctttgt

SEQ ID NO: 2735072 - DNA, 19 bp, Homo sapiens
tactatctttgtctaaaca

SEQ ID NO: 2735073 - DNA, 17 bp, Homo sapiens
tactcagaagcctgagg

SEQ ID NO: 2735074 - DNA, 19 bp, Homo sapiens
tactcagaagcctgaggct

SEQ ID NO: 2735075 - DNA, 11 bp, Homo sapiens
tactcagagct

SEQ ID NO: 2735076 - DNA, 14 bp, Homo sapiens
tactcagagctgcg

SEQ ID NO: 2735077 - DNA, 16 bp, Homo sapiens
tactcagagctgcggg

SEQ ID NO: 2735078 - DNA, 22 bp, Homo sapiens
tactcagagctgcgggctgagg

SEQ ID NO: 2735079 - DNA, 18 bp, Homo sapiens
tactcattccccggggcg

SEQ ID NO: 2735080 - DNA, 21 bp, Homo sapiens
tactcccagcgctggctccag

SEQ ID NO: 2735081 - DNA, 14 bp, Homo sapiens
tactgacagaaatg

SEQ ID NO: 2735082 - DNA, 13 bp, Homo sapiens
tactgcacatttt

SEQ ID NO: 2735083 - DNA, 19 bp, Homo sapiens
tactggcctcgcctggcct

SEQ ID NO: 2735084 - DNA, 13 bp, Homo sapiens
tactgtcccagga

SEQ ID NO: 2735085 - DNA, 16 bp, Homo sapiens
tacttcccccaccctg

SEQ ID NO: 2735086 - DNA, 20 bp, Homo sapiens
tactttaatttttataaata

SEQ ID NO: 2735087 - DNA, 13 bp, Homo sapiens
tactttttaaaca

SEQ ID NO: 2735088 - DNA, 14 bp, Homo sapiens
tactttttctgtac

SEQ ID NO: 2735089 - DNA, 23 bp, Homo sapiens
tactttttctgtactttttgttt

SEQ ID NO: 2735090 - DNA, 21 bp, Homo sapiens
tagaaatttattcttatctta

SEQ ID NO: 2735091 - DNA, 18 bp, Homo sapiens
tagaacacccactggcca

SEQ ID NO: 2735092 - DNA, 21 bp, Homo sapiens
tagaaccagccgtattttaca

SEQ ID NO: 2735093 - DNA, 14 bp, Homo sapiens
tagaataaaattgt

SEQ ID NO: 2735094 - DNA, 15 bp, Homo sapiens
tagaatcaagtctgt

SEQ ID NO: 2735095 - DNA, 18 bp, Homo sapiens
tagaatcaagtctgtgaa

SEQ ID NO: 2735096 - DNA, 15 bp, Homo sapiens
tagacgggttgaaag

SEQ ID NO: 2735097 - DNA, 17 bp, Homo sapiens
tagacgggttgaaagac

SEQ ID NO: 2735098 - DNA, 21 bp, Homo sapiens
tagacgggttgaaagacatca

SEQ ID NO: 2735099 - DNA, 22 bp, Homo sapiens
tagacgggttgaaagacatcaa

SEQ ID NO: 2735100 - DNA, 19 bp, Homo sapiens
tagagacggggtttcacca

SEQ ID NO: 2735101 - DNA, 20 bp, Homo sapiens
tagagatatgcagaaggaag

SEQ ID NO: 2735102 - DNA, 14 bp, Homo sapiens
tagagatatttaaa

SEQ ID NO: 2735103 - DNA, 16 bp, Homo sapiens
tagagatatttaaaag

SEQ ID NO: 2735104 - DNA, 19 bp, Homo sapiens
tagagatatttaaaagaca

SEQ ID NO: 2735105 - DNA, 20 bp, Homo sapiens
tagagatatttaaaagacaa

SEQ ID NO: 2735106 - DNA, 14 bp, Homo sapiens
tagagctcctgtcc

SEQ ID NO: 2735107 - DNA, 15 bp, Homo sapiens
tagagctcctgtccc

SEQ ID NO: 2735108 - DNA, 23 bp, Homo sapiens
tagaggtcccctcacgtgaccag

SEQ ID NO: 2735109 - DNA, 13 bp, Homo sapiens
tagagtcagcctt

SEQ ID NO: 2735110 - DNA, 13 bp, Homo sapiens
tagagtctggaat

SEQ ID NO: 2735111 - DNA, 19 bp, Homo sapiens
tagagtggcgattgaatgc

SEQ ID NO: 2735112 - DNA, 21 bp, Homo sapiens
tagatccaggcttctcccgga

SEQ ID NO: 2735113 - DNA, 20 bp, Homo sapiens
tagattctcacctgccttca

SEQ ID NO: 2735114 - DNA, 21 bp, Homo sapiens
tagcaaagattaaatgtgtca

SEQ ID NO: 2735115 - DNA, 13 bp, Homo sapiens
tagcacatgattt

SEQ ID NO: 2735116 - DNA, 18 bp, Homo sapiens
tagcacatgattttcttt

SEQ ID NO: 2735117 - DNA, 20 bp, Homo sapiens
tagccaaggtgggctgagcc

SEQ ID NO: 2735118 - DNA, 20 bp, Homo sapiens
tagccaggatggtcttgatc

SEQ ID NO: 2735119 - DNA, 17 bp, Homo sapiens
tagccagtcattgtaac

SEQ ID NO: 2735120 - DNA, 22 bp, Homo sapiens
tagcgtccatttcttatttaat

SEQ ID NO: 2735121 - DNA, 15 bp, Homo sapiens
tagctacttttcaga

SEQ ID NO: 2735122 - DNA, 17 bp, Homo sapiens
tagctagctatttctat

SEQ ID NO: 2735123 - DNA, 18 bp, Homo sapiens
tagctagctatttctatg

SEQ ID NO: 2735124 - DNA, 20 bp, Homo sapiens
tagcttttagttttaaaact

SEQ ID NO: 2735125 - DNA, 21 bp, Homo sapiens
taggaaagcaccgcagcatgt

SEQ ID NO: 2735126 - DNA, 23 bp, Homo sapiens
taggaagttacctggatgccatt

SEQ ID NO: 2735127 - DNA, 14 bp, Homo sapiens
taggactctgaggc

SEQ ID NO: 2735128 - DNA, 23 bp, Homo sapiens
taggagttcgagaccagcctggc

SEQ ID NO: 2735129 - DNA, 18 bp, Homo sapiens
taggataaattacattaa

SEQ ID NO: 2735130 - DNA, 17 bp, Homo sapiens
taggatgaatgggaaag

SEQ ID NO: 2735131 - DNA, 15 bp, Homo sapiens
taggattttctcaag

SEQ ID NO: 2735132 - DNA, 12 bp, Homo sapiens
taggcagcctgc

SEQ ID NO: 2735133 - DNA, 15 bp, Homo sapiens
taggcagggatttga

SEQ ID NO: 2735134 - DNA, 17 bp, Homo sapiens
taggcagggatttgagg

SEQ ID NO: 2735135 - DNA, 15 bp, Homo sapiens
tagggaagcagggac

SEQ ID NO: 2735136 - DNA, 19 bp, Homo sapiens
tagggcaaagatctcagca

SEQ ID NO: 2735137 - DNA, 14 bp, Homo sapiens
tagggcctcggagg

SEQ ID NO: 2735138 - DNA, 18 bp, Homo sapiens
tagggcctcggaggctcc

SEQ ID NO: 2735139 - DNA, 23 bp, Homo sapiens
tagggcctcggaggctcctccct

SEQ ID NO: 2735140 - DNA, 13 bp, Homo sapiens
tagggtccttgaa

SEQ ID NO: 2735141 - DNA, 23 bp, Homo sapiens
tagtatctattgtgttggcttta

SEQ ID NO: 2735142 - DNA, 19 bp, Homo sapiens
tagtcaataactctgattt

SEQ ID NO: 2735143 - DNA, 15 bp, Homo sapiens
tagtcacctctgggc

SEQ ID NO: 2735144 - DNA, 21 bp, Homo sapiens
tagtcccagctactcagaagc

SEQ ID NO: 2735145 - DNA, 18 bp, Homo sapiens
tagtcctagaggacctga

SEQ ID NO: 2735146 - DNA, 16 bp, Homo sapiens
tagtcctttttgtaac

SEQ ID NO: 2735147 - DNA, 23 bp, Homo sapiens
tagtgccctccacagccgcagcc

SEQ ID NO: 2735148 - DNA, 14 bp, Homo sapiens
tagtgcttcttgta

SEQ ID NO: 2735149 - DNA, 22 bp, Homo sapiens
tagtgcttcttgtaatatttct

SEQ ID NO: 2735150 - DNA, 22 bp, Homo sapiens
tagttctcaatcactgctcccc

SEQ ID NO: 2735151 - DNA, 20 bp, Homo sapiens
tagttgattgcgagaatttt

SEQ ID NO: 2735152 - DNA, 18 bp, Homo sapiens
tagtttaaaatgaagcaa

SEQ ID NO: 2735153 - DNA, 17 bp, Homo sapiens
tataaaaaatggtgcct

SEQ ID NO: 2735154 - DNA, 19 bp, Homo sapiens
tataaaaaatggtgcctga

SEQ ID NO: 2735155 - DNA, 13 bp, Homo sapiens
tataaacatgaag

SEQ ID NO: 2735156 - DNA, 15 bp, Homo sapiens
tataaacatgaaggg

SEQ ID NO: 2735157 - DNA, 14 bp, Homo sapiens
tataaatatgtgaa

SEQ ID NO: 2735158 - DNA, 19 bp, Homo sapiens
tataaatatgtgaaaatga

SEQ ID NO: 2735159 - DNA, 15 bp, Homo sapiens
tataacaaactatgt

SEQ ID NO: 2735160 - DNA, 14 bp, Homo sapiens
tataacttatttgc

SEQ ID NO: 2735161 - DNA, 15 bp, Homo sapiens
tataagcaagacagt

SEQ ID NO: 2735162 - DNA, 22 bp, Homo sapiens
tataagcaagacagtggcacta

SEQ ID NO: 2735163 - DNA, 13 bp, Homo sapiens
tataatttaaaga

SEQ ID NO: 2735164 - DNA, 14 bp, Homo sapiens
tataatttaaagaa

SEQ ID NO: 2735165 - DNA, 19 bp, Homo sapiens
tataattttattgctggaa

SEQ ID NO: 2735166 - DNA, 13 bp, Homo sapiens
tatacaaacaggt

SEQ ID NO: 2735167 - DNA, 18 bp, Homo sapiens
tatacaactttcatttaa

SEQ ID NO: 2735168 - DNA, 23 bp, Homo sapiens
tatacagattcctgttgtgtaat

SEQ ID NO: 2735169 - DNA, 18 bp, Homo sapiens
tatacataaacagttttg

SEQ ID NO: 2735170 - DNA, 16 bp, Homo sapiens
tataccccatttgatt

SEQ ID NO: 2735171 - DNA, 19 bp, Homo sapiens
tatagaattatattttctt

SEQ ID NO: 2735172 - DNA, 15 bp, Homo sapiens
tatagagatatgcag

SEQ ID NO: 2735173 - DNA, 22 bp, Homo sapiens
tatagctagctatttctatgta

SEQ ID NO: 2735174 - DNA, 19 bp, Homo sapiens
tatagctctacacaacatg

SEQ ID NO: 2735175 - DNA, 18 bp, Homo sapiens
tataggataaattacatt

SEQ ID NO: 2735176 - DNA, 20 bp, Homo sapiens
tataggataaattacattaa

SEQ ID NO: 2735177 - DNA, 11 bp, Homo sapiens
tataggcagat

SEQ ID NO: 2735178 - DNA, 18 bp, Homo sapiens
tataggcagatctttaaa

SEQ ID NO: 2735179 - DNA, 13 bp, Homo sapiens
tatataaagaaaa

SEQ ID NO: 2735180 - DNA, 21 bp, Homo sapiens
tatataaagaaaatcaatgaa

SEQ ID NO: 2735181 - DNA, 13 bp, Homo sapiens
tatataatgcaac

SEQ ID NO: 2735182 - DNA, 18 bp, Homo sapiens
tatataattttattgctg

SEQ ID NO: 2735183 - DNA, 18 bp, Homo sapiens
tatatacaaagccttggt

SEQ ID NO: 2735184 - DNA, 17 bp, Homo sapiens
taaattctctctaacat

SEQ ID NO: 2735185 - DNA, 15 bp, Homo sapiens
taaattcttaaaact

SEQ ID NO: 2735186 - DNA, 22 bp, Homo sapiens
taaattcttaaaactttctaaa

SEQ ID NO: 2735187 - DNA, 19 bp, Homo sapiens
taaatttgttgtcatgtgt

SEQ ID NO: 2735188 - DNA, 21 bp, Homo sapiens
taaatttgttgtcatgtgtat

SEQ ID NO: 2735189 - DNA, 13 bp, Homo sapiens
taacaaattattt

SEQ ID NO: 2735190 - DNA, 23 bp, Homo sapiens
taacaatatgattgcactaaata

SEQ ID NO: 2735191 - DNA, 20 bp, Homo sapiens
taacatgaaaaacacggcag

SEQ ID NO: 2735192 - DNA, 22 bp, Homo sapiens
taacatgtgatggttgattcac

SEQ ID NO: 2735193 - DNA, 15 bp, Homo sapiens
taacatttaggagaa

SEQ ID NO: 2735194 - DNA, 16 bp, Homo sapiens
taacgaacgttttaaa

SEQ ID NO: 2735195 - DNA, 21 bp, Homo sapiens
taactaccctctcaaatggac

SEQ ID NO: 2735196 - DNA, 17 bp, Homo sapiens
taactcagacattccaa

SEQ ID NO: 2735197 - DNA, 19 bp, Homo sapiens
taactccagtgatgttctt

SEQ ID NO: 2735198 - DNA, 14 bp, Homo sapiens
taactcccactcct

SEQ ID NO: 2735199 - DNA, 12 bp, Homo sapiens
taactctgattt

SEQ ID NO: 2735200 - DNA, 15 bp, Homo sapiens
taactctgcaggaaa

SEQ ID NO: 2735201 - DNA, 22 bp, Homo sapiens
taactttgcttgattaaacagc

SEQ ID NO: 2735202 - DNA, 12 bp, Homo sapiens
taagaatagtct

SEQ ID NO: 2735203 - DNA, 15 bp, Homo sapiens
taagaggcagcgtga

SEQ ID NO: 2735204 - DNA, 21 bp, Homo sapiens
taagagggtgaacaaagaaaa

SEQ ID NO: 2735205 - DNA, 18 bp, Homo sapiens
taagatactcaagcaggt

SEQ ID NO: 2735206 - DNA, 15 bp, Homo sapiens
taagatgatgttaaa

SEQ ID NO: 2735207 - DNA, 17 bp, Homo sapiens
taagcagagttctttgc

SEQ ID NO: 2735208 - DNA, 18 bp, Homo sapiens
taagcagagttctttgca

SEQ ID NO: 2735209 - DNA, 15 bp, Homo sapiens
taagcagattacaat

SEQ ID NO: 2735210 - DNA, 23 bp, Homo sapiens
taagcagattacaataaatcctt

SEQ ID NO: 2735211 - DNA, 21 bp, Homo sapiens
taagcattctgagctgggctt

SEQ ID NO: 2735212 - DNA, 17 bp, Homo sapiens
taagcgggatcccagca

SEQ ID NO: 2735213 - DNA, 19 bp, Homo sapiens
taagctctatctgcaatgt

SEQ ID NO: 2735214 - DNA, 12 bp, Homo sapiens
taagctgtaaaa

SEQ ID NO: 2735215 - DNA, 15 bp, Homo sapiens
taagctgtaaaaaga

SEQ ID NO: 2735216 - DNA, 14 bp, Homo sapiens
taagctgtagaact

SEQ ID NO: 2735217 - DNA, 19 bp, Homo sapiens
taagcttagattttctgta

SEQ ID NO: 2735218 - DNA, 15 bp, Homo sapiens
taagctttctccttt

SEQ ID NO: 2735219 - DNA, 16 bp, Homo sapiens
taagctttctcctttg

SEQ ID NO: 2735220 - DNA, 16 bp, Homo sapiens
taaggatcttttgtaa

SEQ ID NO: 2735221 - DNA, 19 bp, Homo sapiens
taaggatggagccagctct

SEQ ID NO: 2735222 - DNA, 16 bp, Homo sapiens
taaggcagaactagga

SEQ ID NO: 2735223 - DNA, 18 bp, Homo sapiens
taaggcttaggtgccagg

SEQ ID NO: 2735224 - DNA, 20 bp, Homo sapiens
taaggtacggtgagactctg

SEQ ID NO: 2735225 - DNA, 17 bp, Homo sapiens
taaggtcttcttgtgtc

SEQ ID NO: 2735226 - DNA, 20 bp, Homo sapiens
taaggtcttcttgtgtcctg

SEQ ID NO: 2735227 - DNA, 18 bp, Homo sapiens
taagtcatggtcctggct

SEQ ID NO: 2735228 - DNA, 18 bp, Homo sapiens
taagtgtggatgttcaga

SEQ ID NO: 2735229 - DNA, 17 bp, Homo sapiens
taagttgaatggcctgc

SEQ ID NO: 2735230 - DNA, 20 bp, Homo sapiens
taagtttatgtctaaagagc

SEQ ID NO: 2735231 - DNA, 13 bp, Homo sapiens
taagttttataca

SEQ ID NO: 2735232 - DNA, 22 bp, Homo sapiens
taatatctgagaagtgtatata

SEQ ID NO: 2735233 - DNA, 13 bp, Homo sapiens
taatatgaaagcc

SEQ ID NO: 2735234 - DNA, 12 bp, Homo sapiens
taatattctctg

SEQ ID NO: 2735235 - DNA, 13 bp, Homo sapiens
taatatttcttca

SEQ ID NO: 2735236 - DNA, 18 bp, Homo sapiens
taatcaagagtctctcca

SEQ ID NO: 2735237 - DNA, 21 bp, Homo sapiens
taatcaagagtctctccagcc

SEQ ID NO: 2735238 - DNA, 19 bp, Homo sapiens
taatcatcaggtttactca

SEQ ID NO: 2735239 - DNA, 20 bp, Homo sapiens
taatccatgtgctgctgtgg

SEQ ID NO: 2735240 - DNA, 15 bp, Homo sapiens
taatctgttgtttga

SEQ ID NO: 2735241 - DNA, 17 bp, Homo sapiens
taatgaggtccctctag

SEQ ID NO: 2735242 - DNA, 15 bp, Homo sapiens
taatgcttatgtgtt

SEQ ID NO: 2735243 - DNA, 14 bp, Homo sapiens
taatggaaacatgc

SEQ ID NO: 2735244 - DNA, 19 bp, Homo sapiens
taattcaccaaaagttcat

SEQ ID NO: 2735245 - DNA, 12 bp, Homo sapiens
taatttaaagaa

SEQ ID NO: 2735246 - DNA, 17 bp, Homo sapiens
taatttaaagaaacact

SEQ ID NO: 2735247 - DNA, 19 bp, Homo sapiens
taatttaaagaaacactaa

SEQ ID NO: 2735248 - DNA, 19 bp, Homo sapiens
taatttataggcagatctt

SEQ ID NO: 2735249 - DNA, 20 bp, Homo sapiens
taatttataggcagatcttt

SEQ ID NO: 2735250 - DNA, 23 bp, Homo sapiens
taatttgtgcatcagaaaatgca

SEQ ID NO: 2735251 - DNA, 20 bp, Homo sapiens
taattttttgcagtcttttg

SEQ ID NO: 2735252 - DNA, 23 bp, Homo sapiens
taattttttgcagtcttttgctg

SEQ ID NO: 2735253 - DNA, 20 bp, Homo sapiens
tacaaaagcagcttttagtt

SEQ ID NO: 2735254 - DNA, 15 bp, Homo sapiens
tacaaacaggtgcta

SEQ ID NO: 2735255 - DNA, 13 bp, Homo sapiens
tacaaataaagat

SEQ ID NO: 2735256 - DNA, 16 bp, Homo sapiens
tacaaataattttttg

SEQ ID NO: 2735257 - DNA, 15 bp, Homo sapiens
tacaacaaacactgt

SEQ ID NO: 2735258 - DNA, 20 bp, Homo sapiens
tacaacaaacactgtgatgt

SEQ ID NO: 2735259 - DNA, 13 bp, Homo sapiens
tacaacctatgta

SEQ ID NO: 2735260 - DNA, 15 bp, Homo sapiens
tacaagcaagcaaaa

SEQ ID NO: 2735261 - DNA, 13 bp, Homo sapiens
tacaaggtatgta

SEQ ID NO: 2735262 - DNA, 10 bp, Homo sapiens
tacaataaat

SEQ ID NO: 2735263 - DNA, 11 bp, Homo sapiens
tacaataaatg

SEQ ID NO: 2735264 - DNA, 13 bp, Homo sapiens
tacaataaatgct

SEQ ID NO: 2735265 - DNA, 16 bp, Homo sapiens
tacacaacatgtatgt

SEQ ID NO: 2735266 - DNA, 15 bp, Homo sapiens
tacactccagcctga

SEQ ID NO: 2735267 - DNA, 18 bp, Homo sapiens
tacactccagcctgagca

SEQ ID NO: 2735268 - DNA, 11 bp, Homo sapiens
tacactttatt

SEQ ID NO: 2735269 - DNA, 19 bp, Homo sapiens
tacagagaaattctgtggt

SEQ ID NO: 2735270 - DNA, 11 bp, Homo sapiens
tacagcagggt

SEQ ID NO: 2735271 - DNA, 18 bp, Homo sapiens
tacagcagggtcttgctg

SEQ ID NO: 2735272 - DNA, 21 bp, Homo sapiens
tacagcagggtcttgctgtaa

SEQ ID NO: 2735273 - DNA, 13 bp, Homo sapiens
tacagtaaataaa

SEQ ID NO: 2735274 - DNA, 15 bp, Homo sapiens
tacagtaaataaatt

SEQ ID NO: 2735275 - DNA, 16 bp, Homo sapiens
tacagtaaataaattg

SEQ ID NO: 2735276 - DNA, 21 bp, Homo sapiens
tacagtaaataaattgtttga

SEQ ID NO: 2735277 - DNA, 13 bp, Homo sapiens
tacagtcattatt

SEQ ID NO: 2735278 - DNA, 14 bp, Homo sapiens
tacagtctcaattt

SEQ ID NO: 2735279 - DNA, 17 bp, Homo sapiens
tacagtctcaattttgt

SEQ ID NO: 2735280 - DNA, 13 bp, Homo sapiens
tacagtgatatgg

SEQ ID NO: 2735281 - DNA, 12 bp, Homo sapiens
tacagttcagtt

SEQ ID NO: 2735282 - DNA, 22 bp, Homo sapiens
tacagttcagttcctctttgca

SEQ ID NO: 2735283 - DNA, 19 bp, Homo sapiens
tacataatttgcaatttca

SEQ ID NO: 2735284 - DNA, 16 bp, Homo sapiens
tacatacaacctatgt

SEQ ID NO: 2735285 - DNA, 16 bp, Homo sapiens
tacattactgtatgta

SEQ ID NO: 2735286 - DNA, 22 bp, Homo sapiens
tacattatattcctctaaaact

SEQ ID NO: 2735287 - DNA, 12 bp, Homo sapiens
tacattatgtta

SEQ ID NO: 2735288 - DNA, 13 bp, Homo sapiens
tacattatgttat

SEQ ID NO: 2735289 - DNA, 22 bp, Homo sapiens
tacattatgttattggaatttt

SEQ ID NO: 2735290 - DNA, 16 bp, Homo sapiens
tacattcatctggagg

SEQ ID NO: 2735291 - DNA, 20 bp, Homo sapiens
taccaagccaccgcagctgc

SEQ ID NO: 2735292 - DNA, 21 bp, Homo sapiens
taccaagccaccgcagctgct

SEQ ID NO: 2735293 - DNA, 22 bp, Homo sapiens
taccaagccaccgcagctgctg

SEQ ID NO: 2735294 - DNA, 17 bp, Homo sapiens
taccacaccctgcctgc

SEQ ID NO: 2735295 - DNA, 19 bp, Homo sapiens
taccacaccctgcctgctg

SEQ ID NO: 2735296 - DNA, 14 bp, Homo sapiens
taccactcaggcca

SEQ ID NO: 2735297 - DNA, 16 bp, Homo sapiens
taccaggcacatggct

SEQ ID NO: 2735298 - DNA, 14 bp, Homo sapiens
taccaggtctcctc

SEQ ID NO: 2735299 - DNA, 16 bp, Homo sapiens
taccaggtctcctcca

SEQ ID NO: 2735300 - DNA, 20 bp, Homo sapiens
taccaggtctcctccaccgc

SEQ ID NO: 2735301 - DNA, 18 bp, Homo sapiens
taccatattgctcttaaa

SEQ ID NO: 2735302 - DNA, 20 bp, Homo sapiens
taccatattgctcttaaaaa

SEQ ID NO: 2735303 - DNA, 16 bp, Homo sapiens
taccattattttacag

SEQ ID NO: 2735304 - DNA, 17 bp, Homo sapiens
taccattattttacagt

SEQ ID NO: 2735305 - DNA, 13 bp, Homo sapiens
tacccactctttg

SEQ ID NO: 2735306 - DNA, 18 bp, Homo sapiens
tacccactctttgctaca

SEQ ID NO: 2735307 - DNA, 14 bp, Homo sapiens
tacccagtcatgta

SEQ ID NO: 2735308 - DNA, 18 bp, Homo sapiens
tacccatccaactcctct

SEQ ID NO: 2735309 - DNA, 16 bp, Homo sapiens
gtctttgcaaaggact

SEQ ID NO: 2735310 - DNA, 16 bp, Homo sapiens
gtctttggtgaacatt

SEQ ID NO: 2735311 - DNA, 14 bp, Homo sapiens
gtgaaaaatgagct

SEQ ID NO: 2735312 - DNA, 20 bp, Homo sapiens
gtgaaaaatgagcttgtaaa

SEQ ID NO: 2735313 - DNA, 19 bp, Homo sapiens
gtgaaagatgcaagcacct

SEQ ID NO: 2735314 - DNA, 22 bp, Homo sapiens
gtgaaattcaacctgtgtctta

SEQ ID NO: 2735315 - DNA, 13 bp, Homo sapiens
gtgaactgagact

SEQ ID NO: 2735316 - DNA, 17 bp, Homo sapiens
gtgaattacactcaagg

SEQ ID NO: 2735317 - DNA, 22 bp, Homo sapiens
gtgaattacactcaaggaaaag

SEQ ID NO: 2735318 - DNA, 22 bp, Homo sapiens
gtgacaacatttttgtacatta

SEQ ID NO: 2735319 - DNA, 20 bp, Homo sapiens
gtgacacagctgagctggcc

SEQ ID NO: 2735320 - DNA, 19 bp, Homo sapiens
gttcacaccattctcctgc

SEQ ID NO: 2735321 - DNA, 22 bp, Homo sapiens
gttcacaccattctcctgcctc

SEQ ID NO: 2735322 - DNA, 13 bp, Homo sapiens
gttcacactccta

SEQ ID NO: 2735323 - DNA, 13 bp, Homo sapiens
gttcagaattttg

SEQ ID NO: 2735324 - DNA, 19 bp, Homo sapiens
gttcagaattttggaaaaa

SEQ ID NO: 2735325 - DNA, 22 bp, Homo sapiens
gttcagaattttggaaaaatgt

SEQ ID NO: 2735326 - DNA, 17 bp, Homo sapiens
gttcagtagttccagga

SEQ ID NO: 2735327 - DNA, 23 bp, Homo sapiens
gttcataaatttgttgtcatgtg

SEQ ID NO: 2735328 - DNA, 19 bp, Homo sapiens
gttcattcaaaatgtccag

SEQ ID NO: 2735329 - DNA, 22 bp, Homo sapiens
gttcctcgggatgaaaagccat

SEQ ID NO: 2735330 - DNA, 16 bp, Homo sapiens
gttcgagaccagcctg

SEQ ID NO: 2735331 - DNA, 19 bp, Homo sapiens
gttctaactcttagaagtg

SEQ ID NO: 2735332 - DNA, 16 bp, Homo sapiens
gttctgcactcctgga

SEQ ID NO: 2735333 - DNA, 15 bp, Homo sapiens
gttctgtgtcctcgc

SEQ ID NO: 2735334 - DNA, 12 bp, Homo sapiens
gttgaaagacat

SEQ ID NO: 2735335 - DNA, 14 bp, Homo sapiens
gttgaaagacatca

SEQ ID NO: 2735336 - DNA, 19 bp, Homo sapiens
gttgaaagacatcaatgaa

SEQ ID NO: 2735337 - DNA, 13 bp, Homo sapiens
gttgagtttgctg

SEQ ID NO: 2735338 - DNA, 16 bp, Homo sapiens
gttgcataaacaatcc

SEQ ID NO: 2735339 - DNA, 20 bp, Homo sapiens
gttgcataaacaatccaaat

SEQ ID NO: 2735340 - DNA, 17 bp, Homo sapiens
gttgctgttgctgttgg

SEQ ID NO: 2735341 - DNA, 23 bp, Homo sapiens
gttgctgttggcatcttgctgct

SEQ ID NO: 2735342 - DNA, 12 bp, Homo sapiens
gttggaaaagaa

SEQ ID NO: 2735343 - DNA, 21 bp, Homo sapiens
gttgggccatactggcctcgc

SEQ ID NO: 2735344 - DNA, 15 bp, Homo sapiens
gttgtcatgtgtatg

SEQ ID NO: 2735345 - DNA, 14 bp, Homo sapiens
gttgtctccctggc

SEQ ID NO: 2735346 - DNA, 12 bp, Homo sapiens
gttgtctttctt

SEQ ID NO: 2735347 - DNA, 19 bp, Homo sapiens
gttgtttttaagtcctgta

SEQ ID NO: 2735348 - DNA, 14 bp, Homo sapiens
gtttaaaaaaagta

SEQ ID NO: 2735349 - DNA, 23 bp, Homo sapiens
gtttaaaaaaagtatatattcta

SEQ ID NO: 2735350 - DNA, 19 bp, Homo sapiens
gtttaaaagtccactttta

SEQ ID NO: 2735351 - DNA, 15 bp, Homo sapiens
gtttacaacaaacac

SEQ ID NO: 2735352 - DNA, 16 bp, Homo sapiens
gtttacaacaaacact

SEQ ID NO: 2735353 - DNA, 21 bp, Homo sapiens
gtttacaacaaacactgtgat

SEQ ID NO: 2735354 - DNA, 19 bp, Homo sapiens
gtttacagtaaataaattg

SEQ ID NO: 2735355 - DNA, 12 bp, Homo sapiens
gtttacagtgta

SEQ ID NO: 2735356 - DNA, 19 bp, Homo sapiens
gtttatggggctctcacag

SEQ ID NO: 2735357 - DNA, 15 bp, Homo sapiens
gtttcactgttcatg

SEQ ID NO: 2735358 - DNA, 15 bp, Homo sapiens
gtttcatgagcccaa

SEQ ID NO: 2735359 - DNA, 21 bp, Homo sapiens
gtttccaaagggcagtaaagt

SEQ ID NO: 2735360 - DNA, 19 bp, Homo sapiens
gtttccagctaagcctgat

SEQ ID NO: 2735361 - DNA, 18 bp, Homo sapiens
gtttcccagtgagcctct

SEQ ID NO: 2735362 - DNA, 19 bp, Homo sapiens
gtttcccagtgagcctctg

SEQ ID NO: 2735363 - DNA, 20 bp, Homo sapiens
gtttcccagtgagcctctgc

SEQ ID NO: 2735364 - DNA, 22 bp, Homo sapiens
gtttccgtggcaaccctcagct

SEQ ID NO: 2735365 - DNA, 14 bp, Homo sapiens
gtttctcaaagaaa

SEQ ID NO: 2735366 - DNA, 23 bp, Homo sapiens
gtttctccccctgggctctgccc

SEQ ID NO: 2735367 - DNA, 23 bp, Homo sapiens
gtttctcggcaccagtgcctcag

SEQ ID NO: 2735368 - DNA, 21 bp, Homo sapiens
gtttctgcccacattggaccc

SEQ ID NO: 2735369 - DNA, 11 bp, Homo sapiens
gtttcttgctt

SEQ ID NO: 2735370 - DNA, 19 bp, Homo sapiens
gtttgaaagtgaataaact

SEQ ID NO: 2735371 - DNA, 20 bp, Homo sapiens
gtttgacgaagaaacaaaaa

SEQ ID NO: 2735372 - DNA, 23 bp, Homo sapiens
gtttgcacagagggcgctcctgt

SEQ ID NO: 2735373 - DNA, 13 bp, Homo sapiens
gtttgcttctaaa

SEQ ID NO: 2735374 - DNA, 21 bp, Homo sapiens
gtttgggggttaccaaaaata

SEQ ID NO: 2735375 - DNA, 23 bp, Homo sapiens
gtttggtacagttcataattcac

SEQ ID NO: 2735376 - DNA, 22 bp, Homo sapiens
gtttgtataccatgatgcatgg

SEQ ID NO: 2735377 - DNA, 13 bp, Homo sapiens
gtttgtcagtaaa

SEQ ID NO: 2735378 - DNA, 15 bp, Homo sapiens
gtttgttcacactcc

SEQ ID NO: 2735379 - DNA, 15 bp, Homo sapiens
gttttaaaaataagt

SEQ ID NO: 2735380 - DNA, 18 bp, Homo sapiens
gttttatacataaacagt

SEQ ID NO: 2735381 - DNA, 14 bp, Homo sapiens
gttttccaccctgg

SEQ ID NO: 2735382 - DNA, 23 bp, Homo sapiens
gttttcccgagcaaagtctaaag

SEQ ID NO: 2735383 - DNA, 17 bp, Homo sapiens
gttttctggcttctgct

SEQ ID NO: 2735384 - DNA, 15 bp, Homo sapiens
gttttcttctaatca

SEQ ID NO: 2735385 - DNA, 19 bp, Homo sapiens
gttttggagaaaaattaca

SEQ ID NO: 2735386 - DNA, 15 bp, Homo sapiens
gtttttaagtcctgt

SEQ ID NO: 2735387 - DNA, 23 bp, Homo sapiens
gtttttgttgagtctctgaacat

SEQ ID NO: 2735388 - DNA, 15 bp, Homo sapiens
taaaaaaacacaaaa

SEQ ID NO: 2735389 - DNA, 11 bp, Homo sapiens
taaaaagaaat

SEQ ID NO: 2735390 - DNA, 19 bp, Homo sapiens
taaaaataagttttataca

SEQ ID NO: 2735391 - DNA, 19 bp, Homo sapiens
taaaaatgatgataatcat

SEQ ID NO: 2735392 - DNA, 21 bp, Homo sapiens
taaaacacacctaagagaaaa

SEQ ID NO: 2735393 - DNA, 14 bp, Homo sapiens
taaaacagaagcaa

SEQ ID NO: 2735394 - DNA, 14 bp, Homo sapiens
taaaagacaaacac

SEQ ID NO: 2735395 - DNA, 17 bp, Homo sapiens
taaaagagtagaaaagg

SEQ ID NO: 2735396 - DNA, 20 bp, Homo sapiens
taaaagcacaagtacttttg

SEQ ID NO: 2735397 - DNA, 18 bp, Homo sapiens
taaaagggttcaaggact

SEQ ID NO: 2735398 - DNA, 15 bp, Homo sapiens
taaaagtttgtcctt

SEQ ID NO: 2735399 - DNA, 18 bp, Homo sapiens
taaaagtttgtcctttaa

SEQ ID NO: 2735400 - DNA, 18 bp, Homo sapiens
taaaatagagtctggaat

SEQ ID NO: 2735401 - DNA, 19 bp, Homo sapiens
taaaatctggcaaagttat

SEQ ID NO: 2735402 - DNA, 17 bp, Homo sapiens
taaaatcttcagctggt

SEQ ID NO: 2735403 - DNA, 18 bp, Homo sapiens
taaaatcttcagctggtg

SEQ ID NO: 2735404 - DNA, 18 bp, Homo sapiens
taaaatgaagcaatttat

SEQ ID NO: 2735405 - DNA, 16 bp, Homo sapiens
taaaatgctttaaaaa

SEQ ID NO: 2735406 - DNA, 17 bp, Homo sapiens
taaaatgtttaattcat

SEQ ID NO: 2735407 - DNA, 15 bp, Homo sapiens
taaaattgtaaaatt

SEQ ID NO: 2735408 - DNA, 19 bp, Homo sapiens
taaaattgtaaaattgtat

SEQ ID NO: 2735409 - DNA, 23 bp, Homo sapiens
taaaattttttgatgtcagcctt

SEQ ID NO: 2735410 - DNA, 18 bp, Homo sapiens
taaacagatgtccctgaa

SEQ ID NO: 2735411 - DNA, 16 bp, Homo sapiens
taaacagcaaagccat

SEQ ID NO: 2735412 - DNA, 18 bp, Homo sapiens
taaaccttgtttctttct

SEQ ID NO: 2735413 - DNA, 24 bp, Homo sapiens
taaactcctactgcttcctctgaa

SEQ ID NO: 2735414 - DNA, 21 bp, Homo sapiens
taaacttagaataaaattgta

SEQ ID NO: 2735415 - DNA, 13 bp, Homo sapiens
taaacttcagcac

SEQ ID NO: 2735416 - DNA, 22 bp, Homo sapiens
taaagaaaagttttgtaaattt

SEQ ID NO: 2735417 - DNA, 16 bp, Homo sapiens
taaagaaacactaaat

SEQ ID NO: 2735418 - DNA, 19 bp, Homo sapiens
taaagacagggtttcacca

SEQ ID NO: 2735419 - DNA, 10 bp, Homo sapiens
taaagagctc

SEQ ID NO: 2735420 - DNA, 11 bp, Homo sapiens
taaagcagagt

SEQ ID NO: 2735421 - DNA, 20 bp, Homo sapiens
taaagcttacccttggtttg

SEQ ID NO: 2735422 - DNA, 16 bp, Homo sapiens
taaaggacaaacagtg

SEQ ID NO: 2735423 - DNA, 19 bp, Homo sapiens
taaaggacaaacagtgaat

SEQ ID NO: 2735424 - DNA, 17 bp, Homo sapiens
taaaggagaaggcatga

SEQ ID NO: 2735425 - DNA, 22 bp, Homo sapiens
taaaggagaaggcatgaaattg

SEQ ID NO: 2735426 - DNA, 22 bp, Homo sapiens
taaaggtatttagaatatatta

SEQ ID NO: 2735427 - DNA, 14 bp, Homo sapiens
taaagtttacagta

SEQ ID NO: 2735428 - DNA, 16 bp, Homo sapiens
taaagtttacagtaaa

SEQ ID NO: 2735429 - DNA, 13 bp, Homo sapiens
taaataaaagcac

SEQ ID NO: 2735430 - DNA, 22 bp, Homo sapiens
taaataaaagcacaagtacttt

SEQ ID NO: 2735431 - DNA, 20 bp, Homo sapiens
taaatacacagcatgcagac

SEQ ID NO: 2735432 - DNA, 21 bp, Homo sapiens
taaatactccattattttatt

SEQ ID NO: 2735433 - DNA, 21 bp, Homo sapiens
taaatatagttgtctttcttt

SEQ ID NO: 2735434 - DNA, 22 bp, Homo sapiens
taaatatagttgtctttctttg

SEQ ID NO: 2735435 - DNA, 16 bp, Homo sapiens
taaatatatatttatc

SEQ ID NO: 2735436 - DNA, 23 bp, Homo sapiens
taaatgccttggtttgatttcta

SEQ ID NO: 2735437 - DNA, 18 bp, Homo sapiens
taaatgcttcttaaagtt

SEQ ID NO: 2735438 - DNA, 16 bp, Homo sapiens
taaattatttctaaaa

SEQ ID NO: 2735439 - DNA, 19 bp, Homo sapiens
gcccaaacaccctcctggc

SEQ ID NO: 2735440 - DNA, 22 bp, Homo sapiens
gcccaaacaccctcctggcaca

SEQ ID NO: 2735441 - DNA, 14 bp, Homo sapiens
gcccaacaggccct

SEQ ID NO: 2735442 - DNA, 19 bp, Homo sapiens
gcccaaccatcggtccaca

SEQ ID NO: 2735443 - DNA, 17 bp, Homo sapiens
gcccacacacactcctt

SEQ ID NO: 2735444 - DNA, 18 bp, Homo sapiens
gcccacacacactccttc

SEQ ID NO: 2735445 - DNA, 11 bp, Homo sapiens
gcccacagccc

SEQ ID NO: 2735446 - DNA, 14 bp, Homo sapiens
gcccacagctctgc

SEQ ID NO: 2735447 - DNA, 15 bp, Homo sapiens
gcccacagctctgct

SEQ ID NO: 2735448 - DNA, 17 bp, Homo sapiens
gcccacagctctgctgg

SEQ ID NO: 2735449 - DNA, 16 bp, Homo sapiens
gcccaccagcggcctt

SEQ ID NO: 2735450 - DNA, 16 bp, Homo sapiens
gcccaccgcatgcccc

SEQ ID NO: 2735451 - DNA, 16 bp, Homo sapiens
gcccacgtcctgtcag

SEQ ID NO: 2735452 - DNA, 21 bp, Homo sapiens
gcccagagggcccaggcaggc

SEQ ID NO: 2735453 - DNA, 13 bp, Homo sapiens
gcccagccactgc

SEQ ID NO: 2735454 - DNA, 20 bp, Homo sapiens
gcccagccattaccatggag

SEQ ID NO: 2735455 - DNA, 20 bp, Homo sapiens
gcccagcctgtcctggtaca

SEQ ID NO: 2735456 - DNA, 13 bp, Homo sapiens
gcccagctccccc

SEQ ID NO: 2735457 - DNA, 16 bp, Homo sapiens
gcccagctcccccggg

SEQ ID NO: 2735458 - DNA, 17 bp, Homo sapiens
gcccagctcccccggga

SEQ ID NO: 2735459 - DNA, 19 bp, Homo sapiens
gcccagctcccccgggagg

SEQ ID NO: 2735460 - DNA, 13 bp, Homo sapiens
gcccagctgcacc

SEQ ID NO: 2735461 - DNA, 14 bp, Homo sapiens
gcccagctgcacct

SEQ ID NO: 2735462 - DNA, 19 bp, Homo sapiens
gcccaggacggggccggcc

SEQ ID NO: 2735463 - DNA, 23 bp, Homo sapiens
gcccaggacggggccggccaggt

SEQ ID NO: 2735464 - DNA, 14 bp, Homo sapiens
gcccaggcaggcca

SEQ ID NO: 2735465 - DNA, 13 bp, Homo sapiens
gcccaggccatct

SEQ ID NO: 2735466 - DNA, 20 bp, Homo sapiens
gcccaggctagagtgcagtg

SEQ ID NO: 2735467 - DNA, 20 bp, Homo sapiens
gcccaggctggagtgcaatg

SEQ ID NO: 2735468 - DNA, 13 bp, Homo sapiens
gcccaggctggcc

SEQ ID NO: 2735469 - DNA, 15 bp, Homo sapiens
gcccaggctggccag

SEQ ID NO: 2735470 - DNA, 20 bp, Homo sapiens
gcccatcagtgtacccccgc

SEQ ID NO: 2735471 - DNA, 12 bp, Homo sapiens
gcccatcccccc

SEQ ID NO: 2735472 - DNA, 15 bp, Homo sapiens
gcccatcccccctca

SEQ ID NO: 2735473 - DNA, 16 bp, Homo sapiens
gcccatcccccctcac

SEQ ID NO: 2735474 - DNA, 18 bp, Homo sapiens
gcccatcccccctcacca

SEQ ID NO: 2735475 - DNA, 22 bp, Homo sapiens
gcccatctgtccatcctcctct

SEQ ID NO: 2735476 - DNA, 17 bp, Homo sapiens
gcccatgggcactgctg

SEQ ID NO: 2735477 - DNA, 22 bp, Homo sapiens
gcccatgggcactgctgggtgg

SEQ ID NO: 2735478 - DNA, 20 bp, Homo sapiens
gccccaaacgggctgccctg

SEQ ID NO: 2735479 - DNA, 13 bp, Homo sapiens
gccccaaatcaca

SEQ ID NO: 2735480 - DNA, 19 bp, Homo sapiens
gccccaacccccagcaccc

SEQ ID NO: 2735481 - DNA, 17 bp, Homo sapiens
gccccacagcccacgtc

SEQ ID NO: 2735482 - DNA, 15 bp, Homo sapiens
gccccacccagggct

SEQ ID NO: 2735483 - DNA, 21 bp, Homo sapiens
gccccaccccaccctgcccct

SEQ ID NO: 2735484 - DNA, 21 bp, Homo sapiens
gccccaccctcaaaccctgtg

SEQ ID NO: 2735485 - DNA, 12 bp, Homo sapiens
gccccagcctgg

SEQ ID NO: 2735486 - DNA, 14 bp, Homo sapiens
gccccagcctggcc

SEQ ID NO: 2735487 - DNA, 16 bp, Homo sapiens
gccccagcctggccca

SEQ ID NO: 2735488 - DNA, 20 bp, Homo sapiens
gccccagcctggcccagctc

SEQ ID NO: 2735489 - DNA, 13 bp, Homo sapiens
gccccatctcctc

SEQ ID NO: 2735490 - DNA, 22 bp, Homo sapiens
gccccatctcctcccatggcct

SEQ ID NO: 2735491 - DNA, 20 bp, Homo sapiens
gcccccaccccagcacagct

SEQ ID NO: 2735492 - DNA, 17 bp, Homo sapiens
gccccccatcctggccc

SEQ ID NO: 2735493 - DNA, 14 bp, Homo sapiens
gccccctcgtgcca

SEQ ID NO: 2735494 - DNA, 15 bp, Homo sapiens
gccccgggctgaccc

SEQ ID NO: 2735495 - DNA, 19 bp, Homo sapiens
gcctgttgctgaagtcatt

SEQ ID NO: 2735496 - DNA, 19 bp, Homo sapiens
gccttaaggccacactggc

SEQ ID NO: 2735497 - DNA, 18 bp, Homo sapiens
gccttatgagaacatggt

SEQ ID NO: 2735498 - DNA, 15 bp, Homo sapiens
gccttgaagccactg

SEQ ID NO: 2735499 - DNA, 16 bp, Homo sapiens
gccttggtcccagaca

SEQ ID NO: 2735500 - DNA, 22 bp, Homo sapiens
gccttggtcccagacagctgga

SEQ ID NO: 2735501 - DNA, 18 bp, Homo sapiens
gccttggttcccttgtgt

SEQ ID NO: 2735502 - DNA, 23 bp, Homo sapiens
gcctttctcgtggtagaagccag

SEQ ID NO: 2735503 - DNA, 19 bp, Homo sapiens
gcctttgggaggcagcatc

SEQ ID NO: 2735504 - DNA, 15 bp, Homo sapiens
gcgaaggggccctgg

SEQ ID NO: 2735505 - DNA, 16 bp, Homo sapiens
gcgaaggggccctggt

SEQ ID NO: 2735506 - DNA, 15 bp, Homo sapiens
gcgaccccatctgcc

SEQ ID NO: 2735507 - DNA, 18 bp, Homo sapiens
gcgaccccatctgcccag

SEQ ID NO: 2735508 - DNA, 21 bp, Homo sapiens
gcgaccccatctgcccaggac

SEQ ID NO: 2735509 - DNA, 13 bp, Homo sapiens
gcgagaattttca

SEQ ID NO: 2735510 - DNA, 16 bp, Homo sapiens
gcgagaggaggggccc

SEQ ID NO: 2735511 - DNA, 21 bp, Homo sapiens
gcgagctatgatcgcgccact

SEQ ID NO: 2735512 - DNA, 19 bp, Homo sapiens
gcgcacctgccccctggtg

SEQ ID NO: 2735513 - DNA, 24 bp, Homo sapiens
gcgccactacactccagcctgagc

SEQ ID NO: 2735514 - DNA, 14 bp, Homo sapiens
gcgcctctccactg

SEQ ID NO: 2735515 - DNA, 18 bp, Homo sapiens
gcgcctgtcccctcacag

SEQ ID NO: 2735516 - DNA, 19 bp, Homo sapiens
gcgctgcctgtgtggtgtc

SEQ ID NO: 2735517 - DNA, 17 bp, Homo sapiens
gcgcttagaaacatgtt

SEQ ID NO: 2735518 - DNA, 13 bp, Homo sapiens
gcggcgcagaggg

SEQ ID NO: 2735519 - DNA, 19 bp, Homo sapiens
gcgggagtgggggctgtgc

SEQ ID NO: 2735520 - DNA, 15 bp, Homo sapiens
gcgggatggtcctgg

SEQ ID NO: 2735521 - DNA, 15 bp, Homo sapiens
gcgggcagcacagca

SEQ ID NO: 2735522 - DNA, 20 bp, Homo sapiens
gcgggggagccaacagcagc

SEQ ID NO: 2735523 - DNA, 19 bp, Homo sapiens
gcgggtggatcacctgagg

SEQ ID NO: 2735524 - DNA, 20 bp, Homo sapiens
gcgtgtcaactttcatttga

SEQ ID NO: 2735525 - DNA, 19 bp, Homo sapiens
gcgtgtcgtgggtgtgtgt

SEQ ID NO: 2735526 - DNA, 21 bp, Homo sapiens
gctaaagttatatttgtctgt

SEQ ID NO: 2735527 - DNA, 16 bp, Homo sapiens
gctaagcctgatgatg

SEQ ID NO: 2735528 - DNA, 22 bp, Homo sapiens
gctaaggaagacacagcccaga

SEQ ID NO: 2735529 - DNA, 13 bp, Homo sapiens
gctacaataaatg

SEQ ID NO: 2735530 - DNA, 15 bp, Homo sapiens
gctacaataaatgct

SEQ ID NO: 2735531 - DNA, 13 bp, Homo sapiens
gctaccctccctg

SEQ ID NO: 2735532 - DNA, 19 bp, Homo sapiens
gctaccctccctgctgtcc

SEQ ID NO: 2735533 - DNA, 14 bp, Homo sapiens
gctagccatatatt

SEQ ID NO: 2735534 - DNA, 12 bp, Homo sapiens
gctagggctgga

SEQ ID NO: 2735535 - DNA, 18 bp, Homo sapiens
gctagtctcttctcagag

SEQ ID NO: 2735536 - DNA, 21 bp, Homo sapiens
gctagtctcttctcagagcag

SEQ ID NO: 2735537 - DNA, 15 bp, Homo sapiens
gctataaagaaaaga

SEQ ID NO: 2735538 - DNA, 19 bp, Homo sapiens
gctatatgccttaagccaa

SEQ ID NO: 2735539 - DNA, 20 bp, Homo sapiens
gctattcaggaggctgaggc

SEQ ID NO: 2735540 - DNA, 19 bp, Homo sapiens
gctcactgcaagctctgcc

SEQ ID NO: 2735541 - DNA, 20 bp, Homo sapiens
gctcagcaatagggtgcagt

SEQ ID NO: 2735542 - DNA, 12 bp, Homo sapiens
gctcagcagccc

SEQ ID NO: 2735543 - DNA, 17 bp, Homo sapiens
gctcagtctcaggagca

SEQ ID NO: 2735544 - DNA, 12 bp, Homo sapiens
gctccacagtgt

SEQ ID NO: 2735545 - DNA, 17 bp, Homo sapiens
gctccagaatgtgctgc

SEQ ID NO: 2735546 - DNA, 18 bp, Homo sapiens
gctccagaatgtgctgcc

SEQ ID NO: 2735547 - DNA, 19 bp, Homo sapiens
gctccagaatgtgctgcct

SEQ ID NO: 2735548 - DNA, 13 bp, Homo sapiens
gctccatgctggt

SEQ ID NO: 2735549 - DNA, 18 bp, Homo sapiens
gctcccagtgtcttcctg

SEQ ID NO: 2735550 - DNA, 20 bp, Homo sapiens
gctcccagtgtcttcctgtg

SEQ ID NO: 2735551 - DNA, 12 bp, Homo sapiens
gctcccctgagg

SEQ ID NO: 2735552 - DNA, 17 bp, Homo sapiens
gctccccttgcccttcc

SEQ ID NO: 2735553 - DNA, 17 bp, Homo sapiens
gctcccgagctactctc

SEQ ID NO: 2735554 - DNA, 16 bp, Homo sapiens
gctccgtgagcccttg

SEQ ID NO: 2735555 - DNA, 17 bp, Homo sapiens
gctccgtgagcccttgg

SEQ ID NO: 2735556 - DNA, 16 bp, Homo sapiens
gctcctcccctgccgc

SEQ ID NO: 2735557 - DNA, 23 bp, Homo sapiens
gctcctcccctgccgcctcccgg

SEQ ID NO: 2735558 - DNA, 13 bp, Homo sapiens
gctcctccctctg

SEQ ID NO: 2735559 - DNA, 15 bp, Homo sapiens
gctcctccctctgcc

SEQ ID NO: 2735560 - DNA, 15 bp, Homo sapiens
gctcctgctcattgt

SEQ ID NO: 2735561 - DNA, 11 bp, Homo sapiens
gctcctgctgc

SEQ ID NO: 2735562 - DNA, 12 bp, Homo sapiens
gctcctgctgca

SEQ ID NO: 2735563 - DNA, 14 bp, Homo sapiens
gctcctgctgcacc

SEQ ID NO: 2735564 - DNA, 19 bp, Homo sapiens
gctcctgtccctacccact

SEQ ID NO: 2735565 - DNA, 21 bp, Homo sapiens
gctcctgtccctacccactct

SEQ ID NO: 2735566 - DNA, 23 bp, Homo sapiens
gctcctgtccctacccactcttt

SEQ ID NO: 2735567 - DNA, 13 bp, Homo sapiens
gctcctgtgccct

SEQ ID NO: 2735568 - DNA, 15 bp, Homo sapiens
gctcctgtgccctta

SEQ ID NO: 2735569 - DNA, 12 bp, Homo sapiens
gctcgggcccag

SEQ ID NO: 2735570 - DNA, 15 bp, Homo sapiens
gctctacacaacatg

SEQ ID NO: 2735571 - DNA, 20 bp, Homo sapiens
gaaaaagttaagatagcttt

SEQ ID NO: 2735572 - DNA, 24 bp, Homo sapiens
gaaaaatgtcactgaagtgattga

SEQ ID NO: 2735573 - DNA, 22 bp, Homo sapiens
gaaaacaattgttctgggtgat

SEQ ID NO: 2735574 - DNA, 15 bp, Homo sapiens
gaaaacccccagcat

SEQ ID NO: 2735575 - DNA, 15 bp, Homo sapiens
gaaaaccctaagtgt

SEQ ID NO: 2735576 - DNA, 21 bp, Homo sapiens
gaaaaccctaagtgtggatgt

SEQ ID NO: 2735577 - DNA, 15 bp, Homo sapiens
gaaaacctgttttta

SEQ ID NO: 2735578 - DNA, 16 bp, Homo sapiens
gaaaactaaggatttt

SEQ ID NO: 2735579 - DNA, 16 bp, Homo sapiens
gaaaagccatatctag

SEQ ID NO: 2735580 - DNA, 22 bp, Homo sapiens
gaaaagccatatctagtcaata

SEQ ID NO: 2735581 - DNA, 14 bp, Homo sapiens
gaaaagggctcaga

SEQ ID NO: 2735582 - DNA, 14 bp, Homo sapiens
gaaaaggttttatt

SEQ ID NO: 2735583 - DNA, 18 bp, Homo sapiens
gaaaatagggtccttgaa

SEQ ID NO: 2735584 - DNA, 18 bp, Homo sapiens
gaaaatgtgtctgcaaca

SEQ ID NO: 2735585 - DNA, 14 bp, Homo sapiens
gaaacaatttaaat

SEQ ID NO: 2735586 - DNA, 12 bp, Homo sapiens
gaaacagcctgg

SEQ ID NO: 2735587 - DNA, 13 bp, Homo sapiens
gaaaccagaaaag

SEQ ID NO: 2735588 - DNA, 16 bp, Homo sapiens
gaaaccagaaaagcaa

SEQ ID NO: 2735589 - DNA, 19 bp, Homo sapiens
gaaacctgtccataaagta

SEQ ID NO: 2735590 - DNA, 12 bp, Homo sapiens
gaaacctttcta

SEQ ID NO: 2735591 - DNA, 18 bp, Homo sapiens
gaaactttgatctctgct

SEQ ID NO: 2735592 - DNA, 21 bp, Homo sapiens
gaaagaattctattttgctgg

SEQ ID NO: 2735593 - DNA, 14 bp, Homo sapiens
gaaagacatcaatg

SEQ ID NO: 2735594 - DNA, 18 bp, Homo sapiens
gaaagcaccgcagcatgt

SEQ ID NO: 2735595 - DNA, 20 bp, Homo sapiens
gaaagcaccgcagcatgtgg

SEQ ID NO: 2735596 - DNA, 17 bp, Homo sapiens
gaaaggattttaccaaa

SEQ ID NO: 2735597 - DNA, 21 bp, Homo sapiens
gaaaggattttaccaaagcat

SEQ ID NO: 2735598 - DNA, 24 bp, Homo sapiens
gaaaggattttaccaaagcatcaa

SEQ ID NO: 2735599 - DNA, 12 bp, Homo sapiens
gaaagggaaagc

SEQ ID NO: 2735600 - DNA, 19 bp, Homo sapiens
gaaagtatttttgaaagaa

SEQ ID NO: 2735601 - DNA, 17 bp, Homo sapiens
gaaagtcagatgcccag

SEQ ID NO: 2735602 - DNA, 17 bp, Homo sapiens
gaaagtgaataaacttc

SEQ ID NO: 2735603 - DNA, 22 bp, Homo sapiens
gaaagtgaataaacttcagcac

SEQ ID NO: 2735604 - DNA, 14 bp, Homo sapiens
gaaatcagagctgg

SEQ ID NO: 2735605 - DNA, 23 bp, Homo sapiens
gaaatcagagctggcagcctcca

SEQ ID NO: 2735606 - DNA, 12 bp, Homo sapiens
gaaatcatatta

SEQ ID NO: 2735607 - DNA, 18 bp, Homo sapiens
gaaatcctggtttgtaat

SEQ ID NO: 2735608 - DNA, 20 bp, Homo sapiens
gaaatcgccttatgagaaca

SEQ ID NO: 2735609 - DNA, 20 bp, Homo sapiens
gaaattcaacctgtgtctta

SEQ ID NO: 2735610 - DNA, 21 bp, Homo sapiens
gaaattcaacctgtgtcttat

SEQ ID NO: 2735611 - DNA, 11 bp, Homo sapiens
gaaatttattc

SEQ ID NO: 2735612 - DNA, 20 bp, Homo sapiens
gaaatttccactcaggtctg

SEQ ID NO: 2735613 - DNA, 19 bp, Homo sapiens
gaaattttactgacagaaa

SEQ ID NO: 2735614 - DNA, 20 bp, Homo sapiens
gaaatttttttccagaattg

SEQ ID NO: 2735615 - DNA, 14 bp, Homo sapiens
gaacaatcacaaaa

SEQ ID NO: 2735616 - DNA, 15 bp, Homo sapiens
gaacacactcagcag

SEQ ID NO: 2735617 - DNA, 16 bp, Homo sapiens
gaacacccactggcca

SEQ ID NO: 2735618 - DNA, 16 bp, Homo sapiens
gaacacccggaaagac

SEQ ID NO: 2735619 - DNA, 18 bp, Homo sapiens
gaacacccggaaagactg

SEQ ID NO: 2735620 - DNA, 19 bp, Homo sapiens
gaacacccggaaagactga

SEQ ID NO: 2735621 - DNA, 22 bp, Homo sapiens
gaacacgtccagaatttttcat

SEQ ID NO: 2735622 - DNA, 18 bp, Homo sapiens
gaacatggtgtgtgtctc

SEQ ID NO: 2735623 - DNA, 19 bp, Homo sapiens
gaacatggtgtgtgtctct

SEQ ID NO: 2735624 - DNA, 21 bp, Homo sapiens
gaacatggtgtgtgtctctga

SEQ ID NO: 2735625 - DNA, 13 bp, Homo sapiens
gaacattgcaata

SEQ ID NO: 2735626 - DNA, 15 bp, Homo sapiens
gaacattgcaataga

SEQ ID NO: 2735627 - DNA, 17 bp, Homo sapiens
gaacattgcaatagaaa

SEQ ID NO: 2735628 - DNA, 20 bp, Homo sapiens
gaaccagccgtattttacat

SEQ ID NO: 2735629 - DNA, 16 bp, Homo sapiens
gaacccaggaggtgga

SEQ ID NO: 2735630 - DNA, 15 bp, Homo sapiens
gaacctttcccttgt

SEQ ID NO: 2735631 - DNA, 16 bp, Homo sapiens
gaacctttcccttgtg

SEQ ID NO: 2735632 - DNA, 14 bp, Homo sapiens
gaacgttttaaagc

SEQ ID NO: 2735633 - DNA, 15 bp, Homo sapiens
gaactccccagggcc

SEQ ID NO: 2735634 - DNA, 18 bp, Homo sapiens
gaactccgctggatgggg

SEQ ID NO: 2735635 - DNA, 21 bp, Homo sapiens
gaactctaccctggtaggaaa

SEQ ID NO: 2735636 - DNA, 15 bp, Homo sapiens
gaactctgcaggcag

SEQ ID NO: 2735637 - DNA, 12 bp, Homo sapiens
gaactgctgggg

SEQ ID NO: 2735638 - DNA, 16 bp, Homo sapiens
gaactgctggggctgg

SEQ ID NO: 2735639 - DNA, 19 bp, Homo sapiens
gaactgctggggctggtga

SEQ ID NO: 2735640 - DNA, 19 bp, Homo sapiens
gaactggacgcccagctga

SEQ ID NO: 2735641 - DNA, 13 bp, Homo sapiens
gaactgtgctccc

SEQ ID NO: 2735642 - DNA, 13 bp, Homo sapiens
gaacttgatggct

SEQ ID NO: 2735643 - DNA, 17 bp, Homo sapiens
gaactttgccttaagtt

SEQ ID NO: 2735644 - DNA, 16 bp, Homo sapiens
gaactttttttccccc

SEQ ID NO: 2735645 - DNA, 16 bp, Homo sapiens
gaagaaaatgagatgg

SEQ ID NO: 2735646 - DNA, 12 bp, Homo sapiens
gaagaaacaaaa

SEQ ID NO: 2735647 - DNA, 21 bp, Homo sapiens
gaagaaacccttccacgtgta

SEQ ID NO: 2735648 - DNA, 16 bp, Homo sapiens
gaagaaccgcattttg

SEQ ID NO: 2735649 - DNA, 15 bp, Homo sapiens
gaagaactgcatggg

SEQ ID NO: 2735650 - DNA, 21 bp, Homo sapiens
gaagaactgcatggggagtac

SEQ ID NO: 2735651 - DNA, 13 bp, Homo sapiens
gaagaagttttaa

SEQ ID NO: 2735652 - DNA, 15 bp, Homo sapiens
gaagactgtgacatc

SEQ ID NO: 2735653 - DNA, 20 bp, Homo sapiens
gaagacttcaatattaaatg

SEQ ID NO: 2735654 - DNA, 12 bp, Homo sapiens
gaagagaggcac

SEQ ID NO: 2735655 - DNA, 17 bp, Homo sapiens
gaagagaggcacctgct

SEQ ID NO: 2735656 - DNA, 20 bp, Homo sapiens
gaagagaggcacctgctgga

SEQ ID NO: 2735657 - DNA, 21 bp, Homo sapiens
gaagagccttcacatgaaatt

SEQ ID NO: 2735658 - DNA, 15 bp, Homo sapiens
gaagaggcctttcta

SEQ ID NO: 2735659 - DNA, 17 bp, Homo sapiens
gaagaggggtcttttat

SEQ ID NO: 2735660 - DNA, 18 bp, Homo sapiens
gaagcaaacacacagact

SEQ ID NO: 2735661 - DNA, 11 bp, Homo sapiens
gaagcaggagt

SEQ ID NO: 2735662 - DNA, 23 bp, Homo sapiens
gaagcaggttgaggggctcctgg

SEQ ID NO: 2735663 - DNA, 17 bp, Homo sapiens
gaagcatcctccccacc

SEQ ID NO: 2735664 - DNA, 22 bp, Homo sapiens
gaagcatcctccccaccagagc

SEQ ID NO: 2735665 - DNA, 22 bp, Homo sapiens
gaagccatccctttttttacat

SEQ ID NO: 2735666 - DNA, 20 bp, Homo sapiens
gaagctatttcctttgcgca

SEQ ID NO: 2735667 - DNA, 20 bp, Homo sapiens
gaaggactggccgtggctcc

SEQ ID NO: 2735668 - DNA, 12 bp, Homo sapiens
gaaggatttctt

SEQ ID NO: 2735669 - DNA, 14 bp, Homo sapiens
gaaggcctcccctg

SEQ ID NO: 2735670 - DNA, 18 bp, Homo sapiens
gaaggctgggtccagggg

SEQ ID NO: 2735671 - DNA, 13 bp, Homo sapiens
gaagggaaggaag

SEQ ID NO: 2735672 - DNA, 17 bp, Homo sapiens
gaagggcctgctctgct

SEQ ID NO: 2735673 - DNA, 19 bp, Homo sapiens
gaagggcctgctctgcttt

SEQ ID NO: 2735674 - DNA, 14 bp, Homo sapiens
gaagtgcagctcag

SEQ ID NO: 2735675 - DNA, 16 bp, Homo sapiens
gaagtgcagctcagga

SEQ ID NO: 2735676 - DNA, 12 bp, Homo sapiens
gaataaacttca

SEQ ID NO: 2735677 - DNA, 13 bp, Homo sapiens
gaataaacttcag

SEQ ID NO: 2735678 - DNA, 13 bp, Homo sapiens
gaatacttgaagt

SEQ ID NO: 2735679 - DNA, 16 bp, Homo sapiens
gaatagaggccaaatt

SEQ ID NO: 2735680 - DNA, 15 bp, Homo sapiens
gaatattaagaaaca

SEQ ID NO: 2735681 - DNA, 20 bp, Homo sapiens
gaatcaagatgtcagactgg

SEQ ID NO: 2735682 - DNA, 21 bp, Homo sapiens
gaatcaagatgtcagactggc

SEQ ID NO: 2735683 - DNA, 18 bp, Homo sapiens
gaatcagattcaggagct

SEQ ID NO: 2735684 - DNA, 19 bp, Homo sapiens
gaatcctgccacacatgct

SEQ ID NO: 2735685 - DNA, 17 bp, Homo sapiens
gaatcctgggcccccag

SEQ ID NO: 2735686 - DNA, 15 bp, Homo sapiens
gaatgaagcatgtag

SEQ ID NO: 2735687 - DNA, 15 bp, Homo sapiens
gaatgaggaacaatc

SEQ ID NO: 2735688 - DNA, 16 bp, Homo sapiens
gaatgccgggcccctc

SEQ ID NO: 2735689 - DNA, 12 bp, Homo sapiens
gaatgggaaagt

SEQ ID NO: 2735690 - DNA, 16 bp, Homo sapiens
gaatggtttttgttga

SEQ ID NO: 2735691 - DNA, 15 bp, Homo sapiens
gaatgtcataaagaa

SEQ ID NO: 2735692 - DNA, 13 bp, Homo sapiens
gaatgtcccagag

SEQ ID NO: 2735693 - DNA, 14 bp, Homo sapiens
gaatgtgctgcctt

SEQ ID NO: 2735694 - DNA, 17 bp, Homo sapiens
gaattaactccattcca

SEQ ID NO: 2735695 - DNA, 15 bp, Homo sapiens
gaattacccttcctc

SEQ ID NO: 2735696 - DNA, 16 bp, Homo sapiens
gaattacccttcctca

SEQ ID NO: 2735697 - DNA, 20 bp, Homo sapiens
gaattacccttcctcatctg

SEQ ID NO: 2735698 - DNA, 16 bp, Homo sapiens
gaattcacaaacaaat

SEQ ID NO: 2735699 - DNA, 21 bp, Homo sapiens
gagtcaaagctgaccatggat

SEQ ID NO: 2735700 - DNA, 19 bp, Homo sapiens
gagtcacccctctgtccag

SEQ ID NO: 2735701 - DNA, 20 bp, Homo sapiens
gagtcacccctctgtccagc

SEQ ID NO: 2735702 - DNA, 24 bp, Homo sapiens
gagtcacccctctgtccagccagc

SEQ ID NO: 2735703 - DNA, 11 bp, Homo sapiens
gagtcagcctt

SEQ ID NO: 2735704 - DNA, 20 bp, Homo sapiens
gagtccagggcgggagtggg

SEQ ID NO: 2735705 - DNA, 21 bp, Homo sapiens
gagtctcgctctgctgcccag

SEQ ID NO: 2735706 - DNA, 11 bp, Homo sapiens
gagtctctcca

SEQ ID NO: 2735707 - DNA, 12 bp, Homo sapiens
gagtctctccag

SEQ ID NO: 2735708 - DNA, 15 bp, Homo sapiens
gagtctctccagcct

SEQ ID NO: 2735709 - DNA, 17 bp, Homo sapiens
gagtctggcaaacatgt

SEQ ID NO: 2735710 - DNA, 12 bp, Homo sapiens
gagtctgtctca

SEQ ID NO: 2735711 - DNA, 18 bp, Homo sapiens
gagtcttcactgctctgc

SEQ ID NO: 2735712 - DNA, 13 bp, Homo sapiens
gagtgagaccctg

SEQ ID NO: 2735713 - DNA, 13 bp, Homo sapiens
gagtgctgcagct

SEQ ID NO: 2735714 - DNA, 15 bp, Homo sapiens
gagtgctgcagcttt

SEQ ID NO: 2735715 - DNA, 23 bp, Homo sapiens
gagtgctgcagctttgggaaagc

SEQ ID NO: 2735716 - DNA, 18 bp, Homo sapiens
gagtggcattggcagcag

SEQ ID NO: 2735717 - DNA, 20 bp, Homo sapiens
gagtgtcctgtctgctgggc

SEQ ID NO: 2735718 - DNA, 15 bp, Homo sapiens
gagtgtctctgcctg

SEQ ID NO: 2735719 - DNA, 19 bp, Homo sapiens
gagttcaagaccagcctgg

SEQ ID NO: 2735720 - DNA, 23 bp, Homo sapiens
gagttcattcaaaatgtccagct

SEQ ID NO: 2735721 - DNA, 17 bp, Homo sapiens
gagttcgagaccagcct

SEQ ID NO: 2735722 - DNA, 22 bp, Homo sapiens
gagttctttgcaagcttattta

SEQ ID NO: 2735723 - DNA, 20 bp, Homo sapiens
gagttgtggaaagcctctgc

SEQ ID NO: 2735724 - DNA, 22 bp, Homo sapiens
gagtttgctgtatacaaacagg

SEQ ID NO: 2735725 - DNA, 19 bp, Homo sapiens
gataaggcagaactaggag

SEQ ID NO: 2735726 - DNA, 21 bp, Homo sapiens
gataataaatgcttcttaaag

SEQ ID NO: 2735727 - DNA, 22 bp, Homo sapiens
gatacagtcattatttaaagca

SEQ ID NO: 2735728 - DNA, 22 bp, Homo sapiens
gatactttaatttttataaata

SEQ ID NO: 2735729 - DNA, 14 bp, Homo sapiens
gatagtgcctctgc

SEQ ID NO: 2735730 - DNA, 23 bp, Homo sapiens
gatataataaatatatatttatc

SEQ ID NO: 2735731 - DNA, 19 bp, Homo sapiens
gatatccacaaatgctatt

SEQ ID NO: 2735732 - DNA, 17 bp, Homo sapiens
gatatccccagggaaac

SEQ ID NO: 2735733 - DNA, 17 bp, Homo sapiens
gatatgaaaaataaata

SEQ ID NO: 2735734 - DNA, 16 bp, Homo sapiens
gatattgaccatgtga

SEQ ID NO: 2735735 - DNA, 17 bp, Homo sapiens
gatcaagccaaaaaaga

SEQ ID NO: 2735736 - DNA, 24 bp, Homo sapiens
gatcacgccactgcactccagcct

SEQ ID NO: 2735737 - DNA, 11 bp, Homo sapiens
gatcagcctcc

SEQ ID NO: 2735738 - DNA, 20 bp, Homo sapiens
gatcatataagcaagacagt

SEQ ID NO: 2735739 - DNA, 18 bp, Homo sapiens
gatcattacatggctgtg

SEQ ID NO: 2735740 - DNA, 22 bp, Homo sapiens
gatcccccaagtgtcctggacc

SEQ ID NO: 2735741 - DNA, 22 bp, Homo sapiens
gatcccctgtcccctggggctg

SEQ ID NO: 2735742 - DNA, 23 bp, Homo sapiens
gatccgacttgaattttcccact

SEQ ID NO: 2735743 - DNA, 19 bp, Homo sapiens
gatctgcccgcctcggcct

SEQ ID NO: 2735744 - DNA, 15 bp, Homo sapiens
gatctgcttccctgg

SEQ ID NO: 2735745 - DNA, 19 bp, Homo sapiens
gatcttgctggcagggcct

SEQ ID NO: 2735746 - DNA, 14 bp, Homo sapiens
gatctttaaataca

SEQ ID NO: 2735747 - DNA, 19 bp, Homo sapiens
gatctttaaatacagtcaa

SEQ ID NO: 2735748 - DNA, 23 bp, Homo sapiens
gatgaaaagccatatctagtcaa

SEQ ID NO: 2735749 - DNA, 17 bp, Homo sapiens
gatgaaaccgtccctga

SEQ ID NO: 2735750 - DNA, 17 bp, Homo sapiens
gatgagaaaactgagag

SEQ ID NO: 2735751 - DNA, 14 bp, Homo sapiens
gatgatgatgaaaa

SEQ ID NO: 2735752 - DNA, 23 bp, Homo sapiens
gatgcattcccggtgcagaacag

SEQ ID NO: 2735753 - DNA, 15 bp, Homo sapiens
gatgccacaccaagc

SEQ ID NO: 2735754 - DNA, 19 bp, Homo sapiens
gatgccacaccaagctgtg

SEQ ID NO: 2735755 - DNA, 21 bp, Homo sapiens
gatgccacaccaagctgtgcc

SEQ ID NO: 2735756 - DNA, 14 bp, Homo sapiens
gatgctgcctgagt

SEQ ID NO: 2735757 - DNA, 11 bp, Homo sapiens
gatgctggcct

SEQ ID NO: 2735758 - DNA, 12 bp, Homo sapiens
gatgctggcctc

SEQ ID NO: 2735759 - DNA, 22 bp, Homo sapiens
gatgctggcctcttggcacctg

SEQ ID NO: 2735760 - DNA, 12 bp, Homo sapiens
gatgctgggctg

SEQ ID NO: 2735761 - DNA, 13 bp, Homo sapiens
gatgctgggctgg

SEQ ID NO: 2735762 - DNA, 17 bp, Homo sapiens
gatgctgggctgggtgc

SEQ ID NO: 2735763 - DNA, 16 bp, Homo sapiens
gatggagaaacaggct

SEQ ID NO: 2735764 - DNA, 13 bp, Homo sapiens
gatggtcctgggg

SEQ ID NO: 2735765 - DNA, 21 bp, Homo sapiens
gatggtcctggggctctgtgc

SEQ ID NO: 2735766 - DNA, 20 bp, Homo sapiens
gatgtgctcccaccaggcag

SEQ ID NO: 2735767 - DNA, 21 bp, Homo sapiens
gatgtgctcccaccaggcagc

SEQ ID NO: 2735768 - DNA, 19 bp, Homo sapiens
gatgtggatggaggtgatg

SEQ ID NO: 2735769 - DNA, 20 bp, Homo sapiens
gattaaacagcaaagccata

SEQ ID NO: 2735770 - DNA, 13 bp, Homo sapiens
gcactctgtgccc

SEQ ID NO: 2735771 - DNA, 12 bp, Homo sapiens
gcactgaaaacc

SEQ ID NO: 2735772 - DNA, 21 bp, Homo sapiens
gcactgcccagggaagccctc

SEQ ID NO: 2735773 - DNA, 18 bp, Homo sapiens
gcactgctgggtggccca

SEQ ID NO: 2735774 - DNA, 12 bp, Homo sapiens
gcactgtcctgc

SEQ ID NO: 2735775 - DNA, 17 bp, Homo sapiens
gcactttataagccaat

SEQ ID NO: 2735776 - DNA, 14 bp, Homo sapiens
gcagaactgctggg

SEQ ID NO: 2735777 - DNA, 18 bp, Homo sapiens
gcagaactgctggggctg

SEQ ID NO: 2735778 - DNA, 21 bp, Homo sapiens
gcagaagccccaactgtgatc

SEQ ID NO: 2735779 - DNA, 13 bp, Homo sapiens
gcagaatcctggg

SEQ ID NO: 2735780 - DNA, 15 bp, Homo sapiens
gcagaatcctgggcc

SEQ ID NO: 2735781 - DNA, 16 bp, Homo sapiens
gcagaatcctgggccc

SEQ ID NO: 2735782 - DNA, 18 bp, Homo sapiens
gcagacagtgtcagagtc

SEQ ID NO: 2735783 - DNA, 15 bp, Homo sapiens
gcagaggaggagaaa

SEQ ID NO: 2735784 - DNA, 17 bp, Homo sapiens
gcagaggagtccagggc

SEQ ID NO: 2735785 - DNA, 12 bp, Homo sapiens
gcagaggcagcg

SEQ ID NO: 2735786 - DNA, 13 bp, Homo sapiens
gcagaggggcagg

SEQ ID NO: 2735787 - DNA, 18 bp, Homo sapiens
gcagaggggcaggccctg

SEQ ID NO: 2735788 - DNA, 20 bp, Homo sapiens
gcagaggggcaggccctgca

SEQ ID NO: 2735789 - DNA, 12 bp, Homo sapiens
gcagaggggctt

SEQ ID NO: 2735790 - DNA, 19 bp, Homo sapiens
gcagaggggctttctggag

SEQ ID NO: 2735791 - DNA, 20 bp, Homo sapiens
gcagaggggctttctggaga

SEQ ID NO: 2735792 - DNA, 16 bp, Homo sapiens
gcagaggtgagcagag

SEQ ID NO: 2735793 - DNA, 19 bp, Homo sapiens
gcagagttctttgcaagct

SEQ ID NO: 2735794 - DNA, 15 bp, Homo sapiens
gcagatagtgcctct

SEQ ID NO: 2735795 - DNA, 15 bp, Homo sapiens
gcagatctttaaata

SEQ ID NO: 2735796 - DNA, 20 bp, Homo sapiens
gcagatggatccacgtgctc

SEQ ID NO: 2735797 - DNA, 21 bp, Homo sapiens
gcagatgggcctgtgtgcacc

SEQ ID NO: 2735798 - DNA, 16 bp, Homo sapiens
gcagattacaataaat

SEQ ID NO: 2735799 - DNA, 17 bp, Homo sapiens
gcagcaggtgctgctac

SEQ ID NO: 2735800 - DNA, 19 bp, Homo sapiens
gcagcaggtgctgctaccc

SEQ ID NO: 2735801 - DNA, 19 bp, Homo sapiens
gcagcatgtggggaagcaa

SEQ ID NO: 2735802 - DNA, 22 bp, Homo sapiens
gcagccacgaacacgcatgcct

SEQ ID NO: 2735803 - DNA, 19 bp, Homo sapiens
gcagccccaccccaccctg

SEQ ID NO: 2735804 - DNA, 14 bp, Homo sapiens
gcagccgcctccct

SEQ ID NO: 2735805 - DNA, 15 bp, Homo sapiens
gcagcctccagtgct

SEQ ID NO: 2735806 - DNA, 17 bp, Homo sapiens
gcagcctccagtgctgg

SEQ ID NO: 2735807 - DNA, 18 bp, Homo sapiens
gcagcctccagtgctggc

SEQ ID NO: 2735808 - DNA, 15 bp, Homo sapiens
gcagcctccagtggg

SEQ ID NO: 2735809 - DNA, 22 bp, Homo sapiens
gcagcctccagtgggaggacag

SEQ ID NO: 2735810 - DNA, 22 bp, Homo sapiens
gcagcgagctatgatcgcgcca

SEQ ID NO: 2735811 - DNA, 24 bp, Homo sapiens
gcagcgagttgtggaaagcctctg

SEQ ID NO: 2735812 - DNA, 13 bp, Homo sapiens
gcagcgcctgtcc

SEQ ID NO: 2735813 - DNA, 21 bp, Homo sapiens
gcagcgcctgtcccctcacag

SEQ ID NO: 2735814 - DNA, 13 bp, Homo sapiens
gcagctccagctg

SEQ ID NO: 2735815 - DNA, 13 bp, Homo sapiens
gcagctgctgcca

SEQ ID NO: 2735816 - DNA, 14 bp, Homo sapiens
gcagctgctgccac

SEQ ID NO: 2735817 - DNA, 15 bp, Homo sapiens
gcagctgctgccact

SEQ ID NO: 2735818 - DNA, 13 bp, Homo sapiens
gcagctggctctc

SEQ ID NO: 2735819 - DNA, 11 bp, Homo sapiens
gcagctgggcc

SEQ ID NO: 2735820 - DNA, 16 bp, Homo sapiens
gcagctgggcccacag

SEQ ID NO: 2735821 - DNA, 23 bp, Homo sapiens
gcagctgggcccacagcccccac

SEQ ID NO: 2735822 - DNA, 13 bp, Homo sapiens
gcagcttcagttg

SEQ ID NO: 2735823 - DNA, 15 bp, Homo sapiens
gcagcttctgccact

SEQ ID NO: 2735824 - DNA, 15 bp, Homo sapiens
gcaggaaaccccagc

SEQ ID NO: 2735825 - DNA, 15 bp, Homo sapiens
gcaggaaatcagagc

SEQ ID NO: 2735826 - DNA, 19 bp, Homo sapiens
gcaggaaatcagagctggc

SEQ ID NO: 2735827 - DNA, 20 bp, Homo sapiens
gcaggaaatcagagctggca

SEQ ID NO: 2735828 - DNA, 22 bp, Homo sapiens
gcaggaaatcagagctggcagc

SEQ ID NO: 2735829 - DNA, 15 bp, Homo sapiens
gcaggaaccggaggg

SEQ ID NO: 2735830 - DNA, 15 bp, Homo sapiens
gcaggagagcttccc

SEQ ID NO: 2735831 - DNA, 18 bp, Homo sapiens
gcttccagcttcctctga

SEQ ID NO: 2735832 - DNA, 22 bp, Homo sapiens
gcttccagcttcctctgagccg

SEQ ID NO: 2735833 - DNA, 18 bp, Homo sapiens
gcttcccctccaccctaa

SEQ ID NO: 2735834 - DNA, 15 bp, Homo sapiens
gcttccctctgcctg

SEQ ID NO: 2735835 - DNA, 17 bp, Homo sapiens
gcttccctggggcccca

SEQ ID NO: 2735836 - DNA, 15 bp, Homo sapiens
gcttcctctgagccg

SEQ ID NO: 2735837 - DNA, 17 bp, Homo sapiens
gcttcctctgagccgca

SEQ ID NO: 2735838 - DNA, 13 bp, Homo sapiens
gcttcctggaccg

SEQ ID NO: 2735839 - DNA, 23 bp, Homo sapiens
gcttctccacaacctcctcctcc

SEQ ID NO: 2735840 - DNA, 12 bp, Homo sapiens
gcttctgccact

SEQ ID NO: 2735841 - DNA, 19 bp, Homo sapiens
gcttctgccacttcccagg

SEQ ID NO: 2735842 - DNA, 16 bp, Homo sapiens
gcttctgcctcagctt

SEQ ID NO: 2735843 - DNA, 12 bp, Homo sapiens
gcttctgctggg

SEQ ID NO: 2735844 - DNA, 17 bp, Homo sapiens
gcttctgctgggctggg

SEQ ID NO: 2735845 - DNA, 13 bp, Homo sapiens
gcttctggagccc

SEQ ID NO: 2735846 - DNA, 18 bp, Homo sapiens
gcttctggagcccttggg

SEQ ID NO: 2735847 - DNA, 18 bp, Homo sapiens
gcttctggctttgttctt

SEQ ID NO: 2735848 - DNA, 14 bp, Homo sapiens
gcttgaacccagga

SEQ ID NO: 2735849 - DNA, 15 bp, Homo sapiens
gcttgaacccaggag

SEQ ID NO: 2735850 - DNA, 15 bp, Homo sapiens
gcttgactctactcc

SEQ ID NO: 2735851 - DNA, 18 bp, Homo sapiens
gcttgcctcggctcctgc

SEQ ID NO: 2735852 - DNA, 16 bp, Homo sapiens
gcttggcttcccctcc

SEQ ID NO: 2735853 - DNA, 19 bp, Homo sapiens
gcttgtggactctctgcct

SEQ ID NO: 2735854 - DNA, 20 bp, Homo sapiens
gcttgtggactctctgcctg

SEQ ID NO: 2735855 - DNA, 22 bp, Homo sapiens
gcttgttgtttttaagtcctgt

SEQ ID NO: 2735856 - DNA, 18 bp, Homo sapiens
gctttagctggagggaga

SEQ ID NO: 2735857 - DNA, 22 bp, Homo sapiens
gctttaggactgacatttctat

SEQ ID NO: 2735858 - DNA, 17 bp, Homo sapiens
gctttataccccatttg

SEQ ID NO: 2735859 - DNA, 15 bp, Homo sapiens
gctttatcaggggac

SEQ ID NO: 2735860 - DNA, 23 bp, Homo sapiens
gctttcctaaagtctctgctgct

SEQ ID NO: 2735861 - DNA, 12 bp, Homo sapiens
gctttctcagtg

SEQ ID NO: 2735862 - DNA, 13 bp, Homo sapiens
gctttctggagag

SEQ ID NO: 2735863 - DNA, 14 bp, Homo sapiens
gctttgttcttgtc

SEQ ID NO: 2735864 - DNA, 14 bp, Homo sapiens
gcttttcctgtctg

SEQ ID NO: 2735865 - DNA, 15 bp, Homo sapiens
gcttttcctgtctgt

SEQ ID NO: 2735866 - DNA, 23 bp, Homo sapiens
gcttttcgaactgtgctcccacg

SEQ ID NO: 2735867 - DNA, 15 bp, Homo sapiens
gcttttctcccagaa

SEQ ID NO: 2735868 - DNA, 17 bp, Homo sapiens
gctttttgtattaacaa

SEQ ID NO: 2735869 - DNA, 13 bp, Homo sapiens
ggaaaaaggcttc

SEQ ID NO: 2735870 - DNA, 22 bp, Homo sapiens
ggaaaagggctcagagctgctg

SEQ ID NO: 2735871 - DNA, 19 bp, Homo sapiens
ggaaaattagcttttagtt

SEQ ID NO: 2735872 - DNA, 23 bp, Homo sapiens
ggaaacctgtgaaagctgcactc

SEQ ID NO: 2735873 - DNA, 19 bp, Homo sapiens
gggctcagagctgctgagc

SEQ ID NO: 2735874 - DNA, 17 bp, Homo sapiens
gggctcagatcctgggc

SEQ ID NO: 2735875 - DNA, 20 bp, Homo sapiens
gggctcagggaccacagcaa

SEQ ID NO: 2735876 - DNA, 15 bp, Homo sapiens
gggctccctcctgga

SEQ ID NO: 2735877 - DNA, 11 bp, Homo sapiens
gggctcctgga

SEQ ID NO: 2735878 - DNA, 12 bp, Homo sapiens
gggctcctggaa

SEQ ID NO: 2735879 - DNA, 14 bp, Homo sapiens
gggctcctgtgccc

SEQ ID NO: 2735880 - DNA, 15 bp, Homo sapiens
gggctcctgtgccct

SEQ ID NO: 2735881 - DNA, 12 bp, Homo sapiens
gggctctgcccc

SEQ ID NO: 2735882 - DNA, 20 bp, Homo sapiens
gggctctgccccagctctgg

SEQ ID NO: 2735883 - DNA, 21 bp, Homo sapiens
gggctctgccccagctctggc

SEQ ID NO: 2735884 - DNA, 16 bp, Homo sapiens
gggctctgtgggctgc

SEQ ID NO: 2735885 - DNA, 19 bp, Homo sapiens
gggctctgtgggctgcact

SEQ ID NO: 2735886 - DNA, 17 bp, Homo sapiens
gggctgagccctggcag

SEQ ID NO: 2735887 - DNA, 20 bp, Homo sapiens
gggctgcactctgtgcccat

SEQ ID NO: 2735888 - DNA, 15 bp, Homo sapiens
gggctgcccgctccc

SEQ ID NO: 2735889 - DNA, 19 bp, Homo sapiens
gggctgcccgctcccagtg

SEQ ID NO: 2735890 - DNA, 12 bp, Homo sapiens
gggctgctgggg

SEQ ID NO: 2735891 - DNA, 20 bp, Homo sapiens
gggctgctgggggctcccct

SEQ ID NO: 2735892 - DNA, 22 bp, Homo sapiens
gggctgggttggcgcaccctcc

SEQ ID NO: 2735893 - DNA, 20 bp, Homo sapiens
gggctgtcggtgtgctgtca

SEQ ID NO: 2735894 - DNA, 21 bp, Homo sapiens
gggctgtcggtgtgctgtcag

SEQ ID NO: 2735895 - DNA, 13 bp, Homo sapiens
gggcttccctggg

SEQ ID NO: 2735896 - DNA, 18 bp, Homo sapiens
gggcttgtggactctctg

SEQ ID NO: 2735897 - DNA, 14 bp, Homo sapiens
ggggaccactgggc

SEQ ID NO: 2735898 - DNA, 19 bp, Homo sapiens
ggggaggatcactggagcc

SEQ ID NO: 2735899 - DNA, 21 bp, Homo sapiens
ggggcaacaaggtgcacagac

SEQ ID NO: 2735900 - DNA, 13 bp, Homo sapiens
ggggcaggccctg

SEQ ID NO: 2735901 - DNA, 16 bp, Homo sapiens
ggggcaggccctgcac

SEQ ID NO: 2735902 - DNA, 16 bp, Homo sapiens
ggggcatgctggggca

SEQ ID NO: 2735903 - DNA, 20 bp, Homo sapiens
ggggcccgttgtctccctgg

SEQ ID NO: 2735904 - DNA, 17 bp, Homo sapiens
ggggctccccttgccct

SEQ ID NO: 2735905 - DNA, 20 bp, Homo sapiens
ggggctccccttgcccttcc

SEQ ID NO: 2735906 - DNA, 12 bp, Homo sapiens
ggggctcctgga

SEQ ID NO: 2735907 - DNA, 21 bp, Homo sapiens
ggggctcctggaaaggctcag

SEQ ID NO: 2735908 - DNA, 17 bp, Homo sapiens
ggggctcgccccaccca

SEQ ID NO: 2735909 - DNA, 12 bp, Homo sapiens
ggggctgctggg

SEQ ID NO: 2735910 - DNA, 10 bp, Homo sapiens
ggggctgggt

SEQ ID NO: 2735911 - DNA, 19 bp, Homo sapiens
ggggctgggttggcgcacc

SEQ ID NO: 2735912 - DNA, 21 bp, Homo sapiens
ggggctggtgaggccggccct

SEQ ID NO: 2735913 - DNA, 13 bp, Homo sapiens
gggggctcccctt

SEQ ID NO: 2735914 - DNA, 11 bp, Homo sapiens
ggggggaggca

SEQ ID NO: 2735915 - DNA, 22 bp, Homo sapiens
ggggtccttcaagttagctcag

SEQ ID NO: 2735916 - DNA, 21 bp, Homo sapiens
gggtaccaggcacatggctgg

SEQ ID NO: 2735917 - DNA, 13 bp, Homo sapiens
gggtcctcggccc

SEQ ID NO: 2735918 - DNA, 13 bp, Homo sapiens
gggtgagagagga

SEQ ID NO: 2735919 - DNA, 15 bp, Homo sapiens
gggtgatttctagaa

SEQ ID NO: 2735920 - DNA, 19 bp, Homo sapiens
gggtgcgaccccatctgcc

SEQ ID NO: 2735921 - DNA, 11 bp, Homo sapiens
gggtggcccat

SEQ ID NO: 2735922 - DNA, 19 bp, Homo sapiens
gggtgttgtagtagctgaa

SEQ ID NO: 2735923 - DNA, 22 bp, Homo sapiens
gggttcaaggactaacgaacgt

SEQ ID NO: 2735924 - DNA, 14 bp, Homo sapiens
gggttcctcttccc

SEQ ID NO: 2735925 - DNA, 22 bp, Homo sapiens
gggttggcgcaccctcccctcc

SEQ ID NO: 2735926 - DNA, 17 bp, Homo sapiens
gggtttacaacaaacac

SEQ ID NO: 2735927 - DNA, 14 bp, Homo sapiens
gggtttggcccctg

SEQ ID NO: 2735928 - DNA, 16 bp, Homo sapiens
gggttttccaccctgg

SEQ ID NO: 2735929 - DNA, 19 bp, Homo sapiens
ggtaactcttggccagagc

SEQ ID NO: 2735930 - DNA, 21 bp, Homo sapiens
ggtaactcttggccagagctg

SEQ ID NO: 2735931 - DNA, 23 bp, Homo sapiens
ggtaccaggcacatggctggggg

SEQ ID NO: 2735932 - DNA, 18 bp, Homo sapiens
ggtactgaaggcttctgc

SEQ ID NO: 2735933 - DNA, 11 bp, Homo sapiens
ggtagaagcca

SEQ ID NO: 2735934 - DNA, 15 bp, Homo sapiens
ggtagcgagctgctc

SEQ ID NO: 2735935 - DNA, 16 bp, Homo sapiens
ggtagcgagctgctct

SEQ ID NO: 2735936 - DNA, 19 bp, Homo sapiens
ggtagcgagctgctctgct

SEQ ID NO: 2735937 - DNA, 20 bp, Homo sapiens
ggtagcgagctgctctgcta

SEQ ID NO: 2735938 - DNA, 22 bp, Homo sapiens
ggtaggaaagcaccgcagcatg

SEQ ID NO: 2735939 - DNA, 14 bp, Homo sapiens
ggtagtactgggaa

SEQ ID NO: 2735940 - DNA, 22 bp, Homo sapiens
ggtatcgttcgcttgttttaaa

SEQ ID NO: 2735941 - DNA, 23 bp, Homo sapiens
ggtatctgcatgtaaaatcttca

SEQ ID NO: 2735942 - DNA, 12 bp, Homo sapiens
ggtatgatcatt

SEQ ID NO: 2735943 - DNA, 22 bp, Homo sapiens
ggtattttaggcagggatttga

SEQ ID NO: 2735944 - DNA, 17 bp, Homo sapiens
ggtccaacccagcctga

SEQ ID NO: 2735945 - DNA, 18 bp, Homo sapiens
ggtccaggggagggaaaa

SEQ ID NO: 2735946 - DNA, 14 bp, Homo sapiens
ggtcccacccagga

SEQ ID NO: 2735947 - DNA, 15 bp, Homo sapiens
ggtcccacccaggaa

SEQ ID NO: 2735948 - DNA, 12 bp, Homo sapiens
ggtcccacttcc

SEQ ID NO: 2735949 - DNA, 21 bp, Homo sapiens
ggtcccgaggatgctgtcagg

SEQ ID NO: 2735950 - DNA, 22 bp, Homo sapiens
ggtcccgtgaaaacactcgtgt

SEQ ID NO: 2735951 - DNA, 15 bp, Homo sapiens
ggtcctcggcccatc

SEQ ID NO: 2735952 - DNA, 20 bp, Homo sapiens
ggtcctcggcccatctgtcc

SEQ ID NO: 2735953 - DNA, 22 bp, Homo sapiens
ggtcctggggctctgtgcaggg

SEQ ID NO: 2735954 - DNA, 23 bp, Homo sapiens
ggtcctggggctctgtgcaggga

SEQ ID NO: 2735955 - DNA, 16 bp, Homo sapiens
ggtccttccaggcccc

SEQ ID NO: 2735956 - DNA, 20 bp, Homo sapiens
ggtcgggagttcaagaccag

SEQ ID NO: 2735957 - DNA, 20 bp, Homo sapiens
ggtctccatgaagaagctgg

SEQ ID NO: 2735958 - DNA, 19 bp, Homo sapiens
ggtctcgaactcctgacct

SEQ ID NO: 2735959 - DNA, 19 bp, Homo sapiens
ggtctcgctgatgctgggc

SEQ ID NO: 2735960 - DNA, 18 bp, Homo sapiens
ggtctgctcgggcccagg

SEQ ID NO: 2735961 - DNA, 19 bp, Homo sapiens
ggtctgctcgggcccaggc

SEQ ID NO: 2735962 - DNA, 13 bp, Homo sapiens
ggtcttctgcatc

SEQ ID NO: 2735963 - DNA, 17 bp, Homo sapiens
ggtcttgatctcctgag

SEQ ID NO: 2735964 - DNA, 20 bp, Homo sapiens
ggtgacccatttcaggaggt

SEQ ID NO: 2735965 - DNA, 17 bp, Homo sapiens
ggtgacggactcagact

SEQ ID NO: 2735966 - DNA, 22 bp, Homo sapiens
ggtgacggtcctttaggcagcc

SEQ ID NO: 2735967 - DNA, 18 bp, Homo sapiens
ggtgacttgcctggggcc

SEQ ID NO: 2735968 - DNA, 23 bp, Homo sapiens
ggtgaggccggccctgcccctcc

SEQ ID NO: 2735969 - DNA, 22 bp, Homo sapiens
ggtgcacagtaatatgaaagcc

SEQ ID NO: 2735970 - DNA, 18 bp, Homo sapiens
ggtgccaggctgtaagca

SEQ ID NO: 2735971 - DNA, 17 bp, Homo sapiens
ggtgccggtaccagcct

SEQ ID NO: 2735972 - DNA, 18 bp, Homo sapiens
ggtgcctgattcggctgt

SEQ ID NO: 2735973 - DNA, 15 bp, Homo sapiens
gtcccctggggctgg

SEQ ID NO: 2735974 - DNA, 16 bp, Homo sapiens
gtcccctggggctggt

SEQ ID NO: 2735975 - DNA, 23 bp, Homo sapiens
gtcccgcttattctcctccctgt

SEQ ID NO: 2735976 - DNA, 13 bp, Homo sapiens
gtccctacccact

SEQ ID NO: 2735977 - DNA, 14 bp, Homo sapiens
gtccctacccactc

SEQ ID NO: 2735978 - DNA, 20 bp, Homo sapiens
gtccctacccactctttgct

SEQ ID NO: 2735979 - DNA, 18 bp, Homo sapiens
gtccctgactctctgtga

SEQ ID NO: 2735980 - DNA, 12 bp, Homo sapiens
gtccctggggca

SEQ ID NO: 2735981 - DNA, 16 bp, Homo sapiens
gtccctggggcactcc

SEQ ID NO: 2735982 - DNA, 17 bp, Homo sapiens
gtccctggggcactccc

SEQ ID NO: 2735983 - DNA, 19 bp, Homo sapiens
gtccctggggcactccccc

SEQ ID NO: 2735984 - DNA, 20 bp, Homo sapiens
gtccctggggcactccccca

SEQ ID NO: 2735985 - DNA, 21 bp, Homo sapiens
gtccctggggcactcccccag

SEQ ID NO: 2735986 - DNA, 22 bp, Homo sapiens
gtccctggggcactcccccagg

SEQ ID NO: 2735987 - DNA, 12 bp, Homo sapiens
gtccgcctctgc

SEQ ID NO: 2735988 - DNA, 19 bp, Homo sapiens
gtccggagcgaccctggct

SEQ ID NO: 2735989 - DNA, 14 bp, Homo sapiens
gtcctagagctcct

SEQ ID NO: 2735990 - DNA, 17 bp, Homo sapiens
gtcctagagctcctgtc

SEQ ID NO: 2735991 - DNA, 20 bp, Homo sapiens
gtcctagagctcctgtccct

SEQ ID NO: 2735992 - DNA, 22 bp, Homo sapiens
gtcctaggccacaccatctcct

SEQ ID NO: 2735993 - DNA, 20 bp, Homo sapiens
gtcctcaaagaagtggttct

SEQ ID NO: 2735994 - DNA, 19 bp, Homo sapiens
gtcctcggcccatctgtcc

SEQ ID NO: 2735995 - DNA, 12 bp, Homo sapiens
gtcctctccacc

SEQ ID NO: 2735996 - DNA, 20 bp, Homo sapiens
gtcctctccacctagtggct

SEQ ID NO: 2735997 - DNA, 17 bp, Homo sapiens
gtcctgacttcaggggc

SEQ ID NO: 2735998 - DNA, 20 bp, Homo sapiens
gtcctgaggagtgtcctgtc

SEQ ID NO: 2735999 - DNA, 22 bp, Homo sapiens
gtcctgaggagtgtcctgtctg

SEQ ID NO: 2736000 - DNA, 14 bp, Homo sapiens
gtcctgctggcctg

SEQ ID NO: 2736001 - DNA, 16 bp, Homo sapiens
gtcctgctggcctgct

SEQ ID NO: 2736002 - DNA, 13 bp, Homo sapiens
gtcctggaatgaa

SEQ ID NO: 2736003 - DNA, 19 bp, Homo sapiens
gtcctggaatgaagcatgt

SEQ ID NO: 2736004 - DNA, 23 bp, Homo sapiens
gtcctggaccctggcctaaagaa

SEQ ID NO: 2736005 - DNA, 20 bp, Homo sapiens
gtcctgggagaacctcaggc

SEQ ID NO: 2736006 - DNA, 15 bp, Homo sapiens
gtcctggggctctgt

SEQ ID NO: 2736007 - DNA, 17 bp, Homo sapiens
gtcctggggctctgtgc

SEQ ID NO: 2736008 - DNA, 18 bp, Homo sapiens
gtcctggtacagcagggt

SEQ ID NO: 2736009 - DNA, 21 bp, Homo sapiens
gtcctggtacagcagggtctt

SEQ ID NO: 2736010 - DNA, 19 bp, Homo sapiens
gtcctgtcagtgccgccgc

SEQ ID NO: 2736011 - DNA, 19 bp, Homo sapiens
gtcctgtccggagcgaccc

SEQ ID NO: 2736012 - DNA, 15 bp, Homo sapiens
gtcctgtctgctggg

SEQ ID NO: 2736013 - DNA, 15 bp, Homo sapiens
gtccttactcagagc

SEQ ID NO: 2736014 - DNA, 20 bp, Homo sapiens
gtccttactcagagctgcgg

SEQ ID NO: 2736015 - DNA, 22 bp, Homo sapiens
gtccttactcagagctgcgggc

SEQ ID NO: 2736016 - DNA, 15 bp, Homo sapiens
gtcctttaggcagcc

SEQ ID NO: 2736017 - DNA, 21 bp, Homo sapiens
gtcctttaggcagcctgccgc

SEQ ID NO: 2736018 - DNA, 16 bp, Homo sapiens
gtcctttgttgctgtt

SEQ ID NO: 2736019 - DNA, 17 bp, Homo sapiens
gtccttttgtaccatgg

SEQ ID NO: 2736020 - DNA, 14 bp, Homo sapiens
gtcctttttgtaac

SEQ ID NO: 2736021 - DNA, 16 bp, Homo sapiens
gtcgactttgagctgg

SEQ ID NO: 2736022 - DNA, 13 bp, Homo sapiens
gtcgcgctgcctg

SEQ ID NO: 2736023 - DNA, 17 bp, Homo sapiens
gtcgcgctgcctgtgtg

SEQ ID NO: 2736024 - DNA, 13 bp, Homo sapiens
gtcgtgtccagcc

SEQ ID NO: 2736025 - DNA, 16 bp, Homo sapiens
gtcgtgtctgctgttg

SEQ ID NO: 2736026 - DNA, 14 bp, Homo sapiens
gtctaaagagcttt

SEQ ID NO: 2736027 - DNA, 16 bp, Homo sapiens
gtctaaagtttacagt

SEQ ID NO: 2736028 - DNA, 20 bp, Homo sapiens
gtctactcattccccggggc

SEQ ID NO: 2736029 - DNA, 12 bp, Homo sapiens
gtctagtagaac

SEQ ID NO: 2736030 - DNA, 17 bp, Homo sapiens
gtctcaactactcagct

SEQ ID NO: 2736031 - DNA, 16 bp, Homo sapiens
gtctcaattttgtatt

SEQ ID NO: 2736032 - DNA, 18 bp, Homo sapiens
gtctcaattttgtattta

SEQ ID NO: 2736033 - DNA, 14 bp, Homo sapiens
gtctcacactcctc

SEQ ID NO: 2736034 - DNA, 16 bp, Homo sapiens
gtctcacactcctcct

SEQ ID NO: 2736035 - DNA, 20 bp, Homo sapiens
gtctcacactcctcctgcca

SEQ ID NO: 2736036 - DNA, 21 bp, Homo sapiens
gtctcacactcctcctgccag

SEQ ID NO: 2736037 - DNA, 24 bp, Homo sapiens
gtctcagactctttttgtacctgg

SEQ ID NO: 2736038 - DNA, 12 bp, Homo sapiens
gtctcaggagca

SEQ ID NO: 2736039 - DNA, 23 bp, Homo sapiens
gtctcccgcttggggcatttgtg

SEQ ID NO: 2736040 - DNA, 12 bp, Homo sapiens
gtctccctggcc

SEQ ID NO: 2736041 - DNA, 14 bp, Homo sapiens
gtctccctggccct

SEQ ID NO: 2736042 - DNA, 15 bp, Homo sapiens
gtctccctggccctc

SEQ ID NO: 2736043 - DNA, 16 bp, Homo sapiens
gtctccctggccctca

SEQ ID NO: 2736044 - DNA, 12 bp, Homo sapiens
gtctcctccacc

SEQ ID NO: 2736045 - DNA, 18 bp, Homo sapiens
gtctcctgtatcatttct

SEQ ID NO: 2736046 - DNA, 16 bp, Homo sapiens
gtctcggtggtaccag

SEQ ID NO: 2736047 - DNA, 12 bp, Homo sapiens
gtctctccagcc

SEQ ID NO: 2736048 - DNA, 14 bp, Homo sapiens
gtctctccagcctc

SEQ ID NO: 2736049 - DNA, 24 bp, Homo sapiens
gtctctccagcctcacagatgctg

SEQ ID NO: 2736050 - DNA, 12 bp, Homo sapiens
gtctctctgcct

SEQ ID NO: 2736051 - DNA, 14 bp, Homo sapiens
gtctctctgcctgc

SEQ ID NO: 2736052 - DNA, 17 bp, Homo sapiens
gtctctctgcctgctgg

SEQ ID NO: 2736053 - DNA, 18 bp, Homo sapiens
gtctctctgcctgctggg

SEQ ID NO: 2736054 - DNA, 21 bp, Homo sapiens
gtctctctgcctgctgggctc

SEQ ID NO: 2736055 - DNA, 19 bp, Homo sapiens
gtctctgcctggagcaggg

SEQ ID NO: 2736056 - DNA, 22 bp, Homo sapiens
gtctctgcctggagcaggggtg

SEQ ID NO: 2736057 - DNA, 15 bp, Homo sapiens
gtctcttctcagagc

SEQ ID NO: 2736058 - DNA, 16 bp, Homo sapiens
gtctcttctcagagca

SEQ ID NO: 2736059 - DNA, 17 bp, Homo sapiens
gtctcttgactggctca

SEQ ID NO: 2736060 - DNA, 13 bp, Homo sapiens
gtctgcttctgca

SEQ ID NO: 2736061 - DNA, 16 bp, Homo sapiens
gtctgtccaacccctc

SEQ ID NO: 2736062 - DNA, 22 bp, Homo sapiens
gtctgtccaacccctcccccac

SEQ ID NO: 2736063 - DNA, 15 bp, Homo sapiens
gtctgtctgctctta

SEQ ID NO: 2736064 - DNA, 16 bp, Homo sapiens
gtctgtctgctcttat

SEQ ID NO: 2736065 - DNA, 23 bp, Homo sapiens
gtctgtctgctcttatttttgta

SEQ ID NO: 2736066 - DNA, 20 bp, Homo sapiens
gtctgtctttgcaaaggact

SEQ ID NO: 2736067 - DNA, 21 bp, Homo sapiens
gtctgtgaaagtctcctgtat

SEQ ID NO: 2736068 - DNA, 13 bp, Homo sapiens
gtctgtgctctgt

SEQ ID NO: 2736069 - DNA, 22 bp, Homo sapiens
gtctgtgttgcgtgtcgtgggt

SEQ ID NO: 2736070 - DNA, 21 bp, Homo sapiens
gtctgttccccatggccactt

SEQ ID NO: 2736071 - DNA, 13 bp, Homo sapiens
gtcttactttgtg

SEQ ID NO: 2736072 - DNA, 17 bp, Homo sapiens
gtcttcactgctctgcc

SEQ ID NO: 2736073 - DNA, 16 bp, Homo sapiens
gtcttccaaccccagc

SEQ ID NO: 2736074 - DNA, 18 bp, Homo sapiens
gtcttccaaccccagctg

SEQ ID NO: 2736075 - DNA, 14 bp, Homo sapiens
gtcttcctgtgggg

SEQ ID NO: 2736076 - DNA, 17 bp, Homo sapiens
gtcttcttgtgtcctga

SEQ ID NO: 2736077 - DNA, 14 bp, Homo sapiens
gtcttgatctcctg

SEQ ID NO: 2736078 - DNA, 15 bp, Homo sapiens
gtcttgatctcctga

SEQ ID NO: 2736079 - DNA, 16 bp, Homo sapiens
gtcttggttagagaag

SEQ ID NO: 2736080 - DNA, 12 bp, Homo sapiens
gtctttctttgc

SEQ ID NO: 2736081 - DNA, 17 bp, Homo sapiens
gtctttctttgctgctg

SEQ ID NO: 2736082 - DNA, 19 bp, Homo sapiens
gtctttctttgctgctgtg

SEQ ID NO: 2736083 - DNA, 18 bp, Homo sapiens
ggttgaggggctcctgga

SEQ ID NO: 2736084 - DNA, 13 bp, Homo sapiens
ggttgcagggagc

SEQ ID NO: 2736085 - DNA, 22 bp, Homo sapiens
ggttggaaaagaaatcaatttt

SEQ ID NO: 2736086 - DNA, 17 bp, Homo sapiens
ggttggcgcaccctccc

SEQ ID NO: 2736087 - DNA, 12 bp, Homo sapiens
ggtttcaattta

SEQ ID NO: 2736088 - DNA, 21 bp, Homo sapiens
ggtttcccagtgagcctctgc

SEQ ID NO: 2736089 - DNA, 15 bp, Homo sapiens
gtaaaaagaaattgt

SEQ ID NO: 2736090 - DNA, 15 bp, Homo sapiens
gtaaaaagattatat

SEQ ID NO: 2736091 - DNA, 21 bp, Homo sapiens
gtaaaaagattatatatcata

SEQ ID NO: 2736092 - DNA, 14 bp, Homo sapiens
gtaaaatcttcagc

SEQ ID NO: 2736093 - DNA, 18 bp, Homo sapiens
gtaaatactccattattt

SEQ ID NO: 2736094 - DNA, 23 bp, Homo sapiens
gtaaatgaagggtcatttctctt

SEQ ID NO: 2736095 - DNA, 14 bp, Homo sapiens
gtaactcagacatt

SEQ ID NO: 2736096 - DNA, 18 bp, Homo sapiens
gtaactcagacattccaa

SEQ ID NO: 2736097 - DNA, 16 bp, Homo sapiens
gtaactcttggccaga

SEQ ID NO: 2736098 - DNA, 17 bp, Homo sapiens
gtaagacttgattggtt

SEQ ID NO: 2736099 - DNA, 16 bp, Homo sapiens
gtaagctctatctgca

SEQ ID NO: 2736100 - DNA, 20 bp, Homo sapiens
gtaagcttagattttctgta

SEQ ID NO: 2736101 - DNA, 18 bp, Homo sapiens
gtaagtaccactcaggcc

SEQ ID NO: 2736102 - DNA, 20 bp, Homo sapiens
gtaagtataacaaactatgt

SEQ ID NO: 2736103 - DNA, 19 bp, Homo sapiens
gtaagtttatgtctaaaga

SEQ ID NO: 2736104 - DNA, 13 bp, Homo sapiens
gtaataaatacac

SEQ ID NO: 2736105 - DNA, 15 bp, Homo sapiens
gtaataaatacacag

SEQ ID NO: 2736106 - DNA, 12 bp, Homo sapiens
gtaatatattgc

SEQ ID NO: 2736107 - DNA, 13 bp, Homo sapiens
gtaatatattgct

SEQ ID NO: 2736108 - DNA, 23 bp, Homo sapiens
gtaattattgtgatttcccgtgg

SEQ ID NO: 2736109 - DNA, 21 bp, Homo sapiens
gtaatttgtatctgaaggaga

SEQ ID NO: 2736110 - DNA, 17 bp, Homo sapiens
gtaatttttaaagcaaa

SEQ ID NO: 2736111 - DNA, 20 bp, Homo sapiens
gtacaaagatatgctaagca

SEQ ID NO: 2736112 - DNA, 21 bp, Homo sapiens
gtacagttatttatgcctctg

SEQ ID NO: 2736113 - DNA, 18 bp, Homo sapiens
gtacagttcataattcac

SEQ ID NO: 2736114 - DNA, 18 bp, Homo sapiens
gtacatcttgtaagacac

SEQ ID NO: 2736115 - DNA, 17 bp, Homo sapiens
gtacattcatctggagg

SEQ ID NO: 2736116 - DNA, 16 bp, Homo sapiens
gtaccacaccctgcct

SEQ ID NO: 2736117 - DNA, 20 bp, Homo sapiens
gtaccacaccctgcctgctg

SEQ ID NO: 2736118 - DNA, 22 bp, Homo sapiens
gtaccacaccctgcctgctgtg

SEQ ID NO: 2736119 - DNA, 17 bp, Homo sapiens
gtaccatattgctctta

SEQ ID NO: 2736120 - DNA, 18 bp, Homo sapiens
gtacccccgcccaggctg

SEQ ID NO: 2736121 - DNA, 23 bp, Homo sapiens
gtacccccgcccaggctggccag

SEQ ID NO: 2736122 - DNA, 15 bp, Homo sapiens
gtacctgattgtatt

SEQ ID NO: 2736123 - DNA, 17 bp, Homo sapiens
gtacctggtgacccctt

SEQ ID NO: 2736124 - DNA, 16 bp, Homo sapiens
gtaccttaatttgact

SEQ ID NO: 2736125 - DNA, 12 bp, Homo sapiens
gtactatctttg

SEQ ID NO: 2736126 - DNA, 14 bp, Homo sapiens
gtactatctttgtc

SEQ ID NO: 2736127 - DNA, 23 bp, Homo sapiens
gtactcaggaggctgaggggagg

SEQ ID NO: 2736128 - DNA, 16 bp, Homo sapiens
gtacttcagtcttgga

SEQ ID NO: 2736129 - DNA, 17 bp, Homo sapiens
gtacttcagtcttggag

SEQ ID NO: 2736130 - DNA, 20 bp, Homo sapiens
gtacttcccaattgccacat

SEQ ID NO: 2736131 - DNA, 11 bp, Homo sapiens
gtagaagccag

SEQ ID NO: 2736132 - DNA, 19 bp, Homo sapiens
gtagccccgggctgaccca

SEQ ID NO: 2736133 - DNA, 15 bp, Homo sapiens
gtagccttgcccgga

SEQ ID NO: 2736134 - DNA, 17 bp, Homo sapiens
gtagtcgtcaagttgca

SEQ ID NO: 2736135 - DNA, 11 bp, Homo sapiens
gtagtgtcttc

SEQ ID NO: 2736136 - DNA, 17 bp, Homo sapiens
gtagttccaggactcag

SEQ ID NO: 2736137 - DNA, 12 bp, Homo sapiens
gtataaggatct

SEQ ID NO: 2736138 - DNA, 17 bp, Homo sapiens
gtataaggatcttttgt

SEQ ID NO: 2736139 - DNA, 19 bp, Homo sapiens
gtataaggatcttttgtaa

SEQ ID NO: 2736140 - DNA, 18 bp, Homo sapiens
gtataattaattgtcatt

SEQ ID NO: 2736141 - DNA, 15 bp, Homo sapiens
gtataggataaatta

SEQ ID NO: 2736142 - DNA, 19 bp, Homo sapiens
gtatatctggccacactgg

SEQ ID NO: 2736143 - DNA, 16 bp, Homo sapiens
gtatatgtatatctat

SEQ ID NO: 2736144 - DNA, 17 bp, Homo sapiens
gtatatgtatatctata

SEQ ID NO: 2736145 - DNA, 14 bp, Homo sapiens
gtatattagtttga

SEQ ID NO: 2736146 - DNA, 14 bp, Homo sapiens
gtatcccactagcc

SEQ ID NO: 2736147 - DNA, 15 bp, Homo sapiens
gtatctgcatgtaaa

SEQ ID NO: 2736148 - DNA, 20 bp, Homo sapiens
gtatctgcatgtaaaatctt

SEQ ID NO: 2736149 - DNA, 17 bp, Homo sapiens
gtatctggtatctgcat

SEQ ID NO: 2736150 - DNA, 23 bp, Homo sapiens
gtatgggaagccatattcacacc

SEQ ID NO: 2736151 - DNA, 20 bp, Homo sapiens
gtatgtacagttcataaatt

SEQ ID NO: 2736152 - DNA, 13 bp, Homo sapiens
gtattagccagga

SEQ ID NO: 2736153 - DNA, 20 bp, Homo sapiens
gtatttaagaaagggaaagc

SEQ ID NO: 2736154 - DNA, 21 bp, Homo sapiens
gtatttaatgatttttgtgta

SEQ ID NO: 2736155 - DNA, 19 bp, Homo sapiens
gtattttaggcagggattt

SEQ ID NO: 2736156 - DNA, 16 bp, Homo sapiens
gtatttttatttaaat

SEQ ID NO: 2736157 - DNA, 20 bp, Homo sapiens
gtatttttgaaagaattcta

SEQ ID NO: 2736158 - DNA, 22 bp, Homo sapiens
gtattttttttttaaataaaag

SEQ ID NO: 2736159 - DNA, 18 bp, Homo sapiens
gtcaaagcggatgctggc

SEQ ID NO: 2736160 - DNA, 19 bp, Homo sapiens
gtcaacactcttcttgagc

SEQ ID NO: 2736161 - DNA, 20 bp, Homo sapiens
gtcaagttccctcctgcagc

SEQ ID NO: 2736162 - DNA, 17 bp, Homo sapiens
gtcaataactctgattt

SEQ ID NO: 2736163 - DNA, 16 bp, Homo sapiens
gtcacagctcttgttt

SEQ ID NO: 2736164 - DNA, 14 bp, Homo sapiens
gtcaccatgcaagg

SEQ ID NO: 2736165 - DNA, 15 bp, Homo sapiens
gtcaccatgcaaggg

SEQ ID NO: 2736166 - DNA, 16 bp, Homo sapiens
gtcaccctgcagagct

SEQ ID NO: 2736167 - DNA, 19 bp, Homo sapiens
gtcactggctgcctccact

SEQ ID NO: 2736168 - DNA, 16 bp, Homo sapiens
gtcagactgctgggac

SEQ ID NO: 2736169 - DNA, 18 bp, Homo sapiens
gtcagactggctggctgc

SEQ ID NO: 2736170 - DNA, 22 bp, Homo sapiens
gtcagactggctggctgcagtg

SEQ ID NO: 2736171 - DNA, 15 bp, Homo sapiens
gtcagtaaatactcc

SEQ ID NO: 2736172 - DNA, 22 bp, Homo sapiens
gtcataactagaactgaatttt

SEQ ID NO: 2736173 - DNA, 17 bp, Homo sapiens
gtcatcaaaacctgcgc

SEQ ID NO: 2736174 - DNA, 12 bp, Homo sapiens
gtcatgtgccac

SEQ ID NO: 2736175 - DNA, 19 bp, Homo sapiens
gtcattaagcgggatccca

SEQ ID NO: 2736176 - DNA, 14 bp, Homo sapiens
gtcattatttaaag

SEQ ID NO: 2736177 - DNA, 17 bp, Homo sapiens
gtcattcctaatgcatt

SEQ ID NO: 2736178 - DNA, 15 bp, Homo sapiens
gtcatttctcttttt

SEQ ID NO: 2736179 - DNA, 21 bp, Homo sapiens
gtcatttgacaacacatgtgg

SEQ ID NO: 2736180 - DNA, 22 bp, Homo sapiens
gtccaaaatatttgtgatttac

SEQ ID NO: 2736181 - DNA, 14 bp, Homo sapiens
gtccaacccagcct

SEQ ID NO: 2736182 - DNA, 15 bp, Homo sapiens
gtccaacctgcctgt

SEQ ID NO: 2736183 - DNA, 19 bp, Homo sapiens
gtccagaccattgtcttcc

SEQ ID NO: 2736184 - DNA, 20 bp, Homo sapiens
gtccagaccattgtcttcca

SEQ ID NO: 2736185 - DNA, 15 bp, Homo sapiens
gtccagccagctcct

SEQ ID NO: 2736186 - DNA, 21 bp, Homo sapiens
gtccagcttctcttgaaaact

SEQ ID NO: 2736187 - DNA, 23 bp, Homo sapiens
gtccagtcctttgttgctgttgc

SEQ ID NO: 2736188 - DNA, 22 bp, Homo sapiens
cttccaccagagcaggggctgc

SEQ ID NO: 2736189 - DNA, 16 bp, Homo sapiens
cttccaggcccccacc

SEQ ID NO: 2736190 - DNA, 12 bp, Homo sapiens
cttccatttcta

SEQ ID NO: 2736191 - DNA, 12 bp, Homo sapiens
cttcccccaagg

SEQ ID NO: 2736192 - DNA, 15 bp, Homo sapiens
cttcccccaccctgg

SEQ ID NO: 2736193 - DNA, 16 bp, Homo sapiens
cttcccccaccctggg

SEQ ID NO: 2736194 - DNA, 11 bp, Homo sapiens
cttcccctcca

SEQ ID NO: 2736195 - DNA, 22 bp, Homo sapiens
cttcccctcctacccctcccag

SEQ ID NO: 2736196 - DNA, 16 bp, Homo sapiens
cttccccttgtccctg

SEQ ID NO: 2736197 - DNA, 17 bp, Homo sapiens
cttccccttgtccctgg

SEQ ID NO: 2736198 - DNA, 18 bp, Homo sapiens
cttccccttgtccctggg

SEQ ID NO: 2736199 - DNA, 19 bp, Homo sapiens
cttccccttgtccctgggg

SEQ ID NO: 2736200 - DNA, 21 bp, Homo sapiens
cttccccttgtccctggggca

SEQ ID NO: 2736201 - DNA, 19 bp, Homo sapiens
cttccctccccacagtcct

SEQ ID NO: 2736202 - DNA, 15 bp, Homo sapiens
cttccctctgcctga

SEQ ID NO: 2736203 - DNA, 22 bp, Homo sapiens
cttccctgcttttctcccagaa

SEQ ID NO: 2736204 - DNA, 17 bp, Homo sapiens
cttccctgggcctcagc

SEQ ID NO: 2736205 - DNA, 13 bp, Homo sapiens
cttccctggggcc

SEQ ID NO: 2736206 - DNA, 16 bp, Homo sapiens
cttccctggggcccca

SEQ ID NO: 2736207 - DNA, 23 bp, Homo sapiens
cttcctacacccttggacttgag

SEQ ID NO: 2736208 - DNA, 14 bp, Homo sapiens
cttcctcatctgtg

SEQ ID NO: 2736209 - DNA, 15 bp, Homo sapiens
cttcctcatctgtgc

SEQ ID NO: 2736210 - DNA, 19 bp, Homo sapiens
cttcctcatctgtgcctgt

SEQ ID NO: 2736211 - DNA, 14 bp, Homo sapiens
cttcctctgagccg

SEQ ID NO: 2736212 - DNA, 22 bp, Homo sapiens
cttcctgacccggattggccct

SEQ ID NO: 2736213 - DNA, 18 bp, Homo sapiens
cttcctggaccggggcct

SEQ ID NO: 2736214 - DNA, 22 bp, Homo sapiens
cttcctggtgaggcccagcctg

SEQ ID NO: 2736215 - DNA, 21 bp, Homo sapiens
cttccttaattcactcccaca

SEQ ID NO: 2736216 - DNA, 13 bp, Homo sapiens
cttctcagagcag

SEQ ID NO: 2736217 - DNA, 22 bp, Homo sapiens
cttctcagagcagcactggggt

SEQ ID NO: 2736218 - DNA, 17 bp, Homo sapiens
ttaaattttaaggtaga

SEQ ID NO: 2736219 - DNA, 15 bp, Homo sapiens
ttaacaaagttactg

SEQ ID NO: 2736220 - DNA, 22 bp, Homo sapiens
ttaacaggttttcttctaatca

SEQ ID NO: 2736221 - DNA, 10 bp, Homo sapiens
ttaactctgc

SEQ ID NO: 2736222 - DNA, 16 bp, Homo sapiens
ttaactctgcaggaaa

SEQ ID NO: 2736223 - DNA, 20 bp, Homo sapiens
ttaagaaacaatttaaattg

SEQ ID NO: 2736224 - DNA, 12 bp, Homo sapiens
ttaagcatgagt

SEQ ID NO: 2736225 - DNA, 18 bp, Homo sapiens
ttaagcatgagtggcctt

SEQ ID NO: 2736226 - DNA, 17 bp, Homo sapiens
ttaataggataaattaa

SEQ ID NO: 2736227 - DNA, 19 bp, Homo sapiens
ttaataggatgaatgggaa

SEQ ID NO: 2736228 - DNA, 15 bp, Homo sapiens
ttaatctgttgtttg

SEQ ID NO: 2736229 - DNA, 20 bp, Homo sapiens
ttaatctgtttgtttggcac

SEQ ID NO: 2736230 - DNA, 18 bp, Homo sapiens
ttaatggaaacatgctgt

SEQ ID NO: 2736231 - DNA, 15 bp, Homo sapiens
ttaattcactcccac

SEQ ID NO: 2736232 - DNA, 12 bp, Homo sapiens
ttaattcattaa

SEQ ID NO: 2736233 - DNA, 20 bp, Homo sapiens
ttaattcattaatctgtttg

SEQ ID NO: 2736234 - DNA, 16 bp, Homo sapiens
ttaatttttataaata

SEQ ID NO: 2736235 - DNA, 15 bp, Homo sapiens
ttacaacaaacactg

SEQ ID NO: 2736236 - DNA, 20 bp, Homo sapiens
ttacagatcatataagcaag

SEQ ID NO: 2736237 - DNA, 15 bp, Homo sapiens
ttacagtaaataaat

SEQ ID NO: 2736238 - DNA, 16 bp, Homo sapiens
ttacagtgtatttaag

SEQ ID NO: 2736239 - DNA, 16 bp, Homo sapiens
ttacataatttgcaat

SEQ ID NO: 2736240 - DNA, 14 bp, Homo sapiens
ttacatacagtgat

SEQ ID NO: 2736241 - DNA, 15 bp, Homo sapiens
ttacatacagtgata

SEQ ID NO: 2736242 - DNA, 17 bp, Homo sapiens
ttacatgaattgcattt

SEQ ID NO: 2736243 - DNA, 15 bp, Homo sapiens
ttacatggctgtggt

SEQ ID NO: 2736244 - DNA, 10 bp, Homo sapiens
ttacatttca

SEQ ID NO: 2736245 - DNA, 20 bp, Homo sapiens
ttaccattattttacagtct

SEQ ID NO: 2736246 - DNA, 14 bp, Homo sapiens
ttacccttcctcat

SEQ ID NO: 2736247 - DNA, 22 bp, Homo sapiens
ttacccttcctcatctgtgcct

SEQ ID NO: 2736248 - DNA, 12 bp, Homo sapiens
ttactaaagtca

SEQ ID NO: 2736249 - DNA, 15 bp, Homo sapiens
ttactcagagctgcg

SEQ ID NO: 2736250 - DNA, 22 bp, Homo sapiens
ttactcagtgaaatcatattaa

SEQ ID NO: 2736251 - DNA, 15 bp, Homo sapiens
ttactgacagaaatg

SEQ ID NO: 2736252 - DNA, 13 bp, Homo sapiens
ttactgtcccagg

SEQ ID NO: 2736253 - DNA, 20 bp, Homo sapiens
ttacttacaaaagcagcttt

SEQ ID NO: 2736254 - DNA, 17 bp, Homo sapiens
ttacttccatgatactt

SEQ ID NO: 2736255 - DNA, 11 bp, Homo sapiens
ttacttctctt

SEQ ID NO: 2736256 - DNA, 14 bp, Homo sapiens
ttactttttaaaca

SEQ ID NO: 2736257 - DNA, 18 bp, Homo sapiens
ttactttttaaacagtgt

SEQ ID NO: 2736258 - DNA, 16 bp, Homo sapiens
ttagaaaatcagattt

SEQ ID NO: 2736259 - DNA, 22 bp, Homo sapiens
ttagaaccagccgtattttaca

SEQ ID NO: 2736260 - DNA, 19 bp, Homo sapiens
ttagaagatctgcttccct

SEQ ID NO: 2736261 - DNA, 18 bp, Homo sapiens
ttagaatcaagtctgtga

SEQ ID NO: 2736262 - DNA, 14 bp, Homo sapiens
ttagagtcagcctt

SEQ ID NO: 2736263 - DNA, 14 bp, Homo sapiens
ttagcaatcatttt

SEQ ID NO: 2736264 - DNA, 17 bp, Homo sapiens
ttagcaatcattttata

SEQ ID NO: 2736265 - DNA, 20 bp, Homo sapiens
ttagcttcatatctaattta

SEQ ID NO: 2736266 - DNA, 21 bp, Homo sapiens
ttaggagttcgagaccagcct

SEQ ID NO: 2736267 - DNA, 19 bp, Homo sapiens
ttaggcagggatttgagga

SEQ ID NO: 2736268 - DNA, 13 bp, Homo sapiens
ttaggtgccaggc

SEQ ID NO: 2736269 - DNA, 20 bp, Homo sapiens
ttagtcattattattacttt

SEQ ID NO: 2736270 - DNA, 23 bp, Homo sapiens
ttataaacctctaatttattttg

SEQ ID NO: 2736271 - DNA, 14 bp, Homo sapiens
tgcaatgtcctgca

SEQ ID NO: 2736272 - DNA, 18 bp, Homo sapiens
tgcaatgtttttgtgtag

SEQ ID NO: 2736273 - DNA, 19 bp, Homo sapiens
tgcaatgtttttgtgtaga

SEQ ID NO: 2736274 - DNA, 14 bp, Homo sapiens
tgcaattgagggct

SEQ ID NO: 2736275 - DNA, 18 bp, Homo sapiens
tgcaatttcaggaattta

SEQ ID NO: 2736276 - DNA, 17 bp, Homo sapiens
tgcacagacctcagaga

SEQ ID NO: 2736277 - DNA, 19 bp, Homo sapiens
tgcacagagggcgctcctg

SEQ ID NO: 2736278 - DNA, 16 bp, Homo sapiens
tgcacagcttcctgag

SEQ ID NO: 2736279 - DNA, 18 bp, Homo sapiens
tgcacattggaagctccc

SEQ ID NO: 2736280 - DNA, 12 bp, Homo sapiens
tgcaccaaagac

SEQ ID NO: 2736281 - DNA, 16 bp, Homo sapiens
tgcaccaacccagccg

SEQ ID NO: 2736282 - DNA, 16 bp, Homo sapiens
tgcaccattctttctt

SEQ ID NO: 2736283 - DNA, 15 bp, Homo sapiens
tgcaccccctcctgc

SEQ ID NO: 2736284 - DNA, 16 bp, Homo sapiens
tgcacctatggcccag

SEQ ID NO: 2736285 - DNA, 20 bp, Homo sapiens
tgcacctgccagcctggctt

SEQ ID NO: 2736286 - DNA, 18 bp, Homo sapiens
tgcacgtcaccctcctga

SEQ ID NO: 2736287 - DNA, 21 bp, Homo sapiens
tgcacgttaacagcgtgtcaa

SEQ ID NO: 2736288 - DNA, 18 bp, Homo sapiens
tgcactaaataaactact

SEQ ID NO: 2736289 - DNA, 19 bp, Homo sapiens
tgcactaaataaactactt

SEQ ID NO: 2736290 - DNA, 15 bp, Homo sapiens
tgcactccagcctgg

SEQ ID NO: 2736291 - DNA, 16 bp, Homo sapiens
tgcactccagcctggg

SEQ ID NO: 2736292 - DNA, 18 bp, Homo sapiens
tgcactccagcctgggcg

SEQ ID NO: 2736293 - DNA, 20 bp, Homo sapiens
tgcactctctctctgttaaa

SEQ ID NO: 2736294 - DNA, 12 bp, Homo sapiens
tgcactctgtgc

SEQ ID NO: 2736295 - DNA, 15 bp, Homo sapiens
tgcactgtatgctgg

SEQ ID NO: 2736296 - DNA, 15 bp, Homo sapiens
tgcactgtcctgctc

SEQ ID NO: 2736297 - DNA, 21 bp, Homo sapiens
tgcactgtcctgctccacagt

SEQ ID NO: 2736298 - DNA, 22 bp, Homo sapiens
tgcactgtcctgctccacagtg

SEQ ID NO: 2736299 - DNA, 23 bp, Homo sapiens
tgcactgtcctgctccacagtgt

SEQ ID NO: 2736300 - DNA, 13 bp, Homo sapiens
tgcagaggggaaa

SEQ ID NO: 2736301 - DNA, 13 bp, Homo sapiens
tgcagaggggcag

SEQ ID NO: 2736302 - DNA, 21 bp, Homo sapiens
tgcagaggggcaggccctgca

SEQ ID NO: 2736303 - DNA, 22 bp, Homo sapiens
tgcagaggggcaggccctgcac

SEQ ID NO: 2736304 - DNA, 21 bp, Homo sapiens
tgcagaggggctttctggaga

SEQ ID NO: 2736305 - DNA, 16 bp, Homo sapiens
tgcagaggtgagcaga

SEQ ID NO: 2736306 - DNA, 21 bp, Homo sapiens
tgcagccccgcgcctccttcc

SEQ ID NO: 2736307 - DNA, 22 bp, Homo sapiens
tgcagccttaaacagtgtccag

SEQ ID NO: 2736308 - DNA, 18 bp, Homo sapiens
tgcagcttcctgtcaaca

SEQ ID NO: 2736309 - DNA, 18 bp, Homo sapiens
tgcaggaaatcagagctg

SEQ ID NO: 2736310 - DNA, 19 bp, Homo sapiens
tgcaggaaatcagagctgg

SEQ ID NO: 2736311 - DNA, 17 bp, Homo sapiens
tgcaggcccagcagact

SEQ ID NO: 2736312 - DNA, 24 bp, Homo sapiens
tgcagggaggaggtggcagccctg

SEQ ID NO: 2736313 - DNA, 18 bp, Homo sapiens
tgcaggggactgggccat

SEQ ID NO: 2736314 - DNA, 19 bp, Homo sapiens
tgcaggtctccatgaagaa

SEQ ID NO: 2736315 - DNA, 17 bp, Homo sapiens
gctaccctccctgctgt

SEQ ID NO: 2736316 - DNA, 15 bp, Homo sapiens
gctactcagaagcct

SEQ ID NO: 2736317 - DNA, 18 bp, Homo sapiens
gctactcagaagcctgag

SEQ ID NO: 2736318 - DNA, 18 bp, Homo sapiens
gctagctatttctatgta

SEQ ID NO: 2736319 - DNA, 23 bp, Homo sapiens
gctaggggaaggactggccgtgg

SEQ ID NO: 2736320 - DNA, 23 bp, Homo sapiens
gctatattttcatgacttttcca

SEQ ID NO: 2736321 - DNA, 15 bp, Homo sapiens
gctattcccttctga

SEQ ID NO: 2736322 - DNA, 18 bp, Homo sapiens
gctattcccttctgatct

SEQ ID NO: 2736323 - DNA, 14 bp, Homo sapiens
gctatttctatgta

SEQ ID NO: 2736324 - DNA, 17 bp, Homo sapiens
gctcagagctgctgagc

SEQ ID NO: 2736325 - DNA, 20 bp, Homo sapiens
gctcagagctgctgagcagg

SEQ ID NO: 2736326 - DNA, 16 bp, Homo sapiens
gctcaggaggcttgga

SEQ ID NO: 2736327 - DNA, 21 bp, Homo sapiens
gctcagtctcaggagcatggg

SEQ ID NO: 2736328 - DNA, 17 bp, Homo sapiens
gctcagtgatctcactt

SEQ ID NO: 2736329 - DNA, 16 bp, Homo sapiens
gctcattgtggccagt

SEQ ID NO: 2736330 - DNA, 23 bp, Homo sapiens
gctcccagtgtcttcctgtgggg

SEQ ID NO: 2736331 - DNA, 15 bp, Homo sapiens
gctcccccgggaggg

SEQ ID NO: 2736332 - DNA, 21 bp, Homo sapiens
gctcccccgggaggggcccgc

SEQ ID NO: 2736333 - DNA, 20 bp, Homo sapiens
gctcccctgaggctggcatc

SEQ ID NO: 2736334 - DNA, 19 bp, Homo sapiens
gctccccttgcccttcctg

SEQ ID NO: 2736335 - DNA, 19 bp, Homo sapiens
gctcccgagctactctctt

SEQ ID NO: 2736336 - DNA, 20 bp, Homo sapiens
gctcccgagctactctcttg

SEQ ID NO: 2736337 - DNA, 15 bp, Homo sapiens
gctccctcctggagc

SEQ ID NO: 2736338 - DNA, 20 bp, Homo sapiens
gctccctggtgagggagcct

SEQ ID NO: 2736339 - DNA, 22 bp, Homo sapiens
gctccctggtgagggagcctcg

SEQ ID NO: 2736340 - DNA, 15 bp, Homo sapiens
gctcctagcccagca

SEQ ID NO: 2736341 - DNA, 12 bp, Homo sapiens
gctcctcccctg

SEQ ID NO: 2736342 - DNA, 15 bp, Homo sapiens
gctcctcccctgccg

SEQ ID NO: 2736343 - DNA, 17 bp, Homo sapiens
gctcctcccctgccgcc

SEQ ID NO: 2736344 - DNA, 19 bp, Homo sapiens
gctcctcccctgccgcctc

SEQ ID NO: 2736345 - DNA, 18 bp, Homo sapiens
gctcctccctctgcctca

SEQ ID NO: 2736346 - DNA, 22 bp, Homo sapiens
gctcctgctcattgtggccagt

SEQ ID NO: 2736347 - DNA, 12 bp, Homo sapiens
gctcctgtccct

SEQ ID NO: 2736348 - DNA, 12 bp, Homo sapiens
gctcctgtgccc

SEQ ID NO: 2736349 - DNA, 17 bp, Homo sapiens
gctcgccccacccaggg

SEQ ID NO: 2736350 - DNA, 20 bp, Homo sapiens
gctctacacaacatgtatgt

SEQ ID NO: 2736351 - DNA, 19 bp, Homo sapiens
gctctaccctgcagcttgg

SEQ ID NO: 2736352 - DNA, 18 bp, Homo sapiens
gctctatgtgggaaaaaa

SEQ ID NO: 2736353 - DNA, 19 bp, Homo sapiens
gctctcggcttcaccaggg

SEQ ID NO: 2736354 - DNA, 15 bp, Homo sapiens
gctctgaggagtgga

SEQ ID NO: 2736355 - DNA, 18 bp, Homo sapiens
gctctgccccagctctgg

SEQ ID NO: 2736356 - DNA, 19 bp, Homo sapiens
gctctgccccagctctggc

SEQ ID NO: 2736357 - DNA, 23 bp, Homo sapiens
gctctgcccccaactcccggagg

SEQ ID NO: 2736358 - DNA, 15 bp, Homo sapiens
gctctgcctcccgtg

SEQ ID NO: 2736359 - DNA, 15 bp, Homo sapiens
gctctgcctctaact

SEQ ID NO: 2736360 - DNA, 22 bp, Homo sapiens
gctctgcctctaactccctcct

SEQ ID NO: 2736361 - DNA, 22 bp, Homo sapiens
gctctgctggaagaactgcatg

SEQ ID NO: 2736362 - DNA, 20 bp, Homo sapiens
gctctgcttttcctgtctgt

SEQ ID NO: 2736363 - DNA, 15 bp, Homo sapiens
gctctggcctccaag

SEQ ID NO: 2736364 - DNA, 16 bp, Homo sapiens
gctctgtcaccctggc

SEQ ID NO: 2736365 - DNA, 19 bp, Homo sapiens
gctctgtcaccctggccac

SEQ ID NO: 2736366 - DNA, 20 bp, Homo sapiens
gctctgtcaccctggccacc

SEQ ID NO: 2736367 - DNA, 13 bp, Homo sapiens
gctctgtccttgt

SEQ ID NO: 2736368 - DNA, 24 bp, Homo sapiens
gctctgtgggctgcactctgtgcc

SEQ ID NO: 2736369 - DNA, 17 bp, Homo sapiens
gctcttacttcccccac

SEQ ID NO: 2736370 - DNA, 23 bp, Homo sapiens
gctcttacttcccccaccctggg

SEQ ID NO: 2736371 - DNA, 14 bp, Homo sapiens
gctgaacagtgctc

SEQ ID NO: 2736372 - DNA, 19 bp, Homo sapiens
gctgaacagtgctctgcct

SEQ ID NO: 2736373 - DNA, 18 bp, Homo sapiens
gctgacagagccagaggc

SEQ ID NO: 2736374 - DNA, 14 bp, Homo sapiens
gctgagactgcggg

SEQ ID NO: 2736375 - DNA, 14 bp, Homo sapiens
gctgagctggccta

SEQ ID NO: 2736376 - DNA, 14 bp, Homo sapiens
gctgaggcaccaga

SEQ ID NO: 2736377 - DNA, 13 bp, Homo sapiens
gctgaggcctccc

SEQ ID NO: 2736378 - DNA, 16 bp, Homo sapiens
gctgagggcatctctg

SEQ ID NO: 2736379 - DNA, 20 bp, Homo sapiens
gctgagggcatctctgagtg

SEQ ID NO: 2736380 - DNA, 22 bp, Homo sapiens
gctgaggggaggatcactggag

SEQ ID NO: 2736381 - DNA, 16 bp, Homo sapiens
gctgatgctgggctgg

SEQ ID NO: 2736382 - DNA, 16 bp, Homo sapiens
gctgcaattgagggct

SEQ ID NO: 2736383 - DNA, 16 bp, Homo sapiens
gctgcaccaacccagc

SEQ ID NO: 2736384 - DNA, 19 bp, Homo sapiens
gctgcaccaacccagccgc

SEQ ID NO: 2736385 - DNA, 21 bp, Homo sapiens
gctgcaccaacccagccgctg

SEQ ID NO: 2736386 - DNA, 21 bp, Homo sapiens
gctgcacctgccagcctggct

SEQ ID NO: 2736387 - DNA, 17 bp, Homo sapiens
gctgcacgtcaccctcc

SEQ ID NO: 2736388 - DNA, 14 bp, Homo sapiens
gctgcactctgtgc

SEQ ID NO: 2736389 - DNA, 16 bp, Homo sapiens
gctgcactctgtgccc

SEQ ID NO: 2736390 - DNA, 19 bp, Homo sapiens
gctgcactctgtgcccatg

SEQ ID NO: 2736391 - DNA, 13 bp, Homo sapiens
gctgcagaggggc

SEQ ID NO: 2736392 - DNA, 21 bp, Homo sapiens
gctgcagaggggcaggccctg

SEQ ID NO: 2736393 - DNA, 13 bp, Homo sapiens
gctgccactctgc

SEQ ID NO: 2736394 - DNA, 16 bp, Homo sapiens
gctgccactctgctgc

SEQ ID NO: 2736395 - DNA, 22 bp, Homo sapiens
gctgccatggcgtgtccctctc

SEQ ID NO: 2736396 - DNA, 14 bp, Homo sapiens
gctgcccgctccca

SEQ ID NO: 2736397 - DNA, 17 bp, Homo sapiens
gctgcccggcgccctct

SEQ ID NO: 2736398 - DNA, 12 bp, Homo sapiens
gctgcctccact

SEQ ID NO: 2736399 - DNA, 20 bp, Homo sapiens
gctgcctccactcccacttc

SEQ ID NO: 2736400 - DNA, 15 bp, Homo sapiens
gctgcctgtacagaa

SEQ ID NO: 2736401 - DNA, 14 bp, Homo sapiens
gctgcgggctgagg

SEQ ID NO: 2736402 - DNA, 15 bp, Homo sapiens
gctgcgggctgaggg

SEQ ID NO: 2736403 - DNA, 21 bp, Homo sapiens
gctgcgtcagaccagtactgg

SEQ ID NO: 2736404 - DNA, 23 bp, Homo sapiens
gctgctaatcctgaggctggtag

SEQ ID NO: 2736405 - DNA, 17 bp, Homo sapiens
gctgctaccctccctgc

SEQ ID NO: 2736406 - DNA, 23 bp, Homo sapiens
gctgctgagcaggaaccggaggg

SEQ ID NO: 2736407 - DNA, 17 bp, Homo sapiens
gctgctgccactctgct

SEQ ID NO: 2736408 - DNA, 18 bp, Homo sapiens
gctgctggcccacagctc

SEQ ID NO: 2736409 - DNA, 20 bp, Homo sapiens
gctgctggcccacagctctg

SEQ ID NO: 2736410 - DNA, 18 bp, Homo sapiens
gctggaagaactgcatgg

SEQ ID NO: 2736411 - DNA, 22 bp, Homo sapiens
gctggaaggtactgaaggcttc

SEQ ID NO: 2736412 - DNA, 13 bp, Homo sapiens
gctggacaaccca

SEQ ID NO: 2736413 - DNA, 16 bp, Homo sapiens
gctggacggcattcct

SEQ ID NO: 2736414 - DNA, 16 bp, Homo sapiens
gctggagaagcccatg

SEQ ID NO: 2736415 - DNA, 16 bp, Homo sapiens
gctggatggctcccct

SEQ ID NO: 2736416 - DNA, 20 bp, Homo sapiens
gctggcaatgccctacctgc

SEQ ID NO: 2736417 - DNA, 17 bp, Homo sapiens
gctggcagcctccagtg

SEQ ID NO: 2736418 - DNA, 12 bp, Homo sapiens
gctggcagggcc

SEQ ID NO: 2736419 - DNA, 15 bp, Homo sapiens
gctggcatcctggct

SEQ ID NO: 2736420 - DNA, 17 bp, Homo sapiens
gctggcatcctggctgg

SEQ ID NO: 2736421 - DNA, 21 bp, Homo sapiens
gctggcatcctggctggctgt

SEQ ID NO: 2736422 - DNA, 13 bp, Homo sapiens
gctggccacagaa

SEQ ID NO: 2736423 - DNA, 14 bp, Homo sapiens
gctggccagcccca

SEQ ID NO: 2736424 - DNA, 18 bp, Homo sapiens
gctggccagccccacagc

SEQ ID NO: 2736425 - DNA, 21 bp, Homo sapiens
gctggccagccccacagccca

SEQ ID NO: 2736426 - DNA, 22 bp, Homo sapiens
gctggccagccccacagcccac

SEQ ID NO: 2736427 - DNA, 15 bp, Homo sapiens
gctggcccacagctc

SEQ ID NO: 2736428 - DNA, 18 bp, Homo sapiens
gctggcccacagctctgc

SEQ ID NO: 2736429 - DNA, 22 bp, Homo sapiens
gctggcctctagaacacccact

SEQ ID NO: 2736430 - DNA, 11 bp, Homo sapiens
gctggcctgct

SEQ ID NO: 2736431 - DNA, 13 bp, Homo sapiens
gctggcctgctct

SEQ ID NO: 2736432 - DNA, 16 bp, Homo sapiens
gctggcggcgcagagg

SEQ ID NO: 2736433 - DNA, 14 bp, Homo sapiens
gctggctgcagtga

SEQ ID NO: 2736434 - DNA, 12 bp, Homo sapiens
gctggctgctgg

SEQ ID NO: 2736435 - DNA, 14 bp, Homo sapiens
gctggctggggcct

SEQ ID NO: 2736436 - DNA, 16 bp, Homo sapiens
gctggctgtgtcctct

SEQ ID NO: 2736437 - DNA, 22 bp, Homo sapiens
gctgggaccccagctagggctg

SEQ ID NO: 2736438 - DNA, 15 bp, Homo sapiens
gctgggcccacagcc

SEQ ID NO: 2736439 - DNA, 16 bp, Homo sapiens
ggcaggtctgggccag

SEQ ID NO: 2736440 - DNA, 23 bp, Homo sapiens
ggcagtgaacacactcagcagcc

SEQ ID NO: 2736441 - DNA, 20 bp, Homo sapiens
ggcagttctgtgtcctcgca

SEQ ID NO: 2736442 - DNA, 23 bp, Homo sapiens
ggcatcacagggcagagccggga

SEQ ID NO: 2736443 - DNA, 15 bp, Homo sapiens
ggcatcaggaaagga

SEQ ID NO: 2736444 - DNA, 14 bp, Homo sapiens
ggcatcctggctgg

SEQ ID NO: 2736445 - DNA, 16 bp, Homo sapiens
ggcatcctggctggct

SEQ ID NO: 2736446 - DNA, 18 bp, Homo sapiens
ggcatcctggctggctgt

SEQ ID NO: 2736447 - DNA, 16 bp, Homo sapiens
ggcatccttctgcctt

SEQ ID NO: 2736448 - DNA, 19 bp, Homo sapiens
ggcatccttctgccttttt

SEQ ID NO: 2736449 - DNA, 20 bp, Homo sapiens
ggcatctctgagtgtctctg

SEQ ID NO: 2736450 - DNA, 22 bp, Homo sapiens
ggcatctctgagtgtctctgcc

SEQ ID NO: 2736451 - DNA, 23 bp, Homo sapiens
ggcatctctgagtgtctctgcct

SEQ ID NO: 2736452 - DNA, 16 bp, Homo sapiens
ggcatcttgctgctaa

SEQ ID NO: 2736453 - DNA, 21 bp, Homo sapiens
ggcatgacactctagtgactt

SEQ ID NO: 2736454 - DNA, 13 bp, Homo sapiens
ggcatgctggggc

SEQ ID NO: 2736455 - DNA, 21 bp, Homo sapiens
ggcattctctctgctcagtga

SEQ ID NO: 2736456 - DNA, 18 bp, Homo sapiens
ggcattggcagcaggtgc

SEQ ID NO: 2736457 - DNA, 21 bp, Homo sapiens
ggcattggcagcaggtgctgc

SEQ ID NO: 2736458 - DNA, 22 bp, Homo sapiens
ggcatttggtgagagtcaaagc

SEQ ID NO: 2736459 - DNA, 15 bp, Homo sapiens
ggccaacaaggactc

SEQ ID NO: 2736460 - DNA, 17 bp, Homo sapiens
ggccaaggtttcccagt

SEQ ID NO: 2736461 - DNA, 23 bp, Homo sapiens
ggccaaggtttcccagtgagcct

SEQ ID NO: 2736462 - DNA, 21 bp, Homo sapiens
ggccaccagcttccctctgcc

SEQ ID NO: 2736463 - DNA, 24 bp, Homo sapiens
ggccaccagcttccctctgcctga

SEQ ID NO: 2736464 - DNA, 16 bp, Homo sapiens
ggccacgtctgtgctc

SEQ ID NO: 2736465 - DNA, 17 bp, Homo sapiens
ggccactccccagtgct

SEQ ID NO: 2736466 - DNA, 15 bp, Homo sapiens
ggccagcaggcagcg

SEQ ID NO: 2736467 - DNA, 17 bp, Homo sapiens
ggccagcaggcagcgcc

SEQ ID NO: 2736468 - DNA, 18 bp, Homo sapiens
ggccagcaggcagcgcct

SEQ ID NO: 2736469 - DNA, 13 bp, Homo sapiens
ggccagccccaca

SEQ ID NO: 2736470 - DNA, 23 bp, Homo sapiens
ggccagccccacagcccacgtcc

SEQ ID NO: 2736471 - DNA, 14 bp, Homo sapiens
ggccagtcctagag

SEQ ID NO: 2736472 - DNA, 15 bp, Homo sapiens
ggccagtcctagagc

SEQ ID NO: 2736473 - DNA, 18 bp, Homo sapiens
ggccagtcctagagctcc

SEQ ID NO: 2736474 - DNA, 24 bp, Homo sapiens
ggccagtcctagagctcctgtccc

SEQ ID NO: 2736475 - DNA, 18 bp, Homo sapiens
ggccatcttccaggtggg

SEQ ID NO: 2736476 - DNA, 20 bp, Homo sapiens
ggcccagagcgaggaaagga

SEQ ID NO: 2736477 - DNA, 15 bp, Homo sapiens
ggcccagccactgca

SEQ ID NO: 2736478 - DNA, 12 bp, Homo sapiens
ggcccagcctgt

SEQ ID NO: 2736479 - DNA, 14 bp, Homo sapiens
ggcccagctccccc

SEQ ID NO: 2736480 - DNA, 13 bp, Homo sapiens
ggcccaggccatc

SEQ ID NO: 2736481 - DNA, 16 bp, Homo sapiens
ggcccatcagtgtacc

SEQ ID NO: 2736482 - DNA, 13 bp, Homo sapiens
ggcccatcccccc

SEQ ID NO: 2736483 - DNA, 18 bp, Homo sapiens
ggcccatcccccctcacc

SEQ ID NO: 2736484 - DNA, 19 bp, Homo sapiens
ggcccatcccccctcacca

SEQ ID NO: 2736485 - DNA, 20 bp, Homo sapiens
ggcccatctgtccatcctcc

SEQ ID NO: 2736486 - DNA, 23 bp, Homo sapiens
ggcccatctgtccatcctcctct

SEQ ID NO: 2736487 - DNA, 11 bp, Homo sapiens
ggccccagcct

SEQ ID NO: 2736488 - DNA, 12 bp, Homo sapiens
ggccccagcctg

SEQ ID NO: 2736489 - DNA, 20 bp, Homo sapiens
ggccccagcctggcccagct

SEQ ID NO: 2736490 - DNA, 13 bp, Homo sapiens
ggccccaggccct

SEQ ID NO: 2736491 - DNA, 22 bp, Homo sapiens
ggcccccagagacctttgccca

SEQ ID NO: 2736492 - DNA, 23 bp, Homo sapiens
ggcccctcaggggaagctgctag

SEQ ID NO: 2736493 - DNA, 14 bp, Homo sapiens
ggccccttctccag

SEQ ID NO: 2736494 - DNA, 21 bp, Homo sapiens
ggccccttctccagcaagcag

SEQ ID NO: 2736495 - DNA, 23 bp, Homo sapiens
ggccccttctccagcaagcagtg

SEQ ID NO: 2736496 - DNA, 17 bp, Homo sapiens
ggcccgcttgcctcggc

SEQ ID NO: 2736497 - DNA, 19 bp, Homo sapiens
ggcccgcttgcctcggctc

SEQ ID NO: 2736498 - DNA, 23 bp, Homo sapiens
ggcccgcttgcctcggctcctgc

SEQ ID NO: 2736499 - DNA, 20 bp, Homo sapiens
ggcccgttgtctccctggcc

SEQ ID NO: 2736500 - DNA, 22 bp, Homo sapiens
ggcccgttgtctccctggccct

SEQ ID NO: 2736501 - DNA, 21 bp, Homo sapiens
ggccctaggattcctccccca

SEQ ID NO: 2736502 - DNA, 22 bp, Homo sapiens
ggccctaggattcctcccccag

SEQ ID NO: 2736503 - DNA, 23 bp, Homo sapiens
ggccctcaaggcctcccacagtg

SEQ ID NO: 2736504 - DNA, 12 bp, Homo sapiens
ggccctgcccct

SEQ ID NO: 2736505 - DNA, 14 bp, Homo sapiens
ggccctgcccctcc

SEQ ID NO: 2736506 - DNA, 17 bp, Homo sapiens
ggccctgcccctccccc

SEQ ID NO: 2736507 - DNA, 12 bp, Homo sapiens
ggccggccctgc

SEQ ID NO: 2736508 - DNA, 15 bp, Homo sapiens
ggccggccctgcccc

SEQ ID NO: 2736509 - DNA, 16 bp, Homo sapiens
ggccggccctgcccct

SEQ ID NO: 2736510 - DNA, 13 bp, Homo sapiens
ggcctcccacagt

SEQ ID NO: 2736511 - DNA, 14 bp, Homo sapiens
ggcctcccacagtg

SEQ ID NO: 2736512 - DNA, 18 bp, Homo sapiens
ggcctcgcctggcctgag

SEQ ID NO: 2736513 - DNA, 19 bp, Homo sapiens
ggcctcggaggctcctccc

SEQ ID NO: 2736514 - DNA, 20 bp, Homo sapiens
ggcctctagaacacccactg

SEQ ID NO: 2736515 - DNA, 17 bp, Homo sapiens
ggcctctgtgcagacag

SEQ ID NO: 2736516 - DNA, 21 bp, Homo sapiens
ggcctcttggcacctgcctag

SEQ ID NO: 2736517 - DNA, 13 bp, Homo sapiens
ggcctgacctcca

SEQ ID NO: 2736518 - DNA, 14 bp, Homo sapiens
ggcctgacctccag

SEQ ID NO: 2736519 - DNA, 20 bp, Homo sapiens
ggcctgacctccagtcctgc

SEQ ID NO: 2736520 - DNA, 22 bp, Homo sapiens
ggcctgacctccagtcctgctg

SEQ ID NO: 2736521 - DNA, 18 bp, Homo sapiens
ggcctgccttgaagccac

SEQ ID NO: 2736522 - DNA, 11 bp, Homo sapiens
ggcctgctctg

SEQ ID NO: 2736523 - DNA, 13 bp, Homo sapiens
ggcctgctctgct

SEQ ID NO: 2736524 - DNA, 18 bp, Homo sapiens
ggcctgctgcgtcagacc

SEQ ID NO: 2736525 - DNA, 15 bp, Homo sapiens
ggccttccctcccca

SEQ ID NO: 2736526 - DNA, 17 bp, Homo sapiens
ggcgacagagcaagact

SEQ ID NO: 2736527 - DNA, 18 bp, Homo sapiens
ggcgcaccctcccctccc

SEQ ID NO: 2736528 - DNA, 13 bp, Homo sapiens
ggcgcagagggaa

SEQ ID NO: 2736529 - DNA, 11 bp, Homo sapiens
ggcgccctctg

SEQ ID NO: 2736530 - DNA, 13 bp, Homo sapiens
ggcgccctctgtc

SEQ ID NO: 2736531 - DNA, 17 bp, Homo sapiens
ggcgcgtctgccccacc

SEQ ID NO: 2736532 - DNA, 21 bp, Homo sapiens
ggcggcacgccaacagccccc

SEQ ID NO: 2736533 - DNA, 14 bp, Homo sapiens
ggcggcgcagaggg

SEQ ID NO: 2736534 - DNA, 16 bp, Homo sapiens
ggcggcgcagagggaa

SEQ ID NO: 2736535 - DNA, 22 bp, Homo sapiens
ggcgggcacctatagtcccagc

SEQ ID NO: 2736536 - DNA, 20 bp, Homo sapiens
ggcgtcgctggacaacccag

SEQ ID NO: 2736537 - DNA, 16 bp, Homo sapiens
ggcgtggtggcgggca

SEQ ID NO: 2736538 - DNA, 19 bp, Homo sapiens
ggctacaaaccaggagcaa

SEQ ID NO: 2736539 - DNA, 21 bp, Homo sapiens
ggctcacgcctatgatcccag

SEQ ID NO: 2736540 - DNA, 19 bp, Homo sapiens
ggctcactgcaagctctgc

SEQ ID NO: 2736541 - DNA, 12 bp, Homo sapiens
ggctcagctgtg

SEQ ID NO: 2736542 - DNA, 17 bp, Homo sapiens
ggctcagggaccacagc

SEQ ID NO: 2736543 - DNA, 16 bp, Homo sapiens
ggctcatcagaactga

SEQ ID NO: 2736544 - DNA, 14 bp, Homo sapiens
ggctccatgctggt

SEQ ID NO: 2736545 - DNA, 15 bp, Homo sapiens
ggctccccttgccct

SEQ ID NO: 2736546 - DNA, 16 bp, Homo sapiens
ggctccctcctggagc

SEQ ID NO: 2736547 - DNA, 15 bp, Homo sapiens
ggctccgtgagccct

SEQ ID NO: 2736548 - DNA, 21 bp, Homo sapiens
ggctcctccctctgcctcatc

SEQ ID NO: 2736549 - DNA, 14 bp, Homo sapiens
ggctcctgctgcac

SEQ ID NO: 2736550 - DNA, 23 bp, Homo sapiens
ggctcctgctgcaccaacccagc

SEQ ID NO: 2736551 - DNA, 14 bp, Homo sapiens
ggctcgccccaccc

SEQ ID NO: 2736552 - DNA, 18 bp, Homo sapiens
ggctcgccccacccaggg

SEQ ID NO: 2736553 - DNA, 21 bp, Homo sapiens
ggctctgccagcgtccccggc

SEQ ID NO: 2736554 - DNA, 12 bp, Homo sapiens
ggctctgcccca

SEQ ID NO: 2736555 - DNA, 23 bp, Homo sapiens
ggctctgccccagctctggcttc

SEQ ID NO: 2736556 - DNA, 15 bp, Homo sapiens
ggctctgtgggctgc

SEQ ID NO: 2736557 - DNA, 17 bp, Homo sapiens
ggctcttaactgttgct

SEQ ID NO: 2736558 - DNA, 20 bp, Homo sapiens
ggctgaacagtgctctgcct

SEQ ID NO: 2736559 - DNA, 21 bp, Homo sapiens
ggctgacccagtgtgtgctca

SEQ ID NO: 2736560 - DNA, 12 bp, Homo sapiens
ggctgagccctg

SEQ ID NO: 2736561 - DNA, 14 bp, Homo sapiens
ggctgagccctggc

SEQ ID NO: 2736562 - DNA, 16 bp, Homo sapiens
ggctgagccctggcag

SEQ ID NO: 2736563 - DNA, 15 bp, Homo sapiens
gtgtcactggctgcc

SEQ ID NO: 2736564 - DNA, 17 bp, Homo sapiens
gtgtcactggctgcctc

SEQ ID NO: 2736565 - DNA, 18 bp, Homo sapiens
gtgtcactggctgcctcc

SEQ ID NO: 2736566 - DNA, 19 bp, Homo sapiens
gtgtcactggctgcctcca

SEQ ID NO: 2736567 - DNA, 23 bp, Homo sapiens
gtgtcactggctgcctccactcc

SEQ ID NO: 2736568 - DNA, 15 bp, Homo sapiens
gtgtcagcactcagg

SEQ ID NO: 2736569 - DNA, 23 bp, Homo sapiens
gtgtccagaccattgtcttccaa

SEQ ID NO: 2736570 - DNA, 20 bp, Homo sapiens
gtgtccctttttgcagggga

SEQ ID NO: 2736571 - DNA, 14 bp, Homo sapiens
gtgtcctgtctgct

SEQ ID NO: 2736572 - DNA, 15 bp, Homo sapiens
gtgtcgtagccaagg

SEQ ID NO: 2736573 - DNA, 19 bp, Homo sapiens
gtgtctagtagaacaatgt

SEQ ID NO: 2736574 - DNA, 12 bp, Homo sapiens
gtgtctctgcct

SEQ ID NO: 2736575 - DNA, 15 bp, Homo sapiens
gtgtctgcagctcct

SEQ ID NO: 2736576 - DNA, 18 bp, Homo sapiens
gtgtctgcagctcctgga

SEQ ID NO: 2736577 - DNA, 18 bp, Homo sapiens
gtgtgaaagtcagatgcc

SEQ ID NO: 2736578 - DNA, 17 bp, Homo sapiens
gtgtgccccccatcctg

SEQ ID NO: 2736579 - DNA, 19 bp, Homo sapiens
gtgtgccccccatcctggc

SEQ ID NO: 2736580 - DNA, 22 bp, Homo sapiens
gtgtgccccccatcctggccca

SEQ ID NO: 2736581 - DNA, 16 bp, Homo sapiens
gtgtgcctgcagcccc

SEQ ID NO: 2736582 - DNA, 18 bp, Homo sapiens
gtgtgcctgcagccccgc

SEQ ID NO: 2736583 - DNA, 16 bp, Homo sapiens
gtgtgtaccacaccct

SEQ ID NO: 2736584 - DNA, 23 bp, Homo sapiens
gtgtgtaccacaccctgcctgct

SEQ ID NO: 2736585 - DNA, 14 bp, Homo sapiens
gtgtgtagccaagg

SEQ ID NO: 2736586 - DNA, 14 bp, Homo sapiens
gtgttaggcctggc

SEQ ID NO: 2736587 - DNA, 20 bp, Homo sapiens
gtgttcagtagttccaggac

SEQ ID NO: 2736588 - DNA, 17 bp, Homo sapiens
gtgttgacgtaagctct

SEQ ID NO: 2736589 - DNA, 18 bp, Homo sapiens
gtcacagggcctggggag

SEQ ID NO: 2736590 - DNA, 20 bp, Homo sapiens
gtcacccaggctggagtaca

SEQ ID NO: 2736591 - DNA, 13 bp, Homo sapiens
gtcaccctcctga

SEQ ID NO: 2736592 - DNA, 15 bp, Homo sapiens
gtcaccctcctgagc

SEQ ID NO: 2736593 - DNA, 16 bp, Homo sapiens
gtcactggctgcctcc

SEQ ID NO: 2736594 - DNA, 20 bp, Homo sapiens
gtcactggctgcctccactc

SEQ ID NO: 2736595 - DNA, 15 bp, Homo sapiens
gtcacttatcctgac

SEQ ID NO: 2736596 - DNA, 17 bp, Homo sapiens
gtcacttatcctgacac

SEQ ID NO: 2736597 - DNA, 14 bp, Homo sapiens
gtcagactgctggg

SEQ ID NO: 2736598 - DNA, 15 bp, Homo sapiens
gtcagactgctggga

SEQ ID NO: 2736599 - DNA, 20 bp, Homo sapiens
gtcagactgctgggactggc

SEQ ID NO: 2736600 - DNA, 13 bp, Homo sapiens
gtcagcactcagg

SEQ ID NO: 2736601 - DNA, 14 bp, Homo sapiens
gtcagcctcccaca

SEQ ID NO: 2736602 - DNA, 22 bp, Homo sapiens
gtcagccttgcatcaagggctt

SEQ ID NO: 2736603 - DNA, 20 bp, Homo sapiens
gtcaggagagccctctgctg

SEQ ID NO: 2736604 - DNA, 17 bp, Homo sapiens
gtcagtgccgccgcctc

SEQ ID NO: 2736605 - DNA, 17 bp, Homo sapiens
gtcataactagaactga

SEQ ID NO: 2736606 - DNA, 20 bp, Homo sapiens
gtcatcaaaacctgcgcagt

SEQ ID NO: 2736607 - DNA, 15 bp, Homo sapiens
gtcatggtcctggct

SEQ ID NO: 2736608 - DNA, 17 bp, Homo sapiens
gtcatgtgtatgagaag

SEQ ID NO: 2736609 - DNA, 21 bp, Homo sapiens
gtcattatttgataacatttt

SEQ ID NO: 2736610 - DNA, 18 bp, Homo sapiens
gtcattcctaatgcatta

SEQ ID NO: 2736611 - DNA, 18 bp, Homo sapiens
gtcattgtaacctcgtgt

SEQ ID NO: 2736612 - DNA, 11 bp, Homo sapiens
gtcatttaaaa

SEQ ID NO: 2736613 - DNA, 22 bp, Homo sapiens
gtccaaattgtctgtctgctct

SEQ ID NO: 2736614 - DNA, 15 bp, Homo sapiens
gtccaacccctcccc

SEQ ID NO: 2736615 - DNA, 16 bp, Homo sapiens
gtccaacctgcctgtg

SEQ ID NO: 2736616 - DNA, 16 bp, Homo sapiens
gtccaaggcagttctg

SEQ ID NO: 2736617 - DNA, 21 bp, Homo sapiens
gtccacagtggaaccagccca

SEQ ID NO: 2736618 - DNA, 18 bp, Homo sapiens
gtccagccagctcctgca

SEQ ID NO: 2736619 - DNA, 17 bp, Homo sapiens
gtccagggcgggagtgg

SEQ ID NO: 2736620 - DNA, 19 bp, Homo sapiens
gtccaggggagggaaaagc

SEQ ID NO: 2736621 - DNA, 12 bp, Homo sapiens
gtccagtgccca

SEQ ID NO: 2736622 - DNA, 12 bp, Homo sapiens
gtccataaagta

SEQ ID NO: 2736623 - DNA, 14 bp, Homo sapiens
gtccatcctcctct

SEQ ID NO: 2736624 - DNA, 15 bp, Homo sapiens
gtccatttcttattt

SEQ ID NO: 2736625 - DNA, 21 bp, Homo sapiens
gtcccacttcccctcctaccc

SEQ ID NO: 2736626 - DNA, 20 bp, Homo sapiens
gtcccaggagcaaatgctgg

SEQ ID NO: 2736627 - DNA, 21 bp, Homo sapiens
gtcccaggagcaaatgctgga

SEQ ID NO: 2736628 - DNA, 12 bp, Homo sapiens
gtcccagtgaac

SEQ ID NO: 2736629 - DNA, 15 bp, Homo sapiens
gtcccctcacagact

SEQ ID NO: 2736630 - DNA, 21 bp, Homo sapiens
gtcccctcacagactcttcca

SEQ ID NO: 2736631 - DNA, 21 bp, Homo sapiens
gtcccctcttgccccaacccc

SEQ ID NO: 2736632 - DNA, 12 bp, Homo sapiens
gtcccctggggc

SEQ ID NO: 2736633 - DNA, 19 bp, Homo sapiens
gtcccctggggctggtgga

SEQ ID NO: 2736634 - DNA, 19 bp, Homo sapiens
gtcccgaggatgctgtcag

SEQ ID NO: 2736635 - DNA, 23 bp, Homo sapiens
gtccctacccactctttgctaca

SEQ ID NO: 2736636 - DNA, 18 bp, Homo sapiens
gtccctgaagtcttgcat

SEQ ID NO: 2736637 - DNA, 23 bp, Homo sapiens
gtccctgaagtcttgcattgaat

SEQ ID NO: 2736638 - DNA, 16 bp, Homo sapiens
gtcccttccatttcta

SEQ ID NO: 2736639 - DNA, 20 bp, Homo sapiens
gtccctttttgcaggggact

SEQ ID NO: 2736640 - DNA, 22 bp, Homo sapiens
gtccctttttgcaggggactgg

SEQ ID NO: 2736641 - DNA, 20 bp, Homo sapiens
gtccggagcgaccctggctc

SEQ ID NO: 2736642 - DNA, 15 bp, Homo sapiens
gtcctagagctcctg

SEQ ID NO: 2736643 - DNA, 14 bp, Homo sapiens
gtcctcaaagaagt

SEQ ID NO: 2736644 - DNA, 16 bp, Homo sapiens
gtcctcacagcctctc

SEQ ID NO: 2736645 - DNA, 22 bp, Homo sapiens
gtcctccaacaataaagagctc

SEQ ID NO: 2736646 - DNA, 14 bp, Homo sapiens
gtcctcggcccatc

SEQ ID NO: 2736647 - DNA, 20 bp, Homo sapiens
gtcctcggcccatctgtcca

SEQ ID NO: 2736648 - DNA, 19 bp, Homo sapiens
gtcctctcagagcctcagc

SEQ ID NO: 2736649 - DNA, 14 bp, Homo sapiens
gtcctctccaccta

SEQ ID NO: 2736650 - DNA, 18 bp, Homo sapiens
gtcctctccacctagtgg

SEQ ID NO: 2736651 - DNA, 18 bp, Homo sapiens
gtcctctgcttcctgagc

SEQ ID NO: 2736652 - DNA, 20 bp, Homo sapiens
gtcctgacttcaggggctgc

SEQ ID NO: 2736653 - DNA, 14 bp, Homo sapiens
gtcctgctccacag

SEQ ID NO: 2736654 - DNA, 11 bp, Homo sapiens
gtcctgctggc

SEQ ID NO: 2736655 - DNA, 12 bp, Homo sapiens
gtcctgctggcc

SEQ ID NO: 2736656 - DNA, 20 bp, Homo sapiens
gtcctggaatgaagcatgta

SEQ ID NO: 2736657 - DNA, 13 bp, Homo sapiens
gtcctggaccctg

SEQ ID NO: 2736658 - DNA, 19 bp, Homo sapiens
gtcctgggagaacctcagg

SEQ ID NO: 2736659 - DNA, 13 bp, Homo sapiens
gtcctgtcagtgc

SEQ ID NO: 2736660 - DNA, 16 bp, Homo sapiens
gtcctgtcagtgccgc

SEQ ID NO: 2736661 - DNA, 21 bp, Homo sapiens
gtcctgtcagtgccgccgcct

SEQ ID NO: 2736662 - DNA, 20 bp, Homo sapiens
gtcctgtccggagcgaccct

SEQ ID NO: 2736663 - DNA, 13 bp, Homo sapiens
gtcctgtctgctg

SEQ ID NO: 2736664 - DNA, 14 bp, Homo sapiens
gtcctgtctgctgg

SEQ ID NO: 2736665 - DNA, 16 bp, Homo sapiens
gtcctgtctgctgggc

SEQ ID NO: 2736666 - DNA, 17 bp, Homo sapiens
gtcctgtctgctgggct

SEQ ID NO: 2736667 - DNA, 14 bp, Homo sapiens
gtccttactcagag

SEQ ID NO: 2736668 - DNA, 17 bp, Homo sapiens
gtccttactcagagctg

SEQ ID NO: 2736669 - DNA, 14 bp, Homo sapiens
gtccttccaggccc

SEQ ID NO: 2736670 - DNA, 12 bp, Homo sapiens
gtccttgaaaca

SEQ ID NO: 2736671 - DNA, 14 bp, Homo sapiens
gtcctttaggcagc

SEQ ID NO: 2736672 - DNA, 15 bp, Homo sapiens
gtcctttgttgctgt

SEQ ID NO: 2736673 - DNA, 19 bp, Homo sapiens
gtcctttgttgctgttgct

SEQ ID NO: 2736674 - DNA, 22 bp, Homo sapiens
gtccttttgtaccatggtgtga

SEQ ID NO: 2736675 - DNA, 16 bp, Homo sapiens
gtcgaatttttattat

SEQ ID NO: 2736676 - DNA, 12 bp, Homo sapiens
gtcgcgctgcct

SEQ ID NO: 2736677 - DNA, 16 bp, Homo sapiens
gtcgcgctgcctgtgt

SEQ ID NO: 2736678 - DNA, 15 bp, Homo sapiens
tacaataaatgctga

SEQ ID NO: 2736679 - DNA, 17 bp, Homo sapiens
tacaataaatgctgaat

SEQ ID NO: 2736680 - DNA, 21 bp, Homo sapiens
tacacaacatgtatgtggata

SEQ ID NO: 2736681 - DNA, 16 bp, Homo sapiens
tacactccagcctgag

SEQ ID NO: 2736682 - DNA, 17 bp, Homo sapiens
tacactccagcctgagc

SEQ ID NO: 2736683 - DNA, 19 bp, Homo sapiens
tacagaacacgctttcaca

SEQ ID NO: 2736684 - DNA, 17 bp, Homo sapiens
tacagtaaataaattgt

SEQ ID NO: 2736685 - DNA, 14 bp, Homo sapiens
tacagtcaacttac

SEQ ID NO: 2736686 - DNA, 22 bp, Homo sapiens
tacagtctcaattttgtattta

SEQ ID NO: 2736687 - DNA, 16 bp, Homo sapiens
tacagtgtatttaaga

SEQ ID NO: 2736688 - DNA, 16 bp, Homo sapiens
tacagttcataattca

SEQ ID NO: 2736689 - DNA, 17 bp, Homo sapiens
tacagttcataattcac

SEQ ID NO: 2736690 - DNA, 18 bp, Homo sapiens
tacagttcataattcacc

SEQ ID NO: 2736691 - DNA, 12 bp, Homo sapiens
aaaaaaaacaaa

SEQ ID NO: 2736692 - DNA, 13 bp, Homo sapiens
aaaaagaaattgt

SEQ ID NO: 2736693 - DNA, 14 bp, Homo sapiens
aaaaagaagtttgg

SEQ ID NO: 2736694 - DNA, 17 bp, Homo sapiens
aaaaagtatatattcta

SEQ ID NO: 2736695 - DNA, 20 bp, Homo sapiens
aaaaagtcagactgctggga

SEQ ID NO: 2736696 - DNA, 11 bp, Homo sapiens
aaaaatagaag

SEQ ID NO: 2736697 - DNA, 16 bp, Homo sapiens
aaaaatatatacagat

SEQ ID NO: 2736698 - DNA, 14 bp, Homo sapiens
aaaaatcttggttt

SEQ ID NO: 2736699 - DNA, 16 bp, Homo sapiens
aaaaatgagcttgtaa

SEQ ID NO: 2736700 - DNA, 14 bp, Homo sapiens
aaaaatgatttaat

SEQ ID NO: 2736701 - DNA, 12 bp, Homo sapiens
aaaaatgtcact

SEQ ID NO: 2736702 - DNA, 13 bp, Homo sapiens
aaaaattacagat

SEQ ID NO: 2736703 - DNA, 21 bp, Homo sapiens
aaaaattacagatcatataag

SEQ ID NO: 2736704 - DNA, 22 bp, Homo sapiens
aaaacatatgtctgtctttgca

SEQ ID NO: 2736705 - DNA, 24 bp, Homo sapiens
aaaacatatgtctgtctttgcaaa

SEQ ID NO: 2736706 - DNA, 22 bp, Homo sapiens
aaaaccctaagtgtggatgttc

SEQ ID NO: 2736707 - DNA, 15 bp, Homo sapiens
aaaacctgtttttaa

SEQ ID NO: 2736708 - DNA, 22 bp, Homo sapiens
aaaacctgtttttaacatgtga

SEQ ID NO: 2736709 - DNA, 20 bp, Homo sapiens
aaaactaaggatttttcaag

SEQ ID NO: 2736710 - DNA, 13 bp, Homo sapiens
aaaactgctttat

SEQ ID NO: 2736711 - DNA, 11 bp, Homo sapiens
aaaacttattt

SEQ ID NO: 2736712 - DNA, 15 bp, Homo sapiens
aaaacttatttgagt

SEQ ID NO: 2736713 - DNA, 13 bp, Homo sapiens
aaaacttcagaga

SEQ ID NO: 2736714 - DNA, 13 bp, Homo sapiens
aaaagaaatcaat

SEQ ID NO: 2736715 - DNA, 15 bp, Homo sapiens
aaaagaaatcaattt

SEQ ID NO: 2736716 - DNA, 21 bp, Homo sapiens
aaaagacattgaaagctctat

SEQ ID NO: 2736717 - DNA, 20 bp, Homo sapiens
aaaagattatatatcataaa

SEQ ID NO: 2736718 - DNA, 17 bp, Homo sapiens
aaaagcacaagtacttt

SEQ ID NO: 2736719 - DNA, 23 bp, Homo sapiens
aaaagcaggcttgtgctttatac

SEQ ID NO: 2736720 - DNA, 11 bp, Homo sapiens
aaaagccatat

SEQ ID NO: 2736721 - DNA, 22 bp, Homo sapiens
aaaagtaagtaccactcaggcc

SEQ ID NO: 2736722 - DNA, 11 bp, Homo sapiens
aaaagtatata

SEQ ID NO: 2736723 - DNA, 16 bp, Homo sapiens
aaaagttaaactactt

SEQ ID NO: 2736724 - DNA, 18 bp, Homo sapiens
aaaatcaaatttttctgg

SEQ ID NO: 2736725 - DNA, 16 bp, Homo sapiens
aaaatcttcagctggt

SEQ ID NO: 2736726 - DNA, 13 bp, Homo sapiens
aaaatgaagcaat

SEQ ID NO: 2736727 - DNA, 15 bp, Homo sapiens
aaaatgaagcaattt

SEQ ID NO: 2736728 - DNA, 22 bp, Homo sapiens
aaaatgaagcaatttatatctt

SEQ ID NO: 2736729 - DNA, 22 bp, Homo sapiens
aaaatgagactatgcgttttta

SEQ ID NO: 2736730 - DNA, 15 bp, Homo sapiens
aaaatgcattatgtg

SEQ ID NO: 2736731 - DNA, 21 bp, Homo sapiens
aaaatgcggcactatttctga

SEQ ID NO: 2736732 - DNA, 14 bp, Homo sapiens
aaaatggtgcctga

SEQ ID NO: 2736733 - DNA, 23 bp, Homo sapiens
aaaatgtcactgaagtgattgaa

SEQ ID NO: 2736734 - DNA, 15 bp, Homo sapiens
aaaattgtaaaattg

SEQ ID NO: 2736735 - DNA, 13 bp, Homo sapiens
aaaattgtataga

SEQ ID NO: 2736736 - DNA, 17 bp, Homo sapiens
aaaatttagcttatgct

SEQ ID NO: 2736737 - DNA, 15 bp, Homo sapiens
aaacaatttaaattg

SEQ ID NO: 2736738 - DNA, 16 bp, Homo sapiens
aaacacacagactctg

SEQ ID NO: 2736739 - DNA, 23 bp, Homo sapiens
aaacactaaattagtttaaaatg

SEQ ID NO: 2736740 - DNA, 20 bp, Homo sapiens
aaacactgggctctgaggag

SEQ ID NO: 2736741 - DNA, 14 bp, Homo sapiens
aaacagaatttttc

SEQ ID NO: 2736742 - DNA, 20 bp, Homo sapiens
aaacagggacactacaaaca

SEQ ID NO: 2736743 - DNA, 18 bp, Homo sapiens
aaacagtgggagggaatt

SEQ ID NO: 2736744 - DNA, 18 bp, Homo sapiens
aaacatatgtctgtcttt

SEQ ID NO: 2736745 - DNA, 13 bp, Homo sapiens
aaacatgaaaaca

SEQ ID NO: 2736746 - DNA, 17 bp, Homo sapiens
aaacatgaaaacattga

SEQ ID NO: 2736747 - DNA, 21 bp, Homo sapiens
aaacatgtgcaactcttgtat

SEQ ID NO: 2736748 - DNA, 23 bp, Homo sapiens
aaacatgtgcaactcttgtattg

SEQ ID NO: 2736749 - DNA, 21 bp, Homo sapiens
aaacatttctggacagtacct

SEQ ID NO: 2736750 - DNA, 17 bp, Homo sapiens
aaaccaacccatgtata

SEQ ID NO: 2736751 - DNA, 12 bp, Homo sapiens
aaaccaggagca

SEQ ID NO: 2736752 - DNA, 22 bp, Homo sapiens
aaaccctaagtgtggatgttca

SEQ ID NO: 2736753 - DNA, 21 bp, Homo sapiens
aaaccctgtggggcctgatgg

SEQ ID NO: 2736754 - DNA, 18 bp, Homo sapiens
aaacctctaatttatttt

SEQ ID NO: 2736755 - DNA, 12 bp, Homo sapiens
aaacctgcattt

SEQ ID NO: 2736756 - DNA, 18 bp, Homo sapiens
aaaccttgtttctttctg

SEQ ID NO: 2736757 - DNA, 21 bp, Homo sapiens
aaacgtattttgatcagtgtt

SEQ ID NO: 2736758 - DNA, 19 bp, Homo sapiens
aaactaccagtgggcatgt

SEQ ID NO: 2736759 - DNA, 21 bp, Homo sapiens
aaactaccagtgggcatgtat

SEQ ID NO: 2736760 - DNA, 23 bp, Homo sapiens
aaactaccagtgggcatgtatta

SEQ ID NO: 2736761 - DNA, 14 bp, Homo sapiens
aaactctgccagcc

SEQ ID NO: 2736762 - DNA, 14 bp, Homo sapiens
aaactgctgttaat

SEQ ID NO: 2736763 - DNA, 17 bp, Homo sapiens
aaacttagaataaaatt

SEQ ID NO: 2736764 - DNA, 12 bp, Homo sapiens
aaacttcagaga

SEQ ID NO: 2736765 - DNA, 18 bp, Homo sapiens
aaacttcagagaaattat

SEQ ID NO: 2736766 - DNA, 13 bp, Homo sapiens
aaacttcagcacc

SEQ ID NO: 2736767 - DNA, 12 bp, Homo sapiens
aaagaaaatcaa

SEQ ID NO: 2736768 - DNA, 13 bp, Homo sapiens
aaagaaacactaa

SEQ ID NO: 2736769 - DNA, 15 bp, Homo sapiens
aaagaaacactaaat

SEQ ID NO: 2736770 - DNA, 13 bp, Homo sapiens
aaagaactgcccc

SEQ ID NO: 2736771 - DNA, 24 bp, Homo sapiens
aatgacacactgcggtgtctgcag

SEQ ID NO: 2736772 - DNA, 20 bp, Homo sapiens
aatgagaaaatgtctttatt

SEQ ID NO: 2736773 - DNA, 19 bp, Homo sapiens
aatgaggaacaatcacaaa

SEQ ID NO: 2736774 - DNA, 20 bp, Homo sapiens
aatgagtttccagctaagcc

SEQ ID NO: 2736775 - DNA, 15 bp, Homo sapiens
aatgatgataatcat

SEQ ID NO: 2736776 - DNA, 15 bp, Homo sapiens
aatgcaacaatgtgt

SEQ ID NO: 2736777 - DNA, 21 bp, Homo sapiens
aatgcacattggaagctccca

SEQ ID NO: 2736778 - DNA, 11 bp, Homo sapiens
aatgcaggaga

SEQ ID NO: 2736779 - DNA, 20 bp, Homo sapiens
aatgcatgtaaggtcttctt

SEQ ID NO: 2736780 - DNA, 23 bp, Homo sapiens
aatgccaacttgtccttttgtac

SEQ ID NO: 2736781 - DNA, 22 bp, Homo sapiens
aatgccctacctgcctgttctc

SEQ ID NO: 2736782 - DNA, 20 bp, Homo sapiens
aatgcgtggcacatctaaat

SEQ ID NO: 2736783 - DNA, 21 bp, Homo sapiens
aatgctattcagataaggcag

SEQ ID NO: 2736784 - DNA, 22 bp, Homo sapiens
aatgctattcagataaggcaga

SEQ ID NO: 2736785 - DNA, 20 bp, Homo sapiens
aatgctgtgcaaacagtgta

SEQ ID NO: 2736786 - DNA, 22 bp, Homo sapiens
aatgctgtgcaaacagtgtaag

SEQ ID NO: 2736787 - DNA, 19 bp, Homo sapiens
aatgcttctgcctcagctt

SEQ ID NO: 2736788 - DNA, 16 bp, Homo sapiens
aatgcttcttaaagtt

SEQ ID NO: 2736789 - DNA, 15 bp, Homo sapiens
aatgctttccaaaac

SEQ ID NO: 2736790 - DNA, 22 bp, Homo sapiens
aatggcacgatctcagctcacc

SEQ ID NO: 2736791 - DNA, 10 bp, Homo sapiens
aatggccatg

SEQ ID NO: 2736792 - DNA, 18 bp, Homo sapiens
aatggcttacttacaaaa

SEQ ID NO: 2736793 - DNA, 22 bp, Homo sapiens
aatggcttacttacaaaagcag

SEQ ID NO: 2736794 - DNA, 14 bp, Homo sapiens
aatgggaaagtatt

SEQ ID NO: 2736795 - DNA, 18 bp, Homo sapiens
aatggtgttactaaagtc

SEQ ID NO: 2736796 - DNA, 19 bp, Homo sapiens
aatggtgttactaaagtca

SEQ ID NO: 2736797 - DNA, 15 bp, Homo sapiens
aatgtaatgatcata

SEQ ID NO: 2736798 - DNA, 21 bp, Homo sapiens
aatgtaatgatcataagtcta

SEQ ID NO: 2736799 - DNA, 17 bp, Homo sapiens
aatgtcactgaagtgat

SEQ ID NO: 2736800 - DNA, 12 bp, Homo sapiens
aatgtcattatt

SEQ ID NO: 2736801 - DNA, 15 bp, Homo sapiens
aatgtcattatttga

SEQ ID NO: 2736802 - DNA, 14 bp, Homo sapiens
aatgtcccagaggc

SEQ ID NO: 2736803 - DNA, 14 bp, Homo sapiens
aatgtgactcaaga

SEQ ID NO: 2736804 - DNA, 13 bp, Homo sapiens
aatgtgatcatct

SEQ ID NO: 2736805 - DNA, 18 bp, Homo sapiens
aatgtgatcatctttgct

SEQ ID NO: 2736806 - DNA, 19 bp, Homo sapiens
aatgtgatcatctttgctg

SEQ ID NO: 2736807 - DNA, 12 bp, Homo sapiens
aatgtgtcattg

SEQ ID NO: 2736808 - DNA, 20 bp, Homo sapiens
aatgtgtctgcaacatggat

SEQ ID NO: 2736809 - DNA, 23 bp, Homo sapiens
aatgttggtgcaattaactctgg

SEQ ID NO: 2736810 - DNA, 12 bp, Homo sapiens
aattaatctttt

SEQ ID NO: 2736811 - DNA, 15 bp, Homo sapiens
aattaatcttttaaa

SEQ ID NO: 2736812 - DNA, 22 bp, Homo sapiens
aattaatgagttttatccaaga

SEQ ID NO: 2736813 - DNA, 16 bp, Homo sapiens
aattactggacatatg

SEQ ID NO: 2736814 - DNA, 16 bp, Homo sapiens
aattagcaatcatttt

SEQ ID NO: 2736815 - DNA, 19 bp, Homo sapiens
aattagcaatcattttata

SEQ ID NO: 2736816 - DNA, 14 bp, Homo sapiens
aattagtttaaaat

SEQ ID NO: 2736817 - DNA, 16 bp, Homo sapiens
aattagtttaaaatga

SEQ ID NO: 2736818 - DNA, 13 bp, Homo sapiens
aattattgtgatt

SEQ ID NO: 2736819 - DNA, 16 bp, Homo sapiens
aattattgtgatttcc

SEQ ID NO: 2736820 - DNA, 19 bp, Homo sapiens
aattattttccaaaatcta

SEQ ID NO: 2736821 - DNA, 20 bp, Homo sapiens
aattcaaagaaaaccctaag

SEQ ID NO: 2736822 - DNA, 14 bp, Homo sapiens
aattcaaagctcta

SEQ ID NO: 2736823 - DNA, 18 bp, Homo sapiens
aattcaaagctctattaa

SEQ ID NO: 2736824 - DNA, 16 bp, Homo sapiens
aattcaccaaaagttc

SEQ ID NO: 2736825 - DNA, 21 bp, Homo sapiens
aattcactgttgaatgcctgt

SEQ ID NO: 2736826 - DNA, 17 bp, Homo sapiens
aattcattaatctgttt

SEQ ID NO: 2736827 - DNA, 16 bp, Homo sapiens
aattcattgtgtatga

SEQ ID NO: 2736828 - DNA, 15 bp, Homo sapiens
aattccatgcactct

SEQ ID NO: 2736829 - DNA, 17 bp, Homo sapiens
aattctattttgctgga

SEQ ID NO: 2736830 - DNA, 18 bp, Homo sapiens
aattgttctgggtgattt

SEQ ID NO: 2736831 - DNA, 13 bp, Homo sapiens
aatttaaattgtt

SEQ ID NO: 2736832 - DNA, 20 bp, Homo sapiens
aatttaccattattttacag

SEQ ID NO: 2736833 - DNA, 21 bp, Homo sapiens
aatttaccattattttacagt

SEQ ID NO: 2736834 - DNA, 22 bp, Homo sapiens
aatttaccattattttacagtc

SEQ ID NO: 2736835 - DNA, 13 bp, Homo sapiens
aatttacttttta

SEQ ID NO: 2736836 - DNA, 15 bp, Homo sapiens
aatttagtcattatt

SEQ ID NO: 2736837 - DNA, 19 bp, Homo sapiens
aatttataggcagatcttt

SEQ ID NO: 2736838 - DNA, 21 bp, Homo sapiens
aatttataggcagatctttaa

SEQ ID NO: 2736839 - DNA, 22 bp, Homo sapiens
aatttataggcagatctttaaa

SEQ ID NO: 2736840 - DNA, 19 bp, Homo sapiens
aatttatatctttatgcaa

SEQ ID NO: 2736841 - DNA, 20 bp, Homo sapiens
aatttatatctttatgcaaa

SEQ ID NO: 2736842 - DNA, 21 bp, Homo sapiens
aatttccactcaggtctgttt

SEQ ID NO: 2736843 - DNA, 19 bp, Homo sapiens
aatttgtatctgaaggaga

SEQ ID NO: 2736844 - DNA, 20 bp, Homo sapiens
aatttgtatctgaaggagat

SEQ ID NO: 2736845 - DNA, 20 bp, Homo sapiens
aatttgtgcatcagaaaatg

SEQ ID NO: 2736846 - DNA, 22 bp, Homo sapiens
aattttaaggtagaacctcacc

SEQ ID NO: 2736847 - DNA, 18 bp, Homo sapiens
aattttactgacagaaat

SEQ ID NO: 2736848 - DNA, 22 bp, Homo sapiens
aattttattaaaagagtagaaa

SEQ ID NO: 2736849 - DNA, 17 bp, Homo sapiens
aattttcaaataaggaa

SEQ ID NO: 2736850 - DNA, 21 bp, Homo sapiens
aattttctgtgttctgaagtc

SEQ ID NO: 2736851 - DNA, 23 bp, Homo sapiens
aattttctttcatacattatatt

SEQ ID NO: 2736852 - DNA, 17 bp, Homo sapiens
aattttgaggtctttta

SEQ ID NO: 2736853 - DNA, 19 bp, Homo sapiens
aattttggaaaaatgtcac

SEQ ID NO: 2736854 - DNA, 20 bp, Homo sapiens
aattttggaaaaatgtcact

SEQ ID NO: 2736855 - DNA, 12 bp, Homo sapiens
aattttgtaaaa

SEQ ID NO: 2736856 - DNA, 16 bp, Homo sapiens
aattttgtatgaaaaa

SEQ ID NO: 2736857 - DNA, 11 bp, Homo sapiens
aattttgtcac

SEQ ID NO: 2736858 - DNA, 21 bp, Homo sapiens
aatttttattatttgttttcc

SEQ ID NO: 2736859 - DNA, 12 bp, Homo sapiens
aattttttgcag

SEQ ID NO: 2736860 - DNA, 17 bp, Homo sapiens
aattttttgcagtcttt

SEQ ID NO: 2736861 - DNA, 17 bp, Homo sapiens
acaaaaaaataataaaa

SEQ ID NO: 2736862 - DNA, 21 bp, Homo sapiens
acaaacagtgaatttaagcat

SEQ ID NO: 2736863 - DNA, 13 bp, Homo sapiens
acaaaccaggagc

SEQ ID NO: 2736864 - DNA, 19 bp, Homo sapiens
acaaagttactggctcttt

SEQ ID NO: 2736865 - DNA, 17 bp, Homo sapiens
acaaataaagatggcta

SEQ ID NO: 2736866 - DNA, 16 bp, Homo sapiens
acaaatacactttatt

SEQ ID NO: 2736867 - DNA, 19 bp, Homo sapiens
acaaatggctgtaaaacta

SEQ ID NO: 2736868 - DNA, 20 bp, Homo sapiens
acaaatggcttacttacaaa

SEQ ID NO: 2736869 - DNA, 18 bp, Homo sapiens
acaaatgtgtcccagtga

SEQ ID NO: 2736870 - DNA, 13 bp, Homo sapiens
acaacatgtatgt

SEQ ID NO: 2736871 - DNA, 14 bp, Homo sapiens
acaacatgtatgtg

SEQ ID NO: 2736872 - DNA, 11 bp, Homo sapiens
acaacccagaa

SEQ ID NO: 2736873 - DNA, 16 bp, Homo sapiens
acaacctttcccattt

SEQ ID NO: 2736874 - DNA, 23 bp, Homo sapiens
acaagaagggttttccaccctgg

SEQ ID NO: 2736875 - DNA, 14 bp, Homo sapiens
acaagcaagcaaaa

SEQ ID NO: 2736876 - DNA, 13 bp, Homo sapiens
acaagtacttttg

SEQ ID NO: 2736877 - DNA, 18 bp, Homo sapiens
acaagttaaggtatctgg

SEQ ID NO: 2736878 - DNA, 13 bp, Homo sapiens
acaataaagagct

SEQ ID NO: 2736879 - DNA, 12 bp, Homo sapiens
acaataaatgct

SEQ ID NO: 2736880 - DNA, 21 bp, Homo sapiens
acaataaatgctgaatgaatc

SEQ ID NO: 2736881 - DNA, 20 bp, Homo sapiens
acaataccagaagtgaatta

SEQ ID NO: 2736882 - DNA, 15 bp, Homo sapiens
acaatttaaattgtt

SEQ ID NO: 2736883 - DNA, 19 bp, Homo sapiens
acacaaaaaaataataaaa

SEQ ID NO: 2736884 - DNA, 16 bp, Homo sapiens
acacaacatgtatgtg

SEQ ID NO: 2736885 - DNA, 20 bp, Homo sapiens
acacacccccaagccacagg

SEQ ID NO: 2736886 - DNA, 15 bp, Homo sapiens
acacactcagcagcc

SEQ ID NO: 2736887 - DNA, 19 bp, Homo sapiens
acacagcccagacaagatg

SEQ ID NO: 2736888 - DNA, 14 bp, Homo sapiens
acacagtgtttcct

SEQ ID NO: 2736889 - DNA, 16 bp, Homo sapiens
acacatatatgtatat

SEQ ID NO: 2736890 - DNA, 16 bp, Homo sapiens
acacatttttaaaaca

SEQ ID NO: 2736891 - DNA, 18 bp, Homo sapiens
acacatttttaaaacaac

SEQ ID NO: 2736892 - DNA, 20 bp, Homo sapiens
acaccaagctgtgccaccct

SEQ ID NO: 2736893 - DNA, 20 bp, Homo sapiens
acaccccccgccccccacct

SEQ ID NO: 2736894 - DNA, 22 bp, Homo sapiens
actctgcaggaaatcagagctg

SEQ ID NO: 2736895 - DNA, 15 bp, Homo sapiens
actctggacctctct

SEQ ID NO: 2736896 - DNA, 12 bp, Homo sapiens
actctgtgccca

SEQ ID NO: 2736897 - DNA, 13 bp, Homo sapiens
actctgtgcccat

SEQ ID NO: 2736898 - DNA, 15 bp, Homo sapiens
actctgtgcccatgg

SEQ ID NO: 2736899 - DNA, 17 bp, Homo sapiens
actcttccaccagagca

SEQ ID NO: 2736900 - DNA, 20 bp, Homo sapiens
actcttccaccagagcaggg

SEQ ID NO: 2736901 - DNA, 23 bp, Homo sapiens
actcttccaccagagcaggggct

SEQ ID NO: 2736902 - DNA, 20 bp, Homo sapiens
actcttcccccactcctctt

SEQ ID NO: 2736903 - DNA, 13 bp, Homo sapiens
actcttggccaga

SEQ ID NO: 2736904 - DNA, 16 bp, Homo sapiens
actctttgctacaata

SEQ ID NO: 2736905 - DNA, 18 bp, Homo sapiens
actctttgctacaataaa

SEQ ID NO: 2736906 - DNA, 21 bp, Homo sapiens
actctttgctacaataaatgc

SEQ ID NO: 2736907 - DNA, 10 bp, Homo sapiens
actgaaagaa

SEQ ID NO: 2736908 - DNA, 14 bp, Homo sapiens
actgaaagtggttt

SEQ ID NO: 2736909 - DNA, 19 bp, Homo sapiens
actgaaggcttctgcagct

SEQ ID NO: 2736910 - DNA, 15 bp, Homo sapiens
actgagtctcgaggg

SEQ ID NO: 2736911 - DNA, 20 bp, Homo sapiens
actgatcttacctttatgag

SEQ ID NO: 2736912 - DNA, 18 bp, Homo sapiens
actgcaagaggctcctgt

SEQ ID NO: 2736913 - DNA, 13 bp, Homo sapiens
actgcaagctctg

SEQ ID NO: 2736914 - DNA, 14 bp, Homo sapiens
actgcaagctctgc

SEQ ID NO: 2736915 - DNA, 15 bp, Homo sapiens
actgcaagctctgcc

SEQ ID NO: 2736916 - DNA, 16 bp, Homo sapiens
actgcaagctctgcct

SEQ ID NO: 2736917 - DNA, 19 bp, Homo sapiens
actgcaagctctgcctccc

SEQ ID NO: 2736918 - DNA, 16 bp, Homo sapiens
actgcaccccctcctg

SEQ ID NO: 2736919 - DNA, 17 bp, Homo sapiens
actgcactccagcctgg

SEQ ID NO: 2736920 - DNA, 18 bp, Homo sapiens
actgcactccagcctggg

SEQ ID NO: 2736921 - DNA, 21 bp, Homo sapiens
actgcactccagcctgggcga

SEQ ID NO: 2736922 - DNA, 14 bp, Homo sapiens
actgccccatctcc

SEQ ID NO: 2736923 - DNA, 13 bp, Homo sapiens
actgccgcctcct

SEQ ID NO: 2736924 - DNA, 17 bp, Homo sapiens
actgcgaggttgtttta

SEQ ID NO: 2736925 - DNA, 21 bp, Homo sapiens
actgcgaggttgttttaaagt

SEQ ID NO: 2736926 - DNA, 21 bp, Homo sapiens
actgcgccacggcactccagc

SEQ ID NO: 2736927 - DNA, 12 bp, Homo sapiens
actgcggagcag

SEQ ID NO: 2736928 - DNA, 21 bp, Homo sapiens
actgcgggatggtcctggggc

SEQ ID NO: 2736929 - DNA, 22 bp, Homo sapiens
actgcggtgtctgcagctcctg

SEQ ID NO: 2736930 - DNA, 13 bp, Homo sapiens
actgctgggactg

SEQ ID NO: 2736931 - DNA, 18 bp, Homo sapiens
actgctgggactggccag

SEQ ID NO: 2736932 - DNA, 18 bp, Homo sapiens
actgctggggctggtgag

SEQ ID NO: 2736933 - DNA, 20 bp, Homo sapiens
actgctgggtggcccatccc

SEQ ID NO: 2736934 - DNA, 22 bp, Homo sapiens
actgctgttaattgattaaaat

SEQ ID NO: 2736935 - DNA, 15 bp, Homo sapiens
actggagagtggcaa

SEQ ID NO: 2736936 - DNA, 12 bp, Homo sapiens
actggagcccag

SEQ ID NO: 2736937 - DNA, 13 bp, Homo sapiens
actggagcccagg

SEQ ID NO: 2736938 - DNA, 23 bp, Homo sapiens
actggcatctccctgaccttctc

SEQ ID NO: 2736939 - DNA, 15 bp, Homo sapiens
actggccgtggctcc

SEQ ID NO: 2736940 - DNA, 18 bp, Homo sapiens
actggcctcgcctggcct

SEQ ID NO: 2736941 - DNA, 17 bp, Homo sapiens
actggctgcctccactc

SEQ ID NO: 2736942 - DNA, 22 bp, Homo sapiens
actggctgcctccactcccact

SEQ ID NO: 2736943 - DNA, 16 bp, Homo sapiens
actggctggctgcagt

SEQ ID NO: 2736944 - DNA, 23 bp, Homo sapiens
actgggccatgggtcctcggccc

SEQ ID NO: 2736945 - DNA, 22 bp, Homo sapiens
actgggcccctcaggggaagct

SEQ ID NO: 2736946 - DNA, 20 bp, Homo sapiens
actggtgatgggacaattct

SEQ ID NO: 2736947 - DNA, 19 bp, Homo sapiens
actgtaagcagattacaat

SEQ ID NO: 2736948 - DNA, 20 bp, Homo sapiens
actgtataaacaaattagca

SEQ ID NO: 2736949 - DNA, 16 bp, Homo sapiens
actgtcctcgcagaga

SEQ ID NO: 2736950 - DNA, 13 bp, Homo sapiens
actgtcctgctcc

SEQ ID NO: 2736951 - DNA, 16 bp, Homo sapiens
actgtcctgctccaca

SEQ ID NO: 2736952 - DNA, 20 bp, Homo sapiens
actgtcctgctccacagtgt

SEQ ID NO: 2736953 - DNA, 17 bp, Homo sapiens
actgtcctgtccggagc

SEQ ID NO: 2736954 - DNA, 17 bp, Homo sapiens
actgtgacacagctgag

SEQ ID NO: 2736955 - DNA, 17 bp, Homo sapiens
actgtgacatcagaagt

SEQ ID NO: 2736956 - DNA, 13 bp, Homo sapiens
actgtgctcccac

SEQ ID NO: 2736957 - DNA, 15 bp, Homo sapiens
actgtgctcccacgg

SEQ ID NO: 2736958 - DNA, 21 bp, Homo sapiens
actgtgtttctagttgcattt

SEQ ID NO: 2736959 - DNA, 20 bp, Homo sapiens
actgttcccagcaaagtttt

SEQ ID NO: 2736960 - DNA, 22 bp, Homo sapiens
actgttcccagcaaagttttca

SEQ ID NO: 2736961 - DNA, 22 bp, Homo sapiens
actgttctcaccttaactcagc

SEQ ID NO: 2736962 - DNA, 10 bp, Homo sapiens
acttaaacat

SEQ ID NO: 2736963 - DNA, 16 bp, Homo sapiens
acttacaaaagcagct

SEQ ID NO: 2736964 - DNA, 22 bp, Homo sapiens
acttagaataaaattgtaaaat

SEQ ID NO: 2736965 - DNA, 12 bp, Homo sapiens
acttatttgagt

SEQ ID NO: 2736966 - DNA, 22 bp, Homo sapiens
acttatttgagtgattatttgt

SEQ ID NO: 2736967 - DNA, 13 bp, Homo sapiens
acttcataaaact

SEQ ID NO: 2736968 - DNA, 13 bp, Homo sapiens
acttcatgcccac

SEQ ID NO: 2736969 - DNA, 19 bp, Homo sapiens
acttcccaattgccacatt

SEQ ID NO: 2736970 - DNA, 15 bp, Homo sapiens
acttcccccaccctg

SEQ ID NO: 2736971 - DNA, 12 bp, Homo sapiens
acttcccctcct

SEQ ID NO: 2736972 - DNA, 21 bp, Homo sapiens
acttcccctcctacccctccc

SEQ ID NO: 2736973 - DNA, 12 bp, Homo sapiens
acttccctccaa

SEQ ID NO: 2736974 - DNA, 22 bp, Homo sapiens
acttccctgcttttctcccaga

SEQ ID NO: 2736975 - DNA, 18 bp, Homo sapiens
acttcctcgcctctccca

SEQ ID NO: 2736976 - DNA, 22 bp, Homo sapiens
acttcctggtgaggcccagcct

SEQ ID NO: 2736977 - DNA, 19 bp, Homo sapiens
acttgagggtaataaactt

SEQ ID NO: 2736978 - DNA, 15 bp, Homo sapiens
acttgatatttcctt

SEQ ID NO: 2736979 - DNA, 23 bp, Homo sapiens
acttgtccttttgtaccatggtg

SEQ ID NO: 2736980 - DNA, 23 bp, Homo sapiens
acttgttcaacagtttctcaagt

SEQ ID NO: 2736981 - DNA, 15 bp, Homo sapiens
actttataagccaat

SEQ ID NO: 2736982 - DNA, 17 bp, Homo sapiens
actttgaaggtaataaa

SEQ ID NO: 2736983 - DNA, 23 bp, Homo sapiens
actttgagggtgtatattttctg

SEQ ID NO: 2736984 - DNA, 15 bp, Homo sapiens
actttgatctctgct

SEQ ID NO: 2736985 - DNA, 13 bp, Homo sapiens
actttgtcccgct

SEQ ID NO: 2736986 - DNA, 11 bp, Homo sapiens
actttgttcac

SEQ ID NO: 2736987 - DNA, 17 bp, Homo sapiens
acttttccatgtatcta

SEQ ID NO: 2736988 - DNA, 21 bp, Homo sapiens
acttttccatgtatctacctc

SEQ ID NO: 2736989 - DNA, 15 bp, Homo sapiens
acttttctaaagctc

SEQ ID NO: 2736990 - DNA, 14 bp, Homo sapiens
actttttaaacagt

SEQ ID NO: 2736991 - DNA, 14 bp, Homo sapiens
actttttgaatgtc

SEQ ID NO: 2736992 - DNA, 17 bp, Homo sapiens
actttttgttttgttct

SEQ ID NO: 2736993 - DNA, 21 bp, Homo sapiens
actttttgttttgttcttggt

SEQ ID NO: 2736994 - DNA, 14 bp, Homo sapiens
agaaaaaaagcaaa

SEQ ID NO: 2736995 - DNA, 22 bp, Homo sapiens
agaaaaccctaagtgtggatgt

SEQ ID NO: 2736996 - DNA, 19 bp, Homo sapiens
agaaaacctgtttttaaca

SEQ ID NO: 2736997 - DNA, 22 bp, Homo sapiens
agaaaacctgtttttaacatgt

SEQ ID NO: 2736998 - DNA, 18 bp, Homo sapiens
agaaaagcaatactgttt

SEQ ID NO: 2736999 - DNA, 21 bp, Homo sapiens
agaaaatgaatttgactggtt

SEQ ID NO: 2737000 - DNA, 18 bp, Homo sapiens
agaaaatgagatgggttg

SEQ ID NO: 2737001 - DNA, 14 bp, Homo sapiens
agaaaatgcaggag

SEQ ID NO: 2737002 - DNA, 12 bp, Homo sapiens
agaaacactaaa

SEQ ID NO: 2737003 - DNA, 16 bp, Homo sapiens
agaaacaggctctgag

SEQ ID NO: 2737004 - DNA, 19 bp, Homo sapiens
agaaactttgatctctgct

SEQ ID NO: 2737005 - DNA, 22 bp, Homo sapiens
agaaactttgatctctgcttac

SEQ ID NO: 2737006 - DNA, 21 bp, Homo sapiens
agaaaggatttcctttctttt

SEQ ID NO: 2737007 - DNA, 15 bp, Homo sapiens
agaaaggccactcag

SEQ ID NO: 2737008 - DNA, 15 bp, Homo sapiens
agaaatagctatgga

SEQ ID NO: 2737009 - DNA, 13 bp, Homo sapiens
agaaatcaatttt

SEQ ID NO: 2737010 - DNA, 18 bp, Homo sapiens
agaaatcgccttatgaga

SEQ ID NO: 2737011 - DNA, 17 bp, Homo sapiens
agaaatgtttttggcaa

SEQ ID NO: 2737012 - DNA, 15 bp, Homo sapiens
agaaattagccgggc

SEQ ID NO: 2737013 - DNA, 20 bp, Homo sapiens
agaaattttactgacagaaa

SEQ ID NO: 2737014 - DNA, 22 bp, Homo sapiens
agaaatttttttccagaattga

SEQ ID NO: 2737015 - DNA, 14 bp, Homo sapiens
agaacaaatacact

SEQ ID NO: 2737016 - DNA, 22 bp, Homo sapiens
agaacacagtgcctggcaaggc

SEQ ID NO: 2737017 - DNA, 15 bp, Homo sapiens
agaacacccactggc

SEQ ID NO: 2737018 - DNA, 18 bp, Homo sapiens
agcctagaccctcctcct

SEQ ID NO: 2737019 - DNA, 23 bp, Homo sapiens
agcctcacagatgctggcctctt

SEQ ID NO: 2737020 - DNA, 17 bp, Homo sapiens
agcctccagtgctggct

SEQ ID NO: 2737021 - DNA, 18 bp, Homo sapiens
agcctccagtgctggctg

SEQ ID NO: 2737022 - DNA, 14 bp, Homo sapiens
agcctccagtggga

SEQ ID NO: 2737023 - DNA, 17 bp, Homo sapiens
agcctcccaagtagctg

SEQ ID NO: 2737024 - DNA, 13 bp, Homo sapiens
agcctccctctga

SEQ ID NO: 2737025 - DNA, 14 bp, Homo sapiens
agcctccctctgac

SEQ ID NO: 2737026 - DNA, 11 bp, Homo sapiens
agcctcctgag

SEQ ID NO: 2737027 - DNA, 12 bp, Homo sapiens
agcctctgctgc

SEQ ID NO: 2737028 - DNA, 14 bp, Homo sapiens
agcctctgctgcca

SEQ ID NO: 2737029 - DNA, 18 bp, Homo sapiens
agcctctgctgccatggc

SEQ ID NO: 2737030 - DNA, 11 bp, Homo sapiens
agcctctgtgt

SEQ ID NO: 2737031 - DNA, 13 bp, Homo sapiens
agcctctgtgtca

SEQ ID NO: 2737032 - DNA, 20 bp, Homo sapiens
agcctctgtgtcactggctg

SEQ ID NO: 2737033 - DNA, 17 bp, Homo sapiens
agcctgaaccgtgtgct

SEQ ID NO: 2737034 - DNA, 11 bp, Homo sapiens
agcctgaggct

SEQ ID NO: 2737035 - DNA, 17 bp, Homo sapiens
agcctgaggctgagact

SEQ ID NO: 2737036 - DNA, 14 bp, Homo sapiens
agcctggccaacat

SEQ ID NO: 2737037 - DNA, 15 bp, Homo sapiens
agcctggccaccagc

SEQ ID NO: 2737038 - DNA, 14 bp, Homo sapiens
agcctggcccagct

SEQ ID NO: 2737039 - DNA, 17 bp, Homo sapiens
agcctggcccagctccc

SEQ ID NO: 2737040 - DNA, 18 bp, Homo sapiens
agcctggcccagctcccc

SEQ ID NO: 2737041 - DNA, 20 bp, Homo sapiens
agcctggcttctggagccct

SEQ ID NO: 2737042 - DNA, 14 bp, Homo sapiens
agcctgtcctggta

SEQ ID NO: 2737043 - DNA, 18 bp, Homo sapiens
agcctgtcgtgtccagcc

SEQ ID NO: 2737044 - DNA, 19 bp, Homo sapiens
agcctgtcgtgtccagcct

SEQ ID NO: 2737045 - DNA, 12 bp, Homo sapiens
agcgaccctggc

SEQ ID NO: 2737046 - DNA, 17 bp, Homo sapiens
agcgagctgctctgcta

SEQ ID NO: 2737047 - DNA, 19 bp, Homo sapiens
agcgaggaaaggattttac

SEQ ID NO: 2737048 - DNA, 12 bp, Homo sapiens
agcgcacctgcc

SEQ ID NO: 2737049 - DNA, 14 bp, Homo sapiens
agcgcacctgcccc

SEQ ID NO: 2737050 - DNA, 13 bp, Homo sapiens
agcgcctcctgga

SEQ ID NO: 2737051 - DNA, 14 bp, Homo sapiens
agcgcctcctggac

SEQ ID NO: 2737052 - DNA, 16 bp, Homo sapiens
agcgcctgtcccctca

SEQ ID NO: 2737053 - DNA, 19 bp, Homo sapiens
agcgcctgtcccctcacag

SEQ ID NO: 2737054 - DNA, 22 bp, Homo sapiens
agcgcctgtcccctcacagact

SEQ ID NO: 2737055 - DNA, 15 bp, Homo sapiens
agcgctggctccagg

SEQ ID NO: 2737056 - DNA, 22 bp, Homo sapiens
agcggaaaaggttttattttgt

SEQ ID NO: 2737057 - DNA, 20 bp, Homo sapiens
agcggatgctggccacagaa

SEQ ID NO: 2737058 - DNA, 13 bp, Homo sapiens
agcggccttgaag

SEQ ID NO: 2737059 - DNA, 23 bp, Homo sapiens
agcgtccatttcttatttaatta

SEQ ID NO: 2737060 - DNA, 16 bp, Homo sapiens
agctagctatttctat

SEQ ID NO: 2737061 - DNA, 18 bp, Homo sapiens
agctattagcaactgtgc

SEQ ID NO: 2737062 - DNA, 14 bp, Homo sapiens
agctattcaggagg

SEQ ID NO: 2737063 - DNA, 20 bp, Homo sapiens
agctattcaggaggctgagg

SEQ ID NO: 2737064 - DNA, 17 bp, Homo sapiens
agctattcccttctgat

SEQ ID NO: 2737065 - DNA, 19 bp, Homo sapiens
agctattcccttctgatct

SEQ ID NO: 2737066 - DNA, 18 bp, Homo sapiens
agctatttcctttgcgca

SEQ ID NO: 2737067 - DNA, 16 bp, Homo sapiens
agctatttctatgtat

SEQ ID NO: 2737068 - DNA, 20 bp, Homo sapiens
agctcataagctgtagaact

SEQ ID NO: 2737069 - DNA, 14 bp, Homo sapiens
agctccctggtgag

SEQ ID NO: 2737070 - DNA, 22 bp, Homo sapiens
agctccctggtgagggagcctc

SEQ ID NO: 2737071 - DNA, 14 bp, Homo sapiens
agctcctcccctgc

SEQ ID NO: 2737072 - DNA, 15 bp, Homo sapiens
agctcctcccctgcc

SEQ ID NO: 2737073 - DNA, 16 bp, Homo sapiens
agctcctcccctgccg

SEQ ID NO: 2737074 - DNA, 17 bp, Homo sapiens
agctcctcccctgccgc

SEQ ID NO: 2737075 - DNA, 19 bp, Homo sapiens
agctcctgtccctacccac

SEQ ID NO: 2737076 - DNA, 20 bp, Homo sapiens
agctcctgtccctacccact

SEQ ID NO: 2737077 - DNA, 13 bp, Homo sapiens
agctctatctgca

SEQ ID NO: 2737078 - DNA, 17 bp, Homo sapiens
agctctatctgcaatgt

SEQ ID NO: 2737079 - DNA, 15 bp, Homo sapiens
agctctcctgctgca

SEQ ID NO: 2737080 - DNA, 12 bp, Homo sapiens
agctctgctgga

SEQ ID NO: 2737081 - DNA, 20 bp, Homo sapiens
agctctggcttccagaaaac

SEQ ID NO: 2737082 - DNA, 14 bp, Homo sapiens
agctcttgggcctg

SEQ ID NO: 2737083 - DNA, 15 bp, Homo sapiens
agctcttgggcctga

SEQ ID NO: 2737084 - DNA, 17 bp, Homo sapiens
agctcttgggcctgacc

SEQ ID NO: 2737085 - DNA, 18 bp, Homo sapiens
agctcttgggcctgacct

SEQ ID NO: 2737086 - DNA, 24 bp, Homo sapiens
agctcttgggcctgacctccagtc

SEQ ID NO: 2737087 - DNA, 15 bp, Homo sapiens
agctgacagagccag

SEQ ID NO: 2737088 - DNA, 19 bp, Homo sapiens
agctgacagagccagaggc

SEQ ID NO: 2737089 - DNA, 13 bp, Homo sapiens
agctgacagtcct

SEQ ID NO: 2737090 - DNA, 14 bp, Homo sapiens
agctgagctggcct

SEQ ID NO: 2737091 - DNA, 16 bp, Homo sapiens
agctgaggcctccctt

SEQ ID NO: 2737092 - DNA, 16 bp, Homo sapiens
agctgcagcttcctgt

SEQ ID NO: 2737093 - DNA, 18 bp, Homo sapiens
agctgcgggctgagggca

SEQ ID NO: 2737094 - DNA, 24 bp, Homo sapiens
agctgcgggctgagggcatctctg

SEQ ID NO: 2737095 - DNA, 21 bp, Homo sapiens
agctgctaggggaaggactgg

SEQ ID NO: 2737096 - DNA, 13 bp, Homo sapiens
agctgctgccact

SEQ ID NO: 2737097 - DNA, 18 bp, Homo sapiens
agctggcagcctccagtg

SEQ ID NO: 2737098 - DNA, 23 bp, Homo sapiens
agctggcagcctccagtgggagg

SEQ ID NO: 2737099 - DNA, 18 bp, Homo sapiens
agctggcctctagaacac

SEQ ID NO: 2737100 - DNA, 23 bp, Homo sapiens
agctggcctctagaacacccact

SEQ ID NO: 2737101 - DNA, 17 bp, Homo sapiens
agctgggactacaggca

SEQ ID NO: 2737102 - DNA, 12 bp, Homo sapiens
agctgggcccac

SEQ ID NO: 2737103 - DNA, 15 bp, Homo sapiens
agctgggcccacagc

SEQ ID NO: 2737104 - DNA, 16 bp, Homo sapiens
agctgggcccacagcc

SEQ ID NO: 2737105 - DNA, 19 bp, Homo sapiens
agctgggcccacagccccc

SEQ ID NO: 2737106 - DNA, 22 bp, Homo sapiens
agctgggcccacagcccccacc

SEQ ID NO: 2737107 - DNA, 13 bp, Homo sapiens
agctggtgccaga

SEQ ID NO: 2737108 - DNA, 21 bp, Homo sapiens
agctggtggatggtgactttt

SEQ ID NO: 2737109 - DNA, 16 bp, Homo sapiens
agctgtaaatataaat

SEQ ID NO: 2737110 - DNA, 22 bp, Homo sapiens
agctgtagaactctgcaggcag

SEQ ID NO: 2737111 - DNA, 21 bp, Homo sapiens
agctgtataattaattgtcat

SEQ ID NO: 2737112 - DNA, 19 bp, Homo sapiens
agctgtcccctggagaagg

SEQ ID NO: 2737113 - DNA, 12 bp, Homo sapiens
agctgtgccacc

SEQ ID NO: 2737114 - DNA, 20 bp, Homo sapiens
agctgtgccaccctgggctc

SEQ ID NO: 2737115 - DNA, 14 bp, Homo sapiens
agctgtggtcccac

SEQ ID NO: 2737116 - DNA, 17 bp, Homo sapiens
agctgtggtcccaccca

SEQ ID NO: 2737117 - DNA, 13 bp, Homo sapiens
agctgtgtctctg

SEQ ID NO: 2737118 - DNA, 16 bp, Homo sapiens
agctgtgtctctgtat

SEQ ID NO: 2737119 - DNA, 16 bp, Homo sapiens
agcttaaagagaaaaa

SEQ ID NO: 2737120 - DNA, 18 bp, Homo sapiens
agcttagattttctgtaa

SEQ ID NO: 2737121 - DNA, 19 bp, Homo sapiens
agcttatttagcacatttt

SEQ ID NO: 2737122 - DNA, 21 bp, Homo sapiens
agcttatttagcacattttga

SEQ ID NO: 2737123 - DNA, 18 bp, Homo sapiens
agcttcatatctaattta

SEQ ID NO: 2737124 - DNA, 17 bp, Homo sapiens
agcttctcttgaaaact

SEQ ID NO: 2737125 - DNA, 15 bp, Homo sapiens
agcttctgctgggct

SEQ ID NO: 2737126 - DNA, 22 bp, Homo sapiens
agcttgactctactcccagcgc

SEQ ID NO: 2737127 - DNA, 13 bp, Homo sapiens
agcttgtaaatac

SEQ ID NO: 2737128 - DNA, 14 bp, Homo sapiens
agctttgggaaagc

SEQ ID NO: 2737129 - DNA, 14 bp, Homo sapiens
aggaaaagcctctg

SEQ ID NO: 2737130 - DNA, 15 bp, Homo sapiens
aggaaaagcctctgt

SEQ ID NO: 2737131 - DNA, 11 bp, Homo sapiens
aggaaagcacc

SEQ ID NO: 2737132 - DNA, 21 bp, Homo sapiens
aggaaagcaccgcagcatgtg

SEQ ID NO: 2737133 - DNA, 16 bp, Homo sapiens
aggaagctctctttcc

SEQ ID NO: 2737134 - DNA, 17 bp, Homo sapiens
aggaagggagggagctg

SEQ ID NO: 2737135 - DNA, 13 bp, Homo sapiens
aggaatttaattt

SEQ ID NO: 2737136 - DNA, 11 bp, Homo sapiens
aggacaaacag

SEQ ID NO: 2737137 - DNA, 16 bp, Homo sapiens
aggacaaacagtgaat

SEQ ID NO: 2737138 - DNA, 21 bp, Homo sapiens
aggacaacctgcccctcccca

SEQ ID NO: 2737139 - DNA, 15 bp, Homo sapiens
aggacagtgcttcag

SEQ ID NO: 2737140 - DNA, 16 bp, Homo sapiens
aggacagtgcttcagc

SEQ ID NO: 2737141 - DNA, 17 bp, Homo sapiens
aggacagtgcttcagcc

SEQ ID NO: 2737142 - DNA, 21 bp, Homo sapiens
aggacatgatggagcgcacct

SEQ ID NO: 2737143 - DNA, 22 bp, Homo sapiens
ataatttaaagaaacactaaat

SEQ ID NO: 2737144 - DNA, 20 bp, Homo sapiens
ataatttcagttattttgct

SEQ ID NO: 2737145 - DNA, 12 bp, Homo sapiens
ataatttgcaat

SEQ ID NO: 2737146 - DNA, 17 bp, Homo sapiens
ataatttgcaatttcag

SEQ ID NO: 2737147 - DNA, 19 bp, Homo sapiens
ataattttttgcagtcttt

SEQ ID NO: 2737148 - DNA, 23 bp, Homo sapiens
ataattttttgcagtcttttgct

SEQ ID NO: 2737149 - DNA, 12 bp, Homo sapiens
atacaaacaggt

SEQ ID NO: 2737150 - DNA, 18 bp, Homo sapiens
atacaacctatgtaattt

SEQ ID NO: 2737151 - DNA, 13 bp, Homo sapiens
atacataaacagt

SEQ ID NO: 2737152 - DNA, 15 bp, Homo sapiens
atacatgctgctaat

SEQ ID NO: 2737153 - DNA, 22 bp, Homo sapiens
atactggcctcgcctggcctga

SEQ ID NO: 2737154 - DNA, 17 bp, Homo sapiens
atacttattattttgca

SEQ ID NO: 2737155 - DNA, 23 bp, Homo sapiens
atactttaatttttataaatatg

SEQ ID NO: 2737156 - DNA, 17 bp, Homo sapiens
atagaattatattttct

SEQ ID NO: 2737157 - DNA, 22 bp, Homo sapiens
atagacgggttgaaagacatca

SEQ ID NO: 2737158 - DNA, 23 bp, Homo sapiens
atagacgggttgaaagacatcaa

SEQ ID NO: 2737159 - DNA, 14 bp, Homo sapiens
atagagatatttaa

SEQ ID NO: 2737160 - DNA, 17 bp, Homo sapiens
atagcaaggccagggca

SEQ ID NO: 2737161 - DNA, 16 bp, Homo sapiens
atagcattctctatca

SEQ ID NO: 2737162 - DNA, 22 bp, Homo sapiens
atagctagctatttctatgtat

SEQ ID NO: 2737163 - DNA, 17 bp, Homo sapiens
atagctctacacaacat

SEQ ID NO: 2737164 - DNA, 14 bp, Homo sapiens
ataggcagatcttt

SEQ ID NO: 2737165 - DNA, 23 bp, Homo sapiens
atagggaaggtatatcaggaggg

SEQ ID NO: 2737166 - DNA, 20 bp, Homo sapiens
atagggtccttgaaacagaa

SEQ ID NO: 2737167 - DNA, 17 bp, Homo sapiens
atagtcaatcaaacagg

SEQ ID NO: 2737168 - DNA, 21 bp, Homo sapiens
atagtcaatcaaacagggaca

SEQ ID NO: 2737169 - DNA, 14 bp, Homo sapiens
atagtcagagtgtc

SEQ ID NO: 2737170 - DNA, 14 bp, Homo sapiens
atataaagaaaatc

SEQ ID NO: 2737171 - DNA, 19 bp, Homo sapiens
atataataaatatatattt

SEQ ID NO: 2737172 - DNA, 14 bp, Homo sapiens
atataatgaacacg

SEQ ID NO: 2737173 - DNA, 18 bp, Homo sapiens
atatacaagcaagcaaaa

SEQ ID NO: 2737174 - DNA, 17 bp, Homo sapiens
atatagctctacacaac

SEQ ID NO: 2737175 - DNA, 21 bp, Homo sapiens
atatagctctacacaacatgt

SEQ ID NO: 2737176 - DNA, 22 bp, Homo sapiens
atatagctctacacaacatgta

SEQ ID NO: 2737177 - DNA, 17 bp, Homo sapiens
atatagttgtctttctt

SEQ ID NO: 2737178 - DNA, 14 bp, Homo sapiens
atatatatttatca

SEQ ID NO: 2737179 - DNA, 15 bp, Homo sapiens
atatatcataaagta

SEQ ID NO: 2737180 - DNA, 16 bp, Homo sapiens
atatatgtatatgtat

SEQ ID NO: 2737181 - DNA, 23 bp, Homo sapiens
atatattctacacatatatgtat

SEQ ID NO: 2737182 - DNA, 12 bp, Homo sapiens
atatattgctgc

SEQ ID NO: 2737183 - DNA, 12 bp, Homo sapiens
atatcaggaggg

SEQ ID NO: 2737184 - DNA, 12 bp, Homo sapiens
atatcataaagt

SEQ ID NO: 2737185 - DNA, 22 bp, Homo sapiens
atatcatttttataaattttaa

SEQ ID NO: 2737186 - DNA, 16 bp, Homo sapiens
atatccacaaatgcta

SEQ ID NO: 2737187 - DNA, 17 bp, Homo sapiens
atatctagtcaataact

SEQ ID NO: 2737188 - DNA, 13 bp, Homo sapiens
atatctatatctc

SEQ ID NO: 2737189 - DNA, 18 bp, Homo sapiens
atatctgagaagtgtata

SEQ ID NO: 2737190 - DNA, 19 bp, Homo sapiens
atatctgagaagtgtatat

SEQ ID NO: 2737191 - DNA, 15 bp, Homo sapiens
atatgcaatcctact

SEQ ID NO: 2737192 - DNA, 12 bp, Homo sapiens
atatggatattt

SEQ ID NO: 2737193 - DNA, 23 bp, Homo sapiens
atatggatatttttaatttatga

SEQ ID NO: 2737194 - DNA, 16 bp, Homo sapiens
atatgtatatgtatat

SEQ ID NO: 2737195 - DNA, 22 bp, Homo sapiens
atattaaatgactttttgaatg

SEQ ID NO: 2737196 - DNA, 14 bp, Homo sapiens
atattaagaaacaa

SEQ ID NO: 2737197 - DNA, 14 bp, Homo sapiens
atattattaatata

SEQ ID NO: 2737198 - DNA, 14 bp, Homo sapiens
atattcaaattcat

SEQ ID NO: 2737199 - DNA, 22 bp, Homo sapiens
atattcacacctcacgctctgg

SEQ ID NO: 2737200 - DNA, 22 bp, Homo sapiens
atattcagtgctgtggcctggg

SEQ ID NO: 2737201 - DNA, 23 bp, Homo sapiens
atattcagtgctgtggcctgggc

SEQ ID NO: 2737202 - DNA, 20 bp, Homo sapiens
atattcatcaaataaacctt

SEQ ID NO: 2737203 - DNA, 14 bp, Homo sapiens
atattcccatggta

SEQ ID NO: 2737204 - DNA, 21 bp, Homo sapiens
atattccgggtgccattccca

SEQ ID NO: 2737205 - DNA, 16 bp, Homo sapiens
atattctaaattcact

SEQ ID NO: 2737206 - DNA, 18 bp, Homo sapiens
atattctaaattcactgt

SEQ ID NO: 2737207 - DNA, 21 bp, Homo sapiens
atattctacacatatatgtat

SEQ ID NO: 2737208 - DNA, 22 bp, Homo sapiens
atattctacacatatatgtata

SEQ ID NO: 2737209 - DNA, 12 bp, Homo sapiens
atattcttttgt

SEQ ID NO: 2737210 - DNA, 17 bp, Homo sapiens
atattgaccatgtgatt

SEQ ID NO: 2737211 - DNA, 18 bp, Homo sapiens
atattgaccatgtgatta

SEQ ID NO: 2737212 - DNA, 19 bp, Homo sapiens
atattgaccatgtgattat

SEQ ID NO: 2737213 - DNA, 21 bp, Homo sapiens
atattgctcttaaaaatcttg

SEQ ID NO: 2737214 - DNA, 22 bp, Homo sapiens
atatttaataggataaattaat

SEQ ID NO: 2737215 - DNA, 21 bp, Homo sapiens
atatttacatgaattgcattt

SEQ ID NO: 2737216 - DNA, 13 bp, Homo sapiens
atatttactttaa

SEQ ID NO: 2737217 - DNA, 13 bp, Homo sapiens
atatttatttatg

SEQ ID NO: 2737218 - DNA, 16 bp, Homo sapiens
atatttcttcaagtga

SEQ ID NO: 2737219 - DNA, 14 bp, Homo sapiens
atcaaacatgaaaa

SEQ ID NO: 2737220 - DNA, 15 bp, Homo sapiens
atcaacacttttctc

SEQ ID NO: 2737221 - DNA, 23 bp, Homo sapiens
atcaacttttctgagctggtgta

SEQ ID NO: 2737222 - DNA, 19 bp, Homo sapiens
atcaagagtctctccagcc

SEQ ID NO: 2737223 - DNA, 20 bp, Homo sapiens
atcaagagtctctccagcct

SEQ ID NO: 2737224 - DNA, 14 bp, Homo sapiens
atcaagtctgtgaa

SEQ ID NO: 2737225 - DNA, 12 bp, Homo sapiens
atcaatgaagga

SEQ ID NO: 2737226 - DNA, 19 bp, Homo sapiens
atcacaaaagctgtgtctc

SEQ ID NO: 2737227 - DNA, 21 bp, Homo sapiens
atcacaaaagctgtgtctctg

SEQ ID NO: 2737228 - DNA, 23 bp, Homo sapiens
atcacaaaagctgtgtctctgta

SEQ ID NO: 2737229 - DNA, 13 bp, Homo sapiens
atcacaaacatat

SEQ ID NO: 2737230 - DNA, 19 bp, Homo sapiens
atcacagggcagagccggg

SEQ ID NO: 2737231 - DNA, 18 bp, Homo sapiens
atcaccaagtgtggaatt

SEQ ID NO: 2737232 - DNA, 12 bp, Homo sapiens
atcacctgaggt

SEQ ID NO: 2737233 - DNA, 12 bp, Homo sapiens
atcactgctccc

SEQ ID NO: 2737234 - DNA, 14 bp, Homo sapiens
atcactggagccca

SEQ ID NO: 2737235 - DNA, 16 bp, Homo sapiens
atcactggagcccagg

SEQ ID NO: 2737236 - DNA, 17 bp, Homo sapiens
atcactggagcccagga

SEQ ID NO: 2737237 - DNA, 19 bp, Homo sapiens
atcagaagtaactcccact

SEQ ID NO: 2737238 - DNA, 20 bp, Homo sapiens
atcagagctggcagcctcca

SEQ ID NO: 2737239 - DNA, 22 bp, Homo sapiens
atcagagctggcagcctccagt

SEQ ID NO: 2737240 - DNA, 22 bp, Homo sapiens
atcagctattcccttctgatct

SEQ ID NO: 2737241 - DNA, 21 bp, Homo sapiens
atcagctttttgtattaacaa

SEQ ID NO: 2737242 - DNA, 22 bp, Homo sapiens
atcagctttttgtattaacaaa

SEQ ID NO: 2737243 - DNA, 10 bp, Homo sapiens
atcaggaggg

SEQ ID NO: 2737244 - DNA, 21 bp, Homo sapiens
atcaggtcattattttttaca

SEQ ID NO: 2737245 - DNA, 22 bp, Homo sapiens
atcagtgtgccccccatcctgg

SEQ ID NO: 2737246 - DNA, 12 bp, Homo sapiens
atcataaagtat

SEQ ID NO: 2737247 - DNA, 12 bp, Homo sapiens
atcatcaggttt

SEQ ID NO: 2737248 - DNA, 20 bp, Homo sapiens
atcattggtatctgatatct

SEQ ID NO: 2737249 - DNA, 22 bp, Homo sapiens
atcattggtatctgatatctgt

SEQ ID NO: 2737250 - DNA, 14 bp, Homo sapiens
atccaaatgctgtg

SEQ ID NO: 2737251 - DNA, 19 bp, Homo sapiens
atccaaatgctgtgcaaac

SEQ ID NO: 2737252 - DNA, 18 bp, Homo sapiens
atccaaccccccacctgc

SEQ ID NO: 2737253 - DNA, 13 bp, Homo sapiens
atccaattggata

SEQ ID NO: 2737254 - DNA, 16 bp, Homo sapiens
atccacaaatgctatt

SEQ ID NO: 2737255 - DNA, 23 bp, Homo sapiens
atccaggcttctcccggacctgg

SEQ ID NO: 2737256 - DNA, 16 bp, Homo sapiens
atccagtagggaaaat

SEQ ID NO: 2737257 - DNA, 14 bp, Homo sapiens
atccagtctgcaga

SEQ ID NO: 2737258 - DNA, 19 bp, Homo sapiens
atccatgtgctgctgtggc

SEQ ID NO: 2737259 - DNA, 14 bp, Homo sapiens
atccattgtggaaa

SEQ ID NO: 2737260 - DNA, 23 bp, Homo sapiens
atccatttggcagaactgctggg

SEQ ID NO: 2737261 - DNA, 23 bp, Homo sapiens
atcccagcatctcagagtccagt

SEQ ID NO: 2737262 - DNA, 17 bp, Homo sapiens
atcccctgtcccctggg

SEQ ID NO: 2737263 - DNA, 18 bp, Homo sapiens
atcccctgtcccctgggg

SEQ ID NO: 2737264 - DNA, 19 bp, Homo sapiens
atcccctgtcccctggggc

SEQ ID NO: 2737265 - DNA, 21 bp, Homo sapiens
atcccggtgcatgcaggtctc

SEQ ID NO: 2737266 - DNA, 19 bp, Homo sapiens
attttgagggtgtaaccag

SEQ ID NO: 2737267 - DNA, 23 bp, Homo sapiens
attttgatattttcacagatgga

SEQ ID NO: 2737268 - DNA, 14 bp, Homo sapiens
attttgatcagtgt

SEQ ID NO: 2737269 - DNA, 21 bp, Homo sapiens
attttgctggagactatttaa

SEQ ID NO: 2737270 - DNA, 22 bp, Homo sapiens
attttggaaaaatgtcactgaa

SEQ ID NO: 2737271 - DNA, 16 bp, Homo sapiens
attttggacgtgtgag

SEQ ID NO: 2737272 - DNA, 16 bp, Homo sapiens
attttgtaattattgt

SEQ ID NO: 2737273 - DNA, 21 bp, Homo sapiens
attttgtcacagctcttgttt

SEQ ID NO: 2737274 - DNA, 12 bp, Homo sapiens
attttgtcttta

SEQ ID NO: 2737275 - DNA, 16 bp, Homo sapiens
attttgttttttaagt

SEQ ID NO: 2737276 - DNA, 12 bp, Homo sapiens
atttttaaaagg

SEQ ID NO: 2737277 - DNA, 21 bp, Homo sapiens
atttttaaaggacaaacagtg

SEQ ID NO: 2737278 - DNA, 18 bp, Homo sapiens
atttttacaaataaagat

SEQ ID NO: 2737279 - DNA, 15 bp, Homo sapiens
atttttattatttgt

SEQ ID NO: 2737280 - DNA, 19 bp, Homo sapiens
atttttctgggaagaaaat

SEQ ID NO: 2737281 - DNA, 21 bp, Homo sapiens
atttttgaaagaattctattt

SEQ ID NO: 2737282 - DNA, 16 bp, Homo sapiens
atttttgctcttctgt

SEQ ID NO: 2737283 - DNA, 19 bp, Homo sapiens
atttttgtacattatgtta

SEQ ID NO: 2737284 - DNA, 20 bp, Homo sapiens
atttttgtacattatgttat

SEQ ID NO: 2737285 - DNA, 16 bp, Homo sapiens
attttttaaataaaat

SEQ ID NO: 2737286 - DNA, 15 bp, Homo sapiens
attttttgcagtctt

SEQ ID NO: 2737287 - DNA, 17 bp, Homo sapiens
attttttgcagtctttt

SEQ ID NO: 2737288 - DNA, 15 bp, Homo sapiens
atttttttttgtaaa

SEQ ID NO: 2737289 - DNA, 22 bp, Homo sapiens
attttttttttaaataaaagca

SEQ ID NO: 2737290 - DNA, 15 bp, Homo sapiens
caaaaaaaatcttta

SEQ ID NO: 2737291 - DNA, 19 bp, Homo sapiens
caaaaatctcccagtgaca

SEQ ID NO: 2737292 - DNA, 12 bp, Homo sapiens
caaaacatttct

SEQ ID NO: 2737293 - DNA, 11 bp, Homo sapiens
caaaagcaaac

SEQ ID NO: 2737294 - DNA, 15 bp, Homo sapiens
caaaagctgtgtctc

SEQ ID NO: 2737295 - DNA, 17 bp, Homo sapiens
caaaagctgtgtctctg

SEQ ID NO: 2737296 - DNA, 18 bp, Homo sapiens
caaaagttcatataattt

SEQ ID NO: 2737297 - DNA, 23 bp, Homo sapiens
caaaatattatgcaaactactgt

SEQ ID NO: 2737298 - DNA, 17 bp, Homo sapiens
caaaatctaaaagctgt

SEQ ID NO: 2737299 - DNA, 19 bp, Homo sapiens
caaacacacagactctgtg

SEQ ID NO: 2737300 - DNA, 14 bp, Homo sapiens
caaacactgggctc

SEQ ID NO: 2737301 - DNA, 12 bp, Homo sapiens
caaacaggtgct

SEQ ID NO: 2737302 - DNA, 16 bp, Homo sapiens
caaacaggtgctaaca

SEQ ID NO: 2737303 - DNA, 12 bp, Homo sapiens
caaacagtgaat

SEQ ID NO: 2737304 - DNA, 15 bp, Homo sapiens
caaacatgaaaacat

SEQ ID NO: 2737305 - DNA, 16 bp, Homo sapiens
caaacatgaaaacatt

SEQ ID NO: 2737306 - DNA, 18 bp, Homo sapiens
caaacatgaaaacattga

SEQ ID NO: 2737307 - DNA, 21 bp, Homo sapiens
caaacatgtgcaactcttgta

SEQ ID NO: 2737308 - DNA, 12 bp, Homo sapiens
caaaccaggagc

SEQ ID NO: 2737309 - DNA, 13 bp, Homo sapiens
caaaccctgtggg

SEQ ID NO: 2737310 - DNA, 17 bp, Homo sapiens
caaactggggcctccct

SEQ ID NO: 2737311 - DNA, 15 bp, Homo sapiens
caaagaaaaccctaa

SEQ ID NO: 2737312 - DNA, 18 bp, Homo sapiens
caaagaaatttccactca

SEQ ID NO: 2737313 - DNA, 22 bp, Homo sapiens
caaagagtctctggctcagctg

SEQ ID NO: 2737314 - DNA, 15 bp, Homo sapiens
caaagatctcagcag

SEQ ID NO: 2737315 - DNA, 17 bp, Homo sapiens
caaagccaaactctgcc

SEQ ID NO: 2737316 - DNA, 22 bp, Homo sapiens
caaagccaaactctgccagcca

SEQ ID NO: 2737317 - DNA, 16 bp, Homo sapiens
caaagccatattctaa

SEQ ID NO: 2737318 - DNA, 19 bp, Homo sapiens
caaagccatattctaaatt

SEQ ID NO: 2737319 - DNA, 18 bp, Homo sapiens
caaagccttggtcccgtg

SEQ ID NO: 2737320 - DNA, 20 bp, Homo sapiens
caaaggactgtaagcagatt

SEQ ID NO: 2737321 - DNA, 16 bp, Homo sapiens
caaaggccagcagcag

SEQ ID NO: 2737322 - DNA, 18 bp, Homo sapiens
caaagggcagtaaagttt

SEQ ID NO: 2737323 - DNA, 15 bp, Homo sapiens
caaagtctaaagttt

SEQ ID NO: 2737324 - DNA, 20 bp, Homo sapiens
caaagtctaaagtttacagt

SEQ ID NO: 2737325 - DNA, 17 bp, Homo sapiens
caaagttatatttactt

SEQ ID NO: 2737326 - DNA, 13 bp, Homo sapiens
caaagttccagtt

SEQ ID NO: 2737327 - DNA, 14 bp, Homo sapiens
caaagttttcagat

SEQ ID NO: 2737328 - DNA, 18 bp, Homo sapiens
caaataaaccttgtttct

SEQ ID NO: 2737329 - DNA, 22 bp, Homo sapiens
caaataattttttgcagtcttt

SEQ ID NO: 2737330 - DNA, 13 bp, Homo sapiens
caaatacatacaa

SEQ ID NO: 2737331 - DNA, 23 bp, Homo sapiens
caaatacatacaacctatgtaat

SEQ ID NO: 2737332 - DNA, 15 bp, Homo sapiens
caaatagcaaggcca

SEQ ID NO: 2737333 - DNA, 20 bp, Homo sapiens
caaatgagcattagctactt

SEQ ID NO: 2737334 - DNA, 16 bp, Homo sapiens
caaatgcattcatgtt

SEQ ID NO: 2737335 - DNA, 17 bp, Homo sapiens
caaatgcattcatgttt

SEQ ID NO: 2737336 - DNA, 15 bp, Homo sapiens
caaatgctgtgcaaa

SEQ ID NO: 2737337 - DNA, 22 bp, Homo sapiens
caaatgctgtgcaaacagtgta

SEQ ID NO: 2737338 - DNA, 17 bp, Homo sapiens
caaatggcttacttaca

SEQ ID NO: 2737339 - DNA, 19 bp, Homo sapiens
caaatggcttacttacaaa

SEQ ID NO: 2737340 - DNA, 19 bp, Homo sapiens
caaatgtgtcccagtgaac

SEQ ID NO: 2737341 - DNA, 12 bp, Homo sapiens
caaattaatctt

SEQ ID NO: 2737342 - DNA, 22 bp, Homo sapiens
caaattgtctgtctgctcttat

SEQ ID NO: 2737343 - DNA, 21 bp, Homo sapiens
caaattttattaaaagagtag

SEQ ID NO: 2737344 - DNA, 19 bp, Homo sapiens
caaattttgaggtctttta

SEQ ID NO: 2737345 - DNA, 12 bp, Homo sapiens
caacaaacactg

SEQ ID NO: 2737346 - DNA, 16 bp, Homo sapiens
caacaaggtgcacaga

SEQ ID NO: 2737347 - DNA, 13 bp, Homo sapiens
caacaagtaactt

SEQ ID NO: 2737348 - DNA, 22 bp, Homo sapiens
caacaatacatgctgctaattc

SEQ ID NO: 2737349 - DNA, 20 bp, Homo sapiens
caacacatgtgggagaggag

SEQ ID NO: 2737350 - DNA, 14 bp, Homo sapiens
caacactcttcttg

SEQ ID NO: 2737351 - DNA, 21 bp, Homo sapiens
caacagtgaacagcttcactt

SEQ ID NO: 2737352 - DNA, 22 bp, Homo sapiens
caacagtgttaggcctggcaca

SEQ ID NO: 2737353 - DNA, 23 bp, Homo sapiens
caacagtgttaggcctggcacag

SEQ ID NO: 2737354 - DNA, 12 bp, Homo sapiens
caacagtttctc

SEQ ID NO: 2737355 - DNA, 21 bp, Homo sapiens
caacatggattccaaagcatt

SEQ ID NO: 2737356 - DNA, 18 bp, Homo sapiens
caacatggcgaaaccccg

SEQ ID NO: 2737357 - DNA, 15 bp, Homo sapiens
caacatgtatgtgga

SEQ ID NO: 2737358 - DNA, 13 bp, Homo sapiens
caacatgtttctg

SEQ ID NO: 2737359 - DNA, 18 bp, Homo sapiens
caacattaccttgtcttt

SEQ ID NO: 2737360 - DNA, 16 bp, Homo sapiens
caacccagccgctgcc

SEQ ID NO: 2737361 - DNA, 17 bp, Homo sapiens
caacccagccgctgccc

SEQ ID NO: 2737362 - DNA, 13 bp, Homo sapiens
caacccagcctga

SEQ ID NO: 2737363 - DNA, 13 bp, Homo sapiens
caaccccagctgg

SEQ ID NO: 2737364 - DNA, 16 bp, Homo sapiens
caaccccagctggcct

SEQ ID NO: 2737365 - DNA, 20 bp, Homo sapiens
caacccccagcacccgggct

SEQ ID NO: 2737366 - DNA, 16 bp, Homo sapiens
caaccccccacctgcc

SEQ ID NO: 2737367 - DNA, 18 bp, Homo sapiens
caacctgcctgtgcatga

SEQ ID NO: 2737368 - DNA, 14 bp, Homo sapiens
caacctgtccttac

SEQ ID NO: 2737369 - DNA, 23 bp, Homo sapiens
caacctgtccttactcagagctg

SEQ ID NO: 2737370 - DNA, 14 bp, Homo sapiens
caacctgtgtctta

SEQ ID NO: 2737371 - DNA, 18 bp, Homo sapiens
caacgctctaccctgcag

SEQ ID NO: 2737372 - DNA, 20 bp, Homo sapiens
caacgctctaccctgcagct

SEQ ID NO: 2737373 - DNA, 23 bp, Homo sapiens
caacgctctaccctgcagcttgg

SEQ ID NO: 2737374 - DNA, 23 bp, Homo sapiens
caactcccggaggtgtcaccttc

SEQ ID NO: 2737375 - DNA, 15 bp, Homo sapiens
caacttgattcttgt

SEQ ID NO: 2737376 - DNA, 19 bp, Homo sapiens
caagaaaacctgtttttaa

SEQ ID NO: 2737377 - DNA, 15 bp, Homo sapiens
caagaaggtttctgt

SEQ ID NO: 2737378 - DNA, 22 bp, Homo sapiens
caagacagtggcactaaaatgt

SEQ ID NO: 2737379 - DNA, 14 bp, Homo sapiens
caagaccagcctgg

SEQ ID NO: 2737380 - DNA, 16 bp, Homo sapiens
caagactctgtctcaa

SEQ ID NO: 2737381 - DNA, 18 bp, Homo sapiens
caagacttcactgcagcc

SEQ ID NO: 2737382 - DNA, 20 bp, Homo sapiens
caagacttcactgcagcctt

SEQ ID NO: 2737383 - DNA, 21 bp, Homo sapiens
caagacttcactgcagccttt

SEQ ID NO: 2737384 - DNA, 12 bp, Homo sapiens
caagagaacatt

SEQ ID NO: 2737385 - DNA, 18 bp, Homo sapiens
caagagaaggcttttcta

SEQ ID NO: 2737386 - DNA, 16 bp, Homo sapiens
caagaggctcctgtcc

SEQ ID NO: 2737387 - DNA, 15 bp, Homo sapiens
caagagtctctccag

SEQ ID NO: 2737388 - DNA, 16 bp, Homo sapiens
caagagtctctccagc

SEQ ID NO: 2737389 - DNA, 17 bp, Homo sapiens
caagagtctctccagcc

SEQ ID NO: 2737390 - DNA, 21 bp, Homo sapiens
cagatttactgtcccaggagc

SEQ ID NO: 2737391 - DNA, 14 bp, Homo sapiens
cagattttctcctg

SEQ ID NO: 2737392 - DNA, 12 bp, Homo sapiens
cagcaaagccat

SEQ ID NO: 2737393 - DNA, 15 bp, Homo sapiens
cagcaaagttttcag

SEQ ID NO: 2737394 - DNA, 18 bp, Homo sapiens
cagcaaggaggctggctg

SEQ ID NO: 2737395 - DNA, 15 bp, Homo sapiens
cagcaaggcacctgc

SEQ ID NO: 2737396 - DNA, 23 bp, Homo sapiens
cagcaaggcacctgcaggttggg

SEQ ID NO: 2737397 - DNA, 17 bp, Homo sapiens
cagcaatagggtgcagt

SEQ ID NO: 2737398 - DNA, 21 bp, Homo sapiens
cagcaatagggtgcagttttc

SEQ ID NO: 2737399 - DNA, 13 bp, Homo sapiens
cagcaattaatta

SEQ ID NO: 2737400 - DNA, 21 bp, Homo sapiens
cagcacagcaaggaggctggc

SEQ ID NO: 2737401 - DNA, 16 bp, Homo sapiens
cagcacagctcctccc

SEQ ID NO: 2737402 - DNA, 22 bp, Homo sapiens
cagcacagctcctcccctgccg

SEQ ID NO: 2737403 - DNA, 15 bp, Homo sapiens
cagcacgttttctgg

SEQ ID NO: 2737404 - DNA, 15 bp, Homo sapiens
cagcagccagctcct

SEQ ID NO: 2737405 - DNA, 21 bp, Homo sapiens
cagcagccccaccccaccctg

SEQ ID NO: 2737406 - DNA, 14 bp, Homo sapiens
cagcagctgcctct

SEQ ID NO: 2737407 - DNA, 17 bp, Homo sapiens
cagcagggtcttgctgt

SEQ ID NO: 2737408 - DNA, 11 bp, Homo sapiens
cagcaggtgct

SEQ ID NO: 2737409 - DNA, 14 bp, Homo sapiens
cagcaggtgctgct

SEQ ID NO: 2737410 - DNA, 21 bp, Homo sapiens
cagcatcaaacatgaaaacat

SEQ ID NO: 2737411 - DNA, 15 bp, Homo sapiens
cagcattttcacatt

SEQ ID NO: 2737412 - DNA, 19 bp, Homo sapiens
cagcattttcacattttgc

SEQ ID NO: 2737413 - DNA, 15 bp, Homo sapiens
cagccacgaacacgc

SEQ ID NO: 2737414 - DNA, 19 bp, Homo sapiens
cagccactgcagcacagga

SEQ ID NO: 2737415 - DNA, 15 bp, Homo sapiens
cagccagccctggag

SEQ ID NO: 2737416 - DNA, 19 bp, Homo sapiens
cagccagccctggaggctg

SEQ ID NO: 2737417 - DNA, 15 bp, Homo sapiens
cagccagctcctgca

SEQ ID NO: 2737418 - DNA, 15 bp, Homo sapiens
cagccaggactcctt

SEQ ID NO: 2737419 - DNA, 13 bp, Homo sapiens
cagccccacagcc

SEQ ID NO: 2737420 - DNA, 18 bp, Homo sapiens
cagcccccaccccagcac

SEQ ID NO: 2737421 - DNA, 19 bp, Homo sapiens
cagccccgtgtagccccgg

SEQ ID NO: 2737422 - DNA, 22 bp, Homo sapiens
cagccccgtgtagccccgggct

SEQ ID NO: 2737423 - DNA, 23 bp, Homo sapiens
cagccccgtgtagccccgggctg

SEQ ID NO: 2737424 - DNA, 16 bp, Homo sapiens
cagccctggaggctgg

SEQ ID NO: 2737425 - DNA, 20 bp, Homo sapiens
cagccctggaggctggatgg

SEQ ID NO: 2737426 - DNA, 17 bp, Homo sapiens
cagccctttgcaggccc

SEQ ID NO: 2737427 - DNA, 13 bp, Homo sapiens
cagccgcctccct

SEQ ID NO: 2737428 - DNA, 16 bp, Homo sapiens
cagccgctgcccggcg

SEQ ID NO: 2737429 - DNA, 22 bp, Homo sapiens
cagccgctgcccggcgccctct

SEQ ID NO: 2737430 - DNA, 13 bp, Homo sapiens
cagccgtatttta

SEQ ID NO: 2737431 - DNA, 16 bp, Homo sapiens
cagcctcacagatgct

SEQ ID NO: 2737432 - DNA, 15 bp, Homo sapiens
cagcctccagtgctg

SEQ ID NO: 2737433 - DNA, 16 bp, Homo sapiens
cagcctccagtgctgg

SEQ ID NO: 2737434 - DNA, 17 bp, Homo sapiens
cagcctcccagctttct

SEQ ID NO: 2737435 - DNA, 14 bp, Homo sapiens
cagcctccctctga

SEQ ID NO: 2737436 - DNA, 22 bp, Homo sapiens
cagcctccctctgacctgcagg

SEQ ID NO: 2737437 - DNA, 20 bp, Homo sapiens
cagcctcctgagtagctggg

SEQ ID NO: 2737438 - DNA, 18 bp, Homo sapiens
cagcctgaggctgagact

SEQ ID NO: 2737439 - DNA, 18 bp, Homo sapiens
cagcctgagtgcaccacc

SEQ ID NO: 2737440 - DNA, 14 bp, Homo sapiens
cagcctgccccagc

SEQ ID NO: 2737441 - DNA, 19 bp, Homo sapiens
cagcctgccccagcctccc

SEQ ID NO: 2737442 - DNA, 23 bp, Homo sapiens
cagcctgccccagcctcccagct

SEQ ID NO: 2737443 - DNA, 20 bp, Homo sapiens
cagcctgccgccgtctctgt

SEQ ID NO: 2737444 - DNA, 21 bp, Homo sapiens
cagcctggcttctggagccct

SEQ ID NO: 2737445 - DNA, 19 bp, Homo sapiens
cagcctgggcgacagagca

SEQ ID NO: 2737446 - DNA, 12 bp, Homo sapiens
cagcctgtcctg

SEQ ID NO: 2737447 - DNA, 19 bp, Homo sapiens
cagcctgtcgtgtccagcc

SEQ ID NO: 2737448 - DNA, 22 bp, Homo sapiens
cagcgagttgtggaaagcctct

SEQ ID NO: 2737449 - DNA, 23 bp, Homo sapiens
cagcgcctcctggacctgaaggc

SEQ ID NO: 2737450 - DNA, 12 bp, Homo sapiens
cagcgcctgtcc

SEQ ID NO: 2737451 - DNA, 22 bp, Homo sapiens
cagcgcctgtcccctcacagac

SEQ ID NO: 2737452 - DNA, 17 bp, Homo sapiens
cagcgctggctccaggc

SEQ ID NO: 2737453 - DNA, 14 bp, Homo sapiens
cagctactcagaag

SEQ ID NO: 2737454 - DNA, 19 bp, Homo sapiens
cagctactcagaagcctga

SEQ ID NO: 2737455 - DNA, 22 bp, Homo sapiens
cagctactcagaagcctgaggc

SEQ ID NO: 2737456 - DNA, 13 bp, Homo sapiens
cagctagggctgg

SEQ ID NO: 2737457 - DNA, 22 bp, Homo sapiens
cagctattcaggaggctgaggc

SEQ ID NO: 2737458 - DNA, 23 bp, Homo sapiens
cagctattcaggaggctgaggca

SEQ ID NO: 2737459 - DNA, 14 bp, Homo sapiens
cagctcctcccctg

SEQ ID NO: 2737460 - DNA, 23 bp, Homo sapiens
cagctcctcccctgccgcctccc

SEQ ID NO: 2737461 - DNA, 20 bp, Homo sapiens
cagctctgtcaccctggcca

SEQ ID NO: 2737462 - DNA, 23 bp, Homo sapiens
cagctctgtcaccctggccacca

SEQ ID NO: 2737463 - DNA, 18 bp, Homo sapiens
cagctgacagtcctctcc

SEQ ID NO: 2737464 - DNA, 17 bp, Homo sapiens
cagctgcacctgccagc

SEQ ID NO: 2737465 - DNA, 21 bp, Homo sapiens
cagctgcacctgccagcctgg

SEQ ID NO: 2737466 - DNA, 22 bp, Homo sapiens
cagctgcacctgccagcctggc

SEQ ID NO: 2737467 - DNA, 17 bp, Homo sapiens
cagctgctgccactctg

SEQ ID NO: 2737468 - DNA, 12 bp, Homo sapiens
cagctggcctct

SEQ ID NO: 2737469 - DNA, 16 bp, Homo sapiens
cagctggctctccacc

SEQ ID NO: 2737470 - DNA, 12 bp, Homo sapiens
cagctgggccca

SEQ ID NO: 2737471 - DNA, 22 bp, Homo sapiens
cagctgggcccacagcccccac

SEQ ID NO: 2737472 - DNA, 18 bp, Homo sapiens
cagctggtggatggtgac

SEQ ID NO: 2737473 - DNA, 22 bp, Homo sapiens
cagctggtggatggtgactttt

SEQ ID NO: 2737474 - DNA, 17 bp, Homo sapiens
cagctgtagctcccgag

SEQ ID NO: 2737475 - DNA, 18 bp, Homo sapiens
cagctgtgaacatggact

SEQ ID NO: 2737476 - DNA, 20 bp, Homo sapiens
cagctgtgaacatggactct

SEQ ID NO: 2737477 - DNA, 16 bp, Homo sapiens
cagctgtggtcccacc

SEQ ID NO: 2737478 - DNA, 17 bp, Homo sapiens
cagctgtggtcccaccc

SEQ ID NO: 2737479 - DNA, 23 bp, Homo sapiens
cagctgtggtcccacccaggaag

SEQ ID NO: 2737480 - DNA, 12 bp, Homo sapiens
cagcttcagttg

SEQ ID NO: 2737481 - DNA, 13 bp, Homo sapiens
cagcttcctctga

SEQ ID NO: 2737482 - DNA, 12 bp, Homo sapiens
cagcttcctgtc

SEQ ID NO: 2737483 - DNA, 14 bp, Homo sapiens
cagcttctcttgaa

SEQ ID NO: 2737484 - DNA, 11 bp, Homo sapiens
cagcttctgcc

SEQ ID NO: 2737485 - DNA, 18 bp, Homo sapiens
cagcttctgccacttccc

SEQ ID NO: 2737486 - DNA, 19 bp, Homo sapiens
cagcttctgccacttccca

SEQ ID NO: 2737487 - DNA, 14 bp, Homo sapiens
cagcttctgctggg

SEQ ID NO: 2737488 - DNA, 15 bp, Homo sapiens
cagcttctgctgggc

SEQ ID NO: 2737489 - DNA, 17 bp, Homo sapiens
cagcttctgctgggctg

SEQ ID NO: 2737490 - DNA, 13 bp, Homo sapiens
cagcttggagaac

SEQ ID NO: 2737491 - DNA, 23 bp, Homo sapiens
cagctttccctccccagagttct

SEQ ID NO: 2737492 - DNA, 14 bp, Homo sapiens
cagctttttgtatt

SEQ ID NO: 2737493 - DNA, 19 bp, Homo sapiens
caggaaaagcctctgtgtc

SEQ ID NO: 2737494 - DNA, 15 bp, Homo sapiens
caggaaaggaagatg

SEQ ID NO: 2737495 - DNA, 15 bp, Homo sapiens
caggaagggagggag

SEQ ID NO: 2737496 - DNA, 23 bp, Homo sapiens
caggaagggagggagctgaggcc

SEQ ID NO: 2737497 - DNA, 17 bp, Homo sapiens
caggaatttaatttata

SEQ ID NO: 2737498 - DNA, 23 bp, Homo sapiens
caggacggggccggccaggtggg

SEQ ID NO: 2737499 - DNA, 24 bp, Homo sapiens
caggacggggccggccaggtgggc

SEQ ID NO: 2737500 - DNA, 19 bp, Homo sapiens
caggactccttagactgat

SEQ ID NO: 2737501 - DNA, 19 bp, Homo sapiens
caggagatggaagagtcat

SEQ ID NO: 2737502 - DNA, 15 bp, Homo sapiens
caggagctgacagag

SEQ ID NO: 2737503 - DNA, 24 bp, Homo sapiens
caggagctgacagagccagaggca

SEQ ID NO: 2737504 - DNA, 19 bp, Homo sapiens
caggaggctccgtgagccc

SEQ ID NO: 2737505 - DNA, 22 bp, Homo sapiens
caggaggctccgtgagcccttg

SEQ ID NO: 2737506 - DNA, 16 bp, Homo sapiens
caggaggggaagaggc

SEQ ID NO: 2737507 - DNA, 16 bp, Homo sapiens
caggagtcaccatgca

SEQ ID NO: 2737508 - DNA, 19 bp, Homo sapiens
caggagtcaccatgcaagg

SEQ ID NO: 2737509 - DNA, 21 bp, Homo sapiens
caggagtcaccatgcaagggt

SEQ ID NO: 2737510 - DNA, 16 bp, Homo sapiens
caggatatccccaggg

SEQ ID NO: 2737511 - DNA, 18 bp, Homo sapiens
caggatatccccagggaa

SEQ ID NO: 2737512 - DNA, 15 bp, Homo sapiens
caggatgaccctgcg

SEQ ID NO: 2737513 - DNA, 14 bp, Homo sapiens
ccagggaagccctc

SEQ ID NO: 2737514 - DNA, 19 bp, Homo sapiens
ccagggccccagaacacag

SEQ ID NO: 2737515 - DNA, 15 bp, Homo sapiens
ccagggccctgcaga

SEQ ID NO: 2737516 - DNA, 16 bp, Homo sapiens
ccaggggcaggcacag

SEQ ID NO: 2737517 - DNA, 14 bp, Homo sapiens
ccaggtaactttgc

SEQ ID NO: 2737518 - DNA, 23 bp, Homo sapiens
ccaggtaagcaggaggaggtgcc

SEQ ID NO: 2737519 - DNA, 21 bp, Homo sapiens
ccaggtctcctccaccgccat

SEQ ID NO: 2737520 - DNA, 14 bp, Homo sapiens
ccaggtgcagtggc

SEQ ID NO: 2737521 - DNA, 22 bp, Homo sapiens
ccaggtgcagtggctcacgcct

SEQ ID NO: 2737522 - DNA, 23 bp, Homo sapiens
ccaggtggggtgaggcagtgggt

SEQ ID NO: 2737523 - DNA, 17 bp, Homo sapiens
ccagtactgggaaggag

SEQ ID NO: 2737524 - DNA, 23 bp, Homo sapiens
ccagtatcctgctggttcactct

SEQ ID NO: 2737525 - DNA, 20 bp, Homo sapiens
ccagtcaagttccctcctgc

SEQ ID NO: 2737526 - DNA, 18 bp, Homo sapiens
ccagtcctagagctcctg

SEQ ID NO: 2737527 - DNA, 15 bp, Homo sapiens
ccagtcctgctggcc

SEQ ID NO: 2737528 - DNA, 21 bp, Homo sapiens
ccagtcctgctggcctgctct

SEQ ID NO: 2737529 - DNA, 20 bp, Homo sapiens
ccagtcctttgttgctgttg

SEQ ID NO: 2737530 - DNA, 18 bp, Homo sapiens
ccagtcgatatctcactt

SEQ ID NO: 2737531 - DNA, 18 bp, Homo sapiens
ccagtcgcgctgcctgtg

SEQ ID NO: 2737532 - DNA, 19 bp, Homo sapiens
ccagtcgcgctgcctgtgt

SEQ ID NO: 2737533 - DNA, 13 bp, Homo sapiens
ccagtgagcctct

SEQ ID NO: 2737534 - DNA, 16 bp, Homo sapiens
ccagtgagcctctgcg

SEQ ID NO: 2737535 - DNA, 14 bp, Homo sapiens
ccagtgctcctgtg

SEQ ID NO: 2737536 - DNA, 14 bp, Homo sapiens
ccagtgctggctgc

SEQ ID NO: 2737537 - DNA, 18 bp, Homo sapiens
ccagtgctggctgctggc

SEQ ID NO: 2737538 - DNA, 19 bp, Homo sapiens
ccagtggcccccactcaca

SEQ ID NO: 2737539 - DNA, 15 bp, Homo sapiens
ccagtgggaggacag

SEQ ID NO: 2737540 - DNA, 15 bp, Homo sapiens
ccagtgtagccttgc

SEQ ID NO: 2737541 - DNA, 18 bp, Homo sapiens
ccagtgtattttctgtgt

SEQ ID NO: 2737542 - DNA, 19 bp, Homo sapiens
ccagtgtattttctgtgtt

SEQ ID NO: 2737543 - DNA, 15 bp, Homo sapiens
ccagtgtcttcctgt

SEQ ID NO: 2737544 - DNA, 15 bp, Homo sapiens
ccagtgtgatcccaa

SEQ ID NO: 2737545 - DNA, 17 bp, Homo sapiens
ccagtgtggctgtctgc

SEQ ID NO: 2737546 - DNA, 18 bp, Homo sapiens
ccagtgtgtgctcagcag

SEQ ID NO: 2737547 - DNA, 21 bp, Homo sapiens
ccatagagatatttaaaagac

SEQ ID NO: 2737548 - DNA, 16 bp, Homo sapiens
ccatatctagtcaata

SEQ ID NO: 2737549 - DNA, 23 bp, Homo sapiens
ccatatctagtcaataactctga

SEQ ID NO: 2737550 - DNA, 14 bp, Homo sapiens
ccatattgctctta

SEQ ID NO: 2737551 - DNA, 15 bp, Homo sapiens
ccatattgctcttaa

SEQ ID NO: 2737552 - DNA, 22 bp, Homo sapiens
ccatattgctcttaaaaatctt

SEQ ID NO: 2737553 - DNA, 13 bp, Homo sapiens
ccatatttttaaa

SEQ ID NO: 2737554 - DNA, 18 bp, Homo sapiens
ccatcagtgtacccccgc

SEQ ID NO: 2737555 - DNA, 23 bp, Homo sapiens
ccatcagtgtacccccgcccagg

SEQ ID NO: 2737556 - DNA, 20 bp, Homo sapiens
ccatcccccctcaccagggg

SEQ ID NO: 2737557 - DNA, 18 bp, Homo sapiens
ccatcctcctctccatgc

SEQ ID NO: 2737558 - DNA, 19 bp, Homo sapiens
ccatcctcctctccatgca

SEQ ID NO: 2737559 - DNA, 17 bp, Homo sapiens
ccatcctggcccatcag

SEQ ID NO: 2737560 - DNA, 21 bp, Homo sapiens
ccatctcctcccaccagtggc

SEQ ID NO: 2737561 - DNA, 20 bp, Homo sapiens
ccatctctctactcctacct

SEQ ID NO: 2737562 - DNA, 16 bp, Homo sapiens
ccatctgcccaggacg

SEQ ID NO: 2737563 - DNA, 15 bp, Homo sapiens
ccatctgtccatcct

SEQ ID NO: 2737564 - DNA, 16 bp, Homo sapiens
ccatcttccaggtggg

SEQ ID NO: 2737565 - DNA, 13 bp, Homo sapiens
ccatgatacttta

SEQ ID NO: 2737566 - DNA, 14 bp, Homo sapiens
ccatgcaagtgctg

SEQ ID NO: 2737567 - DNA, 15 bp, Homo sapiens
ccatgcaagtgctgt

SEQ ID NO: 2737568 - DNA, 17 bp, Homo sapiens
ccatggagacaagaagg

SEQ ID NO: 2737569 - DNA, 20 bp, Homo sapiens
ccatggattcccctggacat

SEQ ID NO: 2737570 - DNA, 23 bp, Homo sapiens
ccatggccacgaggaagcagcaa

SEQ ID NO: 2737571 - DNA, 15 bp, Homo sapiens
ccatggccttccctc

SEQ ID NO: 2737572 - DNA, 21 bp, Homo sapiens
ccatggccttccctccccaca

SEQ ID NO: 2737573 - DNA, 20 bp, Homo sapiens
ccatgggcactgctgggtgg

SEQ ID NO: 2737574 - DNA, 22 bp, Homo sapiens
ccatgggcactgctgggtggcc

SEQ ID NO: 2737575 - DNA, 12 bp, Homo sapiens
ccatgggcctgc

SEQ ID NO: 2737576 - DNA, 15 bp, Homo sapiens
ccatggtagactgtg

SEQ ID NO: 2737577 - DNA, 18 bp, Homo sapiens
ccatggtagactgtgaca

SEQ ID NO: 2737578 - DNA, 15 bp, Homo sapiens
ccatgtatctacctc

SEQ ID NO: 2737579 - DNA, 23 bp, Homo sapiens
ccatgtgcacctatggcccagcc

SEQ ID NO: 2737580 - DNA, 23 bp, Homo sapiens
ccatgtggtttgctgttaccaaa

SEQ ID NO: 2737581 - DNA, 14 bp, Homo sapiens
ccattaccatggag

SEQ ID NO: 2737582 - DNA, 21 bp, Homo sapiens
ccattccaagtcaacactctt

SEQ ID NO: 2737583 - DNA, 14 bp, Homo sapiens
ccattctcctgcct

SEQ ID NO: 2737584 - DNA, 14 bp, Homo sapiens
ccattgtcttccaa

SEQ ID NO: 2737585 - DNA, 15 bp, Homo sapiens
ccattgtcttccaac

SEQ ID NO: 2737586 - DNA, 23 bp, Homo sapiens
ccattgtcttccaaccccagctg

SEQ ID NO: 2737587 - DNA, 20 bp, Homo sapiens
ccatttgccagattgcccca

SEQ ID NO: 2737588 - DNA, 20 bp, Homo sapiens
ccatttggcagaactgctgg

SEQ ID NO: 2737589 - DNA, 14 bp, Homo sapiens
cccaaacaccctcc

SEQ ID NO: 2737590 - DNA, 13 bp, Homo sapiens
cccaacaggccct

SEQ ID NO: 2737591 - DNA, 15 bp, Homo sapiens
cccaacccccagcac

SEQ ID NO: 2737592 - DNA, 15 bp, Homo sapiens
cccaactcccggagg

SEQ ID NO: 2737593 - DNA, 12 bp, Homo sapiens
cccaagccacag

SEQ ID NO: 2737594 - DNA, 19 bp, Homo sapiens
cccaatccatttggcagaa

SEQ ID NO: 2737595 - DNA, 14 bp, Homo sapiens
cccacacacactcc

SEQ ID NO: 2737596 - DNA, 15 bp, Homo sapiens
cccacagcccacgtc

SEQ ID NO: 2737597 - DNA, 21 bp, Homo sapiens
cccacagcccccaccccagca

SEQ ID NO: 2737598 - DNA, 14 bp, Homo sapiens
cccacagctctgct

SEQ ID NO: 2737599 - DNA, 16 bp, Homo sapiens
cccacagctctgctgg

SEQ ID NO: 2737600 - DNA, 16 bp, Homo sapiens
cccacagtagagcact

SEQ ID NO: 2737601 - DNA, 23 bp, Homo sapiens
cccacagtgactcgggctcctgt

SEQ ID NO: 2737602 - DNA, 14 bp, Homo sapiens
cccacattggaccc

SEQ ID NO: 2737603 - DNA, 20 bp, Homo sapiens
cccaccaaggtctcacactc

SEQ ID NO: 2737604 - DNA, 12 bp, Homo sapiens
cccaccagagct

SEQ ID NO: 2737605 - DNA, 15 bp, Homo sapiens
cccaccagagctgcc

SEQ ID NO: 2737606 - DNA, 18 bp, Homo sapiens
cccaccagagctgcctcc

SEQ ID NO: 2737607 - DNA, 12 bp, Homo sapiens
cccacccaggaa

SEQ ID NO: 2737608 - DNA, 13 bp, Homo sapiens
cccaccccagcac

SEQ ID NO: 2737609 - DNA, 14 bp, Homo sapiens
cccacccccacttc

SEQ ID NO: 2737610 - DNA, 18 bp, Homo sapiens
cccacccccacttcatgc

SEQ ID NO: 2737611 - DNA, 19 bp, Homo sapiens
cccaccctcaaaccctgtg

SEQ ID NO: 2737612 - DNA, 14 bp, Homo sapiens
cccaccctgcccct

SEQ ID NO: 2737613 - DNA, 22 bp, Homo sapiens
cccaccttcaattcctgggccc

SEQ ID NO: 2737614 - DNA, 19 bp, Homo sapiens
cccacggggaccactgggc

SEQ ID NO: 2737615 - DNA, 20 bp, Homo sapiens
cccacggggaccactgggcc

SEQ ID NO: 2737616 - DNA, 21 bp, Homo sapiens
cccacggggaccactgggccc

SEQ ID NO: 2737617 - DNA, 20 bp, Homo sapiens
cccacgtctctctgcctgct

SEQ ID NO: 2737618 - DNA, 15 bp, Homo sapiens
cccacgtgcacagct

SEQ ID NO: 2737619 - DNA, 16 bp, Homo sapiens
cccactaagctttctc

SEQ ID NO: 2737620 - DNA, 17 bp, Homo sapiens
cccactccccaccttca

SEQ ID NO: 2737621 - DNA, 12 bp, Homo sapiens
cccactgcaccc

SEQ ID NO: 2737622 - DNA, 14 bp, Homo sapiens
cccactgcaccccc

SEQ ID NO: 2737623 - DNA, 15 bp, Homo sapiens
cccactgcaccccct

SEQ ID NO: 2737624 - DNA, 21 bp, Homo sapiens
cccactgcaccccctcctgct

SEQ ID NO: 2737625 - DNA, 23 bp, Homo sapiens
cccactgcaccccctcctgctgc

SEQ ID NO: 2737626 - DNA, 16 bp, Homo sapiens
cccactggccagtcct

SEQ ID NO: 2737627 - DNA, 19 bp, Homo sapiens
cccacttcatgcccactgc

SEQ ID NO: 2737628 - DNA, 17 bp, Homo sapiens
cccacttcccctcctac

SEQ ID NO: 2737629 - DNA, 16 bp, Homo sapiens
cccacttccctgacac

SEQ ID NO: 2737630 - DNA, 19 bp, Homo sapiens
cccacttccctgacactgc

SEQ ID NO: 2737631 - DNA, 24 bp, Homo sapiens
cccacttccctgacactgcggggc

SEQ ID NO: 2737632 - DNA, 22 bp, Homo sapiens
cccagaaggctgggtccagggg

SEQ ID NO: 2737633 - DNA, 13 bp, Homo sapiens
cccagacagctgg

SEQ ID NO: 2737634 - DNA, 20 bp, Homo sapiens
cccagagacctttgcccaca

SEQ ID NO: 2737635 - DNA, 14 bp, Homo sapiens
cccagagggcccag

SEQ ID NO: 2737636 - DNA, 23 bp, Homo sapiens
cccagagggcccaggcaggccac

SEQ ID NO: 2737637 - DNA, 21 bp, Homo sapiens
cctcccagggccagggccctg

SEQ ID NO: 2737638 - DNA, 19 bp, Homo sapiens
cctcccatggccttccctc

SEQ ID NO: 2737639 - DNA, 16 bp, Homo sapiens
cctccccaccagagct

SEQ ID NO: 2737640 - DNA, 19 bp, Homo sapiens
cctccccaccagagctgcc

SEQ ID NO: 2737641 - DNA, 19 bp, Homo sapiens
cctcccccacgtctctctg

SEQ ID NO: 2737642 - DNA, 23 bp, Homo sapiens
cctcccccacgtctctctgcctg

SEQ ID NO: 2737643 - DNA, 12 bp, Homo sapiens
cctcccctgagg

SEQ ID NO: 2737644 - DNA, 13 bp, Homo sapiens
cctcccctgagga

SEQ ID NO: 2737645 - DNA, 12 bp, Homo sapiens
cctcccctgccg

SEQ ID NO: 2737646 - DNA, 18 bp, Homo sapiens
cctcccgggaagcatcct

SEQ ID NO: 2737647 - DNA, 21 bp, Homo sapiens
cctcccgggaagcatcctccc

SEQ ID NO: 2737648 - DNA, 14 bp, Homo sapiens
cctccctagatcca

SEQ ID NO: 2737649 - DNA, 22 bp, Homo sapiens
cctccctagatccaggcttctc

SEQ ID NO: 2737650 - DNA, 13 bp, Homo sapiens
cctccctctgcct

SEQ ID NO: 2737651 - DNA, 19 bp, Homo sapiens
cctccctctgcctcatcct

SEQ ID NO: 2737652 - DNA, 12 bp, Homo sapiens
cctccctgctgt

SEQ ID NO: 2737653 - DNA, 19 bp, Homo sapiens
cctccctgctgtcccctct

SEQ ID NO: 2737654 - DNA, 22 bp, Homo sapiens
cctccctgctgtcccctcttgc

SEQ ID NO: 2737655 - DNA, 12 bp, Homo sapiens
cctccgcctaga

SEQ ID NO: 2737656 - DNA, 19 bp, Homo sapiens
cctccgccttcactccggt

SEQ ID NO: 2737657 - DNA, 13 bp, Homo sapiens
cctcctaggagta

SEQ ID NO: 2737658 - DNA, 21 bp, Homo sapiens
cctcctccagttctgatgagg

SEQ ID NO: 2737659 - DNA, 13 bp, Homo sapiens
cctcctctccatg

SEQ ID NO: 2737660 - DNA, 14 bp, Homo sapiens
cctcgaccagaatc

SEQ ID NO: 2737661 - DNA, 14 bp, Homo sapiens
cctcgcctctccca

SEQ ID NO: 2737662 - DNA, 14 bp, Homo sapiens
cctcggaggctcct

SEQ ID NO: 2737663 - DNA, 22 bp, Homo sapiens
cctcggaggctcctccctctgc

SEQ ID NO: 2737664 - DNA, 16 bp, Homo sapiens
cctcggcagatgctgt

SEQ ID NO: 2737665 - DNA, 22 bp, Homo sapiens
cctcggcccatctgtccatcct

SEQ ID NO: 2737666 - DNA, 12 bp, Homo sapiens
cctcggcctccc

SEQ ID NO: 2737667 - DNA, 22 bp, Homo sapiens
cctcggcctcccaaagtgctgg

SEQ ID NO: 2737668 - DNA, 15 bp, Homo sapiens
cctcggctcctgctg

SEQ ID NO: 2737669 - DNA, 17 bp, Homo sapiens
cctcggctcctgctgca

SEQ ID NO: 2737670 - DNA, 21 bp, Homo sapiens
cctcgggaccctcccagtgag

SEQ ID NO: 2737671 - DNA, 19 bp, Homo sapiens
cctcgggatgaaaagccat

SEQ ID NO: 2737672 - DNA, 20 bp, Homo sapiens
cctcgtttgatagtgcttct

SEQ ID NO: 2737673 - DNA, 20 bp, Homo sapiens
cctctaactccctcctcaca

SEQ ID NO: 2737674 - DNA, 16 bp, Homo sapiens
cctctagaacacccac

SEQ ID NO: 2737675 - DNA, 18 bp, Homo sapiens
cctctagaacacccactg

SEQ ID NO: 2737676 - DNA, 24 bp, Homo sapiens
cctctagaacacccactggccagt

SEQ ID NO: 2737677 - DNA, 15 bp, Homo sapiens
cctctagtgccctcc

SEQ ID NO: 2737678 - DNA, 16 bp, Homo sapiens
cctctcagagcctcag

SEQ ID NO: 2737679 - DNA, 21 bp, Homo sapiens
cctctgaatgtcccagaggct

SEQ ID NO: 2737680 - DNA, 16 bp, Homo sapiens
cctctgacctgcaggc

SEQ ID NO: 2737681 - DNA, 12 bp, Homo sapiens
cctctgcccagc

SEQ ID NO: 2737682 - DNA, 21 bp, Homo sapiens
cctctgcccagcctgccccag

SEQ ID NO: 2737683 - DNA, 17 bp, Homo sapiens
cctctgcccgcagagcc

SEQ ID NO: 2737684 - DNA, 23 bp, Homo sapiens
cctctgcctcatcctcctcctca

SEQ ID NO: 2737685 - DNA, 14 bp, Homo sapiens
cctctgctgccatg

SEQ ID NO: 2737686 - DNA, 15 bp, Homo sapiens
cctctgctgccatgg

SEQ ID NO: 2737687 - DNA, 19 bp, Homo sapiens
cctctgtccagccagctcc

SEQ ID NO: 2737688 - DNA, 15 bp, Homo sapiens
cctctgtgcagacag

SEQ ID NO: 2737689 - DNA, 14 bp, Homo sapiens
cctctgtgtcactg

SEQ ID NO: 2737690 - DNA, 22 bp, Homo sapiens
cctctgtgtcactggctgcctc

SEQ ID NO: 2737691 - DNA, 20 bp, Homo sapiens
cctcttcggttgtcttgaaa

SEQ ID NO: 2737692 - DNA, 23 bp, Homo sapiens
cctcttgccccaacccccagcac

SEQ ID NO: 2737693 - DNA, 13 bp, Homo sapiens
cctcttggcacct

SEQ ID NO: 2737694 - DNA, 15 bp, Homo sapiens
cctctttgcatggaa

SEQ ID NO: 2737695 - DNA, 16 bp, Homo sapiens
cctgaaccgtgtgctc

SEQ ID NO: 2737696 - DNA, 17 bp, Homo sapiens
cctgaatgtcctttctc

SEQ ID NO: 2737697 - DNA, 23 bp, Homo sapiens
cctgacccggattggccctgccc

SEQ ID NO: 2737698 - DNA, 14 bp, Homo sapiens
cctgacctccagtc

SEQ ID NO: 2737699 - DNA, 14 bp, Homo sapiens
cctgaccttctcca

SEQ ID NO: 2737700 - DNA, 16 bp, Homo sapiens
cctgaccttctccagg

SEQ ID NO: 2737701 - DNA, 13 bp, Homo sapiens
cctgactctctgt

SEQ ID NO: 2737702 - DNA, 15 bp, Homo sapiens
cctgactctctgtga

SEQ ID NO: 2737703 - DNA, 16 bp, Homo sapiens
cctgactctctgtgac

SEQ ID NO: 2737704 - DNA, 23 bp, Homo sapiens
cctgacttcaggggctgcccgct

SEQ ID NO: 2737705 - DNA, 21 bp, Homo sapiens
cctgagatactgaagtgcagc

SEQ ID NO: 2737706 - DNA, 11 bp, Homo sapiens
cctgagattct

SEQ ID NO: 2737707 - DNA, 18 bp, Homo sapiens
cctgagattctttaagga

SEQ ID NO: 2737708 - DNA, 20 bp, Homo sapiens
cctgagattctttaaggaga

SEQ ID NO: 2737709 - DNA, 21 bp, Homo sapiens
cctgagattctttaaggagat

SEQ ID NO: 2737710 - DNA, 23 bp, Homo sapiens
cctgagattctttaaggagatag

SEQ ID NO: 2737711 - DNA, 19 bp, Homo sapiens
cctgaggagtgtcctgtct

SEQ ID NO: 2737712 - DNA, 15 bp, Homo sapiens
cctgaggatcccctg

SEQ ID NO: 2737713 - DNA, 23 bp, Homo sapiens
cctgaggatcccctgtcccctgg

SEQ ID NO: 2737714 - DNA, 21 bp, Homo sapiens
cctgaggctgagactgcggga

SEQ ID NO: 2737715 - DNA, 13 bp, Homo sapiens
cctgaggctggca

SEQ ID NO: 2737716 - DNA, 19 bp, Homo sapiens
cctgaggctggcatcctgg

SEQ ID NO: 2737717 - DNA, 21 bp, Homo sapiens
cctgaggctggcatcctggct

SEQ ID NO: 2737718 - DNA, 20 bp, Homo sapiens
cctgaggctggtagcagaat

SEQ ID NO: 2737719 - DNA, 20 bp, Homo sapiens
cctgatcattacatggctgt

SEQ ID NO: 2737720 - DNA, 16 bp, Homo sapiens
cctgatgctcatatca

SEQ ID NO: 2737721 - DNA, 15 bp, Homo sapiens
cctgattgtattttt

SEQ ID NO: 2737722 - DNA, 13 bp, Homo sapiens
cctgcactgtcct

SEQ ID NO: 2737723 - DNA, 16 bp, Homo sapiens
cctgcactgtcctgct

SEQ ID NO: 2737724 - DNA, 19 bp, Homo sapiens
cctgcactgtcctgctcca

SEQ ID NO: 2737725 - DNA, 19 bp, Homo sapiens
cctgcagaggggaaaccag

SEQ ID NO: 2737726 - DNA, 22 bp, Homo sapiens
cctgcagccccgcgcctccttc

SEQ ID NO: 2737727 - DNA, 21 bp, Homo sapiens
cctgcaggccaagagcagagg

SEQ ID NO: 2737728 - DNA, 22 bp, Homo sapiens
cctgcaggccaagagcagaggc

SEQ ID NO: 2737729 - DNA, 17 bp, Homo sapiens
cctgcaggttgggccat

SEQ ID NO: 2737730 - DNA, 21 bp, Homo sapiens
cctgcatatctctagtccctg

SEQ ID NO: 2737731 - DNA, 19 bp, Homo sapiens
cctgcatttttaaaggaca

SEQ ID NO: 2737732 - DNA, 23 bp, Homo sapiens
cctgccactttggtacatggcca

SEQ ID NO: 2737733 - DNA, 13 bp, Homo sapiens
cctgccagcctgg

SEQ ID NO: 2737734 - DNA, 14 bp, Homo sapiens
cctgccagctctgt

SEQ ID NO: 2737735 - DNA, 17 bp, Homo sapiens
cctgccatttgcaccct

SEQ ID NO: 2737736 - DNA, 18 bp, Homo sapiens
cctgccccagcctcccag

SEQ ID NO: 2737737 - DNA, 16 bp, Homo sapiens
cctgccccgcccagct

SEQ ID NO: 2737738 - DNA, 23 bp, Homo sapiens
cctgcccctccctagatccaggc

SEQ ID NO: 2737739 - DNA, 20 bp, Homo sapiens
cctgccccttgtcctctcag

SEQ ID NO: 2737740 - DNA, 17 bp, Homo sapiens
cctgcctagctcttggg

SEQ ID NO: 2737741 - DNA, 18 bp, Homo sapiens
cctgcctagctcttgggc

SEQ ID NO: 2737742 - DNA, 19 bp, Homo sapiens
cctgcctagctcttgggcc

SEQ ID NO: 2737743 - DNA, 23 bp, Homo sapiens
cctgcctagctcttgggcctgac

SEQ ID NO: 2737744 - DNA, 19 bp, Homo sapiens
cctgcctcagcctcctgag

SEQ ID NO: 2737745 - DNA, 20 bp, Homo sapiens
cctgcctcagcctcctgagt

SEQ ID NO: 2737746 - DNA, 15 bp, Homo sapiens
cctgcctgctgtgga

SEQ ID NO: 2737747 - DNA, 13 bp, Homo sapiens
cctgcctgggcct

SEQ ID NO: 2737748 - DNA, 14 bp, Homo sapiens
cctgcctgggcctc

SEQ ID NO: 2737749 - DNA, 15 bp, Homo sapiens
cctgcctgggcctcc

SEQ ID NO: 2737750 - DNA, 16 bp, Homo sapiens
cctgcctgggcctccc

SEQ ID NO: 2737751 - DNA, 13 bp, Homo sapiens
cctgcctgtgcat

SEQ ID NO: 2737752 - DNA, 14 bp, Homo sapiens
cctgcctgtgcatg

SEQ ID NO: 2737753 - DNA, 13 bp, Homo sapiens
cctgccttgaagc

SEQ ID NO: 2737754 - DNA, 19 bp, Homo sapiens
cctgccttgaagccactga

SEQ ID NO: 2737755 - DNA, 19 bp, Homo sapiens
cctgcgagagaccctacag

SEQ ID NO: 2737756 - DNA, 18 bp, Homo sapiens
cctgctcattgtggccag

SEQ ID NO: 2737757 - DNA, 12 bp, Homo sapiens
cctgctctgctt

SEQ ID NO: 2737758 - DNA, 16 bp, Homo sapiens
cctgctctgcttttcc

SEQ ID NO: 2737759 - DNA, 23 bp, Homo sapiens
cctgctctgcttttcctgtctgt

SEQ ID NO: 2737760 - DNA, 17 bp, Homo sapiens
ctcacgtgaccagcccc

SEQ ID NO: 2737761 - DNA, 19 bp, Homo sapiens
ctcacgtgaccagccccgt

SEQ ID NO: 2737762 - DNA, 23 bp, Homo sapiens
ctcactgcaagctctgcctcccg

SEQ ID NO: 2737763 - DNA, 13 bp, Homo sapiens
ctcagaagcctga

SEQ ID NO: 2737764 - DNA, 18 bp, Homo sapiens
ctcagaagcctgaggctg

SEQ ID NO: 2737765 - DNA, 12 bp, Homo sapiens
ctcagactcctg

SEQ ID NO: 2737766 - DNA, 15 bp, Homo sapiens
ctcagactcctggct

SEQ ID NO: 2737767 - DNA, 20 bp, Homo sapiens
ctcagagagcatcttttcct

SEQ ID NO: 2737768 - DNA, 18 bp, Homo sapiens
ctcagagcagcactgggg

SEQ ID NO: 2737769 - DNA, 14 bp, Homo sapiens
ctcagagcctcagc

SEQ ID NO: 2737770 - DNA, 16 bp, Homo sapiens
ctcagagctgcgggct

SEQ ID NO: 2737771 - DNA, 17 bp, Homo sapiens
ctcagagctgcgggctg

SEQ ID NO: 2737772 - DNA, 20 bp, Homo sapiens
ctcagagctgcgggctgagg

SEQ ID NO: 2737773 - DNA, 17 bp, Homo sapiens
ctcagagctgctgagca

SEQ ID NO: 2737774 - DNA, 22 bp, Homo sapiens
ctcagagcttttcgaactgtgc

SEQ ID NO: 2737775 - DNA, 20 bp, Homo sapiens
ctcagagggaggagtttttc

SEQ ID NO: 2737776 - DNA, 17 bp, Homo sapiens
ctcagagtccagtcaag

SEQ ID NO: 2737777 - DNA, 17 bp, Homo sapiens
ctcagcagccagctcct

SEQ ID NO: 2737778 - DNA, 13 bp, Homo sapiens
ctcagcagccccc

SEQ ID NO: 2737779 - DNA, 20 bp, Homo sapiens
ctcagccagccctggaggct

SEQ ID NO: 2737780 - DNA, 23 bp, Homo sapiens
ctcagccagccctggaggctgga

SEQ ID NO: 2737781 - DNA, 12 bp, Homo sapiens
ctcagcctccag

SEQ ID NO: 2737782 - DNA, 14 bp, Homo sapiens
ctcagcctccaggc

SEQ ID NO: 2737783 - DNA, 12 bp, Homo sapiens
ctcagcctcctg

SEQ ID NO: 2737784 - DNA, 12 bp, Homo sapiens
ctcagctgcctc

SEQ ID NO: 2737785 - DNA, 13 bp, Homo sapiens
ctcagctgcctca

SEQ ID NO: 2737786 - DNA, 14 bp, Homo sapiens
ctcagctgtggtcc

SEQ ID NO: 2737787 - DNA, 18 bp, Homo sapiens
ctcagctgtggtcccacc

SEQ ID NO: 2737788 - DNA, 20 bp, Homo sapiens
ctcagcttcccaagtagctg

SEQ ID NO: 2737789 - DNA, 22 bp, Homo sapiens
ctcagcttcccaagtagctgag

SEQ ID NO: 2737790 - DNA, 18 bp, Homo sapiens
ctcaggccaggtgcagtg

SEQ ID NO: 2737791 - DNA, 12 bp, Homo sapiens
ctcagggaccac

SEQ ID NO: 2737792 - DNA, 16 bp, Homo sapiens
ctcagggaccacagca

SEQ ID NO: 2737793 - DNA, 19 bp, Homo sapiens
ctcagggaccacagcaagg

SEQ ID NO: 2737794 - DNA, 16 bp, Homo sapiens
ctcaggggaagctgct

SEQ ID NO: 2737795 - DNA, 22 bp, Homo sapiens
ctcaggggaagctgctagggga

SEQ ID NO: 2737796 - DNA, 19 bp, Homo sapiens
ctcaggtagggagctaagg

SEQ ID NO: 2737797 - DNA, 17 bp, Homo sapiens
ctcaggtagtactggga

SEQ ID NO: 2737798 - DNA, 18 bp, Homo sapiens
ctcaggtagtactgggaa

SEQ ID NO: 2737799 - DNA, 22 bp, Homo sapiens
ctcaggtgacggactcagactc

SEQ ID NO: 2737800 - DNA, 23 bp, Homo sapiens
ctcaggtgacggactcagactcc

SEQ ID NO: 2737801 - DNA, 16 bp, Homo sapiens
ctcagtctcaggagca

SEQ ID NO: 2737802 - DNA, 17 bp, Homo sapiens
ctcagtgtcagcactca

SEQ ID NO: 2737803 - DNA, 12 bp, Homo sapiens
ctcatctgtgcc

SEQ ID NO: 2737804 - DNA, 17 bp, Homo sapiens
ctcatctgtgcctgtct

SEQ ID NO: 2737805 - DNA, 18 bp, Homo sapiens
ctcatctgtgcctgtctg

SEQ ID NO: 2737806 - DNA, 22 bp, Homo sapiens
ctcatgcaagacttcactgcag

SEQ ID NO: 2737807 - DNA, 20 bp, Homo sapiens
ctcatggatttggttatgat

SEQ ID NO: 2737808 - DNA, 21 bp, Homo sapiens
ctcatgtcatttctcatggat

SEQ ID NO: 2737809 - DNA, 21 bp, Homo sapiens
ctcattccctcgggaccctcc

SEQ ID NO: 2737810 - DNA, 15 bp, Homo sapiens
ctcattgtggccagt

SEQ ID NO: 2737811 - DNA, 23 bp, Homo sapiens
ctcattgtggccagtttagagtt

SEQ ID NO: 2737812 - DNA, 22 bp, Homo sapiens
ctccaaacactgggctctgagg

SEQ ID NO: 2737813 - DNA, 23 bp, Homo sapiens
ctccaaacactgggctctgagga

SEQ ID NO: 2737814 - DNA, 20 bp, Homo sapiens
ctccaacaataaagagctca

SEQ ID NO: 2737815 - DNA, 17 bp, Homo sapiens
ctccaagaggctggaaa

SEQ ID NO: 2737816 - DNA, 23 bp, Homo sapiens
ctccacagggacacagtctggtg

SEQ ID NO: 2737817 - DNA, 14 bp, Homo sapiens
ctccacccactgtc

SEQ ID NO: 2737818 - DNA, 23 bp, Homo sapiens
ctccaccctaaagtctcaggtga

SEQ ID NO: 2737819 - DNA, 12 bp, Homo sapiens
ctccacctcctg

SEQ ID NO: 2737820 - DNA, 13 bp, Homo sapiens
ctccacctcctgg

SEQ ID NO: 2737821 - DNA, 16 bp, Homo sapiens
ctccacctcctgggtt

SEQ ID NO: 2737822 - DNA, 14 bp, Homo sapiens
ctccactcccactt

SEQ ID NO: 2737823 - DNA, 18 bp, Homo sapiens
ctccactgtttcatgagc

SEQ ID NO: 2737824 - DNA, 21 bp, Homo sapiens
ctccactgtttcatgagccca

SEQ ID NO: 2737825 - DNA, 22 bp, Homo sapiens
ctccactgtttcatgagcccaa

SEQ ID NO: 2737826 - DNA, 16 bp, Homo sapiens
ctccagactgcggagc

SEQ ID NO: 2737827 - DNA, 22 bp, Homo sapiens
ctccagcacgttttctggcttc

SEQ ID NO: 2737828 - DNA, 23 bp, Homo sapiens
ctccagcacgttttctggcttct

SEQ ID NO: 2737829 - DNA, 14 bp, Homo sapiens
ctccagcctcacag

SEQ ID NO: 2737830 - DNA, 22 bp, Homo sapiens
ctccagcctcacagatgctggc

SEQ ID NO: 2737831 - DNA, 23 bp, Homo sapiens
ctccagcctcacagatgctggcc

SEQ ID NO: 2737832 - DNA, 13 bp, Homo sapiens
ctccagcctgggc

SEQ ID NO: 2737833 - DNA, 14 bp, Homo sapiens
ctccagctgttacc

SEQ ID NO: 2737834 - DNA, 19 bp, Homo sapiens
ctccagctgttacctgaga

SEQ ID NO: 2737835 - DNA, 20 bp, Homo sapiens
ctccagctgttacctgagat

SEQ ID NO: 2737836 - DNA, 14 bp, Homo sapiens
ctccagggacagaa

SEQ ID NO: 2737837 - DNA, 14 bp, Homo sapiens
ctccaggtaacttt

SEQ ID NO: 2737838 - DNA, 13 bp, Homo sapiens
ctccagtcctgct

SEQ ID NO: 2737839 - DNA, 15 bp, Homo sapiens
ctccagtcctgctgg

SEQ ID NO: 2737840 - DNA, 18 bp, Homo sapiens
ctccagtcctgctggcct

SEQ ID NO: 2737841 - DNA, 21 bp, Homo sapiens
ctccagtcctgctggcctgct

SEQ ID NO: 2737842 - DNA, 23 bp, Homo sapiens
ctccagtcctgctggcctgctct

SEQ ID NO: 2737843 - DNA, 22 bp, Homo sapiens
ctccagtgctggctgctggccc

SEQ ID NO: 2737844 - DNA, 19 bp, Homo sapiens
ctccatgctggtgtggcca

SEQ ID NO: 2737845 - DNA, 14 bp, Homo sapiens
ctcccacagtgact

SEQ ID NO: 2737846 - DNA, 21 bp, Homo sapiens
ctcccaccaggcagctccagc

SEQ ID NO: 2737847 - DNA, 19 bp, Homo sapiens
ctcccacggggaccactgg

SEQ ID NO: 2737848 - DNA, 16 bp, Homo sapiens
ctcccactcctaatca

SEQ ID NO: 2737849 - DNA, 20 bp, Homo sapiens
ctcccactcctaatcaagag

SEQ ID NO: 2737850 - DNA, 19 bp, Homo sapiens
ctcccacttccctgacact

SEQ ID NO: 2737851 - DNA, 14 bp, Homo sapiens
ctcccagaaggctg

SEQ ID NO: 2737852 - DNA, 11 bp, Homo sapiens
ctcccagctga

SEQ ID NO: 2737853 - DNA, 21 bp, Homo sapiens
ctcccagctgacagtcctctc

SEQ ID NO: 2737854 - DNA, 23 bp, Homo sapiens
ctcccagctgacagtcctctcca

SEQ ID NO: 2737855 - DNA, 22 bp, Homo sapiens
ctcccagggccagggccctgca

SEQ ID NO: 2737856 - DNA, 17 bp, Homo sapiens
ctcccagtgtcttcctg

SEQ ID NO: 2737857 - DNA, 14 bp, Homo sapiens
ctcccatggccttc

SEQ ID NO: 2737858 - DNA, 19 bp, Homo sapiens
ctccccacagtcctcacag

SEQ ID NO: 2737859 - DNA, 16 bp, Homo sapiens
ctccccaccagagctg

SEQ ID NO: 2737860 - DNA, 20 bp, Homo sapiens
ctccccaccagagctgcctc

SEQ ID NO: 2737861 - DNA, 21 bp, Homo sapiens
ctccccaccttcaattcctgg

SEQ ID NO: 2737862 - DNA, 14 bp, Homo sapiens
ctccccagcccttt

SEQ ID NO: 2737863 - DNA, 13 bp, Homo sapiens
ctccccagggcct

SEQ ID NO: 2737864 - DNA, 12 bp, Homo sapiens
ctccccagtgct

SEQ ID NO: 2737865 - DNA, 21 bp, Homo sapiens
ctccccattagagtcagcctt

SEQ ID NO: 2737866 - DNA, 14 bp, Homo sapiens
ctcccccagagcca

SEQ ID NO: 2737867 - DNA, 19 bp, Homo sapiens
ctcccccccggggctgggt

SEQ ID NO: 2737868 - DNA, 22 bp, Homo sapiens
ctccccctaccgcatggcagct

SEQ ID NO: 2737869 - DNA, 11 bp, Homo sapiens
ctccccctggg

SEQ ID NO: 2737870 - DNA, 12 bp, Homo sapiens
ctccccctgggc

SEQ ID NO: 2737871 - DNA, 13 bp, Homo sapiens
ctccccctgggct

SEQ ID NO: 2737872 - DNA, 23 bp, Homo sapiens
ctccccctgggctctgccccagc

SEQ ID NO: 2737873 - DNA, 19 bp, Homo sapiens
ctcccctgaggatcccctg

SEQ ID NO: 2737874 - DNA, 15 bp, Homo sapiens
ctcccctgaggctgg

SEQ ID NO: 2737875 - DNA, 22 bp, Homo sapiens
ctcccctgaggctggcatcctg

SEQ ID NO: 2737876 - DNA, 12 bp, Homo sapiens
ctcccctgccgc

SEQ ID NO: 2737877 - DNA, 19 bp, Homo sapiens
ctcccggacctggactagg

SEQ ID NO: 2737878 - DNA, 22 bp, Homo sapiens
ctcccgggaagcatcctcccca

SEQ ID NO: 2737879 - DNA, 23 bp, Homo sapiens
ctcccgggaagcatcctccccac

SEQ ID NO: 2737880 - DNA, 14 bp, Homo sapiens
ctccctagatccag

SEQ ID NO: 2737881 - DNA, 16 bp, Homo sapiens
ctccctagatccaggc

SEQ ID NO: 2737882 - DNA, 17 bp, Homo sapiens
ctccctagatccaggct

SEQ ID NO: 2737883 - DNA, 16 bp, Homo sapiens
ctgctgcatggcactg

SEQ ID NO: 2737884 - DNA, 20 bp, Homo sapiens
ctgctgcatttgtgtcatct

SEQ ID NO: 2737885 - DNA, 18 bp, Homo sapiens
ctgctgccactctgctgc

SEQ ID NO: 2737886 - DNA, 20 bp, Homo sapiens
ctgctgccactctgctgcct

SEQ ID NO: 2737887 - DNA, 21 bp, Homo sapiens
ctgctgccactctgctgcctg

SEQ ID NO: 2737888 - DNA, 16 bp, Homo sapiens
ctgctgcctgtattct

SEQ ID NO: 2737889 - DNA, 15 bp, Homo sapiens
ctgctggcccacagc

SEQ ID NO: 2737890 - DNA, 22 bp, Homo sapiens
ctgctgggaccccagctagggc

SEQ ID NO: 2737891 - DNA, 17 bp, Homo sapiens
ctgctgggactggccag

SEQ ID NO: 2737892 - DNA, 12 bp, Homo sapiens
ctgctgggctct

SEQ ID NO: 2737893 - DNA, 13 bp, Homo sapiens
ctgctgggctctt

SEQ ID NO: 2737894 - DNA, 15 bp, Homo sapiens
ctgctgggctggggc

SEQ ID NO: 2737895 - DNA, 17 bp, Homo sapiens
ctgctgggctggggcct

SEQ ID NO: 2737896 - DNA, 14 bp, Homo sapiens
ctgctggggctggt

SEQ ID NO: 2737897 - DNA, 15 bp, Homo sapiens
ctgctgggggctccc

SEQ ID NO: 2737898 - DNA, 17 bp, Homo sapiens
ctgctgggggctcccct

SEQ ID NO: 2737899 - DNA, 21 bp, Homo sapiens
ctgctgggggctccccttgcc

SEQ ID NO: 2737900 - DNA, 14 bp, Homo sapiens
ctgctgggtggccc

SEQ ID NO: 2737901 - DNA, 15 bp, Homo sapiens
ctgctgggtggccca

SEQ ID NO: 2737902 - DNA, 16 bp, Homo sapiens
ctgctgggtggcccat

SEQ ID NO: 2737903 - DNA, 21 bp, Homo sapiens
ctgctgggtggcccatccccc

SEQ ID NO: 2737904 - DNA, 20 bp, Homo sapiens
ctgctggtaatttgtatctg

SEQ ID NO: 2737905 - DNA, 13 bp, Homo sapiens
ctgctgtggagcc

SEQ ID NO: 2737906 - DNA, 15 bp, Homo sapiens
ctgctgtggagccca

SEQ ID NO: 2737907 - DNA, 23 bp, Homo sapiens
ctgcttatcaataaacctgtttg

SEQ ID NO: 2737908 - DNA, 15 bp, Homo sapiens
ctgcttccctggggc

SEQ ID NO: 2737909 - DNA, 16 bp, Homo sapiens
ctgcttccctggggcc

SEQ ID NO: 2737910 - DNA, 17 bp, Homo sapiens
ctgcttccctggggccc

SEQ ID NO: 2737911 - DNA, 19 bp, Homo sapiens
ctgcttccctggggcccca

SEQ ID NO: 2737912 - DNA, 13 bp, Homo sapiens
ctgcttcctgagc

SEQ ID NO: 2737913 - DNA, 13 bp, Homo sapiens
ctgcttcctggac

SEQ ID NO: 2737914 - DNA, 14 bp, Homo sapiens
ctgcttctgcattc

SEQ ID NO: 2737915 - DNA, 9 bp, Homo sapiens
ctgctttat

SEQ ID NO: 2737916 - DNA, 20 bp, Homo sapiens
ctgcttttcctgtctgtata

SEQ ID NO: 2737917 - DNA, 20 bp, Homo sapiens
ctgctttttgctttcttctt

SEQ ID NO: 2737918 - DNA, 20 bp, Homo sapiens
ctggaaaccacacttcttga

SEQ ID NO: 2737919 - DNA, 14 bp, Homo sapiens
ctggaaaggctcag

SEQ ID NO: 2737920 - DNA, 21 bp, Homo sapiens
ctggaaaggctcagtctcagg

SEQ ID NO: 2737921 - DNA, 23 bp, Homo sapiens
ctggaaaggctcagtctcaggag

SEQ ID NO: 2737922 - DNA, 22 bp, Homo sapiens
ctggaagaactgcatggggagt

SEQ ID NO: 2737923 - DNA, 19 bp, Homo sapiens
ctggaaggtactgaaggct

SEQ ID NO: 2737924 - DNA, 13 bp, Homo sapiens
ctggaatgaagca

SEQ ID NO: 2737925 - DNA, 19 bp, Homo sapiens
ctggaatgaagcatgtagc

SEQ ID NO: 2737926 - DNA, 12 bp, Homo sapiens
ctggacaaccca

SEQ ID NO: 2737927 - DNA, 13 bp, Homo sapiens
ctggacaacccag

SEQ ID NO: 2737928 - DNA, 14 bp, Homo sapiens
ctggacaacccaga

SEQ ID NO: 2737929 - DNA, 19 bp, Homo sapiens
ctggacccatttgccagga

SEQ ID NO: 2737930 - DNA, 13 bp, Homo sapiens
ctggaccctggcc

SEQ ID NO: 2737931 - DNA, 13 bp, Homo sapiens
ctggaccggggcc

SEQ ID NO: 2737932 - DNA, 15 bp, Homo sapiens
ctggacggcattcct

SEQ ID NO: 2737933 - DNA, 14 bp, Homo sapiens
ctggactagggcct

SEQ ID NO: 2737934 - DNA, 14 bp, Homo sapiens
ctggactctggcac

SEQ ID NO: 2737935 - DNA, 15 bp, Homo sapiens
ctggactctggcacc

SEQ ID NO: 2737936 - DNA, 18 bp, Homo sapiens
ctggactctggcacccag

SEQ ID NO: 2737937 - DNA, 18 bp, Homo sapiens
ctggacttgagcttggca

SEQ ID NO: 2737938 - DNA, 14 bp, Homo sapiens
ctggagactattta

SEQ ID NO: 2737939 - DNA, 15 bp, Homo sapiens
ctggagcatcccagg

SEQ ID NO: 2737940 - DNA, 17 bp, Homo sapiens
ctggagcatcccaggcg

SEQ ID NO: 2737941 - DNA, 13 bp, Homo sapiens
ctggagcccagga

SEQ ID NO: 2737942 - DNA, 15 bp, Homo sapiens
ctggagctgccagca

SEQ ID NO: 2737943 - DNA, 20 bp, Homo sapiens
ctggaggaacattgggaagg

SEQ ID NO: 2737944 - DNA, 23 bp, Homo sapiens
ctggatgaacaggatgtataata

SEQ ID NO: 2737945 - DNA, 19 bp, Homo sapiens
ctggatgagcaactcctgt

SEQ ID NO: 2737946 - DNA, 22 bp, Homo sapiens
ctggattgatcggagcctcctc

SEQ ID NO: 2737947 - DNA, 22 bp, Homo sapiens
ctggatttttacaaataaagat

SEQ ID NO: 2737948 - DNA, 22 bp, Homo sapiens
ctggcaatgccctacctgcctg

SEQ ID NO: 2737949 - DNA, 22 bp, Homo sapiens
ctggcacaacgctctaccctgc

SEQ ID NO: 2737950 - DNA, 12 bp, Homo sapiens
ctggcacagtgt

SEQ ID NO: 2737951 - DNA, 21 bp, Homo sapiens
ctggcacagtgtctgggctga

SEQ ID NO: 2737952 - DNA, 12 bp, Homo sapiens
ctggcatcctgg

SEQ ID NO: 2737953 - DNA, 13 bp, Homo sapiens
ctggcatcctggc

SEQ ID NO: 2737954 - DNA, 15 bp, Homo sapiens
ctggcatcctggctg

SEQ ID NO: 2737955 - DNA, 16 bp, Homo sapiens
ctggcatcctggctgg

SEQ ID NO: 2737956 - DNA, 21 bp, Homo sapiens
ctggcatcctggctggctgtg

SEQ ID NO: 2737957 - DNA, 18 bp, Homo sapiens
ctggcatctccctgacct

SEQ ID NO: 2737958 - DNA, 13 bp, Homo sapiens
ctggccagcccca

SEQ ID NO: 2737959 - DNA, 14 bp, Homo sapiens
ctggccagccccac

SEQ ID NO: 2737960 - DNA, 15 bp, Homo sapiens
ctggccagccccaca

SEQ ID NO: 2737961 - DNA, 16 bp, Homo sapiens
ctggccagccccacag

SEQ ID NO: 2737962 - DNA, 17 bp, Homo sapiens
ctggccagccccacagc

SEQ ID NO: 2737963 - DNA, 18 bp, Homo sapiens
ctggccagccccacagcc

SEQ ID NO: 2737964 - DNA, 19 bp, Homo sapiens
ctggccagtcctagagctc

SEQ ID NO: 2737965 - DNA, 20 bp, Homo sapiens
ctggccagtcctagagctcc

SEQ ID NO: 2737966 - DNA, 21 bp, Homo sapiens
ctggccagtcctagagctcct

SEQ ID NO: 2737967 - DNA, 14 bp, Homo sapiens
ctggcccacagctc

SEQ ID NO: 2737968 - DNA, 15 bp, Homo sapiens
ctggcccacagctct

SEQ ID NO: 2737969 - DNA, 19 bp, Homo sapiens
ctggcccacagctctgctg

SEQ ID NO: 2737970 - DNA, 20 bp, Homo sapiens
ctggcccacagctctgctgg

SEQ ID NO: 2737971 - DNA, 22 bp, Homo sapiens
ctggcccacagctctgctggaa

SEQ ID NO: 2737972 - DNA, 13 bp, Homo sapiens
ctggcccagctcc

SEQ ID NO: 2737973 - DNA, 22 bp, Homo sapiens
ctggcccagctcccccgggagg

SEQ ID NO: 2737974 - DNA, 16 bp, Homo sapiens
ctggcccatcagtgta

SEQ ID NO: 2737975 - DNA, 18 bp, Homo sapiens
ctggccctcaaggcctcc

SEQ ID NO: 2737976 - DNA, 19 bp, Homo sapiens
ctggccctcaaggcctccc

SEQ ID NO: 2737977 - DNA, 14 bp, Homo sapiens
ctggccgtggctcc

SEQ ID NO: 2737978 - DNA, 13 bp, Homo sapiens
ctggcctaaagaa

SEQ ID NO: 2737979 - DNA, 16 bp, Homo sapiens
ctggcctcgcctggcc

SEQ ID NO: 2737980 - DNA, 20 bp, Homo sapiens
ctggcctcgcctggcctgag

SEQ ID NO: 2737981 - DNA, 21 bp, Homo sapiens
ctggcctctagaacacccact

SEQ ID NO: 2737982 - DNA, 17 bp, Homo sapiens
ctggcctcttggcacct

SEQ ID NO: 2737983 - DNA, 24 bp, Homo sapiens
ctggcctcttggcacctgcctagc

SEQ ID NO: 2737984 - DNA, 20 bp, Homo sapiens
ctggcctgaggtctcgctga

SEQ ID NO: 2737985 - DNA, 22 bp, Homo sapiens
ctggcctgctcttacttccccc

SEQ ID NO: 2737986 - DNA, 20 bp, Homo sapiens
ctggccttgtccccagctcc

SEQ ID NO: 2737987 - DNA, 15 bp, Homo sapiens
ctggcggcgcagagg

SEQ ID NO: 2737988 - DNA, 16 bp, Homo sapiens
ctggcggcgcagaggg

SEQ ID NO: 2737989 - DNA, 13 bp, Homo sapiens
ctggctcagctgt

SEQ ID NO: 2737990 - DNA, 16 bp, Homo sapiens
ctggctcagctgtggt

SEQ ID NO: 2737991 - DNA, 19 bp, Homo sapiens
ctggctcagctgtggtccc

SEQ ID NO: 2737992 - DNA, 23 bp, Homo sapiens
ctggctccaggctcctcatgagg

SEQ ID NO: 2737993 - DNA, 22 bp, Homo sapiens
ctggctctgccagcgtccccgg

SEQ ID NO: 2737994 - DNA, 21 bp, Homo sapiens
ctggctctttgtgtgtctcca

SEQ ID NO: 2737995 - DNA, 17 bp, Homo sapiens
ctggctgaacagtgctc

SEQ ID NO: 2737996 - DNA, 21 bp, Homo sapiens
ctggctgcctccactcccact

SEQ ID NO: 2737997 - DNA, 13 bp, Homo sapiens
ctggctgctggcc

SEQ ID NO: 2737998 - DNA, 17 bp, Homo sapiens
ctggctggctgcagtga

SEQ ID NO: 2737999 - DNA, 15 bp, Homo sapiens
ctggctggctgtgtc

SEQ ID NO: 2738000 - DNA, 13 bp, Homo sapiens
ctggctgtgtcct

SEQ ID NO: 2738001 - DNA, 15 bp, Homo sapiens
ctggctgtgtcctct

SEQ ID NO: 2738002 - DNA, 16 bp, Homo sapiens
ctggcttctgcttcat

SEQ ID NO: 2738003 - DNA, 13 bp, Homo sapiens
ctgggaaggagga

SEQ ID NO: 2738004 - DNA, 13 bp, Homo sapiens
ctgggaagggaag

SEQ ID NO: 2738005 - DNA, 16 bp, Homo sapiens
ctgggaagggaaggaa

SEQ ID NO: 2738006 - DNA, 21 bp, Homo sapiens
ctgggaatggaaggctttgcc

SEQ ID NO: 2738007 - DNA, 19 bp, Homo sapiens
gaattttctttcatacatt

SEQ ID NO: 2738008 - DNA, 22 bp, Homo sapiens
gaattttctttcatacattata

SEQ ID NO: 2738009 - DNA, 19 bp, Homo sapiens
gaattttggaaaaatgtca

SEQ ID NO: 2738010 - DNA, 20 bp, Homo sapiens
gacaaagccaaactctgcca

SEQ ID NO: 2738011 - DNA, 23 bp, Homo sapiens
gacaacatcgcaatagtttttta

SEQ ID NO: 2738012 - DNA, 15 bp, Homo sapiens
gacaacatttttgta

SEQ ID NO: 2738013 - DNA, 20 bp, Homo sapiens
gacaacatttttgtacatta

SEQ ID NO: 2738014 - DNA, 20 bp, Homo sapiens
gacaaccacgtaccaagcca

SEQ ID NO: 2738015 - DNA, 15 bp, Homo sapiens
gacaattgtcttttt

SEQ ID NO: 2738016 - DNA, 23 bp, Homo sapiens
gacacaatgttgcactgaaaacc

SEQ ID NO: 2738017 - DNA, 22 bp, Homo sapiens
gacacactgcggtgtctgcagc

SEQ ID NO: 2738018 - DNA, 23 bp, Homo sapiens
gacacactgcggtgtctgcagct

SEQ ID NO: 2738019 - DNA, 19 bp, Homo sapiens
gacacagctgagctggcct

SEQ ID NO: 2738020 - DNA, 21 bp, Homo sapiens
gacacccaccccctctttgtg

SEQ ID NO: 2738021 - DNA, 14 bp, Homo sapiens
gacactacaaacat

SEQ ID NO: 2738022 - DNA, 19 bp, Homo sapiens
gacactgcggggcttggct

SEQ ID NO: 2738023 - DNA, 20 bp, Homo sapiens
gacactgcggggcttggctg

SEQ ID NO: 2738024 - DNA, 13 bp, Homo sapiens
gacagaagcagga

SEQ ID NO: 2738025 - DNA, 14 bp, Homo sapiens
gacagagccagagg

SEQ ID NO: 2738026 - DNA, 17 bp, Homo sapiens
gacagtacctgattgta

SEQ ID NO: 2738027 - DNA, 22 bp, Homo sapiens
gacagtgacgtgactcagagct

SEQ ID NO: 2738028 - DNA, 15 bp, Homo sapiens
gacagtgtcagagtc

SEQ ID NO: 2738029 - DNA, 15 bp, Homo sapiens
gacatattcccatgg

SEQ ID NO: 2738030 - DNA, 14 bp, Homo sapiens
gacatcaatgaaac

SEQ ID NO: 2738031 - DNA, 20 bp, Homo sapiens
gacatcagaagtaactccca

SEQ ID NO: 2738032 - DNA, 23 bp, Homo sapiens
gacatgatttagggaagcaggga

SEQ ID NO: 2738033 - DNA, 22 bp, Homo sapiens
gacatgctctccccacaggggg

SEQ ID NO: 2738034 - DNA, 13 bp, Homo sapiens
gacattgtaaacg

SEQ ID NO: 2738035 - DNA, 12 bp, Homo sapiens
gaccactgggcc

SEQ ID NO: 2738036 - DNA, 18 bp, Homo sapiens
gaccactgggcccctcag

SEQ ID NO: 2738037 - DNA, 19 bp, Homo sapiens
gaccactgggcccctcagg

SEQ ID NO: 2738038 - DNA, 14 bp, Homo sapiens
gaccagtactggga

SEQ ID NO: 2738039 - DNA, 20 bp, Homo sapiens
gaccagtactgggaaggagg

SEQ ID NO: 2738040 - DNA, 14 bp, Homo sapiens
gaccatgtgattat

SEQ ID NO: 2738041 - DNA, 14 bp, Homo sapiens
gaccattgtcttcc

SEQ ID NO: 2738042 - DNA, 16 bp, Homo sapiens
gaccattgtcttccaa

SEQ ID NO: 2738043 - DNA, 19 bp, Homo sapiens
gaccattgtcttccaaccc

SEQ ID NO: 2738044 - DNA, 20 bp, Homo sapiens
gaccattgtcttccaacccc

SEQ ID NO: 2738045 - DNA, 23 bp, Homo sapiens
gaccattgtcttccaaccccagc

SEQ ID NO: 2738046 - DNA, 12 bp, Homo sapiens
gacccagtgtgt

SEQ ID NO: 2738047 - DNA, 16 bp, Homo sapiens
gacccatttcaggagg

SEQ ID NO: 2738048 - DNA, 16 bp, Homo sapiens
gaccccatctgcccag

SEQ ID NO: 2738049 - DNA, 17 bp, Homo sapiens
gaccccatctgcccagg

SEQ ID NO: 2738050 - DNA, 17 bp, Homo sapiens
gaccccttttcagcttc

SEQ ID NO: 2738051 - DNA, 21 bp, Homo sapiens
gacccggattggccctgcccc

SEQ ID NO: 2738052 - DNA, 23 bp, Homo sapiens
gacccggattggccctgcccctc

SEQ ID NO: 2738053 - DNA, 18 bp, Homo sapiens
gaccctcctccactccac

SEQ ID NO: 2738054 - DNA, 22 bp, Homo sapiens
gaccctcctcctcccccagagg

SEQ ID NO: 2738055 - DNA, 17 bp, Homo sapiens
gaccctcgtttgatagt

SEQ ID NO: 2738056 - DNA, 22 bp, Homo sapiens
gaccctgcgaaggggccctggt

SEQ ID NO: 2738057 - DNA, 15 bp, Homo sapiens
gaccctggctctgcc

SEQ ID NO: 2738058 - DNA, 12 bp, Homo sapiens
gaccctgtctct

SEQ ID NO: 2738059 - DNA, 18 bp, Homo sapiens
gaccgggtctgcttctgc

SEQ ID NO: 2738060 - DNA, 13 bp, Homo sapiens
gacctcagatgtg

SEQ ID NO: 2738061 - DNA, 20 bp, Homo sapiens
gacctccagtcctgctggcc

SEQ ID NO: 2738062 - DNA, 13 bp, Homo sapiens
gacctctcttgtg

SEQ ID NO: 2738063 - DNA, 14 bp, Homo sapiens
gacctgaactctgc

SEQ ID NO: 2738064 - DNA, 22 bp, Homo sapiens
gacctgaactctgcaactgaat

SEQ ID NO: 2738065 - DNA, 16 bp, Homo sapiens
gacctggagctgccag

SEQ ID NO: 2738066 - DNA, 19 bp, Homo sapiens
gacctggagctgccagcac

SEQ ID NO: 2738067 - DNA, 22 bp, Homo sapiens
gaccttacaaccacatttctgg

SEQ ID NO: 2738068 - DNA, 16 bp, Homo sapiens
gaccttctccagggac

SEQ ID NO: 2738069 - DNA, 17 bp, Homo sapiens
gacctttcagctgtgaa

SEQ ID NO: 2738070 - DNA, 13 bp, Homo sapiens
gacctttgcccac

SEQ ID NO: 2738071 - DNA, 20 bp, Homo sapiens
gacgctgtgattggcaggag

SEQ ID NO: 2738072 - DNA, 14 bp, Homo sapiens
gacggactcagact

SEQ ID NO: 2738073 - DNA, 17 bp, Homo sapiens
gacggggtttccccatg

SEQ ID NO: 2738074 - DNA, 15 bp, Homo sapiens
gacgggttgaaagac

SEQ ID NO: 2738075 - DNA, 21 bp, Homo sapiens
gacgggttgaaagacatcaat

SEQ ID NO: 2738076 - DNA, 21 bp, Homo sapiens
gacggtcctttaggcagcctg

SEQ ID NO: 2738077 - DNA, 23 bp, Homo sapiens
gacggtcctttaggcagcctgcc

SEQ ID NO: 2738078 - DNA, 23 bp, Homo sapiens
gacgtcctggaatgaagcatgta

SEQ ID NO: 2738079 - DNA, 17 bp, Homo sapiens
gacgtgactcagagctt

SEQ ID NO: 2738080 - DNA, 22 bp, Homo sapiens
gactagggcctcggaggctcct

SEQ ID NO: 2738081 - DNA, 19 bp, Homo sapiens
gactatgcgtttttataaa

SEQ ID NO: 2738082 - DNA, 18 bp, Homo sapiens
gactcagactcctggctt

SEQ ID NO: 2738083 - DNA, 12 bp, Homo sapiens
gactcagagctt

SEQ ID NO: 2738084 - DNA, 19 bp, Homo sapiens
gactccagcacgttttctg

SEQ ID NO: 2738085 - DNA, 12 bp, Homo sapiens
gactcctggctt

SEQ ID NO: 2738086 - DNA, 17 bp, Homo sapiens
gactcctggcttcatgt

SEQ ID NO: 2738087 - DNA, 19 bp, Homo sapiens
gactcgggctcctgtgccc

SEQ ID NO: 2738088 - DNA, 20 bp, Homo sapiens
gactcgggctcctgtgccct

SEQ ID NO: 2738089 - DNA, 21 bp, Homo sapiens
gactctacctgcaagatttca

SEQ ID NO: 2738090 - DNA, 13 bp, Homo sapiens
gactctctgcctg

SEQ ID NO: 2738091 - DNA, 16 bp, Homo sapiens
gactctctgcctgctt

SEQ ID NO: 2738092 - DNA, 15 bp, Homo sapiens
gactctctgtgacct

SEQ ID NO: 2738093 - DNA, 22 bp, Homo sapiens
gactctgaggctctttctgggc

SEQ ID NO: 2738094 - DNA, 22 bp, Homo sapiens
gactctgcagatagtgcctctg

SEQ ID NO: 2738095 - DNA, 14 bp, Homo sapiens
gactctgtgagatt

SEQ ID NO: 2738096 - DNA, 17 bp, Homo sapiens
gactcttccaccagagc

SEQ ID NO: 2738097 - DNA, 12 bp, Homo sapiens
gactcttcctgc

SEQ ID NO: 2738098 - DNA, 13 bp, Homo sapiens
gactcttcctgca

SEQ ID NO: 2738099 - DNA, 21 bp, Homo sapiens
gactctttttgtacctggtga

SEQ ID NO: 2738100 - DNA, 23 bp, Homo sapiens
gactgcgccacggcactccagcc

SEQ ID NO: 2738101 - DNA, 24 bp, Homo sapiens
gactgcgccacggcactccagcct

SEQ ID NO: 2738102 - DNA, 15 bp, Homo sapiens
gactgcggagcagcc

SEQ ID NO: 2738103 - DNA, 16 bp, Homo sapiens
gactggctggctgcag

SEQ ID NO: 2738104 - DNA, 14 bp, Homo sapiens
gacttcactgcagc

SEQ ID NO: 2738105 - DNA, 16 bp, Homo sapiens
gacttcactgcagcct

SEQ ID NO: 2738106 - DNA, 19 bp, Homo sapiens
gacttcactgcagcctttc

SEQ ID NO: 2738107 - DNA, 15 bp, Homo sapiens
gacttcaggagctga

SEQ ID NO: 2738108 - DNA, 20 bp, Homo sapiens
gacttcaggggctgcccgct

SEQ ID NO: 2738109 - DNA, 23 bp, Homo sapiens
gacttcaggggctgcccgctccc

SEQ ID NO: 2738110 - DNA, 19 bp, Homo sapiens
gacttcctcgcctctccca

SEQ ID NO: 2738111 - DNA, 23 bp, Homo sapiens
gacttcctggtgaggcccagcct

SEQ ID NO: 2738112 - DNA, 20 bp, Homo sapiens
gacttgaattttcccactgc

SEQ ID NO: 2738113 - DNA, 21 bp, Homo sapiens
gacttgaattttcccactgca

SEQ ID NO: 2738114 - DNA, 11 bp, Homo sapiens
gacttgcctgg

SEQ ID NO: 2738115 - DNA, 14 bp, Homo sapiens
gacttgcctggggc

SEQ ID NO: 2738116 - DNA, 22 bp, Homo sapiens
gacttgctttaaatagatttca

SEQ ID NO: 2738117 - DNA, 13 bp, Homo sapiens
gactttgtgatcc

SEQ ID NO: 2738118 - DNA, 18 bp, Homo sapiens
gacttttccatgtatcta

SEQ ID NO: 2738119 - DNA, 15 bp, Homo sapiens
gacttttttctaaac

SEQ ID NO: 2738120 - DNA, 17 bp, Homo sapiens
gagaaaaatggcctgca

SEQ ID NO: 2738121 - DNA, 13 bp, Homo sapiens
gagaaaactgaga

SEQ ID NO: 2738122 - DNA, 16 bp, Homo sapiens
gagaaaacttatttga

SEQ ID NO: 2738123 - DNA, 16 bp, Homo sapiens
gagaaaatgcaggaga

SEQ ID NO: 2738124 - DNA, 17 bp, Homo sapiens
gagaaacaggctctgag

SEQ ID NO: 2738125 - DNA, 18 bp, Homo sapiens
gagaaatttttttccaga

SEQ ID NO: 2738126 - DNA, 14 bp, Homo sapiens
gagaaggcctcccc

SEQ ID NO: 2738127 - DNA, 15 bp, Homo sapiens
gagaaggcctcccct

SEQ ID NO: 2738128 - DNA, 16 bp, Homo sapiens
gagaagggcctgctct

SEQ ID NO: 2738129 - DNA, 15 bp, Homo sapiens
gagacctttgcccac

SEQ ID NO: 2738130 - DNA, 13 bp, Homo sapiens
gcaggaggcagga

SEQ ID NO: 2738131 - DNA, 19 bp, Homo sapiens
gcaggatgcgctgggacgg

SEQ ID NO: 2738132 - DNA, 13 bp, Homo sapiens
gcaggcacagcac

SEQ ID NO: 2738133 - DNA, 18 bp, Homo sapiens
gcaggcacagcacaggga

SEQ ID NO: 2738134 - DNA, 18 bp, Homo sapiens
gcaggcagcgcctgtccc

SEQ ID NO: 2738135 - DNA, 20 bp, Homo sapiens
gcaggccaagagcagaggca

SEQ ID NO: 2738136 - DNA, 24 bp, Homo sapiens
gcaggccaagagcagaggcagcga

SEQ ID NO: 2738137 - DNA, 15 bp, Homo sapiens
gcaggccctgcactg

SEQ ID NO: 2738138 - DNA, 20 bp, Homo sapiens
gcaggccctgcactgtcctg

SEQ ID NO: 2738139 - DNA, 21 bp, Homo sapiens
gcaggccctgcactgtcctgc

SEQ ID NO: 2738140 - DNA, 14 bp, Homo sapiens
gcagggacaccccc

SEQ ID NO: 2738141 - DNA, 18 bp, Homo sapiens
gcagggagcaactctcca

SEQ ID NO: 2738142 - DNA, 22 bp, Homo sapiens
gcagggagccgagatcacgcca

SEQ ID NO: 2738143 - DNA, 14 bp, Homo sapiens
gcagggatttgagg

SEQ ID NO: 2738144 - DNA, 14 bp, Homo sapiens
gcagggcctgctac

SEQ ID NO: 2738145 - DNA, 12 bp, Homo sapiens
gcaggggactgg

SEQ ID NO: 2738146 - DNA, 15 bp, Homo sapiens
gcaggggctgctggg

SEQ ID NO: 2738147 - DNA, 13 bp, Homo sapiens
gcagggtcttgct

SEQ ID NO: 2738148 - DNA, 15 bp, Homo sapiens
gcaggtgctgctacc

SEQ ID NO: 2738149 - DNA, 22 bp, Homo sapiens
gcaggtgctgctaccctccctg

SEQ ID NO: 2738150 - DNA, 23 bp, Homo sapiens
gcaggtgctgctaccctccctgc

SEQ ID NO: 2738151 - DNA, 22 bp, Homo sapiens
gcaggttgaggggctcctggaa

SEQ ID NO: 2738152 - DNA, 18 bp, Homo sapiens
gcagtaaactttctctgc

SEQ ID NO: 2738153 - DNA, 18 bp, Homo sapiens
gcagtaagtcttttttga

SEQ ID NO: 2738154 - DNA, 13 bp, Homo sapiens
gcagtctgaagga

SEQ ID NO: 2738155 - DNA, 18 bp, Homo sapiens
gcagtcttttgctgtgct

SEQ ID NO: 2738156 - DNA, 21 bp, Homo sapiens
gcagtgaacacactcagcagc

SEQ ID NO: 2738157 - DNA, 23 bp, Homo sapiens
gcagtgaacacactcagcagccc

SEQ ID NO: 2738158 - DNA, 15 bp, Homo sapiens
gcagtgaactgagac

SEQ ID NO: 2738159 - DNA, 16 bp, Homo sapiens
gcagtgaactgagact

SEQ ID NO: 2738160 - DNA, 22 bp, Homo sapiens
gcagtgattgttatgccttgct

SEQ ID NO: 2738161 - DNA, 21 bp, Homo sapiens
gcagtgccctctggacagctt

SEQ ID NO: 2738162 - DNA, 13 bp, Homo sapiens
gcagtgtttgtat

SEQ ID NO: 2738163 - DNA, 14 bp, Homo sapiens
gcagttctgtgtcc

SEQ ID NO: 2738164 - DNA, 17 bp, Homo sapiens
gcatagtcactgtctca

SEQ ID NO: 2738165 - DNA, 17 bp, Homo sapiens
gcatatccattgtggaa

SEQ ID NO: 2738166 - DNA, 18 bp, Homo sapiens
gcatatccattgtggaaa

SEQ ID NO: 2738167 - DNA, 18 bp, Homo sapiens
gcatatctctagtccctg

SEQ ID NO: 2738168 - DNA, 15 bp, Homo sapiens
gcatcaaacatgaaa

SEQ ID NO: 2738169 - DNA, 16 bp, Homo sapiens
gcatcaaacatgaaaa

SEQ ID NO: 2738170 - DNA, 13 bp, Homo sapiens
gcatcaatacaac

SEQ ID NO: 2738171 - DNA, 19 bp, Homo sapiens
gcatcaatacaaccagccc

SEQ ID NO: 2738172 - DNA, 17 bp, Homo sapiens
gcatcacagggcagagc

SEQ ID NO: 2738173 - DNA, 18 bp, Homo sapiens
gcatcctccccaccagag

SEQ ID NO: 2738174 - DNA, 19 bp, Homo sapiens
gcatcctccccaccagagc

SEQ ID NO: 2738175 - DNA, 21 bp, Homo sapiens
gcatcctggctggctgtgtcc

SEQ ID NO: 2738176 - DNA, 22 bp, Homo sapiens
gcatctccctgaccttctccag

SEQ ID NO: 2738177 - DNA, 20 bp, Homo sapiens
gcatctctgagtgtctctgc

SEQ ID NO: 2738178 - DNA, 22 bp, Homo sapiens
gcatctctgagtgtctctgcct

SEQ ID NO: 2738179 - DNA, 24 bp, Homo sapiens
gcatctctgagtgtctctgcctgg

SEQ ID NO: 2738180 - DNA, 17 bp, Homo sapiens
gcatgaattcacaaaca

SEQ ID NO: 2738181 - DNA, 20 bp, Homo sapiens
gcatgaattcacaaacaaat

SEQ ID NO: 2738182 - DNA, 11 bp, Homo sapiens
gcatgagtggc

SEQ ID NO: 2738183 - DNA, 20 bp, Homo sapiens
gcatgccccctcgtgccagt

SEQ ID NO: 2738184 - DNA, 12 bp, Homo sapiens
gcatgcctcagc

SEQ ID NO: 2738185 - DNA, 16 bp, Homo sapiens
gcatgcctcagccagc

SEQ ID NO: 2738186 - DNA, 20 bp, Homo sapiens
gcatgcctcagccagccctg

SEQ ID NO: 2738187 - DNA, 13 bp, Homo sapiens
gcatgctggggca

SEQ ID NO: 2738188 - DNA, 16 bp, Homo sapiens
gcatgctggggcaagt

SEQ ID NO: 2738189 - DNA, 13 bp, Homo sapiens
gcatggaatttgt

SEQ ID NO: 2738190 - DNA, 14 bp, Homo sapiens
gcatggcactgacc

SEQ ID NO: 2738191 - DNA, 18 bp, Homo sapiens
gcatggcactgaccgccg

SEQ ID NO: 2738192 - DNA, 16 bp, Homo sapiens
gcatggcagctgggcc

SEQ ID NO: 2738193 - DNA, 17 bp, Homo sapiens
gcatggcagctgggccc

SEQ ID NO: 2738194 - DNA, 23 bp, Homo sapiens
gcatggcagctgggcccacagcc

SEQ ID NO: 2738195 - DNA, 23 bp, Homo sapiens
gcatggggataaaggagaaggca

SEQ ID NO: 2738196 - DNA, 20 bp, Homo sapiens
gcatgtaaaatcttcagctg

SEQ ID NO: 2738197 - DNA, 19 bp, Homo sapiens
gcattcacagcgcctcctg

SEQ ID NO: 2738198 - DNA, 20 bp, Homo sapiens
gcattcacagcgcctcctgg

SEQ ID NO: 2738199 - DNA, 12 bp, Homo sapiens
gcattcatgttt

SEQ ID NO: 2738200 - DNA, 17 bp, Homo sapiens
gcattcccggtgcagaa

SEQ ID NO: 2738201 - DNA, 15 bp, Homo sapiens
gcattctagtgcaga

SEQ ID NO: 2738202 - DNA, 13 bp, Homo sapiens
gcattctctctgc

SEQ ID NO: 2738203 - DNA, 15 bp, Homo sapiens
gcattctctctgctc

SEQ ID NO: 2738204 - DNA, 15 bp, Homo sapiens
gcattctgagctggg

SEQ ID NO: 2738205 - DNA, 16 bp, Homo sapiens
gcattctgagctgggc

SEQ ID NO: 2738206 - DNA, 15 bp, Homo sapiens
gcattggcagcaggt

SEQ ID NO: 2738207 - DNA, 22 bp, Homo sapiens
gcattttcacattttgcctttc

SEQ ID NO: 2738208 - DNA, 15 bp, Homo sapiens
gcattttcagcatca

SEQ ID NO: 2738209 - DNA, 23 bp, Homo sapiens
gcattttgaatgtgatcatcttt

SEQ ID NO: 2738210 - DNA, 21 bp, Homo sapiens
gccaaaacaatgcccgtaaga

SEQ ID NO: 2738211 - DNA, 13 bp, Homo sapiens
gccaacagccccc

SEQ ID NO: 2738212 - DNA, 18 bp, Homo sapiens
gccaacggcaacagcatg

SEQ ID NO: 2738213 - DNA, 20 bp, Homo sapiens
gccaagagcagaggcagcga

SEQ ID NO: 2738214 - DNA, 18 bp, Homo sapiens
gccaaggctgagagctct

SEQ ID NO: 2738215 - DNA, 22 bp, Homo sapiens
gccaaggtttcccagtgagcct

SEQ ID NO: 2738216 - DNA, 23 bp, Homo sapiens
gccaaggtttcccagtgagcctc

SEQ ID NO: 2738217 - DNA, 11 bp, Homo sapiens
gccaattttgt

SEQ ID NO: 2738218 - DNA, 17 bp, Homo sapiens
gccacaccaagctgtgc

SEQ ID NO: 2738219 - DNA, 19 bp, Homo sapiens
gccacaccaagctgtgcca

SEQ ID NO: 2738220 - DNA, 12 bp, Homo sapiens
gccacactgggc

SEQ ID NO: 2738221 - DNA, 13 bp, Homo sapiens
gccacactgggct

SEQ ID NO: 2738222 - DNA, 15 bp, Homo sapiens
gccacactgggctca

SEQ ID NO: 2738223 - DNA, 19 bp, Homo sapiens
gccaccacccaacctgtcc

SEQ ID NO: 2738224 - DNA, 23 bp, Homo sapiens
gccaccatattcagtgctgtggc

SEQ ID NO: 2738225 - DNA, 13 bp, Homo sapiens
gccaccctgggct

SEQ ID NO: 2738226 - DNA, 13 bp, Homo sapiens
gccaccgcagctg

SEQ ID NO: 2738227 - DNA, 14 bp, Homo sapiens
gccaccgcagctgc

SEQ ID NO: 2738228 - DNA, 15 bp, Homo sapiens
gccaccgcagctgct

SEQ ID NO: 2738229 - DNA, 18 bp, Homo sapiens
gccaccgcagctgctgcc

SEQ ID NO: 2738230 - DNA, 21 bp, Homo sapiens
gccaccgcagctgctgccact

SEQ ID NO: 2738231 - DNA, 23 bp, Homo sapiens
gccaccgcagctgctgccactct

SEQ ID NO: 2738232 - DNA, 16 bp, Homo sapiens
gccaccgcgcccagcc

SEQ ID NO: 2738233 - DNA, 19 bp, Homo sapiens
gccactacactccagcctg

SEQ ID NO: 2738234 - DNA, 23 bp, Homo sapiens
gccactacactccagcctgagca

SEQ ID NO: 2738235 - DNA, 15 bp, Homo sapiens
gccactacctttgtc

SEQ ID NO: 2738236 - DNA, 16 bp, Homo sapiens
gccactacctttgtcc

SEQ ID NO: 2738237 - DNA, 16 bp, Homo sapiens
gccactccccagtgct

SEQ ID NO: 2738238 - DNA, 15 bp, Homo sapiens
gccactctgctgcct

SEQ ID NO: 2738239 - DNA, 19 bp, Homo sapiens
gccactgcactccagcctg

SEQ ID NO: 2738240 - DNA, 20 bp, Homo sapiens
gccactgcactccagcctgg

SEQ ID NO: 2738241 - DNA, 21 bp, Homo sapiens
gccactgcactccagcctggg

SEQ ID NO: 2738242 - DNA, 17 bp, Homo sapiens
gccagagctgagtggca

SEQ ID NO: 2738243 - DNA, 14 bp, Homo sapiens
gccagccccacagc

SEQ ID NO: 2738244 - DNA, 14 bp, Homo sapiens
gccagccctggagg

SEQ ID NO: 2738245 - DNA, 15 bp, Homo sapiens
gccagccctggaggc

SEQ ID NO: 2738246 - DNA, 12 bp, Homo sapiens
gccagcctggct

SEQ ID NO: 2738247 - DNA, 19 bp, Homo sapiens
gccagctctgtcaccctgg

SEQ ID NO: 2738248 - DNA, 17 bp, Homo sapiens
gccaggactccttagac

SEQ ID NO: 2738249 - DNA, 21 bp, Homo sapiens
gccaggctgtaagcattctga

SEQ ID NO: 2738250 - DNA, 17 bp, Homo sapiens
gccagggccctgcagag

SEQ ID NO: 2738251 - DNA, 14 bp, Homo sapiens
gccagggcttgtgg

SEQ ID NO: 2738252 - DNA, 22 bp, Homo sapiens
gccagggcttgtggactctctg

SEQ ID NO: 2738253 - DNA, 13 bp, Homo sapiens
gccaggtgcagtg

SEQ ID NO: 2738254 - DNA, 18 bp, Homo sapiens
gctgctgggggctcccct

SEQ ID NO: 2738255 - DNA, 19 bp, Homo sapiens
gctgctgggggctcccctt

SEQ ID NO: 2738256 - DNA, 15 bp, Homo sapiens
gctgctgtggcatca

SEQ ID NO: 2738257 - DNA, 23 bp, Homo sapiens
gctggaaaagggctcagagctgc

SEQ ID NO: 2738258 - DNA, 15 bp, Homo sapiens
gctggactctggcac

SEQ ID NO: 2738259 - DNA, 19 bp, Homo sapiens
gctggactctggcacccag

SEQ ID NO: 2738260 - DNA, 19 bp, Homo sapiens
gctggatgagcaactcctg

SEQ ID NO: 2738261 - DNA, 14 bp, Homo sapiens
gctggcagcctcca

SEQ ID NO: 2738262 - DNA, 15 bp, Homo sapiens
gctggcagcctccag

SEQ ID NO: 2738263 - DNA, 15 bp, Homo sapiens
gctggccagccccac

SEQ ID NO: 2738264 - DNA, 20 bp, Homo sapiens
gctggcccacagctctgctg

SEQ ID NO: 2738265 - DNA, 22 bp, Homo sapiens
gctggcccacagctctgctgga

SEQ ID NO: 2738266 - DNA, 23 bp, Homo sapiens
gctggcctctagaacacccactg

SEQ ID NO: 2738267 - DNA, 13 bp, Homo sapiens
gctggcctcttgg

SEQ ID NO: 2738268 - DNA, 18 bp, Homo sapiens
gctggcctcttggcacct

SEQ ID NO: 2738269 - DNA, 15 bp, Homo sapiens
gctggcggcgcagag

SEQ ID NO: 2738270 - DNA, 13 bp, Homo sapiens
gctggctgcagtg

SEQ ID NO: 2738271 - DNA, 16 bp, Homo sapiens
gctggctgctggccca

SEQ ID NO: 2738272 - DNA, 15 bp, Homo sapiens
gctggctgggcatgg

SEQ ID NO: 2738273 - DNA, 16 bp, Homo sapiens
gctggctgggcatgga

SEQ ID NO: 2738274 - DNA, 13 bp, Homo sapiens
gctggctgtgtcc

SEQ ID NO: 2738275 - DNA, 15 bp, Homo sapiens
gctggctgtgtcctc

SEQ ID NO: 2738276 - DNA, 13 bp, Homo sapiens
gctgggcccacag

SEQ ID NO: 2738277 - DNA, 14 bp, Homo sapiens
gctgggcccacagc

SEQ ID NO: 2738278 - DNA, 20 bp, Homo sapiens
gctgggcccacagcccccac

SEQ ID NO: 2738279 - DNA, 21 bp, Homo sapiens
gctgggcccacagcccccacc

SEQ ID NO: 2738280 - DNA, 23 bp, Homo sapiens
gctgggctacaaaccaggagcaa

SEQ ID NO: 2738281 - DNA, 20 bp, Homo sapiens
gctgggctcttaactgttgc

SEQ ID NO: 2738282 - DNA, 21 bp, Homo sapiens
gctgggctcttaactgttgct

SEQ ID NO: 2738283 - DNA, 15 bp, Homo sapiens
gctgggctggggcct

SEQ ID NO: 2738284 - DNA, 14 bp, Homo sapiens
gctgggctgggtgc

SEQ ID NO: 2738285 - DNA, 21 bp, Homo sapiens
gctggggcctatcagtgtgcc

SEQ ID NO: 2738286 - DNA, 12 bp, Homo sapiens
gctggggcctga

SEQ ID NO: 2738287 - DNA, 19 bp, Homo sapiens
gctggggcctgatggggag

SEQ ID NO: 2738288 - DNA, 17 bp, Homo sapiens
gctgggttggcgcaccc

SEQ ID NO: 2738289 - DNA, 22 bp, Homo sapiens
gctgggttggcgcaccctcccc

SEQ ID NO: 2738290 - DNA, 16 bp, Homo sapiens
gctggtggattgggca

SEQ ID NO: 2738291 - DNA, 14 bp, Homo sapiens
gctgtaaatataaa

SEQ ID NO: 2738292 - DNA, 19 bp, Homo sapiens
gctgtaagcattctgagct

SEQ ID NO: 2738293 - DNA, 19 bp, Homo sapiens
gctgtacattactgtatgt

SEQ ID NO: 2738294 - DNA, 21 bp, Homo sapiens
gctgtagaactctgcaggcag

SEQ ID NO: 2738295 - DNA, 22 bp, Homo sapiens
gctgtagaactctgcaggcaga

SEQ ID NO: 2738296 - DNA, 15 bp, Homo sapiens
gctgtagctcccgag

SEQ ID NO: 2738297 - DNA, 15 bp, Homo sapiens
gctgtatacaaacag

SEQ ID NO: 2738298 - DNA, 13 bp, Homo sapiens
gctgtcctaggcc

SEQ ID NO: 2738299 - DNA, 18 bp, Homo sapiens
gctgtcggtgtgctgtca

SEQ ID NO: 2738300 - DNA, 12 bp, Homo sapiens
gctgtgccaccc

SEQ ID NO: 2738301 - DNA, 15 bp, Homo sapiens
gctgtgccaccctgg

SEQ ID NO: 2738302 - DNA, 22 bp, Homo sapiens
gctgtggaaaggattctaaaca

SEQ ID NO: 2738303 - DNA, 21 bp, Homo sapiens
gctgttacctgagatactgaa

SEQ ID NO: 2738304 - DNA, 19 bp, Homo sapiens
gcttactaatgtgccccat

SEQ ID NO: 2738305 - DNA, 17 bp, Homo sapiens
gcttaggtgccaggctg

SEQ ID NO: 2738306 - DNA, 18 bp, Homo sapiens
gcttaggtgccaggctgt

SEQ ID NO: 2738307 - DNA, 23 bp, Homo sapiens
gcttcagcctgaggctgagactg

SEQ ID NO: 2738308 - DNA, 15 bp, Homo sapiens
gcttcagttgttttc

SEQ ID NO: 2738309 - DNA, 15 bp, Homo sapiens
gcttccaaggtggtc

SEQ ID NO: 2738310 - DNA, 19 bp, Homo sapiens
gcttccagcttcctctgag

SEQ ID NO: 2738311 - DNA, 16 bp, Homo sapiens
gcttcccaagtagctg

SEQ ID NO: 2738312 - DNA, 13 bp, Homo sapiens
gcttcccctccac

SEQ ID NO: 2738313 - DNA, 17 bp, Homo sapiens
gcttcccctccacccta

SEQ ID NO: 2738314 - DNA, 16 bp, Homo sapiens
gcttccctctgcctga

SEQ ID NO: 2738315 - DNA, 16 bp, Homo sapiens
gcttccctgggcctca

SEQ ID NO: 2738316 - DNA, 18 bp, Homo sapiens
gcttccctggggccccat

SEQ ID NO: 2738317 - DNA, 13 bp, Homo sapiens
gcttcctctgagc

SEQ ID NO: 2738318 - DNA, 22 bp, Homo sapiens
gcttccttggcatcacagggca

SEQ ID NO: 2738319 - DNA, 13 bp, Homo sapiens
gcttctgccactt

SEQ ID NO: 2738320 - DNA, 18 bp, Homo sapiens
gcttctgccacttcccag

SEQ ID NO: 2738321 - DNA, 16 bp, Homo sapiens
gcttctgctgggctgg

SEQ ID NO: 2738322 - DNA, 22 bp, Homo sapiens
gcttctgctgggctggggcctg

SEQ ID NO: 2738323 - DNA, 12 bp, Homo sapiens
gcttctggagcc

SEQ ID NO: 2738324 - DNA, 14 bp, Homo sapiens
gcttctggagccct

SEQ ID NO: 2738325 - DNA, 17 bp, Homo sapiens
gcttgaacccaggaggt

SEQ ID NO: 2738326 - DNA, 20 bp, Homo sapiens
gcttgaacccaggaggtgga

SEQ ID NO: 2738327 - DNA, 22 bp, Homo sapiens
gcttgactctactcccagcgct

SEQ ID NO: 2738328 - DNA, 15 bp, Homo sapiens
gcttgcctcggctcc

SEQ ID NO: 2738329 - DNA, 22 bp, Homo sapiens
gcttgcctcggctcctgctgca

SEQ ID NO: 2738330 - DNA, 19 bp, Homo sapiens
gcttggaaagcatcacctc

SEQ ID NO: 2738331 - DNA, 21 bp, Homo sapiens
gcttggaaagcatcacctcag

SEQ ID NO: 2738332 - DNA, 23 bp, Homo sapiens
gcttgtcaaatagcaaggccagg

SEQ ID NO: 2738333 - DNA, 21 bp, Homo sapiens
gcttgtggactctctgcctgc

SEQ ID NO: 2738334 - DNA, 22 bp, Homo sapiens
gcttgtggactctctgcctgct

SEQ ID NO: 2738335 - DNA, 12 bp, Homo sapiens
gcttgttttaaa

SEQ ID NO: 2738336 - DNA, 13 bp, Homo sapiens
gcttgttttaaaa

SEQ ID NO: 2738337 - DNA, 15 bp, Homo sapiens
gctttacaaataatt

SEQ ID NO: 2738338 - DNA, 23 bp, Homo sapiens
gctttataccccatttgatttcg

SEQ ID NO: 2738339 - DNA, 12 bp, Homo sapiens
gctttctccttt

SEQ ID NO: 2738340 - DNA, 21 bp, Homo sapiens
gctttcttctttccagacccc

SEQ ID NO: 2738341 - DNA, 19 bp, Homo sapiens
gctttgccatgggcctgct

SEQ ID NO: 2738342 - DNA, 20 bp, Homo sapiens
gctttgccatgggcctgctg

SEQ ID NO: 2738343 - DNA, 22 bp, Homo sapiens
gctttggctgcacgtcaccctc

SEQ ID NO: 2738344 - DNA, 16 bp, Homo sapiens
gctttgttcttgtcat

SEQ ID NO: 2738345 - DNA, 14 bp, Homo sapiens
gcttttctcccaga

SEQ ID NO: 2738346 - DNA, 17 bp, Homo sapiens
ggaaaaatgtcactgaa

SEQ ID NO: 2738347 - DNA, 14 bp, Homo sapiens
ggaaaagcctctgt

SEQ ID NO: 2738348 - DNA, 16 bp, Homo sapiens
ggaaagactgaaagaa

SEQ ID NO: 2738349 - DNA, 21 bp, Homo sapiens
ggaaagcaccgcagcatgtgg

SEQ ID NO: 2738350 - DNA, 18 bp, Homo sapiens
ggaaagcatcacctcagg

SEQ ID NO: 2738351 - DNA, 13 bp, Homo sapiens
ggaaagcctctgc

SEQ ID NO: 2738352 - DNA, 16 bp, Homo sapiens
ggaacacccggaaaga

SEQ ID NO: 2738353 - DNA, 18 bp, Homo sapiens
ggaacggggtccttcaag

SEQ ID NO: 2738354 - DNA, 17 bp, Homo sapiens
ggaactccccagggcct

SEQ ID NO: 2738355 - DNA, 18 bp, Homo sapiens
ggaactctaccctggtag

SEQ ID NO: 2738356 - DNA, 19 bp, Homo sapiens
ggaactgaagacctccaca

SEQ ID NO: 2738357 - DNA, 16 bp, Homo sapiens
ggaagaactgcatggg

SEQ ID NO: 2738358 - DNA, 15 bp, Homo sapiens
ggaagagaggcacct

SEQ ID NO: 2738359 - DNA, 23 bp, Homo sapiens
ggaagcaagacgtcctggaatga

SEQ ID NO: 2738360 - DNA, 20 bp, Homo sapiens
ggaagccatattcacacctc

SEQ ID NO: 2738361 - DNA, 14 bp, Homo sapiens
ggaagccctcggcc

SEQ ID NO: 2738362 - DNA, 23 bp, Homo sapiens
ggaagcgatgaatttggagactc

SEQ ID NO: 2738363 - DNA, 20 bp, Homo sapiens
ggaagcggaggttgcaggga

SEQ ID NO: 2738364 - DNA, 17 bp, Homo sapiens
ggaaggctggctgggca

SEQ ID NO: 2738365 - DNA, 15 bp, Homo sapiens
ggaagggagggagct

SEQ ID NO: 2738366 - DNA, 19 bp, Homo sapiens
ggaagggggctccatgctg

SEQ ID NO: 2738367 - DNA, 21 bp, Homo sapiens
ggaaggtactgaaggcttctg

SEQ ID NO: 2738368 - DNA, 15 bp, Homo sapiens
ggaatggaaggcttt

SEQ ID NO: 2738369 - DNA, 19 bp, Homo sapiens
ggaatttgtaagtttatgt

SEQ ID NO: 2738370 - DNA, 21 bp, Homo sapiens
ggaattttctttcatacatta

SEQ ID NO: 2738371 - DNA, 16 bp, Homo sapiens
ggacagaagcaggagt

SEQ ID NO: 2738372 - DNA, 13 bp, Homo sapiens
ggacagtcctggg

SEQ ID NO: 2738373 - DNA, 14 bp, Homo sapiens
ggacagtcctggga

SEQ ID NO: 2738374 - DNA, 16 bp, Homo sapiens
ggacagtgcttcagcc

SEQ ID NO: 2738375 - DNA, 21 bp, Homo sapiens
ggacagtgcttcagcctgagg

SEQ ID NO: 2738376 - DNA, 11 bp, Homo sapiens
ggaccctggcc

SEQ ID NO: 2738377 - DNA, 12 bp, Homo sapiens
ggaccctggcct

SEQ ID NO: 2738378 - DNA, 14 bp, Homo sapiens
ggccagcaggcagc

SEQ ID NO: 2738379 - DNA, 14 bp, Homo sapiens
ggccagccccacag

SEQ ID NO: 2738380 - DNA, 18 bp, Homo sapiens
ggccagccccacagccca

SEQ ID NO: 2738381 - DNA, 11 bp, Homo sapiens
ggccagggcct

SEQ ID NO: 2738382 - DNA, 23 bp, Homo sapiens
ggccaggtgggcgggcagcacag

SEQ ID NO: 2738383 - DNA, 21 bp, Homo sapiens
ggccaggttggaaaagaaatc

SEQ ID NO: 2738384 - DNA, 22 bp, Homo sapiens
ggccaggttggaaaagaaatca

SEQ ID NO: 2738385 - DNA, 20 bp, Homo sapiens
ggccagtcctagagctcctg

SEQ ID NO: 2738386 - DNA, 15 bp, Homo sapiens
ggccatactggcctc

SEQ ID NO: 2738387 - DNA, 19 bp, Homo sapiens
ggccatcttccaggtgggg

SEQ ID NO: 2738388 - DNA, 19 bp, Homo sapiens
ggcccacagcccccacccc

SEQ ID NO: 2738389 - DNA, 22 bp, Homo sapiens
ggcccacagcccccaccccagc

SEQ ID NO: 2738390 - DNA, 23 bp, Homo sapiens
ggcccacagcccccaccccagca

SEQ ID NO: 2738391 - DNA, 18 bp, Homo sapiens
ggcccagagcgaggaaag

SEQ ID NO: 2738392 - DNA, 15 bp, Homo sapiens
ggcccagcctgtcct

SEQ ID NO: 2738393 - DNA, 16 bp, Homo sapiens
ggcccagcctgtcctg

SEQ ID NO: 2738394 - DNA, 22 bp, Homo sapiens
ggcccatcagtgtacccccgcc

SEQ ID NO: 2738395 - DNA, 19 bp, Homo sapiens
ggcccatctgtccatcctc

SEQ ID NO: 2738396 - DNA, 22 bp, Homo sapiens
ggcccatctgtccatcctcctc

SEQ ID NO: 2738397 - DNA, 17 bp, Homo sapiens
ggccccaactacacacc

SEQ ID NO: 2738398 - DNA, 15 bp, Homo sapiens
ggccccagcctggcc

SEQ ID NO: 2738399 - DNA, 16 bp, Homo sapiens
ggccccagcctggccc

SEQ ID NO: 2738400 - DNA, 21 bp, Homo sapiens
ggccccagcctggcccagctc

SEQ ID NO: 2738401 - DNA, 22 bp, Homo sapiens
ggccccagcctggcccagctcc

SEQ ID NO: 2738402 - DNA, 20 bp, Homo sapiens
ggcccccactcacagggagc

SEQ ID NO: 2738403 - DNA, 13 bp, Homo sapiens
ggcccccagagac

SEQ ID NO: 2738404 - DNA, 18 bp, Homo sapiens
ggcccctcagggctgtcg

SEQ ID NO: 2738405 - DNA, 17 bp, Homo sapiens
ggcccctcaggggaagc

SEQ ID NO: 2738406 - DNA, 16 bp, Homo sapiens
ggccccttctccagca

SEQ ID NO: 2738407 - DNA, 14 bp, Homo sapiens
ggcccgcttgcctc

SEQ ID NO: 2738408 - DNA, 21 bp, Homo sapiens
ggcccgcttgcctcggctcct

SEQ ID NO: 2738409 - DNA, 14 bp, Homo sapiens
ggcccgggccttat

SEQ ID NO: 2738410 - DNA, 17 bp, Homo sapiens
ggcccgttgtctccctg

SEQ ID NO: 2738411 - DNA, 19 bp, Homo sapiens
ggcccgttgtctccctggc

SEQ ID NO: 2738412 - DNA, 23 bp, Homo sapiens
ggcccgttgtctccctggccctc

SEQ ID NO: 2738413 - DNA, 15 bp, Homo sapiens
ggccctgcactgtcc

SEQ ID NO: 2738414 - DNA, 23 bp, Homo sapiens
ggccctgcactgtcctgctccac

SEQ ID NO: 2738415 - DNA, 15 bp, Homo sapiens
ggccctgcccctccc

SEQ ID NO: 2738416 - DNA, 21 bp, Homo sapiens
ggccctgcccctccccctacc

SEQ ID NO: 2738417 - DNA, 12 bp, Homo sapiens
ggccctggtcct

SEQ ID NO: 2738418 - DNA, 17 bp, Homo sapiens
ggccctggtccttccag

SEQ ID NO: 2738419 - DNA, 18 bp, Homo sapiens
ggcccttggtagagctgg

SEQ ID NO: 2738420 - DNA, 13 bp, Homo sapiens
ggccgagccacct

SEQ ID NO: 2738421 - DNA, 14 bp, Homo sapiens
ggccggccaggtgg

SEQ ID NO: 2738422 - DNA, 15 bp, Homo sapiens
ggccggccaggtggg

SEQ ID NO: 2738423 - DNA, 13 bp, Homo sapiens
ggccggccctgcc

SEQ ID NO: 2738424 - DNA, 14 bp, Homo sapiens
ggccggccctgccc

SEQ ID NO: 2738425 - DNA, 15 bp, Homo sapiens
ggccggtgtgggctg

SEQ ID NO: 2738426 - DNA, 18 bp, Homo sapiens
ggcctaaagaatcccacc

SEQ ID NO: 2738427 - DNA, 20 bp, Homo sapiens
ggcctatcagtgtgcccccc

SEQ ID NO: 2738428 - DNA, 23 bp, Homo sapiens
ggcctatcagtgtgccccccatc

SEQ ID NO: 2738429 - DNA, 17 bp, Homo sapiens
ggcctcagcctccaggc

SEQ ID NO: 2738430 - DNA, 13 bp, Homo sapiens
ggcctccagactg

SEQ ID NO: 2738431 - DNA, 17 bp, Homo sapiens
ggcctccagactgcgga

SEQ ID NO: 2738432 - DNA, 23 bp, Homo sapiens
ggcctccagactgcggagcagcc

SEQ ID NO: 2738433 - DNA, 13 bp, Homo sapiens
ggcctcccctgag

SEQ ID NO: 2738434 - DNA, 15 bp, Homo sapiens
ggcctcccctgagga

SEQ ID NO: 2738435 - DNA, 22 bp, Homo sapiens
ggcctcccctgaggatcccctg

SEQ ID NO: 2738436 - DNA, 13 bp, Homo sapiens
ggcctcccttgag

SEQ ID NO: 2738437 - DNA, 14 bp, Homo sapiens
ggcctcgcctggcc

SEQ ID NO: 2738438 - DNA, 22 bp, Homo sapiens
ggcctcggaggctcctccctct

SEQ ID NO: 2738439 - DNA, 18 bp, Homo sapiens
ggcctctagaacacccac

SEQ ID NO: 2738440 - DNA, 22 bp, Homo sapiens
ggcctctagaacacccactggc

SEQ ID NO: 2738441 - DNA, 23 bp, Homo sapiens
ggcctctagaacacccactggcc

SEQ ID NO: 2738442 - DNA, 15 bp, Homo sapiens
ggcctcttggcacct

SEQ ID NO: 2738443 - DNA, 21 bp, Homo sapiens
ggcctgacctccagtcctgct

SEQ ID NO: 2738444 - DNA, 23 bp, Homo sapiens
ggcctgacctccagtcctgctgg

SEQ ID NO: 2738445 - DNA, 21 bp, Homo sapiens
ggcctgctcttacttccccca

SEQ ID NO: 2738446 - DNA, 19 bp, Homo sapiens
ggcctgctgcgtcagacca

SEQ ID NO: 2738447 - DNA, 15 bp, Homo sapiens
ggcgagaggaggggc

SEQ ID NO: 2738448 - DNA, 16 bp, Homo sapiens
ggcgcaccctcccctc

SEQ ID NO: 2738449 - DNA, 17 bp, Homo sapiens
ggcgcaccctcccctcc

SEQ ID NO: 2738450 - DNA, 14 bp, Homo sapiens
ggcgcgtctgcccc

SEQ ID NO: 2738451 - DNA, 20 bp, Homo sapiens
ggcgcgtctgccccaccctc

SEQ ID NO: 2738452 - DNA, 17 bp, Homo sapiens
ggcgggagtgggggctg

SEQ ID NO: 2738453 - DNA, 15 bp, Homo sapiens
ggcgggcagcacagc

SEQ ID NO: 2738454 - DNA, 14 bp, Homo sapiens
ggcgggggagccaa

SEQ ID NO: 2738455 - DNA, 18 bp, Homo sapiens
ggcgggggagccaacagc

SEQ ID NO: 2738456 - DNA, 22 bp, Homo sapiens
ggcgtcgctggacaacccagaa

SEQ ID NO: 2738457 - DNA, 18 bp, Homo sapiens
ggctaacatttaggagaa

SEQ ID NO: 2738458 - DNA, 19 bp, Homo sapiens
ggctaacatttaggagaag

SEQ ID NO: 2738459 - DNA, 19 bp, Homo sapiens
ggctaacgtttatttaaaa

SEQ ID NO: 2738460 - DNA, 14 bp, Homo sapiens
ggctagagtgcagt

SEQ ID NO: 2738461 - DNA, 20 bp, Homo sapiens
ggctagagtgcagtggcatg

SEQ ID NO: 2738462 - DNA, 22 bp, Homo sapiens
ggctagtctcttctcagagcag

SEQ ID NO: 2738463 - DNA, 20 bp, Homo sapiens
ggctcacgcctatgatccca

SEQ ID NO: 2738464 - DNA, 16 bp, Homo sapiens
ggctcagatcctgggc

SEQ ID NO: 2738465 - DNA, 16 bp, Homo sapiens
ggctcagctgtggtcc

SEQ ID NO: 2738466 - DNA, 19 bp, Homo sapiens
ggctcagctgtggtcccac

SEQ ID NO: 2738467 - DNA, 14 bp, Homo sapiens
ggctcagggaccac

SEQ ID NO: 2738468 - DNA, 14 bp, Homo sapiens
ggctcagtctcagg

SEQ ID NO: 2738469 - DNA, 15 bp, Homo sapiens
ggctcagtctcagga

SEQ ID NO: 2738470 - DNA, 17 bp, Homo sapiens
ggctcagtctcaggagc

SEQ ID NO: 2738471 - DNA, 13 bp, Homo sapiens
ggctcatcagaac

SEQ ID NO: 2738472 - DNA, 21 bp, Homo sapiens
ggctccagaatgtgctgcctt

SEQ ID NO: 2738473 - DNA, 16 bp, Homo sapiens
ggctccatgctggtgt

SEQ ID NO: 2738474 - DNA, 19 bp, Homo sapiens
ggctcccctgaggctggca

SEQ ID NO: 2738475 - DNA, 15 bp, Homo sapiens
ggctccctcctggag

SEQ ID NO: 2738476 - DNA, 12 bp, Homo sapiens
ggctcctccctc

SEQ ID NO: 2738477 - DNA, 16 bp, Homo sapiens
ggctcctccctctgcc

SEQ ID NO: 2738478 - DNA, 19 bp, Homo sapiens
ggctcctccctctgcctca

SEQ ID NO: 2738479 - DNA, 20 bp, Homo sapiens
ggctcctccctctgcctcat

SEQ ID NO: 2738480 - DNA, 15 bp, Homo sapiens
ggctcctgctgcacc

SEQ ID NO: 2738481 - DNA, 16 bp, Homo sapiens
ggctcctgctgcacca

SEQ ID NO: 2738482 - DNA, 21 bp, Homo sapiens
ggctcctgctgcaccaaccca

SEQ ID NO: 2738483 - DNA, 22 bp, Homo sapiens
ggctcctgctgcaccaacccag

SEQ ID NO: 2738484 - DNA, 14 bp, Homo sapiens
ggctcctgtgccct

SEQ ID NO: 2738485 - DNA, 15 bp, Homo sapiens
ggctcgccccaccca

SEQ ID NO: 2738486 - DNA, 14 bp, Homo sapiens
ggctctgccagcgt

SEQ ID NO: 2738487 - DNA, 20 bp, Homo sapiens
ggctctgccccagctctggc

SEQ ID NO: 2738488 - DNA, 21 bp, Homo sapiens
ggctctgccccagctctggct

SEQ ID NO: 2738489 - DNA, 14 bp, Homo sapiens
ggctctgtgggctg

SEQ ID NO: 2738490 - DNA, 18 bp, Homo sapiens
ggctctgtgggctgcact

SEQ ID NO: 2738491 - DNA, 18 bp, Homo sapiens
ggctcttaactgttgctc

SEQ ID NO: 2738492 - DNA, 16 bp, Homo sapiens
ggctgaacagtgctct

SEQ ID NO: 2738493 - DNA, 17 bp, Homo sapiens
ggctgaacagtgctctg

SEQ ID NO: 2738494 - DNA, 18 bp, Homo sapiens
ggctgaacagtgctctgc

SEQ ID NO: 2738495 - DNA, 15 bp, Homo sapiens
ggctgagagagtggc

SEQ ID NO: 2738496 - DNA, 17 bp, Homo sapiens
ggctgagagagtggcat

SEQ ID NO: 2738497 - DNA, 13 bp, Homo sapiens
ggctgagccctgg

SEQ ID NO: 2738498 - DNA, 15 bp, Homo sapiens
ggctgagccctggca

SEQ ID NO: 2738499 - DNA, 14 bp, Homo sapiens
ggctgagggcatct

SEQ ID NO: 2738500 - DNA, 17 bp, Homo sapiens
ggctgagggcatctctg

SEQ ID NO: 2738501 - DNA, 20 bp, Homo sapiens
ggctgcacgtcaccctcctg

SEQ ID NO: 2738502 - DNA, 13 bp, Homo sapiens
gtcctgctggcct

SEQ ID NO: 2738503 - DNA, 17 bp, Homo sapiens
gtcctgctggcctgctc

SEQ ID NO: 2738504 - DNA, 18 bp, Homo sapiens
gtcctgctggcctgctct

SEQ ID NO: 2738505 - DNA, 21 bp, Homo sapiens
gtcctgggagaacctcaggct

SEQ ID NO: 2738506 - DNA, 16 bp, Homo sapiens
gtcctggtacagcagg

SEQ ID NO: 2738507 - DNA, 14 bp, Homo sapiens
gtcctgtcagtgcc

SEQ ID NO: 2738508 - DNA, 22 bp, Homo sapiens
gtccttccaggcccccaccact

SEQ ID NO: 2738509 - DNA, 18 bp, Homo sapiens
gtccttggagtgctgcag

SEQ ID NO: 2738510 - DNA, 16 bp, Homo sapiens
gtcctttaggcagcct

SEQ ID NO: 2738511 - DNA, 17 bp, Homo sapiens
gtcctttaggcagcctg

SEQ ID NO: 2738512 - DNA, 18 bp, Homo sapiens
gtcctttaggcagcctgc

SEQ ID NO: 2738513 - DNA, 17 bp, Homo sapiens
gtcgctggacaacccag

SEQ ID NO: 2738514 - DNA, 19 bp, Homo sapiens
gtcgctggacaacccagaa

SEQ ID NO: 2738515 - DNA, 22 bp, Homo sapiens
gtcggcacgtcccatgtgcatg

SEQ ID NO: 2738516 - DNA, 14 bp, Homo sapiens
gtcgtgtctgctgt

SEQ ID NO: 2738517 - DNA, 22 bp, Homo sapiens
gtctcaaaatatttttttaaga

SEQ ID NO: 2738518 - DNA, 15 bp, Homo sapiens
gtctcacactcctcc

SEQ ID NO: 2738519 - DNA, 22 bp, Homo sapiens
gtctcacactcctcctgccagc

SEQ ID NO: 2738520 - DNA, 23 bp, Homo sapiens
gtctcacactcctcctgccagct

SEQ ID NO: 2738521 - DNA, 14 bp, Homo sapiens
gtctcctccaccgc

SEQ ID NO: 2738522 - DNA, 21 bp, Homo sapiens
gtctcctccaccgccatggct

SEQ ID NO: 2738523 - DNA, 15 bp, Homo sapiens
gtctcgaactcctga

SEQ ID NO: 2738524 - DNA, 16 bp, Homo sapiens
gtctcgctctgctgcc

SEQ ID NO: 2738525 - DNA, 21 bp, Homo sapiens
gtctcgctgatgctgggctgg

SEQ ID NO: 2738526 - DNA, 22 bp, Homo sapiens
gtctcggtggtaccaggtctcc

SEQ ID NO: 2738527 - DNA, 15 bp, Homo sapiens
gtctctctgcctgct

SEQ ID NO: 2738528 - DNA, 19 bp, Homo sapiens
gtctctctgcctgctgggc

SEQ ID NO: 2738529 - DNA, 22 bp, Homo sapiens
gtctctctgcctgctgggctct

SEQ ID NO: 2738530 - DNA, 15 bp, Homo sapiens
gtctctgaacatcct

SEQ ID NO: 2738531 - DNA, 18 bp, Homo sapiens
gtctctgcctggagcagg

SEQ ID NO: 2738532 - DNA, 23 bp, Homo sapiens
gtctctgcttggcttcccctcca

SEQ ID NO: 2738533 - DNA, 15 bp, Homo sapiens
gtctctggctcagct

SEQ ID NO: 2738534 - DNA, 18 bp, Homo sapiens
gtctctggctcagctgtg

SEQ ID NO: 2738535 - DNA, 19 bp, Homo sapiens
gtctctggctcagctgtgg

SEQ ID NO: 2738536 - DNA, 13 bp, Homo sapiens
gtctcttctcaga

SEQ ID NO: 2738537 - DNA, 17 bp, Homo sapiens
gtctcttctcagagcag

SEQ ID NO: 2738538 - DNA, 21 bp, Homo sapiens
gtctcttgactggctcaagaa

SEQ ID NO: 2738539 - DNA, 12 bp, Homo sapiens
gtctgaaggatt

SEQ ID NO: 2738540 - DNA, 22 bp, Homo sapiens
gtctgaccgacgatccctcgac

SEQ ID NO: 2738541 - DNA, 19 bp, Homo sapiens
gtctgcatcagctttttgt

SEQ ID NO: 2738542 - DNA, 13 bp, Homo sapiens
gtctgccccaccc

SEQ ID NO: 2738543 - DNA, 14 bp, Homo sapiens
gtctgccccaccct

SEQ ID NO: 2738544 - DNA, 15 bp, Homo sapiens
gtctgtctttgcaaa

SEQ ID NO: 2738545 - DNA, 17 bp, Homo sapiens
gtcttactttgtgcaaa

SEQ ID NO: 2738546 - DNA, 18 bp, Homo sapiens
gtcttataggtttccact

SEQ ID NO: 2738547 - DNA, 13 bp, Homo sapiens
gtcttccaacccc

SEQ ID NO: 2738548 - DNA, 15 bp, Homo sapiens
gtcttccaaccccag

SEQ ID NO: 2738549 - DNA, 17 bp, Homo sapiens
gtcttccaaccccagct

SEQ ID NO: 2738550 - DNA, 22 bp, Homo sapiens
gtcttccaaccccagctggcct

SEQ ID NO: 2738551 - DNA, 23 bp, Homo sapiens
gtcttccaaccccagctggcctc

SEQ ID NO: 2738552 - DNA, 12 bp, Homo sapiens
gtcttcctgtgg

SEQ ID NO: 2738553 - DNA, 17 bp, Homo sapiens
gtcttgacctgaactct

SEQ ID NO: 2738554 - DNA, 18 bp, Homo sapiens
gtcttgacctgaactctg

SEQ ID NO: 2738555 - DNA, 21 bp, Homo sapiens
gtctttctttgctgctgtgga

SEQ ID NO: 2738556 - DNA, 13 bp, Homo sapiens
gtgaaaaatgagc

SEQ ID NO: 2738557 - DNA, 16 bp, Homo sapiens
gtgaaaatatttaaag

SEQ ID NO: 2738558 - DNA, 16 bp, Homo sapiens
gtgaacaaagaaaaga

SEQ ID NO: 2738559 - DNA, 23 bp, Homo sapiens
gtgaacaaagaaaagacattgaa

SEQ ID NO: 2738560 - DNA, 20 bp, Homo sapiens
gtgaataaacttcagcacca

SEQ ID NO: 2738561 - DNA, 15 bp, Homo sapiens
gtgaattacactcaa

SEQ ID NO: 2738562 - DNA, 16 bp, Homo sapiens
gtgaatttaagcatga

SEQ ID NO: 2738563 - DNA, 22 bp, Homo sapiens
gtgaccccttttcagcttctgc

SEQ ID NO: 2738564 - DNA, 23 bp, Homo sapiens
gtgaccccttttcagcttctgct

SEQ ID NO: 2738565 - DNA, 17 bp, Homo sapiens
gtgacgtgactcagagc

SEQ ID NO: 2738566 - DNA, 14 bp, Homo sapiens
gtgactcagagctt

SEQ ID NO: 2738567 - DNA, 17 bp, Homo sapiens
gtgactcgggctcctgt

SEQ ID NO: 2738568 - DNA, 21 bp, Homo sapiens
gtgactcgggctcctgtgccc

SEQ ID NO: 2738569 - DNA, 17 bp, Homo sapiens
gtgagaagggcctgctc

SEQ ID NO: 2738570 - DNA, 18 bp, Homo sapiens
gtgagaagggcctgctct

SEQ ID NO: 2738571 - DNA, 16 bp, Homo sapiens
gtgagaggaaatgttg

SEQ ID NO: 2738572 - DNA, 16 bp, Homo sapiens
gtgaggccggccctgc

SEQ ID NO: 2738573 - DNA, 18 bp, Homo sapiens
gtgaggccggccctgccc

SEQ ID NO: 2738574 - DNA, 15 bp, Homo sapiens
gtgagtgtgactttt

SEQ ID NO: 2738575 - DNA, 18 bp, Homo sapiens
gtgagtgtgactttttga

SEQ ID NO: 2738576 - DNA, 19 bp, Homo sapiens
gtgatatccacaaatgcta

SEQ ID NO: 2738577 - DNA, 20 bp, Homo sapiens
gtgatcacgatccagtctgc

SEQ ID NO: 2738578 - DNA, 15 bp, Homo sapiens
gtgatcatctttgct

SEQ ID NO: 2738579 - DNA, 22 bp, Homo sapiens
gtgattatggacatcgatatga

SEQ ID NO: 2738580 - DNA, 19 bp, Homo sapiens
gtgattatttgttatttgt

SEQ ID NO: 2738581 - DNA, 15 bp, Homo sapiens
gtgattgactttttg

SEQ ID NO: 2738582 - DNA, 20 bp, Homo sapiens
gtgattggcaggaggcagga

SEQ ID NO: 2738583 - DNA, 20 bp, Homo sapiens
gtgatttcccgtggccccag

SEQ ID NO: 2738584 - DNA, 23 bp, Homo sapiens
gtgatttcccgtggccccagcct

SEQ ID NO: 2738585 - DNA, 14 bp, Homo sapiens
gtgatttttttgtc

SEQ ID NO: 2738586 - DNA, 13 bp, Homo sapiens
gtgcaaacagtgt

SEQ ID NO: 2738587 - DNA, 15 bp, Homo sapiens
gtgcaactcttgtat

SEQ ID NO: 2738588 - DNA, 18 bp, Homo sapiens
gtgcaactcttgtattgc

SEQ ID NO: 2738589 - DNA, 18 bp, Homo sapiens
gtgcacagcttcctgagt

SEQ ID NO: 2738590 - DNA, 16 bp, Homo sapiens
gtgcacctatggccca

SEQ ID NO: 2738591 - DNA, 17 bp, Homo sapiens
gtgcacctatggcccag

SEQ ID NO: 2738592 - DNA, 15 bp, Homo sapiens
gtgcagctcaggaga

SEQ ID NO: 2738593 - DNA, 23 bp, Homo sapiens
gtgcagggaggaggtggcagccc

SEQ ID NO: 2738594 - DNA, 15 bp, Homo sapiens
gtgcatgcaggtctc

SEQ ID NO: 2738595 - DNA, 20 bp, Homo sapiens
gtgcatgccttcataaatta

SEQ ID NO: 2738596 - DNA, 21 bp, Homo sapiens
gtgccaacagtgttaggcctg

SEQ ID NO: 2738597 - DNA, 12 bp, Homo sapiens
gtgccaattttg

SEQ ID NO: 2738598 - DNA, 22 bp, Homo sapiens
gtgccaccctgggctctgtggg

SEQ ID NO: 2738599 - DNA, 16 bp, Homo sapiens
gtgccagtcgcgctgc

SEQ ID NO: 2738600 - DNA, 17 bp, Homo sapiens
gtgccagtcgcgctgcc

SEQ ID NO: 2738601 - DNA, 19 bp, Homo sapiens
gtgccagtcgcgctgcctg

SEQ ID NO: 2738602 - DNA, 14 bp, Homo sapiens
gtgcccatgggcac

SEQ ID NO: 2738603 - DNA, 19 bp, Homo sapiens
gtgcccatgggcactgctg

SEQ ID NO: 2738604 - DNA, 21 bp, Homo sapiens
gtgcccatgggcactgctggg

SEQ ID NO: 2738605 - DNA, 16 bp, Homo sapiens
gtgcccattcctcacc

SEQ ID NO: 2738606 - DNA, 22 bp, Homo sapiens
gtgccgccgcctcgcccaccgc

SEQ ID NO: 2738607 - DNA, 23 bp, Homo sapiens
gtgccgccgcctcgcccaccgca

SEQ ID NO: 2738608 - DNA, 24 bp, Homo sapiens
gtgccgtagtcctttttgtaacta

SEQ ID NO: 2738609 - DNA, 18 bp, Homo sapiens
gtgcctcagtgctgcaat

SEQ ID NO: 2738610 - DNA, 16 bp, Homo sapiens
gtgcgaccccatctgc

SEQ ID NO: 2738611 - DNA, 21 bp, Homo sapiens
gtgctcgcctctgcccagcct

SEQ ID NO: 2738612 - DNA, 13 bp, Homo sapiens
gtgctctgcctct

SEQ ID NO: 2738613 - DNA, 18 bp, Homo sapiens
gtgctgcctctcttctgt

SEQ ID NO: 2738614 - DNA, 18 bp, Homo sapiens
gtgctgctaccctccctg

SEQ ID NO: 2738615 - DNA, 13 bp, Homo sapiens
gtgctggctgctg

SEQ ID NO: 2738616 - DNA, 15 bp, Homo sapiens
gtgctggctgctggc

SEQ ID NO: 2738617 - DNA, 16 bp, Homo sapiens
gtgctgtggcctgggc

SEQ ID NO: 2738618 - DNA, 14 bp, Homo sapiens
gtggaaagcctctg

SEQ ID NO: 2738619 - DNA, 16 bp, Homo sapiens
gtggaaaggattctaa

SEQ ID NO: 2738620 - DNA, 15 bp, Homo sapiens
gtggacagtcctggg

SEQ ID NO: 2738621 - DNA, 23 bp, Homo sapiens
gtggactgaaccgacttttctaa

SEQ ID NO: 2738622 - DNA, 17 bp, Homo sapiens
gtggaggttgcagtgaa

SEQ ID NO: 2738623 - DNA, 21 bp, Homo sapiens
gtggagttctctgttctagag

SEQ ID NO: 2738624 - DNA, 13 bp, Homo sapiens
gtggatcacctga

SEQ ID NO: 2738625 - DNA, 19 bp, Homo sapiens
tcagaattttggaaaaatg

SEQ ID NO: 2738626 - DNA, 15 bp, Homo sapiens
tcagactcctggctt

SEQ ID NO: 2738627 - DNA, 13 bp, Homo sapiens
tcagactgctggg

SEQ ID NO: 2738628 - DNA, 14 bp, Homo sapiens
tcagactgctggga

SEQ ID NO: 2738629 - DNA, 21 bp, Homo sapiens
tcagactgctgggactggcca

SEQ ID NO: 2738630 - DNA, 15 bp, Homo sapiens
tcagagcagcactgg

SEQ ID NO: 2738631 - DNA, 12 bp, Homo sapiens
tcagagcctcag

SEQ ID NO: 2738632 - DNA, 21 bp, Homo sapiens
tcagagctgcgggctgagggc

SEQ ID NO: 2738633 - DNA, 19 bp, Homo sapiens
tcagagctggcagcctcca

SEQ ID NO: 2738634 - DNA, 22 bp, Homo sapiens
tcagagcttttcgaactgtgct

SEQ ID NO: 2738635 - DNA, 23 bp, Homo sapiens
tcagagtgtccctttttgcaggg

SEQ ID NO: 2738636 - DNA, 14 bp, Homo sapiens
tcagatgcccagag

SEQ ID NO: 2738637 - DNA, 22 bp, Homo sapiens
tcagatgcccagagggcccagg

SEQ ID NO: 2738638 - DNA, 15 bp, Homo sapiens
tcagattcaggagct

SEQ ID NO: 2738639 - DNA, 22 bp, Homo sapiens
tcagattgtaaaggtaggtgca

SEQ ID NO: 2738640 - DNA, 12 bp, Homo sapiens
tcagattttctc

SEQ ID NO: 2738641 - DNA, 18 bp, Homo sapiens
tcagcaatagggtgcagt

SEQ ID NO: 2738642 - DNA, 12 bp, Homo sapiens
tcagcagcccca

SEQ ID NO: 2738643 - DNA, 16 bp, Homo sapiens
tcagcagccccacccc

SEQ ID NO: 2738644 - DNA, 15 bp, Homo sapiens
tcagcatcaaacatg

SEQ ID NO: 2738645 - DNA, 16 bp, Homo sapiens
tcagcatcaaacatga

SEQ ID NO: 2738646 - DNA, 18 bp, Homo sapiens
tcagcatcaaacatgaaa

SEQ ID NO: 2738647 - DNA, 13 bp, Homo sapiens
tcagccagccctg

SEQ ID NO: 2738648 - DNA, 16 bp, Homo sapiens
tcagccagccctggag

SEQ ID NO: 2738649 - DNA, 17 bp, Homo sapiens
tcagccagccctggagg

SEQ ID NO: 2738650 - DNA, 20 bp, Homo sapiens
tcagcctcccgagtagctgg

SEQ ID NO: 2738651 - DNA, 13 bp, Homo sapiens
tcagcctcctgag

SEQ ID NO: 2738652 - DNA, 24 bp, Homo sapiens
tcagccttccccctcccagggcca

SEQ ID NO: 2738653 - DNA, 21 bp, Homo sapiens
tcagctattcccttctgatct

SEQ ID NO: 2738654 - DNA, 18 bp, Homo sapiens
tcagctctcctgctgcag

SEQ ID NO: 2738655 - DNA, 18 bp, Homo sapiens
tcagctgtggtcccaccc

SEQ ID NO: 2738656 - DNA, 21 bp, Homo sapiens
tcagcttcccaagtagctgag

SEQ ID NO: 2738657 - DNA, 17 bp, Homo sapiens
tcagcttctgctgggct

SEQ ID NO: 2738658 - DNA, 18 bp, Homo sapiens
tcagcttctgctgggctg

SEQ ID NO: 2738659 - DNA, 21 bp, Homo sapiens
tcagcttctgctgggctgggg

SEQ ID NO: 2738660 - DNA, 20 bp, Homo sapiens
tcaggagagccctctgctgc

SEQ ID NO: 2738661 - DNA, 20 bp, Homo sapiens
tcaggagatggaagagtcat

SEQ ID NO: 2738662 - DNA, 23 bp, Homo sapiens
tcaggaggggaagaggcctttct

SEQ ID NO: 2738663 - DNA, 23 bp, Homo sapiens
tcaggctggtctcgaactcctga

SEQ ID NO: 2738664 - DNA, 17 bp, Homo sapiens
tcaggctttgtctgctc

SEQ ID NO: 2738665 - DNA, 16 bp, Homo sapiens
tcaggggaagctgcta

SEQ ID NO: 2738666 - DNA, 20 bp, Homo sapiens
tcaggggctgcccgctccca

SEQ ID NO: 2738667 - DNA, 20 bp, Homo sapiens
tcaggtgacggactcagact

SEQ ID NO: 2738668 - DNA, 21 bp, Homo sapiens
tcaggtgacggactcagactc

SEQ ID NO: 2738669 - DNA, 22 bp, Homo sapiens
tcaggtgtggcggtgcgtgcct

SEQ ID NO: 2738670 - DNA, 17 bp, Homo sapiens
tcagtaagtataacaaa

SEQ ID NO: 2738671 - DNA, 14 bp, Homo sapiens
tcagtctcaggagc

SEQ ID NO: 2738672 - DNA, 21 bp, Homo sapiens
tcagtgccgccgcctcgccca

SEQ ID NO: 2738673 - DNA, 15 bp, Homo sapiens
tcagtgctgtggcct

SEQ ID NO: 2738674 - DNA, 17 bp, Homo sapiens
tcagtgctgtggcctgg

SEQ ID NO: 2738675 - DNA, 19 bp, Homo sapiens
tcagtgctgtggcctgggc

SEQ ID NO: 2738676 - DNA, 22 bp, Homo sapiens
tcagtgctgtggcctgggcaag

SEQ ID NO: 2738677 - DNA, 17 bp, Homo sapiens
tcagtgtacccccgccc

SEQ ID NO: 2738678 - DNA, 21 bp, Homo sapiens
tcagtgtacccccgcccaggc

SEQ ID NO: 2738679 - DNA, 12 bp, Homo sapiens
tcagtgtatcta

SEQ ID NO: 2738680 - DNA, 19 bp, Homo sapiens
tcagtgtgccccccatcct

SEQ ID NO: 2738681 - DNA, 17 bp, Homo sapiens
tcagttcctctttgcat

SEQ ID NO: 2738682 - DNA, 19 bp, Homo sapiens
tcagttcctctttgcatgg

SEQ ID NO: 2738683 - DNA, 21 bp, Homo sapiens
tcagttcctctttgcatggaa

SEQ ID NO: 2738684 - DNA, 13 bp, Homo sapiens
tcataaagtatgc

SEQ ID NO: 2738685 - DNA, 18 bp, Homo sapiens
tcataaattatttctaaa

SEQ ID NO: 2738686 - DNA, 21 bp, Homo sapiens
tcataaattatttctaaaaca

SEQ ID NO: 2738687 - DNA, 19 bp, Homo sapiens
tcataaatttgttgtcatg

SEQ ID NO: 2738688 - DNA, 23 bp, Homo sapiens
tcataaatttgttgtcatgtgta

SEQ ID NO: 2738689 - DNA, 24 bp, Homo sapiens
tcataaatttgttgtcatgtgtat

SEQ ID NO: 2738690 - DNA, 13 bp, Homo sapiens
tcataattcacca

SEQ ID NO: 2738691 - DNA, 22 bp, Homo sapiens
tcataatttcagttctagttga

SEQ ID NO: 2738692 - DNA, 18 bp, Homo sapiens
tcatagtcaatcaaacag

SEQ ID NO: 2738693 - DNA, 18 bp, Homo sapiens
tcatataatttaaagaaa

SEQ ID NO: 2738694 - DNA, 16 bp, Homo sapiens
tcatatatgactttat

SEQ ID NO: 2738695 - DNA, 11 bp, Homo sapiens
tcatatgaaaa

SEQ ID NO: 2738696 - DNA, 21 bp, Homo sapiens
tcatatgaaaaaaatgcattt

SEQ ID NO: 2738697 - DNA, 21 bp, Homo sapiens
tcatattaattattttccaaa

SEQ ID NO: 2738698 - DNA, 22 bp, Homo sapiens
tcatcccatctaagctgcagct

SEQ ID NO: 2738699 - DNA, 16 bp, Homo sapiens
tcatcctcctcctcat

SEQ ID NO: 2738700 - DNA, 17 bp, Homo sapiens
tcatctggaggctgcgt

SEQ ID NO: 2738701 - DNA, 18 bp, Homo sapiens
tcatctgtgcctgtctgt

SEQ ID NO: 2738702 - DNA, 22 bp, Homo sapiens
tcatgcaagacttcactgcagc

SEQ ID NO: 2738703 - DNA, 14 bp, Homo sapiens
tcatggatttggtt

SEQ ID NO: 2738704 - DNA, 13 bp, Homo sapiens
tcatgtcatttct

SEQ ID NO: 2738705 - DNA, 16 bp, Homo sapiens
tcatgtcatttctcat

SEQ ID NO: 2738706 - DNA, 21 bp, Homo sapiens
tcatgtggcattctctctgct

SEQ ID NO: 2738707 - DNA, 17 bp, Homo sapiens
tcatgttggccaggctg

SEQ ID NO: 2738708 - DNA, 22 bp, Homo sapiens
tcatgttttaaaagtttgtcct

SEQ ID NO: 2738709 - DNA, 15 bp, Homo sapiens
tcattcagcagtcag

SEQ ID NO: 2738710 - DNA, 16 bp, Homo sapiens
tcattgatggagcctg

SEQ ID NO: 2738711 - DNA, 10 bp, Homo sapiens
tcatttctaa

SEQ ID NO: 2738712 - DNA, 21 bp, Homo sapiens
tccaaacactgggctctgagg

SEQ ID NO: 2738713 - DNA, 20 bp, Homo sapiens
tccaaagggcagtaaagttt

SEQ ID NO: 2738714 - DNA, 17 bp, Homo sapiens
tccaaatacattccagt

SEQ ID NO: 2738715 - DNA, 17 bp, Homo sapiens
tccaaatgctgtgcaaa

SEQ ID NO: 2738716 - DNA, 17 bp, Homo sapiens
tccaacaataaagagct

SEQ ID NO: 2738717 - DNA, 16 bp, Homo sapiens
tccaaccccagctggc

SEQ ID NO: 2738718 - DNA, 17 bp, Homo sapiens
tccaaccccagctggcc

SEQ ID NO: 2738719 - DNA, 19 bp, Homo sapiens
tccaaccccagctggcctc

SEQ ID NO: 2738720 - DNA, 17 bp, Homo sapiens
tccaaccccccacctgc

SEQ ID NO: 2738721 - DNA, 15 bp, Homo sapiens
tccaacccctccccc

SEQ ID NO: 2738722 - DNA, 19 bp, Homo sapiens
tccaaggcagttctgtgtc

SEQ ID NO: 2738723 - DNA, 21 bp, Homo sapiens
tccaaggcagttctgtgtcct

SEQ ID NO: 2738724 - DNA, 20 bp, Homo sapiens
tccaagtccaacctgcctgt

SEQ ID NO: 2738725 - DNA, 16 bp, Homo sapiens
tccacaaatgctattc

SEQ ID NO: 2738726 - DNA, 17 bp, Homo sapiens
tccacaacctcctcctc

SEQ ID NO: 2738727 - DNA, 14 bp, Homo sapiens
tccacagccgcagc

SEQ ID NO: 2738728 - DNA, 17 bp, Homo sapiens
tccacagccgcagcctc

SEQ ID NO: 2738729 - DNA, 23 bp, Homo sapiens
tccacagggacacagtctggtgc

SEQ ID NO: 2738730 - DNA, 20 bp, Homo sapiens
tccacagtggaaccagccca

SEQ ID NO: 2738731 - DNA, 13 bp, Homo sapiens
tccaccagagcag

SEQ ID NO: 2738732 - DNA, 21 bp, Homo sapiens
tccaccagagcaggggctgct

SEQ ID NO: 2738733 - DNA, 23 bp, Homo sapiens
tccaccagagcaggggctgctgg

SEQ ID NO: 2738734 - DNA, 15 bp, Homo sapiens
tccacctccacccac

SEQ ID NO: 2738735 - DNA, 12 bp, Homo sapiens
tccacctcctgg

SEQ ID NO: 2738736 - DNA, 13 bp, Homo sapiens
tccacctcctggg

SEQ ID NO: 2738737 - DNA, 22 bp, Homo sapiens
tccacctggccccttctccagc

SEQ ID NO: 2738738 - DNA, 18 bp, Homo sapiens
tccacgtgctcgcctctg

SEQ ID NO: 2738739 - DNA, 13 bp, Homo sapiens
tccacgtgtatgc

SEQ ID NO: 2738740 - DNA, 13 bp, Homo sapiens
tccactcccactt

SEQ ID NO: 2738741 - DNA, 12 bp, Homo sapiens
tccactgtttca

SEQ ID NO: 2738742 - DNA, 16 bp, Homo sapiens
tccagaatgtgctgcc

SEQ ID NO: 2738743 - DNA, 16 bp, Homo sapiens
tccagaccattgtctt

SEQ ID NO: 2738744 - DNA, 13 bp, Homo sapiens
tccagactgcgga

SEQ ID NO: 2738745 - DNA, 16 bp, Homo sapiens
tccagactgcggagca

SEQ ID NO: 2738746 - DNA, 17 bp, Homo sapiens
tccagcacgttttctgg

SEQ ID NO: 2738747 - DNA, 14 bp, Homo sapiens
tccagccagctcct

SEQ ID NO: 2738748 - DNA, 23 bp, Homo sapiens
tcgtttgatagtgcttcttgtaa

SEQ ID NO: 2738749 - DNA, 19 bp, Homo sapiens
tctaaaacattaattgagg

SEQ ID NO: 2738750 - DNA, 18 bp, Homo sapiens
tctaaagtttacagtaaa

SEQ ID NO: 2738751 - DNA, 13 bp, Homo sapiens
tctaaattcactg

SEQ ID NO: 2738752 - DNA, 14 bp, Homo sapiens
tctaaattcactgt

SEQ ID NO: 2738753 - DNA, 13 bp, Homo sapiens
tctaacattttct

SEQ ID NO: 2738754 - DNA, 22 bp, Homo sapiens
tctaaccaaagagtctctggct

SEQ ID NO: 2738755 - DNA, 12 bp, Homo sapiens
tctaagctgcag

SEQ ID NO: 2738756 - DNA, 18 bp, Homo sapiens
tctaagctgcagcttcct

SEQ ID NO: 2738757 - DNA, 19 bp, Homo sapiens
tctaagctgcagcttcctg

SEQ ID NO: 2738758 - DNA, 16 bp, Homo sapiens
tctaatccatgtgctg

SEQ ID NO: 2738759 - DNA, 12 bp, Homo sapiens
tctaccctgcag

SEQ ID NO: 2738760 - DNA, 18 bp, Homo sapiens
tctactcattccccgggg

SEQ ID NO: 2738761 - DNA, 13 bp, Homo sapiens
tctactcccagcg

SEQ ID NO: 2738762 - DNA, 15 bp, Homo sapiens
tctactcctcacagc

SEQ ID NO: 2738763 - DNA, 22 bp, Homo sapiens
tctagaacacccactggccagt

SEQ ID NO: 2738764 - DNA, 13 bp, Homo sapiens
tctagaagcagaa

SEQ ID NO: 2738765 - DNA, 15 bp, Homo sapiens
tctaggtcttggtta

SEQ ID NO: 2738766 - DNA, 15 bp, Homo sapiens
tctagtatctattgt

SEQ ID NO: 2738767 - DNA, 19 bp, Homo sapiens
tctagtccctgtgttctgc

SEQ ID NO: 2738768 - DNA, 14 bp, Homo sapiens
tctagtgccctcca

SEQ ID NO: 2738769 - DNA, 21 bp, Homo sapiens
tctagttgattgcgagaattt

SEQ ID NO: 2738770 - DNA, 18 bp, Homo sapiens
tctatggattatccactg

SEQ ID NO: 2738771 - DNA, 22 bp, Homo sapiens
tctatgtatgtgccaattttgt

SEQ ID NO: 2738772 - DNA, 19 bp, Homo sapiens
tctcaaagaaatttccact

SEQ ID NO: 2738773 - DNA, 14 bp, Homo sapiens
tctcaaatcaaata

SEQ ID NO: 2738774 - DNA, 15 bp, Homo sapiens
tctcaattttgtatt

SEQ ID NO: 2738775 - DNA, 17 bp, Homo sapiens
tctcacactcctcctgc

SEQ ID NO: 2738776 - DNA, 18 bp, Homo sapiens
tctcacactcctcctgcc

SEQ ID NO: 2738777 - DNA, 19 bp, Homo sapiens
tctcaccttaactcagcca

SEQ ID NO: 2738778 - DNA, 18 bp, Homo sapiens
tctcagcagccagctcct

SEQ ID NO: 2738779 - DNA, 22 bp, Homo sapiens
tctcaggtgacggactcagact

SEQ ID NO: 2738780 - DNA, 16 bp, Homo sapiens
tctccacaacctcctc

SEQ ID NO: 2738781 - DNA, 16 bp, Homo sapiens
tctccacctagtggct

SEQ ID NO: 2738782 - DNA, 22 bp, Homo sapiens
tctccactgtttcatgagccca

SEQ ID NO: 2738783 - DNA, 18 bp, Homo sapiens
tctccagatggagaaaca

SEQ ID NO: 2738784 - DNA, 16 bp, Homo sapiens
tctccaggtaactttg

SEQ ID NO: 2738785 - DNA, 20 bp, Homo sapiens
tctcccacgtgcacagcttc

SEQ ID NO: 2738786 - DNA, 21 bp, Homo sapiens
tctccctgaccttctccaggg

SEQ ID NO: 2738787 - DNA, 14 bp, Homo sapiens
tctccctggccctc

SEQ ID NO: 2738788 - DNA, 20 bp, Homo sapiens
tctcctccaccgccatggct

SEQ ID NO: 2738789 - DNA, 11 bp, Homo sapiens
tctcctcccac

SEQ ID NO: 2738790 - DNA, 16 bp, Homo sapiens
tctcctcccatggcct

SEQ ID NO: 2738791 - DNA, 13 bp, Homo sapiens
tctcctccctgtt

SEQ ID NO: 2738792 - DNA, 15 bp, Homo sapiens
tctcctgtatcattt

SEQ ID NO: 2738793 - DNA, 15 bp, Homo sapiens
tctcgaactcctgac

SEQ ID NO: 2738794 - DNA, 16 bp, Homo sapiens
tctcgacttcaggagc

SEQ ID NO: 2738795 - DNA, 15 bp, Homo sapiens
tctcgccctggccag

SEQ ID NO: 2738796 - DNA, 16 bp, Homo sapiens
tctcgccctggccagg

SEQ ID NO: 2738797 - DNA, 17 bp, Homo sapiens
tctcggaaggctggctg

SEQ ID NO: 2738798 - DNA, 23 bp, Homo sapiens
tctctattccaataaagcagagt

SEQ ID NO: 2738799 - DNA, 17 bp, Homo sapiens
tctctccagcctcacag

SEQ ID NO: 2738800 - DNA, 21 bp, Homo sapiens
tctctccagcctcacagatgc

SEQ ID NO: 2738801 - DNA, 22 bp, Homo sapiens
tctctcccacgtgcacagcttc

SEQ ID NO: 2738802 - DNA, 19 bp, Homo sapiens
tctctctactcctacctca

SEQ ID NO: 2738803 - DNA, 15 bp, Homo sapiens
tctctctgcctgctg

SEQ ID NO: 2738804 - DNA, 19 bp, Homo sapiens
tctctctgcctgctgggct

SEQ ID NO: 2738805 - DNA, 12 bp, Homo sapiens
tctctgcctgct

SEQ ID NO: 2738806 - DNA, 17 bp, Homo sapiens
tctctgcctgctgggct

SEQ ID NO: 2738807 - DNA, 17 bp, Homo sapiens
tctctgcctggagcagg

SEQ ID NO: 2738808 - DNA, 18 bp, Homo sapiens
tctctggattcctgtcat

SEQ ID NO: 2738809 - DNA, 15 bp, Homo sapiens
tctctggctcagctg

SEQ ID NO: 2738810 - DNA, 17 bp, Homo sapiens
tctctggctcagctgtg

SEQ ID NO: 2738811 - DNA, 19 bp, Homo sapiens
tctctggctcagctgtggt

SEQ ID NO: 2738812 - DNA, 21 bp, Homo sapiens
tctctgggtttacaacaaaca

SEQ ID NO: 2738813 - DNA, 15 bp, Homo sapiens
tctctgttaaagatc

SEQ ID NO: 2738814 - DNA, 23 bp, Homo sapiens
tctcttgccccaaatcacaaaca

SEQ ID NO: 2738815 - DNA, 21 bp, Homo sapiens
tctgaaagttgtcaccctgga

SEQ ID NO: 2738816 - DNA, 15 bp, Homo sapiens
tctgaacaattctct

SEQ ID NO: 2738817 - DNA, 20 bp, Homo sapiens
tctgaacaatttagggactc

SEQ ID NO: 2738818 - DNA, 17 bp, Homo sapiens
tctgaatattaagaaac

SEQ ID NO: 2738819 - DNA, 19 bp, Homo sapiens
tctgaatattaagaaacaa

SEQ ID NO: 2738820 - DNA, 15 bp, Homo sapiens
tctgaatgtcccaga

SEQ ID NO: 2738821 - DNA, 19 bp, Homo sapiens
tctgacaatgcgtggcaca

SEQ ID NO: 2738822 - DNA, 18 bp, Homo sapiens
tctgaccgggtctgcttc

SEQ ID NO: 2738823 - DNA, 17 bp, Homo sapiens
tctgacctgcaggccaa

SEQ ID NO: 2738824 - DNA, 19 bp, Homo sapiens
tctgacctgcaggccaaga

SEQ ID NO: 2738825 - DNA, 21 bp, Homo sapiens
tctgacctgcaggccaagagc

SEQ ID NO: 2738826 - DNA, 15 bp, Homo sapiens
tctgagatttcacag

SEQ ID NO: 2738827 - DNA, 17 bp, Homo sapiens
tctgaggccccaggccc

SEQ ID NO: 2738828 - DNA, 16 bp, Homo sapiens
tctgagtgtctctgcc

SEQ ID NO: 2738829 - DNA, 20 bp, Homo sapiens
tctgagtgtctctgcctgga

SEQ ID NO: 2738830 - DNA, 14 bp, Homo sapiens
tctgataatgtatt

SEQ ID NO: 2738831 - DNA, 17 bp, Homo sapiens
tctgataatgtattgca

SEQ ID NO: 2738832 - DNA, 15 bp, Homo sapiens
tctgatactgtatct

SEQ ID NO: 2738833 - DNA, 18 bp, Homo sapiens
tctgattcccagaaatac

SEQ ID NO: 2738834 - DNA, 23 bp, Homo sapiens
tctgattttgatattttcacaga

SEQ ID NO: 2738835 - DNA, 15 bp, Homo sapiens
tctgcaacatggatt

SEQ ID NO: 2738836 - DNA, 18 bp, Homo sapiens
tctgcaatgtttttgtgt

SEQ ID NO: 2738837 - DNA, 21 bp, Homo sapiens
tctgcaatgtttttgtgtaga

SEQ ID NO: 2738838 - DNA, 14 bp, Homo sapiens
tctgcactcctgga

SEQ ID NO: 2738839 - DNA, 19 bp, Homo sapiens
tctgcagatagtgcctctg

SEQ ID NO: 2738840 - DNA, 17 bp, Homo sapiens
tctgcagctttggctgc

SEQ ID NO: 2738841 - DNA, 11 bp, Homo sapiens
tctgcaggaaa

SEQ ID NO: 2738842 - DNA, 16 bp, Homo sapiens
tctgcatcagcttttt

SEQ ID NO: 2738843 - DNA, 17 bp, Homo sapiens
tctgcatgtaaaatctt

SEQ ID NO: 2738844 - DNA, 20 bp, Homo sapiens
tctgcatgtaaaatcttcag

SEQ ID NO: 2738845 - DNA, 22 bp, Homo sapiens
tctgcatgtaaaatcttcagct

SEQ ID NO: 2738846 - DNA, 17 bp, Homo sapiens
tctgccacttcccaggt

SEQ ID NO: 2738847 - DNA, 13 bp, Homo sapiens
tctgccagccaca

SEQ ID NO: 2738848 - DNA, 18 bp, Homo sapiens
tctgcccacattggaccc

SEQ ID NO: 2738849 - DNA, 14 bp, Homo sapiens
tctgcccagcctgc

SEQ ID NO: 2738850 - DNA, 12 bp, Homo sapiens
tctgccccaccc

SEQ ID NO: 2738851 - DNA, 21 bp, Homo sapiens
tctgcccccaactcccggagg

SEQ ID NO: 2738852 - DNA, 15 bp, Homo sapiens
tctgcccgcagagcc

SEQ ID NO: 2738853 - DNA, 21 bp, Homo sapiens
tctgcctcatcctcctcctca

SEQ ID NO: 2738854 - DNA, 18 bp, Homo sapiens
tctgcctctaactccctc

SEQ ID NO: 2738855 - DNA, 21 bp, Homo sapiens
tctgcctctaactccctcctc

SEQ ID NO: 2738856 - DNA, 16 bp, Homo sapiens
tctgcctgagattctt

SEQ ID NO: 2738857 - DNA, 20 bp, Homo sapiens
tctgcctgcttcctggaccg

SEQ ID NO: 2738858 - DNA, 13 bp, Homo sapiens
tctgcctttttta

SEQ ID NO: 2738859 - DNA, 18 bp, Homo sapiens
tctgctcctagcccagca

SEQ ID NO: 2738860 - DNA, 18 bp, Homo sapiens
tctgctcttatttttgta

SEQ ID NO: 2738861 - DNA, 12 bp, Homo sapiens
tctgctgggctg

SEQ ID NO: 2738862 - DNA, 15 bp, Homo sapiens
tctgctgttgtggga

SEQ ID NO: 2738863 - DNA, 14 bp, Homo sapiens
tctgcttccctggg

SEQ ID NO: 2738864 - DNA, 16 bp, Homo sapiens
tctggacctctcttgt

SEQ ID NO: 2738865 - DNA, 13 bp, Homo sapiens
tctggagcccttg

SEQ ID NO: 2738866 - DNA, 22 bp, Homo sapiens
tctggaggctgcgtcctgagga

SEQ ID NO: 2738867 - DNA, 20 bp, Homo sapiens
tctggcaccactagggtcct

SEQ ID NO: 2738868 - DNA, 22 bp, Homo sapiens
tctggctcagctgtggtcccac

SEQ ID NO: 2738869 - DNA, 23 bp, Homo sapiens
tctggcttccagaaaaccccagc

SEQ ID NO: 2738870 - DNA, 12 bp, Homo sapiens
tctggcttctgc

SEQ ID NO: 2738871 - DNA, 13 bp, Homo sapiens
tctggcttctgct

SEQ ID NO: 2738872 - DNA, 15 bp, Homo sapiens
tgcctcagccagccc

SEQ ID NO: 2738873 - DNA, 16 bp, Homo sapiens
tgcctcagccagccct

SEQ ID NO: 2738874 - DNA, 17 bp, Homo sapiens
tgcctcagccagccctg

SEQ ID NO: 2738875 - DNA, 18 bp, Homo sapiens
tgcctcagccagccctgg

SEQ ID NO: 2738876 - DNA, 17 bp, Homo sapiens
tgcctcagtgctgcaat

SEQ ID NO: 2738877 - DNA, 16 bp, Homo sapiens
tgcctcatcctcctcc

SEQ ID NO: 2738878 - DNA, 23 bp, Homo sapiens
tgcctcatcctcctcctcattca

SEQ ID NO: 2738879 - DNA, 19 bp, Homo sapiens
tgcctccactcccacttcc

SEQ ID NO: 2738880 - DNA, 13 bp, Homo sapiens
tgcctcggctcct

SEQ ID NO: 2738881 - DNA, 14 bp, Homo sapiens
tgcctcggctcctg

SEQ ID NO: 2738882 - DNA, 21 bp, Homo sapiens
tgcctcggctcctgctgcacc

SEQ ID NO: 2738883 - DNA, 22 bp, Homo sapiens
tgcctcggctcctgctgcacca

SEQ ID NO: 2738884 - DNA, 14 bp, Homo sapiens
tgcctctaactccc

SEQ ID NO: 2738885 - DNA, 16 bp, Homo sapiens
tgcctctaactccctc

SEQ ID NO: 2738886 - DNA, 17 bp, Homo sapiens
tgcctctaactccctcc

SEQ ID NO: 2738887 - DNA, 18 bp, Homo sapiens
tgcctctaactccctcct

SEQ ID NO: 2738888 - DNA, 20 bp, Homo sapiens
tgcctctaactccctcctca

SEQ ID NO: 2738889 - DNA, 14 bp, Homo sapiens
tgcctctcttctgt

SEQ ID NO: 2738890 - DNA, 14 bp, Homo sapiens
tgcctgagattctt

SEQ ID NO: 2738891 - DNA, 22 bp, Homo sapiens
tgcctgagattctttaaggaga

SEQ ID NO: 2738892 - DNA, 23 bp, Homo sapiens
tgcctgagattctttaaggagat

SEQ ID NO: 2738893 - DNA, 19 bp, Homo sapiens
tgcctgagtcacccatgaa

SEQ ID NO: 2738894 - DNA, 21 bp, Homo sapiens
tgcctgattcggctgtctcag

SEQ ID NO: 2738895 - DNA, 13 bp, Homo sapiens
tgcctgcctgggc

SEQ ID NO: 2738896 - DNA, 11 bp, Homo sapiens
tgcctgctggg

SEQ ID NO: 2738897 - DNA, 12 bp, Homo sapiens
tgcctgctgggc

SEQ ID NO: 2738898 - DNA, 14 bp, Homo sapiens
tgcctgcttcctgg

SEQ ID NO: 2738899 - DNA, 18 bp, Homo sapiens
tgcctgcttcctggaccg

SEQ ID NO: 2738900 - DNA, 14 bp, Homo sapiens
tgcctgggcctccc

SEQ ID NO: 2738901 - DNA, 14 bp, Homo sapiens
tgcctggggccaca

SEQ ID NO: 2738902 - DNA, 13 bp, Homo sapiens
tgcctgtacagaa

SEQ ID NO: 2738903 - DNA, 15 bp, Homo sapiens
tgcctgtctgtccaa

SEQ ID NO: 2738904 - DNA, 13 bp, Homo sapiens
tgccttgctattt

SEQ ID NO: 2738905 - DNA, 21 bp, Homo sapiens
tgcctttttgtttttgtaaaa

SEQ ID NO: 2738906 - DNA, 18 bp, Homo sapiens
tgcgaaggggccctggtc

SEQ ID NO: 2738907 - DNA, 18 bp, Homo sapiens
tgcgaccccatctgccca

SEQ ID NO: 2738908 - DNA, 21 bp, Homo sapiens
tgcgagagaccctacagacag

SEQ ID NO: 2738909 - DNA, 17 bp, Homo sapiens
tgcgccacggcactcca

SEQ ID NO: 2738910 - DNA, 22 bp, Homo sapiens
tgcggagcagcctccagtgctg

SEQ ID NO: 2738911 - DNA, 21 bp, Homo sapiens
tgcgggcattttgaatgtgat

SEQ ID NO: 2738912 - DNA, 23 bp, Homo sapiens
tgcgggcattttgaatgtgatca

SEQ ID NO: 2738913 - DNA, 16 bp, Homo sapiens
tgcgggctgagggcat

SEQ ID NO: 2738914 - DNA, 19 bp, Homo sapiens
tgcgggctgagggcatctc

SEQ ID NO: 2738915 - DNA, 16 bp, Homo sapiens
tgcggtgtctgcagct

SEQ ID NO: 2738916 - DNA, 19 bp, Homo sapiens
tgcgtcagaccagtactgg

SEQ ID NO: 2738917 - DNA, 22 bp, Homo sapiens
tgcgtggcacatctaaattgat

SEQ ID NO: 2738918 - DNA, 13 bp, Homo sapiens
tgcgtgtcgtggg

SEQ ID NO: 2738919 - DNA, 15 bp, Homo sapiens
tgctaccctccctgc

SEQ ID NO: 2738920 - DNA, 21 bp, Homo sapiens
tgctaccctccctgctgtccc

SEQ ID NO: 2738921 - DNA, 23 bp, Homo sapiens
tgctaccctccctgctgtcccct

SEQ ID NO: 2738922 - DNA, 20 bp, Homo sapiens
tgctagcaaacaaatggctt

SEQ ID NO: 2738923 - DNA, 22 bp, Homo sapiens
tgctagcaaacaaatggcttac

SEQ ID NO: 2738924 - DNA, 22 bp, Homo sapiens
tgctagcattaccacttccctg

SEQ ID NO: 2738925 - DNA, 20 bp, Homo sapiens
tgctaggggaaggactggcc

SEQ ID NO: 2738926 - DNA, 23 bp, Homo sapiens
tgctaggggaaggactggccgtg

SEQ ID NO: 2738927 - DNA, 15 bp, Homo sapiens
tgctcacgactcttc

SEQ ID NO: 2738928 - DNA, 19 bp, Homo sapiens
tgctcacgactcttcctgc

SEQ ID NO: 2738929 - DNA, 12 bp, Homo sapiens
tgctccacagtg

SEQ ID NO: 2738930 - DNA, 14 bp, Homo sapiens
tgctccattttctt

SEQ ID NO: 2738931 - DNA, 21 bp, Homo sapiens
tgctcccacggggaccactgg

SEQ ID NO: 2738932 - DNA, 22 bp, Homo sapiens
tgctcccacggggaccactggg

SEQ ID NO: 2738933 - DNA, 18 bp, Homo sapiens
tgctcgcctctgcccagc

SEQ ID NO: 2738934 - DNA, 14 bp, Homo sapiens
tgctcgggcccagg

SEQ ID NO: 2738935 - DNA, 12 bp, Homo sapiens
tgctctgcctct

SEQ ID NO: 2738936 - DNA, 13 bp, Homo sapiens
tgctctgcctcta

SEQ ID NO: 2738937 - DNA, 15 bp, Homo sapiens
tgctcttaaaaatct

SEQ ID NO: 2738938 - DNA, 16 bp, Homo sapiens
tgctcttacttccccc

SEQ ID NO: 2738939 - DNA, 13 bp, Homo sapiens
tgctcttctgtat

SEQ ID NO: 2738940 - DNA, 23 bp, Homo sapiens
tgctgaatgtcattatttgataa

SEQ ID NO: 2738941 - DNA, 15 bp, Homo sapiens
tgctgatcgccttat

SEQ ID NO: 2738942 - DNA, 19 bp, Homo sapiens
tgctgcaccaacccagccg

SEQ ID NO: 2738943 - DNA, 21 bp, Homo sapiens
tgctgcagaggggcaggccct

SEQ ID NO: 2738944 - DNA, 15 bp, Homo sapiens
tgctgccactctgct

SEQ ID NO: 2738945 - DNA, 19 bp, Homo sapiens
tgctgcctctcttctgtgt

SEQ ID NO: 2738946 - DNA, 14 bp, Homo sapiens
tgctgcctgagtca

SEQ ID NO: 2738947 - DNA, 18 bp, Homo sapiens
tgctgctaccctccctgc

SEQ ID NO: 2738948 - DNA, 19 bp, Homo sapiens
tgctgctaccctccctgct

SEQ ID NO: 2738949 - DNA, 20 bp, Homo sapiens
tgctgctaccctccctgctg

SEQ ID NO: 2738950 - DNA, 22 bp, Homo sapiens
tgctgctaccctccctgctgtc

SEQ ID NO: 2738951 - DNA, 17 bp, Homo sapiens
tgctggccacagaaagg

SEQ ID NO: 2738952 - DNA, 19 bp, Homo sapiens
tgctggcccacagctctgc

SEQ ID NO: 2738953 - DNA, 14 bp, Homo sapiens
tgctggcctcttgg

SEQ ID NO: 2738954 - DNA, 23 bp, Homo sapiens
tgctggcctcttggcacctgcct

SEQ ID NO: 2738955 - DNA, 16 bp, Homo sapiens
tgctggcggcgcagag

SEQ ID NO: 2738956 - DNA, 17 bp, Homo sapiens
tgctggcggcgcagagg

SEQ ID NO: 2738957 - DNA, 13 bp, Homo sapiens
tgctggctgctgg

SEQ ID NO: 2738958 - DNA, 14 bp, Homo sapiens
tgctggctgctggc

SEQ ID NO: 2738959 - DNA, 20 bp, Homo sapiens
tgctggctttcttttctcta

SEQ ID NO: 2738960 - DNA, 23 bp, Homo sapiens
tgctgggattacaggtgtgagcc

SEQ ID NO: 2738961 - DNA, 19 bp, Homo sapiens
tgctgggcattttcccaga

SEQ ID NO: 2738962 - DNA, 21 bp, Homo sapiens
tgctgggctacaaaccaggag

SEQ ID NO: 2738963 - DNA, 22 bp, Homo sapiens
tgctgggctacaaaccaggagc

SEQ ID NO: 2738964 - DNA, 13 bp, Homo sapiens
tgctggggctggt

SEQ ID NO: 2738965 - DNA, 12 bp, Homo sapiens
tgctgggggctc

SEQ ID NO: 2738966 - DNA, 15 bp, Homo sapiens
tgctgggggctcccc

SEQ ID NO: 2738967 - DNA, 22 bp, Homo sapiens
tgctgtaactcagacattccaa

SEQ ID NO: 2738968 - DNA, 18 bp, Homo sapiens
tgctgtacattactgtat

SEQ ID NO: 2738969 - DNA, 17 bp, Homo sapiens
tgctgtcccctcttgcc

SEQ ID NO: 2738970 - DNA, 22 bp, Homo sapiens
tgctgtgcaaacagtgtaagct

SEQ ID NO: 2738971 - DNA, 16 bp, Homo sapiens
tgctgtggcctgggca

SEQ ID NO: 2738972 - DNA, 15 bp, Homo sapiens
tgctgtgtttgagct

SEQ ID NO: 2738973 - DNA, 13 bp, Homo sapiens
tgcttaagaatca

SEQ ID NO: 2738974 - DNA, 12 bp, Homo sapiens
tgcttcagcctg

SEQ ID NO: 2738975 - DNA, 23 bp, Homo sapiens
tgcttcagcctgaggctgagact

SEQ ID NO: 2738976 - DNA, 20 bp, Homo sapiens
tgcttcatatattgctttat

SEQ ID NO: 2738977 - DNA, 13 bp, Homo sapiens
tgcttcctctgaa

SEQ ID NO: 2738978 - DNA, 12 bp, Homo sapiens
tgcttcctgagc

SEQ ID NO: 2738979 - DNA, 19 bp, Homo sapiens
tgcttcttgtaatatttct

SEQ ID NO: 2738980 - DNA, 21 bp, Homo sapiens
tgcttcttgtaatatttcttc

SEQ ID NO: 2738981 - DNA, 16 bp, Homo sapiens
tgcttgaacccaggag

SEQ ID NO: 2738982 - DNA, 20 bp, Homo sapiens
tgcttgaacccaggaggtgg

SEQ ID NO: 2738983 - DNA, 20 bp, Homo sapiens
tgctttataccccatttgat

SEQ ID NO: 2738984 - DNA, 17 bp, Homo sapiens
tgctttcttctttccag

SEQ ID NO: 2738985 - DNA, 17 bp, Homo sapiens
tgcttttctcccagaag

SEQ ID NO: 2738986 - DNA, 18 bp, Homo sapiens
tgcttttctcccagaagg

SEQ ID NO: 2738987 - DNA, 13 bp, Homo sapiens
tggaaaagaaatc

SEQ ID NO: 2738988 - DNA, 19 bp, Homo sapiens
tggaaaagaaatcaatttt

SEQ ID NO: 2738989 - DNA, 21 bp, Homo sapiens
tggaaaccacacttcttgaaa

SEQ ID NO: 2738990 - DNA, 23 bp, Homo sapiens
tggaaactaccagtgggcatgta

SEQ ID NO: 2738991 - DNA, 19 bp, Homo sapiens
tggaaagcatcacctcagg

SEQ ID NO: 2738992 - DNA, 14 bp, Homo sapiens
tggaaagcctctgc

SEQ ID NO: 2738993 - DNA, 20 bp, Homo sapiens
tggaaaggattctaaacaga

SEQ ID NO: 2738994 - DNA, 13 bp, Homo sapiens
tggaaaggctcag

SEQ ID NO: 2738995 - DNA, 15 bp, Homo sapiens
tgtaatgcttatgtg

SEQ ID NO: 2738996 - DNA, 11 bp, Homo sapiens
tgtaattattg

SEQ ID NO: 2738997 - DNA, 14 bp, Homo sapiens
tgtaattattgtga

SEQ ID NO: 2738998 - DNA, 23 bp, Homo sapiens
tgtaatttttaaagcaaatatat

SEQ ID NO: 2738999 - DNA, 18 bp, Homo sapiens
tgtacaaagatatgctaa

SEQ ID NO: 2739000 - DNA, 13 bp, Homo sapiens
tgtacaaggtatg

SEQ ID NO: 2739001 - DNA, 18 bp, Homo sapiens
tgtacaaggtatgtacag

SEQ ID NO: 2739002 - DNA, 17 bp, Homo sapiens
tgtacagtctcaatttt

SEQ ID NO: 2739003 - DNA, 17 bp, Homo sapiens
tgtacagttatttatgc

SEQ ID NO: 2739004 - DNA, 17 bp, Homo sapiens
tgtaccacaccctgcct

SEQ ID NO: 2739005 - DNA, 19 bp, Homo sapiens
tgtaccacaccctgcctgc

SEQ ID NO: 2739006 - DNA, 20 bp, Homo sapiens
tgtaccacaccctgcctgct

SEQ ID NO: 2739007 - DNA, 21 bp, Homo sapiens
tgtaccacaccctgcctgctg

SEQ ID NO: 2739008 - DNA, 17 bp, Homo sapiens
tgtactttttgttttgt

SEQ ID NO: 2739009 - DNA, 20 bp, Homo sapiens
tgtagcaaccttctgcattc

SEQ ID NO: 2739010 - DNA, 10 bp, Homo sapiens
tgtagccaag

SEQ ID NO: 2739011 - DNA, 22 bp, Homo sapiens
tgtagccccgggctgacccagt

SEQ ID NO: 2739012 - DNA, 17 bp, Homo sapiens
tgtagccttgcccggat

SEQ ID NO: 2739013 - DNA, 21 bp, Homo sapiens
tgtataaattatgaaggacct

SEQ ID NO: 2739014 - DNA, 19 bp, Homo sapiens
tgtatacaaacaggtgcta

SEQ ID NO: 2739015 - DNA, 22 bp, Homo sapiens
tgtataccatgatgcatggagt

SEQ ID NO: 2739016 - DNA, 21 bp, Homo sapiens
tgtatatagctctacacaaca

SEQ ID NO: 2739017 - DNA, 22 bp, Homo sapiens
tgtatatagctctacacaacat

SEQ ID NO: 2739018 - DNA, 13 bp, Homo sapiens
tgtatatagtttg

SEQ ID NO: 2739019 - DNA, 19 bp, Homo sapiens
tgtatatctatatctctaa

SEQ ID NO: 2739020 - DNA, 17 bp, Homo sapiens
tgtatatgtatatctat

SEQ ID NO: 2739021 - DNA, 22 bp, Homo sapiens
tgtatcactcactgccaaaaat

SEQ ID NO: 2739022 - DNA, 12 bp, Homo sapiens
tgtatctaattc

SEQ ID NO: 2739023 - DNA, 18 bp, Homo sapiens
tgtatctttggggaaact

SEQ ID NO: 2739024 - DNA, 16 bp, Homo sapiens
tgtatgagaagtactt

SEQ ID NO: 2739025 - DNA, 15 bp, Homo sapiens
tgtatgagactgtgt

SEQ ID NO: 2739026 - DNA, 12 bp, Homo sapiens
tgtatgctggac

SEQ ID NO: 2739027 - DNA, 14 bp, Homo sapiens
tgtatgtataaatt

SEQ ID NO: 2739028 - DNA, 17 bp, Homo sapiens
tgtatgtggatacagtc

SEQ ID NO: 2739029 - DNA, 22 bp, Homo sapiens
tgtatgtggatacagtcattat

SEQ ID NO: 2739030 - DNA, 12 bp, Homo sapiens
tgtattaacaaa

SEQ ID NO: 2739031 - DNA, 24 bp, Homo sapiens
tgtattaacaaagttactggctct

SEQ ID NO: 2739032 - DNA, 17 bp, Homo sapiens
tgtcaactttcatttga

SEQ ID NO: 2739033 - DNA, 18 bp, Homo sapiens
tgtcaactttcatttgaa

SEQ ID NO: 2739034 - DNA, 17 bp, Homo sapiens
tgtcaatggaagaaacc

SEQ ID NO: 2739035 - DNA, 13 bp, Homo sapiens
tgtcacagctctt

SEQ ID NO: 2739036 - DNA, 17 bp, Homo sapiens
tgtcaccctgcagagct

SEQ ID NO: 2739037 - DNA, 20 bp, Homo sapiens
tgtcactgaagtgattgaaa

SEQ ID NO: 2739038 - DNA, 18 bp, Homo sapiens
tgtcagcttttgcttcat

SEQ ID NO: 2739039 - DNA, 14 bp, Homo sapiens
tgtcaggagatgga

SEQ ID NO: 2739040 - DNA, 19 bp, Homo sapiens
tgtcaggagatggaagagt

SEQ ID NO: 2739041 - DNA, 23 bp, Homo sapiens
tgtcagtgccgccgcctcgccca

SEQ ID NO: 2739042 - DNA, 18 bp, Homo sapiens
tgtcatgtgtatgagaag

SEQ ID NO: 2739043 - DNA, 20 bp, Homo sapiens
tgtcatgtgtatgagaagta

SEQ ID NO: 2739044 - DNA, 23 bp, Homo sapiens
tgtcattatttttgttagcaaag

SEQ ID NO: 2739045 - DNA, 17 bp, Homo sapiens
tgtcattggaagccatc

SEQ ID NO: 2739046 - DNA, 17 bp, Homo sapiens
tgtccaacccctccccc

SEQ ID NO: 2739047 - DNA, 18 bp, Homo sapiens
tgtccaacccctccccca

SEQ ID NO: 2739048 - DNA, 16 bp, Homo sapiens
tgtccaattctcttta

SEQ ID NO: 2739049 - DNA, 18 bp, Homo sapiens
tgtccagaccattgtctt

SEQ ID NO: 2739050 - DNA, 21 bp, Homo sapiens
tgtccagaccattgtcttcca

SEQ ID NO: 2739051 - DNA, 22 bp, Homo sapiens
tgtccagaccattgtcttccaa

SEQ ID NO: 2739052 - DNA, 19 bp, Homo sapiens
tgtccagcttctcttgaaa

SEQ ID NO: 2739053 - DNA, 13 bp, Homo sapiens
tgtccagtgccca

SEQ ID NO: 2739054 - DNA, 14 bp, Homo sapiens
tgtccagtgcccat

SEQ ID NO: 2739055 - DNA, 15 bp, Homo sapiens
tgtccagtgcccatt

SEQ ID NO: 2739056 - DNA, 15 bp, Homo sapiens
tgtccatcctcctct

SEQ ID NO: 2739057 - DNA, 11 bp, Homo sapiens
tgtcccctctt

SEQ ID NO: 2739058 - DNA, 15 bp, Homo sapiens
tgtcccctcttgccc

SEQ ID NO: 2739059 - DNA, 17 bp, Homo sapiens
tgtcccctcttgcccca

SEQ ID NO: 2739060 - DNA, 20 bp, Homo sapiens
tgtcccctggggctggtgga

SEQ ID NO: 2739061 - DNA, 16 bp, Homo sapiens
tgtccctacccactct

SEQ ID NO: 2739062 - DNA, 17 bp, Homo sapiens
tgtccctggtgcagagg

SEQ ID NO: 2739063 - DNA, 22 bp, Homo sapiens
tgtccctttttgcaggggactg

SEQ ID NO: 2739064 - DNA, 22 bp, Homo sapiens
tgtcctaatcatataccagagg

SEQ ID NO: 2739065 - DNA, 22 bp, Homo sapiens
tgtcctccaacaataaagagct

SEQ ID NO: 2739066 - DNA, 21 bp, Homo sapiens
tgtcctctcagagcctcagct

SEQ ID NO: 2739067 - DNA, 14 bp, Homo sapiens
tgtcctgctccaca

SEQ ID NO: 2739068 - DNA, 15 bp, Homo sapiens
tgtcctgctccacag

SEQ ID NO: 2739069 - DNA, 16 bp, Homo sapiens
tgtcctgctccacagt

SEQ ID NO: 2739070 - DNA, 18 bp, Homo sapiens
tgtcctgctccacagtgt

SEQ ID NO: 2739071 - DNA, 16 bp, Homo sapiens
tgtcctggaccctggc

SEQ ID NO: 2739072 - DNA, 19 bp, Homo sapiens
tgtcctggaccctggccta

SEQ ID NO: 2739073 - DNA, 13 bp, Homo sapiens
tgtcctgtctgct
